United States Patent 10,696,975 (GENES AND USES FOR PLANT ENHANCEMENT) - sequence listing, part 3

SEQ ID NO: 7929 - protein, 478 aa, Strelitzia reginae
  misc_feature (439)..(439): Xaa can be any naturally occurring amino acid
  misc_feature (458)..(459): Xaa can be any naturally occurring amino acid
SPAVSTLEEQNLGCIAQIIGPVLDVVFPPGKMPNIYNALVVKGRDTVGQQINVTCEVQQLLGNNRVRAVAMSATDGLMRGMEVIDTGAPLSVPVGGATLGRIFNVLGEPIDNLGPVDTSTTSPIHRPAPAFIQLDTKLSIFETGIKVVDLLAPYRRGGKIGLFGGAGVGKTVLIMELINNIAKAHGGVSVFGGVGERTREGNDLYKEMKESGVINEKNIAESKVALVYGQMNEPPGARMRVGLTALTMAEYFRDVNKQNVLLFIDNIFRFVQAGSEVSALLGRMPSAVGYQPTLSTEMGSLQERITSTKKGSITSIQAVYVPADDLTDPAPATTFAHLDATTVLSRGLAAKGIYPAVDPLDSTSTMLQPRIVGEEHYETAQRVKQTSQRYKELQDIIAILGLDELSEEDRLTVARARKIERFLSQPFVVAEVFTGSPGXYVGLAETIRGFQLILSGEXXSLPEEAFYLVGNIDEATAK

SEQ ID NO: 7930 - protein, 157 aa, Triticum aestivum
  misc_feature (136)..(136): Xaa can be any naturally occurring amino acid
MAEQTFIMIKPDGVQRGLIGEVISRFEKKGFYLKGLKLQNVEKSFAEQHYADLSSKPFFAGLVEYIVSGPVVAMVWEGKSVVSTGRKIIGATNPLASEPGTIRGDFAVDIGRNVIHGSDSVESARKEIALWFPEGXAEWRSSQHNWDLRGLRCVMSG

SEQ ID NO: 7931 - protein, 363 aa, Prochlorococcus marinus str. MIT 9515
MLKAGIIGLPNVGKSTLFNALVENAKAQAANFPFCTIEPNKGIVSVPDHRLHQLATLSSSQNVIPTKIEFVDIAGLVKGASKGEGLGNKFLSNIREVDAIIHVVRCFEDSEVIHVSGKIDPLEDIEIINLELNLADLTQLQKRRERIKKQVKTSKEAQQEDALLEKIEDKLQKGLSVRSISLSVEENLMIKQLGFLTAKPIIYATNLNENDLAEGNNLSSKVQMLAKTENTECIKISAQVESELIELGPEDKKDYLIGLGVEEGGLKSLIKSTYKLLGLKTYFTTGEKETKAWTIKDGMTAPQAAGVIHTDFEKGFIRAQTISYKSLLESGSMANAKNKGLLRSEGKEYVVNEGDVMEFLFNV

SEQ ID NO: 7932 - protein, 586 aa, Triticum aestivum
VKAKEVHREANQVGKGVNLLLATPVHPPRGGGEAGGVTPKTVSVASGYNLLRDPRYNKGLAFTEKERETHYLRGLLPPTVISQELQERKIMHNIRQYQLPLQRYMAMMDLQEGNERLFYKLLIDNVEELLPIVYTPTVGEACQKYGSIFSRPQGLYISLKEKGKILEVLKNWPERSIQVIVVTDGERILGLGDLGCQGMGIPVGKLSLYTALGGVRPSACLPITLDVGTNNEELLNDEFYIGLRQRRAIGQEYADFLHEFMAAVKQNYGEKVLIQFEDFANHNAFDLLARYGTTHLVFNDDIQGTASVVLAGLVAALKLVGGTLAEHTYLFLGAGEAGTGIAELIALEMSRQTKTPIDECRKKIWLVDSKGLIVSARKESLQHFKKPWAHEHEHVGNLLDAVNAIKPTVLIGTSGKGQTFTQEVVEAISSFNEMPIILALSNPTSQAECTAEQAYTWSKGRAVFATGSPFDPVQYNGKIYVPGQANNAYIFPGFGLGVVMSGAIRVHDDMLLAASEALAQQVTQENFDKGLIYPPFSNIRKICAHIAANVAAKAYELGLASRRPRPKDLVKYAESCMYSPIYRNYR

SEQ ID NO: 7933 - protein, 285 aa, Arabidopsis thaliana
MAERGGERGVERGGERGDFGRGFGGRGGRGDRGGRGRGGRGGRRGGRASEEEKWVPVTKLGRLVAAGHIKQIEQIYLHSLPVKEYQIIDMLIGPTLKDEVMKIMPVQKQTRAGQRTRFKAFVVVGDGNGHVGLGVKCSKEVATAIRGAIILAKLSVVPVRRGYWGNKIGKPHTVPCKVTGKCGSVTVRMVPAPRGSGIVAARVPKKVLQFAGIDDVFTSSRGSTKTLGNFVKATFDCLQKTYGFLTPEFWKETRFSRSPYQEHTDFLASKALSTSKPDPVVEDQA

SEQ ID NO: 7934 - protein, 309 aa, Crocosphaera watsonii WH 8501
MSIVIFGSINMDMIAQTPHLPQPGETVIGDHFITLPGGKGANQAVATAKLGRLTYFVGRVGGDSFGRELLKRLETLKINTQGVFIDQKTFSGVAMINVETSGENTIIVIPGANGNIDESDITRLEKILSKTSLLLLQLEIPLAAVEMAAREAKELGVTVMLDPAPAPEKLPDRLYPLIDIITPNQNEAEKLVGFPLDNEEEIKKAANVLLKKGVKIVVIKLGDKGAFYATDKEQDFVPAIKVKTIDTVGAGDGFNGGIAAALDRGLCLKEALKWGTIVGALTTTKEGAQTALPDLDVVHSLLLSDNSSV

SEQ ID NO: 7935 - protein, 174 aa, Zea mays
MASSSDPWIKEYNEASRLADDISSMIADRGSLPQSGPEIMRHTSAIRRKITILGQSKKSDDMSRVAGLDNQGIVGFQRQIMKEQDEGLEKLEETVLSTKHIALAVNEELTLHTRLIDDLEDHVDVTNSRLQRVQKRLAILNKRTKGGCSCTCLLLSVVAIVILAVIVWLLVKYL

SEQ ID NO: 7936 - protein, 429 aa, Bacillus halodurans C-125 [sequence omitted]

SEQ ID NO: 7937 - protein, 537 aa, Mycoplasma pulmonis UAB CTIP
MLEVQGLSKIFSDKKLFENVNLKFTEGNVYGIIGANGAGKSTFLKILAGTIEQTSGTILKEKNKRISTLGQNHNEFDDEIVTDVVIMGNDVLYEIKNKKDAIYNNPDATEKDYTLASELEEKYGEMGGWNAENDAQVLLSSLTIDKDKWYLKMKELKANEKVKVLLAKALFGNPDILIMDEPTNHLDLKSIKWLENFLANYPNVVIVVSHDSDFLDEVCSHIVDIDFGEAKIFTGNYSFWKESSELALELRKQSNLKKEEQIQKLQSFIARFSSNLSKSSQATSRKKALEKITLDEIKPSSRKYPFIKWEINRVPGKQILNVENLSYVNKKGEVLFENVSFSLKLGEKLVIIGNDDLAKTKLIEVILGIEKPSSGKVEWGQTIKTSYFPLNNDNYFNNDLSILDWISQFPLTNELEANKDNSDHRMRSFLGRMLFSGETVFKRVNVTSGGEKARLMFSKMMLEESNFIILDQPLDHLDTESIDSVIKGLKEYKSSCIFTTYNRALIKKVANVILELKENESYIFRVNLDEYEKAMGY

SEQ ID NO: 7938 - protein, 510 aa, Bacillus halodurans C-125
MSKKPVALIILDGFAMRDEAKGNAVAQANKPNFDRYWNQYPHALLKADGEAVGLPEGQMGNSEVGHLNIGAGRIVYQSLTRVNLSIREGEFFENETFLNAMNHVKEKGSSLHIYGLVSDGGIHSHINHLYALLELAKREQVERVYIHGFLDGRDVGPTSAESYLVDLEAKMKELGVGELATLHGRYYAMDRDKRWDRVEKSYRAMVYGEGPAYSSALDVIKDSYENSIHDEFVIPSVITNEDGSPVATIEDDDAIIFFNFRPDRAIQMSQVFTNKDFRGFDRGEKLPQNVYYVCLTHFSETVQGDVAFKPTNLDNTLGEVLAQQNYKQLRIAETEKYPHVTFFFSGGREEPFPGEERILIDSPKVATYDLKPEMSAYEVTDALLNEIEADKHDVIILNFANPDMVGHSGMLEPTIKAVEAVDECLGKVVDAILAKGGAAVITADHGNADEVVTLEGKPMTAHTTNKVPVIVTEEGLNLREDGILADLSPTVLDLLGGKQPAEMTGKTLIK

SEQ ID NO: 7939 - protein, 331 aa, Xanthobacter autotrophicus Py2
MEQPDMRLMEPARLVLNPTTTPLLPAPQLSQALGGPQIWIKRDDLIPFGCGGNKIRGLELIVADALKAGADTLVTGAGVLSNHVRATAAAAAFCGLGMTAVYWGDPPRQTRGNHLLSVLWGAQTRFTGSSDRNSVDGMLEVEAADIRAAGGRPYVIPRGGACALGVIGHVQAVGEVMAQCRQAGIRPDYVVMAVGSGGTLAGWLLGSRLLGASWRVEGITVSRPAAEARVRVKDLADQAADHLGLGRAVPADDVIIHDGFIGAGYGIASPAGMSALERAARCEGVVLDPVYTGKAMAGYGALVGAGRYGEAATVLFLHSGGLPSLFVDGTA

SEQ ID NO: 7940 - protein, 264 aa, Rhodobacter sphaeroides 2.4.1
MTDPVKDRLTLALEVAAEAGRLALDFFARRESLAVEAKASPQDIVSRADREVETLIRARIAARFPDDGVLGEEHGAEEGRSGFTWVIDPIDGTAPFLAGLPHWCVVLALQEEGRTVAGVIEHPLARETFSAQRGQGAFLNGERLRAREDLTIGSCNVALGASHRTSPDFASALVRELMRRGGMFYRNGSGAIMLASVAAGRLGGYYEPHMNPWDCLAAMLMVEEAGGRTAPFPEDAAGGMVLVAAPKVWDDLTAVVKAAEGQAG

SEQ ID NO: 7941 - protein, 131 aa, Triticum monococcum
AVLDGGIPFNKAYGMSAFEYHGTDPRFNRVFNEGMKNHSIIITKKLLEVYKGFEGLGTIVDVGGGVGATVGAIVAAYPAIKGINFDLPHVISEAPPFPGVTHVGGDMFQKVPSGDAILMKWILHDWSDEHC

SEQ ID NO: 7942 - protein, 172 aa, Methanococcus maripaludis S2
MDLRKKIRIVENFPIEGISFKDVTPILKDPKAMKHTTKEIAKYLEDKNVDVVVGPEARGFLFGVPVAHELDIGFVPVRKPGKLPYKTFSVDYALEYGSDSLEIHSDGIEKGQNVAIVDDLLATGGTVLGVSKLVEKLGGHVSALNFVIELTELKGRDKLKGYDIQSLVKYDL

SEQ ID NO: 7943 - protein, 85 aa, Nicotiana langsdorffii x Nicotiana sanderae
IGQLLAIYEHRVAVQGFVWGINSFDQWGVELGKSLASQVRKQLHASRKKGESVEGFNFSTKTLITTYLEASADVPSDPSTLLPKI

SEQ ID NO: 7944 - protein, 411 aa, Mesorhizobium sp. BNC1
MDTQTAISDASFRPATRVASLGVSEILQIGARAAQMKRAGEDVIVLGAGEPDFDTPENVKDAATRAMARGETKYTHLDGSPAMKEAVRHKFLSENRLDFTTDEITVSAGAKQIIYNAFMATLDPGDEVILPAPYWTSYMDVVRICGATPVVVACDAENGFRATAEQIERAITPRTRWLLLNSPSNPSGAAYGAEDYRPILDMLMRNPHVWLMADDIYEHIVYDGFEFVTPLALEPRLRGRTLTINGVSKAYAMTGWRIGYGAGPQPLVKAMSVIQSQSTSNPCSISQAAAIEALTGPQEFLAERRESFRERRDLVVTGLNTIEGIECRVPEGAFYAFAGCGGLLGRRTSDGSEIVSDRDLANYLLKDAKVAVVPGSAFGLSPFFRISYATSKSELTEALRRIGEACRRLVS

SEQ ID NO: 7945 - protein, 328 aa, Rhodobacter sphaeroides 2.4.1
MAQRVLVTGGAGYIGSHACKVLKRAGFEPVTFDNLSTGWEQAVKFGPLARGDLMDRASIDAALETWKPVAVMHFAALSLVGESMRDPGTYWRVNVTGALNLLEATVAAGVKNFVFSSTCATYGDQDGVVLDEDTPQRPINAYGASKRAIEEMVANFGAAFGLNHTIFRYFNVAGADPEGEVGEQHDPETHLIPLMLDAVAGRRPALTVFGTDYPTRDGTCIRDYVHVMDLAQAHVLGLNRLLDGGPNRVFCLGTGRGFSVREVIEQSRAVTNREVPILFGDRRSGDAAALVCGSERAVRELGWEPELSTLPHMIADAWRWHRAPKFHE

SEQ ID NO: 7946 - protein, 434 aa, Rhodobacter sphaeroides 2.4.1
MKIAMIGTGYVGLVSGVCFSDFGHEVVCVDKDATKIAKLRDGKVPIFEPGLEALMARNVAAGRLSFTLDLAEAMRGADAVFIAVGTPTRRGDGHADLTYVMAAAEEIAHALDHYAVVVTKSTVPIGTNRKVAETIRAANPAADFDVASNPEFLREGAAIDDFMRPDRVVVGVETERAKKIMADIYRPLFLRDFPVVYTGLESAEMIKYAANAFLATKITFINEIAALCERVGADIKAVSKGMGLDGRIGNKFLHAGPGYGGSCFPKDTKALARMGQDHASPIQIVESVIKVNDEIKRRMIEKIEDLCEGSCRDKVIAVLGVTFKPNTDDMRDAPALTIVPALVGAGAKVRVVDPEGRREGEHLLPGVRWMEDAYSAAEGASVLVILTEWNEFRALDLQRLARGMADARMADLRNVYAPADARAAGFTHYVGVGR

SEQ ID NO: 7947 - protein, 210 aa, Sphingomonas elodea
FLAASTSSVYGANTDMPFGETQRTATPMSLYAATKGATELMGHSYAHLFRTPMTFFRFFTVYGPWGRPDMALFKFTRAILAGEPIDVYNNGEMVRDFTFIDDLAESIVRLVDAVPGDVPVEGDSLSPAAPFRIVNIGAGRPTPLMDYIGAAEKALGRTAIKNFLPMQAGDVPATEASSDLLRRLTGYAPSTTPEEGVAKFVRWYLEHYQS

SEQ ID NO: 7948 - protein, 539 aa, Methanococcus maripaludis S2
MNEKINTNETKDLKNKIVELVIPKNGSVKNDVLSGLTVALALVPEAIAFSFILGIDPTIGLYAAFIMGIVTALLGGRPGMISGATGSVAVIFAPLVISKVQTSGMESALGYLFIAVLLMGILQVFFGISKVGKFVRLIPHPVMLGFVNGLAIIIFLSQIGQFYGADGNLLPWPILSIMLVLIAITMAISIFLPKITRAVPATLVAIITVTIISYFLNNAGYTVLTVLDFIKSIEPLKTTLAVSMPSFALPNVPLNWDTIKTVLPYSFLAACVGLIESLMTLRLIDELTETRGRSNKECIGQGIANILNGFFGGMGGCAMIGQSMINIRGGGRGRLSGASAAVLLLVFIVWGAPIIEMIPLAALVGVMFIVVIGTFEWSSFRILKKIPLSDAVIIAVVSIMTVVLDLATAVFLGIILAALVFAWDRGKDVWASTKSMKNKKVYMLHGPLFFASTSKFKDLFDYENDPIDVVIDFNKSRVYDHSAIEAINTVAEKYTQHGKQLHLLNLSKDCDKLIKKADNIVEVSILDNLIWHVADDKLE

SEQ ID NO: 7949 - protein, 189 aa, Gossypium armourianum
  misc_feature (54)..(54): Xaa can be any naturally occurring amino acid
  misc_feature (145)..(145): Xaa can be any naturally occurring amino acid
HVGLNGNGEPFVACHDCNFPICKTCFDYELKEGRKACLRCGNPYDENLLDDAVXASGDRSTIAAHMDKSQDAGIHARHISSVSTLDSEMTEDNGNPIWKNRVESWKEKKNKKKKTSIKVEIEAQVPPEQLMEDKPAADAFQPLSXVIPIPKSRLAPYRTVIIMRLIILGLFFHYRVTNPVDSAFALWLT

SEQ ID NO: 7950 - protein, 310 aa, Chlorobium tepidum TLS
MATIANITNTIGRTPLVRLNKLAKGLDADILLKLEYFNPLGSVKDRIGRAMIEAAEAEGKIDARTLIVEPTSGNTGIALAFVCAQRGYRLLLTMPETMSIERRKLLRYLGAELVLTPGAQGMKGAIEEAARIVEAEKNSFNPGQFRNPANPLIHQATTGPEIWNDTEGRVDMLVSGVGTGGTITGTSRFIKALKPNFKSIAVEPKDSAVLSGGQPGPHKIQGIGAGFVPDVLDVSLLDEVVTVSNDDAISTARALASQEGILCGISSGAAVHAAIEVAKRSSSAGKTIVAIIPSTGERYLSTALFEDIEA

SEQ ID NO: 7951 - protein, 189 aa, Gossypium harknessii
HVGLNGNGEPFVACHDCNFPICKTCFDYELKEGRKACLRCGNPYDVNLLDDAVKASGDRSTIAAHMDKSQDAGIHARHISSVSTLDSEMTEANGNPIWKNRVESWKEKKNKKKKTSIKVEIEAQVPPEQLMEDKPAADAFQPLSTVIPIPKSRLAPYRTVIIMRLIILGLFFHYRVTNPVDSAFALWLT

SEQ ID NO: 7952 - protein, 353 aa, Colletotrichum trifolii
MGCGMSTEDKEGKARNEEIENQLKRDKMMQRNEIKMLLLGAGESGKSTILKQMKLIHEGGYSRDERESFKEIIFSNTVQSMRVILEAMESLELPLEDQRMEYHVQTIFMQPAQIEGDVLPPEVGSAIEAVWKDRGVQDCFKRSREYQLNDSARYYFDNIARIAAPDYMPNDQDVLRSRVKTTGITETTFIIGDLTYRMFDVGGQRSERKKWIHCFENVTTILFLVAISEYDQLLFEDETVNRMQEALTLFDSICNSRWFIKTSIILFLNKIDRFKEKLPVSPMKNYFPDYEGGDDYAAACDYILNRFVSLNQHETKQIYTHFTCATDTTQIRFVMAAVNDIIIQENLRLCGLI

SEQ ID NO: 7953 - protein, 483 aa, Saccharomyces cerevisiae YJM789
MLSATKQTFRKLQIRTMSTNTKHYDYLVIGGGSGGVASARRAASYGAKTLLVEAKALGGTCVNVGCVPKKVMWYASDLATRVSHANEYGLYQNLPLDKEHLTFNWPEFKQKRDAYVHRLNGIYQKNLEKEKVDVVFGWARFNKDGNVEVQKRDNTTEVYSANHILVATGGKAIFPENIPGFELGTDSDGFFRLEEQPKKVVVVGAGYIGIELAGVFHGLGSETHLVVRGETVLRKFDECIQNTITDHYVKEGINVHKLSKIVKVEKNVETNKLKIHMNDSKSIDDVDELIWTIGRKSHLGMGSENVGIKLNSHDQIIADEYQNTNVPNIYSLGDVVGKVELTPVAIAAGRKLSNRLFGPEKFRNDKLDYENVPSVIFSHPEAGSIGISEKEAIEKYGKENIKVYNSKFTAMYYAMLSEKSPTRYKIVCAGPNEKVVGLHIVGDSSAEILQGFGVAIKMGATKADFDNCVAIHPTSAEELVTMR

SEQ ID NO: 7954 - protein, 189 aa, Gossypium klotzschianum
HVGLNGNGEPFVACHDCNFPTCKTCFDYELKEGRKACLRCGNPYDENLLDDAEKASGDRFTIAAHMDKSQDAGIHARHISSVSTLDSEMTEANGNPIWKNRVESWKEKKNKKKKTSIKVEIEAQVPPEQLMEDKPAADAFQPFSTVIPIPKSRLAPYRTVIIMRLIILGLFFHYRVTNPVDSAFALWLT

SEQ ID NO: 7955 - protein, 569 aa, Ustilago maydis 521
MGKDKVKKDANENTVEDDIPNFYCRRNPTIPRQDQPRPYAFLQRILSEHRVRTNDDGDQYEELDMLDGSLHRTGDPNLSDAGESMAVQAGSGIITAVQNGLSLRGTAGTLAETSASSDASTSAAQATTDPADLLGSSQSRIVSSGAAQVEEELPWFSQLSSYPQLRSAGIPLLPDDASSSKVGALSAVSNKKRPTTSASIVSASLSSLNGSSRPSSSSSAAGAFLSSSSAPLSRVTSPKTASTSTMEFAFQGSGSPASLSEAVSRAHRPNSSLLIPITSTLSSTGSTSSNVSTGRSPPEPRNTMYATAGPLKALPMSASTTTSIGTASSAPHTIPSTLSKFALTSGSGASNNPPSDFQEDLLPPDNFAMVNSHVYRSSFPKKKHFPFLRTLGLRSVLTLILEEYPETNSTFLDQNGITFFQFGIPGNKEPFVSIPTDKITSALVTILDRRNHPILIHCNKGKHRTGCLIGCLRKLQQWSLTTIFDEYRRFSWPKSRSMDQEFIELYDERAVWRDIDVRWLPKWTVLPLASLNLHGSRKIEDLEDEIDGVNDSEQGAEENQDQMTIWRGM

SEQ ID NO: 7956 - protein, 185 aa, Gossypium klotzschianum
NGNGEPFVACHDCNFPTCKTCFDYELKEGRKACLRCGNPYDENLLDDAEKASGDRFTIAAHMDKSQDAGIHARHISSVSTLDSEMTEDNGNPIWKNRVESWKEKKNKKKKTSIKVEIEAQVPPEQLMEDKPAADAFQPFSTVIPIPKSRLAPYRTVIIMRLIILGLFFHYRVTNPVDSAFALWLT

SEQ ID NO: 7957 - protein, 477 aa, Chlamydomonas reinhardtii
MSVQEYIEKHGLEKKVEEVLNLCVKEKPEEPLSFMAKALGQLTPPEIVKVVGRQIIDSRGNPTVEADVYTRKGMFRAAVPSGASTGVHEAVELRDGDKSKYLGKGVTKAVENINAIIAPALKGMDPVKQAEIDQKMKDLDGTDNKGKLGANAILAVSMAVCKAGAAEKGVPLYKHIADLAGNSKLILPVPSFNIINGGSHAGNALAMQEFMILPVGASSFSEAMRMGCEVYHALKGLIKAKYGQDACNVGDEGGFAPNIGSNDEGLNLVNEAIEKAGYTGKVKIGMDVASSEFYTEDGMYDLDFKNQPNDGSQKKTKEQMLELYNEFCKKYPVISIEDPFEQDDWEPCAKLTTENICQVVGDDILVTNPVRVKKAIDAKAVNALLLKVNQIGTITESIEAVRMAKEAGWGVMTSHRSGETEDSFIADLAVGLASGQIKTGAPCRSERNAKYNQLLRIEEELGENAVYAGESWRHIGW

SEQ ID NO: 7958 - protein, 189 aa, Gossypium laxum
  misc_feature (65)..(65): Xaa can be any naturally occurring amino acid
HVGLNGNGEPFVACHDCNFPICKTCFDYELKEGRKACLRCGNPYDENRLDDAEKASGDRSTIAAXMDKSQDAGIHARHISSVSTLDSEMTEDNGNPIWKNRVESWKEKKNKKKKTSIKVEIEAQVPPEQLMEDKPAADAFQPLSTVIPIPKSRLAPYRTVIIMRLIILGLFFHYRVTNPVDSAFALWLT

SEQ ID NO: 7959 - protein, 182 aa, Salmonella enterica subsp. arizonae serovar 62:z4,z23:--
MQFNIPTLLTLFRVILIPFFVVVFYLPFAWAPMVSALIFCIAAITDWFDGFLARRWNQSTRFGAFLDPVADKVLVAIAMVLVTEHYHSWWVTLPAATMIAREIIISALREWMAELGKRSSVAVSWIGKVKTTAQMVALAWLLWRPNLWVEYAGIALFFVAAVLTLWSMLQYLSAARGDLLDQ

SEQ ID NO: 7960 - protein, 392 aa, Oryza sativa Indica Group
MARSPAARKPSAAQTVAVTLALALASAGLLFLLVRLSPSSPSPHPHPHRRLRLRGARASPSPRGQIPFDPVIAGLERRRDDREWERLAAAGLHAPGFEAAPVPEDYIDGGGGFGADPDEDYINDAARFNLTRRVEALFPKIDVDPADGAVTPAELTAWNLASARREVMHRTARELDLHDRDHDGRIAFSEYERPSWAWRFDDHNSSNDGVGWWKEEHFNASDMDVFSLVYFVQLLTSSRYYEPKANKLVVQRRSQVGDSTGYSLESRERDKDNDGKLNFQEFYNGLFYSIRHFDEEASTDDSNVSDAPARKSFTHLDLDNDGLLSADELKPTIGNLHPPEHFYAKQQADYVITQADTNKDGQLSLQEMIENPYVFYSALFTEDDYGFHDELR

SEQ ID NO: 7961 - protein, 299 aa, Ustilago maydis 521
MAEEQDVKGNNARNGRGDGRWKLEVGIVDAADGLTGCRNVRGPTFTIPDYGERCSRFATKISQRQPPRKSESGSSSTGVETGMVIMTSIASTWTRTASSLSLFCSSRAITTLSSTQLYALRPSKTRASSTVACSEVQLTLALIKPSVCSYQPDVSSILKLIKCSRLSIARTRRLFWTSLDAHSFYAEHRGRFYYDRLILGMISGPSLALALYGPNAIKEWRAMLGPTKAYIGKHTMPASLRAKYGLGDTRNGFHGSDSPESARRELGLVFDGWDTEWWMQREQGKLPVDQEAKLNPLGF

SEQ ID NO: 7962 - protein, 395 aa, Bradyrhizobium japonicum USDA 110
MTVRAGREFLAIPGPTTMPDEVLRAMHRPAIDIYSKEMLDLTESLLSDISKLFATRGKSYIYIANGHGAWEAALSNVLSRGDKVLVLESGRFAIGWGNAAALMGAEVEVLKGDWRRAVRPHEVEERLRRDKEHRIKAVVVVQVDTASGVQNDIEAIGKAIKASGHPALYMVDTVASLGCMPFEMDKWGVDVAMSGSQKGLMTPPGLGFVSANARALEVHKKANMSTPYWSWSEREGTENYRKYAGTAPVHLLFALRKAIDLLHEEGLENAFRRHSLLGEAARRAVSAWTEGQVLGFNIAEASERSNTVTTVTMSNGHDPAVLQRYCKDKCGVVLGTGIGDLSGQAFRIAHMGHINAPMLLGTLGVVEIGLNALKIPHGKGGLEAAVAYLGEEVAA

SEQ ID NO: 7963 - protein, 110 aa, Zea mays
MRRRGAAGVVRAFFNPLGDERILREAIKCELQYPGTPVYDCMLAKFILEKEPVAFMGGVFAGLLRLDLNEDPLKEWISRTVEASGIAEENSSEESSEADQNDAPQQIEIE

SEQ ID NO: 7964 - protein, 396 aa, Thiomicrospira crunogena XCL-2
MTGDFQRIKRLPPYVFNIVGDLKAEARRRGEDIIDFGMGNPDQDTPKHIVDKLIEVVQREGTHRYSVSQGIPRLRKAICNWYKTRYDVDLDMDTEAVVTIGSKEGLAHLALATVEKGDTVLVPNPAYPIHPYGFVIAGADIRHVRMTPDVDFFEELEKAIKESWPTPKMLVLNFPGNPTTQTVDLEFFEKVIAIAKEHDIWVIHDLAYADIVFDGYKAPSILQVEGAKDIAVEFYTLSKSYNMPGWRVGFMVGNPTLVHALKRMKSYLDYGTFTPIQVAAIAALEGPQECVQEICEMYKVRRDVLCQGLNSIGWEVEPPKATMFVWAPIPEAYRELGSLEFSKKLLTEAKVAVSPGIGFGDYGDDYVRFGLIENEHRTRQAIRGIRDMFRKDGLIG

SEQ ID NO: 7965 - protein, 137 aa, Physcomitrella patens
MRWIVGGGVQRTIASPGRGILAIDESNATCGKRLASIGLENNEVNRQAYRQLLCTTPGLGEYISGAIMFEETLYQSTSDGKKMVDCLVEGGIVPGIKVDKGLVPLAGSNEESWCQGLDGLASRTAAYYKQGARFAKW

SEQ ID NO: 7966 - protein, 1518 aa, Kluyveromyces lactis NRRL Y-1140
MSSESTTGRKTNEDGRNSIHSTDSYAQSVNSFHYEEDNESQNAASQLSRQITTILSQENGADRIESLARVISTKTKKQMESFEVDQLDFNLKALLDYLRNSQISQGIESGDSGVAFNDLTAVGVDASAAFGPSVEELIRSWGHLPVHLWKKMTGKKDDVPLRNIIQHCVGVVESGEMLFVVGRPGAGCSTLLKCVSGETSELVEVTGDFSYDGLSQAEMMEKFKGYVIYCPELDFHFPKITVKETIDFALKCKTPRVRIDHLSRNQYVDNMRDLWCTVFGLRHTYATNVGNDVVRGVSGGERKRVSLVEALAMSASIYSWDNATRGLDASTALEFAQAIRTATNLMNNSAIVAIYQAGENIYELFDKTTVLYNGKQVYFGPATEAVGYFERMGYIKPNRMTSAEFLTSVTVDFANRTLAIKDGYEEKMPKSSTEMEAYWHNSEEYQRAVEYYHQYCAAHPEEETRQRLELAKHQRLQKGQRAKSQYVVTFWSQVWYCMMRGFQRTKGDFTYTKVYLSSFLTKGLIVGSMFHKIDPKSQSTTDGAYSRGGLIFYVLLFAAVTSLAEISNSFHNRAIVVKHKTYSMYHTSAESLQEIFTEMPTKFVAVLTLSLVSYWIPVLKYDAGSFFQFLLYLFTTQQCTSFIFKLVATLTKDGGTAHAIGGLWVLMLTVYTGFVLPIGEMHHWIRWFHYLNPLTYAYESLMSTEFHGRQMLCSQLIPSGPGYEGVSISNQICNAAGAIAGNLYVSGDTYVLKKYHFSYNHAWRDWGINIVWTFGYIVMNVVMSEFLKPLEGGGDLLLYKRGHMPELGSESVDTKVASREEMMASLNGPDVDLAKIIESKDVFTWNHLNYTIPYDGATRQLLSDVFGYVKPGKMTALMGESGAGKTTLLNVLAQRISVGVITGDMLVNAKDLPLSFNRSCGYVAQSDNHMGELSVRESLRFAAELRQPKSVPLQEKYDYVEKIISLLGMEKYAEAIIGKTGRGLNVEQRKKLSIGVELVAKPSLLLFLDEPTSGLDSQSAWSIVQFMRALADSGQSILCTIHQPSATLFEQFDRLLLLKKGGKMVYFGDIGENSGTLLNYFERQSGVKCGISENPAEYMLNCIGAGATASASEDWHDLWLKSPECAAAREEVEELHRKLASRPVTDDKELSGKYAANYLTQLKCVFGRTWLQFWRSPVYIRAKFLECVLCALFVGLSYVGVNHSIAGANQSFASIFMMLLIALAMVNQLHVFALDSRELYEVREAASNTFHWSALLLCHCTVEIIWSTACEFICWICYYWPAQYTGRASHAGYFFLIYVIMFPAYFISYGCWVFYMSPDVPSASMINSNLFAAMLLFCGILQPREKMPGFWKRFMYNVSPFTYVVQSLVAPIVQGKKVVCGRNEFAVMDPPEGQTCGEYLSTYIEDNTGYLTNPNDTQSCQYCPYSYQQEVVARFNVKWVYRWRNFGFLWAYIIFNFFAMLFCYWVMRVKNYSVTSIFKIFKIGTWKNAIKPKDRHEKDTTIFQEKPGDAENVNRTKN

SEQ ID NO: 7967 - protein, 384 aa, Physcomitrella patens subsp. patens
MTTWAPFAIGHGYHSDVRAGENTGKERIAVIGSGNWGSVAAKLVATNALSHENIHDEVRMWVFEETLANGEKLTQVINKNKINVKYLPNVNLGVNVVADPNLENTVKDATMLVFCTPHQFVESICKQLQGKVNPNAKAISLIKGMEVKPDGPVMLSKLITKHLGIDCSVLMGANIANEVAMEQFSEATVGYKADTSIAKSWVQAFATPYFHVAAIKDVEGVELCGTLKNVVAIAAGFVDGLGMGNNTKAAIMRIGLKEMIGFSKLLFPTVSDATFFESCGVADLITTCFGGRNRKVAEAYARNGGKRSFDELEAELLGGQKLQGVLTAGEVFQVLKARNWEKKFPLFATVHKIAIGHLPPSTIVDYDNESAQKLHRNPSVGVIG

SEQ ID NO: 7968 - protein, 145 aa, Bacillus anthracis
ESVNKKTIAAFEHGLTPIVCCGETLEERESGKTFDLVAGQVTKALAGLTEEQVKATVIAYEPIWAIGTGKSSSSADANEVCAHIRKVVAEVVSPAAAEAVRIQYGGSVKPENIKEYMAQSDIDGALVGGASLEPASFLGLLGAVK

SEQ ID NO: 7969 - protein, 231 aa, delta proteobacterium MLMS-1
RRITAVMPYYGYSRQDRKVAPRVPITAKVVAEMLMVVGVRRVLTMDLHAGQIQGFFNIPVDNLYAAPVLLDYMHRDLDVSRVVMVSPDAGGVERCRAYAKRLNTTLAIVDKRREKANECEAMSVIGDVKGKIAVMLDDMVDTAGTLCSAAKVLKESGASEVIACCSHGVLSGPAIERLEKSQISQLVITDSVPLRGAARECAKIKVLSVSKLLAEAIRRIHSEDSVSSLFV

SEQ ID NO: 7970 - protein, 712 aa, Wigglesworthia glossinidia endosymbiont of Glossina brevipalpis
MYVSRTIIFVPLEKRVGLNYVFSGIIQAIKRKNIKFTVFQPFKYFNNTKKNFNIIDYTLKKYNIKGNDHKEQFSFDYIVNVLSSNKKNFLLEKIVENFYKQKKNNEIVLIPGINIYNGYEFLEKLNYELAKILDAEIVLILRLYKNFLDYIKLLSFKFGFEKKNKISGIILNELDCTKNSNQSIDCKRLLKNDNLYEIKKNNHENCSLINEKSIPIISKIPFNEDFYFVYLYKIKEHFKAKFLNKNYNYVIKSILFCEVYKENIFKNNFKQSLLVISKKQINKFCLMHLKESKYNFYSSILIIGCDKNENEIKVFCEIAEKKKISVIYNNMSFINFFYYLTKFKFNFYKKFNDIIKISNYISNYISDIWISNFSLKKKEKKFFSPEIFQYNILQLSRYTKKSIILPEGEEIRILCAANICSKKNIAHCILLGNPKNILEKARLNGITIEKNIDIINPVEIREKYISHIINLRKKKCISEISARKQINKNIVLATLMLNEGIVDGLVSGATTTTADTLRPAFQFIKTDPKHSLISSIFFMLLPEQTLIYGDCAININPNSKQLSEIAFQSHNSAIQFGIDPKIAMISYSTGYSGQGESVEKVRQATLIAKKSYPKLVIDGPLQYDAATVKSVAKSKAPFSEVAGKATVLIFPELNTGNTTYKAVQRSSNIICIGPVLQGIKKPVNDLSRGASIDDIVYTIAITAIQSIKKDQN

SEQ ID NO: 7971 - protein, 251 aa, Bacillus halodurans C-125
MRKPIIAGNWKMNKTVGEAKAFVEEVKGAIPSSDKVDSVVCSPALFLEGLVQKAEGTELRIGAQNMHFEESGAFTGEISPVALSDMKVDYVILGHSERRDMFAETDELVNKKTHAAFAHGLTPIVCVGETLEEREANQTYDVVKTQVEKGLEGLTDEQVKVTVIAYEPVWAIGTGKSSSAEDANDVCSYIRKVVTEKFSQEAADAVRIQYGGSVKPANIAEYMAQSDIDGALVGGASLDPQSFLQLLEAVK

SEQ ID NO: 7972 - protein, 253 aa, Gibberella zeae PH-1
MDIDHVPTDAKSKEVVRLWRAWRTVHEMVADREYELAEEEVKISLDRFRDEYCNPDGSININYSRNKLSFSARPSTAMMRKFTPPATAANPDPVADCGPIWIEFLADKTFGVSQIRAFASYVISNNYKTGIMITHVPLSPAARRSLASVESLAKIECFLEDDLLVNITHHELVPKHVLLSREEKIALLKRYRLKETQLPRILQKDPVARYLGLKRGHVVKIIRNSETAGRYASYRFQGTERASGMRTRASNCK

SEQ ID NO: 7973 - protein, 394 aa, Bacillus halodurans C-125
MNKQSVRDVELQGKKVFCRVDFNVPMKDGVVTDDTRIRAALPTIQLLAEKGARIILASHLGRPKGEVVEELRLDPVAARLQELLGKPVAKVNVAHGPEAEQAANELKDGDVLLLENVRFYPGEEKNDPELAKAFASLADVYVNDAFGAAHRAHASTEGIAHHVTAVAGLLMEKELEVLGKALSNPERPFTAIIGGAKVKDKIGVIENLLDKVDNLIIGGGLAYTFIKAQGHEIGKSLLEADKMDLALSFMEKAKEKGVNFYVPQDAIVADDFSNDANTKAVDIDQIPADWEALDIGPKTRETYRNVIQSSKLVIWNGPMGVFELDAFAGGTKAVAEALADANDTYSVIGGGDSAAAVEKFGLANQMSHISTGGGASLEFMEGKALPGVVALNDK

SEQ ID NO: 7974 - protein, 335 aa, Bacillus halodurans C-125
MATKIGINGFGRIGRNVFRAALNNPNVEVVAINDLTDANMLAHLLKYDSVHGKLDAEVKVDGDSLVVNGHSVKVKAERDPAQLGWGDLGVEVVVESTGRFTNREDAAKHLEAGAKKVIISAPAKDEDITVVMGVNENKYDPANHHVLSNASCTTNCLAPFAKVLNDKFGIRRGMMTTVHSYTNDQQILDLPHKDYRRARAAAENIIPTTTGAAKAVALVLPELKGKLNGGAMRVPTPNVSLVDLVAELDKEVTAEEVNAALKEAAEGDLKGILAYSEEPLVSGDYNGNPASSTIDALSTMVMEGNMVKVISWYDNESGYSHRVVDLVDYIAKQGL

SEQ ID NO: 7975 - protein, 145 aa, Bacillus cereus
ESVNKKTIAAFEHGLTPIVCCGETLEERESGKTFDLVAGQVTKALAGLTEEQVKATVIAYEPIWAIGTGKSSSSADANEVCAHIRKVVAEAVSPAAAEAVRIQYGGSVKPENIKEYMAQSDIDGALVGGASLEPASFLGLLGAVK

SEQ ID NO: 7976 - protein, 343 aa, Mycobacterium sp. MCS
MRAAIYHGREDVRIEELPDPSPRAGEVVIEVARAGICGTDLHEYIAGPMHAAPGVVIGHEYSGTVVGVGSGVREFTEGDRVCGVGVFGCGECGFCKQGAEALCGAVGFIGFAVNGALARYASLPTKALFRIPDEISLAEAAVVEPIASAYHAVRRSGLAAGGTVFIAGAGPIGLALVQFSLAQGATQVIVSEVSATRRVAAHRVGATRVIDPLAEDAVEVVRTLTNGNGVDISFDAAGVQPALDAALGVLRPRGRLMVVAIWEAPAGIDINRSVMREANIGFSFCYEAQRQVPAILDLLATGAINLGELITDEIPLDAVVSQGLEELRVNRDAHVKILIDPSA

SEQ ID NO: 7977 - protein, 145 aa, Bacillus thuringiensis serovar sotto
ESVNKKTLAAFEHGLTPIVCCGETLEERESGKTFDLVAGQVTKALAGLTEEQVKATVIAYEPIWAIGTGKSSSSADANEVCAHIRKVVAEAVSPEAAEAVRIQYGGSVKPENIKEYMAQSDIDGALVGGASLEPASFLGLLGAVK

SEQ ID NO: 7978 - protein, 295 aa, Kluyveromyces lactis NRRL Y-1140
MSELTNYKRLEKVGEGTYGVVYKAVDLRHQNRVVAMKKIRLESEDEGVPSTAIREISLLKELKDDNIVRLYDIVHSDAHKLYLVFEFLDLDLKRYMESIPKDQPLGGNIIKKFMMQLCKGIAYCHAHRIIHRDLKPQNLLINRDGNLKLGDFGLARAFGVPLRAYTHEIVTLWYRAPEVLLGGKQYSTGVDVWSIGCIFAEMCNRKPLFSGDSEIDQIFKIFRVLGTPNERTWPDIIYLPDFKTTFPKWNRRNLSEVIPSLDANGIDLLDKLITYDPIHRISAKRAVQHPYFKEE

SEQ ID NO: 7979 - protein, 380 aa, Zea mays
MERMVMRLMRNKNQSLRQLQGAAAGGLASSSSAPSTAGAAASPFSTLQQQEDHPAPGVLNIRDTAAHLIGRTPLVYLNRVTEGCGARVAAKLEFLQPSFSVKDRPAISMIEDAEKKGLITPGKTTLIEPTSGNMGIGLAFMAALKGYELVLTMPSYTSLERRVVMKAFGAQLVLTDPAKGMGGTVRKATQLYENHPSAFMLQQFENPANVQVHYETTGPEIWEDTLGQVDIFVMGIGSGGTVTGVGKYLKEKNPNAKIYGVEPAEANVLNGGKPGPHLITGNGVGFKPDILDMDIMEKVLEVKSEDAVTMAQQLALQEGLLVGISSGANTVAAIELAKRPENKGKLIVTVHPSAGERYLSSALFEGLRKEAEAMQPVPVD

SEQ ID NO: 7980 - protein, 191 aa, Polaromonas sp. JS666
MHALKADTYREFGRFSGWLVLKGVVLHPAFRVVVTLRCCQAADHYAVPLRWLLLTLARLLHRLASQLAGIELPWRTSVAPGLALTHGRGIVVNAGARIGSNVTLFHGVTLGQRDHIDDDGRRFTTYPVIEDEVWIGPHAIVVGGVTIGRGSRIAGGAYVYESIPPYSMVLGNPGNIVKSNCTPDVDNRFVA

SEQ ID NO: 7981 - protein, 568 aa, Arabidopsis thaliana
  misc_feature (303)..(303): Xaa can be any naturally occurring amino acid
MGFGTSSSSSSSSALKWLGFVTAVWVQSISGNNYTFSNYSGALKSLMNLTQLELNSLSVAKDVGKAFGILAGLASDRLSTPVILLIGSFEGLLGYGVQWLVVSRTIQPIPYWQMCVFLCMGGNSTTWMNTAVLVTCIRNFRRNRGPVSGILKGYVGLSTAIFTDLCNALFSSDPASFLVLLSVVPFAVCLTAVFFLREIPPSTTFAEDNEESKYFAVFNIVAVVVAVYLQSYDIIGIKTGAFSIAFASILLILLASPVAVPFHAFIRSKVHDEQDVEGRIDEPLLRSGSEIEVEETIVGAAAXAADNELPPSLKPLSNEEEENHGTIVTTEKKRPVLGEEHTIMEAMLTVDFWVLFVSFLCGVGTGLAVMNNMGQIGLALGYTDVSIFVSMTSIWGFFGRILSGTISEHFIKKAGTPRPLWNAAAQIIMAVGYLLMALALPGSLYIGSMVVGVCYGVRLAITVPTASELFGLKYYGLIYNILILNMPLGSFLFSGLLAGLLYDAEATPTPGGGNTCVGAHCFRIVFIVMAFASIIGVGLDLLLAYRTKGIYAKIHASKKTKKSGGNLR

SEQ ID NO: 7982 - protein, 568 aa, marine gamma proteobacterium HTCC2143
MSIELIKVPDIGGTEGVEVVEICVAVGDQIEAEQSLVVLESDKASMEVPSPMAGKVTAIEIANGDELSEGDVILTLEIVGLSDELNTAADTADALPTPTPTPALEPEPELESEAATDLRSDEKNAVPRQDVSEQSSAPKIEVISVPDMGDAENIDVIEVCVRIGDMVTEGDSLIVLETDKASMEVPSPIAGRVVSLAAKEGTTASAGMEILQLELVNDPAAVTQLASFSKKPDDSFLDPMDTGSATTSQAANAVASATSSLPVEVNSPSDLVYAGPAVRRLAREVGLDIALIKGTGPRGRIIKDDLKLAIKEALTAMPATQPVSGIPAVPDIDFSKFGEVKLESLSKIHRATAQNMHRSWLNVPHVTQFDDANISDLEEFRQSLKAEAERRGVKITPLPFLLKACAAALRENPKFNASLHTSGHQLVYKQYVNIGIAVDTPLGLVVPVIRDVDKKSIWELAAETVEMAQKAKDRKLKIDDMQGGCFTVSSLGNIGGQGFTPIINVPEVAILGVSKLSVKPLWNGTEFVPAKMLPLSLSYDHRAINGGDAGRFLTYLTAILADIRRLAL

SEQ ID NO: 7983 - protein, 476 aa, Nostoc sp. PCC 7120
MTLQSFGVIGLAVMGENIALNVERNGFPIAVYNRSREKTDAFMAQRAGGRNVKAAFTLEEFVAALERPRKILVMVQAGKPVDAVIQQLKPLLDEGDIIIDGGNSWFEDTQRRTQELEPAGLRFLGMGVSGGEEGALNGPSLMPGGTQSSYEYLSPIFNKIAAQVDDGPCVTYVGPGGSGHYVKMVHNGIEYGDMQLIAEAYDLLKNAGGLNAKQLHEVFTEWNTTDELNSFLIEITANIFPYIDPETKLPLVDLIVDAAGQKGTGRWTVQTALELGVSIPTITAAVNARIISSIRDERIAASKQLTGPSGKYDGDTKEFINKVRDALYCSKICSYAQGMALLSTASATFNWNLNLSEMARIWKGGCIIRAGFLNKIKKAFNENPALPNLLLAPEFKQTILDRQAAWREVIITAAKLGIPVPAFSASLDYFDSYRRDRLPQNLTQAQRDYFGAHTYLRTDKAGAFHTEWVPIAEAKK

SEQ ID NO: 7984 - protein, 296 aa, Picea sitchensis
MESPFKETVLKGKTALVTGGGSGIGFAISTELGKHGAAVAIMGRRKTVVQEAAAALQAQGIRAIGVEGDVRNIEDAARVVELTVKQLGRLDILVNGAAGNFLSSAEDLSPNGFRTVLDIDSVGTFTMCNAALQYLKKGGPGKAPSEAGVILNISATLHYTAGWYQIHVSAAKAAVDSITRSLALEWGTDYDIRVNGIAPGPIGDTPGMDKLAPEEIKDDPRFEQPLYRLGEKWDIAMAAVYLASDAGKFVNGATLIVDGGIWLSHPRIAPKEAIRAISRVVEMRSRKTSHASKSKL

SEQ ID NO: 7985 - protein, 618 aa, Chlorobium tepidum TLS
MSPESRTLPGIIRSGDPSICRPPVAGNCRSFTSDHFQQMFKPKLFTVLPELTKEQLGRDIVSGILVGIVALPLGIAFAIASGVSPEKGLISAVIGGFLISFLGGSRVQIGGPTGAFIVILYGIVQQYGLNGLMIATIMAGVILIIMGLSHLGSLIKFIPYPVVVGFTSGIAIIIFSSEVKDFLGLHMASVPADFIDKWAAYFKALPTASPETILVGAVALLIIVFWPKVSRKIPGPLIALIVTTVAVHMLHLQVDTIETRFGDISASIPAPSFPSLDMATIRHLIMPATTIALLGAIEALLSAVVADGMIGARHKSNMELVAQGVANIVSPLFGGIPVTGAIARTATNIKNGGRTPIAGIVHAITLLGIMLVFGSWAKLIPMPTLAAILIVVAWNMSEHHVFRQLLKSPKSDVAVLLTTFGLTVIFDLTIAIEVGMLLSVILFMKRMASLANVGVITGELKDEEDEADPNAIVNRSIPEGVDVFEISGPLFFGAASKFKDAMHVVEKAPSIRILRMRKVMSIDATGLNMLKELFNDCRKSGTTLILSGVHTQPLFAMQQYGLADEIGEENIFGNIDDALDRARSLLGLPVQGRPAGFVASVKREKELQAKIESKGSGK

SEQ ID NO: 7986 - protein, 619 aa, Chlorobium tepidum TLS
MILLCFPGSEQGIGMHQFEFLGQLVLIGALAIVNILVFQKIRIPPVIGLIFTGIMLGPTGFHVIRNSGLISTLAEMGVVLLLFTIGLEFSADDLKKLRKIVLFGGTAQILLTGLVIAMFSYWLMDAIGKSVGSKEALVLGFSFSVSSTALCLKILSDRGELGFDHGKIALGILIFQDMAIVPLMFGFSFLTRGSSMPLESSFEEIALLLLFAIGMFGGFRLLMPKIVRIITELHAGEVLVLGALVLCFGAAWLASLIGLSLALGAFMAGMVIASTDGSHRISRTIDPFREAMTSIFFVSVGLLLDVNMIELPWLIAIALVVLVVKGLIMTGILMALGFSLRVSLMSGMVLAQIGEFSFVLAGTAKDAGLLDQHMFQSMLAVIVVTMIVTPALISAAPKFAAQVAPALGFMPLASKPEPKQPARAAAGPIVCRGEIHAAIIGFGLIGRNIAAVMNATNLNYTVLDTDRKTVKTMRRQGEPLFYGDCTERKSLLRIGVDHSRAVVICIPEIDAAIQCIRLVREINPGAFIIVRSRSLESTNRFYRAGADAAVTELFETSIQMFSELLKHFRVEPETILAQQEIIRREGGNIFRELVTETDGSGDDPAKKSQNGAGFVTSET

SEQ ID NO: 7987 - protein, 433 aa, Oryza sativa Japonica Group
MEISIWRALCILVWGKARICIFNYEWARQILSSKSGHFLKNDTTPTVLALLGKGLVLVEGIDWERHRRVINPAFTMDKIKMMTKTMVACAQNMVKELEDQASSNKNGETQVELDKQFQELTADIISHTAFGSSYKLGIEAFHAQKELQEIAVKSLLNVQIPGFSYLPTKGNWRKLTLEKKLRGTLMQIIQSRLSSKGSGYGSDLLGLMLEACIATDQGREQHQLSLSIDEIIHECKTFFFAGHETTSLLLTWTVFLLSVYPEWQARLRLEALRECGKENPNGDNLSKLKEMSMVFLETLRLYGPALFLQRKPLTDITVGETKIPKDHAIIIPSAIMHRDKEIWGDDTDEFNPLRFQNGVTRAAKVPHALLAFSIGPRSCIGQNFAMLEAKSVMAMILKKFSFTLSPNYVHAPVDLLTLQPKFGLPVVLRLLDA

SEQ ID NO: 7988 - protein, 140 aa, Glycine max
FGSDVYPKNFQAGGLIGGARLNESLPLSEQEDLIVWMRTAALPTFRKLYGKIETDIEVNDVVLVIENNYNTYEFGGRKSIVLSTTTWVGGRNNFLGMAYILIGGISLLLAAAFLLLYVMQPRPLGDPSYLSWNKNPGSLR

SEQ ID NO: 7989 - protein, 322 aa, Physcomitrella patens subsp. patens
MKSAVDTKINSTPHKPLFSFGVITDIQYADIDNGRSFLGVPRYYRHALIGVQRAVQAWNKKGDLSFAIHFGDLVDGFCPKEKSRTAFNTVLSELAKFQGGHVYHMIGNHCLYNLPRQELNQILHIPTSKSEQRSYYSFSPMPEFLFVALDGYDISTLGWPTDHPHFKAAMELLNRRNPNDEKNSPVGLRGVNQRFVKFNGAVGEKQLEWMETKLQEAQDAGQKVVICCHLPLDPGASFPTSLLWNYDAVMTIVHKFNCVVACLGGHAHEGGHSVDSHGIHHHVLEAVLECPPGTDSYGYIDVYHDHLSLRGTGRMESMEMFV

SEQ ID NO: 7990 - protein, 437 aa, Ralstonia metallidurans CH34
MNGKATRIDLLSFKTPQMRAFHLTWMAFFVCFFAWFACAPLMPVLKGEFGLTPNQIANINIAAVAVTILVRLVIGPLCDRFGPRKTYTGLLAIGALPVLGVAFAQNYETFLFFRLLIGAVGASFVITQYHTSVMFAPNVVGTANAASAGWGNAGGGAAQGLMPLLLATILFLGVDHTMGWRVALLVPGILMLVMAVVYWRFTQDCPEGNFSELRARGIAVSGGKGGGGWASFRAASANYRVWMLFITYGACFGVEIFIHNVAATFYVDRFGLSLSAAGMAAASFGLLALFARALGGYVSDKLAMRRGLDARSLILFVFILGEGLGLLGFAHASTATTAVAAMLVFGLFTHMACGATYALVPFIDRKALGGVAGIIGAGGNVGAVAAGFLMKGLGDLQQTLTWLGVAATLAALCAIAVRFSAEHKAQEQALYDSALAN

SEQ ID NO: 7991 - protein, 514 aa, Pholiota nameko
MLSLPILVYLSTITSAYAAIGPTANVHIANKIISPDGFNRSAVLAGTNASSIAFPGPVITGFKGDTFQLNVIDALTNTTMLRSTSIHWHGFFQRGSSWADGPVGVTQCPISPGNSFVYQFSSADQAGTFWYHSHHSTQYCDGLRGAMVVYDRQDPHRNRYEFDDESTIITLADWYHVVAPSAGLVPTPDATLINGIGRYAGGPTVPLAVIRVLPNRRYRFRLVSISCDPNYTFSIDGHNMTIIEVETVNTTPLEVDLIQIFAGQRYSFVLNTNQPVSNYWIRAEPNVGTQGFAGGINSAILRYWGAPTIDPNTTSALSNPLRETNLVPLSGAAAPGTPQVGAADVNLNLDILFNATNNRFTVNNATFAPPTVPVLLQIMNGTRTAAELLPRGSVYVLPPNRVVELSLPGGSVGSPHPIHLHGHTFDVVRSVGSSAYNYANPIKRDVVSIGGAGDNVTIRFRTDNPGPWIMHCHIDWHFEIGLSVVFAEDVDTVNVSTPAAWSQLCPNYNATNAP

SEQ ID NO: 7992 - protein, 1224 aa, Ustilago maydis 521
MAVVDVGFSGYFWLAIKSFAARVICLLSDSGLRSAVSDRMPTKSRKSAPSKFAFFLDQQETFSLHISIFEPLGAVGVAPFQTDNRISLHRVFDRLPDTALQGGHGRATRSQRNFLSTDKSTKSFGSPIDIRFGPLRIDWAERAQDKEMSQASQYRNASSSSTSVGPATVTASASELTKASRRRNVFHAKQPQVALPVASFEKTDSFQGDVSGSKEAESRLASCTEMFQGMTIGATEVAFGIVHLFRDKQDATSNATPTRRAASTTGQTALENQIPEQDIGAVVAVLAVPAYLTASHFLSYIEPAVEAITHLRMLRDMHPNRCMVLIRFRDAKDAEDFHKMYNGQPFNAMDPQEICQVVYITSLTVSKHSSLPFSYPTLTNSDPWPLRPPANAVNQPAYELPTCPVCLERMDSSVTGLMTISCQHTFHCSCLSKWGESRCPVCRYSQTGQPSMHQRRRTPRSSMDPSTPVRQANQVGGSDADESDAESDLDEPSCCAVCETQQDLWVCLVCASVGCGRYKHGHAHRHFSETGHLYSLELETQRVWDYAGDGYVHRLIQNKADGKLVELPSASSATATPEHSSTLPASASYASAMSMSGTKHSGPPAIHSRGDNTRPPYDAQERRRQQQQQQRDQNYAIRDQDSCRSADDQLEAIGMEYSYLLTSQLESQRHFYEDKLDQFQAQLASLTGDLEMLSRKSQLIDELSARTAELERTNEQLRRDKDKSDKKADKAIELARTLERDLHSERSMNKGLMDRLEKTKESEVGLKAQVTDLQEQVSDLMFFVQARDKLDQEGSEAQGGDVEKLDSTFGNAFVISGRNARCGTGGSSTHPPITSLKLESKLIWPVLEKKTLRVMQHGGGKSTKHNPQSTKHEAIVNLCNVLYSYHLPARQTKPREYYIMSLNKTFTLNDGNKIPLIGLGTWLSKPGEVENAVEIAVKAGYRHLDLAKIYQNQDEVGAALKKVIPSVVKREELFITSKLWNTSHQPDKVEAAYNETLKELGLDYLDLYLIHWPVAFQPGSDLVPKTEDGKFTALDLETSLVDTWKALIALQKAGKVKSIGVSNFTIAHLDAIINATGVVPAVNQIEAHPLLPQDDLVAYAQQKNIHLTAYSPLGNNLTGKTKIVDYPQVSEVAKKYNADPAQVLIAWGVKRGYSVIPKSVTETRIKSNFEQLELKDDDYETVTSLYKQLGKVRFNVPFTYSPQWDINVFGEDAEKEAKNEVKTE

SEQ ID NO: 7993 - protein, 72 aa, Glycine max
SSSQVLRTRNRAGAGMGAPFTGLKSMAGLKTRKTNDDITYIASNGCRVQCMHETTPIGMKNLETLDYLPDDL

SEQ ID NO: 7994 - protein, 136 aa, Glycine max
HASDHAYGCELRRRSKWLPSMISSPAVTTVNRAGAGMVAPFTGLKSMAGFPTTKTNNDITSIASNSGRVPCMQVWPPACTKNFETLSYLPYLDDAQLAKAVVYLPKKAWISCWAFELEHVYLYREHIMSPGYYYGR

SEQ ID NO: 7995 - protein, 145 aa, Bacillus thuringiensis serovar kurstaki
ESVNKKTIAAFEHGLTPIVCCGETLEERESGKTFDLVAGQVTKALAGLTEEQVKATVIAYEPIWAIGTGKSSSSADANEVCAHIRKVVAEAVSPEAAEAVRIQYGGSVKPENIKEYMAQSDIDGALVGGASLEPASFLGLLGAVK

SEQ ID NO: 7996 - protein, 739 aa, Nicotiana tabacum
  misc_feature (471)..(471): Xaa can be any naturally occurring amino acid
MAMSQMKIIELEEGWEFMQKGVTKLKKILEGQQDSFNSEEYMMLYTTIYNMCTQKPPHDYSQQLYEKYKEAFEEYINSTVLPALRERHDEFMLREFVKRWANHKLMVRWLSRFFYYLDRYFIARRSLPALNEVGLTCFRDLVYQELNSKARDAVIVLIDQEREGEQIDRALLKNVLDIFVGIGMGQMEYYENDFEDAMLKDTAAYYSRKASSWIVEDSCPDYMLKAEECLKKEKDRVSHYLHVSSETKLLEKVQNELLVVYTNQLLEKEHSGCRALLRDDKVEDLSRMYRLFHRIPKGLEPVANMFKQHVTSEGMVLVQQAEDTASNKAESSGSGEQVFVRKLIELHDKYMAYVTECFTNNSLFHKALKEAFEVFCNKIVSGCSSAELLASYCDNILKKGGSEKLSDDAIEETLDKVVKLLAYISDKDLYAEFYRKKLSRRLLFDKSANDDHERLILTKLKQQCGGQFTSXMEGMVTDLTLARENQNHFQEYLSNNPAASPGIDLTVTVLTTGFWPSYKSSDLSLPVEMVKSVEVFKEFYQTKTKHRKLTWIYSLGTCNINGKFAPKTIELIVGTYQAAALLLFNASDRLSYSEIKSQLNLADDDLVRLLHSLSCAKYKILTKEPSNRTVSPSDHFEFNSKFTDRMRRIRVPLPPADERKKVVEDVDKDRRYAIDACIVRIMKSRKVLPHQQLVLECVEQLSRMFKPDFKAIKKRIEDLITRDYLERDKENPNLFKYLA

SEQ ID NO: 7997 - protein, 102 aa, Arabidopsis thaliana
  misc_feature (34)..(34): Xaa can be any naturally occurring amino acid
LDPVEDDPCLPTEEKVPILMAFNRPISNPDGLYXWGPKESRILWAHFNHVFAVFWELEKGFQEALEEIPRKRGAGMAKFICQEVEPVDDYNEYCHYVAGLVG

SEQ ID NO: 7998 - protein, 145 aa, Bacillus mycoides
ESVNKKTLAAFEHGLTPIVCCGETLEERESGKTFDLVAGQVTKALAGLTEEQVKVTVIAYEPIWAIGTGKSSSSADANEVCAHIRKVVAEAVSPEAAEAVRIQYGGSVKPENIKEYMAQSDIDGALVGGASLEPASFLGLLGAVK

SEQ ID NO: 7999 - protein, 447 aa, Nicotiana tabacum
RGLDPVASIFKQHVTAEGTALVKQAEDAASNKKAEKRDVVGLQEQVFVRKVIELHDKYLAYVNNCFQNHTLFHKALKEAFEVFCNKGVAGSSSAELLATFCDNILKKGGSEKLSDEAIEETLEKVVKLLAYISDKDLFAEFYRKKLARRLLFDKSANDEHERSILTKLKQQCGGQFTSKMEGMVTDLTLARENQASFEEYLSNNPAANPGIDLTVTVLTTGFWPSYKSFDLNLPAEMVRCVEVFKEFYQTKTKHRKLTWIYSLGTCNINGKFEPKTIELVVTTYQASALLLFNASDRLSYQEIMTQLNLSDDDVVRLLHSLSCAKYKILFKEPSTKTISPTDVFEFNSRFADKMRRIKIPLPPEDEKKKVIEDVDKDRRYAIDASIVRIMKSRKVLGYQQLVMECVEQLGRMFKPDVKAIKKRIEDLITRDYLERDKDNPNLFKYLA

SEQ ID NO: 8000 - protein, 288 aa, Arabidopsis thaliana
MIPVKLPPFWRGTKSKELRLLSSLGSYVHGPFCPNWYTYIFFFFEFHNHKRKSLFSVMFDVVALQVFDWRRNKALCDGLPMTADEYAKGITISGRLKNVDLALSLFHESANKTTSVYNALMGAYLCNGLSHHCEQLFLDFNSQQDGPSSSTPSVSTYNILISLYGRLIMVERMESVFLQLQQLNILPDSSTYNNLIAGYIYAWDWDKMEATFHSMKNGLVKPTLATYLLMLRGYANSGNLLRMEDMYQAVKRHVDRNEIKLIESMICAYYRSCHKDRIYQPILNHLAY

SEQ ID NO: 8001 - protein, 1473 aa, Schizosaccharomyces pombe 972h-
MSVKASINNSQEAVSRIAFRCSDALYVVHPNNSILNGALTESLKDLKKFETLNVSGKVPHVLPLKSHADPFAHIADAILAEEEVASTQPKQITSVVASADALFFATPHLYKLAHEPLVAHVAIESTEAFDFASVRDTGFVILFSGNRPGDSSEAALEDTLETASLAHRLALKLNTGVLHFYSPVYDTTAALENIETLPSKEDAQHARVAHIPIEEKQEDSEKEGNIKEAFVPPKFDQPERDAATSEYLESLSIKPFEYSGSDDATDVLLVFGSAASELAKAAVTSSVAVAIVRVLRPWLPSKLQEVLPTSTKRLTVLEPITSLPRKWDPLYLDVLSSFVASGSSIELFAVRYGLSSSEQATEIIKAVRDNLSGALKPSLVCDFTDGVSQVFVPTPPSIEEAYHKLLHRVFKSRLNIVNDPASSATKQNIPSRLIISPQFALGSVLEYENQRRAFCDEVATLLKEKNSSVSSESLEVLSNWIVSVDNLESPVDPELVISELKKDSSAPIKSLLDRSEFFTNVSHWIIGSDAWAYDLGNSALHQVLCLEKNVNLLIVDTQPYSTREAVRSSSRKKDIGLYAMNFGNAYVASTALYSSYTQLISALLEADKFKGPSVVLAYLPYHSADDDAITVLQETKKAVDIGYWPLYRWTPALEDGEYSDFKLDSERIRRELKTFLERDNYLTQLTLRVPSLARTLTQSFGAEVRHQQNVDSRNALNKLIEGLSGPPLTILFASDGGTAENVAKRLQNRASARGSKCKIMAMDDFPIEELGNEKNVVVLVSTAGQGEFPQNGREFWEAIKGADLNLSELKYGVFGFGDYEYWPRKEDKIYYNRPGKQLDARFVELGAAPLVTLGLGNDQDPDGWETAYNLWEPELWKALGLDNVEIDIDEPKPITNEDIKQASNFLRGTIFEGLADESTGALAESDCQLTKFHGIYMQDDRDIRDERKKQGLEPAYGFMIRARMPAGVCTPEQWIAMDDISTKWGNHTLKITTRQTFQWHGVLKKNLRNTIRNIVKVFLTTLGACGDVARNVTCSSTPNNETIHDQLFAVSKQISNELLPTTSSYHEIWIEDPETVEKRKVAGEAVQDVEPLYGPTYLPRKFKVGVAAPPYNDVDVYTNDVALIAIIENDKVLGFNVGIGGGMGTTHNNKKTYPRLATVVGYVLTDKIMEVVKAILIVQRDNGDRENRKHARLKYTVDTLGVSTFVEKVEEVLGYKFEEARDHPQFIKNHDDFEGWHKTEKNKYWRSIFVENGRIENNGILQFKTGLRELAERLYTEKSEAEFRLTANQHVILFNVAENELGWINEHMAKYKLDNNAFSGLRLSSAACVALPTCGLAMAESERYLPKLITKVEEIVYEAGLQKDSIVMRMTGCPNGCSRPWVAEIACVGKAPNTYNLMLGGGFYGQRLNKLYRSSVQEKEILNLLRPLIKRYALEREDGEHFGDWVIRAGIITAVENGGANGAVHEGVSPEAF

SEQ ID NO: 8002 - protein, 174 aa, Prochlorococcus marinus str. MIT 9515
MKHTLSVLVEDESGALSRISGLFARRGFNIDSLAVGPAETKGSSRLTMVVEGDNETLQQMTKQLNKLFNVLGVVDFTNLAAVERELMLLKVSSKEDTRSHILDIVQIFRAKVVDVSDIALTLEVVGDPGKLVALEKLLEPYGILEIARTGKVALKRSSGVNTEMLKTNKYSLDI

SEQ ID NO: 8003 - protein, 549 aa, Zea mays
MARRAASSLVSRCLLARAPAGAPPAAPSAPRRTVPADGMHRLLPGVLQRFSTAAAVEEPITPSVHVNYTKLLINGNFVDSASGKTFPTLDPRTGEVIAHVAEGDAEDINRAVAAARKAFDEGPWPKMTAYERSRILLRFADLIEKHNDELAALETWDNGKPYEQAAQIEVPMVARLMRYYAGWADKIHGLIVPADGPHHVQILHEPIGVAGQIIPWNFPLLMYAWKVGPALACGNTLVLKTAEQTPLSALYISKLLHEAGLPEGVVNVVSGFGPTAGAALASHMDVDKIAFTGSTDTGKIILELAAKSNLKTVTLELGGKSPFIIMDDADVDHAVELAHFALFFNQGQCCCAGSRTFVHERVYDEFVEKAKARALKRVVGDPFRKGVEQGPQIDDEQFKKILRYIRYGVDGGATLVTGGDRLGDKGFYIQPTIFSDVQDGMKIAQEEIFGPVQSILKFKDLNEVIKRANASQYGLAAGVFTNSLDTANTLTRALRAGTVWVNCFDVFDAAIPFGGYKMSGMGREKGVDSLKNYLQVKAVVTPIKNAAWL

SEQ ID NO: 8004 - protein, 451 aa, Neisseria meningitidis MC58
MSEYTPQTAKQGLPALAKSTIWMLSFGFLGVQTAFTLQSSQMSRIFQTLGADPHNLGWFFILPPLAGMLVQPIVGHYSDRTWKPRLGGRRLPYLLYGTLIAVIVMILMPNSGSFGFGYASLAALSFGALMIALLDVSSNMAMQPFKMMVGDMVNEEQKGYAYGIQSFLANTGAVVAAILPFVFAYIGLANTAEKGVVPQTVVVAFYVGAALLVITSAFTIFKVKEYDPETYARYHGIDVAANQEKANWIELLKTAPKAFWTVTLVQFFCWFAFQYMWTYSAGAIAENVWHTTDASSVGYQEAGNWYGVLAAVQSVAAVICSFVLAKVPNKYHKAGYFGCLALGALGFFSVFFIGNQYALVLSYTLIGIAWAGIITYPLTIVTNALSGKHMGTYLGLFNGSICMPQIVASLLSFVLFPMLGGLQATMFLVGGVVLLLGAFSVFLIKETHGGV

SEQ ID NO: 8005 - protein, 224 aa, Nicotiana tabacum
MAMSQMKIIELEEGWEFMQKGVTKLKKILEGQQDSFNSEEYMMLYTTIYNMCTQKPPHDYSQQLYEKYKEAFEEYINSIVLPALRERHDEFMLREFVKRWTNHKLMVRWLSRFFYYLDRYFIARRSLPALNEVGLTCFRDLVYQELNSKARDAVIGWQIDQEREGEQIDRALPKNVLDIFVGIGMGQMEYYENDFEDAMLKDPQLIILGKLQVGLWKDSCPDYM

SEQ ID NO: 8006 - protein, 333 aa, Triticum aestivum
  misc_feature (159)..(159): Xaa can be any naturally occurring amino acid
MAEADITRYWCHECQQAVEEAMVEELKCPLCDGGFVEEMTVEQVEALTEQGATQWDPLDNPFEQAGSPGDSDDEDNSDIGREFEGFIRRHRRASALRRVLDSIHDDLRDDRERDNSVLISAFNQALALQGAALDPDEDRGDHGNANNDDGLLDEYVLGXAGLSLLLQHLAENDPSRYGTPPTKKEAVEALPTVKIEEVVSCSVCLDDLDIGSQAKQLPCEHKFHSPCILPWLELHSSCPVCRFELPSDETKDLSEPSNVDRIESSHEDARADGPGNNGEDSNTNDREDSNRPWALVPWFNGLFSTPEPQTVRATLTDQQLPPASGTNPNAGHS

SEQ ID NO: 8007 - protein, 318 aa, Arabidopsis thaliana
MVALDLEFERYPGERSFGSVSLFKYKRQRDGETQYAAVKTSSDENAKSLYKEFQILSQFKGCSRIVQCYGNGVKEIFNDKGYVEYKIAMEYAFGGSLSDFMDRFKDRKLSDSMIREFTRMLLEGLATIHRHGYVHCDLKPENILVFPSSVYKNGAWIRSYELKISDFGMSKRDGDTQWWQPRKPYVGTPIYMSPESISHGEIGKGLDLWSLGCVVLEMYTRKKPWWHTNYELEELMKCYEPLFPRNLPCDAKLFLMTCFASEPDERKDALTLLRQSFLHGDVNKFTNRQMNVKIDSADDFTLQLEKVSQMLSEIRTMC

SEQ ID NO: 8008 - protein, 145 aa, Bacillus pseudomycoides
ETVNKKTLAAFEHGLTPIVCCGETLEERESGKTFDLVAGQVTKALAGLTEEQVKATVIAYEPIWAIGTGKSSSSADANEVCAHIRKVVAEAVSPAAAEAVRIQYGGSVKPENIKEYMAQSDIDGALVGGASLEPASFLGLLGAVK

SEQ ID NO: 8009 - protein, 598 aa, Oryza sativa Japonica Group
MATESDEADFFRNCPPSRCSSDGPDIKFPFRLESSSSSCGAPGMQLSCSGQDTLLLHHVLGLSKVTGIDYIYGVINIVPLAESWSQCALQKIISANYSTSVYKQYGFQYASLVSCSEEFIWDSTDSIFGPISCLSNASQSLYLVAPYAFVSILPLYCKVVSTEIMIPYTSNQGRKDYNASASTEFNESAKRITTFSEITFTWSAPNITDVCIDCERQQRLCGFSSQRRTAFCKPHGSKSPAKVIIVAVSVPTIVVLTLVVASALYLSLKTKNDDEIQLKVEMFLKTYGTSKPTRYTFSEVKRITRRFKHKLGTGGFGSVYKGELSKGVPVAVKMLENSKGEGEEFINEVATIGRIHHVNVVRLLGFCSEGTRHALIYEFMPNNSLEKYIFSRDYISSQEVLVPDKMLKIALGIAQGIEYLHQGCSQRILHFDIKPHNILLDHSFSPKISDFGLAKLCARDQSIVTLTAARGTMGYIAPELYSRNFGAVSYKSDVFSFGMLVLEMLSGKRNSDPSINSQNEVFVPEWIYETIVSAQESEFAKDMTQEEKEKLRKLAIVALWCVQWNPANRPSMRKVVNMLTGSLQNLKNPPRPFVSSLS

SEQ ID NO: 8010 - protein, 231 aa, Methanococcus maripaludis S2
MIKDERWEGVYSFEDSPYLMETLTNLRNVSTENISFRKGLVRLGRYMGYELTKTMEFEEMHVQTPLEKTKGIFPKDRSNVVIITILRAAFPLMEGLIKNFESAKVGIVSASRGHAPDFKIEMNYIKVPQVTPEDTVIVSDPMIATGSTLIHVLKEFKDSKPKRMMIVGVLAAPEGINAVKAEFPDVEIFVTKIDDKLNNDGYIVPGLGDAGDRAFGEPFKVSMLPQMHNLE

SEQ ID NO: 8011 - protein, 661 aa, Aspergillus oryzae
MAPYPGSDADYFKDKARRDLLTLLEGVRGKKNLVVSQDLAGPVGLFVKFSLLQEYGVDRVFLLENANVDSSQRNVVFLVHAEKTRQVRTVADQIKRLQRNGNVEHEFSIFWVPRRTLVSNAILEDAGIIGDVNIAELPVYFIPLEQDVLSLELEDSFSDLYLHKDPGCVYLAAKALMGIQQRHGYFPRIIGKGDNARRLADLLLRMRKELDAEESSGLTDLSARGLLPSADTESLIIIDREVDFGSALLTQLTYEGLIDETVGIKHNQADVDTAIVGPTPVPQAQESSKAPQQTSKQGQKRKIQLDASDQLFSQLRDANFAIVGDILNKVARRLESDYESRHTAKTTTELREFVNKLPTYQLEHQSLRVHTNLAEEIMRNTRSDIFRKILEVQQNNAAGADPTYQHDSVEELIARDVPLKTVLRLLCLESCMAGGLRPRDLENFKRQIIHAYGHQHLLTFSALEKMELLQPRSSATAMLLPTTGTQPGSKTNYGYLRKNLRLVVEEVSEKDPNDIAYVYSGFAPLSVRLVQCVLQKPYVLSLIRGGSVAASASPSPASTASPGWLGFEDLVKSARGATFSIVQKGDDKAIRARQTLSGNNATKTVYVFFLGGITFTEIAALRFIAEQEAPRRKIVICTTSIINGDKMMDAAIEKQDFTKTE

SEQ ID NO: 8012 - protein, 377 aa, Polaromonas sp. JS666
MNPPAFRLPGMTLEKTTTILLTGGAGYIGSHTFAALIDAGYQPVILDNFSNSHPAVLDRLQQLTGQRVVRERGDVLHAGFVAEVLRHYACEAVIHFAGVKAVGESVQQPLKYYSNNVGGLVSLLQAMETSACRSVVFSSSATVYGDPASVPIHEQFPCAPESPYAQTKLMCEDILASLGAADPAWRVGVLRYFNPVGAHPSGLIGENPRGTPNNLMPYVTQVAVGKRARLQVFGDDYLTPDGTGVRDYLHVMDLAEGHVAAVQALLTRHQSFTVNLGTGKGVSVLEVLSAFERASGRRVPFEFAPRRAGDVAQYYADVSLAEAVLGWRATRTLDDMCRDSWRWQQTNPEGYEAGPDIPPRPGLRSRPNEPAQPAAVA

SEQ ID NO: 8013 - protein, 754 aa, Saccharomyces cerevisiae YJM789
MAHEKFSIPENFTLAQSLQLLYSVVKNQYKNLADLIINSKGNKDTVTYGKIHKNLDTLLVYVNEGLRKIEKTYTLKKGLGNLVVDHPELRSIIEDFQILGQDIRIARRKAETLMAEGNGSPSLSSSSSVLGLGTGNGLRFPKLWRMGSKRDKLKEADEKEARINKQADNIRRARKLEEEKKLGAKLQYERDLELQREKLIELKVKEKVEFEVAQKLEEERVKREEEERKHREQAEKKRISTLKHERKTNYKSRASLDNFSSSSKSSGKIDNSLIKRRSLDVVRTSGERVRTPVRKSMEAAEIGMAAQLAWSQYQNGANHSKVSNNGSHSNELQIRYKPTPPLKKRYDYKKPTVNRPIIKSPTLNRQNSKSSRNIPTNSKLKASKSNTNKVSRRNEQNLEPSSPVLVSATAVPAESKPMRSKSGTPDKESSASSSLDSRKEDILKSVQGVDRNACEQILNEILVTDEKVYWEDIAGLRNAKNSLKEAVVYPFLRPDLFKGLREPVRGMLLFGPPGTGKTMIAKAVATESNSTFFSVSASSLLSKYLGESEKLVRALFYMAKKLSPSIIFIDEIDSMLTARSDNENESSRRIKTELLIQWSSLSSATAQSEDRNNTLDSRVLVLGATNLPWAIDDAARRRFSRKLYIPLPDYETRLYHLKRLMAKQKNSLQDLDYELITEMTEGFSGSDLTSLAKEAAMEPIRDLGDKLMFADFDKIRGIEIKDFQNALLTIKKSVSSESLQKYEEWSSKFGSNGS

SEQ ID NO: 8014 - protein, 723 aa, Debaryomyces hansenii CBS767
MLEDTSENFHHTSQDEFNKIVPWSKKVDLPQITYRATVVGLFIGSIVLVSNFQFGLQTGWVSMMSLPSALLGFAIFKMSPCSKSFTDTENVFVQSVAVAVGTGPLAYGLIGIIPAIEKFLTEEESGLGIKLQLSLTQLMIWSMGLALFGVFFAVPLRRQVIIHEKLPFPSGSATATLISVLHGTEMYNEDKILMENEVSDNTKQVNTSEAIVSSSRDLHDSFPDLNGVATSEELKKLVDAESYRSNVKALLYTFTVSALYTLLSYFVPILRNLPIFGSYLSKNYKWNFQPSPAYIGQGIIMGLPTVSYMLFGAILGWAILAPLSKHEGWAPGEIDNWVSGGQGWILWISLSVMISDSVVSFMVVTCKSISSGVNRAKEFNRRRNLHYERNVEMQQSLLDEQSELDSYETGSDDYMSESRASILITPGEVDVDPQHLVSSKVTLFGIIISSIICIIAVRLVFGSVVPYYATIIAIFLALFLSVMGVRALGETDLNPVSGIGKLSQLLFALIIPSDHPSKILINLVAGGIAEAGAQQAGDLMQDLKTGHLIGASPKAQFVAQLIGTVYSVFLSSVMYKVYNKVYQIPSDLFRVPTAIIWIDCSRLVTGDGLPPKAFEFSIFFGLIFAAISLAKNLTPRTSKFYKYLVYLPNGVAVGIGIYNTPNFTIARFIGGVLAYWWINHKPQSQNDSDNKIGMIIFSSGLVLGEGLLSGFTMILTSLGVKHF

SEQ ID NO: 8015 - protein, 127 aa, Guillardia theta
MTNIIILDTNFLYISLKKRLDIIDVLRQCLCSFVIPCITNCVILELENLGPKFRIVLKYIKSSKMIILKCSHPCEIKYADNCIIYHCSINSSFLVATCDKDLKTRIKKKYNNKIISVKKGNYYIDKS

SEQ ID NO: 8016 - protein, 339 aa, Nostoc sp. PCC 7120
MFGLIGHLTSLEHAQAVAQELGYPEYADQGLDFWCSAPPQIVDHIKVTSITGEIIEGRYVESCFLPEMLASRRIKAATRKVLNAMAHAQKNGIDITALGGFSSIIFENFKLEQFSQVRNVTLEFERFTTGNTHTAYIICRQVEQASQQLGIELSQATVAICGATGDIGSAVTRWLDAKTDVKELLLIARNQERLQELQSELGRGKIMSLDEALPQADIVVWVASMPKGVEINPQVLKQPCLLIDGGYPKNLGTKVQYPGVYVLNGGIVEHSLDIDWKIMKIVNMDVPARQLFACFAESMLLEFEKLYTNFSWGRNQITVDKMEQIGQASVKHGFRPLLV

SEQ ID NO: 8017 - protein, 585 aa, Ustilago maydis 521
MSNESNQIKIGAYLLERLVQLGSQSVQGVPGDFNMGFLDLIEEHPKLKWIGNSNELNAAYAADGYARVKRTIAAVVTTFGVGELSALNGIAGSFSERLPVIHVVGVPSTGAQGSHSLLHHTLGDGRFSAFENMSKEISADSAILKSKQGAGESIDRILITAMKSARPVYLALPTDLVHATIPAEALKTPLDYSIDDNDAKAEEYVLQVAQKHIADAKSAVILVDACAARHGCIQETHELIEKSGLPVFATPMGKTIVDEDHAQYGGIYVGSLTSEKVKNVVEQADVLITVGSLKSDFNSGNFSYRTPKSSTIELHSDYTTIGYSHYPGIGMKKLLPKLSALLETNGDARREETKKIVPKFENALPHDSSSTITQEWLWPRMGQFFQEQDQVIVETGTSSFGMLEAKLPAKTRWVSQVLWGSIGWSVGATLGVALAARENALGRTHLFVGDGSLQLTVQEIGTMIKHGLCPYLFILNNDGYEIERQIHGPQRSYNDIPPYDHSLLLDFFGNEKFHSDAKSHENDPHQSKKQYYRVQTKQQLDELLKDQSFANPDRIRLIEVVMQRGDAPEALKRQAEATGQANKYE

SEQ ID NO: 8018 - protein, 144 aa, Aspergillus oryzae
MKEHLPPGISIAKSENLEEWQMDIRVLDENPLYQNQVYRLKFTFSSKYPIEPPEVQFIELPSTSETPRPIPIHPHIYSNGIICLDLLSSAGWSPVQTVESVCMSIQSMLTANTRDERPPGDSDFVSYNRRRPRDINFFYDDDNV

SEQ ID NO: 8019 - protein, 406 aa, Aspergillus oryzae
MSFTNMLNKLSGQPESYEKKQLYKFGRTLGAGTYGIVREADCSRGKVAVKIILKKNVRGNEQMVYDELEMLQALDHPNIVHFVDWFESKDKFYIVTQLATGGELFDRICDYGKFTEKDASQTIRQVLDAVNYLHERNIVHRDLKPENLLYLTRDPSSPLVLADFGIAKMLDSPSEVLTSMAGSFGYAAPEVMLKQGHGKAVDMWSLGVITYTLLCGYSPFRSESLSDLIEECRSGRIIFHDRYWRDVSKDAKDFILTMLQPDPSKRVTSEEALKHPWLKGESASDRDLLPEIRAYIARSRLKRGIEIIKLANRIEALKMHEEDEDDIPSPADMAASAEESDKSGSAPAESSASGEAEAGTTKKRSLSKVARGAIFREVVLAKVREQKDTEERERLEREAREKTTHA

SEQ ID NO: 8020 - protein, 151 aa, Triticum aestivum
  misc_feature (84)..(84): Xaa can be any naturally occurring amino acid
MAPTVMASSATSVAPFQGLKSTAGLPVSRRSNGASLGSVSNGGRIRCMQVWPIEGIKKFETLSYLPPLSTEALLKQVDYLIRSXKWVLCLEFKQRVWVHLPLSNKRNPPGVTNDWPGYWDNVGNCLCSGLQPDANTRSNEVGKKVKERNYP

SEQ ID NO: 8021 - protein, 339 aa, Debaryomyces hansenii CBS767
MAEAENLTPPSSATPNDYIESLTPEQVEHDQKIGIKAIRLFLQSKTSYDVLPVSYRLIVLDTSLLVKKSLNILLQNNIVSAPLWNNKTSRFAGLLTSSDFINVIQYYFQFPEKFDLVDQLTLNGLRDIEKAIGVDQIETASIHPFKSLYEACVKMIDSKARRIPLIDEDEKTHREIVVSVLTQYRILKFVALNCKETKMLLKPIKNLQGLGTLKDIATCTMDTPVIDVIHLLTQKSVSSVPIVDEQGKLINVYEAVDVLGLVKGGIYNDLVLSVGDALLRRPEDFEGVHTCTLNDRLSTIMDTIRKSRLHRLFVVNDEGKLVSVITLSDILNYILFGED

SEQ ID NO: 8022 - protein, 460 aa, Xanthomonas axonopodis pv. citri str. 306
MPMSDPSAPDHLQRSLSNRHLQLIAIGGAIGTGLFMGSGKTISLAGPSILFVYLIIGAMLFFVMRAMGELLLSNLEYKSFIDFSTDLLGPWAGFFCGWTYWFCWIITAIADVIAIAAYAQFWFPGLAPWIPAILCVLLLLGLNLVTVKLFGEMEFWFALIKIIAIAALIVTGAGLVVWGFRSPSGNVASLSNLWNDGGMFPMGIGGFFAGFQIAVFAFVGIELVGTTAAETADPRRNLPKAINSIPVRILIFYVLALIAIMAVTPWRQVVADKSPFVELFVLAGVPAAASLINFVVLTSATSSANSGIFSTSRMLYGLAEEQHAPKGFAKLSRAAIPARGLLFSCLCLLLGAMLVYLIPNLVTAFTLVTTLSAVLFMFVWSLILCAYIAYRRKRPEQHAASAFKMPGGVLMCYVCLAFFAFVIVLLTLQDDTRQALLASPVWFLLLAIGYAVKRRGNRQR

SEQ ID NO: 8023 - protein, 201 aa, Oryza sativa Indica Group
MAGKAAATTATTANNDSGSGGGGGGYIRTVTLRGFDGIRVRVSAGTMAAASATARARLDEAIRRTPRHAAVPDDVLINVPGVARPVLARVADYCDRHYGGGGEGGEFAAPEGYGFDDPLARFDDELMDGADVGTVVDLLRAATFLRVERLADLASREVAACMRGRTVEGIRQVFGIANDYTDEEEQDVRKENSWAFDAYND

SEQ ID NO: 8024 - protein, 564 aa, Oryza sativa
  misc_feature (84)..(84): Xaa can be any naturally occurring amino acid
  misc_feature (103)..(103): Xaa can be any naturally occurring amino acid
MELAVGAGGMRRSASHTSLSESDDFDLSRLLNKPRINVERQRSFDDRSLSDVSYSGGGHGGTRGGFDGMYSPGGGLRSLVGTPXASSALHSFEPHPIVGDAWXEALRRSLVFFRGQPLGTIAAFDHASEEVLNYDQVFVRDFVPSALAFLMNGEPEIVRHFLLKTLLLQGWEKKVDRFKLGEGAMPASFKVLHDSKKGVDTLHADFGESAIGRVAPVDSGFWWIILLRAYTKSTGDLTLAETPECQKGMRLILSLCLSEGFDTFPTLLCADGCCMIDRRMGVYGYPIEIQALFFMALRCALQLLKHDNEGKEFVERIATRLHALSYHMRSYYWLDFQQLNDIYRYKTEEYSHTAVNKFNVIPDSIPDWLFDFMPCQGGFFIGNVSPARMDFRWFALGNMIAILSSLATPEQSTAIMDLIEERWEELIGEMPLKICYPAIENHEWRIVTGCDPKNTRWSYHNGGSWPVLLWLLTAACIKTGRPQIARRAIDLAERRLLKDGWPEYYDGKLGRYVGKQARKFQTWSIAGYLVAKMMLEDPSHLGMISLEEDKAMKPVLKRSASWTN

SEQ ID NO: 8025 - protein, 440 aa, Photobacterium sp. SKA34
MTASLAERLSQYKTEGTGCKPVASGRLVRVVGLTLEAIGCRAPVGSLCKVETLNGELEAEVVGFSGETLFLMPSEQLLGVMPGAKVTPILHNSGLPVGPELLGRVIDGVGNPLDGLGPIFTEHRASFNATPINPLARKPIKEPLDVGIKAINGCLTVGKGQRIGLFAGSGVGKSVTLGMMTRGTNAQIVVVGLIGERGREVKEFIEESLGPEGRARSVVVAAPADASPLMRLKGCQTSLTIAEYFRDQGFDVLLLMDSLTRFAQAQREIALSVGEPPATKGYPPSVFAKLPALVERAGNGNENQGSITAFFTVLSEGDDLQDPIADASRAILDGHIVLSREMADAGHYPAIDVERSVSRVMPAIVSEEHMLMSKAVRQILSICRKNQDLVSIGAYKPGTDNTIDQAFSFKPKLDAYLQQEMKESVPYEMCVNMLRSTLGG

SEQ ID NO: 8026 - protein, 477 aa, Pseudomonas syringae pv. syringae B728a
MPEWRLGLFKGVRMAVYNYDVVVLGSGPAGEGAAMNAAKAGRKVAMVDSRRQVGGNCTHLGTIPSKALRHSVKQIIQFNTNPMFRAIGEPRWFSFPDVLKNAEMVISKQVASRTSYYARNRVDVFFGTGSFADETSINVVCTNGVVEKLVANQIIIATGSRPYRPADIDFSHKRIYDSDTILSLGHTPRKLIIYGAGVIGCEYASIFSGLGVLVELVDNRDQLLSFLDSEISQALSYHFSNNNVMVRHNEEYEKVEGLDNGVILHLKSGKKIKADALLWCNGRTGNTDKLGLENIGLKANGRGQIEVDETYRTSVSNVYGAGDVIGWPSLASAAYDQGRSAAGSMVDNGSWRYVNDVPTGIYTIPEISSIGKNEHELTQAKVPYEVGKAFFKGMARAQISGERVGMLKILFHRETLEVLGVHCFGDQASEIVHIGQAIMSQPGEANTMKYFVNTTFNYPTMAEAYRVAAYDGLNRLF

SEQ ID NO: 8027 - protein, 276 aa, Physcomitrella patens subsp. patens
MSHAGLRMSTNEKEFIVAAIREEQRIDGRTPFDYRRLQIKFLKEDGSVEVQLGQTRVLAVVKGEITQPYPDRGNEGSLAIFTEFSPMGDPAFEPGRPSEMAVELGRIIDRGLRESRAVDTESLCILSGRSVWSIRVDIHILDNYGNLVDAANLAALAALLSYRRPECTVGGDDGQQIIVHPPEVREPVGLIIHHLPIAVTFAFFGDGNFQVLDPNLKEEEVMGGRITITINSQGEICAVQKGGGVGVSASEVMRCLRIAAAKAQSMTETLKKAVSY

SEQ ID NO: 8028 - protein, 341 aa, Oryza sativa
  misc_feature (117)..(117): Xaa can be any naturally occurring amino acid
  misc_feature (229)..(229): Xaa can be any naturally occurring amino acid
  misc_feature (263)..(263): Xaa can be any naturally occurring amino acid
MEEEKAAAYYDELSRKGEGARRFKQGLGFSSSDPQSTSFPSKPPSTSSSFLSGFVRAGATPAPAQPTKQPPPPPPPPHEPSRTGRHSRSPSPSRRHRTRSSSPSRSRRHRSRSRERXRRSRSREREREDRRASRRRSRSRSRSRSPSRRSGRSSYSENRHGDRRRDDGGGRRGSSKGRGGREGGKVDYSRLIEGYDRMTPAERVKAKMKLQLSETGFGPLFVYVLVFPXSKDSTLGNATVGWERFEFNKDAPLDEDDNDVEVXKHEDTVRDAHENAIFGVPAYPIVDTETTEAEPETNDESEKAKDVEAEPSSSLISDKVLATQSGSWRERAQKLRQNPNA

SEQ ID NO: 8029 - protein, 223 aa, Vibrio campbellii AND4
MKDFLIAPSILSADFARLGEDVEKVLAAGADVVHFDVMDNHYVPNLTFGAPICKALRDYGITAPIDVHLMVKPVDRIIPDFAKAGASMITFHIEASEHVDRTLQLIKEHGCKAGVVLNPATPLAHLEFIIDKVDMILLMSVNPGFGGQSFIPHTLDKLRAVRKMIDESGRDIRLEIDGGVKVDNIREIAEAGADMFVAGSAIFSEPDYKQVIDNMRAELAEVK

SEQ ID NO: 8030 - protein, 797 aa, Kluyveromyces lactis NRRL Y-1140
MINKAAPGLFPQIQYGVPGSNAIETDDDPIYGINKDIFLQVCQNLPTNYESLLKSDRFYMSKMYFAANPSAAKTLEYTDFKQFNKNCDREFKLRNKLQDWVNSNSESGIILPQFNQLDAILTKGYDVVKTKNHHWRNAISHLFNKRRVTGSSSKRYEIEMNYTNSHASTAIIDNIGPELDFIDFKFEDNDIMKIQEVTVSDNIDEVPIDNHHRRKSRHNTSLQRKLKIRHLQMISLGATIGVGLFLNSGRAFSIAGPMGAFIGFLYGALVILATLFSFAEMVAFIPLITGISGLCSRFVGDSFGFTVGWCHWLSYAVAFPSELIASAIMISYYTPFEKVATDNLYLGLTVTILIIVLTGINLLDVRIYAELEYIMSVFKLAVVLFLLVLVLILNCGGFRNGYLGFKFWTKDRSPSPDVTFGPFRPTFDLNDYGSGSKQGIGGFGGVLLSCITCSVSSIFSYIGSEIGFIAAPEAENPRKAVPSVTKRIFVRVVLFYLLSIFMVGTVIYAGDPRLLRIISDNSKVTDQNLEKFMLIIDQLGGMNCNTRLQNDNIFQESSNQSPWVIAFKAVKQCDLANVINGVFVCIGISAASSQLYASSRTLYSMATQNKAPSVFTWCTNGGVPYVSILFCGSLGFLSLLCFDLRSTEALLLFISIGITGSVVMWFGMNLSFLRFYMALKRRPDIIDRNSKEYPYKSPFQPYLCIFGMASTTFLLLMNGIQNFFVWKTANFISSYLIIVIFIVLYSGYNVVRTSTINRLEQIDLDSGRREMDRVLWKENADYTLNIQELFHKVFSYV

SEQ ID NO: 8031 - protein, 449 aa, Magnetococcus sp. MC-1
MISMAQTPTEEHPLRLPWGAYAQVAQEDLGFHRLGWVKKVVGLLIEGNGPAVSIGQMCDVVRENGEVVKAEVVGFRDKSVLLMPLGSIKGIFPGSRIISQGRAEQVPVGPQLLGRVIGPMGEALDGHALPHLDDHVPLHAAPINPMLRRKIEEPLDLGVRAVNSLLTVGRGQRLGIFAGTGVGKSTLLGMMARYTAADINVIALIGERGREVVEFIEDELGPEGMARSIVIVATSDQPPLLRLRAAYMATAIAEFFRAQQKDVLLLMDSITRFAMAQREVGLATGEPPTSRGYPPSTFMLLPRLLERGGRDQGRGSITSIYTVLMEGDDIQDPIVDAVRGILDGHIVLSRDLAAANHYPAIDVNGSLSRLMEGLSEKAHKRAAGQLREILATYVKAEDMINIGAYVAGSNPRIDRAIRFIEPIRTFLKQSVEEPSTLEESIAQLESLFA

SEQ ID NO: 8032 - protein, 421 aa, Arabidopsis thaliana
MTKGGLGIAAMSYVAIDYMRYVSPVWHSRLMPVLWSVLAIAVVTRVLFYKHWSKELRAAIPFLGSIVFLLCALLFEALCVRSVTAVLGLDWHRETPPLPDTGQWFLLALNENLPGTLVEILRAHIIGLHHFLMLFIMLGFSVVFDSVKAPGLGLGARYIFTMGVGRLLRAITFVSTILPSARPWCASARFNNVPSQPHRWAQKYYVPYANDPTAIRKLLHWDAAYADPGSYIGDYRADWGSMSFLNEFLRPSYSEGPSWFALLKKAGGGCNDLMYSGHMLVAVLTAMAWTEAYGGFSSAMIWLFVAHSAQREIRERHHYTVDCIVAIYVGILLWKMTGFIWSAERKTKQTKLEKIQNSLIHAAKDGDIETVRRLVEEIEVSSRVEKQSKVISNRTMTVFACATVITTLTIVILALTLTSDG

SEQ ID NO: 8033 - protein, 409 aa, Schizosaccharomyces pombe 972h-
MSDYGFANIEEAKADAIFKLNAQYHQDEDPKKVNMSVGAYRDDTGKPWILPAVKKASKIVEEQASFNHEYLPIAGLPRFTKAAAEVLFRPNPHLLSEDRVASMQSVSGTGANFLAASFIETFYVKHTGAHVYISNPTWPVHRTLWEKLGVTVDTYPYWDAKNRSFDYEGMLSTIKSAPEGSIFLLHACAHNPTGIDPTREQWLSIFESLLSRKHLVVFDIAYQGFASGDLNRDSWALNEFVKYNKDFFVCQSFAKNMGLYGERTGCMHYVAKDASTKNKVLSQLCIVQRNTISNPPAYGARIAAEILNSPQLFAEWEQDLKTMSSRIIEMRKRLRDSLVALKTPGSWDHITQQIGMFSFTGLTPAQVQFCQERYHLYFSANGRISMAGLNNSNVEHVAQAFNHAVRELP

SEQ ID NO: 8034 - protein, 193 aa, Kluyveromyces lactis NRRL Y-1140
MIALGFGFSVMFAVFIFFRVSGGNLNPAVTLTLVLTNVIPWPRALVMWISQMVAGMAAAGAASAMTPGEILFANGLGGGASRSRGVFLEAFGTAILCTTVLFMAVEKHKATPMAPFAIGIALFVGHLICVYYTGAGLNPARSFGPCIAAASFPNYHWIYWIGPGLGAIMSAALWHILKFLNYENCNPGQDDIL

SEQ ID NO: 8035 - protein, 230 aa, Streptococcus suis 89/1591
MVKLVFARHGESEWNKANLFTGWADVDLSEKGTQQAIDAGKLIKEAGIEFDLAFTSVLKRAIKTTNLALEAADQLWVPVEKSWRLNERHYGGLTGLNKAEAAAEFGDEQVHIWRRSYDTLPPEMAKDHEHSAHTDRRYAHLDDSVIPDAENLKVTLERALPFWEDKIAPALKDGKNVFVGAHGNSIRALVKHIKQLSDDEIMDVEIPNFPPLVFELDENLNIVKEYYLEA

SEQ ID NO: 8036 - protein, 615 aa, Oryza sativa Japonica Group
MGSAWEEEDFARNCPPSWCSDSGPEIRFPHQLESSNSSSSSSCSASCARLACSGPDTILHHPFLGPCKVTAIDYKKAVFQIIPLVDSLSSYPLQKLIIDNLPEPDYHSSRCSLYNAQPGKIVCCSKVLTPSMSPTNDYDGNIADHAVVGPISCLSDPSHFSYLVDAYEDIYSLPLDCKAVSKGIVPISGAVTADGPTFKQLAERILNFAETTVSWSEGGIPDNCVQCEQQGQRCAFSSQRNQTFCMGHKPHGSRVKVIAATSSVAAFVVISLVVATAIYLSLKLSYNEEVHLKVEMFLRTYGTSKPTRYTFSEVKKIARCFKEKVGQGGFGTVYKGKLPNGVPVAVKMLENPTGDGEEFINEVATIGTIHHTNIVRLLGFCSEGTRRALVYELMPNESLEKYIFLRDPNTQELLSPDKMLDIALGIARGMEYLHQGCNQRILHFDIKPHNILLDYNFSPKISDFGLAKLCPRDQSIITLTKARGTMGYIAPELYSRNFGEISYKSDVYSFGMVVLEMVSGRRSWDPSIENQNEVYFPEWIYEKVITEQDFILSREMTEEEKQMVRQLALVALWCIQWNPRNRPSMTKAVNMITGRLQNIQVPPKPFVSYESHPMP

SEQ ID NO: 8037 - protein, 219 aa, Haemophilus influenzae 86-028NP
MNQLEMKKLAAQAALEYVTADTIVGVGSGSTVNCFIEALGTIKNKIQGVVAASKASEELLRKQGIEVFNANDVSSLDIYVDGADEINPQKMMIKGGGAALTREKIVAALAKKFICIVDSSKQVDVLGSTFPLPVEVIPMARSQVGRKLVALGGAPEYREGVVTDNGNVILDVHNFSILNPVEMEKELNNVAGVVTNGIFALRGADVVIVGTPEGAKIID

SEQ ID NO: 8038 - protein, 341 aa, marine gamma proteobacterium HTCC2143
MNKINRRFSIAPMMAWSDRHCRMFWRQLTQHAVMYTEMVTTGAILHAGADRFLTYNTGEHPLALQLGGSNPDDLASCTKIAADFGYDEVNLNCGCPSDRVQNGMFGACLMAHPQRVADCISAMQDASSLPITVKHRIGIDEMESYDEMLEFVKPIADTGCSTFIVHARKAWLQGLSPKQNRDIPPLHYDMVHQLKQDFPSLNVIINGGITSIEHCVSHLQLVDGVMLGRAAYQNPYLLAEVDSLIYNAPTVIKTRDQVLLDYIPYIEEQLQNNVALNHMTRHILGLFQGIPGAKLFRRHISEQAHRSDAGINVVYQARELMLEAQHRADVNHRLNDSSSFI

SEQ ID NO: 8039 - protein, 364 aa, Debaryomyces hansenii CBS767
MQRFIDDLLVKRETCPIDNEYDGEKMGARISAVFVILVSSAFGSFFPILSSKYSFIRMPPWCFFIAKYFGSGVIVATGFIHLLEPASDSLGEECLGGTFVEYPWAFGIALMSLFAMFFIELISFHYIDLKIEKESAEGHSHSHFGSSDIYLKKDESDDDDRLETKPTPQINPYPQHFQHAAEHQDPEVLGTPVEDVNKEHYYGQLVSVFVLEFGILFHSAFVGLSLAVAGEEFVSLYIVLVFHQMFEGLGLGSRIATIEWPKRRRWTPWILALCYTLSTPIAIAIGLGVRTSYPPGSRKALITNGVCDAIAAGILFYSGIVELMAHEFLYSNQFKGPKGFRNIMAAFVVMCLGAGLMALLGKWA

SEQ ID NO: 8040 - protein, 1511 aa, Saccharomyces cerevisiae YJM789
MSSTDEHIEKDISSRSNHDDDYANSVQSYAASEGQVDNEDLAATSQLSRHLSNILSNEEGIERLESMARVISRKTKKEMDSFEINDLDFDLRSLLHYLRSRQLEQGIEPGDSGIAFKNLTAVGVDASAAYGPSVEEMFRNIASIPAHLISKFTKKSDVPLRNIIQNCTGVVESGEMLFVVGRPGAGCSTFLKCLSGETSELVDVQGEFSYDGLDQSEMMSKYKGYVIYCPELDFHFPKITVKETIDFALKCKTPRVRIDKMTRKQYVDNIRDMWCTVFGLRHTYATKVGNDFVRGVSGGERKRVSLVEAQAMNASIYSWDNATRGLDASTALEFAQAIRTATNMVNNSAIVAIYQAGENIYELFDKTTVLYNGRQIYFGPADKAVGYFQRMGWVKPNRMTSAEFLTSVTVDFENRTLDIKPGYEDKVPKSSSEFEEYWLNSEDYQELLRTYDDYQSRHPVNETRDRLDVAKKQRLQQGQRENSQYVVNYWTQVYYCMIRGFQRVKGDSTYTKVYLSSFLIKALIIGSMFHKIDDKSQSTTAGAYSRGGMLFYVLLFASVTSLAEIGNSFSSRPVIVKHKSYSMYHLSAESLQEIITEFPTKFVAIVVLCLITYWIPFMKYEAGAFFQYILYLLTVQQCTSFIFKFVATMSKSGVDAHAVGGLWVLMLCVYAGFVLPIGEMHHWIRWLHFINPLTYAFESLVSTEFHHREMLCSALVPSGPGYEGISIANQVCDAAGAVKGNLYVSGDSYILHQYHFAYKHAWRNWGVNIVWTFGYIVFNVILSEYLKPVEGGGDLLLYKRGHMPELGTENADARTASREEMMEALNGPNVDLEKVIAEKDVFTWNHLDYTIPYDGATRKLLSDVFGYVKPGKMTALMGESGAGKTTLLNVLAQRINMGVITGDMLVNAKPLPASFNRSCGYVAQADNHMAELSVRESLRFAAELRQQSSVPLEEKYEYVEKIITLLGMQNYAEALVGKTGRGLNVEQRKKLSIGVELVAKPSLLLFLDEPTSGLDSQSAWSIVQFMRALADSGQSILCTIHQPSATLFEQFDRLLLLKKGGKMVYFGDIGPNSETLLKYFERQSGMKCGVSENPAEYILNCIGAGATASVNSDWHDLWLASPECAAARAEVEELHRTLPGRAVNDDPELATRFAASYMTQIKCVLRRTALQFWRSPVYIRAKFFECVACALFVGLSYVGVNHSVGGAVEAFSSIFMLLLIALAMINQLHVFAYDSRELYEVREAASNTFHWSVLLLCHAAVENFWSTLCQFMCFICYYWPAQFSGRASHAGFFFFFYVLIFPLYFVTYGLWILYMSPDVPSASMINSNLFAAMLLFCGILQPREKMPAFWRRLMYNVSPFTYVVQALVTPLVHNKKVVCNPHEYNIMDPPSGKTCGEFLSTYMDNNTGYLVNPTATENCQYCPYTVQDQVVAKYNVKWDHRWRNFGFMWAYICFNIAAMLICYYIVRVKVWSLKSVLNFKKWFNGPRKERHEKDTNIFQTVPGDESKITKK

SEQ ID NO: 8041 - protein, 262 aa, Picea sitchensis
MATLLERGWLYLITNFTDFQLASIGSFLLHESIFFLSGLPFIILETTGLLSKYKIQSKTNTPAAQEKCITRLLLYHFCVNLPVMVVSYPVFRFMGMRSVLPLPSWKVVVSQLVCYFILEDFVFYWGHRILHTKWLYKHVHSVHHEYATPFGLTSEYAHPAEILFLGFATIIGPAITGPHLFTLWLWMSLRVLETVEAHCGYDFPWSFSKIFPLYGGADFHDYHHRLLYTKSGNYSSTFTYMDWLFGTDKGYRKLKSLQKDSK

SEQ ID NO: 8042 - protein, 392 aa, Morus alba var. multicaulis
METSITCYTRGAFLPNISSSHSMSFVSPSSISPSFNSKILKSSSLFGESLRTVPKSSLKVSKSKNALPVTKCEIGESLEEFLIKATPDKGLRALLISMGEALRTIAFKVRTASCGGTACVNSFGDEQLAVDMLANNLLFEALRYSHFCKYACSEEVPELQDMGGPVEGGFSVAFDPLDGSSIVDTNFTVGTIFGVWPGDKLTGVTGRDQVAAAMGIYGPRTTYVLALKDVPGTHEFLLLDEGKWQHVKETTEIGEGKLFSPGNLRATFDNPEYNKLIDYYVKEKYTLRYTGGRVPDVNQIIVKEKGIFTNVLSPSAKAKLRLLFEVAPLGFLIEKAGGFSSDGHQSVLEKVIENLDDRTQVAYGSKNEIIRFEETLYGSSRLKGAVPVGAAA

SEQ ID NO: 8043 - protein, 311 aa, Mesorhizobium loti MAFF303099
MKLFAGNSNRVLAEAVARYLNIPLGKATVRRFADQEIFVEIQENVRGEDVFILQSTSFPTNDHLMELLIMIDAFMRSSAKRITAVIPYFGYARQDRRASGRTPISAKLVANMITRAGVDRVLTLDLHAGQIQGFFDIPTDNLFSVPVMARDVKAKYKQLGNVVVVSPDIGGVVRARALAKRFDAQLAIVDKRRERPGESEVMNIIGAVAGKDCLLIDDIVDSGGTLCNAADALLANGATSVTAYITHGVLSGGAVARISGSKLQELVITDSIQPTQGVLDAPNIRVISIADLMGEAISRTATEESVSSLFD

SEQ ID NO: 8044 - protein, 481 aa, Picea sitchensis
MEPRVGNKYRLGRKIGSGSFGEIYLGTNIQSNEEVAIKLENVKTKHPQLVYEAKLYRLLQGGTGIANVRWFGVEGDYNVLVMDLLGPSLEDLFNFCSRKLSLKTVLMLADQMINRIEFVHSRCFLHRDVKPDNFLMGLGRRANQVYVIDFGLAKKYRDPVSHQHIPYRENKNLTGTARYASMNTHLGIEQSRRDDLESLGYVLMYFLRGSLPWQGLKAGTKKQKYEKISEKKVATPIEVLCKTYPSEFASYFHYCRSLRFDDRPDYAYLKRIFRDLFIREGFQFDYVLDWTILKYQQTQMANTPPPSIGAAVGSSSRAPPVADKSSGGQDGRDNPWSSAGADSSRRRNTGAIVNAGSLSKHKSPAQNESGAGKDVVNVGRPERPDRVHLSGLISQTGSTSRRGVISSSRQAILSDADSSSRPRAADLSPIALHNTGGQRSSPVSSADPKRSGSGRIMPSSRNYEATLKGIEGLSFDMDKRQ

SEQ ID NO: 8045 - protein, 243 aa, Magnetococcus sp. MC-1
MLLENRIALVTGAGSGIGKAIAEGYAAAGATVLLLGRTQKKLENVYDAITQAGGKATIVPMDLETGLGAIPELVKNTYERYGRLDILVNNAALLGTLSPLANYRPQEWEQVMRVNVTAPFFLMREFIPLLTQSDDASIINLSSGVGHQGRAFWGAYAASKAALINLSETLAQELEKSPIRVNTVNPGATATTMRAKAFPGEDPTTLPSAQAILPVFLYLASQQSKDVRGEHLNAREWMDWKAV

SEQ ID NO: 8046 - protein, 140 aa, Glycine max
MASSPRSPQPAELEISRQSRILAALSKKVIDLDELRMLAAQGVPDGAGVRSTVWKLLLGYLPKDRALWEQELAKKRSQYEAFKDEFLPNTVGGSSTPGGSEGHSDGNAEHVENGFLDRSEIAQDDHPLSLGKTSQWNQVP

SEQ ID NO: 8047 - protein, 139 aa, Oryza sativa Indica Group
MAARSFQARSPKEESDAAVHEAVTLGLKNAAISGTVVAVPTLVGCRVLPWAKANLNYTAQALIISAACIAGFFITADKAILRNARQNTIGKIDSYAVPPVHHFVFFLVTSGDTVKLLSVWRVRSALVIKIYKELKLGQG

SEQ ID NO: 8048 - protein, 305 aa, Brassica napus
  misc_feature (269)..(269): Xaa can be any naturally occurring amino acid
MDIPQDVAGAWGIPSGMGRHRHLPSDATLFSASLPVLPHGKLQSSDSRDGFPFIDDAAASRPVHESVDDIESHSIGNMLPDEDDLLTGMMDDLDLTELPPDSADDYDLFGSGGGMELDADFRDGLSMNGGPPRLSISSAVPQFNVQNGAGTVAGEHPYGEHPSRTLFVRNINSNVEDSELKTLFEQYGDIRTLYTTCKHRGFVMISYYDIRAARMAMRSLQNKPLRRRKLDIHFSIPKDNPSEKDMNQGTLVVFNLDPSITNDDLHGIXFGAHGEIKEIRETPHKRHHKFVEFYDVRAAEAALKL

SEQ ID NO: 8049 - protein, 530 aa, Blumeria graminis f. sp. tritici
MGIPESFMSPYLQPLLQFGFSIALASGIISLLLLLTFLNVLKQLLFKNPNEPPIVFHWIPIIGSTISYGMNPYKFFHETQAKYGNIFTFILLGKKTTVYLGRQGNNFILNGKLRDVNAEEVYSVLTTPVFGTDVVFDCPNSKLMEQKKFMKAALTTEAFRSYVPIIQNEVESFINKCDDFRKSEGIINIAAVMAEITIYTASHTLQGKEVRDRFDSSLAVLYHDLDMGFTPINFMLHWAPLPHNRARDHAQRTVAKIYMEIINSRRTQKETDNSNLDIMWQLMRSSYKDGTPVPDKEIAHMMIALLMAGQHSSSSSSTWIMLWLAARPDITEELYQEQLEILGSELPPVKYEDLSKLTLHQNVVKEVLRLHAPIHSILRKVKNPMPVPGTSYVIPKTHSLLAAPGWTSRDASYFPNPLKWDPHRWDTGSGGVIGTDMEDEKFDYGYGLISTGAASPYLPFGAGRHRCIGEQFATVQLVTIMATMVRSFKFHNLDGRNSVAETDYSSMFSRPMAPATIAWEKRDKKDKTEC

SEQ ID NO: 8050 - protein, 367 aa, Mesorhizobium loti MAFF303099
MGFKCGIVGLPNVGKSTLFNALTRTAAAQAANYPFCTIEPNTGEVAVPDPRLQKIAAIGKSKEIIPTRISFVDIAGLVRGASKGEGLGNQFLANIREVDAIVHVLRCFEDDDITHVEGRIDPVADAETVETELMLADLDSLERRIVQIRKRAGSKDKEATTVLPMMEAALELLQAGKPTRVLLKGISAEDLRILQGLNLLTSHPVLYVCNVGEADAATGNEHTRAVEKMAAAQGAGTVVISAAIEAEVAQLSDEEEMEFLSSLGLDEPGLNKVIRAGYELLHLITYFTVGPKETRAWTIHKGDKAPQAAGVIHTDFERGFIRAQTIAYNDFVTLGGEVAAKEAGKARDEGKEYVVQDGDIMLFKFNT

SEQ ID NO: 8051 - protein, 176 aa, Arabidopsis thaliana
MDMSLALSTAPMSRTIISATRRSQVSQPKAKKVKPANKRPTMSTSGFSGGTTKELTWKCVEGCGACCKIAKDFSFATPDEIFDNPDDVELYRSMIGDDGWCLNYDKATRKCSIYADRPYFCRVEPEVFKSLYGIEEKKFNKEAVSCCIDTIKTIYGPDSKELDSFNRAIRSNPSSS

SEQ ID NO: 8052 - protein, 597 aa, Zymomonas mobilis
MVRTLGNAIARDRLAHAFLLTGVRGVGKTSTARLIAKALNCVGKDGHGGMTIDPCGECEACRAIAEGRHIDVVEMDAASHTGVDDIRDIVESVRYASVSARFKVYIIDEVHMLSKSAFNALLKTLEEPPAHVKFLFATTEINKVPITVLSRCQRFDLRRISTATLTDYFSKVVQLEQVEAEEEALAMIAKAAEGSVRDGLSILDQAIAHSSGSILAADVREMLGLSDRGVIKSLLVDLLEGKGDRVLDHVKAQYDLGVEPEALLHGLLQLIHAITRSKMGRPDNLTLHPTEEEIWLAELGKKLSFPVLHRLWQLLLKGHSEVQNAVLPLEAAEMALLRVIHASQLPDPAMIIAQFKKQGSVSSNLSPSPEDNRLAPPTSSFQDREAGDVKKNISEQVSPSQFQAKEALLKNGSDFSKSLQSAEKKDFSPFDDDNNSRVAASDYPVEGNQKFSELPENQPRPSAIPIAPASEAKLKNPHFPPDFKSLTEMLFDNGHALLGHSLEDYGRLIEYNPPRLLLENHSRISGETRQELSLALKNLTKQAWQVEFLQDRKGQPSFREAEIAQKEARQKAILNTPIVQAVLKTFPDAEWVQSSDE

SEQ ID NO: 8053 - protein, 162 aa, Schizosaccharomyces pombe 972h-
MNAFVTVGSTQFDDLIRAVLKPEFQHCLVKHGINQLIVQYGKGKQAFGDPKSVAGLTILGFDYAPEIESYIHDASIVISHAGAGSILQTLRSGKRLLVVPNESLMDNHQVELATKLASMNYLVTCSTSNLVEGLEELYPKILTPFPKSDCSTFQKVMQDVAR

SEQ ID NO: 8054 - protein, 370 aa, Zymomonas mobilis
MIYLDYQATTPMAPEAKAAMLPWLDGGANPHSPHRIGRKAAAAVAIAKDQIAALIPEREAGNLVFTSGATEALNMAIKGLWFSGKNTRRKIVTLATEHAATLDSLGYLARLGAEIVLLPVHSDGLVDLEKAAAAIDDKTALVTAMFVNNEIGVIQPIAELAKLACQVGAYFLLDAVQGYGRFALPEGCDMIALSGHKIHAPIGSGALWFKKDITLTPLLHGGHQQEGFRSGTLSPLCLRLWCCRRFGAEQQAKDQSHVAALFALAKAEMPDWIINGSEDQRWLGNFNIHQEGIDSSRLISDARQVAFSAGSACSSGNGRPSHVLKALGLSQKAVRGSIRIGFGRYTTEEELLSGLGYIREAAEKQRRFLS

SEQ ID NO: 8055 - protein, 611 aa, Schizosaccharomyces pombe 972h-
MSPTDTTPLLYSWDDQSRHQDPDWHKLRNYHGAWYRRISRRRFSQFIFAFGLMTLFVLVYSISSNLHTPTQFTGHKVRGRRGAVASEVPVCSDIGVSMLADGGNAVDAAIASTFCIGVVNFFSSGIGGGGFMLIKHPNETAQSLTFREIAPGNVSKHMFDKNPMLAQVGPLSIAIPGELAGLYEAWKSHGLLDWSKLLEPNVKLAREGFPVTRAMERVLKLPEMAHLLKDPIWQPILMPNGKVLRAGDKMFRPAYAKTLEIIANKGIEPFYRGELTNSMVKFIQDNGGIVTVEDFGNYSTVFADALHTSYRGHDVYTCTLPTSGPALIEGLNILDGYPLNTPSLAFPKRLHLEVEAMKWLSAGRTQFGDPDFLPLDHLDVVSKLLSKEFASQIRNNISLSKTYPWEHYNPSYDLPISHGTTHVSTVDSNNLAVSITSTVNLLFGSQLMDPVTGVVFNDQMDDFSIPGASNAFNLSPSPWNFIEPFKRPQSSSAPTILTDINGDFEMALGASGGSRIVTAVLDSIIKRIDMDYDIESMVASARPHHQLLPDILILESGFSKSVATRMKKYGHKVWRLKQHDTPLSQIQAVTRHHSEYYGMSDPRKYGQAAAY

SEQ ID NO: 8056 - protein, 97 aa, Glycine max
MAEKKEMIPKQYDIDAKWDACIDLTVRRFVYSASAGAFGGLLFFRSPVTRWASIAFGAGVGIGSAYAECSRLFDGPPTNLPLPKVSETATQNVPDSE

SEQ ID NO: 8057 - protein, 269 aa, Mangifera indica
NHGISHDLMDGVEKVNKEQYNKCREQKFNEFANKALENADSEIDHLDWESTFFLRHLPVSNISEIPDLDDQYRKAMKEFAAAIEKLAERLLDLLGENLELEKGYLKKAFSNGSKGPTFGTKVSSYPPCPRPDLVKGLRAHTDAGGIILLFQDDQVSGLQFLKDGEWLDVPPMRHAIVVNLGDQLEVITNGKYKSVVHRVVAQTDGNRMSIASFYNPGSDAVIFPAPALVEKEAEEKKEVYPRFVFEDYMKLYVGHKFQAKEPRFEAMKA

SEQ ID NO: 8058 - protein, 246 aa, Escherichia coli K12
MLDQVCQLARNAGDAIMQVYDGTKPMDVVSKADNSPVTAADIAAHTVIMDGLRTLTPDVPVLSEEDPPGWEVRQHWQRYWLVDPLDGTKEFIKRNGEFTVNIALIDHGKPILGVVYAPVMNVMYSAAEGKAWKEECGVRKQIQVRDARPPLVVISRSHADAELKEYLQQLGEHQTTSIGSSLKFCLVAEGQAQLYPRFGPTNIWDTAAGHAVAAAAGAHVHDWQGKPLDYTPRESFLNPGFRVSIY

SEQ ID NO: 8059 - protein, 298 aa, Zymomonas mobilis
MAVNLKTMMEQVAQDIDRLFAEQLPVPEDPRRRLVEAMRYAAIGGGKRLRPLLVVATCALFNVDREAALRVGMAIECIHVYSLIHDDMPCMDNDDLRRGKPTVHKAFDDASAVLSGDALQALAFEILSEEKIHTDPHVRLELIQALLSPPVKDGMVGGQAIDLAAETSTVPFDLPTITRLQQLKTGALFGFCLEAGAIMGRQNKDIRDRLKAYARDIGLAFQIADDLIDAEGDEAVAGKAVGKDAAAGKATFLSLLGLEKARSQAQALVDQAIAHLSVFGSEADYLRSIARYIVARDH

SEQ ID NO: 8060 - protein, 911 aa, Oryza sativa Japonica Group
MQLSCSGHDTILDHPVLGSCKVTAIYYRYRVINAILLVESSSNCPLQKLASTNVSTAVYEPQKKDGATIVGCSKDSIATNQDGIVGPRSCLNLSSHGSQLWYLVPPRTYMSALPPDCTVVAKGIPIPYNYDRNGPNENQYLDISNLKEKANKVINFGETAFTWHLNKITNACQGCEWNGHHCGFSSQRGQAFCQHQGSQVILIAATSSAATLVVLLLMVGTTIYLSLKTRYNEEIHLKVEMFLKTYGTSKPTRYSFSEVKKITRRFREKIGHGGYGNVYKGELPNGVPVAVKMLENSRGDGQEFINEVATIGRIHHANVLRLLGFCSEGTRRTLIYEFMPNDSLEKYIFSQGPNVSREFLVPDKMLDISLGIARGMEYLHQGCNQRILHFDIKPQNILLDYSFNPKISDFGLAKLCARDQSIVTLTAARGTMGYIAPELYSRNFGVISYKSDVYSFGMLVLEMVSGRRNLDPGIDNQHEVYFLEWIYEKVFTGQNLLIGTEMTQDEKYKVRKLAIVALWCIQWNPKNRPSTTQEYCPELSHFQQITSCSEGLQPAFCRSDQSLRCNYPLSVKTTNQNLLSSFILAGSHVEVISATSLVAAFVVLSFIMATALYLSLKSRYDEEVHLKVEMFLRTYGTSKPTRYSFSDVKKITRCFKEQLGQGGFGSVNIVRLLGFCSEGTRHILIYEFMPNESLEKYIFFHDPNTSQELLAPKKMLDIALGIARGMEYLHQGCNQRILHFDIKPHNILLDYNFNLKISDFGLAKLCARDQSIVTLTKARGTMGYIAPELYSRNFGEISYKSDVYSFGMLVLEMVSGRRNSDPSIEDQNEVYFLEWIYEKVITGQDFVLSGEMTEEDRLKVRQMALVALWCIQWNPRNRPSMTKVVNMLTGRLQNIQVPPKPFVSYESHAVP

SEQ ID NO: 8061 - protein, 330 aa, Oryza sativa Japonica Group
MTFLAHKCWKKRITIDAVDKFLRMQLMLGPTRSLQGSEKLGQGGYGSVYKGVLLPGNIHVAVKILANYSCDGEEFINEVSTIGSIHHVNVVSLVGFCAEETRRALVYEYMPNGSLEKYIFSPEKSFSWEKLNEIALGIARGINYLHRGCEMQILHFDIKPHNILLDSKFIPKVADFGLAKLYPQDNSFVPVSAARGTIGYIAPEMISWSFGVISSKSDVYSFGMLLLEMVGGRRNSKQDMSSSSQAYYPSWVYNQLAQQELGEVVTSAFNMHELEKKLCIVGLHCIQMNSYDRPTMSEVIEMLEGDVDGLRLPSRPFFCDDEPMPHLKVQ

SEQ ID NO: 8062 - protein, 289 aa, Methanococcus maripaludis S2
MAEECSGNCDSCGSSSDCSDTKKMMEQQNAQIRDNMSKIKYKIAVMSGKGGVGKSTVTVNLAATLNMMGYKVGVLDGDIHGPNIPQMLGVDQIQPMADENGIYPVSTPQGIKTMSIGYFLPDKNTPIIWRGPKASGAIRQFLSDVNWGELDFLLIDTPPGSGDIQITTLQAIPDIDGVVIVTTPEEVSVLDARKSVSAANTLEIPIIGIVENMGGFVCPECDKVIDIFGKGGGEKAAKELNVFFLGRIPLDIKARVASDRGVPMVTMDCKASEEFKKVVNTVLERIKKE

SEQ ID NO: 8063 - protein, 427 aa, Methanococcus maripaludis S2
MEKHGDYDIKKICVIGLGYIGLPTASMLANHGYDVVGVDVNEKRVNQIKNGELKIEEPGLLTLVKGAINSKNLNVRTSATEADAFIICVPTPALAKEDGSKKCDLSYVMSAVEAILPFVKDGNLIVIESTIPPETTKKIYETLNKKIYVAHCPERVLPGKILKELVENDRIIGGINKKSAEMAKEIYKSFVEGQIYTTDSNTAEMVKLMENTYRDINIALANEFAKICDEIGVNVWDAIKIANKHPRVNILNPGPGVGGHCISIDPWFIVEKTNNAKFIRAARELNDNMPAYVCNSVLSELKKLGIEKPKISIFGATYKGNVEDTRESPSKNVIKMLLENGATVSTYDPHASYFEYPLSTLDECISGSDCIVVLTDHDVFKTIKKDDIDEICPKLKNKIVFDTKNILEHSLWKKAGFTVKLLGNGAW

SEQ ID NO: 8064 - protein, 239 aa, Guillardia theta
MIRYWDFVIKKLNFNIKTYNLNFKSLNRNFDPYQNNGGLVLAITGNKFCVMASDTRISMGYSIPSRLNLRILKISNLCLLGSSGMISDINILHQKLRNEIFRLKYLNNTELNLNGIVYLTSSLLYSRRFFPFYTFNILTGINELGKASNYTYDAIGSFDCNHASTVGNCQSSAQCIMDYIEERKIPNDRNYKTILQVVSLIKIIFSTLCNKQVDMGDILQLFIVSKKGILVENSILRLD

SEQ ID NO: 8065 - protein, 305 aa, Novosphingobium aromaticivorans DSM 12444
MRAESILATIGNTPHIRLSRLFPDHEVWVKCERANPGGSIKDRIGLAMIEAAEADGSLKPGGTIVEPTSGNTGIGLAMAAAVKGYKLILVMPESMSLERRRLMLAYGATFDLTPREKGMKGAIERAKEIVDQTDGAWMPQQFDNPANVSVHVRTTAQEILKDFGSEPIDVLITGVGTGGHLTGCAEELKKHWPSLKAYAVEPTLSPVISGGQPGPHPIQGIGAGFIPGNLHTQSIDGAIQVDPADAKEMARLCASKEGMLVGISSGATLAAIAQKLPSLPAGSRVLGFNYDTGERYLSVPDFLPE

SEQ ID NO: 8066 - protein, 519 aa, Zea mays
  misc_feature (472)..(472): Xaa can be any naturally occurring amino acid
  misc_feature (499)..(499): Xaa can be any naturally occurring amino acid
MQFSSVLPLEGKACMSPVRRGSGGYGSERMRINCCSIRRNKALRRMCFSARGAVSSTQCVLTSDAGPDTLVVRTSFRRNYADPNEVAAVILGGGTGTQLFPLTSTRATPAVPIGGCYRLIDIPMSNCFNSGINKIFVMTQFNSASLNRHIHRTYLGGGINFTDGSVEVLAATQMPGEAAGWFQGTADAVRKFIWVLEDYYKHKAIEHILILSGDQLYRMDYMELVQKHVDDNADITLSCAPVGESRASDYGLVKFDSSGRVIQFSEKPKGAALEEMKVDTSFLNFAIDSPAEYPYIASMGVYVFKRDVLLDLLKSRYAELHDFGSEILPKALHEHNVQAYVFTDYWEDIGTIRSFFDANMALCEQPPKFEFYDPKTPFFTSPRYLPPTKSDKCRIKDAIISHGCFLRECAIEHSIVGVRSRLNSGCELKNTMMMGADLYETEDEISRLLAEGKVPIGVGENTKISNCIIDMXCQGWKERLHNKQRGRPRSRPAGRRILXIRSGIVVVLKNATIKDGTVI

SEQ ID NO: 8067 - protein, 550 aa, Vibrio campbellii AND4
MLKNIDPTQTQAWKALTAHFESAQDMDLKALFAQDAARFDKYSTRFGSDILVDYSKNLINEETLKHLFALANETELKSAIEAMFSGEAINKTEDRAVLHTALRNRSNKPVMAGGEDVMPAVNAVLEKIKSFTERVIGGEWKGYTGKAITDIVNIGIGGSDLGPYMVTEALAPYKNHLNLHFVSNVDGTHIVETLKKVDPETTLFLIASKTFTTQETMTNAHSARDWFLATAGDQAHVAKHFAALSTNAPAVSEFGIDTDNMFEFWDWVGGRYSLWSAIGLSIALAVGYDNFIELLDGAHEMDNHFVSTDLESNIPVILALIGIWYNNFHGAESEAILPYDQYMHRFAAYFQQGNMESNGKYVDREGNAVTYQTGPIIWGEPGTNGQHAFYQLIHQGTKLIPCDFIAPAISHNPASDHHQKLMSNFFAQTEALAFGKSAETVKAEFAKAGKSEEEMASLVPFKVFEGNRPTNSILVKQITPRTLGNLIAMYEHKIFVQGVIWNIFSFDQWGVELGKQLANQILPELADESEISSHDSSTNGLINAFKAFKA

SEQ ID NO: 8068 - protein, 207 aa, Guillardia theta
MLRTFLTTSRNPSLNLISFTKKLINLFPQSKKINRGRKFLTSLISYCVENEVKNLLVIYELKGNPNCLIISHLPSGPSVYFKISNYNILIFKNDINIFFSDLPILLISNLNTPIGSRISKIITNLYPKSSNNSKRIISYVGLSNNIVCNQYLFQKKNYNNENMKLKNIGPRFFLRPFKIILGNISEINSNVEWIITTLIQSKRRMII

SEQ ID NO: 8069 - protein, 413 aa, Rhodopirellula baltica SH 1
MARRRTFAFLSLANWAEPPMKIHEYQGKQLFRTAGVPVLDGHMVTTPDEAAAAYDKLGGKIAVVKAQIHAGGRGKGNVIDNPDQKGVVLVKSAEEAKAAAEGLLGKKLVTIQTGPEGQTVSKVFVEAGCDIARELYLGIVVDRAGSKPVLMVSTEGGVEIETVAEETPELIFKEHFDPAVGLDGFQVRKLCKKLGIEGAAAKSAYKFMTAMCRFFVDFDCEMAEINPLVITGDGEMVALDAKIIFDENAMFRHKDLEELRDLSEEEESELRAKKAGLSYVKLDGNIACLVNGAGLAMSTMDIIKYHGGEPANFLDVGGGANAAQVTEAFRILLSDPNCKGVLVNIFGGIARCTTIAGALITASKEVGFNVPLVVRLEGTEVEEGRKMLAESDVDIINAMDLTDAAKKIVAATA

SEQ ID NO: 8070 - protein, 550 aa, Emericella nidulans
MSPPSAKSMEEGRTPSVQYGYGDPKTLEGEIEEHTATKRGLSSRQLQLLAIGGCIGTGLFVGTSTVLTQTGPAPLLMSYIVMASIVWFVMNVLGEMTTYLPIRGVSVPYLIGRFTEPSIGFASGYNYWYSFAMLLASEVTASGLIIEYWNPPVSVGLWIAIVLVVILALNVFAVEWYGESEFWFAGLKILAIIGLIILGVVLFFGGGPNHDRLGFRYWQDPGAFNPYLVPGDTGKFLGFWTALIKSGFSFIFSPELITTAAGEVEAPRRNIPKATKRFIYRVFTFYILGSLVIGVTVAYNDPTLEAGVESGGSGAGASPFVVAIQNAGIGGLNHVVNAAILISAWSSGNAWCYAGSRTLYSLAGEGQAPKIFTRTNRTGVPYVAVLATWTIGLLSFLNLSSSGQTVFYWFTNITTVGGFINWVLIGIAYLRFRKALQFHGMLDMLPFKTPLQPYGTYYVMFIISILTLTNGYAVFFPGRFTASDFLVSYIVFAIFLALYAGHKIWYRTPWLTKVSEVDIFTGKDEIDRLCENDMERQPRNWLERVWWWIF

SEQ ID NO: 8071 - protein, 318 aa, Vibrio campbellii AND4
MAPMLDWTDRHCRYFHRLMTKETLLYTEMVTTGAIIHGKGDFLAHNEEEHPLALQLGGSNPADLATCAKLAQERGYDEINLNVGCPSDRVQNGRFGACLMAEPQLVADCVAAMKDVVDVPVTVKTRIGIDDHDSYQFLTDFVSIVSEKGGCDQFTIHARKAWLSGLSPKENREIPPLDYPRAYQLKKDFSHLTIAINGGVKSLEEAKEHLQHLDGVMIGREAYQSPYLLAFVDQELFGSNAPVKKRSQIVEEMYPYIEAQLAKGAYLGHITRHMLGLFQSMPGARQWRRYISENAHKPGSGLEVLQAALAKIPKELNV

SEQ ID NO: 8072 - protein, 181 aa, Mesorhizobium loti MAFF303099
MKPSLEDTLLASIRTIPDYPKPGILFRDITTLLGNARAFRRAIDELVHPYAGQKVDKIAGIEARGFILGGAVAHQLSAGFVPIRKKGKLPFDTVRVAYSLEYGLDEMEMHKDGVAPGEKVILVDDLIATGGTAEAAVKLLRQIGADILAACFVIDLPDLGGRAKLEALGVPVRTLIGFEGH

SEQ ID NO: 8073 - protein, 231 aa, Physcomitrella patens subsp. patens
MCKAQGGEVGGGSTRRVIDITHSYRADLPKWQSKTGLGVLTSLVSSLAEGDFANVSELKFEEVHSGTHVDAPGHYVQEHYVAGLDVASLDLDTLIGPVLLIDAPRDSNLTAQALQSLHIPPGVERVIFRTLNSDRRLMWNIEWDSSYVGFTTDGAEWLVNHTNVKFIGIDYLSVAAYVDLVAAHRVLLGKKLVIVEGLNLDEVEMGLYTVHCLPLKLLQAEGCPIRCVLSA

SEQ ID NO: 8074 - protein, 578 aa, Vibrio campbellii AND4
MSANQQSNSQEVLGEVLGPLSDNERLKRQSNLLRGTIEQDLQDRITGGFTADNFQLIRFHGMYQQDDRDIRNERTKQKLEPLHNVMLRARMPGGIITPKQWLAIDKFATEHSLYGSIRLTTRQTFQFHGVLKPNIKLMHQTLNSIGIDSIATAGDVNRNVLCTTNPVESQLHQEAYEWAKKISEHLLPKTRAYAEIWLDGEKVESTEEDEPILGKNYLPRKFKTTVVIPPQNDVDVHANDLNFVAIADNGKLVGFNVLVGGGLAMTHGDTSTYPRRADDFGFIPLEKTLDVAAAVVTTQRDWGNRSNRKNAKTKYTLDRVGSDVFKAEVEKRASVKFAQSRPYEFTERGDRIGWVEGIDGKHHLALFIENGRLLDFPGKPLKTGVAEIAKIHQGDFRMTANQNLIVAGVAKSHKAKIEKIARDHGLMNDSVSEQRKNSMACVAFPTCPLAMAEAERFLPQFVTDIEGILDKHGFAEEDNIIVRVTGCPNGCGRAMLAEIGLVGKAPGRYNLHLGGNRAGTRVPKMYKENITDKQILAEIDQLVARWAAEREKGEAFGDFTIRAGIIQEVFISKRDFYA

SEQ ID NO: 8075 - protein, 213 aa, Triticum aestivum
  misc_feature (170)..(170): Xaa can be any naturally occurring amino acid
FSERAARAGSGINAEPKANDQYLPPFVIVDESGKSVGPIVDGDAVVTFNFRADRMVMLAKALEFPDFDKFDRVRVPKIKYAGMLQYDGELKLPSKYLVSPPLIERTSGEYLVKNGVRTFACSETVKFGHVTFFWNGNRSGYFDETREEYVEIPSDSGITFNEQPKMKALXIAERTRDAILSGKFDQVRINLPNGDMVGHTGDIEATVVALQGC

SEQ ID NO: 8076 - protein, 436 aa, Physcomitrella patens subsp. patens
MTKVFSIILGGGAGTRLQPLTLRRAKPAVPLGGGYRLIDVPMSNCINSGINKIYVLTQFNSTSLNRHLANTYNFGNGCNFGDGYVEVLAAAQRPGFGGDRWFEGTADAVRQYMWLLEDAKNKDVEDVVILSGDHLYRMDYQDFVQKHKDSGADVTVSCIPMDDSRASDFGLMKIDGGRINHFSEKPKGKDLQSMQVDTTVLGLSAEEAQKKPYIASMGIYVFKKSVLAKLLRWRYPLANDFGSEIIPKAAKEFNVNAYLFNDYWEDIGTIKSFFDANLALAAENPNFSFYDAEKPIYTSARYLPPTKIEKCRVKDSIVSHGCFLRECSVEDSVIGIRSRLEAGCDVKRAMVMGADSYETDPEAAALLAEGKVPLGVGENSKLRNCIVDKNARIGKDVVIANTDNVLEAERQSEGFYIRSGIVVVYKNAVIKHGTVI

SEQ ID NO: 8077 - protein, 403 aa, Lactobacillus delbrueckii subsp. lactis
MAKLIVSDVDVKDKKVLVRVDFNVPIKDGVIGDDNRIVAALPTIKYIIENGGKAILLSHLGRIKSDEDKKSLSLAPVAKRLGELLEKPVTFVPSNEGKEVEDAINNMKDGDVVVLENTRFQDIDNDFGKRESKNDPKLGEYWASLGDVFVNDAFGTAHRSHASNVGIATAMKAAGKPVAAGFLLEKEIKFLGNAVANPVHPFVTILGGAKVSDKIGVITNLIPKADHIIIGGGMAYTFLKAQGHNIGKSLVEDDKVEFAKELLEKAGDKLVLPIDHVAATEFNNDAASEVVGQDIPDNEMGLDIGPKTIELFKKTLEGAKTVVWNGPMGVFEMPNFAKGTLEVGRALADLPDATTIVGGGDSTAAAKQLGIAPKLTHISTGGGASLEYLEGKELPGIACVSDK

SEQ ID NO: 8078 - protein, 278 aa, Mangifera indica
FQDYHGLPEFRNAVANFMARVRGNRVKYEPDRIVMSGGATGAHETVAFCLADPGEAFLVPTPYYPGFDRDLRWRTGVQLFPVVCDSSNNFEITREAVEAAYEKAQEDHIRIKGLLLTNPSNPLGTCLDRETLRSLVSFINEKNIHLVCDEIYAATVFMGQPDFISISEIIEEDIHCNRNLIHLVYSLSKDLGFPGFRVGIIYSYNDTVVSCARKMSSFGLVSSQTQHLIASMLSDDEFVDRFITESAERLAKRHRAFTWGLFQVGIGCLKSNAGLFCW

SEQ ID NO: 8079 - protein, 391 aa, Pseudomonas stutzeri KC
MPLSALVAPAGELSRAEINRYSRHLLIPDVGMIGQRRLKNAKVLVIGAGGLGSPTLLYLAAAGVGTIGIIDFDRVDDSNLQRQVIHGVDTVGELKVDSAKKAIARLNPFVQVETYTDRLERDMAIELFSRYDLIMDGTDNFATRYLVNDACVLANKPYVWGSIFRFEGQASVFWENAPNDLGLNYRDLYPEPPPPEMAPSCSEGGVFGILCASIASIMATEAVKLITGIGEPLLGRLVVYDALDMRYRELPVRRLPNRQPITDLAEDYQVFCGLGLPKGDTADAVPGISVTELKKRMDQDEVPVLIDVREPTEWDIVRIPGAILVTKSPTAAQTLRERYGADANLVIVCKSGRRSADVTAELLNLGMRNVRNLEGGVLAWVKDVDSSLPSY

SEQ ID NO: 8080 - protein, 234 aa, Wigglesworthia glossinidia endosymbiont of Glossina brevipalpis
MSIIKLVLMRHGSSIWNDQDRFTGWTDIDLSEKGKNEVKYAGKMLKSFGYSFNFAYTSLLKRAIHSLWVILKEINQSWIPVEKSWRLNERHYGALQGFSKYEIEKKYGKNQLNEWRRGFSISPPKINEKDNYFILNDKRYLNLKTKKLLPFSESLKSTIDRIMPYWDGNIFPRLQNKEKIIIVAHGNSIRAIIKILCNLNEKEIIKINIPTGIPLIYEFDYNMVFKKKYFLFDR

SEQ ID NO: 8081 - protein, 465 aa, Arabidopsis thaliana
MGKRGRACVVVLGDLGRSPRMQYHALSLARQASFQVDIVAYGGSIPHEAVLNHPSIHIHTMAQPRFIQYFPKILYPVTLLLKAFIQFTMLLWFLFVKVPAPDIFLVQNPPSVPTLIAVKWASSWRRAAFVVDWHNFGYTLLALSLGRNNLLVSLYRWSENHYGKMATGSLCVTKAMQHELDQNWGVRAKVLYDQPPEFFRPALLEERHELFCRVRKDLCHPIGVYDFISRELENQELNETLFTTKFNADISLKQNRPALVVSSTSWTPDENFGILLEAAVMYDRRVAARSKGSETAEISEEQHHYPNLLFIITGKGPEKEMYEEKIKRLNLRHVAFRTMWLAAEDYPLLLGSADLGVCLHTSSSGLDLPMKVVDMFGCGLPVCSVSYSCIQELVKDGKNGLLFSSSSELADQLLILFKGFPGNCDALMSLKAGAMETGSSGRWATEWEDCAKPLITQVVSQIADS

SEQ ID NO: 8082 - protein, 146 aa, Triticum aestivum
MAAPMLNQPNSLLANMFAAGLLDDQFQELQMLQEGSAPDFIVKVVTLFCEDGERIIGEIAKLLDKPCVDYDKVGGFVRQLKGSSASIGALRVKNSCIQFHQCCQEKSKDGCVNSLDSVRNDFYDLCSMFKLHASAGPAGAGLNPKQ

SEQ ID NO: 8083 - protein, 266 aa, Mycobacterium sp. MCS
MSTETTSNAVTREHGRLHGKSAVITGAAFGIGRATAVLFAREGARLVVTDIQSEPLLALADELRHAGADVEPVVGDVSVEYDAGRMIGAAVDRFGRLDVLVANAGIIPLGDALEMTAAGWDEVMAIDGRGMFLCCKFAIEAMLPTGGGAIVCLSSISGLAGQKRQAAYGPAKFIATGLTKHLAVEWADRGIRVNAVAPGTIRTERVKRFPEEPGGSEYLAAVERMHPMGRIGEPAEVASAIVFLASDDASFITGAVLPVDGGYLAQ

SEQ ID NO: 8084 - protein, 202 aa, Zea mays
MLLIVWSTTREDLSTQLSPIEAVNFQSEKMQQRKTTAAAAGRPSGTDGSDFSYRMVVDSRYTKVTKGRSRLRLLILVQATIYLIGLSCAFMTSTKNEERNTLGIASASIGLLFAFIGDFGCRRSRVNLLRLYTAASTVVMVLSLFSAVRSRLTMEERNSSGTAANLELLGFISAQLGAVVQILAIIVTGSLVNNMSPPTKTE

SEQ ID NO: 8085 - protein, 410 aa, Oryza sativa
  misc_feature (328)..(328): Xaa can be any naturally occurring amino acid
  misc_feature (337)..(337): Xaa can be any naturally occurring amino acid
MASVTGTQQANWGGLLETAATNVPIAAVTPRHHRSRSHSRYRGRRIQHSRGRRHRIRCPPSPLSPTATTCRFRGRGRRIRKLPPLAPEVGGGCIRPLPATAHCRPPPPLPRLGSVDPRVDVATEDGGGAVGGERRRARRLLLLAGAAAAIALLLSATAPVAGAEDDGYSYIPGSPRGPQNWGSLKPEWATCSSGKMQSPINLGLLDLTLAPGLGNLNYTYQNANASVVNRGHDIMVRFDGDAGSLKINGTAYQLRQMHWHTPSEHTIDGRRYDMELHMVHLNAQNQAAVIGILYTIGTTPDEFLQKLEPYIIAISNQEGKERVIVGGXADPNVAKGXDTVYYRYMGSFTTPPCTEGVIWTVVRKVRTVSLSQITLLKAAVLTGNENNARPLQGVNNREIDLFLPLPLINN

SEQ ID NO: 8086 - protein, 417 aa, Methanococcus maripaludis S2
MEISLVIGYISLLFIIGSFIAKLADRIGIPDIPLLLITGLLIGPVLGLISPIYAQTIFSFVGTIGLIILLLVGAFEMRWIVLKRVLKTVLKLDTIGLVISLLISGIIFSFIYALPFTNPIGFIYGAVNCATDPATLIPIFSKSDVDPKIAVTLEAESVFNDPLGIVATTLTLSSLGLSKSVNPILDFVMLAFGGLALGYVGGKIFEFVVSKDEFGEYIAPLGVGSAMALWFFGEDVAPHFLGYGLSGYMAVAIMGLYIGNVVTKKPKNSKDMHKMAEFCTDLSSLTRILIFVFLGASISLPLLKSFGIYGLLCAIGTLFIARPIGVFIATAIPPVSSLKERIYFALEGPRGVVPAALAAMIYTNIMHNPGIIPHSITQYMPPEMIAGSILVATFATIFLSVIVEASWAYPLANKLFK

SEQ ID NO: 8087 - protein, 682 aa, Oryza sativa Japonica Group
MVIPGPFFRRSTALQVFSVLCVLRFVVPDPDIEWPLIHGIPACPPFTCGHLSKVASPFHRRGYECGVASYELTCTDDKATIQIDNGTYFVTGIDYSDSTFWVVDANISDSRNNCPLPRWKRIPYYYDDVSSDDEESSPYNIQVELDPASRWWSFFVNCSKEINNNVMYSPVACMGTSSSFVYVLTGRLSCYIENLEPSCGYLAMTPLDGMGRVAPAVDSLSYEDVVKFMRKGFRVQFPFRHHRNRSFKDCLMESIPKSTGIGKLSDWFSLSVTENFMDCATAKIPSPYNILLGIILYALMFWTMLARTYLLAPLVVLIFLAQKYLKRMITIDAVEKFLRMQQMLGPTRYAYTDIIAITGHFREKLGQGGYGSVYKGVLLPGDLHVAIKILNGYSNCNGEEFISEVATIGRIHHVNVVRLVGFCSEEMRRALVYEYMPRGSLDKHIFSSERRFSWDKLNEIALGIARGINYLHQGCDMQILHFDIKPHNILLDDNFVPKVADFGLAKLYPRDKSFVSDRALRGTVGYMAPEMVSRSFGIISGKSDVYSFGMLLLEMVGGRRNADPNADSSASKAYYPSWVYDKLIADQQVDEISNFANMHELERKLCLVGLWCIQMKSHDRPTMSEAIEMLEGGVDALQVPLRPFFCDGDGMPPPQVMDSYFHSSDLSAISEEDDGIAELASS

SEQ ID NO: 8088 - protein, 502 aa, Arabidopsis thaliana
MEETNIRVVLYSIFSLIFLIISFKFLKPKKQNLPPSPPGWLPIIGHLRLLKPPIHRTLRSFSETLDHNDGGGVMSLRLGSRLVYVVSSHKVAAEECFGKNDVVLANRPQVIIGKHVGYNNTNMIAAPYGDHWRNLRRLCTIEIFSTHRLNCFLYVRTDEVRRLISRLSRLAGTKKTVVELKPMLMDLTFNNIMRMMTGKRYYGEETTDEEEAKRVRKLVADVGANTSSGNAVDYVPILRLFSSYENRVKKLGEETDKFLQGLIDDKRGQQETGTTMIDHLLVLQKSDIEYYTDQIIKGIILIMVIAGTNTSAVTLEWALSNLLNHPDVISKARDEIDNRVGLDRLIEEADLSELPYLKNIVLETLRLHPATPLLVPHMASEDCKIGSYDMPRGTTLLVNAWAIHRDPNTWDDPDSFKPERFEKEEEAQKLLAFGLGRRACPGSGLAQRIVGLALGSLIQCFEWERVGNVEVDMKEGVGNTVPKAIPLKAICKARPFLHKIIS

SEQ ID NO: 8089 - protein, 94 aa, Crocosphaera watsonii WH 8501
MSIYVGNLSYDVNKEDLEEVFTEYGSVKRVHIPKDRESGRMRGFAFVEMDSDDQEQEAISTLDGAEWMGRTLKVNKAKEREPRGSFNGGGRSNY

SEQ ID NO: 8090 - protein, 511 aa, uncultured marine bacterium 311
MTFAKSKKYLKKIEESSVYDVADITPLSLASHLTKETKNNIFLKREDLQPVFSFKLRGAYNKISYLKKIGTIERVITASAGNHAQGVAYSARKLRLKATIVMPVTTPSIKVSAVKNLGAQVVLVGDTYDEAYEHAIKLSKKPNYAFVHPYDDPDVIAGQGTIGKEILDQAGNDLDAVFVPVGGGGLLAGIGAYIKTLRPDVKIIGVEPEEAAGLYEALKANRIVTLKQVGIFVDGVAVKQVGKVTFPIIKEWVDEVVTVSVDEICAAIEDIFQETRTISEPAGALSLAGLKKLTKSKGWKNKNLVAINSGANLNFDRLSHIVERVQLGEKKEALLSVCIPEEKGSFRQFCKDLGKRMITEFNYRIDDEKEANIFVACRVNEGIKEKSRFIKNLRKKGYSPKDLSDNEMAKLHVKHMVGGRAPKDIISYGEEIFRVEFPERPGALMDFLSLLGDKWNITLFHYRNQGSAYGRVLVGFQANPKETEKLTKHLVKTGFPFWNESKNSAYLSFLE

SEQ ID NO: 8091 - protein, 222 aa, Zea mays
WPAQLDSYAKSAQEIALQELVQSETPKDVVHSQVSKKEDNNENLVVSSGTSGRVVQAFTLLQESPEAQVVVASLASDKNVWDAVMKNEKVIKFYKTYESNYLSNTSYCLPTELSKCSSVASSVSGHEVEDGEAASLQSNTYLPQSAGESVKDYLEKMKALVSEMMANLSNIMQDLVATSDEGRSKGEIKTLTTSSCKDFSNAPSAFVLLAVASIMVVLLKRV

SEQ ID NO: 8092 - protein, 429 aa, Crocosphaera watsonii WH 8501
MLSPILDSSVSQTPTIVNLTNGLTIIAEQMPVDAVNLNVWLKVGSALESNEINGMAHFLEHMVFKGTPNLKNGEFEQRIEQRGAVTNAATSQEYTHFYITSAPNDFADLVPLQLDVIFNPIIEDGAFGREKLVVLEEIRRSYDNPSRRTFYRAMETCFDTLPYRRPVLGPADVIEGLTPQQMREFHGSCYHPNSVTAVAVGNLPVEQLIDIVADSFEKTYYQTETFSDSLQSLSFPVSPESPFEEIIRQEYEDEQLQQARLIMMWKVPGLLDLEETYGLDVLASILGKGKTSRLFQDLREDKNLVSHISVSNMTQKVQGMFYIAAKLEKENVPEVEKIITQHLQSIQKESIKEEELNRIKRQAVNRFIFNNERPSDRTNLYGYYYSQMQSLNPALSYPQVIQSLTTDDIQNAARKYLDPNAYGVTIVTN

SEQ ID NO: 8093 - protein, 310 aa, Populus trichocarpa
MKVTVVSRSGREVIKGGLELSDSATVADLQEAIHKRTKKFYPARQRLTLPLPPGSKERPTVLNYKKNLKEYQDGNLDSLTILFKDLGPQVSYRTLFFFEYLGPLVLYPFFYYFPVYQFLGYKGEHIMHPVQTYALYYWCFHYFKRIMETFFVHRFSHATSPLSNVFRNCAYYWTFGSYIAYYVNHPLYTPVGDLQMKIGFGFGLVCQLANFYCHILLRNLRRPDGNGGYQIPSGFLFNIVTCANYTTEIYQWLGFNIATQTVAGYIFLVVAASIMTNWALAKHRRLKKLFDGKDGRPKYPRRWVILPPVL

SEQ ID NO: 8094 - protein, 887 aa, Novosphingobium aromaticivorans DSM 12444
MTAYVFHFGGGATSSEPRAKDKTIVGGKGANLAEMAGIGLPVPPGFTISTEVCTAYNASGKTFDDALRAGVAAGVSHIEKATGRTFGDAANPLLVSVRSGARVSMPGMMDTVLNLGLNDATVEGLAAGSGDPRFAWDSYRRFIQMYSDVVLGLDHHRFEDALEIVKEDNGFFNDVELGANHWQALVGEYKSIVEDQLGRPFPQDVHEQLWGAIGAVFDSWESDRAKVYRKLNDIPHDWGTAVNVQAMVFGNMGDTSATGVAFTRDPATGEKAYYGEWLVNAQGEDVVAGIRTPQYLTLAARERAGAKPLSMEEAMPGAYAELAAVFELLEKHYRDMQDIEFTVEQGKLWMLQTRSGKRTAKAALKMAVDMVGEGLIDEATAIKRIDPMALDQLLHPTLDPKAARDVLTKGLPASPGAASGTVVFDADTAQAKAERGDAVILVRVETSPEDIHGMHAAKGILTARGGMTSHAAVVARGMGRPCVSGASALSIDMASRTARIGNREIREGDVITLDGSNGDVMAGKVPTVEPELVGDFGTLMAWADKHRRMKVRTNAETPLDCQVARQFGAEGIGLCRTEHMFFEAGRISAVRQMILAEDEAGRRAALAKLLPEQRSDFQSIFEVMAGLPVTIRLLDPPLHEFLPHGETEFAELAEATGLGIEHLKRRAGELHEFNPMLGHRGCRLGITFPEIYEMQARAIFEAACDVAEQSGDAPIPEVMIPLVATKKELEILRALVDRVAAEVFAEKGRTLEYMVGTMIELPRAALMAGEIAEEAKFFSFGTNDLTQTTLGVSRDDAARFLNPYVDQGIYPRDPFVSLDIEGVGQLVELAAERGRKTRPDIKLGICGEHGGDPASIAFCEKTGLDYVSASPYRVPIARLSAAQAALA

SEQ ID NO: 8095 - protein, 478 aa, Picea sitchensis
MADAVRVVRKLRYTFSSGRTRSYEWRIAQLKQVWKLVDENEDQIIEALSEDIGKPPFESFFAEISLTKDSCKVAIKQLKSWMAPEKVSTTLTVFPSKAEILPEPLGAALIISAWNYPLLLSMDPVIGAIAAGNVIVLKPSEVAPATSSLLATLIPQYLDDDAIRVVEGSVAETTSLLEQKWDKIFYTGSGKIGRIVMAAAAKHLTPVTLELGGKCPVIVDPTVDLEVTARRIVAGKWGCNNGQACIAPDYIITPESFAPKLIDALKNTLEKFYGQDPIQSADLSRIVNSSHFVRLTRLLDDPKVSDKVIYGGQRDEKRLIIAPTLVLDAPMDSLIMIEEIFGPLLTIITVQKMEEALEVVSSFSKPLAAYVFTKNKKFERQVVASVSAGGMLVNDTALHVTNHHLPFGGVGESGVGSYHGKFSFEAFSHKKAVLYRGFMGDLMARYPPYTTRKQKIVRCLLSGDFLGLLYAILGWNSK

SEQ ID NO: 8096 - protein, 746 aa, Candida albicans
MSVIAGHHVPRSNDQRQYDTPSVPINIAPDSEGHIHEMSRLKDYEVIEKLGQGTFGVVQKAKSKKDGSLVAIKQLINHSAKEGFPITAMREITILKQLNHKNILTIQDMIFEEPKMSNRTDIITMRGSFYTVTPYMSSDLVGLLENPKIKLELGQIKCIMQQLLKGIQYVHNQKFLHRDIKAANILIGQDGVLKIADFGLARIYHGNVPRLGMGPGGGEKAYTGLVVTRWYRPPEILLGERKYTTAVDQRGIGCVFAELFTGKPILVGKSDSHQAQIVFELVGSPLTWTDAAKLPNKNEYSCGLACKRSLEAKFASIMPTEAIDLLSGLLTLDPFKRLNALDALNHKFFSTDPLPLLPTQMPKFEESHEIDKERFKKLKDKEQAVSELKPPTEIRYDNHSESRYNADHSTFGGGGVGGKETSFSSGKSDYIDHYEPRARRDHYEPRIRNDNKDSNDVRGEFESATRQEQRRRDIQNRLDAGGMDTYIPKTTTGKLREHSGTESLSQKYDNYQPINVSRGSKSPSPSKLSSISQSKADLISKPSAPKVASRESSLERKQVSNGIRTTTDVEPPRARARRPTDMFGRPLTSNSTQAQPTRNKSVERPKDLEKPTNGVTEDRNKKPVLEEKKEVVKPNLAIPKIKKSSSLVSLSSRSSTTPVISNPSKVTKRAASSVTPPVLPKKPKISKTSSESEVSDLEEDSDFTGENATVFERFMALEQLQKSPVYKRIINEKMRFEKLSGGHKSM

SEQ ID NO: 8097 - protein, 300 aa, Rhodobacter sphaeroides 2.4.1
MLSRCSSAAGRGDNLFLIAETQVMTGRIAFQGEPGAYSHQACRQARPEMEAIPCRTFEDAIELVRAGEADLAMLPVENSTYGRVADIHTLLPGSGLRIVDESFVRVHINLLTLRGTPIEQVERAMSHTVLLGQCRTFLRGHDIRPVTGADTAGSARLVAEQGDPALAALASELAGEIYGLDVVARHIEDQSNNTTRFLVMAREADWTRRGPGKMVTTFTFRVRNIPAALYKALGGFATNGINMTKLESYMVGGSFTATEFYADIEGHPEDGNVALALDELRFFTSQSEILGVYPADPGRG

SEQ ID NO: 8098 - protein, 480 aa, Physcomitrella patens subsp. patens
MLSLKNGVLHFVHPSLSIPCFRHGQALRMGTAGNSTRMRPRIHSFPVMAGGAQVKVMESIIGDIAKDRSKVPKVVLKRGKTQLFRGGNPMVYSGAIDRVVGRPPPVAGDLVMVTDGAEQPIAWGVYNPLSMFAVRIMQTEDEARREPECVLNMETLLLSRFSAARKLRKTLGLPSDHTNVFRLVNSEGDRQNFVWYRLSGLIVDVLGEQVVVASSAAWVERHRSTIELAVGKAIKTSHVSWRPSVEILKEEGLQVSTSEDSSLDSASDVVENGVRYLASLDGQKTGFYADQRDSRLLLRSLASGSSVLDLCCYSGGFALNAALGGASYITGVDSSSPALELAKSNASLNRLDANSIDFVKADVAEYMKSALSEGKQWDIVVLDPPKLAPNRKVLQRATAKYRNLNAMAIRLTKPGGLLMTCSCSGAMTQSGNFLSVIQEAAMSANRRVTQLRYAGAAPDHTIDPAYPEGTYLTNVLLRVQ

SEQ ID NO: 8099 - protein, 398 aa, Picea sitchensis
MAAATGAVLKTALSLRKSEWMGQALRPTSVNTSAQSQSYNATALSVRAGAYSEELIKTAKRVASPGRGILAMDESNATCGKRLASIGLENTEANRQAYRQLLVSAPGLGQYISGSILFEETLYQSTTDGKKMVDVLVQQDIVPGIKVDKGLVPLAGSNDESWCQGLDGLASRCAAYYQQGARFAKWRTVVSIPNGPSALAVKEAAWGLARYAAIAQDNGLVPIVEPEILLDGEHGLERTFEVALKVWAEVFFYLAENNVLFEGILLKPSMVTPGAECKDRASPETVAQYTLNLLRRRVPPAVPGIMFLSGGQSEVEATLNLNAMNQAPNPWHVSFSYARALQNTCLKTWAGRPENVDAAQKILLVRAKANSLAQLGKYSAEGESAESKEGMFVKGYTY

SEQ ID NO: 8100 - protein, 176 aa, Photobacterium sp. SKA34
MSLNQVPAGKDIPEDIYVVIEIPANADPIKYEVDKDTGAIFVDRFMSSPMFYPCNYGYVNHTLSLDGDPVDVLVPTPHPLVPGAVIRCRPVGVLKMTDESGEDAKIVAVPHSKLSKEYDHIQDVNDLPELLKAQITHFFERYKELEPNKWVKVEGWDNAEAAKAEILTSFERAQKK

SEQ ID NO: 8101 - protein, 337 aa, Photobacterium sp. SKA34
MTDIRTLGEFIVEKQSDFPHASGELSSLLGSIKLAAKIVNREINKAGLVDITGTVGENNIQGEEQQKLDVYANDKFKAALEARDQVCGIASEEEDEAVGFDKPLNLNAKYVVLMDPLDGSSNIDVNVSVGTIFSIYRRVSPVGSPPTKEDFLQTGNQQVAAGYVIYGSSTMLVYTTGNGVHGFTYDPSLGSFCLSHENMTIPQDGVIYSINEGNYIRFPTGVKQYIKYCQEAVPEEKRPYTSRYIGSLVADFHRNLLKGGIYLYPSTASYPNGKLRLLYECNPMAFIIEQAGGKATDGFQRILDIEPTELHQRVPFFVGSTNMVEKVESLLRDYPEN

SEQ ID NO: 8102 - protein, 272 aa, Leptosphaeria maculans
PVKQNGIKRSETGESNKSDKTNGDCGANGANGIGGLVRVPTTKPPVFEPQVGYRQWVAQAGTLIADLLTCAGADHVITMDLHDPQYQGFFDIPVDNLYGRHLLRKYIQFNIPNYLQAVVVSPDAGGAKRATAIADSLGMPFALIHKERRPTQINDRQNATMMLVGDVADRTTILIDDLADTSNTITRAAKLLKKEGATQVVALITHGILSGDAIDRINASALDKVIVTNTVPQAEHKARCPKLEVLEVGNVFAEAIRRVHHGESISVLFDYS

SEQ ID NO: 8103 - protein, 531 aa, Physcomitrella patens subsp. patens
MDFAKSTVARISFEGLKPEDGLSNQRVEIIVFLAAMFILPFVLLKLMRRPKLKLPPSPPAYPIIGHLHLLGKLPHHSIANIAKTYGEIYSLRLGSVPAIVVTTPEMAKEFLLTHDKIWASRTVRDVSGYYLSYNHTGIAFAPFTPVWRNLRKICTSELFTQKRMEASQGVRDVEMQCMIRRLIDLKLEVNALTANVVTRMVLNKRFMRCVDSTAEEESRAQQFKEIMKDHFTLQGIFMIGDYIPWLRPLDLGGKEKRMKALRKRLDAFLNEILDDHEVKRAKGPIAEEDQDMIDVLLNEMHQQDPNEPHKMDLNNIKSTILNMFAGGTDTATITIEWAMSELLRNPPIMAKLKAELDALIGQDRRVRETDVPNLPYLQAITKETFRLHPAGPLLVPHESTHDCEVAGYRIPAGTRLFVNIYAIGRSSKAWDRPLEFDPERFMTGPDASVDTKGKHYRLLPFGTGRRGCPGMSLGLLLVQFTLAALVHALDWSLPPGMDPEDVDMTEACGLKVPREHALSLNAKPRAAAQFY

SEQ ID NO: 8104 - protein, 483 aa, Ralstonia metallidurans CH34
MTATRPDLPKHDLLIDGKRLPPGSGEYSTDINPATEEPIALVAQGSAADVDTAVLAARAALKSWAGMRAADRGRILNRFADLLEAHAEELITLESLDAGKPLAAVRRQDLPAVVDTVRYYAGWCDKIHGAVIPTRPDALTYTVREPVGVVAAIIPWNFPLMIGMWKIAPALACGCTLIVKPAEITPLTALRVAELALEAGVPPGVFNVVTGKGSVVGNALVAHPGIDKVTFTGSPGVGRGIMQGAASNFKRVTLELGGKSANVIFADADIDAATRAAASGIFFNSGQVCSAGSRILAQRKVYDEVVERLTTRARAIRVGDPASPDTTMGPVVSAAQMKTVLDYVEIGKREGASAVTGGARIGQRGFFVEPTVFANVEHEMRISQEEIFGPVASVIPFEDEAEAVRIANGTAFSLAAGVWSADIARVHKVAGELRAGTVWINTYGYTDVRLPWGGAGDSGLGREHGDAAIENFTEPKAIWLSLR

SEQ ID NO: 8105 - protein, 352 aa, Leptosphaeria maculans
MPPTGSGSSRKISFNVSEQYDIQDVVGEGAYGVVCSALHKPSGQKVAIKKITPFDHSMFCLRTLREMKLLRYFNHENIISILDIQKPRNYETFTEVYLIQELMETDMHRVIRTQELSDDHCQYFIYQTLRALKAMHSANVLHRDLKPSNLLLNANCDLKVCDFGLARSAASTEDNSGFMTEYVATRWYRAPEIMLTFKEYTKAIDVWSVGCILAEMLSGKPLFPGKDYHHQLTLILDVLGTPTMEDYYGIKSRRAREYIRSLPFKKKIPWKAMFPKTNDLALDLLERLLAFNPVKRITVEEALKHPYLEPYHDPDDEPTADPIPEEFFDFDKNKDNLTKEQLKLLIYQEIMR

SEQ ID NO: 8106 - protein, 78 aa, Moritella sp. PE36
MSNFEERVKKIIIEQLGVKEEEVKNEASFVDDLGADSLDTVELVMALEEEFDTDIPDDEAEKITTVQAAIDFVVSSAK

SEQ ID NO: 8107 - protein, 118 aa, Physcomitrella patens subsp. patens
MGTLLRQLQSRVATVTEVVTKYNKQMLEKNKHYIADNPTPEKCQELSKKLFFTQLASFPVRYQAMLKEIDHLKVKLTHRNDLELEDVGISVLFALECYGWFCVGEIIGRGGTIVGYKV

SEQ ID NO: 8108 - protein, 244 aa, Moritella sp. PE36
MSFSSKTVLVTGASRGIGRAIAEHFAKLGAKVIGTATSAQGAERIGAYLGDAGFGLELNVTDQDSVDALYAEIKTRVGHIDILVNNAGITADNIFLRMKEDEWCNVIDTNLTSLYRLCKPCLRGMMKQRYGRIINIGSVVGSTGNGGQANYAAAKSGLLGFTKSLAIEIASRGITVNAVAPGFIETDMTSELTEEQKQTILAQVPTNRLGSTAEIAETVGFLASDGASYITGETIHVNGGMYMA

SEQ ID NO: 8109 - protein, 339 aa, Pseudomonas syringae pv. syringae B728a
MTPESLETPVNIGQPAPVLSRRFSVAPMMDWTDHHCRYFMRKLSKHALLYTEMVTTGALLHGDRERFLRHDETEHPLALQLGGSTAADLAACSRLAQEAGYDEVNLNVGCPSDRVQNNMIGACLMAHPELVADCVKAMRDAVGIPVTVKHRIGINGRDSYAELCDFVGKVQEAGCESFTVHARIAILEGLSPKENRDIPPLRYDVVAQLKSDFPGLEIVLNGGIKTLEQCSEHLQTFDGVMLGREAYHNPYLLAHVDQQLFGSTAPVISRYDALESMRPYIAAHIASGGNMHHVTRHMLGLGLGFPGARRFRQLLSVDIHKAENPMLLLDQAAAFLQGH

SEQ ID NO: 8110 - protein, 335 aa, Mycobacterium sp. MCS
MDVRSVADPSPPPGGVVVEVHATGLCRSDWHGWAGHDRGITLPHVPGHELVGVVAEVGAGVEKWRVGDRVTTPFVCGCGRCQWCLEGQAQVCPDQTQPGFTHWGSYAEYVALHAADANLVAVPDAVGDAAAAGLGCRFATAYRALSARARIRPGEWVTVVGAGGVGLSSVQIAVAFGARVIAVDREPAALALASRLGAEHTVHADGADVAGRVHDLTGGGSHVAVDAVGSAATCADAIHSLRRRGRHLQVGLLPDVTGHPAVPMDRVIAWELDVLGSHGMASGDYPGMMRLIEAGTLRPQAIVERVVGLTEGATLLSSLSVATPAGVTLIDPRLG

SEQ ID NO: 8111 - protein, 158 aa, Ustilago maydis 521
MVSLTTSDNEQFTVDRDVAERSVLIKQMLEDIGDTEQPIPLVNVSSNVLKKVLEYCSHHRNDPPAPADDAEESRRRTTDISDWDAKFIQVDQEMLFEIILAANYLDIKPLLDVGCKTVANMIKGKTTEEIRKLFNIQNDFSPEEEAQIRKENEWAEDR

SEQ ID NO: 8112 - protein, 332 aa, Escherichia coli K12
MKTLGEFIVEKQHEFSHATGELTALLSAIKLGAKIIHRDINKAGLVDILGASGAENVQGEVQQKLDLFANEKLKAALKARDIVAGIASEEEDEIVVFEGCEHAKYVVLMDPLDGSSNIDVNVSVGTIFSIYRRVTPVGTPVTEEDFLQPGNKQVAAGYVVYGSSTMLVYTTGCGVHAFTYDPSLGVFCLCQERMRFPEKGKTYSINEGNYIKFPNGVKKYIKFCQEEDKSTNRPYTSRYIGSLVADFHRNLLKGGIYLYPSTASHPDGKLRLLYECNPMAFLAEQAGGKASDGKERILDIIPETLHQRRSFFVGNDHMVEDVERFIREFPDA

SEQ ID NO: 8113 - protein, 461 aa, Oryza sativa Japonica Group
MSIALEMMEAEREMDKRRSRRWMGLADSHDNPLPRVGIKDRIIDILSIDLRFWGCMIGLSREYYIDMRLSISDMIRGVDHSLYHKLFILYTLCLVKWIAVYTIKLVTPHIALQNSLAFSYAVLCRFVFAPLAVMIFLTRQGQGGYGSVYKGVFLPGDVHVAIKMLDGNSNCNGEDFISEVATIGRIHHINVVRLVGFCSEEMRRALVYEYMPRGSLNKYIFSSERSFSWDKLNEIALGIARGINYLHQGCEMQILHFDIKPDNILLDDNFVSKVADFGLAKLYPREKSFVSDRALRGTVGYMAPEMVSRSFGVISDKSDVYSFGMLLLEMAGGRRNADPNANSNASRAYYPAWVYDQLIADQQVDEISNVADMHELERKLCLVGLWCIQMKSHDRPTMSEAIEMLEGDVDALQVPLRPFFCDGDGIGNGMPPPQVMDSYFHSSELTAISEEDDGIAELASS

SEQ ID NO: 8114 - protein, 474 aa, Mycobacterium sp. MCS
MRRSHSPGSRADGSARDDGWVVTDLDLDLQALPLAPKNPLPYRQLLPLVRHFHTGQEVLRQAAGPVIRLKLGPKWMIPEIVVVTSPAGIRDVLGRNHASAERCRVHDEVRDLGGESLFVLPNDPWIPRRRALQPVFTKPSVRGFGGHMSRAAEMVGERWGQTAQVNLDEECRRLTMRSLGRSILGLDLDAKADLIAGPLPVAAGYAADRALKPVRAPRWLPTPQRRRANAAVATMKAVTNDILQACRADPARDAPLVHALINASDPETGRSLSDDDICNELLVFMLAGHDTTATLLTYALWALGHHPDIQDRVAAEACALGDRLPTPDDVGRLGYTVQVLNESLRLCPPAAGVGRMALRDVEVDGYRVEAGSLVGIGIYAVHRDPELWDRPLEFDPERFSPENVKDRDRWQFIPFAGGPRACIGQHFAMLEATLALATLIRSHEIRSIDDDFPLETPYTTVAAGPIWARVHRRT

SEQ ID NO: 8115 - protein, 631 aa, Oryza sativa Japonica Group
MAGAFRRSAALQAMAAFSVLALVVPDQVQGRGKCPSFSCGRLSYVHFPFRRQGDPAECGVPSYELTCADSNATIQIDKATYLVTDINYSDQYFWVVDASLDSANNCPLPRWSQTPYNENYRLGEDSHRRVQVQLSPDVDWFATFVKCSQEMNSSNVMYRPVACRSGNSSFVYVLTGLGSYLAENLEPSCGYLAMTPLALGGLENWRTATAAATLEDVNYEDVVRSMSEGFAVRFPFRSGGFIDCLRGLISRDEHVYGVACRFVLVMLLMWTSVAYMYWKIKMRVDEVEKFLQLQQMLTPTRYSYTDIIAITSHYRDKLGQGGYGSVYKGVLLPGDVRVAIKMLKGDANCKGEEFISEVSTIGRIHHVNVVRLVGFCSEEIRRALVYEYMPQGSLDKYIFSSEKSFSWDKLNEIALGIARGINYLHHGCDMQILHFDIKPHNILLDNNFVPKVADFGLAKLYPRDKSFVPVSAARGTVGYIAPEMISRGFGAISSKSDVYSFGMLLLEMAGGRRNADPNAENSSQAYYPSRVYRQLTRQETGEITAAADMHELEKKLCIVGLWCIQMRSCDRPMMSEVIEMLEGGVDCLQIPPRPFFCDDDYIPAMESLYLSSEVELAAISEEEDESITELN

SEQ ID NO: 8116 - protein, 456 aa, Oryza sativa
  misc_feature (133)..(133): Xaa can be any naturally occurring amino acid
  misc_feature (165)..(165): Xaa can be any naturally occurring amino acid
  misc_feature (176)..(176): Xaa can be any naturally occurring amino acid
MSFDNFVQITGDARAVRKALFAVSTIIYKCPSKETIPLETSVSDLPPSIIVPSELPVYPSSNFYSPSDAAISSGHPSLSILGSTPHVPELTVSADAHSRLPIYQSVLPVIPAYNTSKCSGELVLRVLCPAGKXIGWLLVKGGVTIKSIKKEIGAREDGYDSKNDXRREILIPITSXEATDDAKSAAVEAVLLLQSKINDDNEGKLNLRLLVPGKVIGCLIGKGGSIVNDMRSKTKAAIYISKGEKPRKASSSDELVEVFGEVENLRDALVQIVLRLRDDVLRDSVDRQNSEKDGKLTVATTDPLYASSYPLPALLPYRQQITPLGYDHRGDIERGLEVYPHSSLYGYSSLQAIDDGYSAVSSYASKGYGGYVGTELPMNPDLKRPPHMEMTIPASGLSKVMGKHGTNLDNIRKISGAHIEIIESKSSRHGHVARISGTTEQKQSAENLIKAFIMST

SEQ ID NO: 8117 - protein, 363 aa, Erwinia carotovora subsp. atroseptica SCRI1043
MGFKCGIVGLPNVGKSTLFNALTKAGIEAANFPFCTIEPNTGVVPMPDPRLDKLAEIVKPQRILPTTMEFVDIAGLVKGASKGEGLGNQFLTNIRETEAIGHVVRCFENDNIIHVNNKVDPADDIEVINTELALSDLDTCERAIHRVQKRAKGGDKDAKAELAALEKCLPQLENAGMLRSLDLSDDDKAAIRYLSFLTLKPTMYIANVNEDGFENNPYLDKVREIAVAEGSVVVAVCAAVESDIAEMDDADREEFMTELGLEEPGLNRVIRAGYELLNLQTYFTAGVKEVRAWTIPVGATAPQAAGKIHTDFEKGFIRAQTIAYEDFITYKGEQGAKEAGKMRSEGKDYIVKDGDVMNFLFNV

SEQ ID NO: 8118 - protein, 288 aa, Crocosphaera watsonii WH 8501
MWTQISQHISETTGKPFTVERQKSVSGGCINQGYCLIGSDIKYFVKINHASKVEMFAAEALGLKEMAQTQTIRVPKPICWGMTERSSYIVLEWLEFGSSHNSAWEEMGIKLAKMHNYQGENKFGWSENNTIGSTPQVNNWTDTWSDFFANHRIGFQLKLANRKGGNFGNYNQIVDKVRQILASIEPQPSLVHGDLWSGNVAVTDAGEPVILDPATYYGDREVDLAMTELFGGFPAAFYRGYNEVFPLDKGYKKRKTLYNLYHILNHFNLFGGGYGSQANFMIQEVLKN

SEQ ID NO: 8119 - protein, 625 aa, Oryza sativa Japonica Group
MASSISSSSITYTLQTALVISSSLLVAADVGGGQSNNHYCPPSSCGDLHNISYPFRLQGDSRDCVAAPRPWYDLSCSNTGKATIQINTRTYYVSSINYTDLSFLVTDATMQDDDSSCPLPPSDHPPYSTDDLLDRTTTDSYGFLDLATSSDSAWACFVNCSRPIQDTTSPWYFNEHITGASIPNIARAIFWSELYFTRCRVAGHAYTTKFMTLMVIIVSAIVIIKLYKVYDTYGYHSICHRYHQALFWLMLAPLVVFIFLAHKYWKTRITIDAVEKFLQMQQMIGPMRYAYTDIIAITSHFRDKLGQGGYGSVYKGVLLPGNVHVAIKMLSGNSNCNGDEFISEVSTIGRIHHINVVRLVGFCSEEMRRALVYEYMPRGSLDKYIFSLEKCFSWDKLNEIALGIARGINYLHQGCEMQILHFDIKPHNILLDDNFVPKVADFGLAKLYPRDKSFVPVSAARGTVGYIAPEMISRSFGTISSKSDVYSFGMLLLEMAGGRRNADPNAANSSQAYYPSRVYKQLTRRETCEISDIVDMHELEKELCVVGLRCIQMRSSDRPTMSEVIEMLEGGSDDLQVPPKPFFCDDEQPLGVEPYHLSSDLTAISEAEEDDDDESISLFQSFSYQ

SEQ ID NO: 8120 - protein, 315 aa, Erwinia carotovora subsp. atroseptica SCRI1043
MPDMKLFAGNAIPELAQRIANRLYTSLGDAAVGRFSDGEVSVQINENVRGGDIFIIQSTCAPTNDNLMELVVMVDALRRASAGRITAVIPYFGYARQDRRVRSARVPITAKVVADFLSSVGVDRVLTVDLHAEQIQGFFDVPVDNVFGSPILLEDMLQQNLENPIVVSPDIGGVVRARAIAKLLNDTDMAIIDKRRPRANVSQVMHIIGDVAGRDCVLVDDMIDTGGTLCKAAEALKERGAKRVFAYATHPIFSGNAYENIKNSVIDEVIVCDTIPLAENIRSLPNVRTLTLSGMLAEAIRRISNEESISAMFEH

SEQ ID NO: 8121 - protein, 189 aa, Carboxydothermus hydrogenoformans Z-2901
MILLIDNYDSFTYNLVQYLGELGHRVVVRRNDRITLSEIREMKPTHIIISPGPCTPNEAGISLDVVRFFAGKIPILGVCLGHQVIGQAFGGKVIQDKIPVHGKTSLIYHDGQGIYKGLPNPFRATRYHSLVVEKEGLPQELIITATTAEGTIMGIRHRTWAIEGVQFHPESIMTEYGKELLLNFLEYQA

SEQ ID NO: 8122 - protein, 418 aa, Erwinia carotovora subsp. atroseptica SCRI1043
MTLLALGINHKTAPVSLRERVVFSQDKLGVALDSLLQQPLVQGGVVLSTCNRTELYLSVDEQENQREQLIRWLCEYHQLRPEEVNSSLYWHQGNAAVSHLMRVASGLDSLVLGEPQILGQVKKAFAESQRGHSLSSELERLFQKSFTVAKRVRTETDIGASAVSVAFAACTLARQIFESLADVTVLLVGAGETIELVARYLRDHNVQKMVIANRTRERAQALATEVGAEVITLAELDEQLVHADIVISSTASTLPIIGKGMMERTLKARRNQPMLMVDIAVPRDIEPEVGKLPNVYLYSVDDLHAIIQHNLAQRKAAAVQAESIVQQESSDFMAWLRAQSAVETIRDYRAQADELRAEMTAKALAAIQQGNDVEAVIQELTHRLTNRLIHAPTKSLQQAARDGDQNRLQILRDSLGLD

SEQ ID NO: 8123 - protein, 181 aa, Populus trichocarpa
MGLSFTKLLGRLFSKKEMRILMVGLDAAGKTTILYKLKLGEIVTTIPTIGFNVETVEYKNISFTVWDVGGQDKIRPLWRHYFQNTQGLIFVVDSNDRDRVGEARDELHRMLNEDELRDAVLLVFANKQDLPNAMNAAEITDKLGLHSLRQRHWYIQSTCATSGEGLYEGLDWLSNNIASKA

SEQ ID NO: 8124 - protein, 582 aa, Rhodobacter sphaeroides 2.4.1
MSDTPEQGYQVLARKYRPQTFADLIGQDAMVRTLKNAFAADRIAHAFVMTGVRGVGKTTTARIIAKGLNCVGPDGTGGPTTEPCGQCEPCRAISEGRHVDVMEMDAASRTGVGDIREIIDSVHYRAASARYKIYIIDEVHMLSTSAFNALLKTLEEPPAHVKFIFATTEIRKVPVTVLSRCQRFDLKRIEPEVMMAHLSRVAGKEGAELTRDALALITRAAEGSVRDAMSLMDQAIAHGAGETTADQVRAMLGLADRGRVLDLFDLVMKGEAAAALAELSGQYADGADPMAVLRDLAEITHWISIIKISPEAAEDPTTPPDERTRGLEMAERLPMRVLTRMWQMLLKAIEEVSLAPNAMMAAEMAVIRLTHVADLPDPEALIRRLQSEPRPGPGPGGGVQAGTQAAPAAPMARMQAAPPRAAHPAPQASGAATAVALAPGTLPCQSFEQMVELIRQKRDMKLLYEVETGVRLVRFAPGRIEFEPAPDAAPDLAARLSQRLQGWTGGRWGISVVSGGGAPTLAEERDKGRLEEEARALENPLVQAVMAAFPGARIAEIRRLEEQAAAEALPEVEDEWDPFEDN

SEQ ID NO: 8125 - protein, 447 aa, Escherichia coli
MSKQQIGVVGMAVMGRNLALNIESRGYTVSIFNRSREKTEEVIAENPGKKLVPYYTVKEFVESLETPRRILLMVKAGAGTDAAIDSLKPYLDKGDIIIDGGNTFFQDTIRRNRELSAEGFNFIGTGVSGGEEGALKGPSIMPGGQKEAYELVAPILTKIAAVAEDGEPCVTYIGTDGAGHYVKMVHNGIEYGDMQLIAEAYSLLKGGLNLSNEELAQTFTEWNNGELSSYLIDITKDIFTKKDEDGNYLVDVILDEAANKGTGKWTSQSALDLGEPLSLITESVFARYISSLKDQRVAASKVLSGPQAQPAGDKAEFIEKVRRALYLGKIVSYAQGFSQLRAASEEYNWDLNYGEIAKIFRAGCIIRAQFLQKITDAYAENPQIANLLLAPYFKQIADDYQQALRDVVAYAVQNGIPVPTFAAAVAYYDSYRAAVLPANLIQAQARL

SEQ ID NO: 8126 - protein, 197 aa, Neisseria gonorrhoeae FA 1090
MSELLDHVASCRLPTEWGVFTMHGFEEANGQEHVALTVGNCSDGNPVLTRIHSECLTGDALFSRKCDCGPQLEAAMRAVQAEGRGIIVYLRQEGRGIGLINKIRAYHLQEQGMDTVEANLALGLPVDARDFRLAQSIYEYLGIRSVKLLTNNPEKIQTLKDAGINVVERIPLHVGENLENERYLQTKADKLGHLMSE

SEQ ID NO: 8127 - protein, 367 aa, Oryza sativa Japonica Group
MEEHRLGGGGGGGGGGGRPPIPGAAGRKLPGLSRHASFVRSPANSTKSGTEKTFENMDAVAYMPVVRSGGWADIGSRHTMEDVFICSDNLMKEFGVESFEDGPSAFYGVFDGHGGKHAADFVCSNLARFIVEDEDFPREIEKALSSAFLQTDAAFADACSVNSSLASGTTALAALVVGRSLLVANAGDCRAVLCCRGKAIEMSRDHKPSCNREKVRIEASGGYVYDGYLNGQLNVARAIGDWHMEGMKACDGLGPLSAEPEVMIRNLTEEDEFLIIGCDGIWDVFRSQNAVDFARRKLQEHNDPVTCCKELVDEAIKRKSGDNLSVVVICFNSRPPPVLTTPRPRVQRSISAEGLRELQSFLDSLAD

SEQ ID NO: 8128 - protein, 366 aa, Novosphingobium aromaticivorans DSM 12444
MGFRCGIVGLPNVGKSTLFNALTETQAAQAANYPFCTIEPNVGNVGVPDPRLDKLAEIAGSQKIIPTQLGFVDIAGLVRGASKGEGLGNQFLGNIREVDAIVHVLRCFENDDIQHVDNKVDPISDAETVETELMLSDLESLEKRVPAAEKKAKAGDKESKIIASVLGQALELLRDGKPARLTQPKDDEEARVFKQAQLLTAKPVLYVCNVEEESAANGNAFSARVFEKAKAEGANAVIVSAAIESELVGMDPEERSVFLEEMGLHETGLARVIRAGYELLHLITFFTVGPKEARAWTVHLGAKAPEAAGEIHSDMQRGFIRAETIAYDDFVSLGGESAARDAGKLRQEGKEYVVKDGDVLHFKFNV

SEQ ID NO: 8129 - protein, 366 aa, Triticum aestivum
  misc_feature (110)..(110): Xaa can be any naturally occurring amino acid
  misc_feature (161)..(161): Xaa can be any naturally occurring amino acid
MESSSPSVPFPLLQAPVESTYRACTIPYRFPSDNPRKATPVEIQWIDLFLKSVPSFRQRAENDPTVPDAPAKAEKFAQRYTDMLEELKKNPESHGGPPDCILLCRLRELXLRELGFHDIFKKVKDEENAKAMSLFEGVVQRNDEIEDGEKRAENLIRGILXAGNIFDLGSAQLAEVFAKDGMSFLASCQNLLSRPWVIDDLDAFKSKWTKKSWEKAVIFVDNSGADIILGILPFARELLRRGTKVILAANDMPSINDITYLELVEIVNKLKDENGKLAGVDVSDLIVANSGNDLPVIDLSSVAPELAYMASDADLVILEGMGRGIETNLYAQMRCDSIKIGMVKHPEVAQFLGGRLYDCVFKFNEA

SEQ ID NO: 8130 - protein, 460 aa, Rhizobium leguminosarum bv. viciae 3841
MALSRRIFKVMASDRMHGKADNGDPRFEVLIVGMNGDLRGKQLPPGTEDKVWAGDIRLPTSTQSLDIWGDDNDDITGLSLTIGDPDGKVIPDRRSLAPMPWAPEGSMQVLATMHEFDGSPSFMDPRAILASVVERYAARGLTPVVATELEFYVMSGDWRETGRPCPPESLTYRGEPNGFQLYDMSAVDALDGYLQTLRAYAKAQNLPADATTAEFGPGQFEFNLLHRADALAAADDCLYLKRIAEQAARRHGLKSTCMAKPYSEHAGSGLHVHASIIDGQGRNILDAKGGEPKLIKSVISGLLDTMRAAQLIFAPFANSYRRFQPGSFAPVDLTWGSGHRGTAIRIPDKDGPAARIEHRVAGADANPYLLLAAILGGMLAGLDGELDPGEETTPSHIPANTTRLTHDFLSAVETFRTSPFIADIFGARYQALYGDTKRKEALAHLRTVSDFDYRTYLPRL

SEQ ID NO: 8131 - protein, 455 aa, Rhizobium leguminosarum bv. viciae 3841
MPDTYPPSNLAAIDAAHHLHPFADMKKLNAEGARIIQRGEGVYIFDNHGRKYLDGFAGLWCVNIGYGRREIADAATRQMNELPYYNTFFGTTSTPATLLAQKVTSHAGERFNHIFFTGSGSEANDTWFRMARVYWSAVGKSSKKIVISRKNGYHGSTVAGASLGGMKYMHEQGDLPIPGIVHIGQPYWYGEGGDLSPAEFGLKVARELEAKIDELGEENVAAFVAEPVQGAAGVIIPPETYWREIDRICKARNILLVTDEVICGFGRLGAWFGHQYFGVEPDLAPIAKGLSSGYLPIGGVLVSDRVADVLINEVGDFNHGFTYSGHPVCAAAALENLRIIEEERLVERVRDDIGPYFGKAWAALADHDLVGEAVSIGLMGGLQLAAEKSTRTRYAKPDQVGALVRNHALANGLVLRATGDRMLASPPLVISHAEVDEMARITRLALDLAWKELKP

SEQ ID NO: 8132 - protein, 506 aa, Brassica napus
MTSINVKLLYHYVITNLFNLCFFPLTAIVAGKAYRLTIDDLHHLYYSYLQHNLITIAPLFAFTVFGSVLYIATRPKPVYLVEYSCYLPPTHCRSSISKVMDIFYQVRKADPSRNGTCDDSSWLDFLRKIQERSGLGDETHGPEGLLQVPPRKTFAAAREETEQVIIGALENLFKNTNVNPKDIGILVVNSSMFNPTPSLSAMVVNTFKLRSNVRSFNLGGMGCSAGVIAIDLAKDLLHVHKNTYALVVSTENITYNIYAGDNRSMMVSNCLFRVGGAAILLSNKPGDRRRSKYELVHTVRTHTGADGKSFRCVQQGDDENGKIGVSLSKDITDVAGRTVKKNIATLGPLILPLSEKLLFFVTFMGKKLFKDKIKHYYVPDFKLAIDHFCIHAGGRAVIDVLEKNLALAPIDVEASRSTLHRFGNTSSSSIWYELAYIEAKGRMKKGNKVWQIALGSGFKCNSAVWVALNNVKASTNSPWEHCIDRYPVKIDSDSGKSETRVQNGRS

SEQ ID NO: 8133 - protein, 454 aa, Pantoea agglomerans
MVMHAFHHDLTEWSKQNQQRLARYDPVRRFGRVTGINGILIECSLPGARIGDLCRIERSGGGSVLSEIVGFSPQKILLSALGALDGISQGALITPLYLPHSICVSTRLLGSVLDGFGRGLEPGGCSAFAEPGLQRNTSPVLSDAPPPTERPRIDTPLPTGLRAIDGLLTIGNGQRVGIFAGAGCGKTTLLAELARNTPCDVIVFGLIGERGRELREFIDHELDETLGKRTVLLCATSDRSSMERARAAFTATAIAEAFRAEGKSVLLIIDSLTRFERAQREIGIALGEPPGRGGLPPSVYTLLLRLVERAGQTRQGAITALYSVLIEQDSMNDPVADEVRSLIDGHIVLSRRLAERNHYPAIDILASLSRTMSNVVDQEHLRQAGSIRSLMAAYKQVEMLIRLGEYQPGHDSLADAAVNANDVINHFLRQSMRTPEPLEQVLTQLAEVSNHAPE

SEQ ID NO: 8134 - protein, 1150 aa, Oryza sativa Japonica Group
MLLFLLFLLAAGEAAAAAAATTLTATPAKLTQSDREITIRWSGLPDPDGLDYVGIYSPPTSSDRDFLGYLFLNGSATWRTGTGELTLPRLPNLRAPYQFRLFRWPAREYSYHHIDHDGNPLPHGRHRVAASGEVAFDSPSRPDQVHLSFADGVDEMRVMFVCGDGGRRVVRYGPAKEEGEGWKEVAAEVRTYEQKHMCDSPANSSVGWRDPGFVFDGLMKGLEPGRRYFYKVGSNSSGWSDTYSFISRDNEANETIAFLFGDMGTYIPYNTYVRTQDESLSTVKWILRDIQALGDKPAFISHIGDISYARGYAWVWDHFFNQIEPIAANTPYHVCIGNHEYDWPLQPWKPWWATGIYGTDGGGECGIPYSVKFRMPGNSFVPTGNGAPDTRNLYYSFDSGVVHFVYMSTETNFVQGSDQYNFIKADLEKVNRSRTPFIVFQGHRPMYTSSNEARDFAHRQQMLQNLEPLLVTYKVTLALWGHVHRYERFCPMKNFQCVNMSSSFVYPGAPVHLVIGMGGQDYQPFWQPRKDHPDVPVYPQPERSMYRGGEFGYTKLVATKEKLTLTYIGNHDGQVHDMVEIFSGQVSNNNGVPEVIDDTKLSTGVSTKLKIPLFSLEIVGSVMFALVLVKLQITIPHCSDRLILLCMSAVRFKSQRSRFPHLHTVRTMSALYEQMSTPLNLELERLSMLNPIMSSDRSSKKVCVVGAGMAGLAAARELRREGLDVTVLEQLAGVGGQWLYDAATDAGDPLGMAGVHSSVFASLRINGPRESIGFSDFPFRPTNDAGGDARRYPVHGELLRYIRDFCDAFGLMDAVRLNTTVTRVAMAPPRRDGSLRWAVRSKRHGEAETEEVFDAVVVAIGHYSQPRLPTIDGMDRWRRKQLHSHSYRVPDSFAGEVVVIVGCSVSGAELALELRRVAKEVHLSTKSTEETITSAMSKSVARYENLHLRPQVEHLREDGTVVFDDGSFVVADAVIYCTGYNYSFPFLDTNGKVTVDDNRVGPLYEHVFPPELAPSLSFVGIPGKVVLPVFIEVQARWVAQVLSGRRTLPSPEEMQRAVEEHTRGMEAAGLPKRWTHDMFLNLERCDDYGERICGFPRMEQWKKEIFVSSLSDMVDDIENFRDGYHDSDLVRDALRRHGWTPAEEDDDAHK

SEQ ID NO: 8135 - protein, 411 aa, Oryza sativa Japonica Group
MVSDHDDGKLPAQWKKVCVVGGGMAGLAAARELRREGLDVTVLEQRGGVGGQWLYDAATDAGDPLGMAGVHSSVFASLRLNSPRESIGFSDFPFRPTNDAGGDARRYPRPRRAPQPRLPTVDGMDRWRRKQLHSHSYRVPDSFAGEVVVIVGCSVSGAELALELRRVAKEVHLSTKSTEETITSAMSKSVARYENLHLRPQVEHLREDGTVVFDDGSFVVADAIIYCTGYNYSFPFLDTNGKVTVDDNRVGPLYEHVFPPELAPSLSFVGIPAKVLLPVFIEVQARWVAQVLSGRRTLPSQEEMQRAVEEHSRGMEAAGLPKRWTHDMFLDLERCDDSGERTCGFPRMEQWKKEIFFSSLSDMVDDMESFRDGYHDSDLVRDGLRRHGWTPVAPRPQEEDDDAKAIGVANI

SEQ ID NO: 8136 - protein, 251 aa, Escherichia coli CFT073
MVDKSQETTHFGFQTVAKEQKADMVAHVFHSVASKYDVMNDLMSFGIHRLWKRFTIDCSGVRRGQTVLDLAGGTGDLTAKFSRLVGETGKVVLADINESMLKMGREKLRNIGVIGNVEYVQANAEALPFPDNTFDCITISFGLRNVTDKDKALRSMYRVLKPGGRLLVLEFSKPIIEPLSKAYDAYSFHVLPRIGSLVANDADSYRYLAESIRMHPDQDTLKTMMQDAGFESVDYYNLTAGVVALHRGYKF

SEQ ID NO: 8137 - protein, 178 aa, Leptospirillum ferrooxidans
MENAQASGQSLAPGEYAEFDTSMGKITCLLLKQSAPHAVENFVGLATGKKEFLDPQTREMVKRKFYDGLIFHRVIKNFMIQGGDPLGNGMGGPGYQFNDEIDPTRDFTKKGVLAMANAGPNTNGSQFFITVAPAPWLAGNYTIFGEVVSGQDVADAISLVPTDRRDRPVTPVVINHVR

SEQ ID NO: 8138 - protein, 771 aa, Escherichia coli CFT073
MISAERDQIGISLIFYLHIFNTKYTLRCIWYDQITLRIQETDMLYKGDTLYLDWLEDGIAELVFDAPGSVNKLDTATVASLGEAIGVLEQQSDLKGLLLRSNKAAFIVGADITEFLSLFLVPEEQLSQWLHFANSVFNRLEDLPVPTIAAVNGYALGGGCECVLATDYRLATPDLRIGLPETKLGIMPGFGGSVRMPRMLGADSALEIIAAGKDVGADQALKIGLVDGVVKAEKLVEGAMAILRQAINGDLDWKAKRQPKLEPLKLSKIEAAMSFTIAKGMVAQTAGKHYPAPITAVKTIEAAARFGREEALNLENKSFVPLAHTNEARALVGIFLNDQYVKGKAKKLTKDVETPKQAAVLGAGIMGGGIAYQSAWKGVPVVMKDINDKSLTLGMTEAAKLLNKQLERGKIDGLKLAGVISTIHPTLDYAGFDRVDVVVEAVVENPKVKKAVLAETEQKVRPDTVLASNTSTIPISELANALERPENFCGMHFFNPVHRMPLVEIIRGEKSSDETIAKVVAWASKMGKTPIVVNDCPGFFVNRVLFPYFAGFSQLLRDGADFRKIDKVMEKQFGWPMGPAYLLDVVGIDTAHHAQAVMAAGFPQRMQKDYRDAIDALFNANRFGQKNGLGFWRYKEDSKGKPKKEEDVVVDDLLAKVSQPKRDFSEEEIIARMMIPMVNEVVRCLEEGIIATPAEADMALVYGLGFPPFHGGAFRWLDTLGSAKYLDMAQQYQHLGPLYEVPEGLRNKARHNEPYYPPVEPARPVGDLKTA

SEQ ID NO: 8139 - protein, 247 aa, Oryza sativa Japonica Group
MAGKRPGDAPAGDTAAKRARTAARRQKTTVSARLRRSETKHDTYVVRVGASRVVATVTARPAVARRWVFSTRWRHGRRLRSGAGLTVAMGVQWTPPSRALAGGAEPRPGTLQLCVGSRCLVFQVAQGNAFPAALRRFLADGGVAAFVGYGIRSDCRKLAAHHGLHVACTRELRAVTGMGSSSMARMAEELLGLAGIKKPAAVGRSRWDAPKLSKKQVKYACVDAFLSHRLGVHVGAAPPSTSSSDSA

SEQ ID NO: 8140 - protein, 480 aa, Salmonella enterica subsp. arizonae serovar 62:z4,z23:--
MSRRLRRTKIVTTLGPATDRDNNLEKVIAAGANVVRMNFSHGSPEDHKMRADKVREIAAKLGRHVAILGDLQGPKIRVSTFKEGKVFLNIGDKFLLDANLGKGEGDKEKVGIDYKGLPADVVPGDILLLDDGRVQLKVLEVQGMKVFTEVTVGGPLSNNKGINKLGGGLSAEALTEKDKADIRTAALIGVDYLAVSFPRCGEDLNYARRLARDAGCDAKIVAKVERAEAVCDQNAMDDIILASDVVMVARGDLGVEIGDPELVGIQKALIRRARQLNRAVITATQMMESMITNPMPTRAEVMDVANAVLDGTDAVMLSAETAAGQYPSETVAAMARVCLGAEKIPSINVSKHRLDVQFDNVEEAIAMSAMYAANHLKGVTAIITMTESGRTALMTSRISSGLPIFAMSRHERTLNLTALYRGVTPVHFDSAADGVVAAHEAVNLLRDKGYLVSGDLVIVTQGDVMSTIGSTNTTRILTVE

SEQ ID NO: 8141 - protein, 93 aa, Triticum aestivum
MASGQQERSQLDRKAREGETVVPGGTGGKSLEAHENLAEGRSRGGQTRREQMGEEGYSEMGRKGGLSTNDESGGERAAREGIDIDESKFKTKS

SEQ ID NO: 8142 - protein, 243 aa, Moritella sp. PE36
MFEFPKYSIASVKNDVLSGLTVALALVPEAIAFAFVAGVEPLVGLYAAFMVGLITAVFGGRPGMISGATGAMAVVMVSLVADNGVQYLFAAVVLAGLLQVLAGIFKLGKFIRIVPHPVMMGFVNGLAIVIFLAQLGQFKFTDSNGNLAWLQDTQLFIMLGLVALTMAIIHFLPKLTKAVPSSLVAIVTVTLIVYYMGLDTRTVVDFVRSMTGDDNATIFCSLRHSVLQVCHLPRNTLCHLTTH

SEQ ID NO: 8143 - protein, 491 aa, Salmonella enterica subsp. arizonae serovar 62:z4,z23:--
MAVTQTAQACDLVIFGAKGDLARRKLLPSLYQLEKAGQIHPDTRIIGVGRADWDKEAYTHVVREALETFMKEKIDEGLWDTLSGRLDFCNLDVNDTPAFSRLGDMLDQKNRTTINYFAMPPSTFGAICKGLGEAKLNAKPARVVMEKPLGTSLATSREINDRVGEYFEECQVYRIDHYLGKETVLNLLALRFANSLFVNNWDNRTIDHVEITVAEEVGIEGRWGYFDQAGQMRDMIQNHLLQILCMIAMSPPSDLSADSIRDEKVKVLKSLRRIDRSNVREKTVRGQYTAGFAQGKKVPGYLEEEGANKSSNTETFVAIRVDIDNWRWAGVPFYLRTGKRLPTKCSEVVVYFKTPELNLFKESWQDLPQNKLTIRLQPDEGVDIQVLNKVPGLDHKHNLQITKLDLSYSETFNQTHLADAYERLLLETMRGIQALFVRRDEVEEAWKWVDSITEAWAMDNDAPKPYQAGTWGPVASVAMITRDGRSWNEFE

SEQ ID NO: 8144 - protein, 93 aa, Triticum aestivum
MASGQQERSELDRMAREGETVVPGGTGGKSLEAQEHLADGRSRGGETRKEQLGEEGYREMGRKGGLSTMEESGGERAAREGIEIDESKFKTKS

SEQ ID NO: 8145 - protein, 213 aa, Wigglesworthia glossinidia endosymbiont of Glossina brevipalpis
MNKKLLSEFGDPVQRVKNALQSLKRGNGILVLDDENRENEGDMIFAAENMTVNQMALAIRFGSGIVCICLTKEKCKILNLPMMVKKNNSKYKTAFTVSIESAYGITTGVSAYDRIITIKTAIKDNAKPDDLNRPGHVFPLQAHPGGILSRAGHTEAAVDLTKLAGLKPAGVICEVMNDDGSMARMPEIINFSKKYNMPVLIIKDIIEYYNFIN

SEQ ID NO: 8146 - protein, 748 aa, Erwinia carotovora subsp. atroseptica SCRI1043
MLTRLREIVENVAATARLSDALDILVNETCQAMDTEVCSIYLADHDRQCYYLMATRGLKKPRGRTVTLAFGQGIVGLVGQRAEPINLADARTHPSFKYIPAVKEQHFRSFLGVPIIYRRHLLGVLVVQQREHRQFDKNEESFMVTLATQMAAILSLSQIKTLFGQYRQTRVKALVAAPGVAIAPGWQDCTQPSLEQVFPASSLDSERERSRLTQALEEATAEFRRFSKRFSASAQKESAAIFDLYSHLLNDARLKRELFQEVDAGNAAEWAVKLVIERFAAQFTNLQDTYLRERAGDLRALGQRLLFHLDDNAQIMGQWPERFILVADELTATLLAELPPERLAGVVVYDGAANSHAAILVRAMGIPTLVGADIQPELLHQRQLIIDGYRGELLVDPEPVLVQEYQRLLTEENELTRLAEGEMEQPAVLKSGERIQVMLNAGLSADHEKRFINQVDGVGLYRTEIPFMLQSGFPSEDEQMAQYQSMLDLYPTRPVMLRTLDIGADKPLPYLPISEENPCLGWRGIRITLDQPEIFLIQVRAMLRANAHIGNLNILLPMISSLDEISEARRLIDQAAGEVEELLGFPQPKPRIGIMIEVPSMLFLLPQLASRIDFVSVGTNDLTQYLLAVDRNNAHVASLYDSLHPSMLQALNMIAVECERHNIPLSVCGEMAGEALGALLLTGLGYRSLSMNGRSVARIKYLLRQITLAESQALVKQLLSAQSSTEVRQWAAIFMEEHGLGGLIRGGR

SEQ ID NO: 8147 - protein, 518 aa, Bacillus sp. SG-1
MSILTVKNLSHGFGDRAIFNDVSFRLLKGEHIGLIGANGEGKSTFMNIITRKLEPDEGKVEWAKRVRVGYLDQHTSLEKGMTIRDVLKTAFQYLFDMETEMNDLFAKMGEASPEELEKLLEETGTLQDALTNNDFYVIDAKVEEIARGLGLDDIGLEREVQDLSGGQRTKVLLAKLLLEKPDILLLDEPTNYLDEQHIVWLRRYLQEYENAFILISHDIPFLNSVINLIYHMENQELTRYAGDYDDFKKVYEMKRQQLESAYKKQQQEISELKDFVARNKARVSTRNMAMSRQKKLDKMDIIELAGEKPKPEFHFKPARTSGKLIFETKDLVIGYDEPLSKPLNLRMERGQKIALYGANGIGKTTLLRSILGEIKPVSGEVELGEHLHIGYFEQEIKNANYNTCIEEVWTEFPSFTQYEVRASLAKCGLMTKHIESKVEVLSGGEKAKVRLCKLINKETNLLVFDEPTNHLDVEAKAELKRALQEYKGSILLISHEPEFYQDIATDLWNCESWTTKVF

SEQ ID NO: 8148 - protein, 362 aa, Neisseria meningitidis MC58
MSQTIDELLLPHRNAIDTIDAEILRLLNERAQHAHAIGELKGTGAVYRPEREVAVLRRIQDLNKGPLPDESVARLFREVMSECLAVERPLTIAYLGPQGTFTQQAAIKHFGHAAHTMACPTIDDCFKQVETRQADYLVAPVENSTEGSVGRTLDLLAVTALQACGEIVLRIHHNLLRKNNGSTEGIAKVFSHAQALAQCNDWLGRHLPNAERIAVSSNAEAARLVAESDDGTVAAIAGRTAAEIYGLDMVAECIEDEPNNTTRFLVMGHHETGASGSDKTSLAVSAPNRAGAVASLLQPLTESGISMTKFESRPSKSVLWEYLFFIDIEGHRRDAQIQTALERLGERASFVKVIGSYPTAVL

SEQ ID NO: 8149 - protein, 370 aa, Rhodococcus rhodochrous
MMKTQAAILWERGGPWSVEEIDLDPPRHGEVLVEMGGSGLCHSDEHVLTGDLPWPLPMVGGHEGAGTVVEVGPGVEGLAAGDRVIFGFLPACGRCAACSAGMQNLCELGQYLGDGTQISDHTSRHHARGQDLGLMCLLGTFAQHTVVSEANCIKIDDDIALDKACLLGCGVVTGWGSAVFTGGVKPGDTSVVVGVGGIGINAVQGAAMNGSQYVVAVDPVEFKRTKALELGATHAVATSEEAQALVADLTYGRGANVVVNTTGVGEGDQIGASLAMTAKRGTVVVTNLHRATEETVKMSALDLVLMEKRVVGSLFGSANPRLHIPKMLGLYRSGHLKLDELATRSYKLDEVNTGYQDMREGRNLRGVITF

SEQ ID NO: 8150 - protein, 482 aa, Rhodococcus rhodochrous
MSMQYDSLFIGGDWIAPSSSKRITAISASTEQPIGSVPEAQEADVDAAVAAARRALDDPAGWAHWAPAARAAAIERLADVLERRAEDVVQCVSAQNGMPVAVARQLEGVFPVVLLRYYAGLARDTATEETRPGLFGGSTLVCREPLGVVGAIVPWNFPQTLAAFKYAPALAAGCTLVIKPSPETVLDAFVFAEAVAEAGIPAGVVNVVPGGREVGAYLVEHPGVDKISFTGSTAAGRSIGEVCGRLLRPVTLELGGKSAAIVLDDAGLDLQTMSEKLFAATLLNNGQTCFLGTRVLAPRSRYSEIVDLFTDLAGTLKVGDALDDTTQIGPMATAAQRDRVEQYIAKGLGDGARITIGGGRPADQDKGWFVEPTIFADVENNHTIAQEEIFGPVLSVIPYSDEDEAVRIANDSDFGLGGTVWTNDPDRGLALAKRVQTGTIGINGYLPEPTAPFGGVKASGLGRELGPEALSNYQQLKSIYLD

SEQ ID NO: 8151 - protein, 358 aa, Chromobacterium violaceum ATCC 12472
MSSMKATVFVGPGRIELREKPIPAVGPGDALVKITTTTICGTDVHILKGEYPVASGLTIGHEPVGVIEKLGADVKGYREGQRVIAGAICPSFTSYGCQDGHPAQDGGCECHGYKPMGGWRFGNTIDGTQAEYVLVPDAQANLAPIPDGLSDEQVLMCPDIMSTGFAGAEAANIRIGDVVVVFAQGPIGLCAVAGARLRGASCIIAVDGLDERLGISRRLGADVTLNFKQVDVIAEIMKLTGGRGVDASIEALGTQGTFESALRVLKPGGTLSSLGVYSSDLRIPLDAFNAGLGDKRIVSSLCPGGKERMRRLMNVLESDRLDLSPLVTHRYKLDQIVEAYDLFSHQRDGVLKVAIQPF

SEQ ID NO: 8152 - protein, 479 aa, Triticum monococcum
MEDVAVAALATAPTPVFSPATAGLTLIAAAAAEPIAAVVAGAMEGVPVTFSVPPVRTTTDDGLPAATGGEGGEASAAGSPCSVTSDCSSVASADFEGVGLGFFGAGVEGGAVVFEDSAASAATVEAEARVAAGGRSVFAVECVPLWGFTSICGRRPEMEDAVIAVPRFFGLPLWMLTGNNMVDGLDPISFRLPAHFFGVYDGHGGAQVADYCRDRLHAALVEELSRIEGSVSGANLGAVEFKKQWEKAFVDCFSRVDDEIAGKVTRGGGGNVGTSSVTAMGMVDPVAPETVGSTAVVAVICSSHIIVSNCGDSRAVLCRGKQPVPLSVDHKPNREDEYARIEAEGGKVIQWNGYRVFGVLAMSRSIGDRYLKPWIIPVPEVTIVPRAKDDECLILASDGLWDVLSNEEVCDVARKRILLWHKKNGVNLSSAQRSGDSPDPAAQAAAECLSKLALQKGSKDNITVIVVDLKAQRKFKSKT

SEQ ID NO: 8153 - protein, 421 aa, Thermococcus kodakarensis KOD1
MVEIDPFEMAVQQLERAAQFMDISEEALEWLKRPMRIVEVSVPVEMDDGSVKVFTGFRVQHNWARGPTKGGIRWHPAETLSTVKALATWMTWKVAVVDLPYGGGKGGIIVDPKKLSEREQERLARSYIRAVYDVIGPCTDIPAPDVYTNPKIMAWMMDEYETIMRRKGPAFGVITGKPPGVGGIVARMDATARGAAFTIREAAKALGWDDLKGKTIAIQGYGNAGYYLHKIMSEEFGMKVVAVSDSKGGIYNPDGLPPADEVLKWKKEHGSVKDMPGTQNITNEELLELEVDILAPSAIEGVITKENADNVKAKIVAEVANGPVTPEADEILHEKGILQIPDFLCNTGGVTVSYFEWVQNINGFYWTVEETRKRLDDKMTKAFWDVFNTHKEKNIHMRDAAYVVAVSRVYEAMKHRGWVKK

SEQ ID NO: 8154 - protein, 406 aa, Oryza sativa Japonica Group
MDAAATRVSTRLRRSTQTHAAYTVHVADRRVIALVTAHPAYARRWVHTTRWLHHRLLRSGRLLVGLGVQWTPLRRPLHRGSPPPPPATLQLCVGHRCLVFHLAHADAIPAALRRFLADPRITFVGSGASNDRRMLSAYYDLHVASARELRAVAAMGNASMEAMADRFLGYPGIAKPTNVSMSAWHAPYLSIEQTHWALVATAVDDDASESEYSSKITDNVRPRVAASDSDIEEEDDDGLSMIHSSSYASDDHVFSSDDFELVGHGLLSSDDEDGYEDFVLGMGALNIDIDDDDDYNGNTGSIGILTVQSYNEHSSIGILTVENYDMAGTEEMFVRNGVATLEELEEDDIVTGAGTVTVDEGGGGYEAFEGNSQAFDDVEEGGYVEDDWYDEDEEELLDYDTSGGFY

SEQ ID NO: 8155 - protein, 467 aa, Vitis vinifera
MGVANNIGKYQLSRTIGEGTFAKVKLAVNTENGQYVAIKIIDKHMVMENNLIFQVQREIRTMKLLHHPNIVRIHEVIGTKTKIYIVMEYVSGGQLSDKMSYVKKLDEQDARKHFQQLIDAVDYCHGRGVSHRDLKPENLLLDSKGNVKVSDFGLSALRKPGDVLSTACGSPCYVAPELLANRGYDGAAADIWSCGVILFELLAGYLPFDDRNLMSLYKKITKAEYTCPEWFTPSQTKLISRILEPNPRRRISIAEIVEDEWFQIDYEPASGIEFDDKINLDDVHAAFNLIEENNAEAKVPHSSFINAFQLIAMSHDLDLSGLFEEKDDNKQKARFGSKHTIDETIKKIEAAAKDVSLSVERKNSKMKMHPQQKMTRCSRSYFNLSAEVIEVAPTHCVVEISKSAGELGVYKEFCTSLSCLLKEKSGIPLEEKDSNEDVVNIKDIQETECSEKKDDKDDKDINGYSSS

SEQ ID NO: 8156 - protein, 499 aa, Saccharomyces cerevisiae YJM789
MGGEDEILSTMEDFAAVYDVLVIGCGPGGFTAAMQASQAGLLTACVDQRASLGGAYLVDGAVPSKTLLYESYLYRLLQQQELIEQRGTRLFPAKFDMQAAQSALKHNIEELGNVYKRELSKNNVTVYKGTAAFKDPHHVEIAQRGMKPFIVEAKYIVVATGSAVIQCPGVAIDNDKIISSDKALSLDYIPSRFTIMGGGTIGLEIACIFNNLGSRVTIVESQSEICQNMDNELASATKTLLQCQGIAFLLDTRVQLAEADAAGQLNITLLNKVSKKTYVHHCDVLMVSIGRRPLLKGLDISSIGLDERDFVENVDVQTQSLLKYPHIKPIGDVTLGPMLALKAEEQAIRAIQSIGCTGSDGTSNCGFPPNVLYCQTQIGWVGYTEEGLAKARIPYQKGRVLFSQNVRYNTLLPREENTTVSPFIKVLIDSRDMKILGVHMINDDANELLSQASMAVSLGLTAHDVCKVPFPHPSLSESFKQAVQLAMANGTSPGVHVRE

SEQ ID NO: 8157 - protein, 540 aa, Geosiphon pyriformis
MNPETSDKNEPIISSQPAADDDDDNNNTEVKEKQDTKPTLDISTVGKNPDSKTAALPTFCLFVALVSVIGAFENGWNTSVSNVPEKIIRDCKNGQKHVNIGVLPDCLPMENLLWGFAVGSYAIGGLIGGISAGYLQTRFGRIRTLVGNNFSFILGALILGSAVNPGMFIIGRILTGVGSGISTVTVPTYLGEIATVKARGALGTIYQLFLVIGILFTQIIGLLLSSVPGWRILLALTAIPALIQLILLRFCVETPRYLISQNKLDEAQQSLQLLRPGFDVTNEYKEIYDGQQEAETVESRDPEKNPKTKDPKAISSGARKSLSFAQLFRDPMCRKMTIICVTLSVIQQLSGINGVIFYSTSIFSEVFADNAKYATVGVGVINLIFTMVSVILIDRQGRKRLLLASEIGIVVTSILVVLGSIYSINLLVVVAVLLFVSSFAIGLGPIPFLIIPELLPTYGVSAAASLAMGLNWLSNFLVGLIFPVLKDALKNYTFLVFAIITSFGAIFTLLFVPETKGRTLEEIHNENSKDTKNLDSQMKS

SEQ ID NO: 8158 - protein, 540 aa, Geosiphon pyriformis
MNPETSDKNEPIISSQPAANDDDDNNNTEVKEKQDTKPTLDISTVGKNPDSKTAALPTFCLFVALVSVIGAFENGWNTSVSNVPEKIIRDCKNGQKHVNIGVLPDCLPMENLLWGFAVGSYAIGGLIGGISAGYLQTRFGRIRTLVGNNFSFILGALILGSAVNPGMFIIGRILTGVGSGISTVTVPTYLGEIATVKARGALGTIYQLFLVIGILFTQIIGLLLSSVPGWRILLALTAIPALIQLILLRFCVETPRYLISQNKLDEAQQSLQLLRPGFDVTNEYKEIYDGQQEAETVESRDPEKNPKTKDPKAISSGARKSLSFAQLFRDPMCRKMTIICVTLSAIQQLSGINGVIFYSTSIFSEVFADNAKYATVGVGVINLIFTMVSVILIDRQGRKRLLLASEIGIVVTSILVVLGSIYSINLLVVVAVLLFVSSFAIGLGPIPFLIIPELLPTYGVSAAASLAMGLNWLSNFLVGLIFPVLKDALKNYTFLVFAIITSFGAIFTLLFVPETKGRTLEEIHNENSKDTKNLDSQMKS

SEQ ID NO: 8159 - protein, 287 aa, Bordetella pertussis Tohama I
MNSQPSVIAPACEADAERRFGGLARLYGPDAPAALRGAHVAVAGLGGVGSWTAEALARCGVGALTLIDLDHIAESNVNRQIHALSDTLGQAKIEAMAQRIGQINPACAVTRVDEFVAPDNVMQVLGGPYAAIVDCTDQAAAKIAMILHARQRGVPLLLCGGAGGKTDPLALRAGDLSEAVNDALLAKLRNKLRREHGFPRASDANGKVRKRVPRMGVRALWFDQPAILPDAWTRAVEGEDDMGAAGTRAAPQGLSCAGYGSVVTVTAAMGLAAANEVLRWVVGKPGA

SEQ ID NO: 8160 - protein, 404 aa, Leptospirillum ferrooxidans
MDDLIYLDNNSTTRVDPRVLEAMIPYFTQDFGNAHSRNHPFGWKAEEAIDKARGEVAALIGADPKEIVFTSGMTESDNLAIKGVAEMYKEKGRHIIVLETDIRSILDPAITLSRAGYEVTTLPVNKEGRVEIETLKKAIRPDTILVSMMASNHEIGTIQPLAEIGAITKEKGILFHVNGAYAASTVPLDVNRMNIDLLSLNAHLIYGPKGVGALYVRRKNPRVKLTPMIDGGGHERGLRSGTLNTPGIVGMGAACRILKESWDKEIPRLKALRDRLEDGIMKELDYVVINGDKDHRAPNVTNLSFAYVEGEALLMGLKEIALSSGSACTSSTLEPSYILRALGVGSDLAHSSIRFSLGRFNTEEEITTTIRRVKEAVSRLRDMSPLYEMAKEGIDIKSVQWSSH

SEQ ID NO: 8161 - protein, 821 aa, Pyrococcus horikoshii OT3
MDKMAYKFIKWFEELRKDDVPLVGGKGANLGEMTNAGIPVPPGFCVTAEAYKYFVENVKVSKEDVKKILGEKANKGTIAEVLASAPDEPRTLQEWIMDIINRTNVDDSKQLQENTAIIRELIESLEMPNEIADEIKQAYKELSQRFGKDEIYVAVRSSATAEDLPEASFAGQQETYLDVLGADDVIDKVKKCWASLWTARATFYRAKQGFDHSKVYLSAVVQKMVNSEKSGVMFTANPVTNNRNEIMINASWGLGEAVVSGAVTPDEYIVEKGTWKIKEKVIAKKEVMVIRNPETGKGTVQVKVAEYLGPEWVEKQVLTDEQIIEVAKMGQKIEEHYGWPQDIEWAYDKDDGKLYIVQSRPITTLKETTTEEVEEVEEAEVILKGLGASPGIGAGRVVVIFDASEIDKVKEGDVLVTTMTNPDMVPAMKRASAIITDEGGRTSHAAIVSRELGIPAVVGTKEATKKLKTGDYVTVDGTRGLVYKGIVKSLVEKKKKEEAAAAPGAAVAAAPLVTGTLVKVNVSMPEVAERAAATGADGVGLLRAEHMILSIGQHPVKFIKEGKEDELVERLAEGIEKVAAAFYPRPVWYRTLDAPTNEFREMPGGEDEPEERNPMLGWRGIRRGLDQPELLRAEFKAIKKVVEKGYNNIGVMLPLVSHPEQIRKAKEIAREVGLEPHKDVAWGIMIEVPAAAIIIEDLIKEGIDFVSFGTNDLTQYTLAIDRDNERVAKLYDETHPAVLKLIKHVIKVCKKYGVETSICGQAGSDPKMARILVRLGIDSISANPDAVQLIRQVVAQEERKLMLEAARKKLLEEEEEEEDLF

SEQ ID NO: 8162 - protein, 199 aa, Escherichia coli CFT073
MMSAPDIRHLPSDTGIEVAFAGRSNAGKSSALNTLTNQKSLARTSKTPGRTQLINLFEVADGKRLVDLPGYGYAEVPEEMKRKWQRALGEYLEKRQSLQGLVVLMDIRHPLKDLDQQMIEWAVDSNIAVLVLLTKADKLASGARKAQLNMVREAVLAFNGDVQVETFSSLKKQGVDKLRQKLDTWFSEMQPVEETQDGE

SEQ ID NO: 8163 - protein, 200 aa, delta proteobacterium MLMS-1
MSLIPFVIEQTPRGERSYDIYSRLLKERIIFLGTGVNDEVANVVIAQMLFLEADDPDKDITFYINSPGGSVTAGLAIYDTMRYVKCDIATLCLGQAASMGAVLLAAGTKGKRYALPNARILIHQPMGGFQGQASDIDIHAREILRMRQGLNKMLADHTGQKLKKIQTDTERDYFMSSEEAKTYGLIDKVLLERTTASEDD

SEQ ID NO: 8164 - protein, 372 aa, Zea mays
MLPTWPPAPPEVAIRIQIAAAATPRAEEPDRTRPRRRLPDLRSLLRAKCSIRAEMAAAWAVLALFLVAAQVAAAAPVTAPAFLWAPKNYGFSSDDAKEVVHYQTISPKSLAKSVLEEGGWSNFMCSREDTQNNVDVAIVFIGSKLQSSDISKDKQVDPALADTLKLSFTRSEFSMAFPYVSTTVDERLEDSLLSSFAENCNNGFGRNRVTYTDTCTGQDLKKYHNMDAINDLVVSGVASRRVNHPSGQTDVIVFCSGGFENPGTAKSEGELLSQLVDLLDLSGAKYTVLYASQPSGLLESPSGLPLGRHLAEKKTNGTKAVQGEKCDGECLVKSSLLEGTFVGIVLLIILISGLMCMMGIDTPSRFEAPQES

SEQ ID NO: 8165 - protein, 198 aa, Triticum aestivum
MDKGVEKARVPPPSKLYTYIGTAMAPTVMASSATSVAPFQGLKSTAALPVSRRSNGASLGSVSNGEGIRCMQVWPIEGIKKFETLSYLPPLSTEALLKQVDYLIRSKWVPCLEFSKVGFIFREHNTSPGYYDGRYWTMWKLPMFGCTDATQVINEVEEVKKEYPDAYVRIIGFDNMRQVQCVSFIAFTPPGCEESGKA

SEQ ID NO: 8166 - protein, 306 aa, Bacillus sp. SG-1
MKILVTGGNGFIGSYVVNSLVEGGYKVVIVDSSIGNKNSINKKVKCYQLNITDKNLSNVFDKERPDAVIHMAAQVDVSRSVMEPIMDAEVNILGTINVLNECVKYKVKKVVYSSTSAVYGENVASEISENEKIMPISFYGISKYTPELYLEAFFKIHGLKYTILRYSNVYGERQGIKGEGGVIPIFIHELMEDRSPVIFGDGKQTRDFIYAGDVAEANVSALNAADMEVLNISSGISITILQLFEQIRDLMGKAVTPNFRGGRSGDILHSRLANSKAIMMLSWEPKVNLPEGLRKTIDYYKEIKLQ

SEQ ID NO: 8167 - protein, 334 aa, Escherichia coli K12
MSGFYHKHFLKLLDFTPAELNSLLQLAAKLKADKKSGKEEAKLTGKNIALIFEKDSTRTRCSFEVAAYDQGARVTYLGPSGSQIGHKESIKDTARVLGRMYDGIQYRGYGQEIVETLAEYASVPVWNGLTNEFHPTQLLADLLTMQEHLPGKAFNEMTLVYAGDARNNMGNSMLEAAALTGLDLRLVAPQACWPEAALVTECRALAQQNGGNITLTEDVAKGVEGADFIYTDVWVSMGEAKEKWAERIALLREYQVNSKMMQLTGNPEVKFLHCLPAFHDDQTTLGKKMAEEFGLHGGMEVTDEVFESAASIVFDQAENRMHTIKAVMVATLSK

SEQ ID NO: 8168 - protein, 87 aa, Triticum aestivum
  misc_feature (75)..(75): Xaa can be any naturally occurring amino acid
TCKFPLTCRYCADLPHGVLELHSRGIFVRNLQSCNFLLDDNDHAVLGIWVTSLLFGLSLPNPDLIQRLGTPNYMXPEHWRPNIRGPI

SEQ ID NO: 8169 - protein, 267 aa, Clostridium tetani E88
MKIYVNEIFLNVEEDIDVFKLKNKIKKDADIVIYNGFPINNNIVLKPLDRIVFIKRGEMPTKEEMEIQLVARHTPKVYEELRKASVAIAGLGGLGSTAALSLARIGIGKLILVDYDVVEPSNLNRQQYFIKHIGMKKTEAIKDIISQCNPFVDIQTIDAYVDEKNMENIFKDADIIIEAFDNAETKALITNTVLTTMKDKKIITASGLAGYEDCNLIRSKKINDRFYIVGDGQAEAKSGRGLMTPRVSVAANHQANLVLELILKENI

SEQ ID NO: 8170 - protein, 388 aa, Vigna radiata var. radiata
YFDGWKAYDENPYDELTNSSGVIQMGLAENQVSFDLLEKYLEEHPEASTWGSGFRENALFQDYHGLRSFRTAMASFMEQIRGGRAKFDPDRVVLTAGATAANELLTFILANPGDALLVPTPYYPGFDRDLRWRTGVNIVPIHCDSSNNFQITPQALEAAYNEAEDDNTKVRGVLITNPSNPLGATVQRSILEYLLDFVTEKNIHLVSDEIYSGSVFSSSEFVSVAEILEARQYKEAERVHIVYSLSKDLGLPGFRVGTIYSYNDSVVTTARRMSSFTLISSQTQHLLACMLSDKKFTENYIGTNRERLRKRYQMIIEGLRSVGIECLKGNAGLFCWMNLSPLLEKPNKEGELELWNAFLHEVKLNISPGSSCRCSEPGWFRVCFANMD

SEQ ID NO: 8171 - protein, 584 aa, Novosphingobium aromaticivorans DSM 12444
MYSFALNRRTLIRSAALGGGGLALSAVLPAWARSGTSGLGVPMAEVSGEQIALSIGHASLRVGGRDGHAIGINGATPGPVIRLKEGQKVRLAVNNTLKEETSIHWHGLLVPFQMDGVPGVSFPGIKAGQTFVYEFPVRQSGTYWYHSHSGMQEAMGMYGAIVIDPAAPDPIAYDREHVIMLADWSFMHPHTQLRKLKAQPGYFNLQKQTLSGLLAGKDQSASERRMWAGMRMDPTDISDVTGATYHFMVNGHDSAANWTGLFAPGERVRLRIINAAAMTNFNVRIPGLAMTVVAADGQNVQPVETDEFQIGIAETYDVIVVPRADEAYGFIAEAIDRSGQVRATLAPRLGMVAPIPAIRERPLLSMQDMGMGDMAAPGADASATDHAAMGHAMPGMDHGSMKMRDPAVAPQVKMGPGVATLSPMPMDRTGERPTGLEKVDHRVLTYRDLKALPPNADKRTPSREIDIHLTANMERYMWSFDGVKFSENTEPIAFRHMERVRVNLINDTMMPHPIHLHGHFFELVTGNPGHHPLKHTVNVLPGGKVSFDLTADELGDWAFHCHMLLHMMSGMFRVVTVRHEEDAA

SEQ ID NO: 8172 - protein, 360 aa, Physcomitrella patens subsp. patens
MNCSGASGKIIPEKVRIGINGFGRFGRLVARVALERNDIELVAVNDPFISTDYMAHMFKYDTVHGRMTEADIYAEDEQTFSFSGKKVAILGFKELSEIPWGEHGVDFVVECTGNYSMKDQAAEHLKGGAKKVIITGFSKDAPMFVVGVNECDYRSEYNVVSMASSTTNCLTPLVKVLNDKFGVVEGVMTTVHSLTATEKLLDRPSRKDLRDGCANIIASTTSATKAIGRLIPRMNGKIKGMAFRVPTADASLIDVAFKLDQCVSYEQVCEAIKEEAEGSLKGILGYTEEDAASTDFIGDSRSCILDAKAGLSLGNGYFKLMAWFDNEWGYSHRVVEFIIHMALMQRTPSHFQTHHARESQ

SEQ ID NO: 8173 - protein, 127 aa, Leptospirillum ferrooxidans
MAYSDKVIDHYNNPRNMGSFDKSDENVGTGIVGAPECGDVMKLQLKINDDGIIEEAKFKTFGCGSAIASSSLATEWVKGKTIDEALKIKNTDIVQELNLPPVKIHCSVLAEDAIKGAIQDYQEKKNR

SEQ ID NO: 8174 - protein, 92 aa, Daucus carota
MASQQEKKELDARARQGETVVPGGTGGKSLEAQQHLAEGRSKGGQTRKEQLGGEGYHEMGRKGGLSNNDMSGGERAEQEGIDIDESKFRTKK

SEQ ID NO: 8175 - protein, 497 aa, Lactococcus lactis subsp. lactis
MENKKTKGISLFALLAIIISGAIGGGVFNLANDLARGSTPGGVVISWLFIGFGILMLVLSFNRLITIKPDLSGVSDYARAGFGDFVGFLSGWGYWISAWTGTIGFAVLMMTSADYFFPSKFANSNGSLTILSVIIVSIISWILMLLVDRGVETAAAVNAIVMIAKLIPLVVFSITGIILFKANVFTQHFWQTFTTNFAADGSVKDFVWHATTVSGLSSQIKGSLMVMVWVFVGIEGATMMGNRAKKKSDTAKTTVIGLAVLLVIYVLLSLLPYGYMDQASLANVKAPGLVYILNEMVGGWGGSLMAVGLMISLLGAWLSWTMLPVEATQQLAEQKLLPSWFGKLNKYHAPSNSLLITQLMIQIFIIITYFVANAYNVFIYMATAVIMICYALVGAYLFKIGLKEASVKNILIGFFTFAFQALALYLSGWQYVWLAMILYTIGFLLFIGAKKESHQSISVKEWLGMLVVTVLGVLASVVLICGAKAGTAFDLRGLLGF

SEQ ID NO: 8176 - protein, 362 aa, Photobacterium sp. SKA34
MAGSYNIAVLPGDGIGPEVMQQAHKVLNAIETKFNLTFNRTEYDVGGIAIDNHGCPLPDATLKGCEQSDAVLFGSVGGPKWEHLAPNDQPERGALLPLRKHFQLFCNLRPAQIHRGLEKFSPLRTDISERGFDIAVVRELTGGIYFGQPKGREGEGAQEKAFDTEVYYRYEIERIAKIAFESARLRSKKVCSIDKANVLQSSILWREVVEEIAKDYPDVTLTHMYIDNATMQLIKDPSQFDVMLCSNIFGDIISDECAMITGSMGMLPSASLNQDKFGMYEPAGGSAPDIAGKNIANPVAQILSAALMLRYSLGEETAARAIEQAVSQALEAGELTADLASDKPALTTSEMGDKIAAYIQQA

SEQ ID NO: 8177 - protein, 436 aa, Neocallimastix frontalis [sequence omitted]

SEQ ID NO: 8178 - protein, 187 aa, Bordetella pertussis Tohama I
MLLMIDNYDSFTYNLVQYFGELGEEVRVARNDQITLDEIAAMRPDRICVSPGPCSPAEAGISVPVIQAFAGKLPILGVCLGHQAIGAAYGGDIVRAQQIMHGKTIAITHTGTDIFTGLPSPCTVIRYNSLTIDPATLPDCLEVTATAPDGDIMGVRHKTLPLYGVQFHPESVLSEHGHALMRNFLTR

SEQ ID NO: 8179 - protein, 445 aa, Ricinus communis
MAITIVSVRARQIFDSRGNPTVEADIKLSDGHLARAAVPSGASTGIYEALELRDGGSDYLGKGVSKAVENVNSIIGPALIGKDPTEQTALDNFMVQELDGTVNEWGWCKQKLGANAILAVSLALCKAGAHVKGIPLYKHIANLAGNKNLVLPVPAFNVINGGSHAGNKLAMQEFMILPVGASSFKEAMKMGAEVYHHLKSVIKKKYGQDATNVGDEGGFAPNIQENKEGLELLKTAIAKAGYTGKVVIGMDVAASEFYGSDKTYDLNFKEENNDGSQKISGEALKDLYKSFASEYPIVSIEDPFDQDDWEHYSKLTSEIGEKVQIVGDDLLVTNPKRVEKAIQEKACNALLLKVNQIGSVTESIEAVRMSKRAGWGVMASHRSGETEDTFIADLSVGLATGQIKTGAPCRSERLAKYNQLLRIEEELGAEAVYAGAKFRTPVEPY

SEQ ID NO: 8180 - protein, 245 aa, Bordetella pertussis Tohama I
MHIMPPEIANTMSTQPASTRIAPSILSADFARLGEEVRNVVAAGADWIHFDVMDNHYVPNLTIGPMVCAAIRPHVQVPIDVHLMVEPVDEIVPQFAKAGANVITFHPEASRHVDRTLALIRDHGCKAGLVFNPATPLHYMDYVMDKLDVVLLMSVNPGFGGQAFIPATLAKLRDARARIDRWRAAGGQPILLEVDGGVKVDNIAEIRAAGADTFVAGSAIFGKPDYAQVIGQLRAEIARGETIAV

SEQ ID NO: 8181 - protein, 280 aa, Chlorobaculum tepidum
  misc_feature (98)..(98): Xaa can be any naturally occurring amino acid
  misc_feature (131)..(131): Xaa can be any naturally occurring amino acid
  misc_feature (266)..(266): Xaa can be any naturally occurring amino acid
NWLIAYQGEPGAYSEIAALRFGEPLPCESFDDVFSAVTEQKADYAVIPIENSLGGSIHQNYDLLLRRPVVILAETFVKVEHCLLGLPGASVETATKAXSHPQALVQCHNFFATHPQIRAEAAYDTAGSAKXVAESRDKSALAIASKRAGELYGLDILKENLADEEWNITRFFCIAHENNPDISHLKVRPDVARQKTSIVFALPNEQGSLFRALATFALRGIDLTKIESRPSRKKAFEYLFYADFIGHREDQNVHNALENLREFATXVKVLGSYGVVNPFF

SEQ ID NO: 8182 - protein, 283 aa, Chlorobaculum tepidum
  misc_feature (4)..(4): Xaa can be any naturally occurring amino acid
  misc_feature (103)..(103): Xaa can be any naturally occurring amino acid
  misc_feature (136)..(136): Xaa can be any naturally occurring amino acid
  misc_feature (271)..(271): Xaa can be any naturally occurring amino acid
SNAXTNWLIAYQGEPGAYSEIAALRFGEPLPCESFDDVFSAVTEQKADYAVIPIENSLGGSIHQNYDLLLRRPVVILAETFVKVEHCLLGLPGASVETATKAXSHPQALVQCHNFFATHPQIRAEAAYDTAGSAKXVAESRDKSALAIASKRAGELYGLDILKENLADEEWNITRFFCIAHENNPDISHLKVRPDVARQKTSIVFALPNEQGSLFRALATFALRGIDLTKIESRPSRKKAFEYLFYADFIGHREDQNVHNALENLREFATXVKVLGSYGVVNP

SEQ ID NO: 8183 - protein, 855 aa, Pyrococcus horikoshii OT3
MHNMEEVREVKVLEKPWVEKYRPQRLDEIVGQEHIVKRLKHYVKTGSMPHLLFAGPPGVGKCLTGDTKVIANGQLFELRELVEKISGGKFGPTPVKGLKVIGIDEDGKLREFEVQYVYKDKTERLIRIRTRLGRELKVTPYHPLLVNRRNGEIKWVKAEELKPGDKLAVPRFLPIVTGEDPLAEWLGYFLGGGYADSKENLIMFTNEDPLLRQRFMELTEKLFSDARIREITHENGTSKVYVNSKKALKLVNSLGNAHIPKECWRGIRSFLRAYFDCNGGVKGNAIVLATASKEMSQEIAYALAGFGIISRIQEYRVIISGSDNVKKFLNEIGFINRNKLEKALKLVKKDDPGHDGLEINYELISYVKDRLRLSFFNDKRSWSYREAKEISWELMKEIYYRLDELEKLKESLSRGILIDWNEVAKRIEEVAEETGIRADELLEYIEGKRKLSFKDYIKIAKVLGIDVEHTIEAMRVFARKYSSYAEIGRRLGTWNSSVKTILESNAVNVEILERIRKIELELIEEILSDEKLKEGIAYLIFLSQNELYWDEITKVEELRGEFIIYDLHVPGYHNFIAGNMPTVVHNTTAALALSRELFGENWRHNFLELNASDERGINVIREKVKEFARTKPIGGASFKIIFLDEADALTQDAQQALRRTMEMFSSNVRFILSCNYSSKIIEPIQSRCAIFRFRPLRDEDIAKRLRYIAENEGLELTEEGLQAILYIAEGDMRRAINILQAAAALDKKITDENVFMVASRARPEDIREMMLLALKGNFLKAREKLREILLKQGLSGEDVLIQMHKEVFNLPIDEPTKVYLADKIGEYNFRLVEGANEMIQLEALLAQFTLVGKKK

SEQ ID NO: 8184 - protein, 468 aa, Pyrococcus horikoshii OT3
MPDVPWIEKYRPRKLSEIVNQEQALEKVRAWIESWLHGNPPKKKALLLAGPPGSGKTTTVYALAHEYNFEVIELNASDERTYNKIARYVQAAYTMDIMGKRRKIIFLDEADNIEPSGAPEIAKLIDKARNPIIMAANHYWEVPKEIRDRAELVEYKRLNQRDVISALVRILKREGITVPKEILTEIAKRSSGDLRAAINDLQTIVAGGYEDAKYVLAYRDVEKTVFQSLGMVFSSDNAKRAKLALMNLDMSPDEFLLWVDENIPHMYLKPEEMARAYEAISRADIYLGRAQRTGNYSLWKYAIDMMTAGVAVAGTKKKGFAKFYPPNTLKMLAESKEERSIRDSIIKKIMKEMHMSKLEALETMKILRTIFENNLDLAAHFTVFLELTEKEVEFLAGKEKAGTIWGKTLSIRRRIKETEKIEEKAVEEKVEEEEAEEEEEEERKEEEKPKAEKKKGKQVTLFDFIKKN

SEQ ID NO: 8185 - protein, 152 aa, Leptospira interrogans serovar Lai str. 56601
MPTAIFKTNFGNFSVYLDEEKAPITAGNFIKLAKDGFYNGLTFHRVIKNFMIQGGCPVGNGTGGPGYKIQDEFHKDLKNEKFTLSMANAGPNTGGSQFFINVRDNFYLDNRHAVFGRVTEGMDIVETISETETGFQDKPTKSVIIETITVSP

SEQ ID NO: 8186 - protein, 67 aa, Oryza sativa Japonica Group
MTTSRRLSDRKVARFEKNVTKRGSVPETVKKGNDYPVGPIVLGFFVFVVVGSSLFQIIRTAQNAGYF

SEQ ID NO: 8187 - protein, 169 aa, Zea mays
MASAAHRSMGSALLSLNLIMYVVVAVIAGWAINYSIDESRNSLKGATPPVRLFPIYFPIGNLATGFFVIFALVTGVVGISTSLAGLHEVSQGYPASMMSAAASALVTWTLTVLAMGLACKEISLSVRPGSLRTLEAFTIILTATQLLCAVSLHAGAHAVILETPIGGRV

SEQ ID NO: 8188 - protein, 267 aa, Brucella suis 1330
MGRAVDNGAHCIDACTQQNTLTGIEPLSEQDKKQAAIKAAQAAADAVREAQAALAEEGRLLFKKSWIFIRGVPSMKFLPPEGPVEIAFAGRSNVGKSSLINALVGKKGLARTSNTPGRTQELNYFVPDGYSGENGDLPPLALVDMPGYGFAEAPKAQVDAWTRLVFDYLRGRTTLKRVYVLIDARHGIKKNDAEVLDLLDKAAVSYQIVLTKIDKIKPAGVPRLLEETHKLTYKRAACFPGIIATSSEKGQGLDDLRAAIALLLKEY

SEQ ID NO: 8189 - protein, 296 aa, Brucella suis 1330
MTTLENPEMQAQLLSAALPYMQRYENKHVVVKYGGHAMGNPELGKAFARDVALLKQSGVNPIVVHGGGPQIQAMLTKLGIESRFEGGLRVTDEKTVEVVEMVLAGSINKEIVALINAEGEWAIGLCGKDGNMVFAQKAHKTVIDPDSNIEKVLDLGFVGEPAEVDRTLLDLLARSEMIPVIAPVAPGRDGHTYNINADTFAGAIAGALAATRLLFLTDVPGVLDKDKKLIKELSVADAQALIRDGTISGGMIPKVETCIDAIRRGVEGVVILNGKTPHSVLLELFTEHGAGTLIVP

SEQ ID NO: 8190 - protein, 313 aa, Brassica napus
QKTSSFNQKEKTSSLNQNETVSAMEFFQKAKAIRMRNSHNKYLSADDDEETVTQDRNGSTKNARWTVEPVRDSYHVIRLKSCYGKYLTASNERFLLGATGKKVIQLKPSRLDSSVEWEPVREGSKIKLRTRNGNYLRGNGGLPPWRNSVTHDNPHLSATQDSISWEVDVVEILVNPQVTAETEFTPSPKTQPPPQKTQPPPHRRPSRTQSSLSERSEQDSVVSPPKSDGRTIYYHIADDEGHVEDESSVGYAFTFKGNSVAELTQTLREETCMEDAVVCTRSPLNGKLFPLRLQLPPNNGTLHVVLVPSSASL

SEQ ID NO: 8191 - protein, 258 aa, Salmonella typhi
MMNPLIIKLGGVLLDSEEALERLFTALVNYRESHQRPLVIVHGGGCVVDELMKGLNLPVKKKDGLRVTPADQIGIITGALAGTANKTLLAWAKKHHIASVGLFLGDGDSVNVTQLDEALGHVGLAQPGSPKLINMLLENGFLPVVSSIGVTDDGQLMNVNADQAATALAATLGADLILLSDVSGILDGKGQRIAEMTASKAEQLIDQGIITDGMIVKVNAALDAARALGRPVDIASWRHAEQLPALFNGTPIGTRILA

SEQ ID NO: 8192 - protein, 306 aa, Synechocystis sp. PCC 6803
MRYGFYTLDVFTDQLFGGNPLAVFPDAEGLTDGQMQKIAAEINYSETVFVLPPVTETGNFRLRIFTPKRELDFAGHPTIGTTYLLGLLQPPSPLVTTTWQLEEPVGLVPVTLHYKQGQLVQTELTVAQLPQTKDSAPSCEDLALLLGLSIDQLQQGEYEPQAYSCGLPFLFIPLINEEALNRISFNPSVWQNLLAGQWADCVYCLAPGDPSLGLSDNKLIHGRMFAPGLGIAEDPATGSGVAALGGYLDDRLDTPGSHHWQIEQGKALGRPSQLQLTVVKDGQGIRAVKVAGRSVLVSEGFMNLGN

SEQ ID NO: 8193 - protein, 266 aa, Glycine max
MVIMSALFSFIFPPPSSLVVSGMSVISLVSLANAGFSEIRGKHLNYSKFWNANPSAEKQVKLSSKAGMLLLYTPAFLAGLASFWIFPHQGLRSTLLQSAVTLHFFKRVFEVVFIHKYSGAMLLDSAIPITLSYFLSTATMIYAQHLTQGLPEPPIDLLYPGIVLFVVGIIGNFYHHYLLSNLRGKGEKEYKIPKGGMFELVICPHYLFEIIEFYGFSFISQTLYAFSFTVGTTLYLLGRSYSTRKWYLSKFEDFPEHVKAIIPFVF

SEQ ID NO: 8194 - protein, 333 aa, Triticum aestivum
  misc_feature (190)..(190): Xaa can be any naturally occurring amino acid
  misc_feature (205)..(205): Xaa can be any naturally occurring amino acid
KNIPYRSGIPGISSTHASGEMLPDFVPDVAGVSLAESGGFVKAPGGAPANVACAISKLGGSSAFIGKFGDDEFGHMLVEILKQNGVNAEGCLFDQHARTALAFVTLKSNGEREFMFYRNPSADMLLTEAELNLDLIRRARIFHYGSISLITEPCRSAHVAATRAAKSAGILCSYDPNVRLPLWPSAQAAXRDGIMSIWKEADFIXVSDEEVPFLTQGDAHDEKNVLSLWFEGLKLLVVTDGEKGCRYFTKDFKGSLPGYSVNTVDTTGAGDAFVGSLLLSVAKDDSIFYNEAKLREVLQFSNACGAICTTKKGAIPALPTTATALDLISKGTN

SEQ ID NO: 8195 - protein, 754 aa, Saccharomyces cerevisiae YJM789
MTSNNSLLGRGRMSYSSTAPPRFKRSVDQRDTFSDNFDYDKDSSNRGRTYIAASNSTTGVPPPNNSRSGCTNNTNNTNNTSNTSNTNNNDSVDENTVFETVPYYLPCFSWLPEYTFNKLWGDVIAGISVASFQIPLALSYTTSIAHVPPLCGLYSLAISPFVYGILGSVPQMIVGPESAISLVVGQAVESITLHKENVSLIDISTVITFVSGTILLFSGISRFGFLGNVLSKALLRGFISSVGLVMIINSLISELKLDKFLVSLPQHYHTPFEKILFLIDYAPAQYHIPTAIFSGCCLIVLFLTRLLKRKLMKYHKSAIFFPDILLVVIVTILISMKFNLKHRYGISIIGDFSMDNFDELKNPLTRPRRKLIPDLFSASLIVAMLGFFESTTASKSLGTTYNLTVSSNRELVALGFMNIVISLFGALPAFGGYGRSKINALSGAQSVMSGVFMGVITLITMNLLLQFVHYIPNCVLSVITTIIGISLLEEVPGDIKFHLRCGGFSELFVFAVTFCTTIFYSIEAGICIGCVYSIINIIKHSAKSRIQILARVAGTSNFTNLDDYMMNMKRNSLDVEGTEEIEGCMIVRIPEPLTFTNSEDLKQRLDRIERYGSSKIHPGRKSLRSKDSIKYVIFDLGGMTSIDSSAAQVLDEIITSYKRRNVFIYLVNVSINDKVRRRLFKAGVAASVERAQANNNENNSSNTFSDAGETYSPYFDSIDAALYEIEKMKIKGNNVPNNDSESFMSNTLFNSSLV

SEQ ID NO: 8196 - protein, 644 aa, Rhizobium leguminosarum bv. viciae 3841
MVQSNPGSQPEPALDVITIGRSSVDLYGQQIGSRLEDIGSFAKSVGGCPANIAIGTARLGLKSGLITRVGDEQMGRFIREQSAREGVATDGIVTDKERLTALVLLAVEAEGVSPMIFYRSDCADMALDEGDIDEDFIRSSRAVLVSGTHFSRPNTEAAQRKAIRIAKANGRKVIFDIDYRPNLWGLAGHAEGFERYVKSDRVSSKMKETLPDCDLIVGTEEEILIASGADDVLGALKEIRRLSPATIVLKRGAMGCIVYDGPIADDLEAGIIGQGFPIEVFNVLGAGDAFMSGFLRGFLRDEPLKTCATWANACGAFAVSRLLCSPEYPTWAELDFFLTTGSKHRALRKDEALNHIHWASTRRGEIPLLMALAIDHRSQLVSVADELGVGHEKIVAFKRLAVAAAARVSNGRDGYGMLIDERFGRDAFFDAATKNFSWIGRPVELPGSKPLRFEFSQDIGSQLVEWPLGHCIKCLCFYHPDDPADLKTEQQEKLRTLFEAARKVGRELLVEIIAGKNGPLTDDTIATALEELYALGIKPDWWKLEPQASREAWKKIDAVIAKNDPWCRGIVLLGLEAPAGELISCFEATLAAPSVKGFAVGRTIFADPARAWLSGEMNDEEAIADMAGRFQQLTEAWLKTRGHQ

SEQ ID NO: 8197 - protein, 571 aa, Clostridium tetani E88
MLKGISASNGIAIGKAFILKIGDVEIIKETIKDGEEENQRFITALEKGKKQLSKIMKDAKEKLGEEKSKIFEAHLFMLDDPEFTGQVSEKILKQKINAEYALKSTSEELVAIFEQIEDDYMRERVADIKDVTNRILRILTGNEGISISEIEEESILIGYDLTPSDTAQIDKNKILGFATEIGGVTSHSAIIARSIGIPSVLGVGKEIEEIKNGELIILDGNKGLIITNPDDEKINLYKKQIEEEKKLQKILGKYKNIEVITLDGRKVEVASNIGSIEDSENALKNGAEGIGLFRTEFLYMASSELPEEEFQYNAYKEVLEKMGEKPVIIRTLDIGGDKKLSYLTIDEEMNPFLGYRAIRLCLHRKDIFKTQLRALLRASYYGNLKIMFPMIANLQELREAKSILEECKEELRKESIAFNENIKVGIMVEIPSAAIMSDVLAKEVDFFSIGTNDLIQYTIAVDRMNEKVSYLYDFFNPAVLRLINNVIVNGHKEGKFVGMCGEMAGKKELIPLLLGMGLDEFSMSASSVLKAKKLITELNYEDCKKIVSKVMEMGTAEEVKAFLERNLNFNE

SEQ ID NO: 8198 - protein, 165 aa, Photobacterium sp. SKA34
MRRIISVLLENQPGALSRVVGLFSQRGYNIESLTVAPTDDPTLSRLNITTNVKNESAYEQIEKHLHKLIDILKVSNITESEHVERELMLTKVKASGFARAEVKRTADIFRGQIIDVTSQIYTIQLIGTGEKLDAFLAAVGEATEIIEVARSGVVGMARGERALKA

SEQ ID NO: 8199 - protein, 315 aa, Escherichia coli CFT073
MSFKLTKDDKIKQDKTNMTRIACVGITVQDRIYSLPTLPEGGGKYQANHYLEIGGGPAATAAVAIAKLGVEVDFIGRIGDDSCGNTLLAELEGWGVNTAFCRRYPNARSSQSAILVDQHGERIIVNYPSPDLGTDAEWLEAIDFSRYDLILADVRWHSGTEKAFSLARLAGVTTLLDADMTPQDISPLVALADHAVFSTPGLKRMTGLQSPEEGLFQATTQTAGKVYVTLGSEGSLWIEDGHLCQQEAFSVNVVDTTGAGDVFHGALAVALAEKMPTKEAIRFASAVAAMKCTQPGGRAGIPNREQTESFLSLYA

SEQ ID NO: 8200 - protein, 617 aa, Lemna paucicostata
  misc_feature (607)..(607): Xaa can be any naturally occurring amino acid
MQDGEDNGVDHNVVVQEQRLPEDYESRVNEATEGLNDGLESGIENSDNQRQNHPPLPPPSPPVPSIGWERFLPVKSLKVLLVENDDSTRHVVNALLRNCSYEVTAVANGLEAWKVLENLSNNVDIVLTEVVMPSLSGIGLLDKIMSHITLKTIPVIMMSSHDSMGIVFKCLSKGAVDFLVKPIRKNELKNLWQHVWRRCHSSSGSGSESGVHTQKSIKSKSIDSDNNDQISDDDDDDENASIDYGEKNDSDNGSGTQSSWTQHAPESPQPTPPGNHLVEAPDSTCVQVTHQKPEAFSTDYVHSYSECSKQNGQNHDNTHEVDTKVDFHRSDGNGNIPSGELTAKAADFIATMSFQASNSLHRFTDNDKIINEDLHSFELSLKRLRSIGGDGIGCSDGRHVLQRSDVSAFSRYNTCTSGRNPSDIPTRESNCNTTSKPAITHEERPVYEVNVKSTMLNENNLQVKIDVSCDLPFEQNQNTLKKLTAAGPPCGSSNMDNGPTDANLGNYSMNVSISGSHHGSNQPNGRTIMDSENGLTGKTEAVGGNGSGSGSGSGVDESRFAQRVAALTKFRQKRKQRCFQKKVRYQSRKKLAEQRPRIRGQFIKHTXCDHTDHEADG

SEQ ID NO: 8201 - protein, 855 aa, Zea mays
  misc_feature (270)..(270): Xaa can be any naturally occurring amino acid
MDRSSDSSNPPGLAVPAASKPPQMAANNNPWRAPLPPLLNARAGFGGDTSLFSTSLPVLPHEKLIFADSSHGTPPMDDTLTKMKVLANDPDEKDYKFDFDLRQIDDLLPDEDEFFAGITDETEPVAQTNTTEELEEFDVFGNGGGMELDIDPVESITVGFANSSIVDGARCNSINPFGVPSTVGTVAGEHPFGEHPSRTLFVRNINSNVEDSELRSLFEQYGDIRTLYTATKHRGFVMISYFDIRAARNAMRALQNKPLRRRKLDIHFSXPKWENPSDKDLNQGTLVIFNLDPSVSNEEVRQIFGAYGEVKEIRETPNKKHHKFIEFYDVRAAEAALRSLNKSEIAGKRIKLEPSRPGGTRRNLMQQLGHDLDQEEPRSYRHPHVGSPIANSPPGAWAHYSSPTDNNMLQAFTRSPTGNGMSPIGMPSLISNAPKIAPIGKDSNRSKYDQVFSNGNQSLGAAFQHSHSYQDHNSEHMSSSPGTLSGPQFLWGSPKPYSEHSKSPIWHPPAIGSALSSSSRTQGQGFLYSSRQASLFGSLDQHHHHVGSAPSGAPFENHFGFLSESPETSYMKQLKFGNMGNVGIGRNGGGLMLGMASHASVNPGSSLIGSLTDNVSSSFRPILSPRLGQAFYTNPPYHGPGTFGLDSSIDHARNRRVDSSVLQADSKRQYLLDLEKIRRGDDTRTTLMIKNIPNKYTSKMLLAAIDELHRGTYDFFYLPIDFKNKCNVGYAFINMISPVHIISFYQMYTYNLQAFNGKKWEKFNSEKVASLAYARIQGRSALISHFQNSSLMNEDKRCRPILFNPNGQDSVNQEAFPINGICIHMPLEDDCLDNEENKSLNEKTGENSTDIAGSL

SEQ ID NO: 8202 - protein, 470 aa, Photobacterium sp. SKA34
MKKTKIVCTIGPKTESVEMLTKLANAGMNVMRLNFSHGDFEEHGQRIRNLREVMVNTGKELAILLDTKGPEIRTIKLEGGQDFSLVAGQDFTFTTDTSVVGNQNCVAVTYPGFAKDLTKGNTILVDDGLIEMEVLETTETEVKCKVLNNGDLGENKGVNLPGVSVKLPALAEKDKADLKFGCEQGVDFVAASFIRKAEDVQEIRALLTANGGENIQIISKIENQEGVDNFDAILDASDGIMVARGDLGVEIPVEEVIFAQKMMIEKCNRARKVVITATQMLDSMIKNPRPTRAEAGDVANAIMDGTDAVMLSGESAKGKYPIEAVTIMAQICARTDYVVKPELGSRLDSPRLRITEAVCKGAVDTAEKLNAPLIIVATEAGKSARSVRKYFPTARILAVTTNTKTAAQLCLSKGVTPVVVDSIESTDAFYLRGKELALETGLGAKGDIVVMVSGALVTSGTTNTASVHVL

SEQ ID NO: 8203 - protein, 185 aa, Mesorhizobium loti MAFF303099
MTGSERAKMAAGEWYTCLDDELEALRALARDAVFEHNCLPPRQRGNLGPGLKALLGGVGDGARVEAPFHCAYGLNIFLGDGVFLNAGCTILDTAAVRIGKGTLLGPNVQIYCAEHHRQAAGRQAGLEIARPVEIGAHAWIGGSAIILGGVTIGEGAIVGAGAVVTRDVPANETAVGNPARPVKRG

SEQ ID NO: 8204 - protein, 272 aa, Erwinia carotovora subsp. atroseptica SCRI1043
MNTQLSEAYLQRFGGTARLYGQQALALFSQAHVCVIGIGGVGSWAAEALARTGIGAITLIDMDDVCVSNTNRQIHALRQHTGQSKTEVMAERILAINPECNVTCVDDFISAENVAEFLDQNFSYVIDAIDSVRPKAALLSYCRRYKIPVVTTGGAGGQIDPTRIEVVDLAKTIQDPLAAKLRERLKHDFNVVKNSKGKLGIDCVFSSEPLVYPQPDGSVCASRSTADGVMRMDCASGFGAATMVTATFGFVAVSHALKKMIAKMERASATQR

SEQ ID NO: 8205 - protein, 458 aa, Mesorhizobium loti MAFF303099
MTAKTFDAIIIGAGQAGTPLAGRLNAAGMSVALIERKLVGGTCVNTGCIPTKTMVASAYAAHLARRATDYGVTLGGPVGVDYKAIKARKDKVSGASRTGLESWIAGMDKCTLYRGHARFESANTVRVGDDLLTADKIFLNTGGRASVPDLPGIHDIDYLTNSSMMDLEVLPRHLIVVGGSYISLEFAQMFRRFGSEITVIEKSPRLTGREDEDVSATILSILENEGITVHVGADDIGFAKQGDDIAVTFSAGKPPAVGSHVLLALGRTLNTDDLGLDRAGVAVDKRGAIIVDDQLRTSVPGIWAMGDCNGKGAFTHTSYNDYEIVAANLLDNDPRKVSDRIEAYALYIDPPLGRCGMTEAAVKKSGRRALVGQRPMTRVGRAVEKGETQGFMKILVDADTRQILGCSVLGPGGDEAVHCVLDLMYAKAPVDTLARATHIHPTVSELLPTIAQELKPLA

SEQ ID NO: 8206 - protein, 401 aa, Erwinia carotovora subsp. atroseptica SCRI1043
MTPFNPATFRQQFPALQHSAVYLDSAATALKPQSVIDAVQQFYCSESGTVHRSQHRGAQVLTQRFEGAREQVATLLHANDPRSIVWTRGSTEAINLVAQSYARPRLQPGDEIIVSEAEHHANLIPWLMVAQQTGASVVKLPIGADLLPDIEQLTTLITPKTRLLALGQMSNVTGGLPDLARAITLAHHYGAVVMVDGAQGIVHCPPDVQALDIDFYAFSGHKLYAPTGIGVLYGKTALLESMMPWQGGGKMMTQVSFDGFLPQAIPQRFEAGTPHIAGVLGLSAALDWLTTLDWHAAEQHSQQLAQLAETHLAQFPGFRSFRSPHSSVLSFDIADVHHSDLITLLAESGIALRAGHHCAQPLMDALGISGTIRASFAPYNNQQDVAALIAAIGNALELLSD

SEQ ID NO: 8207 - protein, 200 aa, Cryptococcus neoformans var. neoformans B-3501A
MAHPFTLLVTVGSTLFPSLTSHVLLPTFLSLLQSLGVQRLVVQYGRAELKLQDDVKQTLNIDSQGDGIGVWSDNDGDRVRDEKQNGMVVEVMRFTNDFEGLVGKSDAVISHAGSGSILTVLRRAPPIPLLVVPNRSLMDDHQSELADALYKDGYVMVASVEDLEEKVQPFLKIWPSQAKLFPETRKEVFREVVDDLMGYD

SEQ ID NO: 8208 - protein, 417 aa, Candida albicans
MMNIDQHHQLQQQHQQQMLQQQAQAQAQAQAQAQQQQQAAAAAAAANAAATTSSSSPRQVSFNVSDHYQILEIVGEGAYGIVCSAIHKPSQQKVAIKKIEPFERSMLCLRTLRELKLLKHFNHENIISILAIQRPINYESFNEIYLIQELMETDLHRVIRTQNLSDDHIQYFIYQTLRALKAMHSANVLHRDLKPSNLLLNSNCDLKICDFGLARSIASQEDNYGFMTEYVATRWYRAPEIMLTFQEYTTAIDVWSVGCILAEMLSGRPLFPGRDYHNQLWLIMEVLGTPNMEDYYNIKSKRAREYIRSLPFCKKIPFSELFANTNNNTSTSNTGGRTNINPLALDLLEKLLIFNPAKRITVEDALKHPYLQLYHDPNDEPISDKIPEDFFDFDKMKDQLTIEDLKKLLYEEIMKPL

SEQ ID NO: 8209 - protein, 263 aa, Triticum aestivum
MAAAGVSREQRWSLAGATALVTGGSRGIGHAIVEELVGLGARVHTCSENAVELEGCRRRWEEMKLPVTVSVCDVSVRAEREKLMESAKQTFDGKLDILVNNVGRNVAKATVECTAEEYSHLMSTNLESAFHLSQLAHPFLRDASIAGGGSVVNISSVASSLGYSTLALYCISKGGVNQLTRSLAAEWAQDKIRVNSVAPGGINTELQNSVDPKVIENTLLRTPMHRLGEPVEVASMVSFLCMPAASFVTGQVMYVDGGRTISG

SEQ ID NO: 8210 - protein, 245 aa, Moritella sp. PE36
MGNWKLNATKASVEALINGLVDAAKDNATVEVAVCPPAVFIPQVEALTANTAISYGAQDCDVNTAGAFTGENSAVMLKEFGCKYTLVGHSERRVIHGESSEVVADKFAVAQENGLVPVLCIGETLEQFEAGETKAVVEAQLQAVVTKSGITSLNNAVIAYEPVWAIGTGKTATPEIAQDIHAHIRSWLAEQDAAVANKVQILYGGSVKGANAAELFGQADIDGGLVGGASLDAVEFSKVIAGASA

SEQ ID NO: 8211 - protein, 488 aa, Neisseria meningitidis MC58
MMKLGFKPIPLAIAAVLCALVLALPVPDGVKPQAWTLLAMFVGVIAAIIGKAMPLGALSIIAVGLVAVTGVTADKPGAAMSDALSAFANPLIWLIAIAVMISRGLLKTGLGMRIGYLFIAVFGRKTLGIGYSLALSELLLAPVTPSNTARGGGIIHPIMQSIAGSYGSNPAKGTEGKMGKYLALVNYHSNPISSAMFITATAPNPLIVNLIAENLGSSFRLSWGAWAWAMAVPGVIAFFVMPLILYFLYPPEIKETPNAVQFAKDRLREMGKMSADEIIMAVIFGILLLLWADVPALITGNHAFSINATATAFIGLSLLLLSGVLTWDDVLKEKSAWDTIIWFGALIMMAAFLNKLGLIKWFSGVLAESVGGLGVSGTAAGVILVLAYMYAHYMFASTTAHITAMFGAFFAAAVSLNAPAMPTALMMAAASNIMMTLTHYATGTSPVIFGSGYTTMGEWWKAGFIMSVVNFLIFFVIGSIWWKVLGYW

SEQ ID NO: 8212 - protein, 269 aa, Zea mays
  misc_feature (207)..(207): Xaa can be any naturally occurring amino acid
  misc_feature (244)..(244): Xaa can be any naturally occurring amino acid
  misc_feature (251)..(251): Xaa can be any naturally occurring amino acid
ALTAMARAKAPRRKPPQAVSRRLLGFCGLSFAAALYVGIDYLRYLSPTWHNRLQPVLWAALALAAAARAPFYRHWDVELRAVLPFLGSIVFMLSAFLIEMISVRFVSVLMGLQWHGSAAPLPDTGQWVLLALNEKLPGSVVDLLRAHVITLHHYLMLFMMLGFSVLFDCIKAPGLGIATRYMFTMAVGRLLRTATFVGTILPSARPXWCAAGRYQIPGHPHPWAQKNIMFHMLSDPMLFRAGIXNDMANAXGQAYPDEYSPDWGPDEFL

SEQ ID NO: 8213 - protein, 166 aa, Zea mays
  misc_feature (87)..(87): Xaa can be any naturally occurring amino acid
  misc_feature (105)..(105): Xaa can be any naturally occurring amino acid
MMSRERKKAAALQEKLKILRSITHSHALSNTSIIMDASAYIKELKQKVVRLNQEIACAQDALRHKASSYPTVTVEALGVQGSSFLVXNVFSDKSCPGLLVAVLEXAFDELGLSVLQATASCADSFRLEAVGGENVADNVDEHVVKQAVLQAVRSCSEGGSEHDDEE

SEQ ID NO: 8214 - protein, 499 aa, Cicer arietinum
MEYNFLTYIIFLSLFLITTKLLFSKRKFKKLPPCPPSIPIIGNLHQVKQPIHHTFYNLSKKYGPIFTLKFGSQPVVVVSSASLVEECFTKNDIIFANRIHSAKTKYLGYNNTNMVSTSYGDLWRNLRRISSIEILSTHRLNSFSEIRKDETMRLIGKLAKKSHKDFTKVELRSLFGELTFNTIMRMVCGKRFYGEESDGTNAEEAKKFRDMMNEMQEFGLGSNLGDFVPLFKLFDFSGGHKKLKKVGEKMDALFQGLVDEHRNNKDKNLNTMIDHLLSLQESQPDYYSDQIIKGLIMALIVAGTETSSVTLEWAMSNLLNHPEILEKAKIELDNHIGQEHLIEEAEATKLQYLQNIISETLRLHPPVTMLLPHLSSHDCTIGGYDVPRNTMLMVNAWAIHRDPNLWADPMSFKPERFENGQGDIGGFIPFGMGRRACPGSGLALRTLGLTLGSLIQCFEWKRIGKEEVDMSEGSGTVVPKAIPLEAQCKARPIINKIFN

SEQ ID NO: 8215 - protein, 804 aa, Pichia angusta
MSKHQTQVVGDFTIGPEIGRGSFANVYKGYDNRTKAPVAVKSVFRSRLKNQKLVENLEIEISILKNLKNPHIVALLDCVKTDQYFHLFMEYCSLGDLSYFIRRRDQLVQTHPLISSILERYPSPPNSHGLNKVLVVNFLKQLASALEFLRDQNLVHRDIKPQNLLLSPPVHSKEEFKRKGYSGLWELPVLKIADFGFARFLPSTSMAETLCGSPLYMAPEILRYEKYNAKADLWSVGAVIYEMSVGKPPFRASNHVELLRKIEKSKDEITFPVSAEVPDDLVRLICGLLKANPTERMGFQEFFNDPLIVYDVQCADEPLECSNVDEQLFISEYLPNLKTSPPAKPAPETIKEESEEEERAERAPTDSLLIGKEADLRIPRPMEGSGKDEVIKKLINKSSPPPDTVKDGQIKKGARRDKDDFVYEKDYVVVEKRTVEVNAIADELAKAGAGAVAIPSPHLGTNEHSAANPSGPTETQTQRRFSPSSRTSSIGSNRRPSWGDRKMPISISPTNALTKALGYTSNRLFGQQQQQPQQAQQAAIESAITNVTTNLLATKTLRPLKPSQETSLEDTEVINQLELLATMAHAISLFAEVKFSQLIPLPPSSSSPGSADYDEMYQNDAFPPQMVKSISSEGVALYVETLSLLAKAMSIASDWWHQNSSKPSTSPKLNDLVQWIRSRFNESLEKAEFLRLRLADANEQLVGESGSSLNKPVVAEKLIFDRALEMSRTAAMNELKNEDLLGCELSYSTAIWMLEALLSNDEEPVTGNEKLDAEDKKIIELFINSIGNRLKVLRQKIDKQGVRS

SEQ ID NO: 8216 - protein, 476 aa, Bacillus sp. SG-1
MVVGELAEERELVIIGGGPGGYHAAIRAAQLGLSVLLIEKEELGGVCLNKGCIPSKVFTQLAKKHKEMAHYQKMGLDSGSVSVNLTKLHDYKSSLIAQLKKGVDSLCKANKVEVIKGSASFLAENKIGVENGHQFTVYSFQSAIIATGAKRELPSFISGYSSRVLNEISIYELSELPEELVVYGSGYIELEAASSFAALGTKVTLVLDGELPFDDSINKELTRVLKKMNVKLMTGFSPEEVKETHDGVSVTLSKQDSDSVTIETSYFLAASKLKGNIDGLGVDRLKMNLTGDGRIEADSSCLTSIQGIYAVGDVTTGSPLAVKAIKQGKVAAESAAGLPSAYDDVLLPVIAQTIPPIASIGMTEKEAAENHEVSVSIYPMGGNGFAQLIGEKEGLIKVVADLNTDLILGIHMIGNSAVEMISGSAVGMEMAGRDEDFSYPYYPHPHTSESLQEAMEALKGKAVHLPPVKQKEFSKV

SEQ ID NO: 8217 - protein, 159 aa, Carboxydothermus hydrogenoformans Z-2901
MEITIVAVGKIKERYLKEGIAEYLKRLSPYARLAVIEVDDENAPENLSPAEAEKVVKKEGERILAKITPSSFVIALDLKGKNLSSEEFAHFISEKNLYGQSKLTFIIGGSLGLSREVLERADFKLSFGRMTYPHQLMRLILLEQIYRAFKIIRGEPYHK

SEQ ID NO: 8218 - protein, 409 aa, Bacillus sp. SG-1
MKRVEVKLHDIGEGMTEAHVSHFFVKAGDSVKADQPLVEVQTDKMTAEIPSPSAGTIKEILVSEGTTIEVGTVVLVMETAGGSKPEQKVKQEKPMISAVSTAPAAPRNRKRILASPYTRKIARENNIDITEVEGTGAAGRITDEDVRRFIASGIPSQPNAEETRQEVSRPEAKPKVSVHGESIPFRGRRKQIGMKMKSSLKTIPHCTHFEEIDVTNLMELRNGLKLKDTNISASAFFVKALSIALKDFPIFNARVDEEKEQITFNNEHHIGIATDTEDGLIVPVVKNVENKSLKVIHSEMKEFTLKARENKLAAKDVTGGTFTISNVGPMGGSIGATPIINHPEVALVSFHKTKKRPMVDENDEIVIRSMMNISMSFDHRAADGATAVAFTNRFAELIENPNLMLVELM

SEQ ID NO: 8219 - protein, 507 aa, Arabidopsis thaliana
MENKSHSNHHRYHHLSSRSHEQNQRGLISINAIIIIGISIISIFIILAILLIIILLHRLKSARVKAQELSCKESFNNMNNGGASTNYSYTSSPGKTPKHSFHNFVKNHKFLIQNQSAMSGDSHIFISVLNYFHIQCVFLIRTLMFLLDDIKRDCLYSRNPTSFRQLPPQTKSCRRSRAEGVEVYTYKELEIATNNFSEEKKIGNGDVYKGVLSDGTVAAIKKLHMFNDNASNQKHEERSFRLEVDLLSRLQCPYLVELLGYCADQNHRILIYEFMPNGTVEHHLHDHNFKNLKDRPQPLDWGARLRIALDCARALEFLHENTISTVIHRNFKCTNILLDQNNRAKVSDFGLAKTGSDKLNGEISTRVIGTTGYLAPEYASTGKLTTKSDVYSYGIVLLQLLTGRTPIDSRRPRGQDVLVSWALPRLTNREKISEMVDPTMKGQYSQKDLIQVAAIAAVCVQPEASYRPLMTDVVHSLIPLVKAFNKSTDSSRFPSRRESLSFDDIMP

SEQ ID NO: 8220 - protein, 303 aa, Solanum lycopersicum
MGLLEGTFLDWEYESYPSYEDFAVLPLFALFFPSVRFLLDRFVFEKVARRLIFGKGQEVVENETDDRRRRIRKFKESAWKCIYFLSAEVFALVVTYNEPWFTNTRYFWVGPGDQVWPDQMYKSKLKALYMYTGGFYTYSIFALIFWETRRSDFGVSMSHHVATAILIVLSYNIRFARVGSVVLAIHDASDIFLEIGKMSKYSGAEALASFRYLCLSWIILRLIYYPFWVLWSTSYEVLQTLDKEKHKVDGPIYYYIFNSLLFCLLVLHIYWWVLIYRMLVKQIQARGQLSDDVRSDSEDEHED

SEQ ID NO: 8221 - protein, 277 aa, Triticum aestivum
  misc_feature (217)..(217): Xaa can be any naturally occurring amino acid
MTLGLFRCFIKQFVQKRCRYRSGIPGISSTHASARVPTRQIGNANTRSAPIPQYHRQPTDPAPTPPPPPPPPLRPPDRRRSRRIAAMGRKLALLVGINYPGTKAELKGCHNDVDRMHKCLVDRFGFDEDNITVLLDRGSSGPQPTGANIRHALAKLVGEARRGDFLFFNYSGHGTRLPAETGQDDDPGYDECIVPSDMNLITDQDFRDLLQKVPDGXIYPSSPNSCHRGGLTGQGKRNRIGNKPPRKNQTPAFGKPQKNRVSPFRGGGVPGSLSSKK

SEQ ID NO: 8222 - protein, 343 aa, Zea mays
  misc_feature (305)..(305): Xaa can be any naturally occurring amino acid
MLGAPSPRTAPPMRKPYMREHSCLIFPPPRGRRPLAVIKFLGGAFIGAVPEVTYGYLLELLALEGFVVVCVPYNVTFDHEAAAREVFQRFHACYDALLASGLPEAGLSALDIAELPLYSVGHSNGALLQLLVGSYFSERIPEANAIVSFNNRPASEAVPYFEQIGPLFRQLMPMMEASPVYSVARNASGDAWKALFDLAGGLLREYDQEATVSLSKFIDQLPSVMNQVTEGVSEFKPTPPENREFCKNSYSVPNTLLVKFTVDAIDDTDIVEDVLRPRVDSIGGQIKKVILSGTHLTPCIQDVKXQVGSEYTPADAIAQGLKSLALSETRVLSRTIADWFTSL

SEQ ID NO: 8223 - protein, 314 aa, uncultured marine bacterium 463
MSDFGSGTSTSEVIEGVDLKGKCALVTGASSGLGVETSRSLASAGAAVIMVARDASKLDTAVAQVRAAVPDAQLDTALLDLADLESVRAGAQTILAKCPSIQLLINNAGVMACPLMRTAQGFEMQLGTNHVGHFLLTCMLAPALVAGAPARVVNLSSAGHRFSAMDLDDPNYHRRDYEKWQAYGQSKTANALFSVGLDQRLQGQGVRSFAVHPGMIMTELSRHMDPSDMEIILAGRNIEDIGFKTVEQGSATSVWAATSQDLDGLGGLYLEDCHIAEPATPDNEAGIESYALDPVTADKLWQLSEDMVGENFNF

SEQ ID NO: 8224 - protein, 220 aa, Chlamydomonas reinhardtii
MPLVYSCISLLHGVTLAEYAAFAGNFGAVAKEYLARTTGEGKLSYAVDGHTFTVLCRGGFVFLVAADEATGKTIPSAFVDKVADEFTSKYADKAAGLAGKEGGLQSSFGKQLKSTMEHATQYPEEYSKVASVQKKVDEVKGIMTENIDKVLARGEKLELLTDKTENLMFESDRFVRTGRALRRRMWMQNCKMKIVVALAVILLAVVIFLLVCFSGGNCLK

SEQ ID NO: 8225 - protein, 328 aa, Chlamydomonas reinhardtii
MGVAVGDAGSEKKSKGRMAVDATAGAIAGCIARFLTGPFDVVKIRFQVQLEPIVGAPADALRRSKYTGFTQALTTIVREEGIQGLWRGTVPGLLLTVPYTAVQFVALQQVRQAAASYGLTANPGTAPLVSLASGALAGAAATVASYPFDLLRTTLAAQGEPKVYKTLWEAARGIVSQRGPAGLYSGLGVTLVEIMPYAALQFGLYDALNAAVADEAAAAAERSASGLQSNRLQAFACGLVAGLVAKLVTHPLDVAKKRYQVAGLQRSLKYGARVEAGFAMRSLAQSLVDIYRTEGVLGLWKGSVPSIIKAAPSAAITFTAYDAVLAWL

SEQ ID NO: 8226 - protein, 623 aa, Lemna gibba
MQDGEDYTVDRNVVGEKHQRSGDYESRINEPTEGLNESLECEVENSVCQQQKNSPLPPPLPPITSIGWERFLPVKSLKVLLVENDDSTRHVVNALLRNCSYEVTAVANGLEAWKFLENLSNNVDIVLTEVVMPSLTGIGLLDKIMSHMTLKTIPVIMMSSHDSMGIVFKCLSKGAVDFLVKPIRKNELKNLWQHVWRRCHSSSGSGSESGVQTQKSIKSKRFDSDDNDRRSDNDSMDYDEKNGSDNGSGAQSSWTKHAPESPQPPAPGDHLAEAPDSTCAQVIHLKPGPFSKDYFRSSSECSKQKDQCDDDMHEKDSKIKIHHSDGDRNNPSGEITAKAADLIATMSVQASNSLHRFTDKDTIINEDSQSFELSLKRLRSIGGDGVGCTDDRYVLRRSDLSAFSRYNTSTASGRNPYNMPKGDSDFNTTCIPAVTHEVGPTREVIMKSTVLNENESSSVVHPTHNKLREKIDLPSNLPCDRNQMAPKKIASVAKPCGSSNMDNGLADTNLGNYSMNVSISGSHHGSNAPNGRTNIESENGLTEKTEAAGCNGSGTGSGSGMDESRFAQRVAALTKFRQKRKQRCFQKKVRYQSRKKLAEQRPRIRGQFAKHTAHNHADHEADD

SEQ ID NO: 8227 - protein, 437 aa, Saccharomyces cerevisiae
MAVSKVYARSVYDSRGNPTVEVELTTEKGVFRSIVPSGASTGVHEALEMRDGDKSKWMGKGVLHAVKNVNDVIAPAFVKANIDVKDQKAVDDFLISLDGTANKSKLGANAILGVSLAASRAAAAEKNVPLYKHLADLSKSKTSPYVLPVPFLNVLNGGSHAGGALALQEFMIAPTGAKTFAEALRIGSEVYHNLKSLTKKRYGASAGNVGDEGGVAPNIQTAEEALDLIVDAIKAAGHDGKVKIGLDCASSEFFKDGKYDLDFKNPNSDKSKWLTGPQLADLYHSLMKRYPIVSIEDPFAEDDWEAWSHFFKTAGIQIVADDLTVTNPKRIATAIEKKAADALLLKVNQIGTLSESIKAAQDSFAAGWGVMVSHRSGETEDTFIADLVVGLRTGQIKTGAPARSERLAKLNQLLRIEEELGDNAVFAGENFHHGDKL

SEQ ID NO: 8228 - protein, 460 aa, Lemna gibba
MAEEGEEMRIDAAGEEPRVVKWEKFLPRMFLRVLLVEADDSTRKIVAALLRKCGYKVSSASDGLEAWKTLKEKPNDTDLVLTEVELPNVSGYALLSMMMEHETCKSIPVIMMSSNDSMKMVFECMLKGAADFLVKPIRKNELRNLWQHVWRRQSSNRAENVPPVIGAANSEYNSASNHTSDCMDSNNKRRAGSEKGNDTQSSCTRPDREAEISDDLMTDREDISDKLERETQGKDDARETCVKVVESTGGLGQPSSSGEGDFVDSREDQTHHHYGFKRCRVLQPGQILGVDYNPAFKHQLKLDSVCNFRGRIQWRSAQKQGHKLNHSSSSAFSWYSAKSTLSPLPPPTENPDAASSENPNSSSPTSLFYTQPGQPETLKCPDQKTPRPTQDDHSSITYENGAPQSKLRLSIEREAALTKFRLKRKDRCFEKKVRYQSRKKLAEQRPRVKGQFVRQVNSGL

SEQ ID NO: 8229 - protein, 166 aa, Zea mays
  misc_feature (89)..(89): Xaa can be any naturally occurring amino acid
PIFFSTPSVPVSGFPRVLGFNKGGLETLPWKRGGGGACSGKSNFFCLGKQTCPFRTQSSKTQGPVDCRVGFQRVFSGRDKQEWVLNSGXGGSTRGRYSLLGFFSNLRGPRGGRFTKFFWAVWGGPLFFFPPAPSFFFFPLFGFPMLGLLPFFLVPPPPGCLFPALF

SEQ ID NO: 8230 - protein, 448 aa, Francisella tularensis subsp. tularensis SCHU S4
MALHGKKDTIDNLDFFEQSLPKFKLPLNSQDPLEVYQEIKDELMLDGNSKQNLATFCQTEVDDFIHKLMDDCIDKNMIDKDEYPQTAEIESRCVNILANLWNSSAENAIGCSTTGSSEAAMLGGMAMKWRWRDKMKAQGKDYTKPNLVTGPVQVCWHKFARYWDIELREIPMSNESLIMTPEAVLERCDENTIGVVPTLGVTFTGQYEPVEQVCKALDDFERQTGVDIPVHVDAASGGFLAPFVEPELKWDFRLPRVKSINSSGHKFGLSPLGVGWVIWADKKYLPDDLIFNVNYLGGNMPAFALNFSRLGGQIVAQYYNFVRLGFEGYKKVHQLCYDVAEYIAKELRKMEIFEIIHAGEGGIPAVSWSLKATKEYSLFDISEKVRAKGWQIAAYTMPNNREDLVVMRVLVRRGFSYDLAQLMIRDLVAVIDSLEGKLKILKRSSFAH

SEQ ID NO: 8231 - protein, 466 aa, Bordetella pertussis Tohama I
MSNGTIVQCIGAVVDIQFPRDNMPKIYEALTLVDEGSSFAEKGLTLEVQQQLGDGVVRTIALGSSDGLRRGMQVAGTGAPISVPVGHGTLGRIMDVLGRPIDEAGPIASDEKRAIHQPAPRFDELSPSVELLETGIKVIDLVCPFAKGGKVGLFGGAGVGKTVNMMELINNIAKQHSGLSVFAGVGERTREGNDFYHEMEESNVLDKVAMVFGQMNEPPGNRLRVALTGLTMAEKFRDEGRDILFFVDNIYRYTLAGTEVSALLGRMPSAVGYQPTLAEEMGVLQERITSTKTGSITSIQAVYVPADDLTDPSPATTFQHLDSTVVLSRDIAALGIYPAVDPLDSSSRQLDPQVVGEEHYQVARGVQQTLQRYKELRDIIAILGMDELSPEDKQAVARARKIQRFLSQPFYVAEVFTGSPGKYVSLAETIRGFKMIVDGECDALPEQAFYMVGTIDEAFEKAKKLQ

SEQ ID NO: 8232 - protein, 389 aa, Rhodopirellula baltica SH 1
MKAVCWHGRNDIRVDNVDDPKILDPRDAIIRITASGICGSDLHLMAGAAPAMEAGDIIGHEPMGEVVEVGNAVSNLSVGDRVVVPFTISCGECFFCQSTLYSLCDQSNRNAEQAEKIMGHSPAGLFGYTHMLGGYAGGQAEYLRVPYADVGPIKVPDGLPDEQVVFLSDIFPTGYMAAENCEITPNDTVAVWGCGPVGQFAIQSAWMLGAKRVIAIDNVPERLEMARSVSKAEVIDYEKSDVYETLQEWTKGRGPDCCIDAVGAENHAAGNLQSVLDDAKTALHLGSDRPHVLNEIFKCCRKGGRVSVPGVYFSSVNLQWGTAMNKALQIRLGQTHMQRYLTPLMEKITDGEIDPSFVITHVEPLDNAPEAYKKFRDKEDGCIKVVLKP

SEQ ID NO: 8233 - protein, 595 aa, Pseudomonas putida KT2440
MPHEGSLLQTAVIFLLAAVLAVPLAKRLQLGAVLGYLLAGVVIGPQALGLIRDTESVAHISELGVVLLLFIIGLELSPKRLWLMRKSVFGVGTAQVVLTGAVIGAIALFGFSQTLPAAIVLGLGLALSSTALGLQSLAESKQLNAPHGRLAFAILLFQDIAAIPLIALVPLLAASGPDTSQGDSLQHGLKVFASIAVVIIGGRYLLRPVFRTVARTGLPEVSTATALLVVIGTAWLMEEAGISMALGAFLAGLLLADSEYRHELESQIEPFKGLLLGLFFISVGMGANLRLLLEMPLVVLGLTLLLVAVKLLLLIGVGRLVGGLNSASALRLGMVLAAGGEFAFVVFKLGKDQGLFDTQTYDLLLMTITLSMAITPLLMLGCARALKRPQPAREVPEQYKQIQTDTPRVVIVGMGRMGQIVARILRAQKIPFIALETSVDTIEMTRMFEQVPVFYGDPLRPEVLHAAKVGEAEYFIITIDDPEAAIHTAARVKRLYPHLKVLARARNRQHVHKLADVGAEPIRETFYSSLEMTRRALVGLGLSDEQAADRIARFTQHDEEVLEAQGQVRDDRAKVMQTAKEARVELERLFDSDAD

SEQ ID NO: 8234 - protein, 375 aa, Pyrococcus horikoshii OT3
METLLLLAILLAVAKFSGWIFEKFNQPIVLGQILAGILMGLIIERNEIIIEFANLGVLMLLFLAGIESDLEEFKKVGKPGILVAGVGVLFAFIFGFIVAYPFFDFGTAMLYGAVMTPTSVSITVKVLMELGKLRTREGTTILAAAVIDDVLGILVLTIVISTLREGSVHYDIILKILLEVAGFLAVFLYIGPVFMEDAFRRLSKIDLPEATTTFAVVFLVLFAYLAEHLNLASILGAYLIGLSIGQTSYKKRIEDHMNTLGYSIFIPLFFVDVGMRIDPRFLLQAKVFALLYALIAMLSKVIGCGLGAYLANFDWKSSLKIGIGMIPRLGVELAMITTAMASGIAGSDVLTVAMTMVFLTTLVTPLLLKRIYQIL

SEQ ID NO: 8235 - protein, 292 aa, Nocardioides sp. JS614
MTTLPSHAEPSNAGPSNADLADLALEVAREAAELVRGRRAAGVTVAATKSSEVDIVTEADRASEALIRRLVAARRPDDGFLGEEGDDVASTSGIRWIVDPIDGTVNFLYDLPQYAVSIAAERDGEVVAGVVINVARRTEYVGHRADRAEHGGAPARATRDGEPLAVRAPTPLRLRLVGTGFNYDSRIRGLQAAAVARLITRIRDIRRSGSCALDLCHLAEGALDGYVEEGVNLWDHAAGGLLAELAGARLEHRPGVGGSDLVVCAPTHGFDDFLEAVQEAGFTADSGVQHAE

SEQ ID NO: 8236 - protein, 198 aa, Leptospira interrogans serovar Lai str. 56601
MSVIPYVIEQTSRGERSYDIFSRLLKDRIIFLGNAINDDYANVITAQLLFLEAENPERDIYLYLNSPGGYVSSGLAIYDTMQYIKPDVRTLCLGQASSMAALLLAGGAAGKRSALPNARIMMHQPMGGATGQASDIEIQAREVLKLKEILNSIYHKHTGKTVEQIQKDTERNFYMTADEAKNYGIIDTVIQIDRKQTE

SEQ ID NO: 8237 - protein, 500 aa, Chromobacterium violaceum ATCC 12472
MSQSVPNIKLLIGGEFVESQTTEWRDIVNPATQEVLARVPLATADEVNAAVAAAKEAFKTWKKTPIGTRARIFLKYQQLIRENMKELAAILTAEQGKTLADAEGDIFRGLEVVEHAANIGTLQMGEYAENVAGGVDTYTVQQPLGVCAGITPFNFPAMIPLWMFPMAIATGNTFVLKPSEQDPMVTMRLVELALEAGIPKGVLNVVHGAASVVDAICDHPDIKAVSFVGSTKVGTHVYQRATLSGKRAQCMMGAKNHAIVLPDANKEQALNQLTGAAFGAAGQRCMALSVAVLVGEAQQWIPELVAKAKGLKVGPGKDNPDLGPVISCAALDRVKSLIARGVEEGAKLELDGRGVKVAGFESGNFVGPTIFSGVKPEMAIYHQEIFGPVLCLMAADTLDEAIAIINANPNGNGTAVFTQSGAAARKFQEEIDVGQVGINVPIPVPVPLFSFTGSRASKLGDLGPYGKQVVAFYTQTKTVTSRWFDDEASSGKVHTTISLR

SEQ ID NO: 8238 - protein, 275 aa, Riccia fluitans
MATACAAVSAVAVPVASVANHIASSSSGTPSLAIPRSYEGLNKSFGARIAPRSTSAFRKPVTGVSLKQFSKGKVASARCASPLVGNVAPDFEAEAVFDQEFVKIKLSEYIGKRYVVLFFYPLDFTFVCPTEITAFSDKHEEFEKLNTEVIGVSTDSVFSHLAWIQTDRKSGGLGDLKYPLVSDLTKKIAEDFGVLIPDQGIALRGLFIIDKEGVIQHATINNLAIGRSVEETLRTLQAVQYVQENPDEVCPAGWKPGEKTMKPDTKLSKEYFAQV

SEQ ID NO: 8239 - protein, 289 aa, Brucella suis 1330
MNIFLFGAGYSTQAFARRMAGEAGRIDGTTRHEQKFPLLEAAGIAPILFDGETPSPELLEKLVRSSHIVISISPNESGDPAVAVVEEALCRRDNTIRWIGYLSTVGVYGDHQGEWVNETTACKPVSRRSLERVKAEEAWTQLSKRHGTPLAILRLSGIYGPGRNAFINLERGTARRIVKAGQVFNRIHVEDIAGSLRLLAGTNADGIFNITDNEPAPPQDVVAYAAELMGVTPPPALPYEEADMTPMARSFYGENKRVSNERIKTLGYEFTYPDYKTAFSAMWAADNWR

SEQ ID NO: 8240 - protein, 441 aa, Haloferax mediterranei
MQTSEPEGSSPNTAEAASQSSEPKPASESALETARRQLYRAADHLDIDPNVVERLKHPEAVHEVTVPIERDDGSVSVYTGYRAQHDSVRGPYKGGLRYHPGVTRDECVGLRMWMTWKTEVRRDGPIFGGAKGGIAVNPKDLTLDEKERLTRRFTQEIRTIIGPMKDIPAPDMGTDPQTMAWVMDAYSMQEGETVPGVVTGKPPIVGGSEGRDTAPGRSVAIIAREAIDYLSWDIEDTTVAVQGFGSVGAPAARLLDDYGANVVAVSDVNGAIYDPDGLDTHAIPTHEEEPEAVMTHDAPETFSNEELLELDVDVLIPAAVGNVLTAENADDVQANLIVEGANGPTTSAADANFAERGVPVIPDILANAGGVTVSYFEWLQDINRRTWSLERVHDELETEMLNAWSVVRDEYESRDVPWRDAAYIVALSRIAAAHDARGLWP

SEQ ID NO: 8241 - protein, 285 aa, Rhizobium leguminosarum bv. viciae 3841
MRVSDLFIYPLKSARGIALPAADIDAYGLPDDRRAMITDAQGHFITQRELPDLARIEARPEASAFRLLMQGKTDISVEPPQPEARMDVIVWKSAVNAAVADPESNRQLSEWLGREVRLVFFDGQARRTANAEWAGEATPVTFTDGYQILVTTTGSLKALNADLAAHGEGGVGMERFRPNIVIDTDEAWAEDRWAAIEIAGIRFDLVKPCSRCIMTTQDQLTGSREGPNPMPAMGRIRMSADRRVPGPLFGWNVTPRGSGRITIDDTVRIVEERPEGWALKRRAAA

SEQ ID NO: 8242 - protein, 280 aa, Streptococcus pneumoniae TIGR4
MNTYQLNNGVEIPVLGFGTFKAKDGEEAYRAVLEALKAGYRHIDTAAIYQNEESVGQAIKDSGVPREEMFVTTKLWNSQQTYEQTRQALEKSIEKLGLDYLDLYLIHWPNPKPLRENDAWKTRNAEVWRAMEDLYQEGKIRAIGVSNFLPHHLDALLETATIVPAVNQVRLAPGVYQDQVVAYCREKGILLEAWGPFGQGELFDSKQVQEIAANHGKSVAQIALAWSLAEGFLPLPKSVTTSRIQANLDCFGIELSHEERETLKTIAVQSGAPRVDDVDF

SEQ ID NO: 8243 - protein, 109 aa, Glycine max
VPSIVKESGRAQVVGADGSRFLEPTLKAGNLFIVPRFFVVSKIAASDGLEWFSIIPTPNPVFTHPAGSIGAWKALSPPVLQASFNVDAGLEQLFRSKKNADAIFFPPPN

SEQ ID NO: 8244 - protein, 500 aa, Triticum aestivum
MKLRLRSMDARGGVAETHRVQLPDTAVLADVKSFLAAKLSAAQPVPAESVRLSLNRSQELCSPDPSATLAALGLASGDLLYFTLSAELLSQPPPPQTLPRNPSPDTASIGQIASGSQSPGEAGGSSSPPQNLHIQPVSSSLPQNLHIEPISSPRPRALHVEPILPVASDPPDVVMAEAVHAPKSLSSLVIGILKREMEAEDAGCANGTVIHRLAVSLQAALVDAGFLAENPMGSRPGLLKDWASGAAATLTVKYTLPELVAMLPEGEEGKTVVLNCSLMPNFVMIYGCVPGACSEVRRLCLELPKLAPLLYLDSNEVGATEEKEILELWRVLKDELCLPLMISLCQLNGLRLPPCLMALPGDLKAKVLEFVPGVDLARVQCACKELQDLAADDNLWKMRLELEMSPSSKGSGWSGDWKQRFVAAWKVDNSRRHHKRPPSPRFSGYGWGIGTRNPLNFPVIGGDSDRLPFINHNILGRSFGNQRRNISPNCNFEGHRQGFP

SEQ ID NO: 8245 - protein, 1068 aa, Arabidopsis thaliana
MLRILKLSTSSRSVPLTRLWLLQLPCFCSSSSSSSSLLSVPSDDHIVRLILDQKSASGALETFRWASTFPGFIHSRSTYRALFHKLCVFRRFDTVYQLLDEMPDSIGLPPDDAIFVTIIRGFGRARLIKRVISVVDLVSKFGIKPSLKVFNSILDVLVKEDIDIAREFFTRKMMASGIHGDVYTYGILMKGLSLTNRIGDGFKLLQIMKTSGVAPNAVVYNTLLHALCKNGKVGRARSLMSEMKEPNDVTFNILISAYCNEQKLIQSMVLLEKCFSLGFVPDVVTVTKVMEVLCNEGRVSEALEVLERVESKGGKVDVVACNTLVKGYCALGKMRVAQRFFIEMERKGYLPNVETYNLLIAGYCDVGMLDSALDTFNDMKTDAIRWNFATFNTLIRGLSIGGRTDDGLKILEMMQDSDTVHGARIDPYNCVIYGFYKENRWEDALEFLLKMEKLFPRAVDRSFKLISLCEKGGMDDLKTAYDQMIGEGGVPSIIVSHCLIHRYSQHGKIEESLELINDMVTRGYLPRSSTFNAVIIGFCKQDKVMNGIKFVEDMAERGCVPDTESYNPLLEELCVKGDIQKAWLLFSRMVEKSIVPDPSMWSSLMFCLSQKTAIHVNSSLQDIIQNRDMSCSSSSGSEEDDEGFDAYRKGGYHAVRIGDQFAGGRYIAQRKLGWGQFSTVWLAYDTRTSNYVALKIQKSALQFAQAALHEIELLQAAADGDPENTKCVIRLIDDFKHAGPNGQHLCMVLEFLGDSLLRLIKYNRYKGMELSKVREICKCILTGLDYLHRELGMIHSDLKPENILLCSTIDPAKDPIRSGLTPILEKPEGNQNGTSTMNLIEKKLKRRAKKAAAKISGRRVSIVGLSETPKKNKRNLDGIDMRCKVVDFGNGCWADNKFAEEIQTRQYRAPEVILQSGYSYSVDMWSFACTAFELATGDMLFAPKEGNGYGEDEDHLALMMELLGKMPRKIAIGGARSKDYFDRHGDLKRIRRLKYWPLDRLLIDKYKLPEAEAREFADFLCPIMDFAPEKRPTAQQCLQHPWLNLRTQNNEDDIEGQMSNMQIKGSCS

SEQ ID NO: 8246 - protein, 209 aa, Bacillus thuringiensis serovar konkukian str. 97-27
MKTSEWIDISQPLNNDIATWPGDTPFSYEVSWSKEESGSVNVGKLTMSIHTGTHIDAPFHFDNNGKKVLDLDIQVYVGPTRIIDVSNLESIGKKELEKFHLEGVERLLLRTSSHGKANEFPDIIPHLRADIAPFLSEKGIRLIGVDVPSVDPLDDKELAAHHQLFKHGIHILENVVLDHVADGDYELIALPLALSDADGSPVRAVIKPI

SEQ ID NO: 8247 - protein, 264 aa, Erwinia carotovora subsp. atroseptica SCRI1043
MAISIKTSEDIEKMRVAGRLAAEVLEIIEPYVVPGVSTGELDRICHDHITNKQQAISASLGYHGFPKSVCISINEVVCHGIPSEERILKDGDIVNIDVTVIKDGFHGDTSKMFIAGKPTILGERLCRITQESLYLALKMVKPGIRLRTLGKAIQQFAEGNNFSVVREYCGHGIGKGFHEEPQVLHYDADDGGVVLQAGMAFTIEPMLNAGDFRIRTMKDGWTVKTKDRSLSAQYEHTIVVTENGCEIMTLRKDDTIPNIITHEQ

SEQ ID NO: 8248 - protein, 588 aa, Vibrio campbellii AND4
MHWTFNRLVTASLLLTSPLLTPTTASANQAADTVAPEQSTGLEQKQLVKAQDYMVTAANPLATQAGADVLAEGGNAIDAMVVVQLMLGLVEPQSSGIGGGAFLVYWDSKKQQLTTYDGRETAPLAATPKLFLDDKGQPLQFYDAVVGGRSVATPGTVRLLWDTHQKYGKLEWKKIIQPVIALAKQGFEISPRLASLIEKDAKRLSRFPATKAYFFNPDGSAKAKGTLLKNPEYAQTLTEIAQQGAKAFYQGDIATDIIKTVQSAPGNPGVLAQPDFDAFQIKQREPVCAPYHNYDVCGMGPPSSGALTVGQILAITEQYDLKGWGPGSAKSWQVIADASRLAFADRGKYMADQDYVPMPTKGLLDKKYLKQRATLIQVGKALSKVEAGNPPWSHTMNLSMDQSIELPSTSHFNIVDKQGNVVSMTTTIENAFGSRLMVRGFLLNNELTDFSFRTHQDGVPIANRLEPGKRPRSSMAPTIMLKDKKPYMAIGSPGGSRIIGYVAQAIIAHTQWDMDIQSAINQPRLLNRFGTLDIEQGTAVESLQPELDKMGFKTHVRDLNSGLHAIRISQGGLEGAADPRREGVAVGQ

SEQ ID NO: 8249 - protein, 466 aa, Pyrococcus horikoshii OT3
MVSMTKWDEIRKYTSKKIEKNLEIVKLDEKYIPRASGFKYYPMVIERSSGSRIWDKDGNEYIDFLTSAAVFNVGHTHPGVVKAVEEQIKKFFNYTMGYLYVEPPVRLAELLVEITPGNFEKKVTYGFSGSDAVDSSIKAARAYTKRVNIISFLHSYHGMTYGALSATGILDPKLKKLLHPMGNFHHVEFPDPYRNSWGIDGYEDPSELANRALDEIERKIKELNEDVAGIIIEPIQGDAGVVIPPEEFVRDLKKLTEEYGIVFIDEEVQTGMGRTGRWWGIEHFGVTPDLIVSAKALGGGMPISAVVGKAEIMDSVPVPFFVFTHIGHAVNASAAIATINVIKEEKLVERSEKLGEYMLKRLRELQETYPIIGDVRGKGLLIGVDIVKEGTREPDRSLAQKISWRAWEKGLIMITFGKHGNVLRIAPPLNIPQEDLDKGVEIIEESIKDAVEGKIPDEVLKFLRAW

SEQ ID NO: 8250 - protein, 873 aa, Candida glabrata CBS 138
MVSVLVSTKGFNPAKFKQASKLLNKSTVGFLSTSAKNKYSLQSKVQNIKNSEVPKTFTRSKVGFSKRSLSSSNGIGTSGTRSTVIQLLNNISTKREVEQYLKYFTSVSQQQFAVIKVGGAIISDNLPELASCLAFLYHVGLYPIVLHGTGPQVNGRLEAQGIEPDYIDGIRITDEHTMAVVRECFLEQNLKLVTALEQLGVRARPITSGVFQAEYLDKSKYQLVGDITKVNKDAIEASIKAGALPILTSLAETPSGQMLNVNADVAAGELARVFEPLKIVYLNEKGGIINGETGERISMINLDEEYEDLLKQSWVKYGTKLKIKEIKELLDYLPRSSSVAIINVQDLQKELFTDSGAGTMIRRGYKLLKRSSLSEFQSADALRNVLQRDADIASKAQSAATYLRELEKAQFVSYSDEPLEALAIVRTEPKIPKLEKFLCSNSAWLNNVTDNVFSTLKRDFPALQWIVSEDDANIAWHFDKSQGSYLKDGKVLFWYGVKDLNTVSELIGEFTKGVTNSGHSSGVFGSQQAKRAYSTVRRTPPKPEATNTSPARVALIGARGYTGRNLVALIDSHPYFEISHVSSRELKGQKLPDYKKAEIIYDNLQIEDIKKLESENAVDFWVMALPNNVSEPFIEAIDSCNGKSKIIDLSADHRFVSEEEWAYGLPEINDREHIYKAKKISNPGCYATGSQLSIAPLLKYVDGLPTVFGVSGYSGAGAKPSPKNDPENLNNNIIPYALTNHIHEREISTRLGHEVAFMPHVGQWFQGIALTVSIPIKKGSIQSNEEAMNIYKDFYKGENLVHIMEDIPSVKEIAGTHGVVIGGFKLNDNKDRIVVCGTIDNLLKGAATQCLQNMNLAMGYGEYDGIPKDKIVS

SEQ ID NO: 8251 - protein, 327 aa, Mesorhizobium loti MAFF303099
MGLLVEGRWQDRWYDTADNGGRFVRTQSQWRDWITVDGAPAEGRTRGFKAEPGRYHLYVSLACPWAHRTLIFRALKRLEGIISVSIVHHFMGPNGWTFLAEDGATGDTLYGLDFLHQIYSKADPAYSGRVTVPVLWDKKEQTIVSNESSEIIRMLNSAFDAWGDASLDFYPEDLRNEIDRVNALVYPTVNNGVYRAGFATTQRAYEEAFGELFAALDRLEERLSKQRYLVSDRITEADWRLFTTLVRFDPVYVGHFKCNLRRIADYPNLSNYLRDLYQLPGVAATVNLHHIKAHYYGSHETINPTRIVPVGPELDYGAPHDRARFAI

SEQ ID NO: 8252 - protein, 496 aa, Pseudomonas putida KT2440
MVAGLLERLGVAAEAYTQGDYPVHTPIDGSQIASVKLLGKAETIARIDQAQSAFEAWRSVPAPRRGELVRLFGEVLREHKADLGELVSIEAGKITQEGLGEVQEMIDICDFAVGLSRQLYGLTIASERPGHHMRETWHPLGVVGVISAFNFPVAVWAWNTALALVAGNSVVWKPSEKTPLTALACQALFEKALKAFGDAPAGLAQLVIGGREAGEAMVDDPRVPLVSATGSTRMGREVGPRVAARFGRSILELGGNNAMILAPSADLDLAVRGILFSAVGTAGQRCTTLRRLIVHRSIKDEVVARVKAAYGKVRIGDPRKDNLVGPLIDKQSFDAMQGALAKARDEGGQVFGGERQLADQYPNAYYVSPAIAEMPAQSDVVRHETFAPILYVLAYDDFEEALRLNNEVPQGLSSCIFTTDIREAERFQSASGSDCGIANVNIGTSGAEIGGAFGGEKETGGGRESGSDAWKGYMRRQTNTVNYSRELPLAQGIVFD

SEQ ID NO: 8253 - protein, 345 aa, Zea mays
  misc_feature (159)..(159): Xaa can be any naturally occurring amino acid
MDEASTSASGAAIRRGFVPARSGVFFYRFTQQNLPAWKPAMTPGCIIAMFLIIGIIFIPFGLLCLQTSNHIAEIIYRYDVDCVPDAYRGNRQAYIKDSSISKNCTLEAKVLEYMRAPIYVYYELENFYQNHRRYVKSRSDKQLRFGAKYTADSCSPVEXNNGSPIVPCGLLAWSLFNDTYGFTRGSKEIKVNRKNISWKSDREHKFGKHVFPSNFQNGTLIGGGKLDPTVPLSEQEDLIVWMRTSALPKFRKLYGVIEDDLHADETIAIFVGNNYNTYTFGGKKSIVLSTASWLGGKNDFLGHAYIVTGSLSIIISILFALIHVKYPRPQGDPNCLSWNRKNSNS

SEQ ID NO: 8254 - protein, 438 aa, Hypocrea jecorina
MGQTLSEPVVEKTSEKGEDDRLIYGVSAMQGWRISMEDAHTAELNLPPPDNDTKTHPDRLSFFGVFDGHGGDKVALFAGENIHNIVFKQESFKSGDYAQGLKDGFLATDRAILNDPKYEEEVSGCTACVTLIAGNKLYVANAGDSRSVLGIKGRAKPLSNDHKPQLETEKNRITAAGGFVDFGRVNGNLALSRAIGDFEFKKSAELSPENQIVTAFPDVEVHELTEEDEFLVIACDGIWDCQSSQAVVEFVRRGIAAKQDLDKICENMMDNCLASNSETGGVGCDNMTMVIIGFLHGKTKEEWYDEIAKRVANGDGPCAPPEYAEFRGPGVHHNYEDSDSGYDVDADSGGKFSLAGSRGRIIFLGDGTEVLTGSDDTEMFDNADEDKDLASQVPKSSGKTDAKEETEAKPAPEAESSKPADGSEKKQDEKTPEESKKD

SEQ ID NO: 8255 - protein, 206 aa, Brucella suis 1330
MSRTLVLVRHGQSEWNLKNLFTGWRDPGLTEQGHAEAKAAGQRLKAAGLKFDIAYTSALSRAQVTCQHILDELGQPGLETIRDQALNERDYGDLSGLNKDDARAKWGEEQVHIWRRSYDVPPPGGESLKDTGARVWPYYLHTIQPHVLREETVLVAAHGNSLRALIMALDGLTPEQILKQELNTGVPIIYRLNADSTVASKEILSA

SEQ ID NO: 8256 - protein, 161 aa, Leptospira interrogans serovar Lai str. 56601
MKHILKILVNNHPGVMSHVSGLFTRRSYNIDSIAVGVTVNPEISSMVIVVKGDEATVDQVKRQLLKLPDVLEVEDLAYHDCVSRELVLLVVKLTETTRTEILSVCEVFEAKIADLTHSSLTIEYSGNSRKVNAIVEIMSKYGIEEIVRTGQIAIRYRSVGS

SEQ ID NO: 8257 - protein, 460 aa, Erwinia carotovora subsp. atroseptica SCRI1043
MTDKVRIDSLGANSLNGNNETYLARQAEFESNVRSYPRKLPLAIAKAEGVWITDVENNQYLDCLAGAGTLALGHNHPDVLQSIQRVITSGLPLHTLDLTTPLKDQFSEYLLSLLPGQGKEYCLQFTGPSGADAVEAALKLAKKYTGRSGVISFSGGYHGMTHGALSVTGNLSPKEAVDGMMPEVQFMPYPHQYRCPLGIGGDAGVKALTYYFENLLNDVESGVRKPAAVILEAVQGEGGVNPAPAEWLQRIRKVTQEHGILLIIDEVQAGFARTGKFFAFEHAGIEPDIIVMSKAVGGGLPLAVLGIKKQFDAWAPGHHTGTFRGNQLAMATGLTTLMHLKDNQVADKVAEQGEWLKAKLAELQKRYPVIGHIRGLGLMIGIEMVKPGEAQDHMGCYPADGDLSALLQKKCFESGLILERGGRNGCVLRLLPSLLISNAELEIFLDKFENALLSAGVKPV

SEQ ID NO: 8258 - protein, 176 aa, Burkholderia vietnamiensis G4
MSSRRIAVRRSGIHGKGVFAVEPIKAGERVVEYKGERISWKEALRRHPHDPNDPNHTFYFALEDGGVIDGKVNGNSARWINHSCTPNCEAEEIKGRVFVHALRDIEPEEELFYDYGLVIDEKLTKKLKREYACHCGAETCRGTLLATPDDDGKKKKKKDKKDGKAESGAKDKKKKK

SEQ ID NO: 8259 - protein, 254 aa, Nostoc punctiforme PCC 73102
MLSILRADFRIIFERDPAARNWLEVLFCYPGLQALLFHRLAHWLYTVGLPFIPRLISHLARFLTGIEIHPGAVIGKSVFIDHGMGVVIGETTIVGDYALIYQGVTLGGTGKECGKRHPTVGENVVVGAGAKVLGNIQIGNNVRIGAGSVVLRDVPSDCTVVGVPGRIMYRSGVRVSPLEHNNLPDSEAQVIRALVDRIEALEEQIQTLQRTNSSEKTPVLVGCLATKEDEPTHDPRWCNLKDKTIQQFLDGAGI

SEQ ID NO: 8260 - protein, 184 aa, Onion yellows phytoplasma OY-M
MNILHDINPERITKEEFIVVIEISQGSKKKYEIDKETGLLLLDRFLTTAFRYPINYGFVPLTHCEDNDPLDVLVLSQEILDPMTLVKCRPLGVIKMIDNDELDEKVIAVPVFDKYFSHLQDLKDMPLPMIAEIKHFFENYKALEKKKVVIEAIQDKQAAFSAIETSLLTYQKVIKPSLKKEKKQ

SEQ ID NO: 8261 - protein, 444 aa, Solanum lycopersicum
MATIKSIKARQIFDSRGNPTVEVDVHISNGVFARAAVPSGASTGIYEALELRDGGSDYLGKGVSKAVNNVNSIIGPALVGKDPTDQTGLDNFMVHQLDGTQNEWGWCKEKLGANAILAVSLAVCKAGAAVRNVPLYKHIADLAGNKKLVLPVPAFNVINGGSHAGNKLAMQEFMILPVGAANFKEAMKMGCEVYHHLKAVIKKKYGQDATNVGDEGGFAPNIQENKEGLELLKTAIEKAGYTGKVVIGMDVAASEFYGKDKSYDLNFKEESNDGSQKISGDQLKDLYKSFVSEYPIVSIEDPFDQDDWETYAKLTAEIGEQVQIVGDDLLVTNPKRVAKAIAEKTCNALLLKVNQIGSVTESIEAVKMSKKAGWGVMTSHRSGETEDTFIADLAVGLSTGQIKTGAPCRSERLAKYNQLLRIEEELGSEAVYAGASFRKPVEPY

SEQ ID NO: 8262 - protein, 565 aa, Francisella tularensis subsp. tularensis SCHU S4
MKKYITGEKLFDTSKHATNVAEYIVARLVDLGITHSFCIPGDFSFALDCALINNPKLNNIVNANELNASYAADGYARVKGAAILSTTYAVGELSALNGVMGSKAENLVVFHLVGSPGDGAVGKKRQVYHTLGDGVFGNFFDLSASAACVSAVITPENARREMNRVIAEAFKYRKPAYISVSLDSGNRPVTDITPDDIDCSYLKSESHQLELATNLVLEHLSKAKKVVAIPAIKLDRFGVTEKAINLIEKLNIPFSIMPHDKSVISETHPNYVGFYAGLLSDTNTAEIVEGSDLIINLGDALWSDFNTAGFTNNLDLNKVLNLGPLFVEDNKTYLADVYLSELLDALLEKVESINYRPNYSRMKIQDTTITKEKLTLRALYTQVLKFLENTDSLVVETGSSSLNMPKLPLPEGVKYFNQTLWGSIGWATPAALGVALANPDSRTILITGEGSHQLTLNELGVMGRYKINPIILYINNDGYMIERALELDPNPSYDDIAQLNYTKLPEAFGCNDWLAIRVKTSEELAEALKKAREHQSGVYIEVITGKYDYGNALDFFNNHLKEMYS

SEQ ID NO: 8263 - protein, 517 aa, Candida glabrata CBS 138
MFSRTITRTLRAPAVLRLYSTNVPLEVPVTLPNGIKYMQPTGLFINGEFVKSHEGKTFDVLNPSTEETIATLYEAQAADVDIAVKAAKEAFENHWSREDPEVRARALFNLADLVEANLETLAGIDSLDNGKSLLCSRADVALVAKYLRSCGGWADKIYGDVIDTGKSHFTYSVKEPLGVCGQIIPWNFPLLMWSWKIGPALATGNTVVLKPAELTPLSALFASKLCQEAGIPAGVVNIIPGPGKTVGERICTHPDIKKVAFTGSTATGSRIMKTAADSIKKVTLELGGKSPNIVFADADLEQAVENIAHGIFFNSGEVCCAGSRIYVQDKCYDEVLDRLKKYTESLKVGNPFGDNTYQGSQTSQQQLDKILEYVDIGKQEGARIVTGGERIGEKGYFFKPTVFADVKENMRIVKDEIFGPIVTVSQFSTVDEVIAMANDSQYGLAAGIHTNDVNKAVEVSSRLKAGTIWINTYNAFHQNVPFGGFGQSGIGREMGSAALDNYTQVKSVRMAITKPRV

SEQ ID NO: 8264 - protein, 1487 aa, Arabidopsis thaliana
MSSNCSCSLLSLFSLLLIIDLTVASSCPKTCGGIDIPYPFGIGTGCYLEKWYEIICVNNSVPFLSIINREVVSISFSDMYRRFFNVGYGSIRIRNPIASKGCSSGGQEFGSLLNMTGYPFYLGDNNMLIAVGCNNTASLTNVEPSIVGCESTCSTNQDIPINDYLGVLYCNARYGDSEYCKNISIMNDTSCNGIGCCKASLPARYQQIIGVEIDDSNTESKGCKVAFITDEEYFLSNGSDPERLHANGYDTVDLRWFIHTANHSFIGSLGCKSIDEYTILRRDNREYGIGCLCDYNSTTTGYATCSCASGFEGNPYIPGECKDINECVRGIDGNPVCTAGKCVNLLGGYTCEYTNHRPLVIGLSTSFSTLVFIGGIYWLYKFIRRQRRLNQKKKFFKRNGGLLLQQQLTTTEGNVDSTRVFNSRELEKATENFSLTRILGEGGQGTVYKGMLVDGRIVAVKKSKVVDEDKLEEFINEVVILSQINHRNIVKLLGCCLETDVPILVYEFIPNGNLFEHLHDDSDDYTMTTWEVRLRIAVDIAGALSYLHSAASSPIYHRDIKSTNIMLDEKHRAKVSDFGTSRTVTVDHTHLTTVVSGTVGYMDPEYFQSSQFTDKSDVYSFGVVLAELITGEKSVSFLRSQEYRTLATYFTLAMKENRLSDIIDARIRDGCKLNQVTAAAKIARKCLNMKGRKRPSMRQVSMELEKIRSYSEDMQPYEYASENEEEKKETLVDVNVESRNYVSVTAASSQYSIATTSSSRDCFLNDWYEVVCNSTTSGKSLAPFLYKINRELVSITLRSSIDSSYGVVHIKSPVTSSGCSQRPVKPLPLNLTGKGSPFFITDSNRLVSVGCDNRALITDIESQITGCESSCDGDKSRLDKICGGYTCCQAKIPADRPQVIGVDLESSGGNTTQGGNCKVAFLTNETYSPANVTEPEQFYTNGFTVIELGWYFDTSDSRLTNPVGCVNLTETGIYTSAPSCVCEYGNFSGFGYSNCYCNQIGYRGNPYLPGGCIDIDECEEGKGLSSCGELTCVNVPGSWRCELNGVGKIKPLFPGESMEFFSRFQSHITEQKRVMIFIVFFRPCAGLVLGFPLLFLVLGIWGLIKFVKKRRKIIRKRMFFKRNGGLLLKQQLTTRGGNVQSSKIFSSKELEKATDNFNMNRVLGQGGQGTVYKGMLVDGRIVAVKRSKVLDEDKVEEFINEVGVLSQINHRNIVKLMGCCLETEVPILVYEHIPNGDLFKRLHHDSDDYTMTWDVRLRISVEIAGALAYLHSAASTPVYHRDVKTTNILLDEKYRAKVSDFGTSRSINVDQTHLTTLVAGTFGYLDPEYFQTSQFTDKSDVYSFGVVLVELITGEKPFSVMRPEENRGLVSHFNEAMKQNRVLDIVDSRIKEGCTLEQVLAVAKLARRCLSLKGKKRPNMREVSVELERIRSSPEDLELHIEEEDEEECAMEINMDDSWSVDMTAPASLFDLSPKLDVEPLVPQRTW

SEQ ID NO: 8265 - protein, 77 aa, Triticum aestivum
KQEGAEAVYACCTHAVLSPPAIERLSGGIFEEVIVTNSILLPEDKCFPQLTVLSMANLVAETIWHVHRDGSVSSIFQ

SEQ ID NO: 8266 - protein, 341 aa, Mycobacterium tuberculosis H37Rv
MAANKREPKVVVLGGGSWGTTVASICARRGPTLQWVRSAVTAQDINDNHRNSRYLGNDVVLSDTLRATTDFTEAANCADVVVMGVPSHGFRGVLVELSKELRPWVPVVSLVKGLEQGTNMRMSQIIEEVLPGHPAGILAGPNIAREVAEGYAAAAVLAMPDQHLATRLSAMFRTRRFRVYTTDDVVGVETAGALKNVFAIAVGMGYSLGIGENTRALVIARALREMTKLGVAMGGKSETFPGLAGLGDLIVTCTSQRSRNRHVGEQLGAGKPIDEIIASMSQVAEGVKAAGVVMEFANEFGLNMPIAREVDAVINHGSTVEQAYRGLIAEVPGHEVHGSGF

SEQ ID NO: 8267 - protein, 407 aa, Triticum aestivum
MADPSFSSPTAASAGDALPAPAASDAPEVTLPAAAPDLDKEFGFQRAELGKEKLAGTVGFHERHVFLCYKGPEEWPSHVEASESDHLPRLLAAAIKARKPNLKKSTKLTICEGEDGTESSLGDVLIFPDMIRYRELTHLDVDNFVDEVLVKDTEWLPGSPEAIKGSYVFVCCHGSRDKRCGVCGPALITRFKEGIEGQGLHGQVAVSACSHVGGHKYAGNVIIFSPDAKGEVTGHWYGYVAPDDVPVLLRQHIGQGEIVGHLWRGQLGLSEEQQKKALELRHATNGLTEEESSAKESPEANGANGAACNPAPAGGCCQGNGGGLTCCQSDVPEAKQDKNIPAEQNHKSSTTESDKENGAASKKGRMKICRTPTWFETWDRSDTYTTLAVVASAATVFAAFRCYKAMN

SEQ ID NO: 8268 - protein, 449 aa, Zea mays
MGNGGGTGDKTKTKATGGLTGRESSSSSHASKRRRGLRGESMADRFIPNDFPDFVAEAEASDGEGHRPAGHRGLLSLPYTRLSDHFVRAARRLKDKVVEETWVKAGRKVTDYTLYTGSLGTALLLFKSFQVTGDRGDLALAADIVRACDDASRGLPFLTFICGRAGVCALGAVIAKHCDDQLRVTQYLSSFDEITITEKVPNELLYGRAGYLWACLFLNKHLSEKTIPLDHINSVAKDIINEGRGFASKGSSPLMYEWHGKKYWGAAHGLAGIMHVLMHTELKPDEQDDVKNTLRYMIKNKFPSGNYPSSEGNESDHLVHWCHGAPGVALTLAKAYEVFHDDYFEQSAAEAAEVVWNRGLLKRVGICHGVSGNAYAFLSLYRLTGNVEYLYRAKAFACFLLEKADQLIAEGAMHGGDRPFSLFEGKAGMSYLLLDMVDPSESRFPAYEL

SEQ ID NO: 8269 - protein, 466 aa, Brucella suis 1330
MPIEAKPEVRTTFERLRQAWLENRPAYEQRMDDLKRLREAFTMRLDEMAKAISADFGNRSQHETLLAEANIVFAEIDDALHHLKRWMKPKRRKAGWKMWPAKAEIRYVPLGVIGVIAPWNYPVNLALAPLVAAIAAGNHVFLKPSEHTPRTAAFLKSLLADVFPEDRVAVALGDAALSAQFSALPFDHLFFTGSTAVGRKVMAAAAQNLTPVTLELGGKSPAIISENANLKRAARAIATGKFFNAGQTCIAPDYVLVHHSKRDEFVALLRAEMEARYSSPSAEKDRTTIINEAQEMRLAGLLADAGEKSEAIIELLPLTERTRLMPPALVMEPTPDSAIMREEIFGPLLPVISYRLLDDAIAHVLKHDRPLALYCFSDNTAEIDMMLGRIIAGGVCVNDTLYHFSCSDLPFGGVGASGMGQYHGYDGFLTFSKAMPVLTKYAPTASDLIKPPYTGLTERLIRFIVR

SEQ ID NO: 8270 - protein, 383 aa, Xanthomonas campestris pv. campestris str. ATCC 33913
MRILVTGGTGYIGSHTCVELARRGHEICIVDNLSNSSERVLDHLAHLIGARPAFHCMDVRAPELAELMQRERIEAVIHFAALKAVGESVREPLRYFNNNVTGTLALLRAMRSAGVANLVFSSSATVYGDENSSPIEEHAPLKAINPYGRTKLMMEEMIGDLSAAWPQFNAALLRYFNPVGAHPSGYLGEDPRGVPNNLMPYIAQVAVGRRDALQVFGDDYPTPDGTGVRDYLHVMDLARAHVDAIEYLHHERQGLVVNLGTGRGHSVLEVAAAFERASGRRIPLQFAPRRDGDVAVYYASTALANRLLGWKAQYDLERMCADTWRWQSLHPEGYAQSRLVRPRATAPMGERVAPLRKLLPGSDGRRRHEPARALLPAHGHSGA

SEQ ID NO: 8271 - protein, 177 aa, Pyrococcus horikoshii OT3
MRFKVSKLMAYILRHSPWEFGLEPDEEGFVSIEELVNAVRKVYPWVTEEYIREIVERDEKGRYEIRGNKIRARYGHSYPVILRHEEDKESKVLYHGTVRRNLKGIMREGIKPMKRQYVHLSINYEDAYNTGRRHGEDVVVLIIDAECLRNKGYKILKAGKKVRIVKHVPVDCISGIL

SEQ ID NO: 8272 - protein, 371 aa, Physcomitrella patens subsp. patens
MESTAELVEFPLLKQWVDYTYRPCTIPWRFPSDKPHQATPTEILWIELFRKSIPSFRKQAELDSTVTDAPAKAAKFALRYGEILDDMLADPESHGGPPDCILLTRLRDVVLREVGFYDIFRKVKDDENAKALALLEGVIAQADAIKDVGARIDHLVKGVFSGNIFDLGAAQLAEIFESTGSNFQDSFEKLLPRPWVLDDLDIFKQKWICKPWKKAVIFVDNSGSDVVLGVLPFARELLRRGTKVVLAANDMPSINDITYEELVQVISKAKHVTSDGKESFYGVDAQHLMVLNSGSDLPVLDLSHISPELAYAAEDADLVVMEGMGRGIETNLYAQFKCDSLNIGMVKHKEVADFLGGRLYDCVIKFTEAIP

SEQ ID NO: 8273 - protein, 412 aa, Carboxydothermus hydrogenoformans Z-2901
MADFKAKALELHKKFRGKIEVKSKVPAKTAEDLSLAYTPGVAEPCKLIAENKDLSYEYTSRWNMVAVVSDGTAVLGLGDIGPYAAMPVMEGKALLFKEFAGVDAFPICLDTKDPDKIVEVVKLLEPTFGGINLEDIAAPNCFYIEERLKKETSIPIFHDDQHGTAIVTLAALINALKIVNKDISKIKVVVNGAGASATAVSKLIMASGVKNLIMCDSKGIIYRGRQEGMNKYKEELAQITNPENIKGTLKDALKGADVFIGLSKAKQVTEEMVKSMNKDAIVFAMANPEPEIYPDEAKRAGARIVATGRSDFPNQVNNVLAFPGVFRGALDVRATDISEKMKIAASYAISSLVAENELNEDYILPKAFDARVASTVAREVAKAALEEGIARIKISPDDVFKHTLELLEKSGS

SEQ ID NO: 8274 - protein, 506 aa, Ralstonia eutropha JMP134
MSFSELGLSDKLVRAVAEQGYTTPTPIQAQAIPAILKGGDLLAGAQTGTGKTAGFTLPMLQLLSESAPQRQGKPAVRALVLTPTRELAAQVEESVRNYGKYVRLRSMVMFGGVGINPQIEQLRRGVEIVVATPGRLLDHVSQRTIDLSSVELLVLDEADRMLDMGFIHDIRKILNVLPPKRQNLLFSATFSDDIRALADRLLNNPASIEVARRNTTAETVAQRVYPVDRERKRELLAHLVREHDWHQVLVFTRTKHGANRLAEQLTKDGLSALAIHGNKSQSARTRALSEFKAGTLRLLVATDIAARGIDIDQLPHVVNFDLPNVPEDYVHRIGRTGRAGAEGEAISLVCVDEHGLLRDIERLIKRKLEQTVLTGFEVDPTIAAEPIQKGRQQRGGGQGGGQGGGRGRAQAKPAAPAAAKPSQGQPRQRPAQNAPRGASQAGGEAARGHGGANRNAGQAQPRNPQRNGGGQARPAQDATGAPARNNNRRPASQAALLGGARAKPAR

SEQ ID NO: 8275 - protein, 640 aa, Carboxydothermus hydrogenoformans Z-2901
MEKKGLSHTAYGGIPGDQYEPYVPPTTRLPEMTVVSLIMGILLALLFGATNTYLGLKVGMTVSASIPGAVIGTAIIRGLLRKQNILETNIIQAIGSAGESIASGVMFTLPALIIWGFKDQFTLAKIAVVATLGTILGVLFVVPLRKNLTVDEHGILPYPEGMATAEVLVAGQVGGQSASGILWGGLIGGIYKLLSGAFGLFKEEIEWNIPGFKNGVFGFDILASLMGVGFIVGLEIGLYMFAGGLLAWFVLIPLISYFGAGVPNPIFPSTVPIAQMDAWAIWSKYIRYIGAGAVAAGGFISLGRSLPMIINSFKAAMGGLAKGQSGEQKRTNQDISVVAIFFGVLGVFITALIVPQMKVTWMGALSIVLFGFFFAAVSARIAGLVGVSNLPVSGMTIAALLASTLLLKAIGVVGTKGMIAAITTGATICVAISIAGSLAQNLKTGYIIGATPKYVQIGVLIGGIASTIVVGWVILMLNQAYGLGTDKIPAPQATLMSMVVKGVMTGTLPWALVLSGVVIGIILAVLKLPILPVAIGLYLPLHLSTGVLAGGVIRWFIDRAFSGETLKEKVEKGILFSSGLIAGDALMGIVIAFLAYKGLSEKVAIFSKLTIAGNPWWGLAMFVVLGLILYRYVASNKKEA

SEQ ID NO: 8276 - protein, 168 aa, Triticum aestivum
TRLFLARKLSLTRAVFYIIMQCLGAICGAGVVKGFQQGLYMGNGGGANVVAPGYTKGDGLGAEIVGTFVLVYTVFSATDAKRNARDSHVPILAPLPIGFAVFLVHLATIPITGTGINPARSLGAAVVYNQHHAWSDHWIFWVGPFIGAALAAIYHQVIIRAIPFKSRS

SEQ ID NO: 8277 - protein, 315 aa, Mycobacterium bovis
MARLTVITTGGTISTTAGPDGVLRPTHCGATLIAGLDMDSDIEVVDLMALDSSKLTPADWDRIGAAVQEAFRGGADGVVITHGTDTLEETALWLDLTYAGSRPVVLTGAMLSADAPGADGPANLRDALAVAADPAARDLGVLVSFGGRVLQPLGLHKVANPDLCGFAGESLGFTSGGVRLTRTKTRPYLGDLGAAVAPRVDIVAVYPGSDAVAMDACVAAGARAVVLEALGSGNAGAAVIEGVRRHCRDGSDPVVIAVSTRVAGARVGAGYGPGHDLVEAGAVMVPRLPPSQARVLLMAALAANSPVADVIDRWG

SEQ ID NO: 8278 - protein, 269 aa, Brucella suis 1330
MSQQNGNVNRVGAQDRVGASGGMEHSFGFKAVDENEKQGLVNDVFHKVAKRYDIMNDLMSAGMHRVWKDAMVAWLTPSKRPGWTSLDVAGGTGDIAFRIVEVSGRQAHVTILDINGSMLGVGRERAIKKGLIDNLEFVEANAEELPFEDNSFDAYTIAFGIRNVPHIDKALSEAYRVLKPGGRFLCLEFSEVELPVLDKVYDEWSFRAIPRIGKMITGDADSYSYLVESIRKFPKQQDFAAMIEKAGFERVSYRNFTGGIAALHSGWKL

SEQ ID NO: 8279 - protein, 620 aa, Oryza sativa
MAGAFRRSAALQAMAAFSVLALVVPDQVQGRGKCPSFSCGRLSYVHFPFRRQGDPAECGVPSYELTCADSNATIQIDKATYLVTDINYSDQYFWVVDASLDSANNCPLPRWSQTPYNENYRLGEDSHRRVQVQLSPDVDWFATFVKCSQEMNSSNVMYRPVACRSGNSSFVYVLTGLGSYLAENLEPSCGYLAMTPLALGGLENWRTATAAATLEDVNYEDVVRSMSEGFAVRFPFRSGGFIDCLRGLIRFVLVMLLMWTSVAYMYWKIKMRVDEVEKFLQLQQMLTPTRYSYTDIIAITSHYRDKLGQGGYGSVYKGVLLPGDVRVAIKMLKGDANCKGEEFISEVSTIGRIHHVNVVRLVGFCSEEIRRALVYEYMPQGSLDKYIFSSEKSFSWDKLNEIALGIARGINYLHHGCDMQILHFDIKPHNILLDNNFVPKVADFGLAKLYPRDKSFVPVSAARGTVGYIAPEMISRGFGAISSKSDVYSFGMLLLEMAGGRRNADPNAENSSQAYYPSRVYRQLTRQETGEITAAADMHELEKKLCIVGLWCIQMRSCDRPMMSEVIEMLEGGVDCLQIPPRPFFCDDDYIPAMESLYLSSEVELAAISEEEDESITELN

SEQ ID NO: 8280 - protein, 386 aa, Lentisphaera araneosa HTCC2155
MLIHEYQARDLFREYGIPVTEGKVFESLEGVEEYATELGQCVVKAQVHAGGRGKGGGVKFAPTVEKAIEHATNILGMQLITHQTTAEGCKVNKILLCPGLDIAKEYYLALTIDRATQCPFIIASTEGGMDIEEVAESTPEKITKIKVDPSAGCWAYHGRKVADALGFEGKQARIVAAVAQNLYKMFMEKDCSIVEINPLVVTEDNEIYAIDGKVNFDSNALYRQKDIVELRDPLEEEPLEVEASEHDLAYIKLDGNVACMVNGAGLAMATMDMIQISGGSPANFLDVGGTATPARVEQAFRILLKDPNVEGILINVFGGIVRCDLVAEGVIEAVKNIGNIEQPIVIRLSGTNSTEGKKLLAESDLTFETADSLNEAAAKIVAAVKK

SEQ ID NO: 8281 - protein, 276 aa, Candida glabrata
VCFSPDGKFLATGAEDKLIRIWDIEQKKIVMVLKGHEQDIYSLDYFPSGDKLVSGSGDRTVRIWDLKTGQCTLTLSIEDGVTTVAVSPGDGKFIAAGSLDRAVRVWDSDTGFLVERLDSENELGTGHKDSVYSVVFTRDGNGVVSGSLDRSVKLWNLRNVNHNNADGKPTSGTCEVTYTGHKDFVLSVATTEDDEYILSGSKDRGVLFWDKVSGNPLLMLQGHRNSVISVAVNHGHPLGPNYHIFATGSGDCKARIWKYIKTTTEVNSNGKIQPIS

SEQ ID NO: 8282 - protein, 410 aa, Glycine max
MVAMAAATASSQLIFSKPRSPSRLCPFQLCVFDTKQVLSSSSGRRRHVGGSGVRCMAVGEAATTETKKRSGYELQTLTNWLLKQEQAGVIDAELTIVLSSISMACKQIASLVQRANISNLTGVQGAVNVQGEDQKKLDVVSNEVFSNCLRSSGRTGIIASEEEDVPVAVEESYSGNYIVVFDPLDGSSNIDAAVSTGSIFGIYSPNDECLADIGDDPTLDTTEQRCVVNVCQPGSNLLAAGYCMYSSSIIFVLTLGNGVFVFTLDPMYGEFVLTQENLQIPRAGKIYAFNEGNYQLWDDKLKKYIDDLKDPGPSGKPYSARYIGSLVGDFHRTLLYGGIYGYPRDKKSKNGKLRLLYECAPMSFIVEQAGGKGSDGHQRILDIQPTEIHQRVPLYIGSVEEVEKVEKYLA

SEQ ID NO: 8283 - protein, 485 aa, Nostoc punctiforme PCC 73102
MTLAETPNYKNSSNPLLSLNYESALESLGDDYYDEVAAAEFPQHILRWRNDALLPRLGLDPQVVKDEDFITAFGQFQGRKPLLALRYHGYQFGEYNGQLGDGRGFLYGQVRATDGELYDFGTKGSGRTPYSRGGDGMLTLKGGVREVLAAEALHHLGVRTSRCLTMIETGLPLWRGDEPSPTRSSVMIRMSSSHIRFGTFERLHYFQRPDLTKKLLDHVIEQYYRHLSSEQDKYVLFYAELVKRVAELVAQWMAAGFCHAVLNTDNMSITGESFDYGPYAFIPTYNPSFIAAYFDYYGRYCYGNQPSICKLNLQMLQEPLKAILDKDEMEAALERFDEYYQAEYSSLMLKRLGFVELSYPQAAELLNLTVEFLKDSQVGYHQFFYEMARTFSSKWRDEPGFVMNNSDIVPVPGASGIFDDWCILYHKILNDFDSDRIDVIAQTLAVHNPKTALLRPVIESTWKAIAQEDNWQPFYELIQAIQSRK

SEQ ID NO: 8284 - protein, 273 aa, Chlamydomonas reinhardtii
MRRRAWALSDYEVLQRVYKGSSSAVYRAVCRRSGLPVALKVYFMARVPANTLHMLRREIELHIGLAHKNIIMLYGAFTDGKHLVLVQEWAARGDLYGIHRLMNCRLTETQTTELVLAPFLDALASLHRRGIVHRDIKPENILYTQGWTLKIADFGVSICLNDERAVTRTGTVDYMENKNNPNLAYTASVDIWSVGVLAYEMLVGFPPFVSEANEQSENAKAMAAFMAAEANTRALSFPSSLSEPARDFIRAALSENPNDRPTAEQLLKHPWLV

SEQ ID NO: 8285 - protein, 698 aa, Francisella tularensis subsp. tularensis SCHU S4
MKKSIFILPTSKHTGLRLLASSMVYALQQKGLKVGSFHPIYDMQMSIENIQEYLLNNRVKDYVEIVLDKFYQKSQEFDFIIISGLFRQGNNAHKLYPINAIIDELNIEIVKALSSEVIITSYHGNKPLIDINDELDYAMRSLPKQINIIGAIITKLNAPYDDDGRVSFSLTDEDISSEQQQQVTVNMLRELPVFAQKGLNLIGVVEWQQEKTSPRILDIKNILKLNLISRVSLEARVDRVMMCSRGVDNFINDLTPNSLVITSADRSDILVTVCLAAKNGMKIAGILLTAEEYLNDKVKELCVETAEKVGLAILTTRNKSVKTILRIADIDLMGIPLDDKERIQRVKEIICNSLDRDKIISAITADVLGHQVMSPPAFRYHLLKMATKAKKRIILPESYEPRTLQAAKNSHEQGLAECVLIGDRDKIHKVAEMNGFSLPKDIQVVNIDDEAEIKYLNTLMNLRKHKGLSESMARDALKNPIVVATVMLYLGEVDGLVSGAEHTTADVLRPALQLIKTKPNSSLVSSVFFMCMPDQVIVFGDCAVNQDPSAEQLVDIAIQSAESAKKFGIEPRVAMISYSTGTSGSGVQVEKVRTATELLKQKAPELLVDGPLQYDAAMIESVAKSKAPDSPVAGRATVLIFPDLNTGNTVYKAVQRSANVLSIGPVLQGINKPVNDLSRGATVDDITYTIAITAIQAI

SEQ ID NO: 8286 - protein, 498 aa, Zea mays
MRTNPTTSRPGISTIEEKSVGRIDQIIGPVLDITFPPGKLPYIYNALIVKSRDTADKQINVTCEVQQLLGNNRVRAVAMSATEGLMRGMEVIDTGTPLSVPVGGATLGRIFNVLGEPIDNLGPVDTSATFPIHRSAPAFIELDTKLSIFETGIKVVDLLAPYRRGGKIGLFGGAGVGKTVLIMELINNIAKAHGGVSVFGGVGERTREGNDLYMEMKESGVINEKNIEESKVALVYGQMNEPPGARMRVGLTALTMAEYFRDVNKQDVLLFIDNIFRFVQAGSEVSALLGRMPSAVGYQPTLSTEMGSLQERITSTKKGSITSIQAVYVPADDLTDPAPATTFAHLDATTVLSRGLASKGIYPAVDPLDSTSTMLQPRIVGNEHYETAQRVKETLQRYKELQDIIAILGLDELSEEDRLTVARARKIERFLSQPFFVAEVFTGSPGKYVGLAETIRGFQLILSGELDGLPEQAFYLVGNIDEASTKAINLEEESKLKK

SEQ ID NO: 8287 - protein, 155 aa, Physcomitrella patens subsp. patens
MPMKLVTVGKDRGAALENVALEYIKKIQRYCPFEEVQLRPNPKNSSDVPTQVSSEGERVMRSISTKDWVIILDERGKELTSEKFADLVADAGETGASAIVFCIGGPFGHGPQVRERANVSVKLSTMVLNHQIAFLVLLEQIYRAWTILRGEKYHH

SEQ ID NO: 8288 - protein, 279 aa, Bacillus cereus E33L
MKNLQSTTTLHNGVEMPWFGLGVFKVEEGPELVEAIKSAIKAGYRSIDTAAIYGNEAAVGEGIRAGIEATGISREELFITSKVWNADQGYEETIAAYEESLKKLQLDYLDLYLVHWPVEGKYKDTWRALETLYKEKRVRAIGVSNFQIHHLQDVIKDAEIKPMINQVEYHPRLTQKELQAFCKEQGIQMEAWSPLMQGQLLDNETLQEIAEKHGKTTAQVILRWDLQNGVITIPKSTKEQRIIANADVFNFELTKEDMEKIDALNQNHRVGPDPDNFDF

SEQ ID NO: 8289 - protein, 196 aa, Physcomitrella patens subsp. patens
MGIYGEGGSNAPPEPVLGHPVYPPPNPYTHQGGPYAPQPSYDHMPAQAPIGGPPMVIPTALTGEWTTDLCGCCSDCDLCCQTCWCPCVSFGQITEVLDEGRSSCFVQGTIYALLCTIGVPCVYSYRWRQRLRRKYMLEKGCCGDFCLHCCCGWCAICQEHRELQNRGLDPSLGWEVAQQNYVRPMVAPTAPGVMLR

SEQ ID NO: 8290 - protein, 170 aa, Oryza sativa
  misc_feature (53)..(53): Xaa can be any naturally occurring amino acid
  misc_feature (90)..(90): Xaa can be any naturally occurring amino acid
  misc_feature (134)..(134): Xaa can be any naturally occurring amino acid
MRTPGKGFLAADESTGTIGKRLASIGVENVEENRRALRELLFTVPGALDCLSXGVILFEETLYLSTRDGTPVVYVLAAAGASGRGSRATXGTVELAGSVRETTTQGHDGLRERCTRYYAYGARFAKGSAVLRIXGSASSTPWQLAVDGHAHGLARYAFICLENWLVPIVK

SEQ ID NO: 8291 - protein, 339 aa, Brassica napus
MDHEADAFRDLMTITRFVLNEQSKYPESRGDFTILLSNIVLGCKFVCSAVNKAGLAKLIGLAGDTNIQGEEQKKLDVLSNDVFVKALVSSGRTSVLVSEEDEEATFVESSKCGKYCVVFDPLDGSSNIDCGVSIGTIFGIYTMEHSDEPTTKDVLKPGNEMVAAGYCMYGSSCMLVLSTGTGVHGFTLDPSLGEFILTHPDIKIPKKGNIYSVNEGNAQNWDGPTTKYVERCKYPKDGSPAKSLRYVGSMVADVHRTLLYGGIFLYPADKKSPNGKLRVLYEVFPMAFLMEQAGGQAFTGKKRALDLVPKKIHERSPIFLGSYDDVEEIKALYAEEEKN

SEQ ID NO: 8292 - protein, 294 aa, Coffea arabica
MDQYEKVEKIGEGTYGVVYKARDKSTNETIALKKIRLEQEDEGVPSTAIREISLLKEMQHGNIVRLQDVVHSEKRLYLVFEYLDLDLKKHMDSCPEFSKDPRLVKMFLYQILRGIAYCHSHRVLHRDLKPQNLLIDRRTNALKLADFGLARAFGIPVRTFTHEVVTLWYRAPEILLGSRHYSTPVDVWSVGCIFAEMVNQRPLFPGDSEIDELFKIFRVMGTPNEDTWPGVTSLPDFKSAFPRWLSQDLATVVPNLDAAGLDLLRKMLCLDPSKRITARNALEHEYFKDIGFVP

SEQ ID NO: 8293 - protein, 245 aa, Bacillus cereus E33L
MVTTDTIHMLEDKIQFIHQDRKDIYLVGPIKLPINLYGETKAFQWYSWLQCSEGTNSVEGIIEKLSSINLADMQQSSVLVYGDFENSEDALIRMHSICHTGDIFGSKRCDCGFQLKQSLHMITEHGSGALFYLANHEGRGIGLFSKAMTYLLQENGLDTVEANLKLGFEDDVRNYDDTIEVLKALRSKPVKLITNNPKKLEALQKAGLNVTSREPLWGDVSEFNEKYLQTKIQRSGHFEGGHLHA

SEQ ID NO: 8294 - protein, 340 aa, Solanum tuberosum
MDHAADRHRTDLMTITRFVLNEQTKHPESRGDFSILLSHIVLGCKFVCTAVNKAGLAKLLGLAGETNVQGEDQKKLDVLSNEVFIKALVSSNRTCILVSEEDEEATFVRPANRGKYCVVFDPLDGSSNIDCGVSIGTIFGIYMIKDGHEPTLDDVLQPGMNMLAAGYCMYGSSCTLVLSTGSGVNGFTLDPSLGEFILTHPDIKIPKKGKIYSVNEGNAKNWDSPTSKYVQSCKYPADGSSPKSLRYIGSMVADVHRTLLYGGIFLYPGDKKSPNGKLRVLYEVFPMSFLMEQAGGQAFTGKQRALDLVPEKIHERSPIFLGSYDDVEEIKKLYAAEEQN

SEQ ID NO: 8295 - protein, 508 aa, Nocardioides sp. JS614
MRPRIVPSARGDVVAGVTVALVLVPQALAYATIAGLDPVYGLYAAVAAPIAGALVGSSPYLQTGPVAVTSLLTFGALEPLARPETLRFAALAAVLAVLVGMVRVLLGLLGGGPIAYLMSQPVVVSFTTAAALLIIGTQVPALLGMQGDSANPLVGAVRALADPAAWSWTDLVVGLVAMTLMLGSRRVWSLFPGALLAVVLAVVWSRATGYDGRTVGAVDLSYSTPQGVSATDLATLLVPALVIAIVGFAEPASIARRYAAADRQPWNPNLEFVGQGLANLASGAAGGFPVGGSFSRTSLNRLSGARTRWSGGITGLVVLAILPFVSVLSALPLAVLAGLVIGAVASLVDVRTPLLYWRWSKPQFSVGVLTAVATMALAPRVERGVLVGVAAALAVHLWREMGVHLPAFVEDATLHLRPTGVLYFGSAPALERSISRLIAEHPSVDRVVLHLDRIGRLDLTGALMLRDILADAESAGRTFEIRGARAHAAGLLVRLLGPEARICGDDVA

SEQ ID NO: 8296 - protein, 343 aa, Listeria monocytogenes EGD-e
MKAVVKTNPGYDQMELKDVEEPQVYGDKVKIKVAFTGICGSDIHTFKGEYKNPTTPVTLGHEFSGVVVEVGPDVTSIKVGDRVTSETTFETCGECIYCKEHDYNLCSNRRGIGTQANGSFAEFVLSREESCHVLDERISLEAAALTEPLACCVHSALEKTTIRPDDTVLVFGPGPIGLLLAQVVKAQGATVIMAGITKDSDRLRLAKELGMDRIVDTLKEDLAEVVLGMTGGYGAERVFDCSGAVPAVNQGLPLTKKKGDFVQVGLFAEKKNAIDEESIIQREIAYIGSRSQKPSSWILALDLLANGKIDTDKMITKVYGLDDWREAFEAVMAGNEIKVLVKS

SEQ ID NO: 8297 - protein, 350 aa, Listeria monocytogenes EGD-e
MRAAVLYENNVIKAEQIDEATCGKDQVRVEVKAVGICGSDIHKMQTRWKYPLPAVMGHEFAGVITEIGSEVTNVAMGDRVAGIPLEPCMECNYCKAGDFALCDNYRMVGSHFHGGFAENVVMKADNVISIGDLDFEEGAMIEPLAVSMHGVLGIQPRLGDTVIVFGIGTIGILVVQCLLLAGVKDIIAVDISDKKLADAREFGCKYTINPKNEDLKERVFAYTNGLGADIALECAGSKITQEQCLLVTKKKGKVGFLGIAYADVLLHEEAFENIFRRELTLKGFWNSYSAPFPGEEWRTSIEFVKQGRIKLKPLISHRYKLEETKEAFDMILSREHDYNKVMILPQKGDD

SEQ ID NO: 8298 - protein, 387 aa, Xanthomonas campestris pv. campestris str. ATCC 33913
MLALNYHGSRDVRVETVPDPLLVERDDLILRVTATAICGSDLHLYHGKIPDLRPGDILGHEFMGIVEEVGPDVTAVRPGDRVVIPFVVACGQCFHCLLQEFSACETTNTGKGAALNHKDMRPPAALFGFSHLYGGLSGGQAEYVRVPKANVGPLVVPDALHDEQVLFLSDILPTGYQAVVDAGVKQRSTVAIFGAGPVGLMAAACCRMLGAERVFMVDRHAYRLDFASRTYGVIPINFDEIDDPADIIVSQTDGRGVDASIEAVGFEAEGSALETALTTLKLEGSSGVALRQCIAATRRCGTVSVPGVYAGFIHAFMFGDAFDKGLTFKMGQTHVQKHMPYLLERIGNGELKPSAIISHRLPLAEAARGYEVFDKKQDDCRKVVLTP

SEQ ID NO: 8299 - protein, 497 aa, Pseudomonas putida KT2440
MTTLTRADWEQRAQQLKIEGRAFINGEYTDAVSGETFECLSPVDGRFLAKVASCDLADANRAVENARATFNSGVWSQLAPAKRKAKLIRFADLLRKNVEELALLETLDMGKPIGDSSSIDIPGAAQAIHWTAEAIDKVYDEVAPTPHDQLGLVTREPVGVVGAIVPWNFPLLMACWKLGPALATGNSVVLKPSEKSPLTAIRIAQLAIEAGIPAGVLNVLPGYGHTVGKALALHMDVDTLVFTGSTKIAKQLMVYAGESNMKRIWLEAGGKSPNIVFADAPDLQAAAEAAASAIAFNQGEVCTAGSRLLVERSIKDKFLPMVVEALKGWKPGNPLDPQTTVGALVDTQQMNTVLSYIEAGHKDGAKLLAGGKRTLEETGGTYVEPTIFDGVTNAMRIAQEEIFGPVLSVIAFDTAEEAVAIANDTPYGLAAGIWTSDISKAHKTARAVRAGSVWVNQYDGGDMTAPFGGFKQSGNGRDKSLHALEKYTELKATWIKL

SEQ ID NO: 8300 - protein, 349 aa, Idiomarina loihiensis L2TR
MTTTARWLPDFMENQRLLLAWPYRSDVWRKHADPARDALIKLIKQLPDNTPVSLVVPASISDSVPEALKSVQRIELDYDDIWLRDTTPLWQLNSDGQLAALSFDFDGWGGVQNVIAADKAFSQSLCSRLMCPVTNSLLIAEGGAFTHNGQGDWLIGLACIKQRNPAMTEPQIKSLLGQLLPGQRLHFFDGGLVADETGGHIDNMALFVDANTVLYAATDNTAHPDYKTCQALKKQLDKLPAYIQTIPLPLPPPQLPAREERAGVELTSSSLKRTVELPLLCSYVNVLQTSKLVVVPQFGLTTDAQAVRTVREALPERKVIAIDAREFVLGGGGLHCISHNLPKFKTDEL

SEQ ID NO: 8301 - protein, 303 aa, Triticum aestivum
MSIARFSCTTHLATLHTLGATRQITRRLLAKMSQGQQRRPSSDQAQAGGGGQGQGQGGGAVRYGDVFPAVTGGLAEKPVAPQDAATMQSAENLVFGETIKGGPAAAMQSAAMRNERMGVVGHDQATDATAEQGVSVSETRVPGGRIVTEFVAGQAVGQYLAPDDAADAGGAGGDDTKITIGEALEAAGYAAGGRPVERSDAAAIQAAEVRATGLDVNIPGGLAAQAQSAADANAWAARDDEKAKLGDVLSNATAKLVADKEVEADDAARVASAETRNKDDKTVRPGGIAASVAAAARLNKQGA

SEQ ID NO: 8302 - protein, 201 aa, Glycine max
  misc_feature (158)..(158): Xaa can be any naturally occurring amino acid
MAEQALEGSQPVDLTKHPSGIVPTLQNIVSTVSLDCKLELKSIALQARNAEYNPKRFAAVIMRIREPKTTALIFASGKMVCTGAKSEQQSKLAARKYARIIQKLGFPAKFKDFKIQNIVGSCDVKFPIRLEGLAYSHGAFSSYEPELFPGLIYRMKCXKHKSVGIFVSGKIVLTGAKVRDETSTAFENIYPVVTEFRKNQQ

SEQ ID NO: 8303 - protein, 249 aa, Klebsiella pneumoniae subsp. pneumoniae MGH 78578
MGNWKLNGSRHMVNELVANLRTELAGVSGCAVAIAPPEMYLDLAKRAAEGSHIHLGAQNVDVNLSGAFTGETSAEMLKDIGAQYIIIGHSERRTYHKESDELIAKKFAVLKEQGLTPVLCIGETEAENEAGKTEEVCARQIDAVLKTQGAAAFEGVVIAYEPVWAIGTGKSATPAQAQAVHKFIRDHIAKADAKIAEQVIIQYGGSVNAGNAAELFTQPDIDGALVGGASLKADAFAVIVKAAEAAKKA

SEQ ID NO: 8304 - protein, 434 aa, Klebsiella pneumoniae subsp. pneumoniae MGH 78578
MSLWLTHPLFLPSLIVGVTIVLWATSLLPEFITALLFFAAAMMAKIAPPEVIFGGFASSAFWLVFSGFVLGIAIRKTGLADRAAQALSARLTDSWPRMVASVVLLSYALAFVMPSNMGRIALLMPIVAAMARRAGIADGSRGWFGLALAVGFGTFQLSATILPANVPNLVMSGAAEGSYGIHLNYVPYLLLHTPVLGWLKGAVLVALICWLFPGKPHPPRDLAPLPPMSRDEKRLAWLLAVVLSLWVTESWHGVGPAWTGLAAAVITLLPRVGFINGEEFASGVNMRTCIYVAGILGLAIAVTQTGIGGAVGNALLQVMPLDKDNPFTSFLALTGITSALNFIMTANGVPALYTTFAQSFADATGFPLLSVIMIQVLGYSTPLLPYQASPIVVAMGLGKVPARAGMQLCLALAAVSYLILLPLDYAWYQLLGKL

SEQ ID NO: 8305 - protein, 362 aa, Oryza sativa Japonica Group
MESDASTSPRRRSTSCYSDSGDSSCSEPFSECGSDDLSFTPAAAAGIHRLLLSCAAEASDGTISSLVAELESPSSSLDSLRRAAMELRLLAKHNPDNRIRIAAAGAVRPLVALLSHADPLLQEHGVTALLNLSICDENKAIIVEAGAIRPLVHALKSAASPAARENAACALLRLSQLDGSAAASIGRAGAIPLLVSLLETGGARGKKDAATALYALCSGARENRLRAVEAGAVRPLLDLMADPETGMVDKAAYVLHSLVGIAEGRSAAVEEGGIPVLVEMVEVGSPRQKEIATLSLLQICEDSAAYRTMVAREGAIPPLVALSQSSSARPKLKTKAEALIEMLRQPRSASLRARPTAVVAAE

SEQ ID NO: 8306 - protein, 389 aa, Ralstonia eutropha JMP134
MNIHEYQGKEILRKYNVPVPRGIPAFSVAEALKAAEELGGPVWVVKAQIHAGGRGKGGGVKVAKSIDDVKTYATNILGMQLVTHQTGPEGKKVNRLLIEEGADIKKELYVSLVVDRVSQKIALMASSEGGMDIEEVAAHTPEKIHTLIIEPSTGLTDADADDIARKIGVPDASVAQARQALQGLYKAFYDTDASLAEINPLILTGEGKVIALDAKFNFDSNALFRHPEIVAYRDLDEEDANEIEASKFDLAYISLDGNIGCLVNGAGLAMATMDTIKLFGGEPANFLDVGGGATTEKVTEAFKLMLKNPNVEAILVNIFGGIMRCDVIAEGVISASKAVNLTVPLVVRMKGTNEDLGKKMLADSGLPIIAADTMEEAAQKVVAAAAGKK

SEQ ID NO: 8307 - protein, 232 aa, Rhodococcus sp. RHA1
MASDLTEFDAVIFDFSGTLFRLEEDDSWMADLTDHDGEPFDLHQQAELMRRMTAPVGQTVEMDAAEHHAWTNRDLDPRFHRQAYLDVLRKSGVAHEDQAVGLYERVIDPGCWSAYPDTAEVLASLKDRGIKVAVLSNIAFDIRPAFADLGVEHLVDAFVLSFEVGAIKPDPKIFEHALAALGSEPERTLMIGDSEEADGAARNVGCAFALVEPLPLAERPDGLRTALGAFGL

SEQ ID NO: 8308 - protein, 480 aa, Brucella suis 1330
MQTRYPDVKLFIDGTWRDGSRGETIEIFNPATDEVIGHIARATTADLDDALAAVDRGFEAWSKVSAFDRYKIMRRAADIFRSRGEEVARLLTMEQGKPLAEARIEAAAACDLIDWFAEEARRSYGRIVPPRQAYVMQAEVKEPVGPVAAFTPWNFPINQAVRKISAALAAGCSILLKAAEDTPAAPAELVRAFAEAGLPDGAINLVYGDPAEISAYLIPHPVIRKVSFTGSTQVGKQLAALAGLHMKRVTMELGGHAPVIIAADADVEQAIKVVSGSKFRNAGQVCISPTRFLIENSVYDQVVEGMAAYATSLKVGDGLEAGTTMGPLVNAKRVNAMERLVQDAREHKARVVTGGERIGNRGNFFEPTILADVPRDATIMNEEPFGPVALLNRFDALDEALSEANRLNYGLAAYAFTGSSAKAARISSTVRSGMITINHYGLALPEVPFGGINDSGYGTEGGADALEAYQNTKFVSFLQA

SEQ ID NO: 8309 - protein, 606 aa, Dechloromonas aromatica RCB
MSTPVESFADLGLSETLLQTLTQIGYETPSPIQAQCIPVLLEGHDLIGMAQTGTGKTAAFALPLMEQIDVKLTKPQALILTPTRELAIQVAEALQTYAKNLPGFHVLPIYGGQSYTIQLKQLSRGAHVIVGTPGRVMDHLERKTLNLDHLKTMVLDEADEMLRMGFIDDVEWILERTPAQHQTALFSATMPEQIRRVAQKYLVEPREIKIKSATATVAAIRQVYWQVSGMHKLDALTRILEVEEDFDAAIIFVRTKTATVELADKLSARGYAAAALNGDLNQQMRERVIEQLKSGALDIVIATDVAARGIDVPRVSHVVNYDIPYDTEAYVHRIGRTGRAGRTGNAILFVAPREIRMLRTIERATRSPIAPLTLPSRADVTNKRVADFKSKVVEVLNAEGLDFFSNIVSQIAEEQNVGAEEVAAALAMMAQEGKPLQIAGEDPRPAPAPRPGSFGESDRKPRFEDRGDRPRFEDRGERPRREDRPARQAPAGDMVRYRIDVGRDHGVEVRDIVGAIANEAGIESRFIGRIGLYEDSSTVELPAGMPAEASNALKRTRIRGVPINLRPDEGRPGAGGAGGGERKFGGGDRKPEGDRGGFKKKKFGDR

SEQ ID NO: 8310 - protein, 275 aa, Bacillus anthracis str. Sterne
MNIGIIGTGNMGNILIDAFLETRAVKPSCLTIINRTPAKAYHIKEKYPSVHIAKTIDKVIERSHLIFICVKPIDIYPILQKYAEHFSDEKCLVSITSPISPSQLETLVPCHVARIIPSITNRALSGASLFTFGNNCSEEWQQKLFRLFKNISTPLVIKEDITRVSSDIASCGPAFFSYLLQCFINAAVDKTNITHEEATTLVSEMVVGMGELLEKGIFTLPTLQEKVCVKGGVTGEGIRVLEEHVGDMFHKLIERTHEKFDEDLKCVDQQFNKHT

SEQ ID NO: 8311 - protein, 156 aa, Chlamydomonas reinhardtii
MSTPTPSGGTDLLLHANHNIGVAMATPSGLVVPNIKQVQRKSLAQVASELSLLQQLAAAGRLPAEALAGGTISVSNIGEGCTIGGTYATPLVSPPEVAIVALGRLQLLPRYPPAAAEAAVSWGADHRVVDGAALAAFSGSWRQLLETPERLLLGAV

SEQ ID NO: 8312 - protein, 440 aa, Arabidopsis thaliana
MMLKLIKSMVQAITRPIQYLIISYLRYLVGPPSLTHHDNQVTVIIEETSENGRINVIHGATQAYLFDKINLDFVEEREFDDIYQGAKLKWRIFVDKNNIGNIPKQCFELRFDEKHRDLVFDSYIPFVESKAKEIKSKKRILEMHTYSHCCDTWETKILDHHSSFETIVMKEDLKRRLIDDIDLFISKEDFYKRVGRHWMRYYLLHGLPGAGKTSLVAAIAKYLNFDVYNITQGVKTDFDTRRLIRRVEDSSILLVEDIDTSLEGSKVALSQLLSSLTWPWSNGKARVVIFTTNNKERFDQTLLCRMEMKIYMGHCCFEDFKTLASNYLGISHDNDAPHRLYPDIKRLIDGQAVTPGQVVEELMKSQDVDVALQSLVRYSSSKENDHIDDDLPQIPEETRKNSNLDSKPRKSQTIIVEALNQVRCNETETGSNIDYSSNEK

SEQ ID NO: 8313 - protein, 180 aa, Triticum aestivum
  misc_feature (109)..(109): Xaa can be any naturally occurring amino acid
  misc_feature (118)..(118): Xaa can be any naturally occurring amino acid
  misc_feature (145)..(145): Xaa can be any naturally occurring amino acid
  misc_feature (161)..(161): Xaa can be any naturally occurring amino acid
PCDFIGVVKSQQPVYLKGETVSNHDELMSNFFAQPDALAYGKTPEQLHSEKVPENLIPHKTFKGNRPSLSLLLPTLSAYEVGQLLSIYEHRIAVQGFIWGINSFDQVGXVELGKSLRXSSKWRKQLHGNPGWEGKPVGGFNHSTXSLLARYLAVQPPPRYXTTVLPKCITQLFLDMPIAS

SEQ ID NO: 8314 - protein, 468 aa, Streptococcus pneumoniae TIGR4
MSSGKIAQVIGPVVDVLFAAGEKLPEINNALVVYKNDERKTKIVLEVALELGDGMVRTIAMESTDGLTRGMEVLDTGRPISVPVGKETLGRVFNVLGDTIDLEAPFTEDAERQPIHKKAPTFDELSTSSEILETGIKVIDLLAPYLKGGKVGLFGGAGVGKTVLIQELIHNIAQEHGGISVFAGVGERTREGNDLYWEMKESGVIEKTAMVFGQMNEPPGARMRVALTGLTIAEYFRDVEGQDVLLFIDNIFRFTQAGSEVSALLGRMPSAVGYQPTLATEMGQLQERITSTKKGSVTSIQAIYVPADDYTDPAPATAFAHLDSTTNLERKLVQLGIYPAVDPLASSSRALAPEIVGEEHYAVAAEVKRVLQRYHELQDIIAILGMDELSDEEKTLVARARRIQFFLSQNFNVAEQFTGQPGSYVPVAETVRGFKEILDGKYDHLPEDAFRGVGSIEDVIAKAEKMGF

SEQ ID NO: 8315 - protein, 274 aa, Onion yellows phytoplasma OY-M
MNYKPRTKVIAGNWKMYKCKDEALEFIQKVSLQVPDQTQVQTLIFPQLTLLDSLAQLQGTNLQVGAQNMFYESEGAFTGEVSPQNLLSLGVKHVLLGHSERRTFFGETDQTVNLKLLSALKHKLVPTVCVGESLLTKENNQTQVFLDQQLTNIFAGVPEEALQNIIIAYEPVWAIGTGKSATPQDANKVIEQIRDKVTALYSSQASCAMRIIYGGSVSVANIKTILEQPAIDGILAGKASLQTEDFLFFAQIASKQALASTKDIFQKNDCPFCC

SEQ ID NO: 8316 - protein, 157 aa, Oryza sativa Japonica Group
MAVSASLPAATPAGRHAAAVYVAAVPLRGPKGPAQALMSAGYSLGLWDLQHFMVLLRPDPARAQALVFDFQPRDPEDALAAFAVLSRSEIPGVVRRRTLRRVPDTRCWLVGHHRSGGGAGAAAAVLAADAFTARWPTDLVVGRHDCRDFTNGWSATS

SEQ ID NO: 8317 - protein, 140 aa, Zea mays
MGVRAAAAAVALVAVMGMLAPRAAAQTPNCAAKLVPCSSYMNTTGTPPDTCCGPLKDAVKNDLKCLCDLYATPEIFKAFNISLDEALGLSKRCGLSDTTAACKGSPSGGGSGSNSGHHTLSVGFSGFMSFLSLALWSVLA

SEQ ID NO: 8318 - protein, 938 aa, Oryza sativa Japonica Group
MARPVSQSHNGPGSFTSPISGAASAHVGPPPLSFQLQLPRRRRSAAAAAAAAAQQFHLPLSVISQGSYVYDSKGNKYLDTLAGLWCTALGGSEPRLVKAATDQLNKLPFYHSFWNSTAKPPLDLAEELISMFTAKEMGKVFFTNSGSEANDSQVKLVWYYNNALGRPNKKKIIAQSQALPAMHLKFDLPAPFVLHTDCPHYWRFGLPGEAEEEFATRLADNLENLILKEGPETVAAFIAEPVIGAGGVIPPPKTYFEKIQAVLQKYDVLFIADEVITGFGRLGTMFGSDLYNIKPDLVSLAKALSSAYVPIGATLVSPEISDVVHSQSNKIGFFAHGFTYSGHPVSCAVALEALKIYRERNIPAHVKQISPRFQEGIKAFAGSSIIGETRGVGLLLATEFANNKSPNDPFPVEWVNEDDDVDEDGDGPNEQGVQNQELTKARRLNVDIEATTSLELEWRLQTSPQLLRFKGHGMLAPFTAGWQSTDVHPLVIERSEGSYVYDIDGKKYLDSLAGLWCTALGGSEPRLVKAATEQLHKLPFYHSFWNRTTKPSLDLAKELLSMFTAREMGKVFFTNSGSEANDSQVKLVWYYNNALGRPDKKKFIARSKSYHGSTLISASLSGLPALHQKFDLPAPFVLHTDCPHYWRFHLPGETEEEFATRLANNLEELILKEGPETVQSSFHRNLYCAKRSKIAAFIAEPVMGAGGVIPPPKTYFEKVQAIVKKYDILFIADEVITAFGRLGTMFGSDMYNIKPDLVSMAKALSSAYVPIGAIMVSPEISDVIHSQSNKLGSFAHGFTYSGHPVACAVAIEALKIYQERNIPDHVKQISPRFQEGVKAFAGSPIVGEIRGVGLILGTEFADNKSPNDPFPAEWGVGAIFGAECQKRGMLVRVAGDNIMMSPPLIMTPDEVEELVSIYGDALKATEERVAELKSKKNN

SEQ ID NO: 8319 - protein, 218 aa, Glycine max
MATISAVQVEFLEFPAVVTSPASGKTYFLGGAGERGLTIEGKFIKFTGIGVYLEDKAVPSLAAKWKGKTSEELVHTLHFYRDIISGPFEKLIRGSKILPLAGAEYSKKVMENCVAHMKSVGTYGDAEAAAIEKFAEAFKNVNFAPGASVFYRQSPDGILGLSFSEDATIPEKEAAVIENKAVSAAVLETMIGEHAVSPDLKRSLASRLPAVLSHGIIV

SEQ ID NO: 8320 - protein, 297 aa, marine gamma proteobacterium HTCC2080
MEAYAMGKESLDCEHTLSLAIREATGQGCPPLLAKALDYAVFPGGARVRPRLCLAVALANGNSEPRLASAAAAAIELLHCASLVHDDLPCFDDAIERRGKPSLHAAFGQRIAVLSGDALIVAAFQQLAELGSSVTHPVRMAQVTAIVAAGVGGPMGICAGQAWECEPRVELEHYHQAKTGALFVAATCAGAAAAGVPSEPWRELGNSIGEAYQVADDIQDAIADTATIGKPTGIDVALDRPSAVRELGLQGAVKRLERCIEKGLDSIPACKGRALLHDVVQQQSNRFFPQGIKHTAA

SEQ ID NO: 8321 - protein, 454 aa, Leptospira interrogans serovar Lai str. 56601
MIEKKFHEKVDVMSKYFLIMDRTETIRKSGKVIRVSGNVIYSEGPPDSKIGELMDVQKSGKEGYLQCEIVGFEGHVYTLMPLGPIEGIYPEAFVFSSGRKLAIPVGKELLGRVLNGVGRPIDKKGHIITKEERPPDNEVPNPLDRPIIRDVLMTGVRAIDGILTIGRGQRVGIFSGSGVGKSSLLGMIARYTDADINVIALVGERGREVNEFIEIDLGKEGLKKSVVLAATSDAPKMEQVNCALLATSIAEYFRDQGKHVNLMMDSLTRFAQANREISASNHEPPITRGFSSSVFSKLAKLVERSGTSKSGGTITGFYTVLTEADEMEDPIADAVRGYIDGHIILNRKLAEKNHYPAIDVPASLSRVMARIAPEDQNLRAGMIRELISVYNSAEELIRLNAYVSGSDPKVDLAIRKKDKIDRYLKQKIQERSTYSHALQGLKEVLEEEQEEEEF

SEQ ID NO: 8322 - protein, 182 aa, Bacillus cereus E33L
MDSMTFLLFGATGDLAKRKIYPALYKLFSNGNITQSISIIGIGRRVMSDVEFQTKVEQSLATFSRRSTDDELGVEEFISTFRYCQLNTVNIEDYQDLLSLVKRRETELNIPENRMFYLSVIPEVFDVIALNIKEIGLWATKGLKRLIIEKPFAHHVTSAHEFNEKLIEDFDETDIFYIDHYL

SEQ ID NO: 8323 - protein, 301 aa, Pseudomonas putida KT2440
MTLDRDAASHVAEVLSEALPYIRRFVGKTLVIKYGGNAMESEELKTGFARDIVLMKAVGINPVVVHGGGPQIGDLLKRLSIESHFIDGMRVTDSATMDVVEMVLGGQVNKDIVNLINRHGGSAIGLTGKDAELIRARKLTVSRQTPEMTTPEIIDIGHVGEVVSVNTDLLNMLVKGDFIPVIAPIGVGANGESYNINADLVAGKVAEALKAEKLMLLTNIAGLMDKQGQVLTGLTTEQVNELIADGTIYGGMLPKIKCALDAVQGGVNSSHIIDGRVPNAVLLEIFTDSGVGTLITNRKPR

SEQ ID NO: 8324 - protein, 494 aa, Bacillus cereus E33L
MESMTFVLFGATGDLAKRKIYPALYNLYRDQKLPKKISVIGLGRREVSHVDFQKRIKESIETFSRHREEGTPELEGFLDNFRYCPLDVSKPEDYERLLQVVREREEELHIKGNRMFYLSVAPEFFETIALNIKESGLDKTDGWKRLMIEKPFGHDLISARELNDKLSRTFEEDEIYRIDHYLGKPMIQNLEALEFANPVLQSIWNKEHIANVQITASETVGVEERAGYYDQAGAIRDMVQNHMLQILMMTAMNLPEKVNACEIREEKRKVMEALRKVKKEDVQNHIIRGQYGAGEINGGQVVAYKEEPGVNPSSNIDTFVAARLWIDNPFWTGVPFYIRTGKRMKEKSTRIVIEFKNTLKQQYQDSNPNAAPNLLIIEISPGENVSLQLNSKNPLKNGEIEPIRINFTCEQADVGVPEAYERLIHDAVSGDATFFAHWREVELSWEWVQPILEAFEENLLPLHEYKSGSYGPEPSNELLQESGFKWWLDQETKK

SEQ ID NO: 8325 - protein, 696 aa, Nocardioides sp. JS614
MCTSVYVASVEGYTGKSAVALGILDVLSRRVERVGVFRPIVRNDQATARGERDYVLDLLTAHEAVTLSYDDCTGVTYDDVHADPVAALDTIVERYHRVAEQCDAVVVIGSDYTDVATPTELSYNARIAANLSSPVLLVLNGADRTPAELVTLADIASTAISASHAALFAVVANRVTHPEPAEVVAALGRDEVPAYAIPYDPLLSAPSVADLMPACNGTVVSGDPALLDREVLGLLVAGMTMPNVLDRLFDGAVVVTAGDRPEVVLGVLMAHVSSNFPQVAGIVLNGGIELPAQVARLLAGIGATLPIIATDLATQETSAALTGVRGRLTVSSPRKIAAALALFAQHVEGDALLDRLDVSPTTAVTPLMFEHQLLDSATSRRMRIVLPEGEEERILRAADLLLRRGVADLTLLGDPIRINAHAARVGADVSAATLLDPRSSELAERFAEEYFDRRKHRGVDRDDALVRVLDESYFGTLMVELGLADGMVSGAVHTTAHTIRPALEVVRTAPGVSVVSSVFFMCLENQVLVYGDCAVNPDPTAEQLADIAISSAETAAAFGVEPRVAMLSYATGSSGAGSDVEKVSAATALVRDRAPELLVEGPIQYDAAIDPAVARTKLPGSPVAGQATVFIFPDLNTGNNTYKAVQRSAGAVAIGPVLQGLRKPVNDLSRGATVRDIVNTVAITAVQAQQLAEVAR

SEQ ID NO: 8326 - protein, 126 aa, Magnaporthe grisea 70-15
MSANDSAAWPLADAALTQEILDLVQSAAHYRQLKKGANEATKTLSRGVSELVILAADCEPLAILLHIPLLAEDKNVPYVFVPSKIALGRACGVSRAVIAASITSNEASDLQGQIRTLRDKVERLAI

SEQ ID NO: 8327 - protein, 420 aa, Oryza sativa
  misc_feature (258)..(258): Xaa can be any naturally occurring amino acid
  misc_feature (286)..(286): Xaa can be any naturally occurring amino acid
  misc_feature (321)..(321): Xaa can be any naturally occurring amino acid
MALHVLASMGDLWRRYAPHNLMILSQLCYTLMYFITEAAFNKGLNPFIYVTYRHLVVAVFLAPFAYYQEKKLRPRMTLMLFLEIFVLSLLGVSLTLNMYFASLMYTSPTFVTSVVNTVASITFVIAIVVRCPTFSRISRRTHAESDRLYCSLSAWLTLARDQINLDAVRMEIVDVRSIRGLAKVAGTVVSFAGVTTMTLYKGTAISSPWKAPISIHGGGGGGGVHESWLKGSFLAVASCICWSIWYILQASSLKRYPXAQLSLTSMNVPPVGGIQSAVFTAFMQHXPEDWRIGFGLKFWCIVYSGFACNGFTVFAQLWCTXEKKGPVFVTMFNPLSTIMVPILAYFMFGENLYVGSIIGGVVVILGLYMLLWGKDKDQEYNANKQQESDLDCEKQARITEFSAAQNDQEEPRRTKKYGPV

SEQ ID NO: 8328 - protein, 315 aa, Escherichia coli
MPDMKLFAGNATPELAQRIANRLYTSLGDAAVGRFSDGEVSVQINENVRGGDIFIIQSTCAPTNDNLMELVVMVDALRRASAGRITAVIPYFGYARQDRRVRSARVPITAKVVADFLSSVGVDRVLTVDLHAEQIQGFFDVPVDNVFGSPILLEDMLQLNLDNPIVVSPDIGGVVRARAIAKLLNDTDMAIIDKRRPRANVSQVMHIIGDVAGRDCVLVDDMIDTGGTLCKAAEALKERGAKRVFAYATHPIFSGNAANNLRNSVIDEVVVCDTIPLSDEIKSLPNVRTLTLSGMLAEAIRRISNEESIFAMFEH

SEQ ID NO: 8329 - protein, 227 aa, Nostoc punctiforme PCC 73102
MSSVQLYFAKASTFSQRTRVVLLEKGIDFSSTEIDLQNKPDGYTQISRYGKVPAIKHGDIEIYESAIINEYLDEVFPEPPLLPRDPGAKAIARIWIDYANTRFVPAFNKFLRGKDAQEQGQGQREFLEALLYIEQEGLGKLSGNGPYWLGEQLSLVDISFYPWFERLPLLEHFRNFTLPTETPRLQKWWNTVRDRESIRAVENPTSFYLERFAKILGAPTPVASAQK

SEQ ID NO: 8330 - protein, 464 aa, Burkholderia vietnamiensis G4
MSTAALVEGKIVQCIGAVIDVEFPRDSMPKIYDALILDGSELTLEVQQQLGDGVVRTICLGASDGLRRGLTVKNTAKPISVPVGKPTLGRIMDVLGRPIDEAGPIESEHTRSIHQKAPAFDELSPSTELLETGIKVIDLICPFAKGGKVGLFGGAGVGKTVNMMELINNIAKEHGGYSVFAGVGERTREGNDFYHEMKDSNVLDKVALVYGQMNEPPGNRLRVALTGLTMAEHFRDEGLDVLFFVDNIYRFTLAGTEVSALLGRMPSAVGYQPTLAEEMGKLQERITSTKKGSITSVQAVYVPADDLTDPSPATTFGHLDATVVLSRDIASLGIYPAVDPLDSTSRQIDPNVIGEEHYTITRRVQQTLQRYKELRDIIAILGMDELSPEDKLSVARARKIQRFLSQPFHVAEVFTGSPGKYVPLKETIRGFKMIVDGECDHLPEQAFYMVGTIDEAFEKAKKIQ

SEQ ID NO: 8331 - protein, 618 aa, Haemophilus influenzae R2866
MSQLANPELMKVVILLASSVTIVPLFKRLGLGSVLGYLVAGCLIGPSVFGIVQDPTAVVHLAELGVVMFLFIIGLEMYPERLWAMRKAIFGRGLLQVGLCGCLLTFSGIYLLGLTKEVSFIAGMGFTLSSTAIVMQSLEERGLTSTSKGQRVISTLIFEDIAIVPLLASVAFLAPHSKEATPHTDWVSIGIALSAVVGLIVTGKWLMNPLFRLISKARIREMMTAGALLVVLGAALAMEIGGLSMAMGAFVAGVMMSESAFRHQLEADIEPFRGLLLGLFFMGVGMSLDLHLVFNHWILLLGIVFLYILGKASAVYIIARITRLDHREAIGRMSLMAHGGEFAFVLFSAAATAEVISNEEQATFTAAVIISMLFSPIIAQIARKLIQRTESKHLDQLDENDLDSIVDLEDNVLVIGFGRFSQIVCQTLLIRGISVSVIDRNIENIRAAAKFGFKVYYGDGIRLDVLRAAGIEKAKCVVLGINDTQRIEHIVSQMKEAYPNLPILTRTYDRKTTVSLIKQDVDFIVRETFESAITLSRATLMKLGIDKIEAEEIIKEVRTLDQERLNEEVLHGFSNEIVKKYWTPRPFIKPHLDTKALNKETEEILSEKIEEEISNDHS

SEQ ID NO: 8332 - protein, 398 aa, Onion yellows phytoplasma OY-M
MTKSLTNMNITNKKVLLRADLNVPLENSVITDDNRIKAILPTLKYLVQQKAKVIIFSHLGRVKTEADKAHFSLQVVAEKIAFYLQQKLKFVPETQGNTLNQAVGQMLPGDVLVVQNTRFEDVPFKKESKNDPELGKYWASLGDVFVNDAFGTCHRTHASNVGIATYIKEKCFGFLVEKEISFLKKIVQTPQRPLVAVLGGSKVSDKIGVIRSLLQKVDVLLIGGGMSYTCLKAKCFNIGTSLLEADKIPLVKELLASPEGKKIVLPKDFVCGKEFSPTTQAAVYSYDNISDDVMGLDIGPQTIELFKTYLQTAQTVVWNGPVGVFEFEQFSKGTKALAETISNLSPNTTTIIGGGDSAAAVFKFGLDQNFSHISTGGGAFLEFLEGKPMPGLACMEKL

SEQ ID NO: 8333 - protein, 335 aa, Onion yellows phytoplasma OY-M
MKVKVAINGFGRIGKLAFRLVFGNPKFEVVAINDLATLETISYLLKYDSIQKPYKLDAVSFEDNYLVVEGQKIPVFQEKNPQDLPWKKLGVDIVLECTGFFTSKEKAALHLEAGAKKVLISAPATGDVKTVVYNVNDQILTKEDAIVSGASCTTNCLAPVVKVLNDNFGINQAFMTTVHSYTSDQSLIDQNHPKGIWTRRGRAAAFNMVPSSTGAAKAISLVIPELKGKLDGTAIRVPTITGSLVDLTAELTQEATPEAINEAFKKAANGTLAYVTDPIVSSDVIGTSYGSLYDSHTLQVLKEKPKFIKLMSWYDNEMSYVSQLVRLLHKVATLV

SEQ ID NO: 8334 - protein, 331 aa, Neisseria gonorrhoeae FA 1090
MNLKNRHFLKLLDFTPEEITTYLDLAAELKDAKKAGREIQRMKGKNIALIFEKTSTRTRCAFEVAARDQGADATYLEPSASQIGHKESIKDTARVLGRMYDAIEYRGFAQETVEELAKYAGVPVFNGLTNEFHPTQMLADALTMREHSGKPLNQTAFAYVGDARYNMGNSLLILGAKLGMDVRIGAPQSLWPSEGIIAAAHAAAKETGAKITLTENAHEAVKGVGFIHTDVWVSMGEPKEVWQERIDLLKDYRVTPELMAASGNPQVKFMHCLPAFHNRETKVGEWIYETFGLNGVEVTEEVFESPAGIVFDQAENRMHTIKAVMVAALGD

SEQ ID NO: 8335 - protein, 121 aa, Arabidopsis thaliana
  misc_feature (40)..(40): Xaa can be any naturally occurring amino acid
LRFVKQVVLDNLPTRNAALKLVNVERSFAEKHYADLASKXPFFQGLVDYIISGPVVAMVWEGKSVVTTGRKIIGATNPLASEPGTIRGDFAVDIGRLDLSPIFVSYGFQSPLFMHWLCLDA

SEQ ID NO: 8336 - protein, 236 aa, Zea mays
RLVGANLENSTPLGKAGTGLVVLSAALAEVIVALGGGLLVGANNLNGALVDLDAREDGLVPIVEPEILVDGPHDIDRCAYVTETVLAACYKALNEHHVLLEGTLLKPNMVTPGSDSKKVTPEVIAQYTVRTLQRTVPAAVPAVVFLSGGQSEEEATLNLNAMNKLSTKKPWALSFSFGRALQASTLKAWAGKVENVEKARAAFLARCKANSEATLGTYKGDAAADTESLHVKDYKY

SEQ ID NO: 8337 - protein, 363 aa, Onion yellows phytoplasma OY-M
MKVGIIGLPNVGKSTLFNALTKMQVLEANYPFATIEPNVGIVEVSDSRLQTLSQIFQSQKTISALIEFKDIAGLVAGASKGEGLGNQFLSHIRNVDAICHVVKCFEDPNIAHVTETNNPVEEIDIIQTELALADLEQIEKRLLKLGKQKNKLDKELLQEKALLTKIKTHLTTQDLKNLVFSDEELKLVKTFNLLFLKPSLYLANIKEHDLLSLDSNVFYQQVLAYATKESKKLIPLCVQLEKEISSLDFAEKQLFLKDYGLVESGLTKLIQESYALLGLQTYFTAGPKEVRAWSFKKGLKAPECARIIHTDLQKGFIKAEVVSYLDLLEAQTFQKSKEKGKVRIEGKEYIVKDGDIITFRFNV

SEQ ID NO: 8338 - protein, 513 aa, Triticum aestivum
  misc_feature (70)..(70): Xaa can be any naturally occurring amino acid
MAPFLNPSPELKHALLWSVPILIIAPTVIFLYMQAVGKKKNTIRLPPSPLRLLIIGHLHLMVHEPHRSLXEAGSQPGPVIHLQLGGIAAIVVSSPEAAKEVLKTHDVHCCSRPSSPGAKLITYGQQDIAFSPYNASWRERRKLFVSELVSSKRVQSFAYALEAQVGELIQSLSLRSPPTEPVNLNETLFTLIDGFIGTVAFGSMNGAKLMKYAKFQQVFSEAMIALSAFSAQDFFPASPMSRWVDKLVGLEARYQRIFLELDSYFEMGLSQHMDPGRVKPDKDDLVDVLISLWLGQGKVTKDHLKALLMDTFIGGTTTSSVTLLWAMSELIKNPTVMQKAQREVRSLVGGKQRLVQVDDLSKLNYLKMVVKETLRLHPPAPLLVPRETMDHVKVLGYDIPAKTRIFVNVWAMGRDPACWEKPEEFYPERFDGMDTDFYGLHYELLPFGAGRRICPAIPMGATIVEFTLASLLHSFDWELPDGMRKEDVSMEGTGRQVFCRKTPLCLVPSVNTG

SEQ ID NO: 8339 - protein, 384 aa, Pyrococcus abyssi GE5
MSKFPEKGLPREEVLNLLEDKTKVDLTFSSGKILGSMCTMPHELAIEVFARYIDRNLGDPGLHPGTRKIEEEVIEMLSDLLHLEKGYGHIVSGGTEANILAVRAFRNISDAERPELILPKSAHFSFIKAGEMLGVKLVWAELKQDYAVDVKDVEAKISDNTIGIVGIAGTTGLGVVDDIPALSDLAREYGIPLHVDAAFGGFVIPFAKSLGYDLPDFDFKLKGVESITIDPHKMGMAPIPAGGIIFRRKKYLKAISVLAPYLAGGKVWQATITGTRPGASVLAVWALIKHLGFEGYREIVRKAMELSRWFAEEIKKLNNAWLVREPMLNIVSFQTKNLRKVERELKRRGWGISAHRGYIRIVFMPHVTKEMVEEFLRDLREVLK

SEQ ID NO: 8340 - protein, 382 aa, Glycine max
MSSTVGQTIKCKAAIAWEAGKPLVIEEVEVAPPQAGEVRLKILYTSLCHTDVYFWDAKGQTPLFPRIFGHEASVGGIVESVGEGVTHLKPGDHALPVFTGECGDCAHCKSEESNMCELLRINTDRGVMIHDGQSRFSKNGQPIHHFLGTSTFSEYTVVHAGCVAKINPAAPLDKVCVLSCGICTGFGATVNVAKPKPGSSVAIFGLGAVGLAAAEGARVSGASRIIGVDLVSARFEEAKKFGVNEFVNPKDHDKPVQQVIAEMTNGGVDRAVECTGSIQAMVSAFECVHDGWGLAVLVGVPSKDDAFKTAPINFLNERTLKGTFYGNYKPRTDLPSVVEKYMSGELEVDKFITHTVPFSEINKAFDLMLKGQSIRCIIRMQE

SEQ ID NO: 8341 - protein, 1266 aa, Coccidioides immitis RS
MSNLYFGLPMLSRGDYTVGWICALPLELAAAQAILDTIHEEPLLDPDSNDDNGYVFGSIGDHNVVIACLPSGVYGTVSAARVAKQMTTSYKSIRFNLMVGIGGGVPSTKKDTRLGDVVVSKPTATSGGVIQYDLGKRTGPDQLKITGTLNKPPQVLLTAAAKLEARDILGQSQFSRYLSQIIERDQNGAFAYPGADQDILFSADYDHVGEESTCSRCDQGKVRHRAARKTEAPKVHYGLIASGNQVMRHGLTRDRLALKNGILCFEMEAAGLMDNHPCLVIRGICDYADSHKNKQWQGYAAAAAAAYGKEILISIPAKPLQGPSVVRVRQSEILNALLLTQPEDDRNSLIIRKGKRVENTCQWIMKNQQYRQWLEQTNSQILWLSGGPGKGKTILAIYLTEELERCVNLKSGTVLYYFCDNQDEKRNTALAVLRGLLHQLLEQHPYLAQYIEKFFDGVETTSYTVSRFERLWRAFYTLLQNGGLNEVVCVVDGLDECEDESLKLFLDSLHSLFLGSKPLNTHFKLLLLSRAQPTFIESKLGRFPRLDLDVDRRHELRRDVEKYITAKVNELELEDQLEESRLKIVREALEKGADGTFLWVGFVADELKGKSKHKMEEILTKVPKRLGDIYKRILHQMEDKEQLARILQWVVLARRPLTLTELAIAVDIHDSNTQSCVEILKDQLSSCRQLLKVMGDSVSLIHNSAKDFLLGDVHSGIEAFCVREETHLVLARTCLDTIEKKRGEAVFGRGPEHMKDSYGRTPLFWAASRGHGEVARLLLDNGANVNSKDKNKLTPLHVATTSEHTKLMTLFLDRGAHIEAKGASGDTPLARAIENGSKEVIKVLLERGANEEYLHAQTRVRPGAHAATRQVSIEDRAEALLDLQDDLLFRRFEKRFEVMGFALGKVLFLLRLKPFFKLIAKYMDYQLDQREASSFEVLRQLVVKDRSTGLEKAVRPVIKFCDRVVDSKDIQRLQGLVVVGNKLVQNALAPGSEALLGVAIQVGVAMFQRAVNQQFREGLDIMGYHSAQSLKIAFEKDKHDVIRREVNKCMLKWSTDVTNGGEGSVDMLGAAWSLYKSIVFDGDPMTTKVMLNIYADAFGELVRGKYSESLFSDLTIVLSNDAAYLARRRDHDAVQTVTKCLMLLAERGDDVFLDFLVDLVPASFQQILHRLPSNLCAWLISEGELLAKDCFLQLQLQTRALKALIECLILMKQTYPTELGETLGYVKKIFETVKQERILDEKDINQILYYIFGISNGDAASDCGSG

SEQ ID NO: 8342 - protein, 702 aa, Triticum aestivum
METKADVAAAGGDDLSTMREQCRSMEEAISFRREAQLGLVGSLQHLVPDLVPSLDRSLRLIAAFNDRSFTPTPNPNAGDPQNPSLKPHHRRAVPDPTRSTRRKTSPGSSPASAAVGGAAPGGLDAVRTMVAVFLLELIPFAEIDAAVLARRLQAESSSASDAERAALADLATELGGSVPAAVALALRRIAEDSGGVQIEEAMIGGKQMMMVWAIDRSKLLKELPESATLLSPQPPPIPQATSSETDANTAIIPRPPPPHQQQQPDMWAHSMPPMFPRPRGMTMAGMQRMVPGLMPLQRPFMAPSPGPSPTQQNQRTEEEDLKDLEVLLSKKTYKEKQNTKTGEELLDLIHRPTAKETAVAAKFKTKGGSQLKEYCTNLTKEDCRRQSGSFVSCAKVHFRRIIAPHTDTNLGDCSFLDTCRHTKTCKYVHYELDQTPDIAPMMAGTLAPPRQIKPHRAEYCSEIELGESQWINCDIRNFRMDILGQFGVIMADPPWDIHMELPYGTMADDEMRTLNVPALQTDGLIFLWVTGRAMELGRECLELWGYKRVEEIIWVKTNQLQRIIRTGRTGHWLNHSKEHCLVGIKGSPLVNRNIDTDVIVAEVRETSRKPDEMYAMLERISPRTRKLELFARMHNTQAGWLSLGNQVSGTRLVDEGLRARYKAAYPDFEVQPPSPPRASAPMDVDQSTPSQKPVASDGERPT

SEQ ID NO: 8343 - protein, 457 aa, marine gamma proteobacterium HTCC2080
MSYSNHFVPPHPKPLPALPALARVLWHGDGNLLELMPGEAYRFDFGNLGYSRRSTVLFNQPELVREILRDDGSRFPKSDLMVNALEPLIGQSIFVTDGARWKRQRGMIDPAFSQLRVSHAFDAMQSAVLDHLDVLDGHADSGDSFSLDMAMSHLTADVICRTIFSTPLAAGVSSDVFEDFTEFEQSVAQVDIFRLIFQKAWAKMPQPPGVLAACQRIRGHLGDLVDPHLENPGAFNDIASDVIAAKDSDTGEAFTREELIDQLGVFFLAGHETSASALTWVFYLLAEQPTLVLRLRNELEHVVGSGPINFNHVKQLPLVRAVFRETLRLYPPITFIPRVALEDCQIGPRKLRRGALVMVSPWTIHRHQRYWSDPDAFIPDRFLVEGESSIQEGAYIPFGVGPHTCIGAGFAQAEAVLIIAELVRRFDFSRADRQSVRPAARLTTRPAQQIKLHCRRL

SEQ ID NO: 8344 - protein, 460 aa, Pseudomonas putida KT2440
MTSVTPCASSSSEMNDFLQAHPDTQYVDLLISDMNGVVRGKRIERASLHKVYEKGINLPASLFALDINGSTVESTGLGLDIGDADRICFPIPGTLSDEPWQKRPTAQLLMTMHELDGQPFFADPREVLRQVVSKFDDLGLTICAAFELEFYLIDQDNLNGRPQPPRSPISGKRPQSTQVYLIDDLDEYADCLQDMLEAAKEQGLPADAIVKESAPAQFEVNLHHVADPLKACDYAILLKRLIKNVAYDHEMDTTFMAKPYPGQAGNGLHVHISLLDKKTGKNIFASDDPLQSDTLRHAIGGVLETMPASMAFLCPNINSYRRFGAQFYVPNAPSWGLDNRTVAVRVPTDSSENVRLEHRVAGADANPYLMLAAILAGVHHGLTNKVEPEAPIEGNSYEQLEQSLPNNLRDALRALDDSEVLNQYISPDYIDIFVACKESELAEFEVSISDLEYNWYLHTV

SEQ ID NO: 8345 - protein, 135 aa, Gloeobacter violaceus PCC 7421
MRNAMETSQMLSPDIDIVASTVLRPWGSFTVLGEGNGYKVKRIEVKPGHRLSLQMHHHRSEHWVVVSGTARVVCNDRIELIHANQSTYVPPCATHRLENPGIIPLVIIEVQNGQYLGEDDIIRFEDDYKRIEPRS

SEQ ID NO: 8346 - protein, 117 aa, Vitis vinifera
MSSDLVDIKFRLYDGSDVGPFRYSSTSTVDMLKERVVSDWPKGKTIIPKAANEVKLISSGKILENDKTVGQCRIPFGELAGGVLVMHVVVQPSLAKTKTEKKIDKSPKKVVCSCSIL

SEQ ID NO: 8347 - protein, 167 aa, Acidovorax sp. JS42
MRAANAMGMNFRIGEGWDVHALVPGRRLVIGGVEIPHTMGLLGHSDADVLLHAITDALLGAAALGDIGSHFPDTDARFKGADSVALLEEAARRVGDTGYAIGNIDSTVVAQAPRLAAHIPAMRERIAGALGLVLDQVNVKAKTAERLGPVGQGLSIEARAAVLLFKK

SEQ ID NO: 8348 - protein, 364 aa, Chlamydophila pneumoniae
MSHTECGIVGLPNVGKSGLFNALTGAQVASCNYPFCTIDPNVGIVPVIDERLEALAKISNSQKIIYADMKFVDIAGLVKGASDGAGLGNRFLSHIRETHAIAHVVRCFDDPDVTHVSGKVNPVEDIEVINLELIFSDFSSAKNIHSKLEKLAKGKREVGALLPLFDTIIAHLEKGLPLRTLELTPEQIVALKPYPFLTMKPMFYIANVDESSLPDMDNDYVAAVREVAAKENSKVVPICVRIEEEIVSLPIEERLEFLMSLGLEKSGLHRLVRAAYDTLGLISYFTTGPQESRAWTVVRGSSAWEAAGEIHTDIQKGFIRAEVITFEDMIECQGRAAARELGKLHIEGRDYIVQDGDTMLVLHN

SEQ ID NO: 8349 - protein, 151 aa, Sinorhizobium meliloti
AERKLLPALYHRQMEGQFTEPTRIIGASRASLSHDEYRRFASDALKEHLKSGEFNEAEVEKFTSRLYYVSVDAKSEQGWDDLKKLLEEGKDRTRAFYLAVGPAIFSDISEKIRDHKLITRNTRIVVEKPIGRDLASATELNDTIGKVFREE

SEQ ID NO: 8350 - protein, 151 aa, Sinorhizobium medicae
AERKLLPALYHRQMEGQFSEPTRIIGASRASLSHEEYRNFAADALKEHLKSGEFNEAEVEKFTARLFYVSVDAKSEQGWDDLKKLLDEGKERTRAFYLAVGPAIFGDISEKIRDHKLITRNTRIVVEKPIGRDLASATELNDTIGKVFREE

SEQ ID NO: 8351 - protein, 384 aa, Burkholderia vietnamiensis G4
MRSAITHRSKLPDVGTTIFTVIGQLAAQHDALNLSQGAPNFAPDPALIDGVARAMRDGHNQYAPMAGVVSLRERLAEKTEALYGARYDPGTEITVIASASEGLYGAISALVHPGDEVIYFEPAFDSYAPIVRMQHATPVAIKLSPEHFRVDWDEVAAAITPRTRMIVVNTPHNPTATVFRADDLERLAQLTRNTDIVVLSDEVYEHVVFDGAQHQSVARHRELAERSVIVSSFGKSFHVTGWRVGYCVAPAALMDEIRKVHQFMTFSADTPMQVAFAQMLARPESYLGLSAFYQAKRDLLARELAGSRLQLLPSEGSFFMLARFRHLSDERDSDFVLRVIRDVRVATIPLSAFYADGTDTGVIRLSFSKDDATLIEGARRLRSL

SEQ ID NO: 8352 - protein, 151 aa, Sinorhizobium meliloti
AERKLLPALYHRQMEGQFTEPTRIIGASRASLSHDEYRKFASDALKEHLKSGEFNEAEVEKFTSRLYYVSVDAKSEQGWDDLKKLLEEGKDRTRAFYLAVGPAIFSDISEKIRDHKLITRNTRIVVEKPIGRDLASATELNDTIGKVFREE

SEQ ID NO: 8353 - protein, 344 aa, Burkholderia xenovorans LB400
MKTHMQAAVVEQFGKPLVLKELAIPTPGPGQVLVKTEACGVCHTDLHATNGDWPLKPGLPFTPGHEGIGIVAALGAGVTAVKEGDRIGVPWLYSACGHCEYCLAAREPVCAEAQFGGYTKNGGFAEYIVADPNYVAHIPAGLAAREAAPLICAGITSYKGIKETQARPGEWVVISGVGGLGHLGIQYAKAMGLQVCAVDIDDGKLAHAKRLGADAVVNANDGDPIAAVIRATGGGAHGVLITAPSLGAFKQGVGMTRKCGTCVLVGLPPGEFPTPLFDVVANCITIRGSFVGNRRDMAEALAFAADGKVRADIELQPLSAINNVFQRLGHGDVPSRVVLEFASH

SEQ ID NO: 8354 - protein, 253 aa, Brassica napus
MPTRNIAIGGVQEEVTHPSALRAALAEFISTLIFVFAGSGSGIAFNKLTDNGATTPSGLVAAALAHAFGLFVAVSVGANISGGHVNPAVTFGAFLGGNITLLRGLLYWIAQLLGSVVACFLLQFATGGLAVPAFGLSAGVGTLNGLVFEIVMTFGLVYTVYATAIDPKNGSLGTIAPIAIGFIVGANILAGGAFSGASMNPAVAFGPAVVSWSWSNHWIYWVGPLVGGGLAGIIYDFVYIIENGHEQLPTTDY

SEQ ID NO: 8355 - protein, 390 aa, Pyrococcus abyssi GE5
MNYIFDLSILLVVAKSLEWLLKKRGVHPIIAHILTGIILGPFGLAIVKPSEELKVLGEFGLIMMMLYMGLTSNFSAISRNKVKATIVATLGVAFSFILGFSTVYFIERNMIAALFVGITLGNTAIEVTSGVLVRERVKKEISSVLMGAAFADDIIAVYLIGLLTGITQGSFSLYPMVVLTIKIVVFIVATLLISEFVFKRSARFYNVVKDLHVFFTFTIILTFMLAFLAEDIGLNQIIGAYLAGLTISRLRERKDPMVITRIKLNELISELEVVLLEFFIPLFFIYVGLMFQPNVREISVLMIALLYLAAILGKLIGCGLGMLLFGSSLRDAIIVGVGMGGRGSLELAILKLGLEKGLINESLFATIVIVSMLTALSTPIFFRGVIRKLS

SEQ ID NO: 8356 - protein, 322 aa, Aeropyrum pernix K1
MASAPALQMASYRKALGRLLARLASELEDLVVLDADTLRSTGAIEVYRSAPRRVLNMGISEQDLIGTAAGIALAGLRPVVTGFGAFLMRGWEQIRNTVDRDGLNVKIVATHTGLSPHVDGSSHQVLEDLALMRSLARTAVFSPADDVATVETVEWLVRRYRGPAYVRLGRDNAFRVYSEEEFTFRPGGGEVLVEPGEAVTLLATGPMVGVSLAAAALLRSEGLRVGVVDVYSIKPAPRRLVLEAAERSRLLVTVEEHRTVGGLGDVVSSILAEEGACARQARIGVPPGVYGSSSRDYMSLLRHLRLDPESVAARVRRLAAAL

SEQ ID NO: 8357 - protein, 412 aa, Rickettsia typhi str. Wilmington
MKENFNISKLKNGLTILTYNMPYVHSVAINLIAKVGARYENEEEEGISHFLEHMAFKGTKTRTAQQIAEEFDSIGGYFNAYTGYENTVYYVRVLSENCHKALNILADIIQNSIFADEEISKEYQIIMQEIAHHHDNPDDLIYETFYNTVYKDQPLGKSILGTAKTLVKFTQEHFLNFIGKHYNAENLYLSIAGNIEHNKIVIIAEELFASLKQGVTSSFIPAKYIGGKGFIHKELEQTSLVLGFECTSYINLEKLYQTYLLSIIFGGGVSSRLFQSIREKLGLAYVVGSYNSAYFDSGVFTIYASTAHEKLELLYSEIKNEIIKITETVSTEELMRAKIQLRSNLQMAQEQNSYKSEEIGKNYSVFGKYILPEEIIEIITNIKADDIINTANKIFSGTTALAIIGPNDLNGF

SEQ ID NO: 8358 - protein, 171 aa, Triticum aestivum
MASGGIKTMASGLLFLNLIMYVVVAVIAGWAVNYSIEDSAHSLRGASPPVRLFPVYFPMGNLATGFFVIFALLAGAVGISTSLTGLRDVTEGYPASMMSAAASALVTWTLTLLAMGLACKEISIGLRPPSLRALETFTIILAGTQLLCVGSLHAGANAAIVQTPMGVRARV

SEQ ID NO: 8359 - protein, 285 aa, Pseudomonas putida KT2440
MSDLSVMVVGCGDVGGRLAKQMLAKGWQVSGLRRSVGQLPAGVQPVAADLAEPSIPQAWPQGPLDYLVYCVAASQHDEAGYQAAYVDGLRHVLAWLAERGQRPRRLLFVSSSSVYAQKGGEWIEEGAATEPEGYSGRVMLEAERLALASGIPASVVRLTGIYGPGREWLLSQVRQGYRVAEEPPLYGNRIHAEDAASLLAFLLQADADGKALDDCYIGVDDDPAPLADVVAWLRAYMGVTEWSDEQRVRRTGSKRCSNARARALGWAPVYPSYKEGYAAILAGKA

SEQ ID NO: 8360 - protein, 372 aa, Idiomarina loihiensis L2TR
METIKSRAMVAWGPGEPLKEEIIDVAPPKKGEVRVRIIATGVCHTDAYTLSGKDPEGIFPSVLGHEGGGIVESVGEGVTSVEVGDHVIPLYTAECGECKFCTSGKTNLCQAVRATQGKGLMPDGTSRFSKDGETIYHYMGTSTFSEYTVLPEISLAKIPKDAPLEKVCLLGCGVTTGMGAVKNTAKVQEGDTVAVFGLGGIGLAVIIGAVQAKASRIIAIDVNDDKQTIAKELGATDFVNPTKYDKPIQEVIVDMTDGGVDFSFECIGNVDVMRAALECCHKGWGESVIIGVAGAGEEISTRPFQLVTGRVWRGSAFGGVKGRTELPDYVKQYMDGKFDLDTFITHTMPLEEINEAFDLMHEGKSIRSVIHY

SEQ ID NO: 8361 - protein, 280 aa, Listeria monocytogenes EGD-e
MTLSFSDTYRLNNGIEMPRHGFGVYKLTDEARMRTALETAVDVGYRLFDTASFYHNEKELGDFFASSGLKRDEFFVTTKMWNTEQGYDETLRAFEKSQKKLQLDQIDLYLVHWPKQDTFFDTWRAVEKLYDEGLVRAIGVSNFEAHHLDRLRTSANVLPVVDQLETHPHFPNHLLHRYLEELHIVHQAWSPLGRGGVLQEQILIDLAEKHGKSPAQIVLRWHLQNNISIIPKSETPSRIRENAAIYDFELSEADMRQVERLNTGERVSHAPDVMYVRSEI

SEQ ID NO: 8362 - protein, 462 aa, Gloeobacter violaceus PCC 7421
MTRITPNSSFSLTLRLHLPNQPGMLAKATAAIGEAGGNIGDIELIEQERAYTVRDLIVDATSEEHAHAIAERVSAIPELKLLQVDDRTFQIHQGGKIQIVSKIPLRTRSDLAMAYTPGVGRICMAIARNPERVYELTIKRNTVAVLTDGSAVLGLGDIGPAGALPVMEGKALLFKEFANIDAFPVCLSTQNVDEIVETAVRISTVFGGINLEDISAPRCFEVERLLQERLDIPVFHDDQHGTAIVVLAALENALKLVDKSLASVRIVINGAGAAGIAIHQLLTAAGARAIVMCDSHGIVSAGRADLNAEKRAVAVEQTGALADAMAGADVFLGVSKGGVLSRAMVQSMATDPVVFAMANPVPEILPEEAEGVVAVMATGRSDYPNQINNVLAFPGIFRGALDCRARRVNLEMKMAAARAIAALVSPDEIAPESIIPSVFDRRVVVAVSAAVQQAARATGVAR

SEQ ID NO: 8363 - protein, 377 aa, Xanthomonas campestris pv. campestris str. ATCC 33913
MSSPSPFPSAQPFGDPAAIRCERAASELRAGRPVLITDAQGHTRAVLGLDSSTAQSYTAFARAAQGRHYLFVTPTRAQVLGLVAPQGARVALASHDYDQLAALAYLRDTPVPSQWTPGDALDAGAVEIARLGLLLPAMLAVELPGEQDRAAFAGCQSLALDDLDSGCATSAAAGYELVTRSPVPLRGLGMSEFVVFRGGVAQRDQVAIVVGQPDLGSAVPVRVHSSCLTGDLFGSLKCDCGDQLRHGLAKLKELGGGVLLYLDQEGRGTGIASKMRAYGYQHAGLDTIDADAQLGFGPDERRYGSAVAMLRGLGISRIRLLTNNPTKAERLRAAGIVVEDRIPVTGDITPENEQYLRTKAARAGHALDVDALILAAQ

SEQ ID NO: 8364 - protein, 478 aa, Ralstonia eutropha JMP134
MTRSTKIVATIGPASSSLEVLTRMIAAGVDVVRLNFSHGTAQDHIDRATLVREAAQACGREVAIMADLQGPKIRVGKFESGKVTLKPGDPFVLDSSCQLGNQERVGLDYQDLPRDVGPGDLLLLNDGLIVLVVDRVLGTEIFTTVRIGGDLSNNKGINRQGGGLSAPALTAKDMDDIKTAMALGADYVAVSFPKNATDMEMARQLAAVAGQPYGRKARMIAKIERAEAINPGVLEEILQASDGIMVARGDLAVEVGNAAVPALQKRMIKLAREANKLTITATQMMESMIVNPVPTRAEVSDVANAVLDGTDAVMLSAETAAGRYPVETVEAMAAVCIEAEKSEVVQLDTDFLNQTFSRIDQSVAMGALFTAYHLQVKAIAALTDSGATALWMSRHRIHVPIYAMTPNVASQRKMQLYRNVVPLPLDASTDRDTALEQAEELLLAQGVVQRGDFIVLTIGEPMGQPGGTNTLKIVRVGS

SEQ ID NO: 8365 - protein, 398 aa, Ralstonia eutropha JMP134
MTSVLRLSDLISQGKISGKRVFIRADMNVPQDDAGNITEDTRIRASVPAIEACLAAGAAVMVTSHLGRPTEGEFKPADSLAPIATRLSELLGKPVKLVQNWVDGVEVAPGQVVLLENCRVNKGEKKNSDELAQKMAKLCDVYVNDAFGTAHRAEATTHGIAKYAPIACAGPLLAAEIDALGKALGQPARPLVAIVAGSKVSTKLTILKSLADKVDNLIVGGGIANTFMLAAGLKIGKSLAEADLVADAKTIIDIMAKRGASVPIPVDVVCAKAFSATAAATVKDVKDVADDDMILDIGPKTAAQLADQLKAAGTIVWNGPVGVFEFDQFGNGTKVLAEAIADSKAFSIAGGGDTLAAIAKYGIADRVGYISTGGGAFLEFLEGKKLPAFEVLEQRAAG

SEQ ID NO: 8366 - protein, 151 aa, Sinorhizobium meliloti
AERKLLPALYHRQMEGQFTEPTRIIGASRASLSHDEYRRFASDALKEHLKSGEFNEAEVERFTSRLYYVSVDAKSEQGWDDLKKLLEEGKDRTRAFYLAVGPAIFSDISEKIRDHKLITRNTRIVVEKPIGRDLASATELNDTIGKVFREE

SEQ ID NO: 8367 - protein, 151 aa, Sinorhizobium meliloti
AERKLLPALYHRQMEGQFTEPTRIIGASRASLSHDEYRRFASDALKEHLKSGEFNEAEVEKFTSRLYYVSVDAKSEQGWDVLKKLLEEGKDRTRAFYLAVGPAIFSDISEKIRDHKLITRNTRIVVEKPIGRDLASATELNDTIGKVFREE

SEQ ID NO: 8368 - protein, 500 aa, Clostridium tetani E88
MGRMVELYNDNYSLVWNRGNNMDIIFISGIILLICAVSSKVLYKYGIPTLIMFLAIGMIMGSEGLGGIYFDNSELANKLCNFGLLFIMFSGGFETNWKTAKPVAFASGVLATGGVVLTAFLIGIFAHFILGLTFLEGMLLGSIISSTDAASVFSILRSKKLNLKNNLAPMLEMESGSNDPVAYMLTTIVIGLITGGKHNIVTLLMTQILIGALVGILVGKISVWLINNINLDIEGLYSILAISTALLSYSGANQLMGNGFLAVYITGLIMGNSRLVHKISLVRYFDGLSWLMQILLFFTLGLLVFPSRLFQVALKGIGTAAFIIFIARPIAVFCVLTLFKRPIKDQLLVSWVGFRGAASIVFATYPLTAGLTVADEIFNIVFFVALVSVLVQGTFFIPIAKKLNLIGEEETVLKTFTDYSGEIHAELLELNITENSEMVGKAIKDIDIPMGILIVMIKRKDKLITPNGGTVIKAYDTIMLSAEDRTQLIEMDEKTKIAFE

SEQ ID NO: 8369 - protein, 470 aa, Burkholderia vietnamiensis G4
MKAESNGRPAAGVKSSGQPALQQTLGTWQLWGIAVGLVISGEYFGWSYGWASAGTLGFVITALFVAAMYTTFIFSFTELTTSIPHAGGPFAYARRAFGPTGGYLAGAATLVEFVFAPPAIALAIGAYLHVQFPGLEPKHAAMGAYLVFMALNIVGVQIAATFELVVTLFAIFELLVFMGVVSPGFAWSNFMKGGWAGADHFSMGAFHGMFAAIPFAIWFFLAIEGVAMAAEEAKNPKRSIPIAYVAGILTLVVLAIGVMVFAGGAGDWTKLANINDPLPQAMKYIVGANSGWMHMLVWLGLFGLVASFHGIILGYSRQIFALAREGYLPEWLGKVHPRFKTPHRAILAGGVVGIAAIYSDELIQFGGQTLTANIVTMSVFGAIVMYIVSMAALFKLRRSQPNMARPFRAPMYPLFPAFAIVAALVCLGTMVYFNGLVAMVFIAFLAVGYAYFIATRSQRASAPADVLLEE

SEQ ID NO: 8370 - protein, 151 aa, Sinorhizobium meliloti
AERKLLPALYHRLMEGQFTEPTRIIGASRASLSHDEYRRFASDALKEHLKSGEFNEAEVEKFTSRLYYVSVDAKSEQGWDDLKKLLEEGKDRTRAFYLAVGPAIFSDISEKIRDHKLITRNTRIVVEKPIGRDLASATELNDTIGKVFREE

SEQ ID NO: 8371 - protein, 490 aa, Rhodococcus sp. RHA1
MTATVSEYLGTPGREAPASARRAKIVCTLGPATATGDRIRELVDCGMDIARLNFSHGEHSDHEENYLRVRDASELAGRAVGILADLQGPKIRLGRFAEGSTVWSDGDLVRITVDECEGTHDRVSTTYKQLAEDAEPGDRLLVDDGKIGLVVTDVDGNDVVCRVTEGGPVSNNKGVSLPGMNVSVPALSGKDIADLEFALRLGVDLIALSFVRSAADIELVHAVMDRVGRRVPVIAKLEKPEAIDNLEAIVLAFDAVMVARGDLGVELPLEQVPLAQKRAIQIARENAKPVIVATQMLESMIENSRPTRAEASDVANAVLDGADAVMLSGETSVGKHVMETVRTMGRIISAVEEKSTHVPPLAHVPRTKGGVLSYAARDIGERLGAAALVAFTQSGDTVRRLARLHTPLPLLAFTPLPAVRAQLALTWGTETFLVDPVESTDQMIHQVDHALLGLGRYQRGDLVVIVAGSPPGTVGSTNLIHVHRIGEEDH

SEQ ID NO: 8372 - protein, 466 aa, Streptococcus pneumoniae TIGR4
MDAKLRYKAKKIKIVFFDIDDTLRNSKTGFIPTTIPTVFKQLREKGILTGIASGRGIFGVVPEIRDLKPDFFVTLNGAYIEDKKGQVIYQHQIEKSDVEEYISWAKQEGIEYGLVGSHDAKLSTRTDMMSEAINPIYPDLDVDPDFHEKEDIYQMWTFEDKGDDLHLPDSLSDKLRMVRWHQHSSDIVPISGSKATGVEKVVEHLGLKPEKVMVFGDGLNDLELFDYAGISVAMGISHDKIKEKADYITKTLEEDGIFAALEVFGMVEKELHFPQVDIETVEGPLATIKTNHGDLRIKLFPEHAPKTVANFVSLSKDGYYDGVIFHRIIKDFMIQGGDPTGTGMGGESIYGESFEDEFSEELYNIRGALSMANAGPNTNGSQFFIVQNQHLPYSKKEITRGGWPEPIAEIYANQGGTPHLDRRHTVFGQLADEASYAVLDAIAAVETGAMDKPVEDVVIETIEIED

SEQ ID NO: 8373 - protein, 513 aa, Bacillus thuringiensis serovar konkukian str. 97-27
MIDQKQQSNTFEERVETIKQGGAPKYHEQNKAKGKLFVRDRLALLFDNGEYVEDALFANCEETGLPADGVITATGKIHGRTACVMANDSTVKAGSWGARTVEKILRIQETAEKLRVPLFYLVDSAGARITDQVEMFPGRRGAGRIFYNQVKLSGKVPQVCLLFGPSAAGGAYIPAFCDVVMMVEGNASMYLGSPRMAEMVIGEKVTLEEMGGARMHCSISGCGDVLCKTEEDAITQARQYISYFPNNYLEKTPLVTPQEPKQFDKTLEQIIPENQNAPFNMKDLINRVIDEGSFYEVKKLFAQELITGLARIDGKPVGIIANQPRMKGGVLFHDSADKAAKFINLCDAYHIPLLFLADVPGFMIGTKVERAGIIRHGAKMISAMSEATVPKISIVVRKAYGAGLYAMAGPAFEPDCCLALPTASIAVMGPEAAVNAVYANKIAALPEEERDSFIAEKREEYKKDIDIYHLASEMVIDGIVHPNNLREELKGRFEMYMSKYQVFTDRKHPVYPV

SEQ ID NO: 8374 - protein, 1162 aa, Arabidopsis thaliana
MTTVIDATMAYRFLEEATDSSSSSSSSKLESSPVDAVLFVGMSLVLGIASRHLLRGTRVPYTVALLVIGIALGSLEYGAKHNLGKIGHGIRIWNEIDPELLLAVFLPALLFESSFSMEVHQIKRCLGQMVLLAVPGVLISTACLGSLVKVTFPYEWDWKTSLLLGGLLSATDPVAVVALLKELGASKKLSTIIEGESLMNDGTAIVVFQLFLKMAMGQNSDWSSIIKFLLKVALGAVGIGLAFGIASVIWLKFIFNDTVIEITLTIAVSYFAYYTAQEWAGASGVLTVMTLGMFYAAFARTAFKGDSQKSLHHFWYFQNLEMVAYIANTLIFILSGVVIAEGILDSDKIAYQAKVTTVLGLRQLYSFTSLLLLLSTWNSWRFLFLLYVYIQLSRVVVVGVLYPLLCRFGYGLDWKESIILVCHIDSVLTYSHSFDSAIKRKFTYQQGDWNIVLLQFLFFTGGIVFLTLIVNGSTTQFVLRLLRMDILPAPKKRILEYTKYEMLNKALRAFQDLGDDEELGPADWPTVESYISSLKGSEGELVHHPHNGSKIGSLDPKSLKDIRVQATYWEMLDEGRISEVTANILMQSVDEALDQVSTTLCDWRGLKPHVNFPNYYNFLHSKVVPRKLVTYFAVERLESACYISAAFLRAHTIARQQLYDFLGESNIGSIVINESEKEGEEAKKFLEKVRSSFPQVLRVVKTKQVTYSVLNHLLGYIENLEKVGLLEEKEIAHLHDAVQTGLKKLLRNPPIVKLPKLSDMITSHPLSVALPPAFCEPLKHSKKEPMKLRGVTLYKEGSKPTGVWLIFDGIVKVTQNLSFTFNSTLGLYEVLTGKPYLCDLITDSMVLCFFIDSEKILSLQSDSTIDDFLWQESALVLLKLLRPQIFESVAMQELRALVSTESSKLTTYVTGESIEIDCNSIGLLLEGFVKPVGIKEELISSPAALSPSNGNQSFHNSSEASGIMRVSFSQQATQYIVETRARAIIFNIGAFGADRTLHRRPSSLTPPRSSSSDQLQRSFRKEHRGLMSWPENIYAKQQQEINKTTLSLSERAMQLSIFGSMVNVYRRSVSFGGIYNNKLQDNLLYKKLPLNPAQGLVSAKSESSIVTKKQLETRKHACQLPLKGESSTRQNTMVESSDEEDEDEGIVVRIDSPSKIVFRNDL

SEQ ID NO: 8375 - protein, 395 aa, Streptococcus pneumoniae TIGR4
MKLSNRVLEMEESVTLAAGARAKALKAEGRDILSLTLGEPDFTTPKNIQDAAIASIRDGRASFYTVTSGLPELKAAVNSYFERFYGYSVASNQVTVAAGAKYSLYTFFMAVVNPGDEVIIPTPYWVSYGDQVKMAEGVPVFVSAKEDNHFKVTVEQLEAARTDKTKVLVLNSPSNPTGMIYTREELLAIGNWAVENDILILADDIYGRLVYNGHEFTPISSLSEAIRKQTVVINGVSKTYAMTGWRIGYAVGEADIIAAMSKIAGQTTSNPSAVAQYAAVEALSGEQDTVESMRQAFEERLNTIYPLLAEVPGFEVVKPQGAFYLFPNVKKAMEMKGYTDVTDFTTVILEEAEVALVTGAGFGAPENVRLSYATDLDTLKEAVERLKAFMGSEND

SEQ ID NO: 8376 - protein, 465 aa, Pyrococcus abyssi GE5
MKTLILAGGKGTRLWPLSREAMPKQFIKVFSDRSLFQKTVERALLFSKPKEIFIVTNKEYKFRVLDDLNELGLKVPEENILLEPVGKNTLPAIYWGLKVIDENYGDSVVAVLPSDHAIKVNDNYMEAFKKAEKLAEKYLVTFGIKPTKPHTGYGYIKPGEKIKVEGKTIGYLVDEFKEKPDLETAKKYVENGYYWNSGMFMFRTSVFMEEARKHAPETVRAFEEGKSIEEIYELVPEISVDYGIMEKTDKAAVVPLNTYWNDLGSFDAVYEALDKDENGNAVQVAGFKAKYININSRNNLILTERLTATVGVEDLIIVDTGDALLVAKRGETQKVKEVYKRLREENDERAIVHRTAYRPWGSYTVLEEGERYKIKRITVLPGKRLSLQIHYHRSEHWVVVRGTAKVVVGDKEFILRPGESTFIPAGVPHRLENPGKVVLEVIETQIGEYLGEDDIVRLQDDFGRE

SEQ ID NO: 8377 - protein, 664 aa, Yersinia pestis CO92
MTTELETSFADLGLSAPILSALTDLGYEKPSPIQLECIPHLLNGRDVLGMAQTGSGKTAAFGLPLLHNIKADLKSPQVLVLAPTRELAVQVAEALSSFSKHINGVNVVALYGGQRYDVQLRALRQGPQVVVGTPGRLLDHLKRGTLNLSNLSGLVLDEADEMLRMGFIEDVETIMAQIPAEHQTALFSATMPEAIRRITRRFMKEPQEVRIQSSVTTRPDISQSYWRVGGGYRKNEALVRFLEAEDFDAAIIFVRTKNATLEVAEALERSGYNSAALNGDMNQALREQTLERLKDGRLDILIATDVAARGLDVERISLVVNYDIPMDSESYVHRIGRTGRAGRAGRALLFVENRERRLLQNIERTMKLTIPEVELPNADLLSERRLAKFAAKVSQQLESSDLDMYRALLAKLQPEEEFDIETLAAALLKMAQGERPLILPPEAPRRPQREFNSRDDRGNDRGSRDRGDSRRDNRSDSRSADSRDGGERPARRERRDVGEMELYRIEVGRDDGVEVRHIVGAIANEGDISSRYIGNIKLFASHSTIELPKGMPGEMLSHFTRTRILNKPLNMQLLGDAQPHERRERPAGGNGGERRGGGRPFSGERREGAGAPPRRSFSGDRAPTGGGERRGNRDGQRSAAPRRDDAAAPAAAAAAPARRRFGDA

SEQ ID NO: 8378 - protein, 366 aa, Zea mays
MENGGAKRDVPDDANEHCPGTQSEEAGKADACAGCPNQQICATAPKGPDPDVVAIVERLATVKHKLLVLSGKGGVGKSTFSAQLSFALAEMDHQVGLLDIDICGPSIPKMLGLEGQDIHQSNLGWSPVYVESNLGVMSIGFMLPNPDDAVIWRGPRKNGLIKQFLKDVDWGEIDYLVVDAPPGTSDEHISIVQYLQATGIDGAIIVTTPQQVSLIDVRKEINFCKKVGVPVLGVVENMSGLRQPLSDLRFIKSDEAGETDATEWALNYIKEKAPELLSVVACSEVFDSSKGGAEKMCHEMGVPFLGKVPMDPQLCKAAEEGRSCFADQKCSASAPALRNIVKKLIKAEGENSVGLLGNLVVRNEMK

SEQ ID NO: 8379 - protein, 371 aa, Candida albicans SC5314
MNRSSYSSQSDNRYSRNPAVLCSFYSKIGACRHGEKCSKKHLKPISSRTILLANLYQNPTLNDDDYGHANGIGSETSQIIDNESVIKNSDTVGTVSQIDDSPHSNSGEVTKDETVETQEVETENSENIAETGDVKIDHNEDQKQIEDVKESDKVESSEEVQQDDKLHKEDTLEKESEDNIKQDENIEDAKLEDTEKDKLPEFTISQSQKDFDQFFQDIFVHISKLGQIRDIAVCENENNHLAGNVYVMFESAEDAYNANLQLNQEWFNGKPVYSDLSPVNDFNDACCEEYRDYHDCQRGAMCNYMHVRLPSSDIEESLYESQAKSYMLKQLEELKKELPGDIRSSSSTNDDETNGNENGISSTMAVLEQLS

SEQ ID NO: 8380 - protein, 467 aa, Candida glabrata CBS 138
MASLFRPPESTRQNARSPRLKLPPLSNVSLAVPGESPTGKLSATSSRGSSATSANMKRPMPPPLPKLDVPLSAASSTEGLVRKMKQLSVEDESPQSGSSRGVERDDTTAVNQSVDSFFSNLISVYDQSSSAITSPKIDEPEDSAVKDALATRVPRSLTQGKDIDELSEEVWHSKNLLAEIETQGVLGEGAGGSVAKCKLRTGKKVFALKTINILNGDPEFQKQLLRELQFNKSFKSEYIVRYFGMFTDEQNSSIYIAMEYMGGKSLEAIYKELLSRGGRISEKVLGKISEAVLRGLSYLHEKKVIHRDIKPQNILLNEDGQVKLCDFGVSGEAVNSLATTFTGTSYYMAPERIQGQPYSVTCDVWSLGLTILEVAQGHFPFGPDKMATTIAPIELLTLILTFTPHLDDEPDKNIKWSRAFKSFIEYCLRKEARARPSPRQMIQHPWIQGQMKKQVDMRKFITKCWQK

SEQ ID NO: 8381 - protein, 496 aa, Coccidioides immitis RS
MAAQTVTLQGAEGRSIEIPTGLFINNEFVPSLTGTTLDTTNPANGDLLATIAAASEEDINAAVQSAKDAFYTTWKATPPTTRQSLILKLADLIERDVDEFANLEALDGGILLSGSKGMHVPHSVETLRYFAGWADKIDGKSIAIPSGIAYTHREPLGVCAAIVPWNAPLIVTMWKLAPCIAAGNTLVLKTSELTPLYGIKLAALIKEAGFPAGVVNIVTGLGAVAGRALSEHMDVRKIAFTGSTLTGRAIMKAAASSNLKKVTLELGGKGPTIIFDDADLQNAVFWATLGITANNGQICVAGSRIYVQEGIYEKFIAAFSAASTKAVAGDPLLSNTTKGPIVSADQHSKIMGYIKKGQDEGARLLHGGGQPAPGYIENTAFVDVNEDMTIMREEIFGPVAAISKFKTESEAIQKANNTEYGLSSAIFTNNVSRADRVSRALESGQVTVNSWGMVHANVPFGGIKMSGFGKDMGEESLDGWTGTKTIKYHTLPEVPN

SEQ ID NO: 8382 - protein, 445 aa, Escherichia coli
AVMGRNLALNIESRGYTVSIFNRSREKTEEVIAENPGKKLVPYYTVKEFVESLETPRRILLMVKAGAGTDAAIDSLKPYLDKGDIIIDGGNTFFQDTIRRNRELSAEGFNFIGTGVSGGEEGALKGPSIMPGGQKEAYELVAPILTKIAAVAEDGEPCVTYIGADGAGHYVKMVHNGIEYGDMQLIAEAYSLLKGGLNLTNEELAQIFTEWNNGELSSYLIDITKDIFTKKDEDGNYLVDVILDEAANKGTGKWTSQSALDLGEPLSLITESVFARYISSLKDQRVAASKVLSGPQAQPAGDKAEFIEKVRRALYLGKIVSYAQGFSQLRAASEEYNWDLNYGEIAKIFRAGCIIRAQFLQKITDAYAENPQIANLLLAPYFKQIADDYQQALRDVVAYAVQNGIPVPTFAAAVAYYDSYRAAVLPANLIQAQRDYFGAHTYKRI

SEQ ID NO: 8383 - protein, 76 aa, Triticum aestivum
  misc_feature (68)..(68): Xaa can be any naturally occurring amino acid
MEQPEAGDGAPQQRHKKSSAAKKAKKGRATRSGSGGAWPAVKPKKDLLVNRLKGTQLLTVPDFLTFGXAKAFVDLA

SEQ ID NO: 8384 - protein, 379 aa, Brassica napus
MATQGQVITCKAAVAYEPNKPLVIEDVQVAPPQAGEVRIKILFTALCHTDAYTWSGKDPEGLFPCILGHEAAGIVESVGEGVTEVQPGDHVIPCYQAECRECKFCKSGKTNLCGKVRSATGVGVMMNDRKSRFSVNGKPIYHFMGTSTFSQYTVVHDVSVAKIDPQAPLEKVCLLGCGVPTGLGAVWNTAKVEPGSNVAIFGLGTVGLAVAEGAKTAGATRIIGIDIDSKKYETAKKFGVNEFVNPKDHQKPIQEVIVDLTDGGVDYSFECIGNVSVMRAALECCHKGWGTSVIVGVAASGQEISTRPFQLVTGRVWKGTAFGGFKSRTQVPWLVEKYMNKEIKVDEYITHNMTLGEINKAFDLLHEGTCLRCVLSTSD

SEQ ID NO: 8385 - protein, 686 aa, Vitis vinifera
MQKLGDFKLPNFFNYPPYFTLLPPRDLAQVVKLGWVYERFQPVRDTQEKQIFVIGLEEEFSLFLNPVIENTLNFGSDGIGTLSHEAREAFLSALVLEGERLWVGGQCYDRKCGQELNLKEQPQGLHPESALTNMPDWGLGVGNSKPILSGSWCLHHLHRHGPIPPGSCLLPPGGLPKVQVTVVADLVGFWESKTKSSTHKVTREESAIATCDPYIWDNKRKPFQITNFSYADLESATNGFSAESFLGKGSYGSVYRALLHHGKLIAAVKRAIGPQQHNNKCASCTNCSTCSNSTSPADNEIEILSRVRNPRLVNLLGFSVDRNEKKLIVVEFMPNGSLYDILHSSPRPPSWRRRVRWASQIAKAVESLHSSNPPVIHRDIKSSNVLLDGKWNARLGDFGLALRGHVEDVRVRCTPPAGTLGYLDPGYLAPGDLSTKSDVFSFGILLLEMISGRNAIDVNYSPPSVVDWAVPLIKHTNFSAICDPRIGEPEDPRVIRQLAVLAARCVRSTAEKRPAATEVVDCLRNVRKMVQSPPIWGNVRRRVQRPSRSRQMTLEVLDGSGEMVKTKKLGSRRNRKVSSVPGAEEGNEAVGSLSDGVIRSKSIGSGSEIKMGWDPKKKPGLVVKMPVMRLVKSRSMGVVQSKRLLHCHQFAFELDKRAHAFRELSEPKLLVWTRSSSFRLLSITGD

SEQ ID NO: 8386 - protein, 445 aa, Citrobacter koseri
AVMGRNLALNIESRGYTVSVFNRSREKTEEVIAENPGKKLVPYYTVKEFVESLETPRRILLMVKAGAGTDAAIDSLKPYLDKGDIIIDGGNTFFQDTIRRNRELSAEGFNFIGTGVSGGEEGALKGPSIMPGGQKEAYELVAPILTKIAAVAEDGEPCVTYIGADGAGHYVKMVHNGIEYGDMQLIAEAYSLLKGGLNLSNEELAETFTEWNKGELNSYLIDITKDIFTKKDEEGKYLVDVILDEAANKGTGKWTSQSSLDLGEPLSLITESVFARYISSLKEQRVAASKVLSGPKAQLEGDKAEFIEKVRRALYLGKIVSYAQGFSQLRAASDEYNWDLNYGEIAKIFRAGCIIRAQFLQKITDAYAENAGIANLLLAPYFKKIADDYQQALRDVVAYAVQNGIPVPTFSAAVAYYDSYRAAVLPANLIQAQRDYFGAHTYKRT

SEQ ID NO: 8387 - protein, 508 aa, Burkholderia vietnamiensis G4
MNPFDLKQLGLDVEYPYRQQYDNYIGGKWVPPVKGDYFENVSPINGKPFCRVPRSGAEDIEAALDAAHAARRKWAKTSVTERANLLLAAADRMEKNLKLLAVAETIDNGKPLRETMAADLPLAVDHFRYFAGCIRAQEGGISEIDDNTVAYHFHEPLGVVGQIIPWNFPLLMAAWKLAPALAAGCCVVMKPAEQTPASVLVLMELIGDLFPAGTINIVNGFGKEAGEALATSKRIAKIAFTGSTPVGKHILRAAAESLIPSTVELGGKSPNIFFADVLDQDDAFLDKTLEGLAMFALNQGEVCTCPSRILIQESIYERFIEKAVARVERIKAGHPLDLQTMIGAQASQQQLDKILSYIDIGRGEGAQCLTGGERTAPAADLGAGYYVKPTMLLGNNKMRVFQEEIFGPVASVMTFKDEQEAIELANDTFFGLGAGVWTRNGTRAYRMGREIEAGRVWTNCYHLYPAHAAFGGYKQSGIGRETHKMALSNYQQTKCLLVSYQAEALGFF

SEQ ID NO: 8388 - protein, 151 aa, Sinorhizobium meliloti
AERKLLPALYHRQMEGQFTEPTRIIGASRASLSHDEYRQFASDALKEHLKSGEFNEAEVEKFTSRLYYVSVDAKSEQGWDDLKKLLDEGKDRTRAFYLAVGPAIFSDISEKIRDHKLITRNTRIVVEKPIGRDLASATELNDTIGKVFREE

SEQ ID NO: 8389 - protein, 151 aa, Sinorhizobium medicae
AERKLLPALYHRQMEGQFSEPTRIIGASRASLSHEEYRNFAADALKEHLKSGEFNEAEVEKFAARLFYVSVDAKSEQGWDDLKKLLDEGKERTRAFYLAVGPAIFGDISEKIRDHKLITRNTRIVVEKPIGRDLASATELNDTIGKVFREE

SEQ ID NO: 8390 - protein, 465 aa, Rhodococcus sp. RHA1
MPNPSPGYSITVRVTAPVGAGTTSTLAGAVASVKGAMTALDVVESHPDHMVIDVTCDASDVEHAEQIASAIADVPGVVVGKVSDRTFLLHLGGKLEVVPKVPLKHRDDLSRAYTPGVARVCTAIAENPEDVRRLTIKRNTVAVVTDGSAVLGLGNIGAAASIPVMEGKAALFKQFADVDAWPVCLDTQDTDAIVEIVRALAPVYGGINLEDISAPRCFEIEARLRDMLDIPVFHDDQHGTAIVVLAALTNALRVVEKSLDTVKIVVSGVGAAGHAIIRLLVAQGATNIVACGRNGILSPDDTSDSFRSWIANNTNPEARSGSLRDAVVGADVFIGVSAPDILTGDDIETMGPDSIVFALANPVPEVDPVAAGRHAAVVATGRSDFPNQINNVLAFPGVVRGLLDAHAVEITDDMLIAAARAISDSVSPSELNPTYIVPSVFDAAVAPAVAAAVRSVADAGGEHDV

SEQ ID NO: 8391 - protein, 371 aa, Vitis vinifera
MGKTTSSSGGKQGLGWMEWLRGWLYVIYEMLFQRISASHLQNPLPLPPLHDLTCIITGSTSGIGLQIARQLAEAGAHVVMAVRNSKAANDLIQKWQSEWSGKGLPLNIEVMELDLLSLDSVARFCEAWNARSAPLHVLINNAGIFSIGEPQKFSKDGYEEHMQVNHLAPALLSILLLPSLIRGSPSRIVNVNSVMHYIGFVDTEDMNVVSGKRKYTSLVGYSSSKLAQVQFSSVLHKRLPAEAGVSVVCVSPGVVQTNVARDLPRIVQAAYHLIPYFIFTPQEGSRSALFAATDPQIPEYCEMLKADEWPVSAFISQDCNPTNPSEEAHNIETSYRVWEKTLELIGLPLDSVERLIEGEEVKCRYGGQAEE

SEQ ID NO: 8392 - protein, 341 aa, Ralstonia solanacearum GMI1000
MNETILLTGATGYIASHTWVELLDAGYQVIGLDNLCNSSAAVLARIEQITAKTPKFVQGDVRDRRLLDDLFASTRISAVIHFAALKSVGESVQKPLAYYDNNMGGLVTLCAAMAHANVRQLVFSSSATVYGNPHTVPITESFPLSATNPYGQTKLMGEQVLRDLEVSNGAWRIAYLRYFNPVGAHHSGLIGEDPRGIPNNLMPYVAQVAAGRREQLSVFGGDWPTPDGTGVRDYIHVVDLARGHLSALDVLRRDGRGFTVNLGTGRGYSVLEVVAAYQRASGRPIPYEIVARRPGDIAACYADPSLAASQLGWRAQYGIERMCEDSWRWQSMNPDGFQTRG

SEQ ID NO: 8393 - protein, 156 aa, Zea mays
MASSPRSPPAPTPEFEISRQSRLFAAGVGAGRLQLSKKLLLGYLPNDRALWPVAVGAEELAKKRGQYAAFKGEFLRNPVRVTREEHPLSLGKTSAWNQFFEYSEIMEQIDRDVKRAHPDMHFFCSDSSFAKSNQESLKNALLIFAKLNAGIGYVQG

SEQ ID NO: 8394 - protein, 624 aa, Oryza sativa Japonica Group
MASISGAAALRPRRRRAGCGCGGTPPPPLPPPPPRPPLHRGPLPLLLVLVGAAALLYPGGAARLQAGAERQHPRRVEKDPIKLWERYVEWLYQHKELGLFVDVSRMGFTEEFLRRMEPRMQRAFAAMRELEKGAIANPDEGRMVGHYWLRDPGLAPNSFLRTKIETTLDRILAFSQDVVSGKIKPPSSPAGRFTQILSIGIGGSALGPQFVSEALAPDNPPLKIRFIDNTDPAGIDHQIAQLGPELASTLVIVISKSGGTPETRNGLLEVQKAFRDAGLDFSKQGVAVTQENSLLDNTARIEGWLARFPMFDWVGGRTSEMSAVGLLPAALQGIDIKEMLVGAALMDEETRNTVVKENPAALLALCWYWASEGIGNKDMVVLPYKDSLLLLSRYLQQLVMESLGKEFDLDGNRVNQGLTVYGNKGSTDQHAYIQQLREGVHNFFVTFIEVLRDRPPGHDWELEPGVTCGDYLFGMLQGTRSALYSNDRESISVTVQEVTPRAVGALVALYERAVGIYASLVNINAYHQPGVEAGKKAAGEVLALQKRVLTVLNEASCKDPAEPLTLDQIAERCHCPEDIEMIYKIIQHMAANDRALIAEGSCGSPRSIKVYLGECNVDEDMLAA

SEQ ID NO: 8395 - protein, 334 aa, Schizosaccharomyces pombe 972h-
MTDVQETQKGALKEIQAFIRSRTSYDVLPTSFRLIVFDVTLFVKTSLSLLTLNNIVSAPLWDSEANKFAGLLTMADFVNVIKYYYQSSSFPEAIAEIDKFRLLGLREVERKIGAIPPETIYVHPMHSLMDACLAMSKSRARRIPLIDVDGETGSEMIVSVLTQYRILKFISMNCKETAMLRVPLNQMTIGTWSNLATASMETKVYDVIKMLAEKNISAVPIVNSEGTLLNVYESVDVMHLIQDGDYSNLDLSVGEALLKRPANFDGVHTCRATDRLDGIFDAIKHSRVHRLFVVDENLKLEGILSLADILNYIIYDKTTTPGVPEQTDNFESAV

SEQ ID NO: 8396 - protein, 219 aa, Magnetospirillum magnetotacticum MS-1
MTLLLAAQDPETGRGLSDIEVKANIVTFIAAGHETTANALTWALYCLSQDGAARARVEAEADAAAGPEGNLRLDRLPFTKAVMEETMRLFPPVPFLSRQALRDDRIGRVKIPRNSTVIVAPWVMQRHRKLWDEPDAFIPDRFFGSRRESIERYAYLPFGAGPRVCIGQSFSVQEATLVLAHVARAVRFTLPDEHPPVTPLHRVTLRPKDGLRMVARRRM

SEQ ID NO: 8397 - protein, 461 aa, Burkholderia xenovorans LB400
MTFLKSPPPTPDAVADEYAAMISGSSLPKYRIPEASSDRRAVFDLVRDELFMDGNSRQNVATFCTTYADDEVRRLMDLSIDKNMIDKDEYPQTAEIEMRCVHMLADLWHATKSWKTTGCSTTGSSEACMLGGLALKWQWKKRREAQGKPTGKPNFVCGPVQVCWAKFARYFDVEMRQVPLSGDATGLRPEDLAQYCDENTIGVVATLGITFTCVYEPVKALAGALDALQANVGLDIPIHVDAASGGFVAPFIQPDLEWDFSVPRVKSINASGHKYGLAPLGVGWIVWRSTQDLPDELIFRVDYLGGDMPTFALNFSRPAGQIIAQYYMLLRLGREGYRHIQQECADTAQALADGLAKIDALDMIYDGRGALPAVCYKLKHPDTAGFTLFDLSDRVRMRGWQIASYELPAGREDTIVQRVLIRRGVTRDMAAMLLEDIKHAIAHLTKNPVPNSTAGPTFHHD

SEQ ID NO: 8398 - protein, 623 aa, Streptococcus pneumoniae TIGR4
MSDFIVEKLSKSVGDKTVFRDISFIIHDLDRIGLIGVNGTGKTTLLDVLSGVSGFDGDVSPFSAKNDYQIGYLTQDPDFDDRKTVLDTVLSSELKEIQLIREYELIMLDYSEDKQARLERVMAEMDSLQAWEIESQVKTVLSKLGIQDLSTPVGELSGGLRRRVQLAQVLLGNHDLLLLDEPTNHLDIAIIEWLTLFLKNSKKTVLFITHDRYFLDALSTRIFELDRAGLTEYQGNYQDYVRLKAEQDERDAALLHKKEQLYKQELAWMRRQPQARATKQQARINRFHDLKKEVSGSSAETDLTMNFETSRIGKKVIEFQDVSFAYENKPILQNFNLLVQAKDRIGIVGDNGVGKSTLLNLIAGSLEPTAGQVVIGETVRIAYFSQQIEGLDESKRVINYLQEVAEEVKTSGGSTTSIAELLEQFLFPRSTHGTLIEKLSGGEKKRLYLLKLLLEKPNVLLLDEPTNDLDIATLTVLENFLQGFAGPVLTVSHDRYFLDKVATKILAFEDGKIRPFFGHYTDYLDEKAFETDMANQVQKAEKEKVVKVREDKKRMTYQEKQEWASIEGDIETLEKRIAAIEEEMQANGSDFGKLATLQKELDEKNEALLEKYERYEYLSEFDS

SEQ ID NO: 8399 - protein, 136 aa, Flaveria trinervia
MNHNQQSNEVRHDDENALSDFLASLTDYTPTIPDELVEHYLAKSGFQCPDVRLTRLVAVAAQKFVSDIAIDALQHCKARQAAVVRDKKEKQQRDKRLIMNMEDLSKALQEYGVNVKHQEYFADNPSAGLESAARDE

SEQ ID NO: 8400 - protein, 327 aa, Oryza sativa
  misc_feature (17)..(17): Xaa can be any naturally occurring amino acid
  misc_feature (48)..(48): Xaa can be any naturally occurring amino acid
  misc_feature (64)..(64): Xaa can be any naturally occurring amino acid
MASSIAMSLRSLAATDXAFLPMPSPSSAPFLLLLSPSTPRLRLHLHLXSTRRLPALLPALPGSXDSFESASVLLLPAVLDFAEPGACEESDVPEESDQEEEGYAPEAEEEAEADEEVEEEAVEASAEVAEEAEDVEEVGEYVEPPEEAKVYVGNLPYDIDSERLAQLFEQAGIVEVSEVIYNRETDRSRGFGFVTMSTVEEAEKAVEMFHRYDVDGRLLTVNKAAPRGARVERPPRQFGPSFRIYVGNLPWQVDDSRLVQLFSEHGKVVDARVVYDRETGRSRGFGFVTMATQEELDDAIAALDGQSLDGRALRVNVAEERPPRRGF

SEQ ID NO: 8401 - protein, 211 aa, Myxococcus xanthus DK 1622
MASPLVVGIAGGTASGKTTVARKVREALADCRVAFIDQDSYYRDLKDLPLADRREVNFDHPDAFDRELLVQHLQALKSGQPIQKPVYDFVTSSRTPQTKKVDPGDIILIEGILVLHMKEVRDEMDVKIYVDADDDLRILRRLTRDIKDRGRDFDHVVSQYLRHVRPMHMGFVEPSKHFADIIIPHGGNNEIAIGMLVGALRGKLSGAVNRD

SEQ ID NO: 8402 - protein, 661 aa, Candida glabrata CBS 138
MATIPKRHTYGGGPEVHYTRNPYSAAPRNSMSSRGKKHVTFGPYIVGSTLGEGEFGKVKLGWTRTPSTGPEQRPAVSKQVAIKLIRRDTIVKNSEKEIKIYREINALKHLTHPNVVRLEEVLQNSKYIGIVLEYASGGEFYKYIQRKRRLKESTACRLFAQLISGVTYMHSKNLVHRDLKLENLLLDKNENLVITDFGFVNEFLPDNEYMKTSCGSPCYAAPELVISTRPYVARKADVWSCGIILYAMLAGYLPWDDDSTNPEGDDIGKLYQYITRTPLKFPEYITPIPRDLLRKILVPDPNKRVNMQYIHRHEWLKPHRPFLAVSTSQWDKLIKNSANVQLDHTKRVSRTSQHFETEQENSSVNQPVRSDMVNKAMDTSNTTDDAQHSIPNRQPLANVFINSRTYSARSASYAPRHSMSDDPNAIESARHAVQNKHESNLATVMGSPNKDKDDTTEDNNLETVARTSSHHRKPRPTSYYPVDINRSANNFSPIVLNLTNSDENDNSKHPYSTSTSNNPVAPTPQRDQSQVVTDEHGLQLEKNRVREQPLTSDKSRMSSLRSNATAKSSDSKKNKRFSLLSFYTNNGSKTSLHNDSKVSVTPSSKEESATVPPSIPSVVHHTDTTENKRNHRASMMGPSAGGDKSTARRVIDFFKRRSMRM

SEQ ID NO: 8403 - protein, 221 aa, Oryza sativa
RYGRNSGSTTRRGRVGGRVGSRSPHEASGALQAICAAGPTPPSRAARAQAASPRRRSGPAPRRPAPGLLRRRRAPHRLAAPPVQLAPRRAAAVTAYCTVQQAQHTTASLDTCEHSPPLLAPPGRVVAGDLHRASRAGERIMVAFCSPKSRNMVNAIKGLFISCDVPMAQFIVNLNASMPASDKFILHMLDPTHMFVQPHVAEMIRRKISEFRDQNSYEKPT

SEQ ID NO: 8404 - protein, 180 aa, Magnetospirillum magnetotacticum MS-1
MITRRWEFERMQLGMIGLGRMGGNIVRRLLRDGHTAVVYDRDPKAIEALTAEGATAAESLEDLVAKLEAPRTAWVMLPAGQITEETVTALGGLMAADDCIIDGGNSFYQDDVRRAQDLDRRGIHYVDVGTSGGVWGLERGYCMMIGGHKEAVDRLDPIFRTLAPGLGDIPRTPGREARDP

SEQ ID NO: 8405 - protein, 266 aa, marine gamma proteobacterium HTCC2080
MAWYTGNALYDTLLLIGFAYALLVFAASFVGTAAYGGRFGLKGKKQGIKLGSRMGWIIMELPGLMVFPVVYFMGTNAYEAVPLFFLAVWMMHYSNRALITPMLMRVQPGTPASFSFNVIIAGWITLFLHGYFNAAYLTEYGDQYTLDWFSDPRFVLGLIVYATGFGLNIHSDHILRNLRSKTPAPNEPRYKIPFGGVFRWVTCPQYLGEILSFTGFAIMTWNLGAVFVLAMTAGNLIPRALYTHRWFRKNFDEYPPERKAIFPKLL

SEQ ID NO: 8406 - protein, 445 aa, Citrobacter koseri
AVMGRNLALNIESRGYTVSVFNRSREKTEEVIAENPGKKLVPYYTVKEFVESLETPRRILLMVKAGAGTDAAIDSLKPYLDKGDIIIDGGNTFFQDTIRRNRELSAEGFNFIGTGVSGGEEGALKGPSIMPGGQKEAYELVAPILTKIAAVAEDGEPCVTYIGADGAGHYVKMVHNGIEYGDMQLIAEAYSLLKGGLNLSNEELADTFTEWNKGELNSYLIDITKDIFTKKDEEGKYLVDVILDEAANKGTGKWTSQSSLDLGEPLSLITESVFARYISSLKEQRVAASKVLSGPKAQLAGDKAEFIEKVRRALYLGKIVSYAQGFSQLRAASDEYNWDLNYGEIAKIFRAGCIIRAQFLQKITDAYAENAGIANLLLAPYFKKIADDYQQALRDVVAYAVQNGIPVPTFSAAVAYYDSYRAAVLPANLIQAQRDYFGAHTYKRT

SEQ ID NO: 8407 - protein, 395 aa, Idiomarina loihiensis L2TR
MDYQLSDRINAIQPSPTLAVTQKANELRQQGKDVIGLGVGEPDFDTPDFIKEAAIQAIRDGKTKYTAVDGIDELKDAVIKKLQRDNNLSYERKEIIVSAGGKHSIFNLLSAWLNPGDEVIIPAPYWVSYPDMTKLVGAEPVIVKAGIDQRFKITPEQLREALTDKTRLMFINSPSNPAGTAYTADELKALAEVLRDYPKVLIATDDMYEHILWSDSAFANFPMVAPDLKDRTVILTGVSKAYAMTGWRIGYAAGPKPIIAAMKKMQSQSTSNPTSISQYAAAAALNGDQSCIDTMVSAFKERHDYLVDALNSIDGVNCVPGDGTFYAFAQVDELMAKAKVSSDVELCEKLLTEANVALVPGSAFGTDGYCRLSFATSMDVLKEAVKRIKDFSESL

SEQ ID NO: 8408 - protein, 445 aa, Citrobacter koseri
AVMGRNLALNIESRGYTVSVFNRSREKTEEGIAENPGKKLVPYYTVKEFVESLETPRRILLMVKAGAGTDAAIDSLKPYLDKGDIIIDGGNTFFQDTIRRNRELSAEGFNFIGTGVSGGEEGALKGPSIMPGGQKEAYELVAPILTKIAAVAEDGEPCVTYIGADGAGHYVKMVHNGIEYGDMQLIAEAYSLLKGGLNLSNEELAETFTEWNKGELNSYLIDITKDIFTKKDEEGKYLVDVILDEAANKGTGKWTSQSSLDLGEPLSLITESVFARYISSLKEQRVAASKVLSGPKAQLAGDKAEFIEKVRRALYLGKIVSYAQGFSQLRAASDEYNWDLNYGEIAKIFRAGCIIRAQFLQKITDAYAENAGIANLLLAPYFKKIADDYQQALRDVVAYAVQNGIPVPTFSAAVAYYDSYRAAVLPANLIQAQRDYFGAHTYKRT

SEQ ID NO: 8409 - protein, 253 aa, Bradyrhizobium sp. ORS278
MDRRHVLKALAGLALCPVCATPGFAAEGAPHWSYEGATGPAKWGDLDAANKVCSVGNQQSPIDIENAMKTRLPDFKLSWAKTADTIVNNGHTIQLNFADGSGTLKLGETNYKLLQVHFHRPSEHQIGGKNFPMEAHFVHRAASGSLAVLGVLMTTGRPNATFSQIVATMPDKEGPAVKADPRINPNMMLPGRRSYYRYAGSLTTPPCSEVVEWLLLSDPIQVAEADVAKFAKLYPMNARPVQKLDRRFVLQGM

SEQ ID NO: 8410 - protein, 255 aa, Vitis vinifera
MAELQPPEGQINGGAAAGVSSENIGGKRQRRPSVRLGDIGDQPYDSHVNRRSNKQWKLPMESDAKYRKESGNIGKASKTRPLMNLSTGGGEFSEALEGQLGFCCDWELESEGFEEARPRDEAGEIELGLQGGEGDEKFSGGEDVDDGFRDFENEDSDSPLKEQSPIHSLENMAVDHGNDREVLGRGRCQSREDGVRDWLNELGLGRYAPVFEIHEVDEQVLPMLTLEDLKDMGINAVGSRRKMYCAIQKLNKGFS

SEQ ID NO: 8411 - protein, 439 aa, Vitis vinifera
MRLLQFGLILALASGFAAIIIYINGLANIYEKSLLSDEDLGALESLQSGFQKCVSSNGLGLQAARGRDYCQVTIKFPSDTVPKWKDPKTGELEGLSFDFNLCEAVATWEQVRNSTTILTKEFIDALPNGWTDYAWRRINKGILLNNCKNKTLCMEKLSLVLPETPPYFPRQFDRCAVIGNSGDLLKTRFGKEIDGYDAVIRENGAPIENYTAYVGKKSTFRLLNRGSAKALDKVVELDETRKEALIIKTTVHDIMNKMIQEVPIHNPVYLMLGASFGSAAKGTGLKALEFALSICESVDMYGFTVDPGYKEWTRYFSESRQGHTPLHGRAYYQMMECLGLIKIHSPMRADPNRIVTYVPSHSTVTAARTASEKLLRRVGAGSGEPLHACSIIKKQLQREPIGISSIRKAAVDHKNFVKGATMYPLEHSPGHGLLCTVPN

SEQ ID NO: 8412 - protein, 446 aa, Escherichia coli
AVMGRNLALNIESRGYTVSIFNRSREKTEEVVAENPGKKLVPYYTVQEFVESLETPRRILLMVKAGAGTDAAIDSLKPYLDKGDIIIDGGNTYYHDTIRRNRELSAEGFNFIGTGVSGGEEGALKGPSIMPGGQKEAYELVAPILKQIAAVAEDGEPCVTYIGADGAGHYVKMVHNGIEYGDMQLIAEAYSLLKHGLNLSNPELAETFTEWNKGELSSYLIDITKDIFTKKDENGIYLVDVILDEAANKGTGKWTSQSSLDLGEPLSLITESVFARYISSLKEQRVAASKVLSGPEVKPFTGDKAEFVEKVRRALYLGKIVSYAQGFSQLRAASEENNWNLNYGEIAKIFRAGCIIRAQFLQKITDAYAENPSIANLLLAPYFKKAADDYQQALRDVVAYAVQNGISTPTFSAAIAYYDSYRAAVLPANLIQAQRDYFGAHTYKRT

SEQ ID NO: 8413 - protein, 360 aa, Streptococcus pneumoniae
MKSKIILKNKTILVTGAAGFIGANLVMSLLQEENPLQIIGIDNLNDYYDVSLKEYRLSTIQEECQSSLNKKWVFIKGDIADSDLMEEIFETYRPQIVVNLAAQAGVRYSITNPDVYMKSNIIGFHTILEKCRKYQENIEHLVYASSSSVYGGNTKIPFSELDAVDNPVSLYAVTKKTNELEAHAYSKLYNIPTTGLRFFTVYGPAGRPDMAYFSFTKQLIDKKPIEIFNYGNCQRDFTYIDDIVEGVKRVMTGAPQKEIGEDGLPIPPYAIYNIGNHQPENLLNFVEILQEKLIAASILPEDYDFSSAQKLVPMQAGDVVATYADISLLEKDFNFKPKTSLRNGLRNFAEWYRNFYQRGE

SEQ ID NO: 8414 - protein, 422 aa, Streptococcus pneumoniae
MQNGIEIFIKGVNRMKITVVGMGYVGLSLAVLLAQHHEVTALDIIDKKIQLINEKKSPIQDEYIEQYFLEKNLHLSATTNEVEAYKDAEMIIIAAPTDYDTHKNFFDTSAVEQVIENIISMNNEALIVIKSTVPVGYTESIREKYGKKNILFSPEFLREANGLYDNLYPNRIIVGTDLNDGALVSKAHEFVSLLQEGALKENIDTLIMGFSEAEAVKLFSNAYLALRVSYFNELDTYAELKGLNTKAIIDGVGLDPRIGQFYNNPSFGYGGYCLPKDSKQLLSNYHDVPENIISAIVSSNETRKKFIAERILEIVGANHIDEYYNLKQEIVVGIYRLVMKKGSDNFRHSSIQGIIKRLKANGVTLMIYEPSLPDGQLFFGSEVVHDFPKFKEKSHLIVANRFDETLMDVKDKVYTRDLFGRD

SEQ ID NO: 8415 - protein, 497 aa, Alternaria alternata
MTSVKLSTPQTGEFEQPTGLFINNEFVKAVDGKTFDVINPSTEEVICSVQEATEKDVDIAVAAARKAFNGPWRKETPENRGKLLNKLADLFEKNADLIAAVEALDNGKAFSMAKNVDVPAAAGCLRYYGGWADKIEGKVVDTAPDSFNYIRKEPIGVCGQIIPWNFPILMWSWKIGPAIATGNTVVLKTAEQTPLSAYIACKLIQEAGFPPGVINVITGFGKIAGAAMSAHMDIDKIAFTGSTVVGRQIMKSAAGSNLKKVTLELGGKSPNIVFADADLDEAIHWVNFGIYFNHGQACCAGSRIYVQEEIYDKFIQRFKERAAQNAVGDPFAADTFQGPQVSQLQFDRIMGYIEEGKKSGATIETGGNRKGDKGYFIEPTIFSNVTEDMKIQQEEIFGPVCTISKFKTKADVIKIGNNTTYGLAAAVHTSNLTTAIEVANALRAGTVWVNSYNTLHWQLPFGGYKESGIGRELGEAALDNYIQTKTVSIRLGDVLFG

SEQ ID NO: 8416 - protein, 445 aa, Escherichia coli
AVMGRNLALNIESRGYTVSIFNRSREKTEEVIAENPGKKLVPYYTVKEFVESLETPRRILLMVKAGAGTDAAIDSLKPYLDKGDIIIDGGNTFFQDTIRRNRELSAEGFNFIGTGVSGGEEGALKGPSIMPGGQKEAYELVAPILTKIAAVAEDGEPCVTYIGADGAGHYVKMVHNGIEYGDMQLIAEAYSLLKGGLNLSNEELAQTFTEWNNGELSSYLIDITKDIFTKKDEDGNYLVDVILDEAANKGTGKWTSQSALDLGEPLSLITESVFARYISSLKDQRVAASKVLSGPQAQPAGDKAEFIEKVRRALYLGKIVSYAQGFSQLRAASEEYNWDLNYGEIAKIFRAGCIIRAQFLQKITDAYAENPQIANLLLAPYFKQIADDYQQALRDVVAYAVQNGIPVPTFAAAVAYYDSYRAAVLPANLIQAQRDYFGAHTYKRI

SEQ ID NO: 8417 - protein, 496 aa, Davidiella tassiana
MTSVQLETPHSGKYEQPTGLFINNEFVKGQEGKTFDVINPSDESVITQVHEATEKDVDIAVAAARKAFEGSWRQETPENRGKLLNNLANLFEKNIDLLAAVESLDNGKAISMAKGDISMCVGCLRYYGGWADKITGKVIDTTPDTFNYVKKEPIGVCGQIIPWNFPLLMWAWKIGPAIACGNTVVLKTAEQTPLGGLVAASLVKEAGFPPGVINVISGFGKVAGAALSSHMDVDKVAFTGSTVVGRTILKAAASSNLKKVTLELGGKSPNIVFEDADIDNAISWVNFGIFFNHGQCCCAGSRVYVQESIYDKFVQKFKERAQKNVVGDPFAADTFQGPQVSKVQFDRIMEYIQAGKDAGATVETGGKRKGDKGYFIEPTIFSNVTEDMKIVKEEIFGPVCSIAKFKTKEDAIKLGNASTYGLAAAVHTKNLNTAIEVSNALKAGTVWVNTYNTLHHQMPFGGYKESGIGRELGEDALANYTQTKTVSIRLGDALFG

SEQ ID NO: 8418 - protein, 258 aa, Xanthomonas campestris pv. campestris str. ATCC 33913
MTAHRWRLDGQTALITGASAGIGLAIARELLGFGADLLMVARDADALAQARDELAEEFPERELHGLAADVSDDEERRAILDWVEDHADGLHLLINNAGGNITRAAIDYTEDEWRGIFETNVFSAFELSRYAHPLLTRHAASAIVNVGSVSGITHVRSGAPYGMTKAALQQMTRNLAVEWAEDGIRVNAVAPWYIRTRRTSGPLSDPDYYEQVIERTPMRRIGEPEEVAAAVGFLCLPAGSYITGECIAVDGGFLRHGF

SEQ ID NO: 8419 - protein, 377 aa, Phycomyces blakesleeanus
MTQPSRRNDMSRLQQFDAGEQYSIVDIVGEGAYGVVCSAVHKPTGQTVAIKRILPFDHAMFCLRTLREIKLLKYFNHENIISILDIVKPKSYDEFTEVYLIQELMETDLHRVIRTQDLSDDHCQYFTYQTLRALKAMHSANVLHRDLKPSNLLLNANCDLKICDLGLARSANSADENSGFMTEYVATRWYRAPEIMLTFKEYTKAIDVWSVGCILAEMLSGKPLFPGRDYHHQLTLILDVLGTPTMDDFYGIKSRGARDYIRSLPFKKRIPFARLFPEATVDLLEKLLSFNPDRRITVEEALKHPYLEAYHDPDDEPNATPIHESFFDFDKYKDQLTKEQLKRKFFFHIIKRKKERLTQNIYINMYITEMLYEEITQ

SEQ ID NO: 8420 - protein, 307 aa, Zea mays
  misc_feature (216)..(216): Xaa can be any naturally occurring amino acid
MASTCAARVPSLRWAPQRGWVGSWVSVRPAKCRTSGGHAVVCAAVSFRPCIDIHKGKVKQIVGSTLRDLANDSMELVTNFESDKSPAEFAKFYKADELLGGHVIMLGANPSSQAAALEALRAYPGGLQVGGGINLENAMSYLNEGASHVIVTSYVFSDGKMNTERLRKLVELVGKQRLVLDLSCRKKDGRYTIVTDRWQKFSDVFVDEPTLEYLAXFADEFLVHGVDVEGKRLGIDEELVELLGHYSPIPVTYAGGVSTMDDLERIKKAGKSRVDVTIGSALDIFGGDLPYKDVVLWHRKQSMVGQV

SEQ ID NO: 8421 - protein, 276 aa, Oryza sativa Indica Group
MSSARRLLLLAGAAAAIALLLSATAPVAGAEDDGYSYIPGSPRGPQNWGSLKPEWATCSSGKMQSPINLGLLDLTLAPGLGNLNYTYQNANASVVNRGHDIMVRFDGDAGSLKINGTAYQLRQMHWHTPSEHTIDGRRYDMELHMVHLNAQNQAAVIGILYTIGTTPDEFLQKMEPYIIAISNQEGKEKMVVGGADPNVAKGKDTVYYRYMGSFTTPPCTEGVIWTVVRKVHTVSLSQITLLKAAVLMGNENNARPLQDLNNREIDLFFPLPLINN

SEQ ID NO: 8422 - protein, 496 aa, Acidovorax sp. JS42
MSRAARSGGGVASPIMHGMSPDDIRHLFDLQRQASRAHPDVPLMVRRERLLRLSKMLDEHGPVLAAAVQADFGMRSQRLTEVADLFVLRAELGHTLRHLARWSRRTKVRTPLFLQPARGWIERQPLGVVGIISPWNYPVQLALGPAIGALAAGNRVMLKPSELTPHTSAQLAALVAQFFAPEEFCVVQGDAATAALVASLPFDHLVFTGSTAVGRKVAQAAAANLTPTTLELGGKSPCIIDADCDMQEAALKIAHGKLLNAGQTCIAPDYVLLPRGNEAAFAEAFRVAVARLFPYFEGNPDYASIISTRHLARLRTMLQQAQTHGADVHVLQPVPGSPPPPPQGIGDGVGRQMAPTLVFGASPNMQLMQEEIFGPVLPVLSYERLDDAIAHINAHPRPLALYWFGRSEAVRDDVLRRTVSGGVSVNDTLMHIAHDALPFGGVGDSGWGAYHGEAGFLRFCHQKSVLAQSRWSLGHLLYPPYGARFDQVMALLRRLM

SEQ ID NO: 8423 - protein, 361 aa, Rhodococcus sp. RHA1
MPQQVRGVIARSKGAPVEIATVNIPDPGPGEVVVDIAACGVCHTDLTYRDGGINDEFPFLLGHEASGIVESVGEGVTSVAVGDFVVLNWRAVCGQCRACKRGRPQYCFDTHNAAQKMTLEDGTELTPALGIGAFADKTLVHAGQCTKVDPSADPAVVGLLGCGVMAGLGAAVNTGNVSRGDTVAVIGCGGVGDAAIMGARLAGAVKIIAIDRDDKKLEWAKDLGATHTINGGQVDAVSAVQELTGGFGADVVIDAVGRPETWKQAFYARDLAGTVVLVGVPTPDMTLEMPLIDFFSRGGSLKSSWYGDCLPERDFPVLVDLYQQGRLPLDKFVTERIKIDEVEAAFHSMHAGEVLRSVVVL

SEQ ID NO: 8424 - protein, 307 aa, Magnetospirillum magnetotacticum MS-1
GAPDLHRVARFVEKPDAAGAERLIGEGALWNSGYFLFRADVMIAELEAHAPQVLEAARGALAKAATDLDFIRLEASAFAQAPKTSIDYAVMERTTRAGVLKVSFAWSDVGTWDAVWQVLERDAHGNAVRGRVELVETTGSLVHSEGDGLTTVVGLDDVVVVSTPDAVLVAAKAHSGKVKDLVGVLREKAHPEADAHRRIYRPWGWYQRIDIGERFQVKRIMVTPGGRLSLQKHFHRAEHWVVVKGTAEVTLNEQILLVHENEAVYLPIGSMHRLTNPGKIPLELIEVQVGSYTGEDDIIRVEDVYGR

SEQ ID NO: 8425 - protein, 135 aa, Oryza sativa Japonica Group
MTTMDKGRALPKFGEWDVKNPASAEGFTVIFQKARDDKKTTGPGNARDKGRALPKFGEWDVKNPASAEGFTVIFQKARDDKKTTGPGNARVGIPPAFRSTDDDGGYRPQFKPAESYPEKKAPKRVKKKWAFCAGC

SEQ ID NO: 8426 - protein, 728 aa, Oryza sativa Japonica Group
MGKSSKKSAVEVAPTSVSVSEGKSGKKGKRNAEDEIEKAVSAKKQKTVREKVVPSKEEAKKVKKQPPPKKVESSSSEEDSSESEEEVKAQPKKTVQPKKAAQPAKEESSDDSSDDSSSDDEPAKKPVARPNKAALSTNSSSSDDSSDESLSDDEPVKKPAAPLKKPVALATNGSKKVETDSSSSDSSSDEESDEDDKKTAAPVKKPSVAAIQKKTQESDSSDSDSDSESDEDVPTKAPAVAKKKEESSESSDSESDSDSDDEAAKTIIPAKAAAVKKEEESSDSSDSDSESESDSDEPAKPTIPAKRPLTKDTKKGQSKDESEDSSDESSEESGDEPPQKKIKDSTTSGTTKPSPKATKKEISSDDESDEDDSSDESSDEDVKQKQTQAKKVQAPVAQESSSSDESSEEDSDMESDEPAKTPQKKIYVSKSFFILQETAVSVGSNKSATKPGQEEPKTPASNQNQATGSKTLFVGNLPYNVEQEQVKQFFQEAGEVVDIRFSTFEDGNFRGFGHVEFATAEAAKKALELAGHDLMGRPVRLDLARERGAYTPGSGRDNSSFKKPAQSSGNTIFIKGFDTSLDIHQIRNSLEEHFGSCGEITRVSIPKDYETGASKGMAYMDFADNGSLSKAYELNGSDLGGYSLYVDEARPRPDNNREGGFSGGRDFNSSGRGGRRGGRGDGSRGRGDRGRGRGFGRGDRGHGGRGTPFKQSAGTPSAGKKTTFGDDD

SEQ ID NO: 8427 - protein, 446 aa, Thermoproteus tenax
MFTKIVATLGPSTDRLPDITALLSKVHGVRINMSHASPSEVEARVNAVRKYEETSGRYIAIIADLRGPSVRTGLMRPLQITAGARVSFKLAEKGDGFVPVPRREFFEVIEEGDEVLMLDGKLVLRIISAAQTSAEAESLSSGVISSNKAIVVKGKEYHIEQPVEEDIRALQTLSRFRDDVDYVALSLVRDGADVRKMRSVVEEAGLTSGIMAKIETKSAVDKIEEIINAADYIVIARGDLALHYGLEYIPKVQRLLVERSLSAGRPVAVATQLLDSMQTNTTPTRAEVNDVYTTASLGVDSLWLTNETASGEHPLEAVDWLRRIVSQVEFGRLKAASPADARDRFAKAVVDMAEDMGGEIAVYSMTGTLAKRIAKFRPMTTVYVGVNERRLARMLELREDVGAHMGPRACGRAGAYLRGGPREAPLQILRQSLDSHVWAQRRHTYY

SEQ ID NO: 8428 - protein, 364 aa, Oryza sativa
MGAKKHTLQVLPWLLLFAQHTAASACDCANTTDGADRQGAMKLKLIAIASILAAGAAGVLVPVIGRSMAALRPDGDIFFAVKAFAAGVILATGMVHILPAAFDALTSPCLKRGGGDRNPFPFAGLVSMSAAVATMVVDSLAAGYYHRSQFRKARPVDNINVHKHAGDERAEHAQHINAHTHGGHTHSHGDIVVCGSPEEGSVAESIRHKVVSQVLELGILVHSVIIGVSLGASVRPSTIRPLVGALSFHQFFEGVGLGGCIVQANFKVRATVIMAIFFSLTAPVGIVLGIAISSSYNVHSSTAFVVEGVFNSASAGILIYMSLVDLLATDFNNPKLQINTKLQLMAYLALFLGAGLMSMLAIWA

SEQ ID NO: 8429 - protein, 104 aa, Vitis vinifera
LDIDFRIAEDVDFIAISFVKSTKGIKHLKSYIVVRSRDSDIVVIAKIESINSLKNLEEIIQASNGAMVAREDLGAHIPLEQVSSAQQKIVQFCKHLNKPVIVAS

SEQ ID NO: 8430 - protein, 401 aa, Oryza sativa
MPLSSLSLLPLHRAPLPPTSNYPPPPPPSRALLLPLLRHSPLARRSPVSRARAVAADGMAAATAAAETPPTLLEYMGQAGAADDLVVLVAHVQSACKRIAALVASPGNAELSRGKAGGGVAVAAGRDAPKPLDELSNEIILSSLRRSGKVAVMASEENHLPIWVSNDGPYVVVTDPLDGSRNIEVSIPTGTIFGIYNRLAELDHLPEEERAQLNSLQSGTHLVASGYVLYSSATIFCISFGAGTHGFTLDHLTGEFVLTHPSIQIPPRGQIYSVNDARYFDWPEGLRKYIDTIRQGKGQHPKKYSARYVCSLVADFHRTLIYGGVAMNPRDHLRLVYEANPLSFLAEQAGGRGSDGKSRILSIQPVKLHQRLPLFLGGMEDMLELESYGDVQQKVNPGYEV

SEQ ID NO: 8431 - protein, 145 aa, Candida glabrata CBS 138
MFLRSTRLMRPFTRMYHPKVIEHYTNPRNVGSMDKTLRNVGTGVVGAPACGDVIKLQIQVNDNTGVIEEAKFKTFGCGSAIASSSYLTELVQGITIEDAEKIKNIEIAKELSLPPVKLHCSMLAEDAIKAAVRDYKTKRSSTTLH

SEQ ID NO: 8432 - protein, 171 aa, Gloeobacter violaceus PCC 7421
MDLEGIDIVLGRPDLSLAAFVAPDAVVVGRVVVARGVSLWYGAVLRGDVERIEIGEDTNIQDGAVLHGDPGRPVIVGARVTIGHRAVIHAAVVEDECLIGIGAVVLDGVTVGTQSIVAAGAVVTRTVPPGLLVAGVPARVVRTLEEAEKAERREHALNYRALAEHYRNHHT

SEQ ID NO: 8433 - protein, 445 aa, Escherichia coli
AVMGRNLALNIESRGYTVSIFNRSREKTEEVIAENPGKKLVPYYTVKEFVESLETPRRILLMVKAGAGTDAAIDSLKPYLDKGDIIIDGGNTFFQDTIRRNRELSAEGFNFIGTGVSGGEEGALKGPSIMPGGQKEAYELVAPILTKIAAVAEDGEPCVTYIGADGAGHYVKMVHNGIEYGDMQLIAEAYSLLKGGLNLTNEELAQTFTEWNNGELSSYLIDITKDIFTKKDEDGNYLVDVILDEAANKGTGKWTSQSALDLGEPLSLITESVFARYISSLKDQRVAASKVLSGPQAQPAGDKAEFIEKVRRALYLGKIVSYAQGFSQLRAASEEYNWDLNYGEIAKIFRAGCIIRAQFLQKITDAYAENPQIANLLLAPYFKQIADDYQQALRDVVAYAVQNGIPVPTFAAAVAYYDSYRAAVLPANLIQAQRDYFGAHTYKRI

SEQ ID NO: 8434 - protein, 445 aa, Escherichia coli
AVMGRNLALNIESRGYTVSIFNRSREKTEEVIAENPGKKLVPYFTVKEFVESLETPRRILLMVKAGAGTDAAIDSLKPYLDKGDIIIDGGNTFFQDTIRRNRELSAEGFNFIGTGVSGGEEGALKGPSIMPGGQKEAYELVAPILTKIAAVAEDGEPCVTYIGADGAGHYVKMVHNGIEYGDMQLIAEAYSLLKGGLNLSNEELAQTFTEWNNGELSSYLIDITKDIFTKKDEDGNYLVDVILDEAANKGTGKWTSQSALDLGEPLSLITESVFARYISSLKDQRVAASKVLSGPQAQPAGDKAEFIEKVRRALYLGKIVSYAQGFSQLRAASEEYNWALNYGEIAKIFRAGCIIRAQFLQKITDAYAENPQIANLLLAPYFKQIADDYQQALRDVVAYAVQNGIPVPTFAAAVAYYDSYRAAVLPANLIQAQRDYFGAHTYKRI

SEQ ID NO: 8435 - protein, 445 aa, Escherichia coli
AVMGRNLALNIESRGYTVSIFNRSREKTEEVIAENPGKKLVPYYTVKEFVESLETPRRILLMVKAGAGTDAAIDSLKPYLDKGDIIIDGGNTFFQDTIRRNRELSSEGFNFIGTGVSGGEEGALKGPSIMPGGQKEAYELVAPILTKIAAVAEDGEPCVTYIGADGAGHYVKMVHNGIEYGDMQLIAEAYSLLKGGLNLTNEELAQTFTEWNNGELSSYLIDITKDIFTKKDEDGNYLVDVILDEAANKGTGKWTSQSALDLGEPLSLITESVFARYISSLKEQRVAASKVLSGPQAQPAGDKGEFIEKVRRALYLGKIVSYAQGFSQLRAASEEYNWDLNYGEIAKIFRAGCIIRAQFLQKITDAYAENPQIANLLLAPYFKQIADDYQQALRDVVAYAVQNGIPVPTFAAAVAYYDSYRAAVLPANLIQAQRDYFGAHTYKRI

SEQ ID NO: 8436 - protein, 324 aa, Pseudomonas putida GB-1
MKFLVVGGAGYIGSHMVKHLLAVGHEVVVADLVWPGPGIQWAKLDIADEAALDVLFGVCRFDAVFHFASFIQVGESVSAPGKYYQNNVAATLALLQAMVNAGIKHLVFSSSAAVYGNPQYVPIDEAHTKGPINPYGLSKWMVEQILEDFDRAYGLKSVCLRYFNAAGADPEGQLGERHDPETHLIPLILQAASGRREAVTVFGRDYDTPDGTCIRDYVHVADLAAAHALAVDYLLAGGERTAFNLGNGLGFSVQQVIDTARTVTGRQINALDAPRRAGDPPRLVADASKAIQVLGWRPEFASLEQIVRHAWQWELQYPWTVQQG

SEQ ID NO: 8437 - protein, 277 aa, Oryza sativa Indica Group
MHRARLLVVVVTAVVALLLPAPAAGAKEDDQFGYIPGTPRGPENWGSLKPEWATCSSGEMQSPINLGLLDLTLAPGLGDLNYTYRNANATVVNRGHDIMVRFDGGDDAAAAGGLVINGTAYRLRQVHWHAPSEHAVDGRRYDMELHMVHLNTQNQTAVVGVLYAIGAQDEFLHKLEPYIIEAADQKDKEKIVNGGVDPNVAKEHDIVYYRYMGSLTTPPCTEGVIWTIVRKVHTVSLSQLALLKAAVVNGNEKNARPLQDVNNRNIGLFIPLPLINV

SEQ ID NO: 8438 - protein, 606 aa, Oryza sativa Indica Group
MLRRFAARRLRPPATAGYPSSPAAAAAAYAHGGGASVLPDGLDRASDAHSRNAAAVGGLLSDLRARVSQVLAGGGAEAVRRNKARGKLLPRERIDRLLDPGASFLELSQMVSRPTDQLQLYEHFIPGLTTKLAGSGVYEEALPSGGIITGIGPVHGRLCMFVANDPTTKGGTYYPITVKKHLRAQEIASECKLPCIYLVDSGGANLPRQAEVFPDRDNFGRIFYNQAKMSSDSIPQIALVLGSCTAGGAYIPAMADESVIVKGNGTIFLAGPPLVKAATGEEISAEDLGGASVHCKISGVSDHFAQDELHGLTLGRNIVKNLHLAAKVPNVQNSACDYQEPLYDVQELRSIAPADMKQSFDIRQVIARIVDGSEFDEFKKLYGTTLVTGFARICGQPVGIIGNNGILFTESALKGSHFIELCAQRNIPLIFLQNITGFMVGSKSEASGIAKAGAKMVMAVSCSKVPKITIIVGGSFGAGNYGMCGRAYSPNFLFMWPTARISVMGGIQAAGVLAQIEKNNRKRQGVEVLSKMITFALTQWTKDEEEAFKAKVVEAYDKEGSPYYSTARLWDDGIIDPADTRRVLSLCLSAAAKPVPEDTKYGVFRM

SEQ ID NO: 8439 - protein, 445 aa, Escherichia coli
AVMGRNLALNIESRGYTVSIFNRSREKTEEVIAENPGKKLVPYYTVKEFVESLETPRRILLMVKAGAGTDAAIDSLKPYLDKGDIIIDGGNTFFQDTIRRNRELSAEGFNFIGTGVSGGEEGALKGPSIMPGGQKEAYELVAPILTKIAAVAEDGEPCVTYIGADGAGHYVKMVHNGIEYGDMQLIAEAYSLLKGGLNLTNEELAQTFTEWNNGELSSYLIDITKDIFTKKDEDGNYLVDVILDEAANKGTGKWTSQSALDLGEPLSLITESVFARYISSLKEQRVAASKVLSGPQAQPAGDKGEFIEKVRRALYLGKIVSYAQGFSQLRAASEEYNWDLNYGEIAKIFRAGCIIRAQFLQKITDAYAENPQIANLLLAPYFKQIADDYQQALRDVVAYAVQNGIPVPTFAAAVAYYDSYRAAVLPANLIQAQRDYFGAHTYKRI

SEQ ID NO: 8440 - protein, 462 aa, Gloeobacter violaceus PCC 7421
MKVGVIGTGYVGLVTGACLSTIGHTVVCMDNNTAKVEGLRQGVMPIYEPGLDELVAAAVAAGRLQFTTGMAETVQDSDVVFITVGTPSRADGSPDLSAVRAVARSIGSHLDGRFRVIVNKSTVPVGSGNWVRMLVEDGANLVAATARSGQHAGNGLAVLAPAAPPNFSVASNPEFLREGSAVWDTFNPDRIVIGAEDARAVEVMRRLYAHWVSPADTDTQAVPMVVTDLASAEMIKYAANAFLATKISFINEIANICERVGADVTRIAEAIGLDKRIGRSFLNAGAGWGGSCFPKDVSALVSTAAEYGYNCELLKATLSVNEHQRQLVIEKLQRELRILKGRTVALWGLAFKPHTDDIRCAPALAVAEHLLNLGCRVVAHDPVVTAAQVQGQLPDLQVAGSALEAVQGADALLVMTEWPEYGGIDPQTVAAVLRQPIVIDARNCLDTQAVQGAGLRYVGVGR

SEQ ID NO: 8441 - protein, 341 aa, Zea mays
MDHAAEAQRTDLMTITRHVLNEQSRHPESRGDFTILLSHIVLGCKFVAAAVNKAGLAKLIGLAGETNVQGEEQKKLDVLSNEVFVKALVSSGRTCVLVSEENEEAIFVDPALRGKYCVCFDPLDGSSNIDCGVSIGTIFGIYMVKDKDNVTLEDVLQPGTNMLAAGYCMYGSSCTLVLSTGNGVNGFTLDPSLGEFILTHPNIKIPKKGKIYSVNEGNAKNWDGPTAKFVEKCKYPEDGSPPRSLRYIGSMVADVHRTLLYGGIFLYPADQKSPNGKLRVLYEVFPMSFLMEQAGGQAFTGKQRALELAPAKLHDRSPVFLGSYDDVEEIKALYASMSNSG

SEQ ID NO: 8442 - protein, 445 aa, Escherichia coli
AVMGRNLALNIESRGYTVSVFNRSREKTEEVIAENPGKKLVPYYTVQEFVESLETPRRILLMVKAGAGTDSAIDSLKPYLDKGDIIIDGGNTFFQDTIRRNRELSAEGFNFIGTGVSGGEEGALKGPSIMPGGQKEAYELVAPILKQIAAVAEDGEPCVTYIGADGAGHYVKMVHNGIEYGDMQLIAEAYALLKGGLALSNEELAQTFTEWNEGELSSYLIDITKDIFTKKDEEGNYLVDVILDEAANKGTGKWTSQSSLDLGEPLSLITESVFARYISSLKDQRVAASKVLSGPQAQPAGDKAEFIEKVRRALYLGKIVSYAQGFSQLRAASDEYNWDLNYGEIAKIFRAGCIIRAQFLQKITDAYSQNAGIANLLLAPYFKQIADDYQQALRDVVAYAVQNGIPVPTFSAAIAYYDSYRSAVLPANLIQAQRDYFGAHTYKRT

SEQ ID NO: 8443 - protein, 231 aa, Oryza sativa Indica Group
MSSARRLLLLAGAAAAIALLLSATAPVAGAEDDGYSYIPGSPRGPQNWGSLKPEWATCSSGKMQSPINLGLLDLTLAPGLGNLNYTYQNANASVVNRGHDIMVRFDGDAGSLKINGTAYQLRQMHWHTPSEHTIDGRRYDMELHMVHLNAQNQAAVIGILYTIGTTPDEFLQKMEPYIIAISNQEGKEKMVVGGADPNVAKGKDTVYYRYMGSFTTPPCTEGVIWTVVRKN

SEQ ID NO: 8444 - protein, 492 aa, Sorghum bicolor
MDLADIPQQQRLMAGLALVVATVIFLKLLLSFRSGGGKKRLPPTIPGAPVVGGLVKFMRGPIPMIREQYAALGSVFTVPIITRRITFLIGPEVSAHFFKGNEAEMSQQEVYRFNVPTFGPGVVFDVDYSVRQEQFRFFTEALRANKLRSYVDQMVAEAEEYFSKWGESGTVDLKYELEHLIILTASRCLLGREVREKLFDDVSALFHDLDNGMQPISVLFPYLPIPAHKRRDKARARLAEIFATIIKSRKASGQSEEDMLQCFIDSKYKNGRPTTEGEVTGLLIAALFAGQHTSSITSTWTGAYMLRFKQYFAEAVEEQKDVMKRHGDKIDHDILAEMDVLYRCIKEALRLHPPLIMLLRQSHSDFTVTTKEGKEYDIPKGHIVATSPSFANRLPHIYKNPDSYDPDRFGPGREEDKAAGAFSYISFGGGRHGCLGEPFAYLQIKAIWTHLLRNFEFELVSPFPENDWNAMVVGIKGEVMVNYKRRKLVVDN

SEQ ID NO: 8445 - protein, 636 aa, Oryza sativa Indica Group
MATAIPQRQLFVAGEWRAPALGRRLPVVNPATESPIGEIPAGTAEDVDAAVAAAREALKRNRGRDWARAPGAVRAKYLRAIAAKVDRQFEYSASVWNKLEAWLIAYLDAVFVVIRFKLLLIDGFKRRGCATTSVYGSRPWIIERKSELARLETLDCGKPLDEAAWDMDDVAGCFEYFADLAESLDKRQNAPVSLPMENFKCYLRKEPIGVVGLITPWYFTFFSHPALIFIYDPSMALMNYPLLMATWKVAPALAAGCTAVLKPSELASVTCLELADVCKEVGLPSGVLNIVTGLGSEAGAPLSSHPGVDKVAFTGSYETGKKIMASAAPMVKPVSLELGGKSPIVVFDDVDVEKAVEWTLFGCFWTNGQICSATSRLILHKKIAKEFQERMVAWAKNIKVSDPLEEGCRLGPVVSEGQYEKIKQFVSTAKSQGATILTGGVRPKHLEKGFYIEPTIITDVDTSMQIWREEVFGPVLCVKEFSTEEEAIELANDTHYGLAGAVLSGDRERCQRLTEEIDAGIIWVNCSQPCFCQAPWGGNKRSGFGRELGEGGIDNYLSVKQVTEYASDEPWGWEILYSIKPELIDYPSSFKSPVSSGTKLLASSSFPGFYNYSFSESGPKAELFGGASDYGRSCSS

SEQ ID NO: 8446 - protein, 308 aa, Sorghum bicolor
MEINIVDKYEKLEKVGEGTYGKVYKAQDKATGQLVALKKTRLEMDEEGIPPTALREISLLNLLSHSIYVVRLLAVEQAAKNGKPVLYLVFEFLDTDLKKYLDVYRRGPAARPLPATLIKNFLYQLCKGVAHCHGHGVLHRDLKPQNLLVDKDKGILKIADLGLGRAFTVPMKSYTHEIVTLWYRAPEVLLGATHYSTGVDMWSVGCIFAEMARRQALFPGDSELQQLLHIFRLLGTPSEEQWPGVSELRDWHEFPQWKPQSLARVVPTLEPEGVDLLSKMLQLDPSNRISAIAAMEHPYFDSLDKSQF

SEQ ID NO: 8447 - protein, 253 aa, Oryza sativa Japonica Group
MGRKFFVGGNWKCNGTTDQVDKIVKILNEGQIASTDVVEVVVSPPYVFLPVVKSQLRPEIQVAAQNCWVKKGGAFTGEVSAEMLVNLSIPWVILGHSERRSLLGESNEFVGDKVAYALSQGLKVIACVGETLEQRESGSTMDVVAAQTKAISERIKDWTNVVVAYEPVWAIGTGKVATPDQAQEVHDGLRKWLAANVSAEVAESTRIIYGGSVTGANCKELAAKPDVDGFLVGGASLKPEFIDIINSATVKSA

SEQ ID NO: 8448 - protein, 306 aa, Ralstonia solanacearum GMI1000
MSARNGFTEADVPDQSGKGFIVTGANTGLGLETSRVLAARGARVLLACRDRSKAEAAMAHIRQTHPGADLAFLPLDLADLASVRAAAGQAMTAPRIDALINNAGVMMPPLMRTTQGFELQLGVNHLGGFALTALLLPKLAQTPGSRVVVTSSLAHRGASIDWDDLSAATRYNRVKRYGASKLANALFFFELDRRLRASGSPVTAVGCHPGAAVTDLVRYMGALQLLQPLVRRFLNTAAMGAWPTLQAATGPVQPGGYYGPTGLRGIRGPSGRATRSAQAQDPLLAQRLWDVSIAMTGIDPGLPVEN

SEQ ID NO: 8449 - protein, 410 aa, Burkholderia sp. 383
MAASPVNPRLDSLQPYPFEKLRALFKDVTPSGALKPISFGIGEPKHATPALIRDAVVAALDGLASYPATAGSDALRTSIAHWLERRYGLPAIDPATQVLPVSGSREALFSLAQTVIDARPSEQGEKAIVLCPNPFYQIYEGAALLAGAEPYFANSDPARNFACDYASVPDAVWARTQLLYVCSPGNPTGAVLTLDDWRELFALSDRHGFVIASDECYSEIYFDEAAPPLGGLEAAHRLGRGFERLVMLSSLSKRSNVPGMRSGFVAGDAALLKKFLLYRTYHGAALSPVWQHASIAAWNDEAHVRENRALYLQKFNTVTPLLADVIDVKLPDAAFYLWANVSRTGLSDTEFARRLYADYNVTVLPGSYLARDAHGTNPGRDFIRIALVAGTPECVEGAQRIVDFCRSLAR

SEQ ID NO: 8450 - protein, 220 aa, Photobacterium profundum SS9
MIAPSILSADFARLGEDVEKVLAAGADVVHFDVMDNHYVPNLTFGAPICKALRDYGITAPIDVHLMVKPVDRIIPDFAKAGATMITFHAEATEHLDRTLQLIKECGCQAGVVFNPATPLHHLDYVMDKVDMILLMSVNPGFGGQSFIPNTLDKLREVRQRIDASGYDIRLEIDGGVKADNIREIAEAGADMFVAGSAIFNQPDYKAAIDEMRAELAKVER

SEQ ID NO: 8451 - protein, 224 aa, Triticum aestivum
  misc_feature (60)..(60): Xaa can be any naturally occurring amino acid
  misc_feature (126)..(126): Xaa can be any naturally occurring amino acid
  misc_feature (192)..(192): Xaa can be any naturally occurring amino acid
  misc_feature (218)..(218): Xaa can be any naturally occurring amino acid
  misc_feature (220)..(220): Xaa can be any naturally occurring amino acid
NPTKGNKSWSSTAVAAALELVDPPGCRNSARAPPARSACSPPTPARQTPLFSGRPSGGIXADPNEVAAVILGGGTGTQLFPLTSTRATPAVPIGGCYRLIDIPMSSCFNSGINKIFVMTQFNSASXDRHIHRTYLGGGINFTDGSVEVLAATQMPGEAAGWFRGTADAVRKFIWVLEDYYKNKSIEHILILXGDQLYRMDYMELVQKHVDDNADITLXCXPVGK

SEQ ID NO: 8452 - protein, 750 aa, Anaplasma marginale str. St. Maries
MGDFSERDREALEFHCKRRPGKVSLLPTKPLMTQGDLSLAYSPGVAVPCLRIASDPDTVYDYTARGNYVAVISNGTAVLGLGNIGPLASKPVMEGKAVLFKRFADIDAVDIEVDTEDVEEFINAVKHLGLSWGGINLEDIRAPECFIIERRLGELMDIPVFHDDQHGTAIITLAGIINALDITGRNLKSVKIVVNGAGAAGIACVEMLKFVGIPNDNIVLCDQNGVIYKGRQLGMNEWKLKHAIETKERDLKDAMKGADIFIGLSVRDVLSKEMLLSMNKDPVIFALANPYPEVNPEFAREVRPDAIIATGRSDYSNQINNVMGFPYIFRGALDVRAKSVNNEMKLAAAEALAMLAREVVSDEVLEAYGGRGMGYGKEYIIPTPFDPRLLSVVSPAVAKAAINSGVARKKIDDWDRYALELNSRISPTSNILNLMYGSVKSSPKRVIFPEGEEVRVIKAALQWYGQGYGTPILVGRVDKIKESLDLIGVDSLEGITIANAAISSRNDVYIDYLYSKLQRMGRLHRSCVRDVKTDRNVFAACMLACGDGDTLVTGITRGYSESLSDIRKVIDARGEVFGLSVVVMEERTLFIADTAINELPTAQQLADIAIKSAAAARSMGHEPRVAFVSFANFGSHSQKESDRVRQCMDIVASRNVDFEYDGEMSVDVALKPESLSMYPFCRLSKPANVLIMPSLYSASISSKLLREVGGTTVVGPILMGMEKPVQIVQMTASVSEILNLAVLATLSHPI

SEQ ID NO: 8453 - protein, 192 aa, Photobacterium profundum SS9
MLLIIDNYDSFTYNLYQYFCELGAEVTVIRNDEIDIAGIAALNPSHLVISPGPCTPDDAGISLQAIEHFSGKLPILGVCLGHQSIAQVFGAQVVRARQVMHGKTSPIMHTDASVFRTLNNPLTVTRYHSLVVKADTLPECFEVTAWTERDGEFDEIMGISHKTLPIEGVQFHPESILTEQGHQLLANFLARR

SEQ ID NO: 8454 - protein, 472 aa, Vigna radiata
MKFLSTKATCNSHGQDSSYFLGWQEYEKNPYDEVLNPEGIIQMGLAENQLSFDLLESWLAKNPDVAGFKSDGKSIFRELALFQDYHGLPSFKKALVDFMAEIRGNKVTFDPNHIVLTAGSTSANQTLMFCLAELGDAFLLPTPYYPGFDRDLKWRTGVEIVPIQCTSSNNFQITEAALKQAYQEAKKRNLRVKGVLVTNPSNPLGTTMSRSELNLLVDFIKDKNMHLISDEIYSGTVYNSPGFVSIMEILKDRNDLKDCGANVWDRVHIVYSLSKDLGLPGFRVGAIYSENEVVVAAATKMSSFGLVSSQTQYLLSAMLGDKKFTKNYISENLKRLKRRQRNLVSGLQKAGISCLKTNNAGLFCWVDMRHLLHSNTFEAEMELWKKILYEVRLNISPGSSCHCTEPGWFRMCFANMSEETLNLAMKRLKTFVQESNHDNGCTAKRVQSSRRKSLSNWVFRLSSREHREQEQR

SEQ ID NO: 8455 - protein, 544 aa, Oryza sativa Japonica Group
MTTSRRLADRKTAKFQKNITKRGSVPETTVKKGNDYPVGPLVLGFFIFVRISYDRDRSVLIGGGGRRAMASGGDDAAAPLLASKHGGEPRRNTFAFACATLASMTTILMGYNLALMSGAELFIREDLGLADEQVEVLSGSMNVFMLASILAAGTVADAAGRRGTLVLANALLMAGALAMSLGGSYAALMAARFVTSVGVGFAVVVAPVYAVEISPASSRGVLSSLPEIFINAGILLSYVSNYALAGLPLRLGWRVMFAAGVVPPVFLAAGVLAMPESPRWLAMRGRDAEARAVLARTSDTPAEADLRLEEITRAVAAQAGVAGGVWRQLLVRPTPTVRRIMTNVLSLHFFQQASGIDVIVLYSPLVFKQAGMASNTSVLAATVAVGVVKTCSILVATLLSDRVGRRPLLLWSAAGMAVALASLALTLCVGAGAPSPARAAAGVASAAAYVAAFSVGLGPLAPSYGSEIMPLWLRAQGAGVGVAVNRVTCGVLSMTFISVAGGITMAGCFFVYAGAAVAAWVFVYVRLPETRGRSLEDMDVLFTK

SEQ ID NO: 8456 - protein, 157 aa, Triticum aestivum
  misc_feature (142)..(142): Xaa can be any naturally occurring amino acid
YNFGFDHYEMSRRKVGFSGLINLLVGHTGPFASGDWILPDLTIQGSMKLNSRLRTFPNTFYFSYATKKTRKLFGITVPSRVLGVHPMLFLRVLQMCMWRDPQSAPLPYKGYRDEDWEDNDGAFNTISMTHPRIPIEHPHRAXKNDSDCHPLQPGICY

SEQ ID NO: 8457 - protein, 337 aa, Yersinia pestis CO92
MKTLGEFIVEKQLDFSHATGELTALLSAIKLGAKIIHRDINKAGLVDILGASGVSNIQGEDQMKLDLFANEKLKAALKARGEVAGIASEEEDDIVIFDGGRAENAKYVVLMDPLDGSSNIDVNVSVGTIFSIYRRITPFGTPITEEDFLQPGTKQVTAGYVVYGSSTMLVYTTGYGVHAFTYDPSLGVFCLSHEKVRYPATGCMYSINEGNYIKFPLGVKKYIKYCQEQDEATKRPYTSRYIGSLVADFHRNLLKGGIYIYPSTASHPQGKLRLLYECNPMAFLAEQAGGKATDGVNRILDIVPEKLHQRAPFFVGTKSMVEDAEGFIAKFPDEEAK

SEQ ID NO: 8458 - protein, 175 aa, Yersinia pestis CO92
MSLNQVPAGKDLPEDIYVVIEIPANADPIKYEIDKETGSLFVDRFMSTAMFYPCNYGYINNTLSLDGDPVDVLVPTPYPLQPGSVIRCRPVGVLKMTDEAGEDAKLVAVPHSKLTKEYDHVKDVQDLPELLKAQIKHFFEHYKDLETGKWVKVDGWEDAAAAKAEILSSFERAKK

SEQ ID NO: 8459 - protein, 234 aa, Triticum aestivum
YLDILLGNLQYQCKTFDINLPSEMVKCVEVFKEFYATRTKHRKLTWIYSLGTCNISAKFDAKTIELIVTTYQAALLLLFNGSTKLSYSEIVTQLNLSDDDVVRLLHSLSCAKYKILSKEPAGRTISPNDSFEFNSKFTDRMRRIKIPLPPVDEKKKVVEDVDKDRRYAIDASIVRIMKSRKVMAHTQLVAECVEQLSRMFKPDFKAIKKRIEDLITRDYLERDKDNANTYRYLA

SEQ ID NO: 8460 - protein, 156 aa, Sulfurospirillum multivorans
MNIVEGKLSLNGDEKVAIINARFNHIITDRLVEGARDAYLRHGGKDENLDLVLVPGAFEIPMALNRLLACSKYDAVCCLGAVIRGSTPHFDYVSAEVTKGVANVALQFAKPVAFGVLTVDSIEQAIERAGSKAGNKGFEAMVTVIELLSLYSALKN

SEQ ID NO: 8461 - protein, 445 aa, Escherichia coli
AVMGRNLALNIESRGYTVSIFNRSREKTEEVIAENPGKKLVPYYTVKEFVESLETPRRILLMVKAGAGTDAAIDSIKPYLDKGDIIIDGGNTFFQDTIRRNRELSAEGFNFIGTGVSGGEEGALKGPSIMPGGQKEAYELVAPILTKIAAVAEDGEPCVTYIGADGAGHYVKMVHNGIEYGDMQLIAEAYSLLKGGLNLSNEELAQTFTEWNNGELSSYLIDITKDIFTKKDEDGNYLVDVILDEAANKGTGKWTSQSALDLGEPLSLITESVFARYISSLKEQRVAASKVLSGPQAQPAGDKGEFIEKVRRALYLGKIVSYAQGFSQLRAASEEYNWDLNYGEIAKIFRAGCIIRAQFLQKITDAYAENPQIANLLLAPYFKQIADDYQQALRDVVAYAVQNGIPVPTFAAAVAYYDSYRAAVLPANLIQAQRDYFGAHTYKRI

SEQ ID NO: 8462 - protein, 126 aa, Zea mays
  misc_feature (36)..(36): Xaa can be any naturally occurring amino acid
  misc_feature (54)..(54): Xaa can be any naturally occurring amino acid
  misc_feature (78)..(78): Xaa can be any naturally occurring amino acid
MMEGGSRADGRNPNQLRPFTCTGNPLHRAHGSARWXQGDTVVLAAVYGPKSGTXGENPEKASIEVVWKPKTGQIGRQXREYEMTLKRTLQSICLLTVHPNTTTSVVLQQARSFAHLVFPNSRKSVE

SEQ ID NO: 8463 - protein, 219 aa, Rhodospirillum rubrum
MTRAIRIAPSLLSADFAISRPRCPSDGRTGADILHFDVMDNHYVPNLTVGPLVCAALRPHTSLPIDVHLMTRPVDPLIDSFAEAGADMITFHPEASDHVHRSVQMIRKRGLKAGVALNPASPLSLLDHILEDLDLVLIMSVNPGFGGQSFIPSALPKIAALANGRRRACRGDRVDGGVNPADARALARPGPISWSGWRSSERVTGPRPSPPSGAPRKVD

SEQ ID NO: 8464 - protein, 445 aa, Escherichia coli
AVMGRNLALNIESRGYTVSIFNRSREKTEEVIAENPGKKLVPYYTVKEFVESLETPRRILLMVKAGAGTDAAIDSLKPYLDKGDIIIDGGNTFFQDTIRRNRELSAEGFNFIGTGVSGGEEGALKGPSIMPGGQKEAYELVAPILTKIAAVAEDGEPCVTYIGADGAGHYVKMVHNGIEYGDMQLIAEAYSLLKGGLSLTNEELAQTFTEWNNGELSSYLIDITKDIFTKKDEDGNYLVDVILDEAANKGTGKWTSQSALDLGEPLSLITESVFARYISSLKDQRVAASKVLSGPQGQPAGDKAEFIEKVRRALYLGKIVSYAQGFSQLRAASEEYNWDLNYGEIAKIFRAGCIIRAQFLQKITDAYAENPQIANLLLAPYFKQIADDYQQALRDVVAYAVQNGIPVPTFAAAVAYYDSYRAAVLPANLIQAQRDYFGAHTYKRI

SEQ ID NO: 8465 - protein, 359 aa, Solanum lycopersicum
MVFPLDSQLQNPISALLDGLYCEEDRFLDDDLGEWSSLDVGNENVKKTLPLLECDMFWEHDELATLLSKENEFHLGFQSLISDGSLMGARKEALDWMLRVIAYYGFTATTAVLAVNYFDRFVSGWCFQKDKPWMSQLAAVACLSIAAKVEETQVPLLLDLQVADSRFVFEAKTIQRMELLVLSTLKWKMNLVTPLSFIDHIMRRFGFMSNLHMDFLKKCERLILDIITDSRLLHYPPSVIATASMFYVINDIEPSNAMEYQNQLMSVLKVRKDIFEECHDLILELMDTACYKLCQSLKRKHHSVPGSPSGVIDAYFSSESSNESWSVASSISSSPEPQYKRNKTQDQRMTLAPLGSNLH

SEQ ID NO: 8466 - protein, 223 aa, Zea mays
MGMLSRPEEVPALLRLKLAAGRIRRQIPPQEHWAFAYDMLQRVSRSFALVIQQLGPELRNAVCVFYLVLRALDTVEDDTAIPNEVKLPILRDFYRHIYNPDWLFSCGANDYRVLMDNFRQVSTAFLELGEGYQKAIEEITRRMGEGMAKFICTEVETIDDYDEYCHYVAGLVGYGLSRLFHATGTEDLAPDHLSNSMGLFLQKTNIIRDYLEDINEIPRCRMF

SEQ ID NO: 8467 - protein, 335 aa, Zea mays
MRARQMNARSALDEVTDTGAFGRSPSTFRSSVSRDRRFPAVAGRYHLYVSYACPWASRCLAFLKLKGLDHAIGVTAVKPIFERTKESDEHLGWVFPAAADEEPGAEPDPLNGARSVRELYEIASSNYAGKPTVPCSIAFQVLWDKQLKTVVNNESSEIIRMLNAEFNGIARNPGLDLYPAHLRASIDEANELVYDAINNGVYKCGFAKKQGPYDEAVTRLYEALDRCEEILGKRRYICGDQLTEADIRLFVTLIRFDEVYAVHFKCNKKLLREYPNLFNYTKDIYQIPGISSTVNMEHIRKHYYGSHPSINPYGIIPAGPNIDYNAPHDRERFSA

SEQ ID NO: 8468 - protein, 2518 aa, Sorangium cellulosum
ILGSDARLASALEAAGAHVTRHRDPGAWIDAIRGGGAPEVVAVLACTTRPDAPSGALAATHGAAADALAALQAWLAEERLASCALVVLTERAVATRPDEDVLDLVHAPVWGLVRAAQVENPDRALILVDVDADDASLPALPALVAAAVARAADASEPQLALREGRRLVPRLGRLGGDDALVPPSAAAYRLHVAAKGTLESLALVPHEEATRPLAEGQIRVAVRAAGLNFRDALDALGMYPGDPGPLGAEGAGVVLEVGPGVTELAPGDRVMGLLSAAFGPIALADHRMVSRIPAGLSFVEAASIPVVFLTAYYGLVDLGRLRPGERVLVHAAAGGVGIAAVQLARHLGAEVFATASPPKWATLRALGLDDDHIASSRSGDFEAHFRRTSGGRGVDVVLDSLARELVDASLRLVALAPDGRFVEMGKSDVRDPLAVAASHPSVAYRAFDLAEAGPERIQAMLAELVALFERGVLRVPPITPCDLRRAPQAFRALAQARLVGKVVLTIPRALDPRGSVLVTGGTGTLGALVARHLVQRHGVRSLVLSSRRGPAAPGADDLRRELEAAGASVAIVACDAGDRLALERLLAGIPADRPLTAVVHAAGTLDDGVLTSLTPERLRSVMSAKVDAAAHLDELTRPLDLSAFVLFASLSGVLGSPGQANYAAANTFLDALAHQRRSRGLPAVSLDWGYWAERTGLTAHLGDTDLQRMARGGLRPLTTDDGLALFDAALAHVDAALVAAPFDPVALRAHAVAPILRGLVRAGAARRKLANNAASAAPLAQRLAGLAPKERERAMIDVVRPEIGVVLGLPPSRHLDGDRPLKELGLDSLMAVELRNRLAAIVGTRLPATLLFDYPTPTALARFLATALVGRGDAAAAPSAARAASAGASDDAIAIVAMACRFPGGVLTPEDLFRLLREGGDAISAFPENRGWDLDALSDGAARQGGFLHDADLFDAEFFGISPRETLALDPQQRLLLEMTWEALERAGIIPASLHGSKSGVFVGVFGSDYVARLLHGPSGAQAMESLRGYIGTGSASSVASGRIAYALGLEGPAISVDTACSSSLVALHLACHAIRRGECSLALAGGVTVMATPGIFGEFSAQHAGAPDGRCKSFSADANGAGWSEGAGIVLLERLSDARKNGHPVLAIVRGSAVNQDGKSQGLTAPNGPAQERVIRDALASAGLAPADVDAVEAHGTGTTLGDPIEARALFATYGAAHAKERPLWLGSLKSNLGHTQAAAGIGGVIKMVLALQSGVLPRTLHAASPSQHIDWSSGAIRLLTEEVPWKPGGSPRRAAVSSFGISGTNAHVVLEEAPRAAAGDDQAAEPARAPLAPPVPVLLSAKSDAALRAQAGKLHAHLAEHEDVALVDVAASLATTRSHFERRAAVVADDRAALLSALAALAEGRAGAGTVAGEALPPGKVAFVFPGQGSQWPSMARALLASSPAFRAEIEACERALAPHVDWSLLAVLGGDEAHAAPMLERVDVVQPVLFAVMIALAATWRAAGVTPDAVVGHSQGEIAAAYVAGALSLEDAARVVALRSRAITKLAGRGAMAAVELTTADLEARLAPFGGRLAIAAINSPHAALVSGDPDAIDELVAELSGAQLFARKVRVDYASHSAHVEAIERTLLEALDGIAPRPATVPLYSAVTGERLDGEALGAAHWYRNLRHTVRFEHATRALLDDGHRFFVEVSPHPVLTVALRDTIDASGHDAVACASLRRDEGDLARFNLSLAELHTRGLAVDWRAFFAPFAPRTVALPTYAFQRERFWLDAPKASGVIPAAASPAEARFWSAVEDGDVATVTDALDVGDDERRAALATLLPTLATWRRARRAQSTIDAWRYRVAWRALTAPPKGDIAGTWLVVAPEVAGALADGVARALEARGARGVLVPVDAEDAARTPLAGRLRAVAGGQAIRGVISFAALDERPAPLEPSVPLGLAVSLGLVQALGDAAIDAPLWLVTRGAVAVGASERVTRPLQAMTWGLGRVVALEHPERWGGLVDLGEESAPDANGARDANVHDRLANLVARRDDEDQLALRAAGTYVRRLVRAPHDGARPPAFAPRGAALVTGGTGALGAHVARWLARIGAEHIVLASRRGAAAPGAAALAEELSALGARVTLAACDVADREAVAALVRDVEAGGATVRAVFHAGGAMHEAPVAAMRVEELADAIAAKARGAQHLHDVFAQRPLDAFVLFSSGAGVWGGGRQGAYAAANAFLDALAEARRADGLAATSIAWGAWAGGGMLATDAERRLKHRGVAPMDPELAVAALAHALDHAETCLAVADVDWARFAPSFASARPRPLLDELAEARSALDALREPPDDARTAAGPEPASTLRTTLAALPEGERHRHLLALVRTETAAVLGHADASRVEPNRGFFDLGLDSLMSVELRRRVQRATGIKLPATLAFDHPTPSALASKVLAAIVLHDATPRASPAAELERLEGMLSAIYADEALRDDLTARLRAFLDKRAVRTERPDDAAFAEKLGSASADELIRLIDQKLGDRIDVDRY

SEQ ID NO: 8469 - protein, 445 aa, Escherichia coli
AVMGRNLALNIESRGYTVSIFNRSREKTEEVIAENPGKKLVPYYTVKEFVESLETPRRILLMVKAGAGTDAAIDSLKPYLDKGDIIIDGGNTFFQDTIRRNRELSAEGFNFIGTGVSGGEEGALKGPSIMPGGQKDAYELVAPILTKIAAVAEDGEPCVTYIGADGAGHYVKMVHNGIEYGDMQLIAEAYSLLKGGLNLSNEELAQTFTEWNNGELSSYLIDITKDIFTKKDEDGNYLVDVILDEAANKGTGKWTSQSALDLGEPLSLITESVFARYISSLKDQRVAASKVLSGPQAHAAGDKDEFIEKVRRALYLGKIVSYAQGFSQLRAASEEYNWDLDYGEIAKIFRAGCIIRAQFLQKITDAYAENPQIANLLLAPYFKQIADDYQQALRDVVAYAVQNGIPVPTFAAAVAYYDSYRAAVLPANLIQAQRDYFGAHTYKRI

SEQ ID NO: 8470 - protein, 445 aa, Escherichia coli
AVMGRNLALNIESRGYTVSIFNRSREKTEEVIAENPGKKLVPYYTVKEFVESLETPRRILLMVKAGAGTDAAIDSLKPYLDKGDIIIDGGNTFFQDTIRRNRELSAEGFNFIGTGVSGGEEGALKGPSIMPGGQKEAYELVAQILTKIAAVAEDGEPCVTYIGADGAGHYVKMVHNGIEYGDMQLIAEAYSLLKGGLNLSNEELAQTFTEWNNGELSSYLIDITKDIFTKKDEDGNYLVDVILDEAANKGTGKWTSQSALDLGEPLSLITESVFARYISSLKDQRVAASKVLSGPQAQPAGDKDEFIEKVRRALYLGKIVSYAQGFSQLRAASEEYNWDLNYGEIAKIFRAGCIIRAQFLQKITDAYAENPQIANLLLAPYFKQIADDYQQALRDVVAYAVQNGIPVPTFAAAVAYYDSYRAAVLPANLIQAQRDYFGAHTYKRI

SEQ ID NO: 8471 - protein, 281 aa, Staphylococcus aureus subsp. aureus NCTC 8325
MKDRPAKYIIEHGIKHGLITENTHLIESTSGNLGIALAMIAKIKGLKLTCVVDPKISPTNLKIIKSYGANVEMVEEPDAHGGYLMTRIAKVQELLATIDDAYWINQYANELNWQSHYHGAGTEIVETIKQPIDYFVAPVSTTGSIMGMSRKIKEVHPNAQIVAVDAKGSVIFGDKPINRELPGIGASRVPEILNRSEINQVIHVDDYQSALGCRKLIDYEGIFAGGSTGSIIAAIEQLITSIEEGATIVTILPDRGDRYLDLVYSDTWLEKMKSRQGVKSE

SEQ ID NO: 8472 - protein, 456 aa, Sorangium cellulosum
MISISKSKQKLLPPGPRSPMALQTLQWLKNPVPFLEACGARYGEMFTLKLPTQWPVVVVQHPEAVKEVFALDSNAGHAGEANNILKPFLGKYSLLVLDGEEHMRQRKMMMPAFHGERMEAYGHAMIDAAHASIDAWPVGSPFGVHAPMQAITLQVILRTVVGMTDGPLLAELEALYPQVIDAASAPAMHFELFRKDLGPWSPWGKFKRRSARGKEIMIHEIRRAREKGTAGRTDVLAMIIDAKDENGELLTEDEIHGELMTLLVAGHETTATALCWALRWLLRDAALTRRVAEEAAEVADDPVKIAKSELLDRVVKEALRLQPIGPVVARVLKQPLTIQGRELPADVMVAPCVQLLHHRPSLYPEPTRFDPDRYATFTPKPWEFIPFGGGLRKCIGAAFSMYEMKMVLATAFSRLSMELATDDIKIIRRGVTLAPSGGLPLVIRKKSPRATKPIAA

SEQ ID NO: 8473 - protein, 405 aa, Photobacterium profundum SS9
MTMEHKVERKLFDEVMVPCYSPMQIIPVKGQGSRIWDQADREYIDFAGGIAVSCLGHCHPVMVNALKSQAEKLWHLSNVMTNEPALRLAKKLTEHSFAEKVFFANSGAEANEAALKLARRYAVDKFGPEKSEIIAFNQGFHGRTFFTVTVGGQAAYSDGFGPKPQAISHIPYNDLSALAEIMSDRTCAIMMEPLQGEGGIISPTSEFVQGVRELCDKHNALLIFDEVQTGNGRTGNFYAYQGLGVTPDILSTAKSLGGGFPIGAMLTTTALAEHMKVGTHGSTYGGNPLACAVAEAVVDEVSKPEVLAGVKEREQWFRDALEQINAKYPIFAEVRGKGLLLGAALNEEWQGRARDVLLAAVEEGLMVLVAGTNVVRFTPSLVIDKADVDEGMARLERAIAKLYNK

SEQ ID NO: 8474 - protein, 643 aa, Burkholderia sp. 383
MIRFNQFSLARGTKPLFESTSFVLNPGEKAGLIGANGAGKSTLFSVLRGELHSDGGDFSMPPSWRIAHVSQETPAVDRSALDYTLDGDAALREIEARIAAASAAHDGAAEADAHAAFADADGYTAPARAEALLLGLGFTLAQTRESVASFSGGWRMRLNLAQALMCRSDLLLLDEPTNHLDLDAIVWLEDWLHRYPGTLVVISHDREFLDSICNVTLHLENRQVKRYGGNYSQFEVLRAQQLALQQSAYEKQQKTIEHLQSFVDRFKAKATKAKQAQSRMKALEKMELIAPAHIASPFTFEFRMPDAAPNPMMVMEDVRCGYHADGGAEIPIVERVALSIQNGQRIGLLGANGQGKSTLIKTLAGTLAPLSGHVRDGKGLTIGYFAQHQLETLREDDSPLAHLARLAPDTREQELRDFLGGFNFSGDMATTPVGPFSGGEKARLALALIIWQKPNLLLLDEPTNHLDLETRHALTMALAQFEGTLILVSHDRHLLRATTDQFMLVAKHRLQPFDGDLDDYRDWLLQHAAEQRAAAKADSAASSGAGAAANRKDQKRQAAEERQRLSVLKKPLQTRITKLEKEMETLHAEKARLDTFVADPASYEAERKTELTDAIRKLGDVNTRLETVEADWLAAQEELEQIG

SEQ ID NO: 8475 - protein, 263 aa, Photobacterium profundum SS9
MERVEQLFNALWQDYTQRLCPSAAQVHALLTEDEPLLNDHIALRTFNLPKVGLDKLAAPFIAIGYKPCGQYRFETKKLYAEHFEHPNPEAPKVFISELMVGQCSAQLQQALRELVDQAPEAALRDPSFLYGGRLWDIDSETYEMLAAESEYAGWVAAHGFGANHFTVSINQLEQFTEVRDVNHLLRHNGFAINESGGEVKGDPEVMLEQSSTMADRVAVGFLDGVKHIPGGFYEFAKRYPQADGELYRGFVAASADKIFESTN

SEQ ID NO: 8476 - protein, 289 aa, Photobacterium profundum SS9
MSAKHPIIAVTGSSGAGTTTTSEAFRKMFNMMNINASWLEGDSFHRYTRPEMDVEIRKAKEQGRHISYFGPEANDFPQLEKFFRQYGDDGSGQFRRYLHTFDEAVPYNQMPGSFTPWQKLPENTDVLFYEGLHGGVVDGEVNAAEHVDLLIGMVPIVNLEWIQKIVRDTRDRGHSREAVMESIVRSMDDYLNYITPQFSRTHINFQRVPTVDTSNPFSAKGIPSLDESFVVIRFRGIENVDFPYLLSMIQGSFMSRHNTLVVPGGKMSFAMELIVRPLIQQLIDTGKVG

SEQ ID NO: 8477 - protein, 325 aa, Sphingomonas sp. KA1
MVKTTICGTDLGIWKGKNPEIEQTQIERSGAFNGRILGHEGIGVIEDVGSAVKNFSKGDKVILSCVSRCGTCENCQKQLYAHCRNGGGWIFGYMIDGTQAEYVRVPFADNSLYLLPPELDEDVAVMLSDALPTAHEIGVQNGDIKPGDTVAIIGSGPVGMGCLLTAQLYSPSRIILVDLDDNRLALARDLGATDTINSGAEDAASKILELTEGRGVDCAIEAVGAEATWNICQQVVKEGGHLANVGVHGHPVTFALDKLWIRNLTITTGLVNANTTAMLLKTCCAGKFPMEKLVTHHFAFSELPKAYDVFKNSAAEKAMKVVIDF

SEQ ID NO: 8478 - protein, 786 aa, Arabidopsis thaliana
MQPSRTRVSFFETGETMKQRKKSYLSIFVIFFSLFFFGIFMYNDNLKSSIADFTSSNPFSSSFVELPPDECDLFTGQWVFDNKTYPLYKEEECEFLTEQVTCLRNGRKDSLFQNWRWQPRDCSLPKFNARVLLEKLRNKRLMFVGDSLNRNQWESMVCLVQSVIPPGRKSLNQTGSLTVFKIQDYNATVEFYWAPFLVESNSDDPEKHSIIDRIIMPESIEKHGVNWIGVDFLVFNSYIWWMNTVSIKVLRGSFDDGDTEYDEIKRPIAYERVLRTLGDWVDHNIDPLSTTVFFMSMSPLHIKSSDWANPEGIRCALETTPILNMSFNVAYGQFSAVGTDYRLFPVAENVTQSLKVPIHFLNITALSEYRKDAHTSVYTIKQGKLLTREQQNDPANFADCIHWCLPGLPDTWNEDSRDLKLAKKAYLSLLYFAVILLPVFLLGCYLYNEKQLRVGQFQEFNTHNLQEHITPLQQSKEDKDKKTDLVPLEFCDVFTGKWVLDNVTHPLYKEDECEFLSEWVACTRNGRPDSKYQKWRWQPQDCSLPRFDSKLLLEKLRGKKLMFIGDSIHYNQWQSMVCMVQSVIPSGKKTLKHTAQMSIFNIEEYNATISFYWAPFLVESNADPPDKRDGKTDPVIIPNSISKHGENWKDADYLIFNTYIWWTRHSTIKVLSSDWGFNEGSKCEKETEPILNMSKPINVGTNRRLYEIALNATKSTKVPIHFLNITTMSEYRKDGHTSFYGSINGKLMTPEQKLDPRTFADCYHWCLPGLPDSWNELLSLYIIYKI

SEQ ID NO: 8479 - protein, 201 aa, Schizosaccharomyces pombe 972h-
MKVYINVYDLMPDSPVNKLAWTLGLGIYHTGLVLEGKEYAFGAHEIPGSTGVFATMPRPPLEGCRWRCSIALPNCTLPKPDVDRILIRLSQEFTGLSYSLLERNCNHFTNAAAIELTGSPIPSFLNRISRIGLAFPTITNALLQHGQKNTSDVDDSSDSSSDVDEETLIVSKSKKAHKDIPKFSAPPPSADLNNLITDSLP

SEQ ID NO: 8480 - protein, 483 aa, Rickettsia typhi str. Wilmington
MAEFTPITIAYGDGIGPEIMDAVLYILRQAEARISLETIEVGEKLYKKHYTSGISEESWNVIQRTGIILKAPITTPQSGGYKSLNVTIRKTLQLFANIRPAVSFHPFTRTLHPNLNLTIIRENEEDLYSGIEYRQTHNMYESLKLISHTGCKKIIRYAFEYAVKNNRKKVTCLSKDNIMKFSDGIFHRVFNEIAKEYPQIDNEHYIIDIGTAKLATTPEIFDIIVTSNLYGDIISDVAAEISGSVGLAGSANIGQHYAMFEAVHGSAPDIAGKGIANPSGLLNAAIMMLVHIGQGDIASLIENAWKKTIEDGVHTFDIYSEHSSSKKVCTKEFAEEVIKRLGQLPMTLPKASYPLIVKKQESKIEYKIDTTEVKKLVGTDIFINIHVFSAHDIADKINKLDIGNFELKTISSKGLKLWPHDLRFEIISDHWCCRFMNKDGTEIKHLDIIILLQALSKANIDFIKVENLFEFDGVACYSLAQGE

SEQ ID NO: 8481 - protein, 352 aa, Triticum aestivum
MADPPSPRLDEDDTFGRDFNASPSRNAAPARSGEKRQFGDLDDDEDDVFASKKGKTKVEESAPGAATGMILSLRESLQTCKENLESNQVELEAAKSEIQKWHSAFQNIPAVPAGTNPEPVSVVTYLNNLKSSEESLKEQLEKAKKREAAFIVTFAKREQEIAELKSAVRDLKTQLRPPSMQTRRLLLDPAIHEEFTRLKNLAEEKEKKIKELQENVAAVNFTPSSKHGKMLMAKCRTLQEENEEIGAMASEGKIHELGMKIEVLKTQNNELRNQFDGLYKHMDGLTNDVERSNEMVSILQEELEAKDVELARLKEMLCQKEATEDDTVVEEREEAANDMNASSDPQPIKVES

SEQ ID NO: 8482 - protein, 398 aa, Glycine max
MCSHSPNHRSKCSAPAPATIIFLFVPLLCSVSFTNVNSQILEACSAATDCGPGLFCGNCPALGLKQPICTRGQATLPTSIVNGLPFNKYTWIVTHNSFSIVDAPPLPGVQRMTFYNQEDTVTNQLRQPAVNTLKEVEAFLTENPTEIVTIVIEDYVHTPKGLTNVFTSAGLDKYWFPVSKMPKKGEDWPTVTEMVQANHRLVVFTSDASKEAGEGIAYQWKHMVENESGDPGVQQGSCPHRKESKALNSKRHSLFLMNYFPTYPVEVDSCKEHSAPLAEMVNTCYKAAGNLLPNFIAVNFYMRSDGGGVFDIVDKMNGHTLCGCSTVTACQAGAPFGSCKNISVPSTSPVTNTAGSFTGSVQFSKSASSVHLPNFLLLVVFYFLQSLAAAVMTISTVL

SEQ ID NO: 8483 - protein, 906 aa, Vitis vinifera
MNLKYCFFLLFLQLLEWEVSLSSLNRHAVATREDVGIPKAQCLKKHFSAIFPECQIDARVLLYDASSEEDILSGHPDFVLDCIDNIDTKGSLRSKRDSISGEVDMATKNPIFTSVISGSLTITSKKLIGSENYLSWSAFVELWFMGQGYEDHLVTPEDAIPDVDKVQWKKIDAQLCSVLWQFVDPKILHHLRAYKTCFKFWTQSKGLYTNDIQRFYKVVSDIVHEEFLTLMPFTNGAEAQQIQADKFFMVLTLIGFRPDLESVRDQILASPSVPSLDDCTYCNKLGHTRDRCYQLHGRPPRTAHIAQSSNPLLSRLDSTASSTSQSITLIGSDYDAYLRYQAATSTFVASVAQTDNVSVCFTQSSSLGPWILDSGASDHISGNKHLFSSITTTSALPTVTLANGSQTMAKGIRREINLNSPETLDEAYHKALEIGILVALLAACVRRGLKVLSATGAGARADPTRIRVADLRESTNDPLSRSKYCLFIFCRHLSLFKIPVSIASKIEKMQRDFLWSGAGEGKRDHLIRWEVVSRPREMGGLGFGKTSMRNSALLGKWLWRFPRERSGLWHKVIASIYGTHPNGWDANMVVRWSHRCPWKAIAQVFQEFSPFVRLVVGNGERIRFWEDLWWGNQTLCAQFADLYRVISVRNLTVSNVLGNSFPLSWNFNFCRNLTDSEIDLLQRLMSSIHSVLLSPSSSDSRAWSLSSSGSFSVKSFFYALSRDSNPLMFLPAKFLWSSKVPSKVKALAWLVAHGKVNTNDKLQLRRPYKALCPQWCILCKGNGESIDHLFLHCPVTIGLWHRLFNLVGVIWVPPRSIEDMLVISFKGLGNSVRGKILWQIACLTLIWMVWQERNNRIFEDKGRTEEVVWDLIRFYSSLWASCTEAFRGVPLSILQINWIGVCVSRV

SEQ ID NO: 8484 - protein, 308 aa, Bradyrhizobium sp. ORS278
MGNPPRHFLDLTEMPVEELRNMLALSSRMKQTLKSNEPSRKPLEGKVLAMIFDKPSTRTRVSFDVGMRQLGGEAIMLTGTEMQLGRGETIADTARVLSRYVDAIMIRILSHEALLELAAHATVPVINGLTRRSHPCQVMADVMTFEEHRGSIEGRTVAWTGDDNNVLASWAHAAERFKFRLNVATPPQLSPGKPMKDFIRATRADIHLGHDPEGAVKNADCVITDTWVSMGDKDGEHRHNLLKPYQVNAKLMSLAKPEALFMHCLPAHRGEEVTDEVIDGPQSVVFDEAENRLHAQKGILAWCFGERA

SEQ ID NO: 8485 - protein, 301 aa, Nitrosomonas europaea ATCC 19718
MKQEFLHIASSLWATVAAQISRHTGQTFAPESLTPIGGGCINQTFCIRDHERQYFVKLNKAGNLAMFESEAAGLGEILDSASLRVPQPLCCGSHHDDAWLVLEFIDLQNRGNAAALGIGLANMHRHTAETFGWIRDNTIGSTPQRNATASDWISFWRQHRLGYQLNLARKNGHTGSLQSLGERLLSEFQHFFTDTLPLPSLLHGDLWGGNYAFDQDGQPVIFDPAVYYGDREADLAMTELFGGFPPDFQAAYRDTWPVETGYTTRKQLYNLYHILNHLNLFGPQYLSQAEITMKKLLAELY

SEQ ID NO: 8486 - protein, 358 aa, Leptospira interrogans serovar Copenhageni str. Fiocruz L1-130
MFKRIVIFLFILIFLSLSFLIFLFLRSSKNTNESITDSPFDPGKNNYLLESEWIHKENLNQPYAIAIDARGYVYTGTADHKVVQIRTNEKIETFAVLSGRPLGMVFDSHGNLLVCVEEVGIVKIRKDGSQKTIISKLPDGSPLRFPHGIDISKDGKIYFTVSSQSYSLQESFLEELFSRPNGMIVTADKNLTLEILNQDLYYPTGIALSSNEEFLLVSEPFRHRISSIPIFGSQRGTEKFFLTNIPGIPALISGNGGFFWVGIPYHRNEILDKTQEYPEIKNLLTGLPVFLFGKNIPRGLVFALNDFGDITANYQDFSDSSVAGITAVLNHAGNIYLVSSTIGKIAKMKPIIEEIQFF

SEQ ID NO: 8487 - protein, 403 aa, Bradyrhizobium sp. ORS278
MTSVAATHLLPVFARVDLSFERGEGAWLIAANGDRYLDFTSGVAVNSLGHAHPHLVKALQEQATKLWHMSNLFKSPDGERLAARLCEQSFADYVFFANSGAEAMEGAIKITRKYHASKGHPERYRIITFEGAFHGRTLATLAATGSAKYLDGFGPPMDGFDQVPFGDIEAVKKAIGPHTAGILVEPVQGEGGVRTAPLTFYKALRQLCDDNGLLLVIDEVQTGMGRTGDLFAHRWLGVTPDVMSLAKALGGGFPIGAVLATAEAASGMTPGSHGSTFGGNPLAVSAANAVLDVMLAPGFFDHVRKMSLLLKQKLAAVKDRHPDIIAEIRGEGLLIGVKAVVPSGDLVAALRDQKLLTVGAGDNVVRFLPPLIVNESEIEQSVEMLDRACTALSGGPARQAAAS

SEQ ID NO: 8488 - protein, 561 aa, Leptospira interrogans serovar Copenhageni str. Fiocruz L1-130
MSEAKELSPVEDIKLNSNNLRGKIAEGLDQNIDTYEEDEKQLLKFHGLYQQKDRDRKKDENGNDIEAPTSFMIRGRIPGGRLTSEQYLVWDELGDKFGGGAIRLTTRQSVQLHTLRIFHLRDVMKAIHEVNLSSMGACGDVVRNVTQAVNPLGKKELQLLDGVSQILSDHFKYKTNAYAEVWLGDKQLNKDEEDPIYGKTYLPRKFKIAVTLAGNNTVDIYANDMGFAATLSSDGNRIDGYFVFAGGGFGMTHNKPETFARAASLLGWVPENALIPVAEAIVTAHRDFGDRTNRKHARLKYVLAEKGVEWFQSEVESRSNVKLDKDKPLPNWETPSYLGWNERQDGTLSLGFHTLAGRIKDFPGKPLKSALKEIIGAYKLSVQITADQDLILIGIQKSDQEKVEKRLEELNVSWKSPSRLYDRALACPALPTCALALTESERSFPEVLNGIQKVLDKLGLSDRAPVVRMTGCPNGCARPYSAEVGIVGQQAGGKYSLFFGADSEGTKVGEYVAKKIALADIPAQLEKAFVLWKNEGDSDEKFGDFVNRFPLERFREALGSM

SEQ ID NO: 8489 - protein, 328 aa, Fulvimarina pelagi HTCC2506
MTRFTVIGAGAWGTALANLYARADHDVVLLGRNADAMAAMEATRRNEGYLPDVYLPPALRATHDAKEALSSAEVVLFVVPAQSLATAAETYGDLVPSNAMLVLCAKGIERRSGRFSSAIMAERFANNPLCVLSGPSFAADVANGLPTAVTVAAGTIERADRAAELLSANTFRCYASDDLAGVEAGGALKNVLALAAGMAIGRGLGESAKAAIVTRGFVELRRLGAAFGGQPQTLMGLSGLGDLILTCSSEQSRNFAYGIALGSGVDRTNLKLAEGVYSAGIAARLARERQIEAPIVQAVAEILDGEISIDEAMHALLSRPLRREVETA

SEQ ID NO: 8490 - protein, 534 aa, Bradyrhizobium sp. BTAi1
MTAQPDTPASAATETSVAALHDKILIVDFGSQVTQLIARRVREDGVYCEIVPFQKAEAAFRQMQPKAVILSGGPESVHEAGSPRAPQLIFDSGVPVMGICYGQMTMAAQLGGTVEGGHHREFGRADVEVKTSSRLFDGVWQPGEQHQVWMSHGDRITQMPPGFSVAGVSPNAPFAVIQDETRKYYGLMFHPEVVHTPDGAKLIRNFVRNIAGLGGDWTMHAFRAEEIKKIRAQVGKGKVICGLSGGVDSAVAAVLIHEAIGDQLTCVFVDHGLLRLNEAETVVDLFRHHYNIPLVHVDASKLFLGELAGVTDPEQKRKTIGRLFIDVFEAEAKKIGGADFLAQGTLYPDVIESVSFTGGPSVTIKSHHNVGGLPARMNMKLVEPLRELFKDEVRVLGRELGLPDVFVGRHPFPGPGLAIRCPGEITVDKLDILRKADAIYIDEIRKAGLYDTIWQAFAVLLPVKTVGVMGDGRTYDYVVGLRAVTSTDGMTADFYPFDMKFLGNTATRIINEVKGVNRVVYDVTSKPPGTIEWE

SEQ ID NO: 8491 - protein, 773 aa, Arabidopsis thaliana
MDEDVEQASLMSFNDRPRAFPNMRSKTYSPLIFRIIRKLNVRVLSIILLFCFGAIFYMGASTSPIIVFVFTVCIISFLLSIYLTKWVLAKDEGPPEMVEISDAIRDGAEGFFRTQYSTISKMAILLAFVILCIYLFRSLTPQQEAAGLGRAMSAYITVAAFLLGALCSGIAGYVGMWVSVRANVRVSSAARRSAREALQIAVRAGGFSALVVVGMAVIGIAILYSTFYVWLGVGSPGSMNVTDLPLLLVGYGFGASFVALFAQLGGGIYTKGADVGADLVGKVEQGIPEDDPRNPAVIADLVGDNVGDCAARGADLFESIAAEIISAMILGGTMAKKCKIEDPSGFILFPLVVHSFDLIISSIGILSIKGTRDASVKSPVEDPMAVLQKGYSLTIILAVITFGASTRWLLYTEQAPSAWFNFALCGLVGIITAYIFVWISKYYTDYKHEPVRTLALASSTGHGTNIIAGVSLGLESTALPVLTISVAIISAYWLGNTSAVATMGMLSTAAYVLTMDMFGPIADNAGGIVEMSQQPESVREITDLLDAVGNTTKATTKGFAIGSAALASFLLFSAYMDEVDIAIPEVFVGGLLGAMLIFLFSAWACAAVGRTAQEVVNEVRRQFIERPGIMEYKEKPDYSRCVAIVASAALREMIKPGALAIASPIVVGLVFRILGYYTGQPLLGAKVVASMLMFATVCGILMALFLNTAGGAWDNAKKYIETGALGGKGSEAHKAAVTGDTVGDPFKDTAGPSIHVLIKMLATITLVMAPVFL

SEQ ID NO: 8492 - protein, 284 aa, Symbiobacterium thermophilum IAM 14863
MERMLTGNVGFLGAGAIAEALIRGMLNAGVVQPEQVLVSNRSDRERLADLNRRYGVRTAGSKGYVVDVCQVVVLACKPKDVAGLLAEVGGRFRPGQIVLSLAAGIATSFIEERVADGVMVVRAMPNTSCQVGESATAVCLGRAATPEAMRLVTEMLASVGQVYTVPEEQMDAVTGLSGSGPAYVYYIVEAMIEAGEAVGLAPEVARALTLQTLKGAALTLATTGADPAVLREQVTSPGGTTAAGLQVLREAGFAQALISAIVRATERSRELGRMPAQAATEVGD

SEQ ID NO: 8493 - protein, 59 aa, Zea mays
HASALVYTLATDGSPFPLELFTPWGEATLADFYVNVIAISVRVIYKEAHWISSAEWVVL

SEQ ID NO: 8494 - protein, 662 aa, Aegilops speltoides
MPRTVSDGGEDFDGDFSSQTGSHRHTDSNSTHHHHGYKVGFPPARGLFAEFTDGVKETFFADDPLREYKDQSRSKKLWLSLVHLFPVLDWARSYKFSMFKGDFVAGLTIASLCIPQDIGYAKLAFLPAHVGLYSSFVPPLVYAMMGSSRDIAIGPVAVVSLLLGTLLQEEIDPVKNPYEYSRLAFTATFFAGITQAMLGFFRLGFIIEFLSHAAIVGFMAGAAVTIALQQLKGFLGIKKFTKKSDIISVMESVWGNVHHGWNYQTILIGASFLAFLLTTKYIAKKNKKLFWVSAIAPLISVVISTFCVYITRADKQGVAIVKDIKQGINPPSFHLIYWSGPYLAKGFRIGVVAGMVALTEAIAIGRTFAAMKDYQIDGNKEMVALGTMNIVGSMTSCYVATGSFSRSAVNYMAGCKTAVSNVVMAIVVMLTLLLITPLFKYTPNAILASIIINAVVSLVDYETAYLIWKVDKMDFVALLGAFFGVVFASVEYGLLIAVAISLGKILLQVTRPRTALLGNLPRTTIYRNVEQYPEAAKVPGIMIVRVDSAIYFTNSNYVKERILRWLRDEEDQQQEQKLSKTEFLIVELSPVTDIDTSGIHALEELLKALEKRKIQLILANPGPAVIQKLRSAKFTDLIGDDKIFLSVGDAVKKFAPKSALNV

SEQ ID NO: 8495 - protein, 156 aa, Haemophilus influenzae
NRTNTPVLVDGKDVMPEVNAVLAKMKDFCQRIISGEWKGYTGKAITDVVNIGIGGSDLGPYMVTEALRPYKNHLNMHFVSNVDGTHIAETLKKVNPETTLFLVASKTFTTQETMTNAQSARDWLLKAAKDESAVAKHFAALSTNAKDVEKFGIDTN

SEQ ID NO: 8496 - protein, 641 aa, Photobacterium profundum SS9
MITFSDMQLLRGGKVLLDNATATIHPGDKVGLVGKNGCGKSTLFALLKNELSLDAGNCQFPSNWELAWVAQETPALERNAIDYVIDGDREYRRLERELAAAEESNNGIKVAELHAKLDIIGGYTINARASELLDGLGFAQEQMQWHLTQFSGGWRMRLNLAQALLCRSDLLLLDEPTNHLDLDAVMWLEKWLQSYRGTLLLISHDRDFLDPVINRIIHVENQTLNSYTGNYSSFEVQRAEKLVLQQAMYQKQQKQVSHMQSYIDRFRYKASKARQAQSRIKALDRMEKVLPAQLDNPFLFEFREPQALPNPILMMDQVAAGYSNNLILEKIRLNLVPGSRIGLLGRNGAGKSTLIKLLSGELPAQAGDLTYSQGVKIGYFAQHQLETLRLDDTPLQHLARLAPQSTEQQLRDYLGSFGFNGEKALDKVGPFSGGEKARLVLALLVWQRPNLLLLDEPTNHLDLDMRQALTFALQSYEGAMVIVSHDRYLLRATTDDLYLVHDRQVTPFDGDLSDYHKWLTEQQRNERRELQAAKPEVNKENSASSRKEQKRLEAELRKKTAPLRKKITQLDKQMEKLSADISDAEEKLADSTIYEADNKALLHKQLKRQGDAKSTLEDVEMEWMVLQEELEAMEATLNADS

SEQ ID NO: 8497 - protein, 655 aa, Aegilops speltoides
MSRTMSGGSEDFNGNISRTGSHRQTDHHGYKVRFPPAKGLFTELAEGVKETFFANDPLREYKDQPRSKKLWLSLAHLFPVLDWARSYTFGMFKGDFVAGLTIASLCIPQDIGYAKLAFLPAHVGLYSSFVPPLVYAAMGTSRDIAIGPAAVLSLLLGTLLQEEINPATNPHEYSRLAFTATFFAGITQAMLGFFRLGFIIEFLSHAAIVGFMAGAAITIGLQQLKGFLGIAKFTKKSDIISVMESVWGNVHHGCNWQTILIGASFLAFLLTTKYIAKKNKKLFWVSAIAPLISLIVSTFCVFITRADKQGVAIVKDIKEGINPPSFHLIYWSGPYLAKGFRIGVVAGMVGLTEAIAIGRTFAAMKDYQIDGNKEMLALGTMNIVGSMTSCYVGTGSMSRSAVNYMAGCKTAISNVVMAIVVMLTLLLVTPLFKYTPNAILASIIIMIVVSLVDYETAYLIWKVDKMDFMALLGAFFGVVFASVEHGLLIAVAISLGKILLQVTRPRTALLGNLPRTTIYTNVEQYPEASKVPGVMIVRVDSAIYFTNSNYVKERILRWLRDEEEQQQEQKLSKTEFLIVELSPVTDIDTSGIHALEELLKALEKRKIQLILANPGPAVIQKLRSAKFTDLIGDDKIFLSVDDAVKKFAPKSALNV

SEQ ID NO: 8498 - protein, 516 aa, Burkholderia sp. 383
MTSSINSSPLNAIADQALGLDDAAVPAAVEPASDEPNFASLGLSPEIVSALQAAGYVKPTPVQQRAIPAGIAGRDLLVSSPTGSGKTAAFMLPAIERFAQLQKTQAQQPRAPREPNQGDRRARRPQPVARPGLLVLTPTRELAMQVTTAATTYGKHLKRLRTVSILGGVAYGQQLMLLAKNPEILVATPGRLLDHLERGRIDLSELKMLVLDEADRMLDMGFIDDIETIVAATPESRQTMLFSATLDGKIGSLTSRLLKDPERIEIQQRLESRANIAQTVHYVDDRDHKDRLLDHLLRDDALDQAIIFTATKIDADQLAGRLADAGFESAALHGDLPQGARNRTIRALRERRVRVLVATDVAARGIDIPGITHVFNYDLPKFAEDYVHRIGRTGRAGRSGTAVSLVHHAEQGALKRIERFVRAPLPVNVIEGFEPRKAPPRNGGNGGRGRPGGGNGGRRFGGKPGGGYGGNGNGNGRSYGGGNGGGWSGKPGGSRDGGPRRDGQRSGGPRRSNSAS

SEQ ID NO: 8499 - protein, 304 aa, Ralstonia solanacearum GMI1000
MDYQAILETIHRDIQPWLGKGRVADYIPELAKASATDFGMAIVTPRGEVFRVGQAETLFSIQSISKLFACTLAFQLEGESLWQRVGREPSGNAFNSLVQLEHENGIPRNPFINAGALVVTDVLCRRFVQAETAMVQFMRRLVDNPRVDYNPRVALSELEHADRNRAMAHFMRSFGNLHMPVETVIDAYCRQCAIEMHCVDLARAVLFLANGGVVPWSGERVIETSPAKRLSALMLTCGTYDAAGDFVYRVGLPAKSGVGGGIVAVLPGEFGVCVWSPGLDVSGNSLAGLQALEWLTTLSGRSIF

SEQ ID NO: 8500 - protein, 600 aa, Photobacterium profundum SS9
MANDVLSVTVVFLAAAVVAVPIAQRLGLGSVLGYLIAGIAIGPWGLGLISDVEAILHFSEFGVVLLLFLIGLELNPKKLWQMRSPILGLGGGQVLVTSLVIASIVMACSSMMPSITWRDALVIGMGLALSSTAIALRIIEEKNLDGSETGQSSFSVLLFQDIAVIPMLAVLPILAGGGGGSWLDFAWMIGGIAALLVGGHFLLRPLFRWVVLSGVRELFNVAALLLVIGIALGMQSLGLSMALGTFLAGVLLAESEYRHELEIAIEPFKGLLLGLFFISVGMAVNLGLLFEFPLQILAAVAALVIVKGLLLYGLARLFGIRAKSRSQMAAILSQGGEFAFVLFTAAQGEGLLGTQLSSFLLVVVSISMMTTPLILLLQDRWFIHTFKSEDEALESDVIDREPRVIITGFGRFGQVVGRLLFANKIRVTVLERDPSQIQFLRKFGYKVYYGDATQLDLLRAAGADKAEAIIICTDEPDEVMEVVTLCQQHFPKLKVLARARSRVEAHQLLSHGVDNFSRETFAGALDLGRQALISLGMHPYKAKRAEAHFRKLDTTALRDLLPQHSEDVHLASRSKEARKELEEIFDREMRGERDRHNGWD

SEQ ID NO: 8501 - protein, 156 aa, Haemophilus influenzae
NRTNTPVLVDGKDVMPEVNAVLAKMKDFCQRIISGEWKGYTGKAITDVVNIGIGGSDLGPYMVTEALRPYKNHLNIHFVSNVDGTHIAETLKKVNPETTLFLVASKTFTTQETMTNAQSARDWLLKTAKDESAVAKHFAALSTNAKDVEKFGIDTN

SEQ ID NO: 8502 - protein, 620 aa, Shigella flexneri 2a str. 301
MSFDIAKYPTLALVDSTQELRLLPNESLPKLCDELRRYLLDSVSRSSGHFASGLGTVELTVALHYVYNTPFDQLIWDVGHQAYPHKILTGRRDKIGTIRQKGGLHPFPWRGESEYDVLSVGHSSTSISAGIGIAVAAEKEGKNRRTVCVIGDGAITAGMAFEAMNHAGDIRPDMLVVLNDNEMSISENVGALNNHLAQLLSGKLYSSLREGGKKVFSGVPPIKELLKRTEEHIKGMVVPGTLFEELGFNYIGPVDGHDVLGLITTLKNMRDLKGPQFLHIMTKKGRGYEPAEKDPITFHAVPKFDPSSGCLPKSSGGLPSYSKIFGDWLCETAAKDNKLMAITPAMREGSGMVEFSRKFPDRYFDVAIAEQHAVTFAAGLAIGGYKPIVAIYSTFLQRAYDQVLHDVAIQKLPVLFAIDRAGIVGADGQTHQGAFDLSYLRCIPEMVIMTPSDENECRQMLYTGYHYNDGPSAVRYPRGNAVGVELTPLEKLPIGKGIVKRRGEKLVILNFGTLMPETAKVAESLNATLVDMRFVKPLDEALILEMAASHEALVTVEENAIMGGAGSGVNEVLMAHRKPVPVLNIGLPDFFIPQGTQEEMRAELGLDAAGMEAKIKAWLA

SEQ ID NO: 8503 - protein, 293 aa, Vitis vinifera
MRCRRLALIVLAAVMLLLVFLGFLFSILGLQCLVYFLVIIGWILVTSTFILCGIFLLLHNVVADTCVAMDEWVQNPTARTALDDILPCVDNATAQETLLRTKDVTYQLVTVVNTVITNVSNINFAPNFVPLYFNQSGPLVPVLCNPFNADLTARQCSAGEVDLDNATQVWSNYVCQVSASGICTTPGRLTPSYYNQMAAAVNISYGLYHYGPYLVDLQDCTFVRQTFTVISDDHCPELRKYSKWIYTGLVMVSVAVMMSLIFWVIYARERRHRVYTKTHMPRNYGAPYEEKAP

SEQ ID NO: 8504 - protein, 299 aa, Shigella flexneri 2a str. 301
MDFPQQLEACVKQANQALSRFIAPLPFQNTPVVETMQYGALLGGKRLRPFLVYATGHMFGVSTNTLDAPAAAVECIHAYSLIHDDLPAMDDDDLRRGLPTCHVKFGEANAILAGDALQTLAFSILSDANMPEVSDRDRISMISELASASGIAGMCGGQALDLDAEGKHVPLDALERIHRHKTGALIRAAVRLGALSAGDKGRRALPVLDKYAESIGLAFQVQDDILDVVGDTATLGKRQGADQQLGKSTYPALLGLEQARKKARDLIDDARQALKQLAEQSLDTSALEALADYIIQRNK

SEQ ID NO: 8505 - protein, 239 aa, Triticum aestivum
MSKLFHSACKAARSFLASSSAPRAASSILADGRNAALATLANLGRNSTLPAAYAHHTNAAASSHGYAWIAAIPAAVYMLQDQEVHAAEMERTFIAIKPDGVQRGLISEIVSRFERKGYKLVAIKLVVPSKQFAEKHYHDLKERPFFNGLCDFLSSGPVLAMVWEGEGVIKYGRKLIGATDPSKSEPGTIRGDLAVVVGRNIIHGSDGPETAKDEIALWFQPKELVSYTSNEEKWIYGVN

SEQ ID NO: 8506 - protein, 246 aa, Zea mays
MVARRRKLAVRRSTLSVGGNPVVNTVTARPGVARRWVYTTLWRYRLQHRYSADGLTVGLGVQWTPPFRKLAPGAEHRPGTLQMCAGNSCLVFQIACAGGAVPRILRRFLADARVTFAGRNVAADCRMLRAHHGLDVASTLELRRGGGGGGRQSLAEMAERLLGIPRGLVEKPQWVGMSKWDRRRLSPAQERYAAVDAYVSCRLGECIRRGVDAVSSQDDYVSSDGDEFVESGGREDLWYLLRNIHM

SEQ ID NO: 8507 - protein, 457 aa, Pyrococcus abyssi GE5
MDYPRIVVNPPGPKAKELIEREKRVLSTGIGVKLFPLVPKRGFGPFIEDVDGNVFIDFLAGAAAASTGYSHPKLVKAVKEQVELIQHSMIGYTHSERAIRVAEKLVKISPIKNSKVLFGLSGSDAVDMAIKVSKFSTRRPWILAFIGAYHGQTLGATSVASFQVSQKRGYSPLMPNVFWVPYPNPYRNPWGINGYEEPQELVNRVVEYLEDYVFSHVVPPDEVAAFFAEPIQGDAGIVVPPENFFKELKKLLDEHGILLVMDEVQTGIGRTGKWFASEWFEVKPDMIIFGKGVASGMGLSGVIGREDIMDITSGSALLTPAANPVISAAADATLEIIEEENLLKNAIEVGSFIMKRLNELKEQFDIIGDVRGKGLMIGVEIVKENGRPDPEMTGKICWRAFELGLILPSYGMFGNVIRITPPLVLTKEVAEKGLEIIEKAIKDAIAGKVERKVVTWH

SEQ ID NO: 8508 - protein, 237 aa, Aeropyrum pernix K1
MGGCDPMDEAARGALDLLGRIGGELGVLGVGTGRTVMRFLREASARGVEPGVAVPSSFETAVELAGLGWSVGDPRVYRGVNVYVDGADEAEPGRGYMVKGGGGALLGEKILSSRSKLNIFIVGEDRLVGRLGEKTPVPVEVEPGFVSMVLASLEELGLNPRVRTSPGKRGPVVSDWGGVIVDLLTGPLEDPRGLESMLRNVPGVRETGLFLGLADYIVVGLSSCGYRVLGPYRGRAV

SEQ ID NO: 8509 - protein, 880 aa, Arabidopsis thaliana
MGKILHLLLLLLKVSVLEFIISVSAFTSPASQPSLSPVYTSMASFSPGIHMGKGQEHKLDAHKKLLIALIITSSSLGLILVSCLCFWVYWSKKSPKNTKNSGESRISLSKKGFVQSFDYKTLEKATGGFKDGNLIGRGGFGDVYKACLGNNTLAAVKKIENVSQEAKREFQNEVDLLSKIHHPNIISLFGYGNELSSSFIVYELMESGSLDTQLHGPSRGSALTWHMRMKIALDTARAVEYLHERCRPPVIHRDLKSSNILLDSSFNAKINIQISDFGLAVMVGAHGKNNIKLSGTLGYVAPEYLLDGKLTDKSDVYAFGVVLLELLLGRRPVEKLSSVQCQSLVTWAMPQLTDRSKLPKIVDPVIKDTMDHKHLYQVAAVAVLCVQPEPSYRPLITDVLHSLVPLVPVELGGTLRDSMASLMLSLGSTSLLPREINKDKLKLGTSASNPFLKAKSFSRVTMTVAVKPSRFEGITMAPPDPILGVSEAFKADTNGMKLNLGVGAYRTEELQPYVLNVVKKAENLMLERGDNKEYLPIEGLAAFNKATAELLFGAGHPVIKEQRVATIQGLSGTGSLRLAAALIERYFPGAKVVISSPTWGNHKNIFNDAKVPWSEYRYYDPKTIGLDFEGMIADIKEAPEGSFILLHGCAHNPTGIDPTPEQWVKIADVIQEKNHIPFFDVAYQGFASGSLDEDAASVRLFAERGMEFFVAQSYSKNLGLYAERIGAINVVCSSADAATRVKSQLKRIARPMYSNPPVHGARIVANVVGDVTMFSEWKAEMEMMAGRIKTVRQELYDSLVSKDKSGKDWSFILKQIGMFSFTGLNKAQSDNMTDKWHVYMTKDGRISLAGLSLAKCEYLADAIIDSYHNALLYWETPIEL

SEQ ID NO: 8510 - protein, 204 aa, Magnetospirillum magnetotacticum MS-1
MVPVPETLETNPINPYGRSKLMSEWMLADAAAAHGFSYGILRYFNVAGADPRGRTGQSTPNATHLIKVATQAALGQRSHLEVFGTDYPTRDGSCLRDYIQVSDLAEAHMVVLNHLRGGGESLTLNCGYGRGYSVLEVVEVVKRISGRDFEVRLSPRRPGDPAQIIAGADRIRNELGWVPKHDDLDAIVAQAFAWEDSLAKRNRR

SEQ ID NO: 8511 - protein, 301 aa, Oryza sativa
  misc_feature (72)..(72): Xaa can be any naturally occurring amino acid
  misc_feature (242)..(242): Xaa can be any naturally occurring amino acid
  misc_feature (270)..(270): Xaa can be any naturally occurring amino acid
MDGKYGLNTNCMTVTRFFLEQQRKHKEATGELTQCLNAIVTAVKAIQSSVRKAGIAKLYGLAGNQNSTGDDXKKLDVLSDELFINMLKSSYTTCVLASEEDENIIIVDKEQRGKYIVCFDPLDGSSNIDCLASIGSIFGIWRRPDSTANSTNADPTLQDALQPGNKLVCSGYALYGSATMLVLATNGGVNGFMLDPAIGEFVLTMPDIKVKPRGNIYSINESYTALWDDAIKEYVENKKFPXKGKAYGSRYVGSMVGDVHKTFIYGGIFXYPATKDAPNGKMKWMDQSNWMDLIGEKGGGL

SEQ ID NO: 8512 - protein, 339 aa, Rhodospirillum rubrum ATCC 11170
MELEKAMTVIAPSAASESVGTSATDIEFRGKVYDSIVDTIGATPLVRLARFSKAHGVVADLLGKCEFFNPLASVKDRIGFAMIDAAERDGRIKPGATLVEPTSGNTGIALAFVCAARGYRLILTMPESMSIERRKMLTHLGAEIDLTPAAKGMKGAVARAQELVESIPGAVLLQQFDNPANPEIHRQTTAQEIWNDTNGAVDIVVSGVGTGGTATGIASVLKKLKPSVKLVVVEPEDSPVISGGAPGPHKIQGIGAGFIPGNLDVSLIDEVVKVANETAFATARAVARQEGVPVGISSGAALAAAVEVGQRPENKDKTLVVILPSFAERYLSTPLFEQP

SEQ ID NO: 8513 - protein, 301 aa, Oryza sativa Indica Group
MRVGFIGTTMEVQKDLRSEKAMYNNYGNSPGMQMPPIGQMPPAAGQMPSANPQPGQFGNPFYGASSGLIKTGLGAYGEKFLGSSSEFMQSNINRYFSNPQYYFHVNDQYVRNKLKVILFPFLHRGHWTRISEPVGGRLSYKPPIYDINAPDLYIPFMAFGSFIILAGFTLGFMGKFTPEAINLQFSRGLIGWALQIVILKGLLYSMGGGEVPLLDLVAYGGYLFAGLSLAVVSRLLWAYSYFVMMPWMSLCMGVFLVRTMKRVLFTEMRSSERHSTRQHYFLLFLAIAQFPLFFWLGNIGA

SEQ ID NO: 8514 - protein, 536 aa, Listeria monocytogenes EGD-e
MTIVAMNEVVKSFTGDIILEKVSLQLEEGERVGLIGRNGEGKSTILKILKGTEGVDSGIVTSKKGARIGLLEQLSSVDPNIIVEHYLRTSFGELEDMEKELRSLEAEMATNASEKLMNRYGDKMALFGELGGYEMDANLNKVVNGLGIGKLLSQSWGDLSGGEKTKTALAHLLLQKTDLLLLDEPTNHLDLMAVEWLTAFLQHYSGTVLVVSHDRYFLDEVVEKMVELENRELIVYHTNFSGYLKEREERLLREFQDYKDQQKKIKKMQQAIKRLRQWAMQANPPNDAMFRRAKNMERALERMEKVKRPVLTQKQMQLQFDEAGRSGQEVVVMENLSKSFSEKTIVQEVSLQIRQGERVAIIGENGAGKSTLLKIMEGKVVPDDGVIKVGASVKIASLSQQMEELNEEMTVLDAFRDKVAVTEGEARQMLAGFMFYGEMVFRKVRNISGGERMRLRLAQFINMPVNTLILDEPTNHLDIASREVLEEAIRAFSGTIITVSHDRYFIDQLCSKVIWLENKQLTVYEGNYSYATSKRR

SEQ ID NO: 8515 - protein, 270 aa, Rhodospirillum rubrum ATCC 11170
MWRGPVAYTKVRGMTQETDTTHFGFRTVKAAEKASLVRGVFDSVAPRYDLMNDLMSGGIHRVWKDAFVDWLDPRPGRAYLDLAGGTGDIAFRILERSRRKVAEGVAPAHVTVCDINKEMLSVGRDRAIDRGIVSGLSWTCGDAEAVPLPDRSVDAYTIAFGLRNVTHIDAALAEARRVLKPGGRFLCLEFSKVVVPVLDQLYDLYSFKMLPIMGRYVARDEEAYRYLAESIRKFPPQEELLARMEAAGLGQVRYRNLSGGIAAMHSGRRL

SEQ ID NO: 8516 - protein, 156 aa, Haemophilus influenzae
NRANTPVLVDGKDVMPEVNAVLAKMKDFCQRIISGEWKGYTGKAISDVVNIGIGGSDLGPYMVTEALRPYKNHLNMHFVSNVDGTHIAETLKKINPETTLFLVASKTFTTQETMTNAQSARDWLLKAAKDESAVAKHFAALSTNAKDVEKFGIDTN

SEQ ID NO: 8517 - protein, 793 aa, Asparagus officinalis
MLLCGPIAGFITLELSHALSSLMLLCGPIAGFIVQPCVGFYSDKCQSRFGRRRPFILVGCLFICLAVIVIGFSSDIGYALGDTKEDCSVYHGPRRKAAVIFVGGFWVLDFANNAVQGPARALMADLSGRFGYNATNAFFAFWMAFGNILGYASGSTGEWHNWLPFLNTSACCDACANLKGAFLVAVVFLLLSMLVTLIVAKEVPLSSIPGKGEEEHRAEFLDIFRSIKNLPPGMPSVLLITGLTCLSWFPFILVDTEWMGREVFHGNPKGTPSQIDAFDRGVRTSVFGIMKDLPKVLNLTLNPSPSPFDVIVVLGSGTWDQHFGKGNISAFALASAFAFVCGCLGLFMLPKLSRSTFKTPYRAGGNQSSDTHEDIGRGVEGDDGDDDGRLSGDDSDNAPSVGSDLYKDEEDKEELEKMSELDREMILAERSTKIDDYMLKKKARETSSKVEMKTRKESPPPLRGRPSLRSDKPALNELRAKRYPNAKSELYAHQMHVHGNKKAQDGGVVQEVKKGLSLRNPSLNPLPNSTLVLFPSFVVAVGRGPRIGTNRAEALTGALLGALCTLHTSHVHLSYEVRLFDDVRSFDEVRLSYEVRLFDKVRLSYEVRLFDEVRLFDEVRSIDEVRISYEVRLFDYDRSFDEVHLSYEVRLFDDVRLSYEVRLFDDIRLSNERPWAALGCGWKLSRECGIRTSVWNMNVGIPTRVWNTNVRLTCAAAVETVPVRTLKPKGFELKGSEIEEIFYLDRKILQIEEILTVLGWYTPEYCTAIPESSLALGSLHRWPNISVSQTHNS

SEQ ID NO: 8518 - protein, 384 aa, Pisum sativum
MGLLCSKSNRYNDAKAEENAQTAEIERRIELETKAEKHIRKLLLLGAGESGKSTIFKQIKLLFQTGFDEAELKSYLPVVHANVYQTIKLLHDGSKEFAQNDVDFSKYVISTENKDIGEKLSEIGGRLDYPRLTKELAQEIESIWKDAAIQETYARGNELQVPDCTHYFMENLQRLSDANYVPTKEDVLLARVRTTGVVEIQFSPVGENKKSGEVYRLFDVGGQRNERRKWIHLFEGVSAVIFCVAISEYDQTLFEDENKNRMMETKELFEWVLKQQCFEKTSFMLFLNKFDIFEKKILDVPLNVCEWFKDYQPVSTGKQEIEHAYEFVKKKFEESYFQSTAPDSVDRVFKIYRTTALDQKVVKKTFKLVDETLRRRNLFEAGLL

SEQ ID NO: 8519 - protein, 384 aa, Pisum sativum
MGLVCSRNRRYRDSDPEENAQAAEIERRIESETKAEKHIQKLLLLGAGESGKSTIFKQIKLLFQTGFDEAELRSYTPVIFANVYQTIKVLHDGAKELAQNDLNSAKYVISDESKDIGEKLSEIGSRLDYPHLTKDLAKEIETLWEDAAIQETYARGNELQVPDCTKYFMENLQRLSDANYVPTKGDVLYARVRTTGVVEIQFSPVGENKRSGEVYRLFDVGGQRNERRKWIHLFEGVTAVIFCAAISEYDQTLFEDESKNRLMETKELFEWILKQPCFEKTSFMLFLNKFDIFEKKILNVPLNVCEWFKDYQPVSSGKQEIEHAYEFVKKKFEELYFQSSAPDRVDRVFKIYRTTALDQKVVKKTFKLVDETLRRRNLFEAGLL

SEQ ID NO: 8520 - protein, 418 aa, uncultured alpha proteobacterium EBAC2C11
MPYMMHEEPGCFEMSQKAEDYAADSAVMQTYGRAEIGFERGEGCWLISETGDRYLDCASGIAVNTLGHSHPRLVAALIEQAGKLWHTSNLYRIPGQEVVAKLLASLSGLDQVFFCNSGAEATEAAVKIARRAAYEKGEQERMTILCAEGAFHGRTLGMLAATDRPLFRTGFGPMPAGFDHVPFGNLNRLRDAMGPHVAAVMVESVQGEGGAKRVPDGYLLGVRAAADEFGALVIADEVQAGIGRTGRLFSYEDSKIKPDIVALAKGLAGGFPIGAVITSKVVGDAMTPGTHGSTFGGNPLAMAAAQVVLEVLSEEGFLADVRARAVHLDDALQALQEQFPTAIAECRGCGFLRGIRLDETIDLAAFVKTLRDDNLLCVPAAENTLRLLPPLTISNDEIDLAVAKIATVLNDIPKHESQ

SEQ ID NO: 8521 - protein, 619 aa, Schizosaccharomyces pombe 972h-
MDYKQRIEKFKDILNSEEPISLPGLCSLCIQGIPDEYSLRAKAWMLMLEFLPTDRSNWQSVLEKHRKTYTSFVQELLIDPWRKLTLHEESGENSDHPLNTSDDSKWKEYFDDNQILEQIDKDIRRTLPDLSFFQGKSEINKKPSVNNVSENISVNTEDDKVEEVGQKLNYTKITSIDQSQETPVHLSTIDFSKFQEECHLVLQGRIYRLENESTSSSTTALSTPRQSMDSKRTINAEAIAGENKLGLHREAAERILFIYAKLNPGIGYVQGMNEILAPLYYVLATDPTYENYYLCECDAFFLFTQMMVQVRDLYEKTLDHDSDHGIHFLMSKFTERLKKYDYELWENLEEKQIHPTYYSFRWFTCLLSQEFPLPDVIRLWDSIIADQMKARLFGKNDDGFNGAYDFLMDFCCSILIELRESILERNFADSIKLLQAHFNVDMPKLLNLTFELQHLRKTSKNDEDMSYVRKNSYNTNALANSLKNRVLSTYNTVKANVPQSSSSYTDNNKQKEPLEEKRSFFPSFRSSLDGVSPTQGRKSGEENIRTIFAKPTAHIGENGWSNLKVKGSSIFQRFGNFVGDTMRYITEEEESSEEEDLTTSRRKIGITSKRKVSVKRNVI

SEQ ID NO: 8522 - protein, 109 aa, Brassica napus
MDKMNQALEKMKMLVGMEVEDEERAAEEESSLSFMEDLNRNCALTTKQRFYGFAICLSAGLACTLLSMLVFFNPIKFVFTFTLGNLMALGSTAFLIGPQRQVTMMLDPA

SEQ ID NO: 8523 - protein, 390 aa, Pyrococcus abyssi GE5
MRQKRKYFIAERVILIKRSKIRELFERASKMENVISLGIGEPDFDTPKNIKEACKRALDEGWTHYTPNAGIQQLREAVVEYYKKFYDVDIDVENVIITAGAYEGTYLAFESLLESGDEVLIPDPAFVSYVEDAKLAEAKPVRIPLREENNFMPDPDELLELVTKKTRMIVINYPNNPTGATLDKEVAKAIADIAQDYNIYILSDEPYEHFIYDDAKHYPMLKFAPENTILANSFSKTFAMTGWRLGFVVAPSEIIKEMIKLHAYIIGNVASFIQVAGVEALRSEESWKAVKEMRKEYNERRKLVLKRLKEMPGIRVKEPKGAFYVFPSIKDTGMSSEKFSEWLLEKARVVVIPGTAFGKMGEGYVRISYATSREKLMEAMDRMEKALSEL

SEQ ID NO: 8524 - protein, 201 aa, Oryza sativa
PTRPPTRPRTRGGRVGGMIFTFYKAQGLSVGSSLVEEDKLELATSLLAKAKEKGVSLLLPSDVIIADKFAPDANSQVVPASAIPDGWMGLDIGPDSVASFSSTLETTQTVIWNGPMGVFEFDKFAVGTEAIAKKLADLSGKGVTTIIGGGDSVAAVEKVGVADVMSHISTGGGASLELLEGKELPGVIALDEAVTVARSKL

SEQ ID NO: 8525 - protein, 248 aa, Daucus carota
MVKLAIGSVGDSFSAVSLKSYLAEFIATLLFVFAGVGSAIAYGHLTADAALDPAGLVAIAIAHAFALFVGVSMAANISGGHLNPAVTLGLAIGGNITIITGLFYWIAQCLGSTVACFLLKFVTAGKAIPTHGVGAGLGAAEGVVFEIVITFALVYTVYATAADPKKGSLGTIAPIAIGFIVGANILAAGPFSGGSMNPARSFGPAVASFDFSGHWIYWVGPLIGGGLAGLVYGDVFIGSYAPIAEDYA

SEQ ID NO: 8526 - protein, 477 aa, Borrelia garinii PBi
MISKLTKIVATISDLRCEPEHIKDLYDAGVNVIRLNTAHQSHEDTIKVIDNVRKISNKIALMIDTKGPEVRTANIENPIIVKTGDNVIISTSPINEPNNLQTNYDGFVKEVPQGSKVLIDDGELEMTVVTKLPDRLICEIKNDGQIKNKKSINTPGISLKLQSVTEKDKGFIELAAKYNVDFIAHSFVRNSKDIQDVQRILNAAGNPDVKIISKIENQEGIDNIEEIVKASYGIMVARGDMGVEIPAEDVPIAQLKITQTCIKYGIPVITATQMLHTMIENPRPTRAEVSDIANAILNGTDAIMLSGETAYGKYPIEAVKMMTSIAKKVEKHRKMTLYKDELFYDKSITRNYIIKCAIDATKLMDVKAIIVDSLKGKTARIMATYRASVPLFITTNSERLARELSLSYGVYSNLVDNNFKRTTEFVVTSLKMLKEQNIVNDKDTVIIISGNPNRDTDKGTEFMEINTVEDAIKGRNI

SEQ ID NO: 8527 - protein, 364 aa, Pseudomonas putida
MPAHSFRIAAIPGDGIGLEVLPEGIRVLEAAALKHGLALEFDTFEWASCDYYLQHGKMMPDDWAEQLKQYDAIYFGAVGWPDKVPDHISLWGSLLKFRREFDQYVNIRPVRLFPGVPCALANRKVGDIDFVVVRENTEGEYSSLGGIMFENTENEIVIQESIFTRRGVDRILKYAFDLAEKRERKHVTSATKSNGMAISMPYWDKRTEAMAAHYPHVSWDKQHIDILCARFVLQPERFDVVVASNLFGDILSDLGPACAGTIGIAPSANLNPERNFPSLFEPVHGSAPDIFGKNIANPIAMIWSGALMLEFLGQGDERYQRAHDDMLNAIERVIADGSVTPDMGGTLSTQQVGAAISDTLARLD

SEQ ID NO: 8528 - protein, 443 aa, Pyrococcus abyssi GE5
MIELSLAEALFLILFTGVISMLISRRTGISYVPIFILTGLVIGPLLKLIPRDLAHEIFDFVRVFGLVIILFTEGHNLSWRLLKKNMPTIVTLDTIGLILTALIAGFIFKVVFNSSFLLGFLFGAIIGATDPATLIPLFRQYRVKQDIETVIVTESIFNDPLGIVLTLIAISMLVPGYGGGIFSTLSEKLGIYAGGVIYFLYNVSVSISLGIFLGILGYKFIKRTGIFDFPEIEAFSLSLAFLGFFIGERLDASGYLVATVTGIVLGNYKLLKPRENIRILKRLQRAIEKEVHFNDTLAALATIFIFVLLGAEMNLEVIWSNLGKGLLVALGVMILARPLATLPLLKWWNFREYLFIALEGPRGVVPSALASLPLSLALKYKSPLLTVHWGEIIMATVVITVLTSVIVETLWIPILKDKLDVGETIKERIEEKEEEKERRKVRG

SEQ ID NO: 8529 - protein, 651 aa, Xanthomonas campestris pv. vesicatoria str. 85-10
MGRTIRLQKIDTMMIDTTRYPRLSRIQTPDDLRRFDEAELTAIAEELRSYLIESVGKSGGHFAAGLGVIELTVALHYLYQTPVDQLVWDVGHQTYPHKILTGRRDQIHTVKQKDGVAPFPKREESIYDTFGVGHSSTSISAALGMAIAAQRNGDDRKVVAVIGDGAMTAGMVYEALNHAGGMDPEPNLLVILNDNRMSISEAVGGLTKMLGRASGSRTLNAIREGGKKILGDKKNNPTARFVRRWEEHWKGMFVPSTLFEEMGFHYTGPIDGHDLPSLVGALKTLQTLKGPQLLHVITTKGKGYELAEGDQIGYHAVGPFDPSKGLVAKAGAKKPTYTDVFSDWVCDMAAAEPKLLVITPAMREGSGLVRFSKEYPQRYFDVAIAEQHAVTLAAGMATQGAKPVVAIYSTFLQRGYDQLVHDVAVQQLDVLFAIDRGGVVGPDGATHAGNLDLSFLRCVPHMVVMAPADEAECRQMLSTGVQYQGPAAVRYPRGTGPGVALDASLATLPIGKAQLRHSGTRIALLGFGATVDAAEAVGRELGLTVVNMRFVKPLDKAMLLELAKTHDGFVTIEDNVVAGGAGAGVSELLNAEAITMPMLHLGLPDSFQHHASREDLLAEAGIDQAGIRAAVLKRWPQLMTSKTPALNAAAG

SEQ ID NO: 8530 - protein, 377 aa, Frankia sp. EAN1pec
MRAVVYREPFQVAVADVPDPRVEHPQDAIVRVSSTSICGSDLHVYEGRTSVRPGTVLGHENMGTVVDRGSAVSHVQLGDRVSVPCTVSCGTCANCERGRTEFCLRTNPDPHRAGAAYGCPDMGPYLGGQAEYLRVPFADFNLLRLPPGDDQELDFATLSDVFPTGFHGTELADVQAGNTVVVFGAGPVGLLAAYSAALRGATALVVDPVPSRLRLCERIGATGIDSSTEDAAERVREETRGRGVDCGIDAVGYQARTASGEEQAGLVLNQLVDCVRWTGSIGVLGVYPTRDPGAADESGARGRLPFDMGAFFAKGLRMGSGPANVKRYNRFLRDLIITGRAQPSCVMSHQLPLADAPDAYARFDHRDAGWIKITLQP

SEQ ID NO: 8531 - protein, 228 aa, Arabidopsis thaliana
MDSDSWSDRLASASRRYQLDFLSRSDNFLGFEEIEGEDDFREEYGMVPGSSCPFCSDYFDIVSLCCHIDEDHPMDAKNGVCPVCAVKVSSDMIAHITLQHANMFKVTRKRKSRRGGAQSMLSILKREFPDGNFQSLFEGTSRAVSSSSASIAADPLLSSFISPMADDFFISESSLCADTSSAKKTLNQSLPERNVEKQSLSAEDHREKLKQSEFVQGILSSMILEDGL

SEQ ID NO: 8532 - protein, 449 aa, Oryza sativa Japonica Group
MATRHQRAAAAPQPANRGAAVAAGKQKAAATAAAGRPGARNRQALGDIGNVLNAHVVDGKIQLPEGINRPITRSFGAQLLKKAQENAVAANKIVVQNPARKEPAPKPAKKVVPRPENAAKASTGAGVNENKKPSESEGAGSSSGGSALKYSRKKVVNTLTSVLTARSKHACGITEKPKEVVEDIDKLDGDNQLAVVEYIEDIYNFYRTAQLERRPTDYMSSQVEVNPKMRAILADWIIDVHYKFELMPETLYLTMYVIDRYLSLQPVLRRELQLVGVAAMLIASKYEEMWAPEVQDLIHVCDNAYSRQHILAMEKNILNRLQWNITVPTPYVFLLRFIKAAGGDKELENMVFFFSEMALKEYGMASLCPSLVAASAVYAAQCTLKRSPLWTSTLKHHTGFTESQLRECAKVLVNAHAAAPESKLKTAYRKYASEQLGRVSLRPPAVCLA

SEQ ID NO: 8533 - protein, 555 aa, Zea mays
MAIPVRSAAAPRRLVPSIPPASSGHVRGLACFGTRTGPRGARGLSMVVADSTSRRAKQADGGDGVLGAPVLGGLGMEGLGDQLSVVMKFGGSSVSSAARMAEVAGLILTFPEERPVVVLSAMGKTTNNLLLAGEKAVGCGVIHVSEIEEWNMVKSLHIKTVDELGLPRSVIQDMLDELEQLLKGIAMMKELTPRTSDYLVSFGECMSTRIFSAYLNKIRVKARQYDAFDIGFITTDEFGNADILEATYPAVAKRLHGDWIQDPAIPVVTGFLGKGWKSGAVTTLGRGGSDLTATTIGKALGLREIQVWKDVDGVLTCDPNIYPHAKTVPYLTFEEATELAYFGAQVLHPQSMRPAREGDIPVRVKNSYNPKAPGTLITRQRDMDKVVLTSIVLKSNVTMLDIVSTRMLGQYGFLARVFAIFEDLCISVDCVATSEVSVSVSLDPSKIWSRELIQQELDHVVEELEKIAIVRLLQQRAIISLIGNVEQSSLILEKTGRVLRKSGVNVQMISQGASKVNMSLIVHDSDAKALVEALHQAFFEDDVLSQVEAENLLVG

SEQ ID NO: 8534 - protein, 188 aa, Zea mays
MCGPTGVGFLHGKFEILSSMEPFLGGGEMIADVFEDKSTYAEPPSRFEAGTPAIGEAIGLGAAIDYLSCIGMEQIHEYEKELGTYLYESLLSVPNVQIYGPAPSQTVHRAPLCSFNIENVHPTDIAEILDLQHSVAIRSGHHCAQILHRTLGINASARASLHFYNTKDEVDTFVDALKATVDFLTDRY

SEQ ID NO: 8535 - protein, 364 aa, Shewanella sp. MR-4
MSYQIAVLAGDGIGPEVMAEARKVLKAVEARFGLNIEYTEYDVGGIAIDNHGCPLPEATLKGCEAADAILFGSVGGPKWEKLPPNEQPERGALLPLRGHFELFCNLRPAKLHDGLEHMSPLRSDISARGFDVLCVRELTGGIYFGKPKGRQGEGESEEAFDTMRYSRREIARIARIAFEAARGRRKKVTSVDKANVLACSVLWRQVVEEVAVDFPDVKLEHIYIDNATMQLLRRPDEFDVMLCSNLFGDILSDEIAMLTGSMGLLSSASMNSTGFGLFEPAGGSAPDIAGKGIANPIAQILSAALMLRHSLKQEEAASAIERAVSKALNSGYLTGELLSSDQRHKAKSTVEMGDFIADAVKAGV

SEQ ID NO: 8536 - protein, 329 aa, uncultured alpha proteobacterium EBAC2C11
MIFPSMKANKQESILGPQTQNANRMTPMRHFLDLKDFSTDTLQSILDVGLSMKVKQKSGDSHELSFSGKTVAMIFEKPSTRTRVSFEVGITQLGGTPLVLSASDLQIGRGESIEDTARVLSRYVNAIVIRCYKHETLLTLAKHASVPVINALTNWSHPCQLMADLMTMIEYHGPLAGQTVAWLGDGNNVAVSWIEAAVHFGFHLRIAGPQRYAPPAGLLAWARANGGDIMLTDDVSLAIDKVQTVVTDVWVSMGADEGSRRKDFAPYQVNAKLMKSAAGDAIFMHCLPAQRGMEVTAEVIDGPQSAVFDEAENRLHAQKAVMLWCLEGY

SEQ ID NO: 8537 - protein, 496 aa, Pisum sativum
MAATGVLAEIIDGDVYKYYADGEWKKSTSGKSVAIINPTTRKPQYKVQACSQEEVNKVMDSAKSAQKSWAKTPLWKRAELLHKAAAILKEHKAAIAECLVKEIAKPAKDAVTEVVRSGDLVSYCAEEGVRILGEGKFLVSDSFPGNERTKYCLTSKIPLGVILAIPPFNYPVNLAVSKIAPALIAGNSIVLKPPTQGAVAALHMVHCFHLAGFPKGLISCVTGKGSEIGDFLTMHPGVNCISFTGGDTGIAISKKSGMIPLQMELGGKDACIVLEDADLDLVAANIIKGGFSYSGQRCTAVKVVLVMESVADALVEKVKVKVAKLSVGPPEDDSDITPVVSESSANFIEGLVNDAKEKGATFCQEYKREGNLIWPLLLDNVRPDMRIAWEEPFGPVLPVIRINSVEEGIHHCNASNFGLQGCVFTKDINKAIMISDAMESGTVQINSAPARGPDHFPFQGIKDSGIGSQGITNSINMMTKVKTTVINLPSPSYTMG

SEQ ID NO: 8538 - protein, 144 aa, Myxococcus xanthus
AIERTLSIIKPDGLEKGVIGKIISRFEEKGLKPVAIRLQHLSQAQAEGFYAVHKARPFFKDLVQFMISGPVVLMVLEGENAVLANRDIMGATNPAQAAEGTIRKDFATSIDKNTVHGSDSLENAKIEIAYFFRETEIHSYPYQK

SEQ ID NO: 8539 - protein, 156 aa, Haemophilus influenzae
NRTNTPVLVDGKDVMPEVNAVLAKMKDFCQRIISGEWKGYTGKAITDVVNIGIGGSDLGPYMVTEALRSYKNHLNMHFVSNVDGTHIAETLKKVNPETTLFLVASKTFTTQETMTNAQSARDWLLKAAKDESAVAKHFAALSTNAKDVEKFGIDTN

SEQ ID NO: 8540 - protein, 363 aa, Vitis vinifera
MGNQGYHPLEELKESKRIQEKRLTAAEAARTTVEANGSALLLLPRIVHSEPHDHISWAEFQYIIDDFGDIFFQIFDDQNILQDPGASNPVNALIGMDLSLYKNRRVAGEYNISESGSTDDISLDDDYFEVEDSEMSDIPVDWGIPDTSSLVHPIYFAKCLTKAVNMEYNKEMDHPSNGISMVGCLRPAFIDEEPYLRRLFSCEDSDGYTSDWKDEEITGFSSKGDGHNPRSTFYRLEIMRIELFSVYGIQALISLQDFQDAEPDVLVHSTKAIVEHFTENGTWFNVALKALCKKKGFHVEGANLIGVDSLGMDVRVFTGVEIQTHRFSFKVRATSAAAAEKQIQQLLFPPSRRKKVQNSWRRS

SEQ ID NO: 8541 - protein, 156 aa, Haemophilus influenzae
NRSNTPVLVDGKDVMPEVNAVLAKMKDFCLRIISGEWKGYTGKAITDVVNIGIGGSDLGPYMVTEALRPYKNHLNMHFVSNVDGTHIAETLKKVNPETTLFLVASKTFTTQETMTNAQSARDWLLKAAKDENEVAKHFAALSTNAKDVEKFGIDTN

SEQ ID NO: 8542 - protein, 354 aa, Ustilago hordei
MGNCLSSSDQKEAKDRSVAIDKQIEQDSRQFKKECKILLLGSGESGKSTIVKQMKIIHQNGYSKDELLLYRLTVIKNLVDSAQAIVLALRKFKMEPEMPENRENVDVILQYRVDADPGATLDHPMARKVDSLWKDPIIPAIMERSSEFYLMDSAAYFFDNVNRIGQADYVPDENDVLRARSKTTGISETRFNMGQLSIHLFDVGGQRSERKKWIHCFEAVTSIIFCVALSEYDQVLLEESGQNRMAESLVLFESVVNSRWFLRTSVILFLNKIDIFKQKIPKQPLSKYFPEYSGGPDINKAAKYILWRFTQTNRARLSIYPHLTQATDTSNIRLVFAAVKETILTNALKDSGIL

SEQ ID NO: 8543 - protein, 156 aa, Haemophilus influenzae
NRANTPVLVDGKDVMPEVNAVLAKMKDFCQRIISGEWKGYTGKAITDVVNIGIGGSDLGPYMVTEALRPYKNHLNMHFVSNVDGTHIAETLKKVNPETTLFLVASKTFTTQETMTNAQSARDWLLKASKDESAVAKHFAALSTNAKDVEKFGIDTN

SEQ ID NO: 8544 - protein, 417 aa, Burkholderia sp. 383
MALIVHKYGGTSMGSVERIKNVAKRVAKWHQAGHQMVVVPSAMSGETNRLLGLAKEISSQPSPRELDMIASTGEQVSVGLLSIALQEIGVEAVSYAGWQVPIKTDSAFTKARIHSIDDERVKADLNAGKVVIITGFQGVDPDGHITTLGRGGSDTSAVAVAAALGAEECLIYTDVDGVYTTDPRVVEEARRLDRVTFEEMLEMASLGSKVLQIRSVEFAGKFQVKTRVLSSLTDPLIALDEEMRSGTLITFEEDETMEKAVISGIAFQRDEARIAVMGVPDKPGIAYQILGPVADANVDVDMIIQNQSVQGKTDFTFTVGRGDYQKAMDILTNQVKGHVNAEQVQGDPKVSKVSVVGVGMRSHVGVASKMFRTLSEEGINIQMISTSEIKISVLIDEKYMELAVRALHKAFELDQAS

SEQ ID NO: 8545 - protein, 187 aa, Gossypium laxum
  misc_feature (134)..(134): Xaa can be any naturally occurring amino acid
GLNGNGEPFVACHDCNFPICKTCFDYELKEGRKACLRCGNPYDENRLDDAEKASGDRSTIAAHMDKSQDAGIHARHISSVSTLDSEMTEANGNPIWKNRVESWKEKKNKKKKTSIKVEIEAQVPPEQLMEDKPXADAFQPLSTVIPIPKSRLAPYRTVIIMRLIILGLFFHYRVTNPVDSAFALWLT

SEQ ID NO: 8546 - protein, 267 aa, Vitis vinifera
MQNLHPLDPAYGHSVGGKDSYADPEECSEDSDSDEDYGSIQRPAFLVEGEPDFDSGPPEDGLEYLRRVRWEAAQIPEVTVAKLDMNKLNKEQTLYMPKIPDIAKCPEHLAPLKKWEDAFLADFAELRAPLDCSNPKNSDKRLPLSIINEDDTSLSPENSSPRTESSGNYPLLSVILGMDSVARVSMLRKCINSLETKSTLSRSDCMWLFALCAAIDTPLHADTCAALRSLLRKCASLRAEKSELDDEVVMLNILVTIAGRYFKQSEN

SEQ ID NO: 8547 - protein, 187 aa, Gossypium laxum
GLNGNGEPFVACHDCNFPICKTCFDYELKEGRKACLRCGNPYDENRLDDAEKGSGDRSTIAAHMDKSQDAGIHARHISSVSTLDSEMTEDNGNPIWKNRVESWKEKRIRKKRTSIKVEIEAQVPPEQLMEDKPAADAFQPLSTVIPIPKSRLAPYRTVIIMRLIILGLFFHYRVTNPVDSAFALWLT

SEQ ID NO: 8548 - protein, 432 aa, Magnetospirillum magnetotacticum MS-1
MTHELEIAARERGIKYFLVSYTDLFGTQRAKLVPAAAIGSTCRNGAGFAGFATWLDMSPADADLLAVPDPSGLIQLPWKPEVGWLPADLVMGGKAVEQGPRNILKRLIKEAAREGLQMKSGVECEFFLITPCGSEPADTADKQTKPCYDQSALMRRYDVISEICDAMLSLGWKPYQNDHEDANGQFEMNWDYDDALITADRHAFFKYMARSIAEKHGFRATFMPKPFMDLTGSGCHAHVSLWSGGQNVFADESDEIGMSRKGYHFIGGLIHSADALAALTNPCVNSYKRINAPRTTSGATWAPNTVTYTGNNRTHMIRIPDGGRFEFRLADGAANPYLLQAGILAAGLDGIRQQRDPGQRLDINMYTDGHKVEGVKQLPLNLLDALRALEASSVLNEALGSFVPSYLKLKRQEWDDYCRHLTQWERDTTLDC

SEQ ID NO: 8549 - protein, 187 aa, Gossypium laxum
  misc_feature (53)..(53): Xaa can be any naturally occurring amino acid
  misc_feature (90)..(90): Xaa can be any naturally occurring amino acid
GLNGNGEPFVACHDCNFPICKTCFDYELKEGRKACLRCGNPYDENRLDDAEKXSGDRSTIAAHMDKSQDAGIHARHISSVSTLDSEMTEXNGNPIWKNRVESWKEKKNKKKRTSIKVEIEAQVPPEQLMEDKLAADAFQPLSTVIPIPKSRLAPYRTVIIMRLIILGLFFHYRVTNPVDSAFALWLT

SEQ ID NO: 8550 - protein, 489 aa, Listeria monocytogenes str. 4b H7858
MGKATGFMEYDRIPSPGRDPKSRTRDWNEYSLPMPVADLTLQAARCMDCGVPFCSVGMEIKNGVSGCPLHNLIPEWNDAVYRGDWYEALQLLLKTNNFPEFTGRICPAPCEGGCTVAISEPAVGIKSIEKAIIDRGFEEGWIKPAPPKKRTGKRIAVIGSGPAGLACADQLNKAGHSVTVIEKSDRIGGLLMYGIPTMKLEKEQVTRRVNLMAEEGIEFVTGVAAGTDVTFAELREEYDSIVLATGAGNARDIPLAGRDAVGIHFAVPYLSQSTRDNLDNGGVQTLSAKGKNVVIIGGGDTGADCVATALRQGAKSIYQFGIQDKLPELRDGENPWPQYPRVFKMDYAHEEAEAVYGRDPREYLINTTSFEKDEAGNLIGLHTVEVEENKAERKYTPVEGSEKYFEVDMVLIAIGFAGTTEDIFTNFGVGKTERHTIDAAKGFYRTSEEGVFACGDARHGQSLVVTAIAEGREAAREVDFYLMGETFLP

SEQ ID NO: 8551 - protein, 187 aa, Gossypium lobatum
GLNGNGEPFVACHDCNFPICKTCFDYELKEGRKACLRCGNPYDENRLDDAEKASGDRSTIAAHMDKSQDAGIHARYISSVSTLDSEMTEDNGNPIWKNRVESWKEKKNKKKKTSIKVEIKAQVPPEQLMEDKPAADAFQPLSTVIPIPKSRLAPYRTVIIMRLIILGLFFHYRVTNPVDSAFALWLT

SEQ ID NO: 8552 - protein, 580 aa, Schizosaccharomyces pombe 972h-
MEPEYVSFSDKDTKSILNESKSSLKDVKPSLEEKSYITPGLVDDVEPKGKNFVVRFFDDFKPAKATGEDGTALKRSLKSRHMQMISIGGAIGTGLYVGSGSSLADGGPASVIINYSLIGIMMFFIVYALGEMAVAYPVAGGFNTYATRFIDPAWGFAVSWNYFINYFVTFPLELTTCAITFRYWTDINSAAWISIFLVVIIIVNLFGVRAYGEVEFILSTVKVVATFGFIILAIIINCGGVPTDHRGYIGGSIIKHKPFRHGFKGFCSVFTTAAFSFSGTEVIGLAAAEVDNPQKALPHAVKQVFWRIAIFYVVSLILIGLLISPDDPNLMGNGSTSVSPFVLAIKEANIKGLPSVFNAVIIISVVSVTNSSTYTAGRTLHGMANLKQAPSFFKYTDRLGRPLLAMIVVLLFGFFAYINEADKNGNDVSDTVFNWLLALSGLSNFFTWGSICLCHIIFRLAFKKQGHSLKELGFVSPMGIWGSCIGLFFNILCLMAQFYVSLFPIGGKPNANDFFQGYLAAPVTLAFFIGYKIYDRSHIPSLDKLDITTGLKTYENLDEEEDEPTTASKRIFKKISSVFC

SEQ ID NO: 8553 - protein, 258 aa, Rickettsia typhi str. Wilmington
MNDNLINALKDLIINTGKVALDIKKTGILIDTKSDGSVVTNADQEISKIIYQTLQSLTSQIAIVCEEQPLPILNSDTFWLIDPIDGTRSYVDGKNTYTVNIGLIENGFPTIGLIYHPETAKLYYTDVNGRLKIEQNSQEIFVKHAPKHKEPNAVVGFYNSNKATKEFLRSYSFGKINTISSSIKLCLIAEGEADIYPKFGQTMEWDIAAGHALIKASGGNILDCDGQEVTYGKVNFANPHFFACSKYWLEMDYIFCIR

SEQ ID NO: 8554 - protein, 426 aa, Thiomicrospira crunogena XCL-2
MSLIKDIKARQVIDSRGNPTVEADVILDDGSKGRGISPSGASTGSREAIELRDGDKSKFGGKGVLKAVNNINTEIRDLLIGKEATDQAAIDNAMIALDGTDNKARLGANAILAVSIAVAQAAAQSKGLPLYAYLKTDDYKMPVPMMNIINGGEHADNSVDFQEFMIMPVGAPSMSEAIRYGAEIFHALKKVLHDKGYNTAVGDEGGFAPDLKSNEEAITVILEAIEAAGYKAGEDIMIAMDAASSELYKDGKYFLGSENKTLTSKEMVDLLSDWVTKYPIISIEDGLDESDWDGFKYQTEKDGKRLQIVGDDLFVTNPKILKEGIEKGIANSILIKINQIGTLTETFEAIQMAKDAGYTAVVSHRSGETEDTVIADIAVATGAGQIKTGSLSRTDRIAKYNQLIRIEEELGSKAVYPGKDAFYNLK

SEQ ID NO: 8555 - protein, 398 aa, Trifolium pratense
MASASASVFKSSSLVLDKSEWVKGQTLRQPMSVVRCSPAAPSSLTIRAGAYTDELVKTAKTIASPGRGILAMDESNATCGKRLASIGLENTEANRQAWRTLLVTVPTLGEYISGAILFEETLYQSTVDGRKIVDVLVEQNIVPGIKVDKGLVPLAGSNDESWCQGLDGLASRSAAYYQQGARFAKWRTVVSIPNGPSALAVKEAAWGLARYAAISQDNGLVPIVEPEILLDGEHNIDRTFEVAQKVWAEVFYYLAENNVQFEGILLKPSMVTPGAESKDRASPATVADYTLKLLQRRIPPAVPGIMFLSGGQSEVEATLNLNEMNKSPNPWHVSFSYARALQNTALKTWGGRVENVKAAQEALLHRAKSNSLAQLGKYAGDGESEEAKKELFVKGYVY

SEQ ID NO: 8556 - protein, 321 aa, Parasitella parasitica
MVVDYLTLDRTEDKMPLRGFGCWKIEKKDAENTIYQAIKIGYRLFDGACDYGNEVEVGRGINKAIKEGLVKREELFIVTKLWNTFHSKQHVRTAFDRQLKDWGLEYFDLYLIHFPIPLQYVDPAVSYPPEWYVPHADKLNFERSPIHECWAEMEKLVQAKLTRNIGVANFNCQAILDLLSYAKIKPAVLQIEIHPLLPQERLVKWVQEQGIQVTAYSSFGPTSYVDLCESGKTYSSLLANADVKSIANKHNANTGQILLRYALDRNIAVIPKSVHEDRMKSNLDILNIQLDQDDRKILNSLKTNQRFNDPMIFGFGLPLFD

SEQ ID NO: 8557 - protein, 209 aa, Arabidopsis thaliana
  misc_feature (65)..(65): Xaa can be any naturally occurring amino acid
  misc_feature (124)..(124): Xaa can be any naturally occurring amino acid
  misc_feature (140)..(140): Xaa can be any naturally occurring amino acid
  misc_feature (151)..(151): Xaa can be any naturally occurring amino acid
  misc_feature (180)..(180): Xaa can be any naturally occurring amino acid
  misc_feature (187)..(187): Xaa can be any naturally occurring amino acid
TRKKKKKKSPYYPPPPTRGLTKSEEDLWLSSMVSSARMVASPAQVTMVAPFNALKTSGAFPVTRXKANNDITSITSNGGRVNCMQGWPPIGKKNRDTLSYLPDLTDSELDKEVDYLIRTKWIPXDEFELKNGFVYPEHGXNSPGYYDGRDXTMRMLPLFSCTYSAQVLKEVGECKKEYPXAFIKIIXFNNTREVQSIRFIAYKTPSFTG

SEQ ID NO: 8558 - protein, 646 aa, Symbiobacterium thermophilum IAM 14863
MAILTVQGLTKYWGVDLLFKDISFLLNEGEKMALVGPNGAGKTTLLRILLGRMEYDEGRIIMPAGTRVAYLSQDPEFTPGRTVFQEARSVFSHLAKWERDLRELEARMGEAESEEALQAVMDEYTRVTALYEAAGAYDAPARTRAVLFGLGFTEADLEKPVEVLSGGQKVRLGLAKILLAEPDLMLLDEPTNHLDLQAVEWLEGYFRQVKSAAILVSHDRYFLDRVISRTLEIDSHTCDMYHGNYSYYVEEKKRRLEARLSAYERQQREAERLRTFYEKWRSNANRKGQAMSRKRQLEKMELMERPQVKRRTMRLSFDVDYESGDDVLVVEGLAKSFGDRTLFRNANLTVQKGDRIALVGPNGSGKTTFLKIIHGLVQPSAGSYRWGVGVQRGYFSQDLDDLDPSRTCLEEIMALPGFTRYDAHSLLGQFLFSGEDALKRIGDCSGGERNRLILAKLMVSGANVLLLDEPTNHLDLESKQVLEEALRAYPGTVLFVSHDRFFVDRIATHVWEFGQPEGIAVYEGNYTAYREEKERQALLAAQAAAAAGADGRAELPRSGAGQDGAGRRPARSRKEERKAAEAVRRLEAEIQRLEQRKAELEERMADPDIYRSATGREAVAEYNAVRDELERLYVEWEELAAELAGG

SEQ ID NO: 8559 - protein, 253 aa, Arabidopsis thaliana
MPTRNIAIGGVQEEVYHPNALRAALAEFISTLIFVFAGSGSGIAFNKITDNGATTPSGLVAAALSHAFGLFVAVSVGANISGGHVNPAVTFGVLLGGNITLLRGILYWIAQLLGSVAACFLLSFATGGEPIPAFGLSAGVRSLNALVFEIVMTFGLVYTVYATAVDPKNASLGTIAPIAIGFIVGANILAGGAFSGASMNPAVAFGPAVVSWTWTNHWVYWAGPLIGGGLAGIIYDFVFIDENAHEQLPTTDY

SEQ ID NO: 8560 - protein, 506 aa, Brassica napus
MTSINVKLLYHYVITNLFNLCFFPLTAIVAGKAYRLTIDDLHHLYYSYLQHNLITIAPLFAFTVFGSVLYIATRPKPVYLVEYSCYLPPTHCRSSISKVMDIFYQVRKADPSRNGTCDDSSWLDFLRKIQERSGLGDETHGPEGLLQVPPRKTFAAAREETEQVIIGALENLFKNTNVNPKDIGILVVNSSMFNPTPSLSAMVVNTFKLRSNVRSFNLGGMGCSAGVIAIDLAKDLLHVHKNTYALVVSTENITYNIYAGDNRSMMVSNCLFRVGGAAILLSNKPGDRRRSKYELVHTVRTHTGADDKSFRCVQQGDDENGKIGVSLSKDITDVAGRTVKKNIATLGPLILPLSEKLLFFVTFMGKKLFKDKIKHYYVPDFKLAIDHFCIHAGGRAVIDVLEKNLALAPIDVEASRSTLHRFGNTSSSSIWYELAYIEAKGRMKKGNKVWQIALGSGFKCNSAVWVALNNVKASTNSPWEHCIDRYPVKIDSDSGKSETRVQNGRS

SEQ ID NO: 8561 - protein, 98 aa, Zea mays
AGRAGPIEVEIHDGPYNVIKNWDYTGLVNAIHNSEGNCWTMKVRTEEQLKEAIAMATGDKKDCLCFIEVIVHKDDTSKELLEWGSRVSAANSRPPNPQ

SEQ ID NO: 8562 - protein, 413 aa, Bradyrhizobium sp. BTAi1
MSIEAAGSPAESQRLLRSLSLTQAVLYGLGVTIGAGIYVLVGIAAARSGMHAPLAFIGAALVMAFSAASFAELGTRMPVSASEAAYVQAAFGRKWLSLGVGLLVVATATISAATISVGSSGYVAVFLPISAPWIISGVVLAMGVVACLATAQSVTFAGIMTVVEVGGLVLIIVTGLGHGTDVVTRLPEMWPPTRDTEAWIGLGGTALIAVFSFIGFEHVVNIAEEMKEPSRTLPRALFLTLGLTALIYALVVWIAVTAVPPQELARSSAPLALVFERLTGLPLVTMSAIAIVATLNGIIVHMIMIGRVIYGLADQGNLPRVFARLNSVTQTPLLATAFGIGAILVLSLAVPLGGLADLTARFTLVVFAIVNIALIRIKGRRQPAPSGAFICPMWVPCFGLASSLLLLVVDLVA

SEQ ID NO: 8563 - protein, 498 aa, Coffea arabica
MKINPTTSGSGVSTLEKKNMGRIVQIIGPVLDVAFPAGKMPNIYNALVVKGRDTVGQPINVTCEVQQLLGNNRVRAVAMSSTDGLTRGMEVIDTGAPLSVPVGGATLGRIFNVLGEPVDNLGAVDTRTTSPIHRSAPAFIQLDTKLSIFETGIKVVDLLAPYRRGGKIGLFGGAGVGKTVLIMELINNIAKAHGGVSVFGGVGERTREGNDLYMEMKESGVINKENIAESKVALVYGQMNEPPGARMRVGLTALTMAEYFRDVNEQDVLLFIDNIFRFVQAGSEVSALLGRMPSAVGYQPTLSTEMGSLQERITSTKEGSITSIQAVYVPADDLTDPAPATTFAHLDATTVLSRGLAAKGIYPAVDPLDSTSTMLQPRIVGEEHYETAQRVKQTLQRYKELQDIIAILGLDELSEEDRLTVARARKIERFLSQPFFVAEVFTGSPGKYVGLAETIRGFQLILSGELDSLPEQAFYLVGNIDEATAKAMNLEMENNLKK

SEQ ID NO: 8564 - protein, 193 aa, Fulvimarina pelagi HTCC2506
MSSTTYSLPNLLTYARIVCVPLVVVCFFVEGSLKSPDYARWTALAIFIAASITDYFDGYLARAWKQTSTIGRMLDPIADKLLVAAVLLLLAADGTIAGWSLWAAIVILCREILVSGLREYLAELKVSVPVTRLAKWKTTFQMVSIGILLAGPAGDKLIPNVTEIGIVCLWIAAVITLITGYDYFRAGLRHIED

SEQ ID NO: 8565 - protein, 214 aa, Candida maltosa
MSISTVDDLSFYSNVEPNQQRFTEVVKTFQTNFPGDDITFFARSPGRVNLIGDHIDYNFFPVLPMAIANDVIAAVNVNSTNEIIITNTDSKDFLKEVIALRNSQIDQEHHSWANYFKCALIVAKQYLEERGVTSLKGMKLTFNGNVPTGGGLSSSAAFCVASTLAIIRANGITDLTKQDLTRITVVSEHYVGVNTGGMDQCASVCGEPDKLLLI

SEQ ID NO: 8566 - protein, 156 aa, Haemophilus influenzae
NRANIPVLVDGKDVMPEINAVLAKMKDFCQRIISGKWKGYTGKAITDVVNIGIGGSDLGPYMVTEALRPYKNHLNMHFISNVDGTHIAETLKKINPETTLFLVASKTFTTQETMRNAQSARDWLLKAAKDESAVAKHFAALSTNAKDVEKFGIDTN

SEQ ID NO: 8567 - protein, 153 aa, Candida maltosa
MSDDIFLVTGGAGYIGSHTVIELINHGIKVVIADNLSNSSYDAVARIEFIVKQHVSHFIKVDIRNEKELNQVFSNHKISGVIHFAALKAVGESTKIPLEYYDNNVSGTIALLNVCKSNNVKTIVFSSSATVYGDVTRFGDNSMIPIPEHCPME

SEQ ID NO: 8568 - protein, 156 aa, Haemophilus influenzae
NRANTPVLVDGKDVMPEVNAVLAKMKDFCQRIISGEWKGYTGKAITDVVNIGIGGSDLGPYMVTEALRPYKNHLNMHFVSNVDGTHIAETLKKVNPETTLFLVASKTFTTQETMTNAQSARDWLLKAAKDESAVAKHFAALSTNAKDVEKFGIDTN

SEQ ID NO: 8569 - protein, 385 aa, Glycine max
MGLLCSRNRRYNDADAEENAQTAEIERRIEVRNERAEKHIQKLLLLGAGESGKSTIFKQIKLLFQTGFDEAELKSYLPVIHANVYQTIKLLHDGSKEFAQNDVDSSKYVISNENKEIGEKLLEIGGRLDYPYLSKELAQEIENLWKDPAIQETYARGSELQIPDCTDYFMENLQRLSDANYVPTKEDVLYARVRTTGVVEIQFSPVGENKKSDEVYRLFDVGGQRNERRKWIHLFEGVSAVIFCAAISEYDQTLFEDENRNRMMETKELFEWILKQPCFEKTSFMLFLNKFDIFEKKILKVPLNVCEWFKDYQPVSTGKQEIEHAYEFVKKKFEESYFQSTAPDRVDRVFKIYRTTALDQKVVKKTFKLVDETLRRRNLLEAGLL

SEQ ID NO: 8570 - protein, 407 aa, uncultured alpha proteobacterium EBAC2C11
MALIVQKFGGTSVADLDCIRHVAQRVKIEVDAGNEVAVVVSAMSGATNQLVDWASDIGALHDAREYDTVLATGEQVTVGLLAIALQNIGIDARSWLGWQIPIWSDNVHGAARIDAINGKAIIERLKNGQVAVIAGFQGIGPDGRITTFGRGGSDTSAVAVAAALEADRCDIYTDVDGVYTTDPRIAPKAKKLSRITFEEMLEMASSGAKVLQTRSVAMAMRHNVNLQVRSSFNDTTGTLVVSEDSVVEQETISGIAYSPNEAKITIIGLPDKPGIAAGVFGALADQQVNVDMIVQSASSAAKKTDISFSVGRDDLQKAVDIINKIKVKLEFESVDASPNVAKISVVGTAMRTQPGVAKTMFETLASKGVNMQVISTSEIKISVLIDTEYTELAVRSLHTAYGLDDDS

SEQ ID NO: 8571 - protein, 384 aa, Solanum tuberosum
MGSLCSRNKHYSQADDEENTQTAEIERRIEQETKADKHIQKLLLLGAGDSGKSTIFKQIKLLFQTGFDEAELKNYIPVIHANVYQTIKILHDGSKELAQNELEASKYLLSAENKEIGEKLSEIGGRLDYPRLTKDLVQDIEALWKDPAIQETLLRGNELQVPDCAHYFMENLERFSDIHYIPTKEDVLFARIRTTGVVEIQFSPVGENKKSGEVYRLFDVGGQRNERRKWIHLFEGVTAVIFCAAISEYDQTLFEDERKNRMMETKELFEWVLKQPCFEKTSFMLFLNKFDIFEQKVLKVPLNTCEWFKDYQSVSTGKQEIEHAYEFVKKKFEESYFQCTAPDRVDRVFKIYRTTALDQKLVKKTFKLVDETLRRRNLFEAGLL

SEQ ID NO: 8572 - protein, 176 aa, Zea mays
  misc_feature (157)..(157): Xaa can be any naturally occurring amino acid
RFLTVSLQPFCHRNIPYGGSLLRRIKVSVADNAPLLPEASRNSVKNVIVWTRQGSPLRAILVISVGAVTSVALTGMLVFMLFFLAATINAIVISLLMSLAAAGGFLALFFAFATAIYIGALSVAIFVISVTTFWTIVAILITTGWIGFFYTVWLITXKSFGFAKHSLCVTGSAIST

SEQ ID NO: 8573 - protein, 84 aa, Vitis vinifera
MVKDFVDQNQASGIGSYDLAVPYPRKVFKGQDLSKSLSDLGLLNRQALMVVPHQRAVAHRRGVSSSRDLTNSTNDSAMEDILHS

SEQ ID NO: 8574 - protein, 384 aa, Actinobacillus pleuropneumoniae
MKPQQLATQKFSEHCGYSAAQTVFAPGRVNIIGEHTDYNDGFVMPCAINYGMAVSFSKRDDSVWRVYAIDIDEQDEFDLSRPIEPSEHKWANYVRGVVKYIQEKCPEFKQGADLAMTSDVPMSSGLSSSAALEISIGKTARVLGDLPLSLTEIALIGQQAENKFVGANCGNMDQLTSALGQKDQVIMIDCRSLDITPTPVPHGYSIAIINSNVKHDLVTGEYNSRRQECEFAARFFGVKALRDVTSERFIERAAELQAQNELAYKRAKHIISENQRVLEAVEALKANDMVKLGQLMAGSHDSMRDDFEITIPEIDYLVELAQVAIGKNGGARMTGGGFGGCIVCLVPDEKVEHLRRIIADNYEKQTGIKETFHLCTACDGVHLI

SEQ ID NO: 8575 - protein, 205 aa, Vitis vinifera
MERSLPSLTFKGSISEAIVEAKRQRKLFVVYISGEDAESIRLENSTWADLNVAEKLSKYCILLHILEGSTEASHFSAIYPQKPAPCITVIGYNGVQLWQNEGFVAAEILASNLEKTWLSLHIQETTATVLTAALASKKSDPLASGAPNIASLQPGSSSSMDVPSSSINKDVKSSEARPLVASEIIEENKSCEHPVKVTLTAAFSP

SEQ ID NO: 8576 - protein, 330 aa, Rickettsiella grylli
MLKPQKKHAHSLMVAPMLGWTTRHYHYFFRLICKKAQLYTEMFTAQAILKSPARERLLTVDANEKALAIQLGGGIASDLSKAAKIVESYGYSEINLNVGCPSEKVQSGGFGVVLLKEPNRVADAIAAMKAVVRLPVTVKTRIGVDNDESYDYLASFIRQVSLAGCDTFIIHARKAWLHGVSPKENREIPPLNYPWVYQIKRDFPHLTIVLNGGITCLKRAYQQLQHVDAVMIGRAAWYNPYLFAQLDALISPQDRFIVPHRFSIILQYLPYLEKALKSGENLAHLIQPLLGLFHGVVGTKQWRQTLSELLQRRYSFVKIKETLQEFISRR

SEQ ID NO: 8577 - protein, 267 aa, Burkholderia sp. 383
MRAGLFPDHIMFTRLREDVATIRERDPAARSAWEVLTCYPGLHALLLHRFAHACWRAKRYWLARFASQAGRFMTGIEIHPGATIGRRVFIDHGMGVVIGETAIVGDDCTIYQGVTLGGTSLTRGAKRHPTLEAGVIVGAGAKVLGGFTVGAGAKIGSNAVVVKPVPAGGTAVGNPARVVMPAQPKPQPERAAFCAYGITPNADDPMSLAIHGLIDHAAKESRRVDEIVAALERLGTHLETLQGADAARLDLRRLSAVLEGKSVERQA

SEQ ID NO: 8578 - protein, 407 aa, Rickettsiella grylli
MALIVQKFGGSSVGSIDKIQQVANKIIETRTQGHQLVVVVSAMEGETNRLISLAKILNEEPDSREYDLLLATGEQAATALLAMALLAQGCPARSYNSFHVPIYTDNHHKKARILNIKEEILRDDIKVGRIPIVAGFQGISDSGDMTTLGRGGSDTTAAALAAVLKADECQIYTDVDGIYTADPRFVPQAKRLERIGFIEMTEFARAGAKVVQHRAVELASKYHIPLRVLSSSQEGSGTLIQVNEEESAIEGVKITGVTASHREAKLTLQGLTAEKEAMSLFFSLLKDARIEIDMLTQQQISPNQMDITFTLARADYHQAKQRLQTLVKKKYALSIVGNKRLAKLSVVGMGLHSHPGIIHTLFQALESENIPIILTLSSALRISLMVNDGEVLQGVRILHQIFGLGEK

SEQ ID NO: 8579 - protein, 186 aa, Gossypium lobatum
LNGNGEPFVACHDCNFPICKTCFDYELKEGRKACLRCGNPYDENRLDDAEKASGDRSTIAAHMDKSQDAGIHARYISSVSTLDSEMTEDNGNPIWKNRVESWKEKKNKKKKTSIKVEIKAQVPPEQLMEDKPAADAFQPLSTVIPIPKSRLAPYRTVIIMRLIILGLFFHYRVTNPVDSAFALWLT

SEQ ID NO: 8580 - protein, 458 aa, Borrelia garinii PBi
MKKQNPWISLSEEEKNQIFNFSESYKKFISKFKTEREVTSYALDKAKKRGFIDAEEKKNLIPGDKIFYTCREKSVAFAIIGKNPIENGMNLIVSHTDSPRLDAKPSPISEENELAFLKTNYYGGIKKYQWLSTPLSIRGVVFLKNGEKVEINIGDNENDPVFVIPDILPHLDKKIQRNKKSDEIIEGENLKILIGSLPIESKEQDKVKLGTLQLIKEKYKIEEEDFVSSEIEIVPAGTAKDVGFDKALIGAYGQDDKICAYASLEAIFDLEEIPSKTAICFLVDKEEIGSTGSTGLDSRYLEYFVSDMIFKIKKSEYNNLQVQKALWNSKSISADVCAAINPIFNSVHDAQNAPKLGYGIPIMKYTGHGGKVMASDADAELVSYIRQLLNKNNIAWQVATLGKVEEGGGGTVAKFLASYGIRTIDMGPAVISMHSPMEITSKFDLYNAYLAYKAFYKE

SEQ ID NO: 8581 - protein, 364 aa, Oryza sativa Japonica Group
MAVALAGARSPGAGAILSLRRLAPAAAAPVRLGGSGTPGTRRRRGIAMAAAASAPPAPADALPKGADSFFRTVISNMEKVYLSRNPTAKTILELVRSYDGDHICYDHFAFRTFGVDGYGIKSLAEFFTDFGYVPREELRFPAKKLRALWFSPPTNDGYTGTGVYGPLPRIFISELLVDELSPQSQDIIQKYIRTSGKGNKHATLASTSGELTWEKPIYSDFQVLSRESEYAAWTLVNGYALNHTTISTHRLISDIRSINKFNKFVEDNGFKLNSEGGILKVSPDGLLQQSSTVADSALFTFADGITESIPRSYIEFAERLVLPQFKDLPNDEVNEHHRRDGFEVGNADKIFESTSNDQLTRRSA

SEQ ID NO: 8582 - protein, 165 aa, Photobacterium profundum SS9
MANEKTQSDLNEKLIAVNRVSKTVKGGRIFSFTALTVVGDGNGRIGFGYGKAREVPAAIQKSMEKARRNMVTVALNEGTLHHAVKGRHTGSKVYMQPASEGTGIIAGGAMRAVLEVAGIRNVLAKAYGSTNPINVVRATIAGLSGMNSPEMIAAKRGLSVKEILG

SEQ ID NO: 8583 - protein, 187 aa, Gossypium schwendimanii
GLNGNGEPFVACHDCNFPICKTCFDYELKEGRKACLRCGNPYDENRLDDAEKASGDRSTIAAHMDKSQDAGIHARQISSVSTLDSEMTEDNGNPIWKNRVESWNEKKNKKKKTSIKVEIEAQVPPEQLMEDKPAADAFQPLSTVIPIPKSRLAPYRTVIIMRLIILGLFFHYRVTNPVDSAFALWLT

SEQ ID NO: 8584 - protein, 190 aa, Cucumis sativus
NSLVIGAYGIVCSVLNSETNEMVAVKKIANAFDNHMDAKRTFREIKLLRHLDHENVIGIRDVIPPPLRREFNDVYISTELMDTDLHQIIRSNQSLSEEHCQYFLYQILRGLKYIHSANVIHRDLKPSNLLLNANCDLKICDFGLARPTSENECMTEYVVTRWYRAPELLLNSDYTAAIDIWSVGNRIPAA

SEQ ID NO: 8585 - protein, 750 aa, Zea mays
MTVTPRITVGDGRLVAHGRSVLAGVPDNIVLTHASGAGLVDGAFVGATAAEPSSMHVFTFGTLRDLRFVCCFRFKLWWMTQRMGTSGRDVPLETQFMLLECGPGDGHGDGDAAVYVAMLPLLEGQFRAALQGNDRDELEITFESGDKAVQTAQGTCMLYVHAGTNPFDTITQAVKVVERHMQTFHHREKKKLPSFVDWFGWCTWDAFYTDVTAESVKQGLKSLADGGTPPRFLIIDDGWQQIGSENKEESANAVVQEGAQFASRLTGIKENAKFQKKTKTKESGGGGGEQQAQTPGLKLLVEEAKREHGVRYVYVWHAMAGYWGGVKPAAEGMEHYESALAYPVQSPGVMGNQPDIVMDSLSVLGLGLVHPRRALSFYDELHSYLASCGVDGVKVDVQNIIETLGAGHGGRVALTRAYHRALEDSVARNFPDKRLHLLHTAVVRASDDFYPRDPASHTVHVSSVAYNTLFLGEFMQPDWDMFHSLHPAADYHGAARAIGGCPIYVSDKPGNHNFELLKKLVLPDGSVLRAQLPGRPTRDCLFADPARDGTSLLKIWNVNKCTGVVGVFNCQGAGWCRVTKKTRVHDAAPGTLTGSVRADDVDVIAGLAGDGWGGEAVVYAYRSGELVRLPQGATLPVTLKVLEFEVFHVSPVRAVAPGVSFAPIGLLDMFNSGGAVEQCEVRGGANAAAAVALRVRGCGRFGAYCSRRPARCMLDATEVEFSHDADTGLVTLHIPVPEQEFYRWSLEIEV

SEQ ID NO: 8586 - protein, 351 aa, Borrelia garinii PBi
MKISVIGAGAWGTAIAKSLADKFDFNIFLWSFEEDVKNGINNDNVNDKYLKGIKLPKNLVASSDLFEVVSMSDYILISTPSLFTVDIFKKLDQFFDSLELKPKLAILTKGFLTFNGKTHTVIEAAEKVIKGYKDEITYIVGPSHAEEVGLGVITGLVAASNSRENAYLFINLFSKTSISLFYSNDVFGVQIAAALKNVFAIAFGILDAYKLNYPNLIGNNTESFLFSISLNNMKDIAIELGGKNVETFLFLSGSGDLDVTCRSMFGRNRRFGNEIVSKNILESFFSIDDLINNIEKIGYLPEGVFAAKSIFSLLKELNRDFNPNSLLSVIYKILNKELRAESVIDYMRNIG

SEQ ID NO: 8587 - protein, 182 aa, Cucumis sativus
YRGDWHGSEVAVKILTEQDFHPERVNEFLREVAIMKSLRHPNIVLFMGAVTKPPNLSIVTEYLSRGSLYRLLHKSGVKDIDETRRINMAFDVAKGMNYLHRRDPPIVHRDLKSPNLLVDKKYTVKVCDFGLSRLKAHTFLSSKSAAGTPEWMAPEVLRDEPSNEKSDVYSFGVILWESNSRG

SEQ ID NO: 8588 - protein, 189 aa, Gossypium thurberi
HVGLNGNGEPFVACHDCNFPICKTCFGYELKEGRKACLRCGNPYDENLLDDAEKASGDRSTIAAHMDKSQDAGIHARHISSVSTLDSEMTEDNGNPIWKNRVESWKEKKSKKKKTSIKVEIEAQVPPEQLMEDKPAADAFQPLSTVIPIPKSRLAPYRTVIIMRLIILGLFFHYRVTNPVDSAFALWLT

SEQ ID NO: 8589 - protein, 189 aa, Gossypium thurberi
  misc_feature (114)..(114): Xaa can be any naturally occurring amino acid
HVGLNGNGEPFVACHDCNFPICKTCFGYELKEGRKACLRCGNPYDENLLDDAEKASGDRSTIAAHMDKSQDAGIHARHISSVSTLDSEMTEDNGNPIWKNRVESWNEKKSKKKXTSIKVEIEAQVPPEQLMEDKPAADAFQPLSTVIPIPKSRLAPYRTVIIMRLIILGLFFHYRVTNPVDSAFALWLT

SEQ ID NO: 8590 - protein, 620 aa, Neurospora crassa
MDNTNRPHLNLGTNDTRMAPNDRTYPTTPSTFPQPVFPGQQAGGSQQYNQAYAQSGNYYQQNHNDPNTGLAHQFAHQNIGSAGRASPYGSRGPSPAQRPRTSGNSGQQQTYGNYLSAPMPSNTQTEFAPLPSGTPTNMAPMPTTTRRSAHSWPLTSLRTASSAPGSATRGECCSDALLPLHPAVIGADTLFRQSEMEQKLGETNDARRRESIWSTAGRKEGQYLRFLRTKDKPENYQTIKIIGKGAFGEVKLVQKKADGKVYAMKSLIKTEMFKKDQLAHVRAERDILAESDSPWVVKLYTTFQDANFLYMLMEFLPGGDLMTMLIKYEIFSEDITRFYIAEIVLAIDAVHKLGFIHRDIKPDNILLDRGGHVKLTDFGLSTGFHKLHDNNYYTQLLQGKSNKPRDNRNSVAIDQINLTVSNRAQINDWRRSRRLMAYSTVGTPDYIAPEIFTGHGYSFDCDWWSLGTIMFECLVGWPPFCAEDSHDTYRKIVNWRHSLYFPDDITLGVDAENLIRSLICNTENRLGRGGAHEIKSHAFFRGVEFDSLRRIRAPFEPRLTSAIDTTYFPTDEIDQTDNATLLKAQQAARGAAAPAQQEESPELSLPFIGYTFKRFDNNFR

SEQ ID NO: 8591 - protein, 418 aa, Sphingomonas sp. KA1
MPIEIKMPALSPTMEEGTLAKWLIKVGDTVSSGDIMAEIETDKATMEFEAVDEGVIADIAVPAGTEGVKVGTVIATLTCEDEEDSAVTMPKAEVKATAEPAKSAEPSTVSVSTPQPTAAPVSKSGRVVASPLAKRIAAQRGVDLGEIRGSGPSGRIVKSDVEGAQDSTPSETQRAPAPQAAVDAVPDFSIPYEAEKLNNVRKTIARRLTEAKQTIPHIYLTVDARLDGLLRLRGELNKALEPDGVKLSVNDLLIKALAKALIRVPKCNVSFAADELRKFTRADISVAVAAPSGLITPIVVDAATKGVAQISTEMKALADKAREGKLQPHEYQGGTASLSNLGMFGIKQFEAVINPPQGMIMAIGAGEQRPYVVDGALAIATVMSATGSFDHRAIDGADGAQLMQAFKDLVENPLGLVA

SEQ ID NO: 8592 - protein, 603 aa, Streptomyces coelicolor A3(2)
MRRPVARNLTVLAVSAAVVVSVGAAAPPTARHHRPAPKTPVAVGYGGAVSSVDRDASAAGVEVLRKGGNAVDAAVATAAALGVTEPYSAGVGGGGYFVYYDAESRTVRTIDGRETAPLTADEKLFTEDGKPLAFADAVTSGLSVGTPGTPATWQTALDRWGSRKLASVLKPAERLARHGFTVDETFRSQTAANEQRFRYFPDTAELFLPGGELPAVGSTFKNPDLARTYQELGREGVGAIYRGALGEDIVDTVNKPPVDPDSGWNARPGDLSAKDLAAYEAKLQAPTRTSYRGLNVYSIAPSSSGGTTVGEALNILERTDLSTADKAGYLHRYIEASRIAFADRGRWVGDPAFEDVPAKELLSQRHADSRACLIKDDAVLTSPLAPGDPRHPAPCAGGGTAAPTTYEGENTTHLTVADKWGNVVAYTLTIEQTGGSGITVPGRGFLLNNELTDFSFAPANPAVHDPNLPGPGKRPRSSIAPTIVLDRHHEPVVALGSPGGATIITTVLQTLTGFLDRGLPLVDAIAAPRASQRNAAQTELEPGLYDSGVRAELEALGHSFKLNPEIGAATAVQRLPHGKWLAAAEKVRRGGGSAMVVEPVRRR

SEQ ID NO: 8593 - protein, 310 aa, Photobacterium mandapamensis
ICLTLTKERCQTLNLPLMVQNNHDKFSTAFTVSIEAATDVTTGISAYDRAKTVQAAIAPNASANDIVMPGHIFPLMAQDGGVLIRAGHTEAGCDVARLAGLEASSVIVEILNEDGTMARRPQLEVFAQKHGLKLGTIADLIEYRTQRESHIERLSESELCTEYGVFNLITYRDTIDNQLHYALCKGDITPDSETLVRVHVKDTLKDILHTGATQWSLQAAMQRIQADSGVLVIISQIEPSAMILNQINHLDSEHQASSPLPITPQSRQIGLGSQILSELGLRKIRLLSSQSQQYRSLSGFDLEVVEYICN

SEQ ID NO: 8594 - protein, 156 aa, Photobacterium mandapamensis
MNIIEGAITAPHANVAIIVSRFNSFINDSLLSGALDALQRQGLVKESNITVVRCPGAYELPLLAQQLAKKGSYDAIIALGSVIRGGTPHFEYVAGECNKGLAQIALEHQIPVAFGVLTVDSIEQAIERAGTKMGNKGSEAALSALEMINVLAEIEP

SEQ ID NO: 8595 - protein, 258 aa, Streptomyces coelicolor A3(2)
MVELKTDTSIDAMHAAGQVVARALTAVRQAADVGVSLLELDAVAHEVLREAGAGSPFLGYRPSFAPTPFPGVICASVNDAIVHGIPDGYRLRDGDLVSIDCGALLDGWAGDSALSFVVGTPRPADVTLIETAERALEAGIAAAVVGNRIGDIAHAIGTVCRSAGYGIMEDFGGHGIGRHMHEDPGVPNEGRPGRGLPLRHGMVLAIEPMLTAGGRDDYHAAPDGWTLRTNDGSRAAHVEHTVAITDGGPRVLTSRDGL

SEQ ID NO: 8596 - protein, 182 aa, Photobacterium mandapamensis
MITVRARVPFKIGQKSQIPAELLSFHGFNSGKEHVAIIFKQADTTTAPLVRLHSECLTGDVFHSSRCDCGEQLNETIEKMHQFGGIILYLRQEGRGIGLYNKIDAYHLQSQGMNTYEANNHLGFADDLRDFSEAAKALMALGINKIRLITNNPKKINELQQYGIEIMDVVNTQVHIKQDNED

SEQ ID NO: 8597 - protein, 317 aa, Frankia sp. EAN1pec
MPAHAPHARLTYLGPEGTFTEAALRTLPEAATHELFPSMSVAAALDAVRNEDAVAALVPIENSVEGAVTATLDELATGRPLIIRREVLLPISFALLVRPGTTLDDVKTVTGHSVAQAQVRRWLAANLPHAEWESAASNAEGARLVRDGRFDCCFAGEFTARRYGLEALLTNVNDAADATTRFVLLGRPGPTSAPTRADKTSIVVWPTEDEPGALLALLQEWAVRKVNLIRIESRPTGEGLGRYCFSIDAEGHVSGRGVSEALMGLHRICRKIRFLGSYPRADRPAPPAGQRLTGHDFVEAADWLSTCLTGDDGDWEP

SEQ ID NO: 8598 - protein, 61 aa, Triticum aestivum
  misc_feature (13)..(13): Xaa can be any naturally occurring amino acid
  misc_feature (29)..(30): Xaa can be any naturally occurring amino acid
  misc_feature (34)..(34): Xaa can be any naturally occurring amino acid
  misc_feature (36)..(37): Xaa can be any naturally occurring amino acid
  misc_feature (46)..(49): Xaa can be any naturally occurring amino acid
  misc_feature (53)..(53): Xaa can be any naturally occurring amino acid
  misc_feature (56)..(58): Xaa can be any naturally occurring amino acid
  misc_feature (60)..(60): Xaa can be any naturally occurring amino acid
DMSKSYMLDTQDXAEAKYKKWEKDLAPHXXDVFXQXXLYDAYKKRXXXXEVDXDAXXXAXE

SEQ ID NO: 8599 - protein, 475 aa, Frankia sp. EAN1pec
MAAVLEFALPDLGEGLTSAEIVRWMVGIGDVIVVDQPVAEVETAKAVVEVPCPHAGVVTALAGPPGTAVPVGTPLITVTVDEPAEQPADGPDGPDGAPGSAGGGSGRVLIGYGPRAEPAPTSRAGRASRASRIDRSLVGATAPEPLPSTPPAPTPPAPTPTAREARQAVKVISPLVRRLARDNAVDLRELTGTGPDGLIRRRDVEAAITAATRTGPATPADLAAPAAPAAPAPLADLAGPDGADVVPLSPLARRAAEAFGRSRREVPDATTWVDADATELLAARDALNAGGAEPRIGVLALLARVCVAALRRFPDLNSTVVTDADGRATGVRQHRAVHLGFAAQTPRGLVVPVVRDAQGHTTASLAAEVTRLTAAARAGRLTPAELTGGTFTLNNYGVFGVDGATPIVNHPEVAMIGIGRILPRPWAVDGELAVRRITQLSFTFDHRVCDGATAGAFLRFVADAVENPTTLLRYL

SEQ ID NO: 8600 - protein, 227 aa, Photobacterium mandapamensis
IRAGHTEAGCDVARLAGLEASSVIVEILNKDGSMARRPQLEIFAEKHGLKLGTIADLIEYRTQRESHIERVYEGELCTEYGIFTLITYRDTIHSQLHYALHKGNIQSNAETLVRVHVKYTLKDILHADATQWSLQAAMKRIQADGGVLVIINQDETPEMLLDKITRHTAEHHTSSLLSNTTQSRQIGLGSQILSELGLRKIRLLSSHCQQYRSLSGFDLEVVEYICN

SEQ ID NO: 8601 - protein, 156 aa, Photobacterium mandapamensis
MNIIVGAYAAPNANIAIIVSRFNNFINESLLSGALDVLEHQGLVKETNIIVVRCPGAYELPLLAQQLAKEGCYDAIIALGSVIRGGTPHFEYVAGECNKGLAKIALEYQIPIAFGVLTVDSIEQAIERAGAKMGNKGSEAALSALEMINVLAELES

SEQ ID NO: 8602 - protein, 182 aa, Photobacterium mandapamensis
MITVRTRVPFKIGQKSQIPAELLSFHGFNSGKEHVAIIFKQADTTTVPLVRLHSECLTGDVFHSSRCDCGEQLNETIEKMHQTGGIILYLRQEGRGIGLYNKIDAYYLQSQGMNTYEANNHLGFADDLRDFSEAAKALMALGTKKIRLITNNPKKVNELKQHGIEIMDVINTQVHIKQGNED

SEQ ID NO: 8603 - protein, 542 aa, Neisseria meningitidis Z2491
MISTNGITMQFGAKPLFENVSVKFGEGNRYGLIGANGSGKSTFMKILGGDLEQTAGEVAIENGVRLGKLRQDQFAYEDMRVLDVVMMGHTEMWAAMTERDAIYANPEATEDDYMKAAELEAKFAEYDGYTAEARAAELLSGVGISEDLHNATMAEVAPGFKLRVLLAQALFSKPDVLLLDEPTNNLDINTIRWLEGVLNQYDSTMIIISHDRHFLNEVCTHMADLDYNTITIYPGNYDDYMLASAQSRERALKDNAKAKEKLQELQEFVARFSANKSKARQATSRLKQADKIKSEMVEVKPSTRQNPYIRFEADEKAKLHRQAVEVEKLAKRFETQLFKNLNFILEAGQRLAIIGPNGAGKSTLLKLLAGAYNPEYSDGLLPDEGSIKWAEKASVGYYPQDHENDFDVDMDLSEWMRQWGQDGDDEQVIRGTLGRLLFGSNDVVKKVKVLSGGEKGRMLYGKLLLLKPNVLVMDEPTNHMDMESIESLNMALEKYNGTLIFVSHDRQFVSSLATQIIELDGKGGYEHYLGDYESYLEKKGVA

SEQ ID NO: 8604 - protein, 364 aa, Zea mays
  misc_feature (351)..(351): Xaa can be any naturally occurring amino acid
MGVYLSTPKTEKVSEDGENDKLKFGVSSMQGWRTTMEDAHSALLDLDNDTAFFGVFDGHGGKVVAKFCAKYLHREVLRSEAYAAGDLGAAVHRAYFRMDEMMRGQRGWRELQALGDKINQFSGIIEGLIWSPKASDSNDRHDDWAFEEGPHSDFTGPNCGSTACVALIRNKQLVVANAGDSRCVISRNGQAYNLSRDHKPELEAERERIRSAGGFVLMGRVNGNLNLSRAIGDMKFKQNKFLPPDKQILTANPDINIVELCDDDEFIVLACDGIWDCMSSQQLVDFIREHIDTEESLSAVCERVLDRCLAPSTMGGEGCDNMTMILVQFKKPIAQVEDASGAEPAEDAGCXTHGAHENGSGKQV

SEQ ID NO: 8605 - protein, 310 aa, Photobacterium mandapamensis
ICLTLTKARCQTLNLPLMVQNNNDKFSTAFTVSIEAAKGVTTGISADDRAKTVLAAVAPNAKPTDIVMPGHIFPLMAQDGGVLIRAGHTEAGCDVARLAGLEASSVIVEILNKDGSMARRPQLEIFAEKHGLKLGTIADLIEYRTQRESHIERVYEGELCTEYGIFNLITYRDTIDSQLHYALYKGNIQSNAETLVRVHVKDTLKDILHAGATQWSLQSAMKRIQADDGVLVIINQDETPEMLLEKITRHAAEHHTSSPLSNTTQSRQIGLGSQILSELGLRKIRLLSSHNQQYRSLSGFDLEVVEYVCN

SEQ ID NO: 8606 - protein, 242 aa, Neisseria meningitidis Z2491
MTTYRIAPSILSADFARLGEEVESVIAAGADLIHFDVMDNHYVPNLTFGPMVCAALKPYASVPIDVHLMVEPVDDLIQSFAKAGASIITFHPEASRHIDRSLSLIRDMGCQAGLVLNPATPVYLLENVLDRLDMVLLMSVNPGFGGQSFIPYTLEKIRQVRAMLDRYEEKSGRRIAIEVDGGIKTDNIAAAAQAGADTFVAGSAIFGKPDYKAVIDAMRAELEKSGRLNLAPMIEIEMPSEN

SEQ ID NO: 8607 - protein, 324 aa, Trifolium pratense
MGVKGFVEGGIASIIAGCSTHPLDLIKVRMQLQGENAPKPNPVQVLRPALAFGQTGSATSIHVAGQTAVPQARVGLVSVGVRLVQQEGVKALFSGVSATVLRQTLYSTTRMGLYDILKNKWTDREAGGTMPLARKIEAGLIAGGVGAAIGNPADVAMVRMQADGRLPAPQRRNYKSVVDAITRMAKQEGVTSLWRGSSLTVNRAMLVTASQLASYDQFKEMILEKGVMKDGLGTHVTASFAAGFVAAVASNPVDVIKTRVMNMKVEAGKEPPYAGALDCAMKTIRAEGPMALYKGFIPTISRQGPFTVVLFVTLEQVRKVLKDF

SEQ ID NO: 8608 - protein, 129 aa, Zea mays
  misc_feature (83)..(83): Xaa can be any naturally occurring amino acid
  misc_feature (92)..(92): Xaa can be any naturally occurring amino acid
MLPCMDPREPSTGKPYAPTKLQSQHLPIDYAGLLVAAVAVLGFMGGDKEGYWLQLMFWAKALAHMINFEHHLNQVHMTLHAIXSGSGHELFXAPLVRQYRVLGSARTSFASFFIGYRADIPAASAGFCS

SEQ ID NO: 8609 - protein, 357 aa, Fulvimarina pelagi HTCC2506
MAQTNALKIATIPGDGIGREVVPEGMRVLEAVGRKFDIAFQFDEVDWSCETYKQTGRMMPEDGLERFKKHDAVFLGAVGWPDVPDHVSLWGLLIPIRRTFHQYVNLRPCRLLRGTTSPLAGRTADDIDFYVVRENVEGEYSEAGGRLYRGMDDEIAIQEAIFTRRGVDRVLRYAFELAKTRKRGHVTSATKSNGIVHTMPFWDERFKAVKADYPDIETSQYHIDILCAHFVQHPDWFDVVVGSNLFGDILSDLGPAVAGSIGIAPSANINPEGDYPSMFEPVHGSAPDIAGQGIANPIGQIWSAAMMLDHLGHPEASAAVIEAMETVIADPASRTKDMGGKANTAECGEAIAQVLAG

SEQ ID NO: 8610 - protein, 370 aa, Agrobacterium tumefaciens str. C58
MTVRSVFLLPGDGIGPEAMTEVRKLIEYMNSAHNAGFTVSEGLVGGSAYDAHGVAISDADMEKALAADAILFGAVGGPKWDGVPYEHRPEAGLLRLRKDLELFANLRPAICYPALAAASSLKPELVEGLDILIVRELTGGVYFGEPKQIIDLGNGQKRGIDTQIYDTFEIERIASVAFELARSRDNRVCSMEKRNVMKSGVLWNQVVTETHAAKYKDVQLEHMLADAGGMQLVRKPKQFDVIVTDNLFGDMLSDVAAMLTGSLGMLPSASLGAPDAKTGKRKAMYEPVHGSAPDIAGKSIANPIAMIASFAMCLRYSFNMVDEATKLEAAIANVLDKGIRTADIMADGCRQVGTSDMGDAVLAEFKALSA

SEQ ID NO: 8611 - protein, 267 aa, Burkholderia sp. 383
MHPMLNIAVKAARRAGQIINRASLDLDLIEIRKKQQNDFVTEVDKAAEDAIIETLKTAYPDHAILAEESGESENESEFKWIIDPLDGTTNFIHGFPYYCVSIALEHKGVVTQAVVYDPNKNDLFTATRGRGAYLNDRRIRVGRRDRLSDALVGTGFPFREKDGLDAYARLFTEMTQACTGLRRPGAAALDLANVAAGRLDAFFEQGINVWDMAAGSLLITEAGGLVGNYTGDADFLHRHEIVAANPKIYAQMIPILKGYTRVHPAAE

SEQ ID NO: 8612 - protein, 368 aa, Desulfotalea psychrophila LSv54
MKQDSNIPKVRESIDTIDNSILELLKKRIGLAKEIGRLKSEDNRSKWDPLREREIYERLITSNEGDFPDESLRSIFHEIITTCRLSQKKAVVAYLGPEATFSHLAGVKYFGHSTDYKPLETIDEVFAEVEKGRVQYGIVPVENSIEGAVFSTLDSFMKYKIKICGEMQLAISHNLVCKSGNIEDIQTVASHNQPLAQCRDWLRKHLPNTPTLPVFSTGLAAKMAADNPNIGAIASSLAISTYDLQVVVKGIEDYEGNTTRFLIIGKESPGISGRDRTSLLIGLMDRPGALNEILSVLSEEGINLAKIESRPIKGKQWKYLFFLDMIGHIEDEQIKRGCARLKQECSYFEWLGSYPQDENSLEYSPANP

SEQ ID NO: 8613 - protein, 470 aa, Sphingomonas sp. KA1
MAEQYDLIVLGSGPGGYVAAIRAAQLGLKTAIVERENLGGICLNWGCIPTKALLRSAEVLHNMRHAAAYGLAADNIRADLDAVVKRSRGVAKQLNQGVTHLMKKNKIAVHMGEGVLKGGGKLEVRGDKGTETLSAKHIIIATGARARDLPFAPADGKRIWTYRHAMTPSEMPGKLLVIGSGAIGIEFASFYNDMGSEVTVVEMMDRIVPVEDADVSAFLEKALKKQGMTILTGAGVESLASGPNGVKARIKDKDGKVSESEFSHVIVAVGIMPNTENIGIEALGIKSERGFIQIDGLGRTNVPGIWAIGDVTPGPWLAHKASHEGVIAAEAIAHALGNKVVHPHAMDKRNIPGCTYCRPQVASVGLTEAKAKEAGYTVKAGTFPFIGNGKAIALGEPEGFIKTVFDAKTGELLGAHMVGTEVTELIQGYVVGKTLETTEAELMATVFPHPTLSEMMHESVLAAFERALHI

SEQ ID NO: 8614 - protein, 686 aa, Lotus japonicus
MPLLSSQNYITVTQNQSIQDDETLVSAEGTFEAGFFGLGNSQRQYFGIWYKSISPRTIVWVANRDAPVQNSTATIKLTDKGNLLILDGSKGIIWSSNGSRAAEKPYMQLLDSGNLVVKDGGKRKKNLIWESFDYPGDTLLAGMKIKSNLVKGPTSYLTSWRNTEDPASGEFSYLIDTRGFPQLVITRNATAYYRAGPWTGKLFSGSSWLRLRKILTFSMQFTSQEISLEYETANRSIITRAVINPSGTTQRLLWSDRSQSWEIISTHPTDQCTYYGLCGANSMCDISNNPICHCLEGFRPKFQAKWNSFDWPGGCVPMKNLSCQNGDGFLKHTGVKLPDTSSSWYGKNKSLDECGTLCLQNCSCTSYAYLDNDIGGSACLIWFGDILDLSIHPNPDQGQEIYIKVVASELDHRRNKKSFMTKKLAGSLAGIVALVICIIILGLATSTCIQRKKNERGDGDSTRSKLLDWNKRLQIIDGIARGLLYLHQDSRLRIIHRDLKTSNILLDNEMNPKISDFGLARIFIGDQVEARTKRVMGTYGYMPPEYAVHGSFSIKSDVFSFGVIVLEIISGKKIRKFYDPHHHLNLLSHAWRLWIEGSPLELVDKLFEDSIIPTEILRYIHVALLCVQRRPETRPDMLSIVLMLNGEKELPKPSLPAFYTGKHDPILLESPSRRCSTSVTISLEAR

SEQ ID NO: 8615 - protein, 469 aa, Magnetospirillum magnetotacticum MS-1
MRLHSLPVRALGLLLALSQPAGAQTAPVVPPAPEPAPIQSDEARLLPVLATRGMVSSQDALATRVGVEILGKGGNAVDAAVAVGFALAVTLPRAGNLGGGGFMMVHRAAARETVAIDYRETAPAAATADMFLNPQGEPDRAASTRTGKAVGVPGTVRGLAEAHRRYGSGKLTLADLIAPAEKLARAGIPVESGLADSLPRASGLLGQWPSSRAVFFEGDHVLPRGATLTQRDLADTLRTIAEQGPDAFYQGPIADKIAAAVRGAGGIMTAADLAAYRPEIRTPVRGTYRGYEIVSMPPPSSGGVHLIEILNILEGYDLAGMGAGSARALHTLAEAMKPAYADRATWLGDPSRTKVPVAGLTAKSYAATLREKIDPERAKSAAEVKAGDPLPYESDQTTHFSVVDAEGNAVSNTYTLNFSYGIGLVAEGTGVLLNNEMDDFSAKSGARNAYGLVGGEANAVAPSARPLSS

SEQ ID NO: 8616 - protein, 719 aa, Oryza sativa
MAAPATLAPCPCHRGTRAVVECDRSTVAMASGHREWMNSCPGLCRACSFGDETSPPVCTGIWGRSSIRQWLCQVFRARTVRIGSEAALDLIWAVHCSQGTGGADEASRDPRLLLAAAARGFPNREILFSPKKPNKEKSLRANSTRSEARIEVGFHNFMDFDCKTARGDSSSVNRSCIVTEGTVVQAKPVSHNGKAKHWNSLSTLNNQKCSYELLSDPKKNVETSDGETASKCDSWCFTDLPSALVCEVLEHLDPKELGIVSCVSTLLHTLATDHQGWKKFYCERWGIPTPPVTLNGPLVPGGTSDWKSWKTLFVEREFRSKSFMGRFSVDVLRDHSEDVRTVFLLASVNLIFTGGNDSVIRMWDLEEGLLIDKSRPLCCTIRAIAADTRLLVTAGTNAFIHCWRAVEGNSYPFHISGNGTDQSPEFRLWGHEGPVTCLALDSLRIFSGSWDMTVRVWDRSEMKCVQKFMHADWVWSVAPHGNTVASTAGRDAYVWDIRSGELENVISNAHYGNAFSLARTHLADVLFTGGEDGAIRLFNVSEVSDDEDIKPAATWVPHTGPVHSLAFEYPWLVSASSDGRVALIDLRKLLTPRKSSKQPFRVKNFDPSSIEPPQRMLHGFGCDLFSVAIGADRIVCGGEDGAVKVWNFSEALEIEKRAQALRSMRQENRMRRKKAQVEMNANGRRSDQCGSIAMKRNQLKGDKSVTWHSKRAINDKVKS

SEQ ID NO: 8617 - protein, 434 aa, Synechococcus sp. CC9605
MTTLEDKSGENAVTKGTSADSKSAGHWSWGFKSPGSHPSAVMNTYGRFPLALAKGKGCWVKDTQGRLYLDAVAGIATCTLGHSDRAMQRALRNQLGRLQHVSNLYQIPEQEELASWLVHNSCADSVFFCNSGAEANEAAIKLARKHGHLRRGIEQPVILTAAASFHGRTLAAVTATGQPKYHKGFEPMVTGFDYFPYNDLKALEALINRYEQAGPSIAAVLVEPLQGEGGVNPGDRAFFSRLREICTERNILLILDEVQVGMGRSGRLWGYEQLGITPDAFTLAKGLGGGHAIGALLVNASADVFEPGDHASTFGGNPFACRAGLTVATEIERRGLLTNVTARGEQLRDGLQELVNCFPEHLQGVRGWGLLQGIVIREGSSWTAPALAKAAIDHGLLLVAAGPSVLRMVPPLTINKREVRELLRRLATTLSSLS

SEQ ID NO: 8618 - protein, 117 aa, Photobacterium mandapamensis
MNIIVGGHAAPDANIAIIVSRFNNFINESLLSGALDVLEHQGLVKEPNIIIVRCPGAFELPFVAQQLAKEGCYDAIIALGSVIRGGTPHFEYVAGECSKGLAKMALEYQIPIAFGVL

SEQ ID NO: 8619 - protein, 517 aa, Triticum aestivum
MGNSCVTGSSSTSNHGQSLKSNGEKASDNSCVTGSCLSNQGQSQESNGSETTFKWRIDGFSSLLDKGWTSSSVFNIRGFDWYMVLNLRDRKSGDKNEYVSLELVLFLAPEILHTVVEASFKFLIYDQSYGKHLEQHQVSQNFQAPSRVSGTSFMIPLATLKEQSSGFLVEDSCVFGIQFIKVVPVKGSSKHRQNLKANVARAIGNSCVTGSSQSSQGHCQESNGSETTFKWRIDGFSSLLDKGEGWTNSSVFNIRGFNWYLMLNPRDRKSGDKNEYVSLKLVLTQTVSERSHLIAKATFKFLIYDQSYGKHHEEHQVSHNFQAASRVSGISCMIPLAKLKEQSSGFLVKDSCVFGIQFIKVVAVKGNDVSETLFVQKISNICSDPQVYTWNIDDFFVLKNPSTSPEFELCGHKWLITIYPSGSDKNPNYLSLYLNMKDSLHKDSAILADVSITIKDQETGKHKKLSARLQLKNCAPTWGWGKFISLEDFKDSSQGYLVKTKCCIEAQIAVIGSSKTE

SEQ ID NO: 8620 - protein, 404 aa, Vitis vinifera
  misc_feature (242)..(242): Xaa can be any naturally occurring amino acid
MAMKHRKLFPTQTATNQSVDCLDFCDSTCPYNCYIYPDSLIPPPPPASPRPPTLSTLDQNDSPNISPYVIITVALLAGFFLLVCFNAIIVKYCCGWRRRNRSPPSESDGRDEEFLDENRGPAIDHPIWFITTAGLQQAIINSITVCKYKRGEGLIEGTECSVCLSEFQEDETLRLLPKCNHAFHIPCIDTWLSSHTNCPLCRARIISDIVNPPLESNDQNSRSLGPNEQTQMENSSNDTELXNNLVRSRGVYESTVGRGGTGELQILDDERTSKEGVNSNGDVVLEVNGNSANNHVVDSEIQPVRRSVSMDSSSAATIFFGLAKFHADESKGNWVDETMDGRKFDSGSVPKRDVAYTSTFRQMGSPSIAQCLHKGPISMKRSNSCGGRFFLPRHNRSTNAILPL

SEQ ID NO: 8621 - protein, 310 aa, Photobacterium mandapamensis
ICLTLTKARCQTLNLPLMVQNNNDKFSTAFTISIEAAKGVTTGISADDRAKTVLAAVAPNAKPTDIVMPGHIFPLMAQDGGVLIRAGHTEAGCDVARLAGLEASSVIVEILNKDGSMARRPQLEIFAEKHGLKLGTIADLIEYRTQRESHIERVYEGELCTEYGIFNLITYRDTIDSQLHYALYKGNIQSNAETLVRVHVKDTLKDILHAGATQWSLQSAMKRIQADDGVLVIINHDETPEMLLEKITRHAAEHHTSSPLSNTTQSRQIGLGSQILSELGLRKIRLLSSHNQQYRSLSGFDLEVVEYVCN

SEQ ID NO: 8622 - protein, 156 aa, Photobacterium mandapamensis
MNIIVGGHAAPDANIAIIVSRFNNFINESLLSGALDVLEHQGLVKEPNIIIVRCPGAFELPFVAQQLAKEGCYDAIIALGSVIRGGTPHFEYVAGECSKGLAKMALEYQIPIAFGVLTVDSIEQAIERAGAKMGNKGSEAALSALEMINLLAELES

SEQ ID NO: 8623 - protein, 182 aa, Photobacterium mandapamensis
MITVRTRVPFKIGPKSQIPAELLSFHGFNSGKEHVAIIFKQADTTTLPLVRLHSECLTGDVFHSSRCDCGEQLNETIEKMHHAGGIILYLRQEGRGIGLYNKIDAYYLQSQGMNTYEANNHLGFADDLRDFSEAAKALMALGTKKIRLITNNPKKVNELKQHGIEIMDVINTQVHIKQGNED

SEQ ID NO: 8624 - protein, 384 aa, Magnaporthe grisea 70-15
MASFFDLKARKQAAANGATTAKQEKQNPENTRTQPWVEKYRPKTLSDVTAQDHTVTVLQRTLQASNLPHMLFYGPPGTGKTSTVLALAKELFGPELMKSRVLELNASDERGISIVREKVKDFARMQLTNPPPGYKSKYPCPPFKIIILDEADSMTQDAQSALRRTMETYSKITRFCLICNYVTRIIDPLASRCSKFRFKSLDQENARSRLEDIAAKEGVALEDGAVDALIKCSEGDLRKAITFLQSAARLVGAVGAAGAGQEDKMDVDSRPVTVRIIEDIAGVIPGKTIDALVEAIRPRGAALTYQAVSKVVEDMVADGWSATQVVGQLYQAIVYDEGIPNIQKNEIVMVFSEVDKRLVDGSDEHLSILDLCLRISVIMSGRKQ

SEQ ID NO: 8625 - protein, 497 aa, Pseudomonas aeruginosa PAO1
MTTLTRADWEARAKDLKIEGRAFVNGEYSNAASGETFDCLSPVDGRFLAKVASCDLADAEQAVKVARNAFDSGAWSRLAPAKRKQTMIRFADLLLENAEELALLETLDMGKPISDSLHIDVASAANSLRWSAEAIDKIYDEVAATPHAELGLVTREPVGVVAAIVPWNFPLLMSCWKLGPALATGNSVILKPSEKSPLTAIRIAQLAVEAGIPKGVFNVLPGYGHTVGKALALHMDVDTLVFTGSTKIAKQLMVYAGESNMKRVWLEAGGKSPNIVFADAPDLKAAAEAAAGAIAFNQGEVCTAGSRLLVERSIKDKFLPLVIEALKGWKPGNPLDPETNVGALVDTQQMNTVLSYIEAGHNDGAKLVAGGKRTLEETGGTYVEPTIFDGVTNAMKIAREEIFGPVLSVIEFEDAEEAVRIANDTPYGLAAAVWTSNLSKAHLTAKALRAGSVWVNQYDGGDMTAPFGGFKQSGNGRDKSLHAFDKYTELKATWIKL

SEQ ID NO: 8626 - protein, 444 aa, Pseudomonas aeruginosa PAO1
MTMNDEPQSSSLDNFWMPFTANRQFKARPRLLESAEGIHYIAQGGRRILDGTAGLWCCNAGHGRREISEAVARQIATLDYAPPFQMGHPLPFELAARLTEIAPPSLNKVFFTNSGSESADTALKIALAYQRAIGQGTRTRLIGRELGYHGVGFGGLSVGGMVNNRKAFSANLLPGVDHLPHTLDVARNAFTVGLPEHGVEKAEELERLVTLHGAENIAAVIVEPMSGSAGVVLPPKGYLQRLREITRKHGILLIFDEVITGFGRVGEAFAAQRWGVVPDLLTCAKGLTNGSIPMGAVFVDEKIHAAFMQGPQGAIEFFHGYTYSGHPVACAAALATLDIYRRDDLFQRAVELEGYWQDALFSLRDLPNVVDIRAVGLVGGVQLAPHADGPGKRGYDVFERCFWEHDLMVRVTGDIIAMSPPLIIDKPHIDQIVERLAQAIRASV

SEQ ID NO: 8627 - protein, 197 aa, Neisseria meningitidis Z2491
MSELLNYVASCRLPTEWGVFTMHGFEEAGGQEHVALTVGDCSDGNPVLTRIHSECLTGDALFSKKCDCGPQLEAAMKAVQAEGRGIIVYLRQEGRGIGLINKIRAYHLQDQGMDTVEANVALGLPVDARDFRLAQSIYEYLGIRSVKLLTNNPEKIQTLKDAGINVVERIPLHVGENLENKRYLQTKADKLGHLMSE

SEQ ID NO: 8628 - protein, 306 aa, Clostridium perfringens ATCC 13124
MNKKIRKAIIPAAGLGTRFLPATKAQPKEMLPIVDKPTIQYIIEEAIASGIEEILIITGRSKKCIEDHFDKSVELEMELEKSGKNELLDLVRDISDMVDIHYIRQKEPRGLGHAIHCAKTFVGDEPFAILLGDDVVYNEEKPCLKQLIDCYNEYKTSVLGVQTVPQSHVSKYGIVDGKYIEGKVYKVKGLVEKPSVEEAPSNVAILGRYIVTPRIFDILENTKPGKGGEIQLTDALLELMGQEAMYAYDFEGRRYDVGDKLGFLEATVEYALRRPEIREGFIEYLNNLSEKESLFKKEVEKDIVTV

SEQ ID NO: 8629 - protein, 363 aa, Neisseria meningitidis Z2491
MSHISPIPEILADIKVGKMVIITDAEDRENEGDLLMAAQFVTPEAINFMIKHARGLVCLPMDGEMVEKLGLPMMTQKNGAQYGTNFTVSIEAAHGITTGISAADRALTIQTAVSPTAKPEDIVQPGHIFPLRAQKGGVLVRAGHTEAGVDLAQMNGLIPAAVICEIINDDGTMARMPELMKFAEEHKLKIGTITDLIEYRSRTESLLEDMGNAPVQTPWGEFQQHVYVDKLSGETHLALVKGTPSADTETLVRVHEPFSVMDFIQANPRHSWSLPKALERVQQAESGVVILLHRTEDGASLLDRTLPKGANQAYKWDSKSYGIGAQILAGLNVKKLRVLGQPSSFTGLTGFGLEVVGFEEAEK

SEQ ID NO: 8630 - protein, 156 aa, Haemophilus influenzae
NRANTPVLVDGKDVMPEINAVLAKMKDFCQRIISGEWKGYTGKSISDVVNIGIGGSDLGPYMVTEALRPYKNHLNMHFVSNVDGTHIAETLKKVNPETTLFLVASKTFTTQETMTNAQSARDWLLKAAKDESAVAKHFAALSTNAKDVEKFGIDTN

SEQ ID NO: 8631 - protein, 311 aa, Symbiobacterium thermophilum IAM 14863
MARIYDSIADTIGRTPLVRLNRVTEGAVATVLAKVEAFNPASSVKDRIGYAMIKDAEEKGILKPGMTIVEPTSGNTGIALAFVAAAKGYRCILTMPDTMSLERRKLLKAFGAELVLTPGAEGMKGAIAKAKEILENTPGAWMPQQFENPANPEIHRKTTAEEIWQDTDGQVDIVVGGVGTGGTLTGVGEVIKARKPDFKVVAVEPAESPVISGGKPGPHKIQGIGAGFIPKNLNTEVVDEVITVASEDAIATARRMAREEGLLVGISSGAAAFAALQVARRPENAGKTIVVVLPDTGERYLSSALWADIQV

SEQ ID NO: 8632 - protein, 380 aa, Glycine max
  misc_feature (223)..(223): Xaa can be any naturally occurring amino acid
MASQPESSDAKGTKRDFSTAILERKKAPNRLVVDEAVNDDNSVVALHPDTMEKLQLFRGDTILIKGKKRKDTICIALADETCEEPKIRMNKVVRNNLRVRLGDVVSVHQCPDVKYGKRVHILPVDDTIEGVTGNLFDAYLKPYFLEAYRPVRKGDLFLVRGGMRSVEFKVIETDPSEYCVVAPDTEIFCEGEPVKREDENRLDEVGYDDVGGVRQQMAQIREXLELPLRHPQLFKSIGVKPPKGILLYGPPGSGKTLIARAVANETGAFFFCINGPEIMSKLAGESESNLRKAFEEAEKNAPSIIFIDEIDSIAPKREKTHGEVERRIVSQLLTLMDGLKSRAHVIVIGATNRPNSIDPALRRFGRFDREIDIGVPDEVG

SEQ ID NO: 8633 - protein, 156 aa, Haemophilus influenzae
NRANTPVLVDGKDVMPEVNAVLAKMKDFCQRIISGEWKGYTGKAITDVVNIGIGGSDLGPYMVTEALRPYKNHLNMHFVSNVDGTHIAETLKKVNPETTLFLVASKTFTTQETMTNAQSARDWLLKAATDESAVAKHFAALSTNAKDVEEFGIDTN

SEQ ID NO: 8634 - protein, 437 aa, Desulfotalea psychrophila LSv54
MNDFRQHAQNLIDFISSSPTAFHATATIRQMLQANGFCQLFEGESWDLQQGTGYFVVRDQGALIAFTLGQEERLEDGFRMLGAHTDSPSLQLKPHPLHHKKSYCKLAVELYGGALLATWFDRDLSIAGRVLVRSGEGEYQKILLDFARPLLCIPSLAIHLDREANKNRSINSQKELEPLLSQKINAGLPDFNTILKKQIEREYPAISVEEILSFDLFCYDQQKPSLLGLEEEFMVTSRLDNQLSCHAGARAIIDAGFAKNTMLLCFNHEENGSVSTSGGDSSFVNTVIERIIAEPEKRHIALARSFLISMDNAHATHPNYPEKSEENHNIDLNYGPVIKINANQRYATSAISAGIYKAIAREAGVPCQEFVMKSDMPCGSTIGPMISARLGVRTIDVGAASFAMHSIREMTGVKDPYLLYRVAAHFLQSDIHHKIHE

SEQ ID NO: 8635 - protein, 197 aa, Magnetospirillum magnetotacticum MS-1
MPARIQPVILCGGSGTRLWPTSRTSLPKQFVPLLGPHSTFQQTLLRLQSPLFARPIIVANRDHRHLVEKQAAAIDAPISLLLEPERRDSGPAILAACTLVAQDEPEAVVLVLPSDHIVTEPRAFRRAVASALPAARAGRLVTFGIEADHASTEYGWIRPGERVEARCHAVCKFAEKPTRCGRPPTCRTGGCGIPATS

SEQ ID NO: 8636 - protein, 248 aa, Brassica napus
  misc_feature (241)..(241): Xaa can be any naturally occurring amino acid
PLKLLLGATKYGPAIDMWSVGCIFAELSNGKPILPGKTETEQLTKIYELCGSPDENNWPGVSKMPWFEQLKSPRPLRRRLREIYRNFDRHALELLERMLVLDPSQRISAKDALDADYFWTDPLPCDPKSLPKYESSHEFQTKKRRQEMRHNEEAAKKQKMQHPQQHSRWPAQQHGVGQTHAAPHWPAGPNHPINNGPPPQIPAGGPSGHHYYQNPRGPAPGSNGYHTSGNQTGGYNNRSRXGGYSSGS

SEQ ID NO: 8637 - protein, 174 aa, Burkholderia sp. 383
MTIYKLGDTAPTIHESVFVADTAAIIGKVVLEENASVWFGATIRGDNETITVGAGSNVQEGAVLHTDPGFPLTIAENVTIGHQAMLHGCTIGEGSLVGIQAVVLNGAVIGRNCLVGAGAVVTEGKTFPDNSLILGAPAKVVRELSAEDIARLRTNAQTYVERRAHFKEQLVRIG

SEQ ID NO: 8638 - protein, 561 aa, Desulfotalea psychrophila LSv54
MSTDDKKIIYSMMKVSKYYDDKPIIKDISLSYYYGAKIGVLGLNGSGKSTLLKILAGVDTEYNGETTLSAGLTVDYLPQEPDLDPEKTVRQIVEEGVQGTVDLLAEFNEINEKFAEPMTDDEMQDLIDRQAKVQEKLDHLEAWDLDSRLDMAMEALRCPPADHTCGILSGGEQRRVALCRILLKKPDILLLDEPTNHLDAESVAWLEHHLQTYAGTVIAVTHDRYFLDNVAGWILELDRGIGIPWKGNYSSWLDQKQKRLAQEEKKESERQRTLKRELEWVKMSPKGRRSKSKARISSYENLLSQDTEKRAKELEIFIPSGPRLGKVVIEAKDICKGFGDRLLVENMNFSLPPGGIVGIIGPNGAGKSTLFKMITGEEEPNSGSIRIGETAKIAYSEQARGKNLDPESTIWEAISEGQETIWLGTKEVNSRAYVGKFNFSGTEQQKKVGLLSGGQRNRVHLARTLKEGGNVLLLDEPTNDLDVNTLRALEEALENFGGCAVVISHDRWFLDRIATHILAFEGDSQVVWFEGNYSDYEKDKKARLGTAADQPHRIKYRQLTR

SEQ ID NO: 8639 - protein, 511 aa, Zea mays
MAAAAISHLRRGAQHHAVLCISLSRRRFSSSAVAAASPLAAAARRLLSTTADSATASTSGEHYKPPPFDPFRAATLSPSAPPLESARLEDEPPSSPPPQDEAAASVAAHEQATLACQELELEGLKAGVEAVKSREESPEEKEAWWLLSRAVVNYCGSAVGTVAANDPSTSQMLNYDQVFIRDFVPSAIAFLLKGESDIVKNFLLHTLQLQALFYSALRCAREMIGVTDGSKNLIRAINNRLSALSFHIREYYWVDMKKINEIYRYKTEEYSHDAINKFNIYPEQIPSWLADWIPVKGGYLIGNLQPAHMDFRFFSLGNLWAIVSSLATQRQAEGILNLIEAKWDDIVANMPLKICYPALEYEEWRIITGSDPKNTPWSYHNGGSWPTLLWQFTLACIKMGRRDLARRAVEVAEKRLSDDKWPEYYDTRTGRFIGKQSRLYQTWSIAGYLSSKMLLDCPEMASILVCDEDFELLEGCACSLNKNARTKCSRRAAKSQTACSVQRTGPRYVAE

SEQ ID NO: 8640 - protein, 223 aa, Zea mays
  misc_feature (125)..(125): Xaa can be any naturally occurring amino acid
  misc_feature (164)..(164): Xaa can be any naturally occurring amino acid
MGRDARKTTTLTLSQIVLNDVESDDEDLDDEDLDDGAEHEVEDAPAELAVKTVEALAAPPKDTERQLSKKELKKRELAELDAVLAELGLSGNSTSAAQDAEKEGANQAGDAEKKEDATVPSESRXSKKKKKKDKSSKEGRKETQEAAEGSEETASAGPDEEDTXTAVDVKERLKKMASMKKKRSSKETDTGAKIAAAEATARSARLAAAKKKEKSHYNQQPVR

SEQ ID NO: 8641 - protein, 480 aa, Synechococcus sp. CC9605
MSDASFDFDVIVIGAGYGGFDAAKHAAEHGLKAAIVESRDMGGTCVNRGCVPSKALLAASGKVRELADDKHLSSFGIHAAPVRFERQKIADHANQLVQTIRTNLTKTLERAGVTILRGHGRLEGSQKVGLREPSGVDRVLTAKDVIIATGSDPFVPPGIETDGRTVFTSDEAINLEWLPRWIAIIGSGYIGLEFADVYTALGCEVTMIEAMGKVMPTFDPDIAKIAGRHLIDGRDIDARSGLLARKVTPGCPVQIELADFNSRELVESLEVDAVLVATGRVPSSKGLNLESLNVETNRGFVPIDDAMRVLVNDQPVPHLWAVGDVTGKLMLAHTAAAQGTVAVDNILGHAREIDYRSIPAATFTHPEISSVGLTEADAKALAEKDGFQLGSVRSYFKANSKALAELDSDGLMKLLFNKTSGEVLGAHIYGLHAADLIQEVANAVARRQSVRQLATEVHTHPTLSEVVEVAYKQASAQVAA

SEQ ID NO: 8642 - protein, 216 aa, Oryza sativa Japonica Group
MASWDDDEFSDEEEQSMGKRLWEDEDAGDDFAAVKDTWDDDDDVKPGKETAATAASTKPPATKGKKSQANAKAKAEAADATPSETSTSNAAAEIAQKQPDDDEPIEKFVPKSEKEFAEYAERIAKDLLRPYEKSYHYIGLMKAMNKLAVASLTSTSVKEIVSSMTTVANEKLKAEKAADAGKKKPGQKKKRLHVNKAEGQKFRDADDDDDDDCLSS

SEQ ID NO: 8643 - protein, 468 aa, Pseudomonas fluorescens Pf-5
MRIELIKSRANLFLTTINLPRLPMIESVEDFLARLKKRDPDQPEFHQAVEEVLRSLWPFLEANPHYLSSGILERICEPERAVVFRVSWVDDQGKVRVNRGFRIQMNSAIGPYKGGLRFHPSVNMGVLKFLAFEQTFKNSLTSLPMGGGKGGSDFNPKGKSDAEVMRFCQAFMSELYRHIGADVDVPAGDIGVGAREIGFLFGQYKRLSNQFTSVLTGKGISYGGSLIRPEATGFGCVYFAEEMLKRRGDRVEGKRVAISGSGNVAQYAARKVMDLGGKVISLSDSEGTLYCESGLSEEQWLAVLELKNVQRGRISELASQFGLEFRAGQTPWDLPCDIALPCATQNELDAEAARTLLRNGCTCVAEGANMPTTLEAVDIFIDAGILFAPGKASNAGGVAVSGLEMSQNAMRLLWTAGEVDSKLHNIMQSIHHACVHYGEENGRINYVKGANIAGFVKVADAMLAQGVV

SEQ ID NO: 8644 - protein, 268 aa, Thiomicrospira crunogena XCL-2
MAIKIKTKQELEKLRIAGKLAADVLVMIEPYVKPGISTGELNDIMAKHMTDVQGTTSATLGYHGFPSESCISVNDVVCHGIPEHDKKLKKGDIVNIDVTVIKDGYFGDNSMMFEVGEVKPFAHKLCQVAHECLWLGIEAVKPNATLYDIAYAIETHAHNNHFSVVKEYCGHGIGSEFHEEPQVVHYTQPELKEIVLQEGMVFTIEPMINQGKSNVKTLGPNKKYPENTIFPVKTADRKLSAQWEHTIAVTKEGYEVLTLRPNEKPVLP

SEQ ID NO: 8645 - protein, 181 aa, Oryza sativa Japonica Group
MIFTFYKAQGLSVGSSLVEEDKLELATSLLAKAKEKGVSLLLPSDVIIADKFAPDANSQVVPASAIPDGWMGLDIGPDSVASFSSTLETTQTVIWNGPMGVFEFDKFAVGTEAIAKKLADLSGKGVTTIIGGGDSVAAVEKVGVADVMSHISTGGGASLELLEGKELPGVIALDEAVTVAV

SEQ ID NO: 8646 - protein, 409 aa, Oryza sativa Japonica Group
MGRKRAVLVGINYAGTEGELKGCLNDVARMRRCLVDRFGFDEADIRVLADADPSTPQPTGANIRLELERLVGDARPGDTLFFHYSGHGLQLPIETGGDDDDTGYDECIVPCDMNLIKDQDFTELVQKVPDGCLFTMVSDSCHSGGLIDKTKEQIGSSTKQSKIQQRERELRRQQAPSPGTCSCASLLQIALRHLPRRGGQRIIGSRSRDGVGEDQPPRSQAELLAADATRAGIKNRSLPLSTFVEMLRERTGKDDVGVGSIRTTLFHHFGDDASPKIRRLVNAMLGRRHGSATASEEHPDKAKPERVDGEGEAAAAKQGAPETRPLPRNGVLISGCQTDETSADATTPEGVSYGALSDAIQSVLAEERRGKVTNMELVRRARELLAKQGYTQQPGLYCRDKHANVAFIC

SEQ ID NO: 8647 - protein, 248 aa, Triticum aestivum
  misc_feature (188)..(188): Xaa can be any naturally occurring amino acid
MSEHYPTLAQTALVAAAFKILLFPAYKSTDFEVHRNWLAITNSLPLEKWYVEKTSEWTLDYPPFFAYFEWILAHVARLVDPLMVKVYNLDYDSWQTVYFQRTSVIVTELVLVWALQTFIETAPLKSRRAAQTVALSIILSPGLLIIDHIHFQYNGFMYGILVMSLVLARQNSELLSSGLIFAALLCFXHIYLYLAPAYFVYLLRAYCLSSKSIFRIRFLNSIKLGLGIGAIFGAAFGPFAAMDQIPQL

SEQ ID NO: 8648 - protein, 336 aa, Dichelobacter nodosus VCS1703A
MILITGGAGYIGSHTTLLLLNQGYELVVLDNLSNSSPESLRRVAQLTGKNIPFVKGDIRDRALLDQLFCDYPINAVMNFAGLKAVGESVAKPLDYYHCNVYGATVLLQAMQEAKIKTFVFSSSATVYGDPIQNPIDENYPTQSPTNPYGATKLMIERMLSDVVRADNDWNIAILRYFNPIGAHESGEIGEDPNGIPNNLLPYIARVATGVFPHLSVFGDDYPTQDGTGVRDYIHVMDLAQGHLDALNVIEQKKGLHIWNLGTGTGYSVLEIIHAFERASGKNIPYQIAPRRQGDIAMCYANPAKAERELGWKATRDLETMMKDTWRWQTKNPNGYR

SEQ ID NO: 8649 - protein, 164 aa, Tropheryma whipplei str. Twist
MVRLRMQTLTAIVEIPRGSRSKYEIDKKTGRLFLDRVVSTAFGYPTNYGFIENTLALDGDPIDALILVQNQLFPGVALHIRPVGVLHMTDDGGEDDKVLCVALKDPYCDHINDLDDVPKHVLNQIEHFFQHYKDLEEGKWVKLGAWNGKDKAIEIITEGLSRFN

SEQ ID NO: 8650 - protein, 388 aa, Bradyrhizobium japonicum USDA 110
MDSLCRTSGMNTLSNTITVAVVGGEGIGPEVTDQSHRILKWFSDRRGAPVILREAQYGLIPYLATGKVLPDDTVEAMEEADAILWGATGGPETTEVPPAARKAGSLLSLRSKYDLYANLRPIVANPALADSAPLKAAVLKDVDFIIIRELTSGIYFGEPRGIETLPDGQRRGFNTQQYTTSQIRRVARTAFELARTRKGRVCSVDKANVLETSVLWREEVTALHEAEFSDVELTHLYVDNAAMQIVRAPSQFDVMVTCNIFGDILSDCAAMASGSLGMLPSVSLGPPDRLGRRKALYEPVHGSAPDIAGKGIANPLGSILSVAMMLRITLHRPEDAALLEKAVDTALAAGARTADIAEPGAKRLSTQEMGDAVLNALDKVVGKEREHA

SEQ ID NO: 8651 - protein, 408 aa, Oryza sativa
MALHAAPPPPPPFTAGRLPTTSRRPCFSAGRIFRCSLPAAAARPRNAAFLAPLRTSSAVCTKAVSNSDGTPGTSSSPHVVCFGELLIDFVPTVNGVSLAEASAFKKAPGGAPANVAVGIARLGGSSAFIGKPQFELGRNIEKVGDDEFGYMLADILKENNVNNQGLLFDAHARTASAFVTLRNDGEREFMFYRNPSADMLLEEKELDLDLIRKAKIFHHGSISLITEPCKTAHIAAAKAAKDAGVLISYDPNLRLPLWSSADDARDGILSIWETADVIKISEEEVSFLTKGEDPYDDSVIKKLMHPNLKLLLVTEGPEGCRYYSKEFNGRVGGLKVNAVDTTGAGDAFVAGILSQLSVDFSLLQDEGRLKEALKFANVCGALTVTERGAIPALPTRQQVVDALTKVVA

SEQ ID NO: 8652 - protein, 506 aa, Phalaenopsis hybrid cultivar
MSIFLIATLFLSLSLHLLLRRFRRRRRILPLPPGPLNFPIVGALPFIGSMPHSGLALLSRRYGPIMFLKMGIRQVVVASSSSAARSFLKTHDSRFSDRPLDIISKQVSYNGQNMVFADYGPKWKLLRKVSNLHLFGPKAMSRWADVRRDEAFSMSHFLKKQSDSKNPVLLSNLLVCSMANVIGRISMSKRVFDEEGKEAKEFKEIIKELLVGQGASNIGDLVPAMRWLDPQGARKKLLGLNQRFVRMISKFLAEHGESRGEREGNPDLLDLIVADKIAGDDGEGLSEENIKGFISDLFVAGTDTSAMVIEWAMAEMLKNPAILRRVQEETDRIVGRDRLLEESDIPNLPYLQAICKEALRKHPPTPLSIPHYASEPCEVEGYHIPGKTWLLVNIWAIGRDPEVWEKPLEFDPERFMEGKMARIDPMGNDFELIPFGAGRRICAGKLMGMVMVQYFLGVLVQGFDWSLPEGVVELDMEEGPGLVLPKAVPLLVTARPRLPAAAYGVV

SEQ ID NO: 8653 - protein, 159 aa, Triticum aestivum
  misc_feature (103)..(103): Xaa can be any naturally occurring amino acid
  misc_feature (112)..(112): Xaa can be any naturally occurring amino acid
  misc_feature (116)..(116): Xaa can be any naturally occurring amino acid
  misc_feature (131)..(131): Xaa can be any naturally occurring amino acid
MGSAASPPRALDAATQEDLKRVSAHRAVDMVESGMTLGLGTGSTAAHALDRLGDLLRTGALRAVAGVPTSLKTEAHAARVGIPMLALADAAEIHLSIDGAHEXVNPDLKLFXGRGXGSLLPKKMIEGAGAXFVVILKKAKVVPRPRVQGAPRHNEGQPL

SEQ ID NO: 8654 - protein, 120 aa, Triticum aestivum
LLPLLPPLPLSVGLRQPRLRPSADDPRSSTKTDGSQPAAPKNPAMTSCRKKKTDDDVTFLEDVKEHIDEFIHASMDEHKTCFKKTIQKMFGMSKVVAERSAAAKEAEVESALPLQTSVSQ

SEQ ID NO: 8655 - protein, 301 aa, Pseudomonas aeruginosa PAO1
MTLSRDDAAQVAKVLSEALPYIRRFVGKTLVIKYGGNAMESEELKAGFARDVVLMKAVGINPVVVHGGGPQIGDLLKRLSIESHFIDGMRVTDAATMDVVEMVLGGQVNKDIVNLINRHGGSAIGLTGKDAELIRAKKLTVTRQTPEMTKPEIIDIGHVGEVTGVNVGLLNMLVKGDFIPVIAPIGVGSNGESYNINADLVAGKVAEALKAEKLMLLTNIAGLMDKQGQVLTGLSTEQVNELIADGTIYGGMLPKIRCALEAVQGGVTSAHIIDGRVPNAVLLEIFTDSGVGTLISNRKRH

SEQ ID NO: 8656 - protein, 416 aa, Nitrosomonas europaea ATCC 19718
MQLFAFGVNHHTAPLDIREHVAFSEESMQHALHDLVGHQLVKEAAIVSTCNRTEIYCNTDTPDKAVGWLADFHHLRFGDLEPYLYRLLREQAVKHAFRVASGLDSMVLGEPQILGQMKNAVKSAEQAGTLGLLLHKMFQRTFFVAKEVRTSTEIGACSVSMAAASARLAERIFGNISEQKVLFIGAGEMIELCAAHFVARHPVHVTVANRTVERAEALARRFNAHPISLGELPDQLALHDIVVTSTASPLPILGKGMLERAIKQRKHRPVFIVDLAVPRDVEAEVAELDDVFLYYVDDLADIVKEGLDNRQGAVTQAETIIESNVVDFMHWVATRQSVPTIRALRNQAERYRRHELARAHKLLAKGEDPEKVLESLSSGLTNKFLHLPSSVLNHATDDEREQLIELVNRLYQLHHS

SEQ ID NO: 8657 - protein, 85 aa, Oryza sativa
TESIEAVKMSKRAGWGVMTSHRSGETEDTFIADLAVGLATGQIKTGAPCRSERLAKYNQLLRIEEELGAAAVYAGAKFRAPVEPY

SEQ ID NO: 8658 - protein, 217 aa, Arabidopsis thaliana
  misc_feature (50)..(50): Xaa can be any naturally occurring amino acid
  misc_feature (73)..(73): Xaa can be any naturally occurring amino acid
  misc_feature (105)..(105): Xaa can be any naturally occurring amino acid
  misc_feature (154)..(154): Xaa can be any naturally occurring amino acid
MSRSWGIPVKLLHEASGHIVTVELKSGELYRGSMIECEDKWNCQLEGLTXLTPLLTTAKDGKVSQLDHVFIRXGKVRFMVIPDILKHAPMFTRGDARIKEKSSSXGVARVRVAMRGKTGCPAPGVKPWRKGGSRLPTLVEGRNDLIFTAPTNVXPFEFLGISSFSVNNPRVESPPFLGFLVHLMPFRRTPLKPKPRERRYPNPLLVLYFGLPRCLNH

SEQ ID NO: 8659 - protein, 399 aa, Rumex palustris
MAIECMHKTDHEVKQGREPLSLVFDSKILRNQASIPKEFIWPDDEKPDHEAAELEVPVIDMEGFCREETKSTNNASKLVQEAFMKHGFFLVKNHGVEAELIKHTHKYMREFFELPLVEKQRVQRKLGEHCGYASSFTTRFSCKLPWKETLSFPYSPEEANNTKVVEEYFNSKMTKDFAHMGKLYQEYCEAMNKLSLRIMELLGLSLGVGRQYFRDYFQGNDSVMRLNYYPPCQEPELALGTGPHCDPTSLTILHQDHVNGLQVFVDGEWRFIYPRFDTFVVNIGDTFMALSNGKYKSCLHRAVVNDTSPRKSLAFFLCPKEDLIVCPPNELVNESSPRVYPDFTWPIFLEFTQKHYRADMNTLLNFSRWVRERNQVQQSDGSSSVCPSIHLSCCNVQIK

SEQ ID NO: 8660 - protein, 113 aa, Bradyrhizobium sp. BTAi1
MLAGLFNRLTGSVSVPAIAHDELVRAHQQRSCVIVDVREPHEFNGGHIPGAVNHPLSRFDPDSLTQDEPVVLICQAGGRSATALRRALSAGRQNVRHYAGGMSGWRAHGGPVA

SEQ ID NO: 8661 - protein, 198 aa, Brassica napus
IIICGFGRVGQIIAQLLSERLIPFVALDVSSDRVTVGRSMDLPVYFGDAGSREVLHKIGAERACAAVVALDAPGANYRCVWALSKYYPNVKTFVRAHDVVHGLNLEKAGATAVVPETLEPSLQLAAAVLAQAKLPTSEIANTINEFRTRHLSELTELSEASGSSLGYGFSRTTSKPKAQESDASEENQIMEGGGTLAV

SEQ ID NO: 8662 - protein, 427 aa, Burkholderia sp. 383
MSAIVDIIGREILDSRGNPTVECDVLLESGTMGRAAVPSGASTGSREAIELRDGEAGRYNGKGVLKAVEHINTEISEAIMGLDASEQAFLDKTLLELDGTDNKSRLGANAMLAVSMAVAKAAAEEAGLPLYRYFGGSGAMQLPVPMMNIVNGGAHANNSLDIQEFMIVPVSQPTFREALRCGAEVFHALKKILSDRGMSTAVGDEGGFAPNFGSNDECLSTILQAIEKAGYRAGEDVLLALDCAASEFYHDGKYQLAGEGLQLSSAEFTDYLATLADKFPIVSIEDGMHESDWEGWKLLTDRLGKKVQLVGDDLFVTNTRILKEGIEKGIANSILIKINQIGTLTETFAAIEMAKRAGYTAVISHRSGETEDSTIADIAVGLNAGQIKTGSLSRSDRISKYNQLLRIEEDLGDIASYPGKSAFYNLR

SEQ ID NO: 8663 - protein, 92 aa, Bordetella petrii
MATTSKPATARKPNAAFMKPLTPSAELAAVIGSEAVPRTEVTKKIWEYIKKHNLQDASNKRNINADAKLRPIFGKDQVTMFELTKLVNAHLK

SEQ ID NO: 8664 - protein, 156 aa, Haemophilus influenzae
NRANTPVLVDGKDVMPEVNAVLAKMKDFCQRIISGEWKGYTGKAITDVVNIGIGGSDLGPYMVTEALRPYKNHLNMHFVSNVDGTHIAETLKKVNPETTLFLVASKTFTTQETMTNAQSARDWLLKATKDESAVAKHFAALSTNAKDVEKFGIDTN

SEQ ID NO: 8665 - protein, 167 aa, Glycine max
MASGSKSVASILLALNLVLYFIVLVIASWAVNHGIQRSGETASVLSIPARIFPIYFPMGNMTTGFFVILSLVAGVVGFTTSLTGLQNIFQWNAPNLHAAAMSSLTTWALTLLAMGFACKEIELGWTDSNLRTLETITIIVSATQLLCTGVIHVGVSEVVAQRMGGRV

SEQ ID NO: 8666 - protein, 333 aa, Oryza sativa Japonica Group
MELHRPPPSVSGVRGKSCLQKPFLVQAKRLEGLEKANPRSRGKQSLEQVKKRAPLIRGTVSPPLPVPGHITQPPYVGKKDASEIASEIQMHDKVSIIHMKAACELAARVLEYAGTLVKPSVTTDEIDKAVHKMIIDAGAYPSPLGYGGFPKSVCTSVNECICHGIPDSRELQDGDIINIDVTVYLNGYHGDTSKTFLCGEVDEASKRLVKVTEECMLRAISACKHGTSLKKIGRRISEHAERHGFGVVDRFVGHGVGRIFHSEPMIYHQRNNMPGQMVEGQTFTIEPALSMGSIDCDMWDDGWTAVTTDGSLAAQFEHTILITKTGAEILTKC

SEQ ID NO: 8667 - protein, 163 aa, Oryza sativa
  misc_feature (125)..(125): Xaa can be any naturally occurring amino acid
MASRCAARVPSPPCAAARSGWAGPVVSIRPARSGVARGRAVVCAVSFRPCIDIHKGKVKQIVGSTLRDSSNDGTALVTNFESDKPPAEFANIYKEDELIGGHVIMLGADPASQAAAMEALHAYPXYVFSEGKMNIERLKQLVDLVGKHTLVLDLSCRKKFTLF

SEQ ID NO: 8668 - protein, 503 aa, Nierembergia sp. NB17
MMQLSTELAIAAIIFLLAHILISKTSGRRLPPGPRGWPVIGALPLLGDMPHVSLAKMAKKYGPIMYLKVGTCGMAVASTPHAAKAFLKTLDINFSNRPPNAGATHFAYNAQDMVFAPYGPRWKLLRKLSNLHMLGGKALEDWSNVRANELGHMLKSMLDLSREGQRVVIADMLTFAMANMIGQVILSKRVFVDKGVEVNEFKNMVVELMTVAGYFNIGDYIPCLAWLDLQGIEKGMKILHKKFDVLLTKMFDEHKTTSHEREGKSDFLDMVMANRDNSEGERLSTTNIKALLLNLFTAGTDTSSSVIEWALTEMLKNPSILKKAQVEMDQVIGKNRRLLESDISNLPYLRAICKETFRKHPSTPLNLPRISSESCEVDGYYIPKNTRLSVNIWAIGRDPDVWENPLKFNPERFLSGKYAKIDPRGNDFELIPFGAGRRICAGTRMGIVMVEYILGTLVHSFDWKLPSDVIELNMEEVFGLALQKAVPLEAMVTPRLPLNVYAP

SEQ ID NO: 8669 - protein, 367 aa, Streptomyces coelicolor A3(2)
MKFGAAVLRAYENPFTVEEVVLAEGPAEGEILVRIAGCGMCRTDLAVRRSGGRSPLPAVLGHEGSGVVVETGGTGTGLSAGDHVVLSFDSCGHCRNCMGAAPAHCDSFAALNLFGGRREHAARFTDTTGTALAPRWFGQSSFAEYALVPARNAVRVDPALPLELLGPLGCGFLTGAGAVLNSFGVGPGDTLAVFGAGAVGLAAVMAAHAAGAATVAVDRHPGRLALAERLHAVAVPATPTGLSDRILRLTGGGTTYALDTTGSAGLINEALRSLRPTGRLGLVARLHGTLPIEAGTLDRGRAIFHICEGDAVPGLLIPRLTALWQAGRFPFDQLIRTYPLADINEAEHDCETGRVVKPVLIPDGRRP

SEQ ID NO: 8670 - protein, 635 aa, Streptococcus pyogenes MGAS8232
MIILQGNKLERSFSGDVLFQNISLQVDERDRIALVGPNGAGKSTLLKLLVGEETPTSGEVNTKKDLTLSYLAQNSRFESDQTIYEEMLKVFEALRQDEKRLRQMEMDMATVSGQDLTRLMTDYDLLTEHFRQQGGFTYESDIKAILNGFKFDESMWQMTIAELSGGQNTRLALAKMLLEKPELLVLDEPTNHLDIETIAWLENYLANYQGALIIVSHDRYFLDKVATVTLDLTPHGLDRYVGNYSRFMTLKAEKLVAEEKQFDKQQKEIAKLEDFVQKNIVRASTTKRAQARRKQLEKIERLDKPTSARKSAHMTFQADKPSGNVVLTVEKAAIGYNQHVLSEPINLDVHKLDAIAIVGPNGIGKSTLIKSVIGQIPFIKGEVKYGANVEIGYYDQTQSHLTSSNTVLEELWQDFSTTPEVDIRNRLGAFLFSGDDVKKSVAMLSGGEKARLLLAKLSMENNNFLVLDEPTNHLDIDSKEVLENALVDFDGTLLFVSHDRYFINRLATKVLEITENGSTLYLGDYDYYLEKKAELEELARLAAGETVEETKEASATDYQLQKANQKERRRLTRRYEEIEARLETIEERIGAIQEDMHASNDTAQLIAWQKEWDQLDQEQEALMEEWETIAEQIES

SEQ ID NO: 8671 - protein, 616 aa, Oryza sativa
MAAALQIGSRPLVGLRSRQHVAPKAPVLRAFSGQNRNLPGQVQPAGLVPLQKPVFQQPAEKPVLVEPVQAAAGDAPSEGKKVLGYDVFTWQKILPLGAMFFCILLNYTILRDTKDVLVVTAPGSGAEIIPFLKTWVNLPMAIGFTVAYAKLANVLSTEALFYTCIIPFICFFGAFAFVFYPLRDVLHPTAFCENLLEQAGPRFAGPIAILRNWTYCLFYVMAELWGSVVVSVLFWGFANQITTVDEASQFYPPFGLGANVALIFSGRAVKLFSQIRAELPPDVDGWGLSLRGLMGMVVIGGILIAGIYYWLNRTVVPRVQKRESKKKKRAKMSVGESFTFLAGSRYIRDLATLVVAYGISINLVEVTWKSKIKAQFPNPNDYSAFMGDFSTATGAVTFTMMILSRYIFKYFGWGVAALITPTVLLITGIAFFCLVLFSDSVAPTLKALGLTPLMAAVLVGAAQNVFSKSSKYSLFDPCKEMAYIPLDDEVKVKGKAAIDVICNPLDKSGGALIQQFMIIGFGSLAASTPYLGVILLSIVLLWIGAANSLAGQFAELNAKTASECGDSMDASGTQQFKYVLDAGSTKGQWVPVTSGETPSGQVKVMTQSEADALNKQ

SEQ ID NO: 8672 - protein, 136 aa, Oryza sativa
IDAYGPISDNAGGIAEMAGMSHRIRERTDALDAAGNTTAAIGKGFAIGSAALVSLALFGAFVSRAGVKVVDVLSPKVFIGLIVGAMLPYWFSAMTMKSVGSAALKMVEEVRRQFNSIPGLMEGTGSSAEIFDGHHE

SEQ ID NO: 8673 - protein, 2429 aa, Gibberella zeae PH-1
MSTFNHFNIKRQAHNLSRTSTDQSWNPFRHVAWNRRSRTLSEAGLEGQQRTRDHTTGEELTHAVTEPGRSGPAREWSAAETMTDARRSKEDGYDREKMVGGGSPMDGSDDIPTSQRSLVGDENQLRNRKREDVPAATDQNVDLEKRKLDRRQSSKLFRHVEPKEPFTVRNQLERTFLNSYINILLIAAPVGIALNYIHSVNRIAVFVVNFIAIIPLAAILSFATEEIALRTGEVLGGLINATFGNAVELIVAILALVDGKVIIVQTSLVGSILSNLLLVLGFCFFFGGLRREAQYFNETVAQTAASMLALAVASVIVPTVFDQAKNTPATNVARLSRGTAVILLIVYAAYLLFQLKTHSSTFRQEGQKVAAKPWSRGGGGNIRQGIMVPGALIGGGMTGREENERLSEMLMNPHRLPKSEGDEDEEEEPQLHFWVAVATLTTATVLIALCAEFMVDSIDAVTKTGGVSEEFVGLILLPIVGNAAEHATAVTVAIKDKMDLAIGVAVGSSMQVALFLIPLLVIIGWGMGNDDMNLSFDLFQVATMFVAVLLVNYLIADGKSHWLEGWLLICLYSIIATTEKVPHDLRIPGSYNVNSSERQPDPMSRNGTTRNPVPRMGPPHWRQYSKSSLDRSHAEAPVSPASISTHSTIKDEKRTRIERRCTVTVNEGYTRDEVLLNFDVVGADVKPGMLMCISTARDDLRKISAGHGSSSKQNQDASKGTSGTQNGDGAGFKYFFVAKDMPQETKTRNPDVEVYVLKHIADAFGMKKGSQVLLTMVDAKNPATEASHVELSFKDQYLSRSDIWRMTVGELTGRTVYKGQSVLFMGTIKAQVTAIYVDSRKTHSAFFTRDTRPIFRSESARYVLFIQMAKEMWEFDAESSGEIMFNKVVNGFLPALFKRWAMLKAKHLVSIVLFARVEYDTGLTAEFDGLAGDFYTGIQPSGLRRPYKDFYRVVVSEMGSGEWTKILHQLKVEFNFFRRDISLYHHKLNAQAEINGPDSIPKDTPSSRVKAESTYAMYGNVLEAINLASSQFAHDHIDRDLTRTGISIAVISPGSGVFEVDYETLRRTTEALVGNGIGIDLICMPKMPLHSVPLFKYRNPQYSDDHGHAHRSSFSRSFHSRDSTPNHPTPVIGSYQSLGESFSPSKGMSLSRRADPLISMATSDQWCFALPQWLHVSFWTGASDEALSYEGIALSVSNKVMQDDEDEFNIRCRMYALQMRSVLETNEIETTPLQVDTHFPANITEPPSSQKYRNTGINDTVYIPSRRAPEGLFEHTSGFQRFVPDRLARPGEKSLWKQLQEFDDHRAKISHGRSRHHSSRYAKDLDEITRRQLAEDSGLYGTSLPEKRAPILGGASARKLSMNITDGDKPSPTSLKKSAEPTPKPPKQIAKQPKLMRQISLGQRGFGIAAPKAVVAEIKAETVNASGVSSGEGKQPSTPRIRPELRPSSPQTITSHPSSVSIQKYRLDAPDTIIEGVPMTPSIPILKRNNSGLDVAAMQLRTASTTIGSSFNNRQPKRDDDRDLRYSEALRADDAQKLYTNKLRAGVLSDAVQDLPTTLSPTTAITPWLTLVNPSNPESLAIDDTVLYSRWQHVYPQITQMKVQKWKALCCPASVPLTTEYFPSKTQFDTEYHRHPYTVEQDADDDLVETPKSRQEFIQELISLRFTQGFQVVVGPLVARAFGQNLIKIGDIFSRDQPLEDGTSIFLSVGNSIHQLSCVNGTEVEVNIFMRKPTDTSFTSQGFSPIYKPAIRTLLDDTYEAREIDLLTPRTDRNWNMIDSYIAGHHNEMSDSLRFWRARFVLIPVLRKDVPISRTQTGDHAEEVRIEGIKRLAQSWQKYRYIPLSERRYHSVAQQKRRRDPNPLDIVWKTDDPSVVITAEVETLPLTEGVEGANRKGLVSAKERFKKSNLNLSTLADAMQQPVENGGVRLQNRRWHLRLYSACFIGSDMVTWLLDNFEDLDTREDAEALGNALMAHDELKAANPKDKGIFVHVDKRHQFRDGNYYYQIASEFAKPHVGWFNTRRTPVPPTPSVESSNRDSPRTLMSARSGEESGSPASTSTTPTISLHHGGKRPRVVLSKVMKYDVDHRKRSYRPERIDLHYDRLHNPDGCYHIRIDWMNVTTKLVEDAVESWAREASQYGLRLVELPIKEACTITETNPFRKPYHIKLAARPPDQKPETYIDPNSLGPTTSPNKHFYQTAILKKFDFVLDTEAASNFPSNVDVSYSWGKPDYKYTQYIHRSGTLLAEITDEGDLLILANRLYSNRPAGMRSIDPPPLVERGGRMASYGPYSTFGMAESATLSSPLLKPTHYFHSPALKPADQQHNKPTPATSPDPDALNTEIDEFCKNKTALEEFYREALEKGQRVQGTPATAPALEAVPEASIPTLGLPPGVLGGNDGAPTKRLNSPMSFLRRSSVQYDGGSSLTGR

SEQ ID NO: 8674 - protein, 249 aa, Vibrio parahaemolyticus RIMD 2210633
MDILSDHEMLRYNRQIILRQFDFEGQEALKQSSVLILGAGGLGCASSQYLATAGVGRITLIDDDIVELSNLQRQVLHHDTDIGRKKVDSAADALRELNPHVEVNTVAKRLDDAQLQALIEQHTVVVDASDNVDTRNQLNRLCFATKTPLISGAAIRMEGQVSVFTYDDPTQPCYQCLSALFGSGALSCVEAGVMAPVVGIVGAVQAMETIKVIANYGQPKKGKILILDALSMSWREMNLIKMPTCPVCG

SEQ ID NO: 8675 - protein, 205 aa, Schizosaccharomyces pombe 972h-
MSVNNEVSADQHNPELEDDTFEHGPPVSLGEKKSLNEYMKMDAEDESLQKWKASLGITGTGYSPSNDRRTVVILKLSLLVDGRDPVDVNMEDAASVEQIRKKGFTIKEGSEFKIGVKFRVQHEVISGLRYVQTVRRRGFVVDKTSTMIGSYGPSETPYDFTSEPDEAPTGMLARGHYEANGKFVDDDKVVHHEFVWAFDVAKSWK

SEQ ID NO: 8676 - protein, 447 aa, Trifolium pratense
MAVSDGVQTPTPQVVGNAFVEQYYSILHQDPDQVHKFYHESSVLSRPEEDGTMTTVTTTAEIDKKIQSFDYTSYRVEVLSADAQPSYNSGVVVVVTGCLTGTDNVKRKFAQSFFLAPQDKGFYVLNDVFRYVDAYKSVDIETVTANDADESAPSEAFTPDPEPIHVAEDIPTIQPVIADTDTNISKEVSLPLENGKLSVTENVIPVNHVKESSHQEQMASIEKVPSNTQEDTPKKSFASIVSAYKDNSAPFLSRTSPAKPAVQPPRVHSVPAPEAPPPNMDIPSEKNNENGGRAHAIFVANLPMTATVEQLDRVFKKFGTIKRDGIQVRSNKGSCFGFVEFESAASLQSALEASPPVMLDNRRLSIEERRGRGGYRNDRNDNFRGRGNFGGGRGGGFNGRNDFDRRGEFSGRPRGGNNTGRSNGDAAPRSYQNGGGKVARQPPVKAQ

SEQ ID NO: 8677 - protein, 356 aa, Neisseria meningitidis Z2491
MTKHIAILRGDGIGPEIVAETVRVLDKLIAQGLDVGYEYAPLGGEAYDEYGHPYPEFTQNLCRKADAVLLGAVGSPQYDNLDRPLRPERGLLAIRKDLNLFANLRPAILYPELANASTLKSEIVAGLDILIVRELTGDIYFGEPRGIRVLENGEREGYNTMKYSESEIRRIAHVAFQSAQKRSKKVCSVGKANVLETTELWREIFEEIGKEYPDVELSHMYVDNAAMQLVRAPKQFDVIATGNIFGDILSDEASMLTGSIGMLPSASLDENGKGLYEPSHGSAPDIAGQNKANPLATVLSLAMLLRYSLNDEARAQQVENAVQKVLQQGLRTGDIYEEGTKLVSCSEMGDAVLATL

SEQ ID NO: 8678 - protein, 342 aa, Gibberella zeae PH-1
MAPSLETPESIDDVFANPIKQKPQLVAPEPQNCVGPDSQQAGKADSCAGCPNQAICASAPKGPDPDIPVISARLENVKHKILVLSGKGGVGKSTFTSLLAHAFATNPDSNVGIMDTDICGPSIPKMMGVEGETVHVSGTGWSPIWVMDNLAVMSIQFLLPNRDDAVIWRGPKKNGLIKQFLKDVEWGDLDFLLVDTPPGTSDEHLSVNSFLKGSGIDGAVMVTTPQEVSLLDVRKEIDFCRKAGIKILGLAENMSGFVCPKCSNESQIFKASTGGGRALAEEMDIPFLGSVPLDPRIRMACDYGESYFDSFPDSPACLAFQGVVKNLAMQLGLDSQDVLPDE

SEQ ID NO: 8679 - protein, 84 aa, Glycine max
GSRSIKSLEEEKKWSKEQKWEMISRVWVEMLCHAASQCRGFHHAKQLSRGGELLTHVWFLMAHLGITEQFQISQGHARAKLIHS

SEQ ID NO: 8680 - protein, 353 aa, Alternaria alternata
MGCGMSTEEKEGKQRNEEIENQLKRDKMMQRNEIKMLLLGAGESGKSTILKQMKLIHEGGYSRDERESFKEIIFSNTVQSMRVILEAMESLELPLDDQRAEYHVQTIFMQPAQIEGDSLPPEVGNAISVLWKDAGVQQCFQRSREYQLNDSAKYYFDSIDRIAAPDYIPNDQDVLRSRVKTTGITETTFIIGDLTYRMFDVGGQRSERKKWIHCFENVTTILFLVAISEYDQLLFEDETVNRMQEALTLFDSICNSRWFVKTSIILFLNKIDRFKEKLPVSPMKNYFPDYEGGPDYAAACDYILNRFVSLNQHETKQIYTHFTCATDTMQIRFVMAAVNDIIIQENLRLCGLI

SEQ ID NO: 8681 - protein, 141 aa, Xylella fastidiosa Temecula1
MVLERTLSIIKPDAVAKNVIGDIYSRFEKAGLKIVAAKYKQLSRREAEGFYAVHRDRPFFNALVEFMISGPVMIQVLESENAVARHRELLGATNPKDAAPGTIRADFAESIEANAAHGSDSVENAAIEVAYFFAATEIILR

SEQ ID NO: 8682 - protein, 336 aa, Xylella fastidiosa Temecula1
MNMAIKVGINGFGRIGRNILRSAVQNFGSNIDIVAINDLLEADYLAYMLQYDSVHGRFKGEIAIEGTALILNGKKIRLTAERDPGNLQWADAGAEIVIESTGLFLTQESAGKHLAAGAKKVIISAPSKDETPMFVYGVNHNSYNGEPIVSNASCTTNCLAPLAKVINDKWGITRGLMTTVHAATATQKTVDGPSNKDWRGGRGILENIIPSSTGAAKAVGKVIPSLNGKLTGMSFRVPTSDVSVVDLTVQLNTPATYKEICTEVKQQSEGPLRGILGYTEDKVVATDFRGETCTCVFDADAGIALDPTFIKLIAWYDNEWGYSNKCLEIAKVIAAK

SEQ ID NO: 8683 - protein, 246 aa, Listonella pelagia
MFGGESASGNPCGVLELDSWLSDEELQKITYEAGLPVTSFVIKINGQFHIRWFALDGEINLCGHGSLGAGAAIISKYKLDSVLFSSKYGDVSIAKKNDAYTLEMPSWKGETCVVPPEIADLAVDAIDVFSTRDLVVVLPSIESVRDFKPDDMRFKQPGNYHALIVTAANGENGYVLRYFAPKIGISEDLATGSAQCSLAPYWFDRLDSDSLQVHQLSSSGGYFSVRRISGDLIVLSANAKLRKIAI

SEQ ID NO: 8684 - protein, 348 aa, Arabidopsis thaliana
DNSVDLLTNDIGVVVVSDENGEPQGFNIYVGGGMGRTHRMESTFARLAEPIGYVPKEDILYAVKAIVVTQREHGRRDDRKYSRMKYLISSWGIEKFRDVVEQYYGKKFEPSRELPEWEFKSYLGWHEQGDGAWFCGLHVDSGRVGGIMKKTLREVIEKYKIDVRITPNQNIVLCDIKTEWKRPITTVLAQAGLLQPEFVDPLNQTAMACPAFPLCPLAITEAERGIPSILKRVRAMFEKVGLDYDESVVIRVTGCPNGCARPYMAELGLVGDGPNSYQVWLGGTPNLTQIARSFMDKVKVHDLEKVCEPLFYHWKLERQTKESFGEYTTRMGFEKLKELIDTYKGVSQ

SEQ ID NO: 8685 - protein, 156 aa, Haemophilus influenzae
NRANTPVLVDGKDVMPEINAVLAKMKDFCQRIISGEWKGYTGKAITDVVNIGIGGSDLGPYMVTEALRPYKNHLNMHFVSNVDGTHIAETLKKVNPETTLFLVASKTFTTQETMTNAQSARDWLLKAAKDESAVAKHFAALSTNAKDVEKFGIDTN

SEQ ID NO: 8686 - protein, 597 aa, Oryza sativa
  misc_feature (117)..(117): Xaa can be any naturally occurring amino acid
MALWWPLLVLAAAYALCRILLFLIPPTVPSIDVDASDVLEDANQNKEDSYIYIPPRKGKGAQTDKVQCYEPATMKYLGYFPALTPDEVKEHVAQARKAQKIWAKSSFKQRRQFLRIXLKYILEHQDLICEISSRDTGKTMVDASLGEIMTTCEKITWLLDEGEKWLKPEYRSCGRSMLHKKAKVEFYPLGVIGAIVSWNYPFHNVFNPMLAAIFSGNAAVIKVSEHASWSGCFYFRIIQAALAAVGAPDNLVHIITGFAETGQALVSSVDKIIFVGSPGVGRMIMNRASDTLIPVTLELGGKDAFIVCEDVDLPSVVQVAVRAALQSSGQNCAGAERFYVHKDIYSTFVSQVVKIIKSISVGPPLSGRYDMGAICMIEHSEKLQNLVNDAVDKGAEIAGRGSFGHLGEDAVDQFFPPTVLVNVNHTMKIMQEEAFGPILPIMKFNSDEEVVKLANDSKYGLGCAVFSGNQKRAIKIASQLHCGVAAINDFASSYMCQSLPFGGVKDSGFGRFAGVEGLRACCLVKAVVEDRWWPYVKTMIPKPIQYPVSENGFEFQELLVETLYGLSVWDRLRSLVNLLKMISEQNNSPANTRKKSR

SEQ ID NO: 8687 - protein, 578 aa, Desulfotalea psychrophila LSv54
MSSDLYRFKYDEFGNTRDIAVYGTGPSIMSCSYTNKSTAFSSKERDDFGLQGSLPPGFRDLEAQVENCHIKLGEKESEEEKYIFIRSLFDRNVTLAHALIQSDLEKFMGIIYTPTVGLAVQKYSAMFRQANGLHFSPDTIDQAEDILRRFAHRDIRVAVVTDNQGILGIGDQGAGGIAICLGKLMLYTQGAGIAPWHCLPISLDIGTDNEALLADKHYLGWRQKRLVGDEYTAFIDRFARAFRNVFPNALCQWEDFSKQNAFDIRDKYRHSMVSFNDDVQGTGAITFSAILSAMKVKRAKLTDQVFLIHGAGAGGVGIGEQIQVALMAEGLSEEEARDKVFTIDSRGVVTVDRKIEAYKKKFAKDGAKLSWLADPENHKLENVIKQAGVTVLIGTSGQGGCFTETVVKNMLGNTERPVIFPLSNPTHMAEAQPKDIYAWTNGQALVATGSPFAPVEHDGKTSRIGQCNNVFVFPGVGLGVLASGAREVLPEFFTAAAYAVSNSLSQEALDRGCLVPEVSEISKVSEKVALAVATCAIEHGVSRPCVYSDFSHNNDPARMKVLISKMRWSPEYLPMTAM

SEQ ID NO: 8688 - protein, 476 aa, Azotobacter vinelandii
SQKFDVIVIGAGPGGYVAAIKSAQLGLKTALIEKYKGKEGKTALGGTCLNVGCIPSKALLDSSYKFHEAHESFKLHGISTGEVAIDVPTMIARKDQIVRNLTGGVASLIKANGVTLFEGHGKLLAGKKVEVTAADGSSQVLDTENVILASGSKPVEIPPAPVDQDVIVDSTGALDFQNVPGKLGVIGAGVIGLELGSVWARLGAEVTVLEAMDKFLPAVDEQVAKEAQKILTKQGLKILLGARVTGTEVKNKQVTVKFVDAEGEKSQAFDKLIVAVGRRPVTTDLLAADSGVTLDERGFIYVDDYCATSVPGVYAIGDVVRGAMLAHKASEEGVVVAERIAGHKAQMNYDLIPAVIYTHPEIAGVGKTEQALKAEGVAINVGVFPFAASGRAMAANDTAGFVKVIADAKTDRVLGVHVIGPSAAELVQQGAIAMEFGTSAEDLGMMVFAHPALSEALHEAALAVSGHAIHVANRKK

SEQ ID NO: 8689 - protein, 412 aa, Nostoc sp. PCC 7120
MSQLTSIEINIALMTLGGLVLALGLLSGWLKERLFLSDPLIALVVGVLLSPSVFGLIDLAHWGKPEIILEQGARLAIAIQVMGVALRLPKAYPFTHWHILAVLLGLLMPLMWLISGLLVYLLLGLPFWVSMLVGAVITPTDPVVSTSVVTGKIAEQNLPERIRYGIFAESAANDGLAYPFVLLPILILTKPPQEALIHWLTKILLWEVGAAVLMGLLIGYLAGWLLQWAETKQTIEKQSFLAYTVALSLAVLGLVKLIGSDGILAVFAAGIAFDMVVGGRDRAEEENVQEAVDRFFTLYIFVLLGLYIPWQQWLELGWKGLLLAVAVLLLRRLPVVLLLRPLLGQLRRIQDALFLGWFGPIGVAAIFYAFLSLRQTGIEATWTIGSLVICASILAHGFTAVPLAKLYAKQQR

SEQ ID NO: 8690 - protein, 434 aa, Rickettsiella grylli
MSSLKEIHVPDLGNISTAAIIDIPVKEGQRIAVEEALITLESDKASVDIPSPFAGTLKELKVNVGDNVSQGDLIAILETEESSDAEEPKIKSIPTGNEEKKSLSETGVEKASILLNKNEEISETVNVSDEEMEDDDPGTIHAGPGVRRLARELGIDLNNIQGTGPKGRILKEDLQKFVKTKLQFASNDKMGLPPVPEIDFNQFGETEKQPLSRIKKLSAQYLHRNWLQVPHVTQFNDADITELEVFRKAQAGFAAKQQIKLTPLVFIMKAVVTSLKAFPSFNASLSANDQELTLKKYYHIGIAVDTSEGLVVPVIRDVDKKSLLTLAEELGHVSQKARAKQLSSGDLQGHSFTISSLGGIGGTAFTPIVNVPDVAILGVSRAQFKPCYREGEFIPRFMLPLSLSYDHRVIDGAEGARFIMHLTECLSDIRRWLL

SEQ ID NO: 8691 - protein, 176 aa, Photobacterium profundum SS9
MSLNQVPAGKDIPEDIYVVIEIPANADPIKYEVDKDTGAIFVDRFMASPMFYPCNYGYVNDTLSLDGDPVDVLVPTPYPLVPGAVIRCRPVGVLKMSDESGEDAKIVAVPHSKLSKEYDHIQDVNDLPELLKAQITHFFERYKELEVGKWVKVDGWEDAAAAKEEIMTSFKRAQEK

SEQ ID NO: 8692 - protein, 344 aa, Photobacterium profundum SS9
MMQGLYMPNMKTLGEFIVEKQNDFPHASGDLSSLLGSIKLAAKIVNREINKAGLVDITGAIGSENVQGEEQQKLDLYANDKFKAAMEARDQVCGVASEEEDEAVTFNKDLNRNAKYVILMDPLDGSSNIDVNVSVGTIFSIYRRVSPIGTTPTQDDFLQPGNQQVAAGYVIYGSSTMLVYTTGNGIHGFTYDPSLGVFCLSHENMQIPEDGQIYSINEGNYIRFPQGVKKYIKFCQEDVPADNRPYTSRYIGSLVSDFHRNLLKGGIYMYPSTAMYPNGKLRLLYECNPMAFLMEQAGGVASDGKNRILDITPTELHQRVPFFVGSTNMVKQVESFIEEYPEQH

SEQ ID NO: 8693 - protein, 771 aa, Aspergillus oryzae
MTVSYDHSSLRNAAPTSMATLEDRFEVMKEVGDGSFGSVAVARVRTAGSNIARRGTMVAIKTMKKTFDSLAPCLELREVIFLRTLPAHPHLVPALDIFLDPLSRKLHICMEYMDGNLYQLMKSRDHKPFDGKHVKSILYQILSGLDHIHAHHFFHRDIKPENILVSTSAPSDSAFSRYSNLVTPPSTPPTYTVKIADFGLARETHSKLPYTTYVSTRWYRAPEVLLRAGEYSAPVDMWAVGAMAVEIATLKPLFPGGNEVDQVWRVCEIMGSPGNWYSKSGSKLGGGEWRDGSRLAQKLGFTFPKMAPHSMESILQAPQWPTSLSHFVTWCLMWDPKNRPTSTQALNHEYFADAVDPLRPKSSTARLLGRKTSDRSFKSPTRENSDSPSLTSKSSWFRRSLIGRSDSDNEQSKQPVVSYSTAPETTKTKPAPSKRATWANGAPMPILPSIRPVSPLSNAVTAQANSCIAGDNGKASKKIGRQLSLNSHGNHYADVHRQEAERALNGGNPLVGANQKESFFSHLRKRARRLSGRNQGNVGSDNVEANAGCMPWSNRSSLALDTANANDAKQGSDLSELDKALQGVKCSLDSTALGNVPVHITSPVEGVKRQSMPQGSIRSMGDSPVSTSGTGAPISSRTRRALQLSSHPVHRYETPEEEDELLDEALHSASKAARRLAQTETSSDGSSNFSHQTMGNDNSRALPSPYPTPSPSAKCDGVSFGHSDTTPIRRLGLPDGKTDATSNRQWPTPPYEDGDWNHSGTTNFMTGSTYR

SEQ ID NO: 8694 - protein, 647 aa, Streptomyces coelicolor A3(2)
MAGIHAAYGTGRPGAQARRRARTPRSGMQFTTRPTLSGTFGMVSSTHWLASQSAMAVLEDGGNAYDAAVAGAFVLHVVEPHLNGPAGEVPILLAPAGGGVRVLCGQGVAPAGATVAHYKGLGLDLVPGTGPLAAAVPGAFDAWLLLLRDHGTKSLADVLKYAVGYAEHGHAPVERVAETVETVRELFETEWTSSAEVYLPDGRPPRPGELLRNPALAATWKRLLAEATGAADRNGVRKGNREAEIDAAREIWRSGFVAEALVRQAGRPTLDTSGERHTGTLTAADLAGWSAHYEAPATYDWNGWTLCKAGPWSQGPVLLQQLALLPPELPAYASADYVHLLVEGCKLAMADREAWYGDADGADRVPLEELLSPEYNAERRRLVGDKASFELRPGAPGGRVPRLAAHALVAAVEGEGLDALGVGEPTVAKGPASPVPGEPDVAADGGTRGDTCHLDIVDRWGNMVSATPSGGWLQSNPVVPELGFPLGTRLQMTWLEEGLPNSLTPGRRPRTTLTPSIALRDGVPVMAFGTPGGDQQDQWQTHFFLAVALRARVRGGLDLQGAIDAPNWHNDSFPGSFFPRGMRAGSVTVESRMPAEVVEELRRRGHDVTVGEAWSEGRLCAVARDPETGVLSAAANPRGMQGYAVGR

SEQ ID NO: 8695 - protein, 281 aa, Streptomyces coelicolor A3(2)
MIEDNETIDEFLARHTGDVEEAVRKAAAQEIMPRWRRLAAHEVDQKAGPHDLVTDADRKAELYLTEVLPRLLPGSVVVGEEAVHANPASYGAIRGEAPVWIVDPVDGTRQFVRGEEGFCTLVALAHRGVVHASWTYAPAGDRLATAARGGGAFLDGERLYAGPPEPGRDLRVATSHPDYTTDEQKRDLLALRTPGVAPRPCGSAGLEYLAVARGESDATAFSWEAAWDHAAGLLLVEEAGGTHLTRTGEPFRITGGNELPFTAARDAATARQVVALLSGEA

SEQ ID NO: 8696 - protein, 401 aa, Synechococcus sp. CC9605
MAPYRLDVLSLAPQAFAPLLELGVIGRAFNAGIAELHLHNPRDFATDRHRKVDDEPYGGGAGMVLKPEPVFAAMEAIPRSPRSRVLLMSPQGRPLQQADLQRWSTEHDQLVFLCGHYEGFDERIRGLADEEVSMGDFVLTGGELPAMTVINGVVRLLPGTVGTADSLVEESHSALLLEHPHYTRPADFRGMTVPDVLRSGDHGSIARWRQEQREQRTRERRPDLFARWQTATMNDPSDPGMELRIGNGYDIHRLVPGRALILGGVTLDHPDGLGLDGHSDADVLVHAVMDALLGALALGDIGKYFPPTDPQWKGADSLKLLDQVVKLVKERGWSVVNIDAVVIAERPKLKPHIAEMSSRMASAIGIAPDAVGVKATTNEGLGPEGQEEGISCQAVALLQRS

SEQ ID NO: 8697 - protein, 302 aa, Thiomicrospira crunogena XCL-2
MYKTLMDTVGNTPLVKIQRMVNPNTNSVVLAKLEGNNPAGSVKDRPALNMIVQAEKRGEIAPGDTLIEATSGNTGIALAMVSAMLGYRLKLIMPDNMSMERRASMAAYGAELILVSKESGMEGARDLAQRLQAEGQGKVLDQFANPDNPLAHYHTTGPEIWRDTEGQVTHFVSAMGTTGTIMGTSMFLKEQSDAVQIVGVQPTEGSSIPGIRRWPKEYLPEIYDDRRVDRVIDLSQDVAEDTMRSMATQEGIFAGVSSGGAMAAALQLAQEVENATIVTIVCDRGDRYLSTNVFPTGHVTHG

SEQ ID NO: 8698 - protein, 182 aa, Picea sitchensis
MSASEDGDARVQGIFDAIRVVPDFPKPGIMFQDITTLLLDHKAFRDCIDIFVERYKDKNISVVAGIEARGFIFGPPIALAIGAKFVPIRKPKKLPGEVISEEYALEYGTDRIEMHVGAVQPGDRTLVVDDLIATGGTLSAAMRLLERVGAEVVECACVIELPELKGRERLGGKPLFILVESA

SEQ ID NO: 8699 - protein, 469 aa, Streptococcus pyogenes MGAS8232
MAFEIIMPKLGVDMQEGEIIEWKKQEGDTVNEGDILLEIMSDKTNMELEAEDSGVLLKIVRPAGDTVPVTEVIGYIGAEGESVDTIASSEKTTEIPVPASADAGPTVAPKENVASPAPQVAATAIPQGNGGKVRATPAARKAAAEMGIDLGQVPGTGPKGRVHKEDVENFKGAQPKASPLARKIAADKGIDLATVSGTGFNGKVMKEDIMAILEAAKPAEAKAPAAKEEKVVDLPEGVEHKPMSAMRKAISKGMTNSYLTAPTFTLNYDIDMTEMIALRKKLIDPIMAKTGLKVSFTDLIGMAVVKTLMKPEHEYMNASLINDANDIELHRFVNLGIAVGLDDGLIVPVIHGADKMSLSDFVLASKDVIKKAQTGKLKAAEMSGSTFSITNLGMFGTKTFNPIINQPNSAILGVGATIPTPTVVDGEIVARPIMAMCLTIDHRLVDGMNGAKFMVDLKKLMENPFELLI

SEQ ID NO: 8700 - protein, 587 aa, Streptococcus pyogenes MGAS8232
MAVEIIMPKLGVDMQEGEIIEWKKQEGDTVNEGDILLEIMSDKTNMELEAEDSGVLFKITRQAGETVPVTEVIGYIGAEGESVEVSSPAASDVNVARTTEDLEAAGLEVPKAPAQAASAAPKAALADDEYDIIVVGGGPAGYYAAIRGAQLGGKIAIVEKSEFGGTCLNVGCIPTKTYLKNAEILDGIKIAAGRGINLASTNYTIDMDKTVDFKNTVVKTLTGGVQGLLKANKVTIFNGLGQVNPDKTVTIGSQTIKGRNVILATGSKVSRINIPGIDSKLVLTSDDILDLREMPKSLAVMGGGVVGIELGLVWASYGVDVTVIEMADRIIPAMDKEVSLELQKILSKKGMKIKTSVGVSEIVEANNQLTLKLNNGEEVVAEKALLSIGRVPQMNGLENLNLEMDRNRIKVNDYQETSIPGIYAPGDVNGTKMLAHAAYRMGEVAAENAIHGNTTRKANLKYTPAAVYTHPEVAMVGLTEEQAREQYGDVLIGKNSFTGNGRAIASNEAHGFVKVIADAKYHEILGVHIIGPAAAEMINEAATIMESELTVDELLLSIHGHPTFSEVMYEAFADVLGEAIHNPPKRK

SEQ ID NO: 8701 - protein, 221 aa, Thiomicrospira crunogena XCL-2
MAKKMELISFKLCPFVQRAVIVLKKKNIDFDITYIDLGNPPDWFKDVSPLGKVPVLKVGNEVLFESSVIQEYVDEVTPPSLHPDDPLLKAKNRAWMSFGDELNVAMFKMGHAKSESAFEEIRDGMLKKLHQLEAVHSGKAFFNGADFCLIDAAYAPFFMRLDLMSLACGFSFLDGLPKMKRWSDNLLAEECVKSSVVTELPQMYVGMLKNIDGSYLSTLCQ

SEQ ID NO: 8702 - protein, 319 aa, Synechococcus sp. CC9605
MGAAVATPRLLTRSRRLLASLLLPLIIVGLCLFQAQPADAARGGRMGGGSFRAPSMPRSGGSYGGGSYGGGYRGGGYRGGGLGFPFLIPIFGFGGGGLFGLLILMAVAGVLVNALRGVGNAPSIGGAAAAPAMPRNVNMIQVQLGLLASAKSLQEDLRSLAASSDTSSSAGLQRLLQETTLALLRQPDLWVYANAESGSVPFSSAESTFNRLSMNERSKLDAELTSNVGGQRTSDSSNSTGDADATNEFIVVTLLVASAASAKLPGADTGEDLRQTLRILGSTASSELMALEVIWQPEGRGDVLSANDLVTAYPNLQHL

SEQ ID NO: 8703 - protein, 160 aa, Bradyrhizobium japonicum USDA 110
MRVAVIAVGRLKQGPERELADRYFERFDEAGRKLGFRELSIHEIPESRARDAATRMAEEAAAIGAYIPDKSILVALDERGQNLDSTVFARHLGRWRDEGAGHTIFVIGGADGLSPELRRKAKLAIAFGSATWPHQMVRVMLLEQLYRAATILAGHPYHRA

SEQ ID NO: 8704 - protein, 74 aa, Populus tremula x Populus alba
CMPGMTGYELLKKIKESSSFREIPVVIMSSENVMARIDRCLEEGAEEFIAKPVKLSDVKRLRDYYMASREVRSV

SEQ ID NO: 8705 - protein, 283 aa, Pseudomonas aeruginosa PAO1
MSQTVMIAGCGDVGGRLGEALLADGWRVHGLRRSVDALPQGILPVAGDLQAPECPAQWPSEPLDYLVYSAAASQHDEAGYRAAYVDGLRHVLGWLQAHGQRPRRLLFVSSTGVYAQTDGGWIDEESPALSQAYSGRIMLDAEQVALDSGIPATRVRLAGIYGPGREWLLNQVRQGYRVVSEPPLYANRIHADDAAGLLAFLLRADAGGQALEDCYIGVDDAPVAMHEVVDYLRQRLGVSQWADEHSVRRAGSKRCSNRRARALGWVPRYPSYREGYAAVLGDA

SEQ ID NO: 8706 - protein, 204 aa, Brassica napus
MEIDDPVTNGNTDAVMTESAPPFTPSPPVPASRSSQLTESLKLEHQLLRVPFEHYKKTIRANHRYLEKEVSSVVSSVGDLADNNWSKDVTVSRLTSLVSRLQGLKRKLEEGSNVENLQAQRCRARIDHLDSADAENITEWNNTKLKRILVDYMLRMSYFETASKLSESSNISDLVDIDIFREAKKVIDALKRKEVASALAWCAD

SEQ ID NO: 8707 - protein, 685 aa, Nitrosomonas europaea ATCC 19718
MANGLTIAICSAILALIFSGLWIRRIYAQSAGDSRMQEIAAAVQEGASAYLKRQYLTIGMVGTVLFVIIGLALSWNTAIGFALGAILSGLAGFMGMNVSVQSNVRTAEAARSGLNEALAIAFRGGAVTGMLVVGLGLLGVAGYTALLVSGADETSSISDLIHPLIGFAFGGSLISIFARLGGGIFTKGADVGADLVGKVEAGIPEDDPRNPAVIADNVGDNVGDCAGMAADLFETYAVTIIATMLLGALLFKTGTGDAAVYPLALGAASIVASIIGCYFVKMREGGKIMNALYRGLAVAGGIAFFAYLPITVWFMGGATLTLDGTEVGGGELIMRLFASTTIGLVLTGLMVVITEYYTSTEYPPVQHIANASTTGHATNIIAGLGVGMRATAAPVLAVCASIIVAYSLAGLYGIAIAATAMLSMTGIIVALDAYGPITDNAGGIAEMAGMPESVRAVTDPLDAVGNTTKAVTKGYAIGSAGLAALVLFADYTHGLEHANKLMTFDLSNHLVIIGLFIGGMVPFLFGAMSMEAVGRAAGSVVLEVRRQFKEIPGIMDGSRKPDYSRAVDMLTKAAIREMIVPSLLPVLIPVLVGVFLGPQALGGVLMGSIVTGLFIAISMTAGGGAWDNAKKYIEDGNYGGKGSDAHKAAVTGDTVGDPYKDTAGPAINPLIKIINIVALLIIPLL

SEQ ID NO: 8708 - protein, 480 aa, Prochlorococcus marinus str. MIT 9515
MEQKIIPIILCGGKGTRLWPLSRQSYPKQFLALHGDKNKSLLQQTQERISFLEGITEPIIICNEEHRFLVAEQMRDINVKPKAIILENEGKNTAPAIALGAIKALEEEQEDPLLLILSADHIIRDLNVFSKVLQKGCKSALENNLVTFGIIPNRPETGYGYIESEFVLDKNNIKGSRIKRFIEKPNKELAQKLVKSNKYTWNSGMFVFKNSLIIKELNKHAPLVLRYCKKAIGSSVRDLDFIRIDGDSFSKSPNIPIDIAVMEKTNLGLVLPLDAGWSDIGNWESLWDNEKKDSFGNVIKGKVFNEGSTDCYIKSENSLLVTLGLKDLILVETSDAILAANKNELNKIKTVLNKLEKKGYTEVNTHRKIYRPWGSYTSLIENEKWLVKSIEVNPGSKLSLQMHHHRTEHWIVVKGTAQVELDNRSFVLSENQSTFIPLGSKHRLSNPGKIDLTLIEIQSGDYIGEDDIVRFKDDYGRIND

SEQ ID NO: 8709 - protein, 638 aa, Oryza sativa Japonica Group
MAKSLLVSSLLAVVAAVVVGAGPNPQYCPPSSCGHLGNISYPFRLQGDSRDCVATPRPWYNLSCSSGRAAIQINTGTYYVSSINYTGEVFSVVDATLQDDDTNSSCPLPRSDHLPFPDWYRDYRPADSYGFFDLATASGTWACFVNCSRAITDIMPWYKPVTCLLPNNSFVFVSFVNCAVGELQPSCRYLAMIPFESRHISDNSSQLQNASYTDIIGFIRKGFSVRFPYRPDQYQSPRMSARECLKDSNRFVLAPLVVLTFLAHKYWKTRIAIDAVEKFLRMQEMLGPKRYAYTDIIAITSHFRDKLGQGGYGSVYKGVLLPGDIHVAIKMLDGKSDCNGEDFISEVATIGRIHHINVVRLVGFCSEEMRRALVYEYMPRGSLNRYIFSSERSFSWDKLNEIALGIARGINYLHQGCEMQILHFDIKPDNILLDDNFIPKVADFGLAKLYPREKSFVSDRALRGTFGYMAPEMACRSFGVISSKSDVYSFGMLLLEMAGGRKNADPNANSNSSRAYYPAWVYDQLIVDQQVDEISSAIDMHEKERKLWLVVFWCIQMKSYDRPTMSEVIEMLEGDVDALQVPPRPFFCDGDSTPPPPVPVMDSICLYSSELTAISEEEDVDGITQLDSSCLLGYERSI

SEQ ID NO: 8710 - protein, 484 aa, Shewanella sp. MR-4
MKFKQDFFTQLPEFYSQVYPQGISNPHWLAWSEDAAKLIDLQQPTDALLQGLSGNAAVEGASYYAQVYSGHQFGGYTPRLGDGRSIILGEALGPQGAWDVALKGGGPTPYSRHGDGRAVMRSAVREFLVSEALHHLGVPTTRALAVIGSDMPVWRESQETAAITVRLARSHIRFGHFEFFCHSERGQADKLTQLLNFTLKQHYPNLSCDLAGYKAWFLQVVQDTAKLIAHWQAIGFAHGVMNTDNMSILGDSFDFGPFAFLDTFQEDFICNHSDPEGRYAFGQQPGIGLWNLQRLAQALTPVIPSDDLIAALNQYQHALVQHYLMLMRVKLGLTERADSTAEQDQQDLELIGRFTVLMEKNQLDYSNTWRRFGQLDPSSAHSSLRDDFIDLNEFDAWYQAYQARLGKVTDIEAWQQARNSVNPKYILRNYLAQEAIIAVEEGNLAPLERLHQVLRQPFAEQVEHEDLAKRPPDWGQGLIMSCSS

SEQ ID NO: 8711 - protein, 345 aa, Prochlorococcus marinus str. MIT 9515
MEEKILVTGCAGFIGFHVCKQLIKKGLFVIGLDNLNNYYDISLKRARLKEIENFSKNNIKGEFLFIKADLKDEKILKNISKVHLPKKVIHLAAQAGVRHSIENPRAYINSNLVGFGNVLEFCKDNQVDHLIYASSSSIYGGNKKIPFSEKDFVDYPVSLYAATKKSNELMAHSYSHLFKLPSTGIRLFTVYGPWGRPDMAPMIFTKSILSSKPIKIFNNGEMFRDFTYIDDVSEAILKLLHLPPKYLNDDKNLNSSELPELTPHRIINIGSSNPINLLEFIDILESEINIKAIRVFEKMQLGDVKKTYADTSYIEDLINYKPNTSLKNGIREFVKWYKNFYKLFS

SEQ ID NO: 8712 - protein, 306 aa, Medicago sativa
  misc_feature (280)..(280): Xaa can be any naturally occurring amino acid
MLDAVNEPENTELRHHDRRKCTHDRFMGSNFQLKDSDRPSSSIDSITNRADQILDDADVGECEIPWEDLVIGERIGLGSYGEVYRADWNGTEVAVKKFLDQDFSGAALSEFKREVRIMRRLRHPNVVLFMGAVTRPPNLSIISEFLPRGSLYRILHRPNCQIDEKQRIKMALDVARGMNCLHANTPTIVHRDLKSPNLLVDNNWNVKVCDFGLSRLKHNTFLSSKSTAGTPEWMAPEVLRNEPSNEKCDVYSFGVILWELATLRLPWSGMNPMQVVGAVXFQNRRLEIPKELDPLVARIIWECWQQ

SEQ ID NO: 8713 - protein, 1230 aa, Oryza sativa Japonica Group
MDTCVAAGPNPQECLPFSCGDLGNISYPFRLQGDSRQCVSTPRPWYNLSCSRGKATIHINTRKYYVISINYTRENFLVVDATMQLDDDTNGTSCPLPRSDHLPYMIYWSDLSSIDSYGFKDLVTASDTWACFVNCSRAITNDSRYKPVTCLSGNNSFPYVYVYIYDDYGCCPVKRLQPSCRYLGMIPFDYVYQPGSYDDDIMSNVLQSASYRDIVGFIRKGFRVNFPLYNNDQRAPTIVERCLNNSMSYFKDQISGASIPHLTRALFWTEIHFVQCVSTNHDYTIKLFSVVITIVSAIDVTKLLFEKSFSWDKLNEIALGIARGINYLHQGCEMQILHFDIKPHNILLDDNFVPKVADFGLAKLYPRDKSFVPVSAARGTVGYIAPEMISRSFGVISSKSDVYSFGMLLLEMAGGRRNADPNAANSSQAYYPSRVYRELTRRETSEISDIADMHELEKKLCIVGLWCIQMRSCDRPTMSEVIEMLEGGSDELQSSGKNLPSESTHPNPHQIILLGKANPARLGAMAKSNASRASATRRKFYFLQKSLLVSSLLAVVAADVVGAGPNQQCFPSSCGDLGNISYPFRLASDSRPCVGTLRPWYNLSCSSGRATIQINTRTYYVTSINYTGEIFSVVDATLQDDDTNGTSCPLPRSDHLPYIDYWPPYLGESSTDSYGFVYLATASDTWACFVNCSRARTDTMPWYRPVTCLLPNNSFVFVSFDDCAVGELQPSCRYLAMIPVDRWNLPDNSSQLQNASYTDIIGFIRKGFSVRFPYRPDQYQSPRMSARECLKDSNRYFKERISHPSILNLTRAIFWSETNSEVDCGYEVAPQKDRIFLGTIVSAIDIIKFHFVLFRLVLGSLVVFIFLAHKYWKTRITIDAVEKFLRMQQMIGPTRFAYTDIIAITSHFRDKLGQGGYGSVYKGVLLPGNVHIAVKMLTGSSSCNGDEFISEVSTIGRIHHVNVVRLVGFCSEEMRRALVYEYMPRGSLDKYIFSSEKSFSWDKLNEIALGIARGINYLHQGCEMQILHFDIKPHNILLDDNFVPKVADFGLAKLYPRDKSFVPVSAARGTVGYIAPEMISRSFGVISSKSDVYSFGMLLLEMAGGRRNADPNAANSSQAYYPSRVYRELTRRETSEISDIADMHELEKKLCIVGLWCIQMRSCDRPTMSEVIEMLEGGSDELQVPPRPFFCDDEQFPGVESYNMPSDLTAISEEHEDDDDESICLFESYQ

SEQ ID NO: 8714 - protein, 625 aa, Chlorella sorokiniana
MVDDSAHGAKVAKGSPTFGDGAYSMGASTPRFSVPVDSENKSKVLKIWSFQRPHHLSFHLSWMSFMLAFFATFAAPPMMPVIRNNLDLTKPDIGGASIAAVTGAVFSRILLGAVCDSYGPRYGHGVLQLLCSAATFAMASITNAAGFIICRMVIGFSLATFVPCQFWCSVMFNAKIVGTANAVAAGWGNMGAGLTHLIMPYIFTGMASHQPDFIAWRCAYFVPGFAHIIIGLLVLMFGQDLPDGNYGALRKAGKKDKAKTHMELLVAVKNYRTWLLVLNYGYCFGVELTVDNNISPYLYDQFGIDLHLAGVLGAVFGLSNLFARALGGLASDYASRRFGMRGRLWTLWIVQSLGGVCSILMFYTSHSLGATMAIVVCWSIFVPMGCGATYGIAPFITRRGLGVATGLIGAGGNTGSAITQALFFTGTSMTTTEGFKWMGVMILAVTATLVLMHFPMWGGMLTRANPEVTEEEYYSRDYTAAEKEQGLHRAILNWASESRSNRGFKEQLAKLSADLTAAAPTTAAAVAQHAERACSLLQAACCRNCPLQAPLHPTLQIAPQLYHHRHPPPLSALTKPETSPFVALVCAPFIACFAGRPATPCSYLVSSSPVHQWYVPLTLLTRHFP

SEQ ID NO: 8715 - protein, 306 aa, Haemophilus influenzae 86-028NP
MKKTLTVLGSINADHVISVPYFAKPGETLTGQNYQIAYGGKGANQAVAAARLGAKVAFISCIGSDSIGKTMKNAFEQEGIDTTHINTVSQEMTGMAFIQVAKSSENSIVLASGANAHLGEMVVRQSEAQIAQSDCLLMQLETPLSGVELAAQIAKKNGVKVVLNPAPAQILSDELLSLIDIITPNETEAEILTGVAVADEQSAVKAASVFHDKGIETVMITLGAKGVFVSRKGKSRIIKGFCVQAIDTTAAGDTFNGGFVTALLEEKSFDEAIRFGQAAAAISVTKKGAQSSIPTRQETLEFLEHA

SEQ ID NO: 8716 - protein, 775 aa, Schizosaccharomyces pombe 972h-
MSTISEVGPWELGLSLGSGGPNSSRLAKHRETGQLAVVKPIVGWSELTSSQQARIEGELVLLRLIEHPNVLQLIDVISAQEQLFVVVEYMPGGELFDCMLRKGSFTEQDTAKFLWQILCGLEYCHKLHICHRDLKPENLYLDAHGSIKIGEFGMASIQQPGKLLQTSCGSPHYASPEIIMGRSYDGCASDIWSCGIIFFALLTGKLPFDDDNIRSLLLKVCQGQFEMPSNISPQAQHLLYRMLDVDSSTRITMEQIREHPFLSCFVHPNISIPIISAPIQPIDPLIVQHLSLVFRCSDDPMPLYEKLASQSPLVEKTLYTLLSRHLHPPSSAAVDRNRAVVDDLLGTAASNGQQMDEEEIEQAINIPTLAPYPISYAAESVPRPATSASPFLTPVTTSGTFNYSFNATNPQSILQRPATTSSAVPQLPKSVTPGLAYPHDSSMLSSNYRPPSALSPRNFNVSINDPEVQLSRRATSLDMSNDFRMNENDPSIVGNLAASNFPTGMGPPRKRVTSRMSEHTGNRVVSFPRGSAFNPRVTRFNVGNEQFSNNIDNNNYNQPYANATMNNSRRLRTPSGERSMRADLSQSPASYDSLNVPKHRRRQSLFSPSSTKKKLSGSPFQPKRSFLRRLFSSEPSCKCVYASLVASELEHEILEVLRRWQLLGIGIADIIYDSVSASISARIKRQNSLNLKPVRFRISVLAEFFGSQAVFVLESGSSTTFDHLATEFQLIFEDKGFLDNLELSYFQASASRPVSRMSVSSSPFAVFRQRQSVQS

SEQ ID NO: 8717 - protein, 1613 aa, Oryza sativa Japonica Group
MAMLTAKLTSPPAATTWLPGGGRRSAPPRRATVIRAAAVSYADELVSTAKSVASPGRGILAIDESNATCGKRLASIGLDNTEVNRQAYRQLLLTTAGLGEYISGAILFEETLYQSTTDGKKFVDCLKDQNIMPGIKVDKGLVPLPGSNNESWCQGLDGLASRRTVVSIPCGPSALAVKEAAWGLARYAAIAQDNGLVPIVEPEILLDGDHAIERTLEVAEKVWSEVFFYLAQNNVLFEGILLKPSMVTPGAEHKQKATPEAIAKHTLTMLRRRVPPAVPGIMFLSGGQSEVEATLNLNAMNQEPNPWHVSFSYARALQNSVLKTWQGRPENVEAAQKALLVRAKANSLAQLGRYTGEGESDEAKKGIRHALRPDPPTPRRRLSPESELSALNPPQTPAVQIPPEPSSRPPAAAAAAPEAEGAEALHEISGPAAAAARLVMLLASCLRGRLRLHRRPRPLIMPSPLFLSRNPNPSPPRSATATGTTILSPPSTSASASMSTSGVYVPPMRRLRSVIASTNGSLAPPPSAAAQAQPGGSTLDNIDEWKWKLHMLLRNEDEQEVISRERKDRRDFEQLSQLAERMGLYSRQYSRIVVFSKVPLPNYRSDLDDKRPQREVSIPSGLQREVDALLSDYLARKRTSSGSFPNAAFSRSSSTDSFATDESFLEQQDNQTSTSAVIERIQRRKSLQLRNQQESWQESHDGQSMMEFRRSLPAYKERQTLLEAIAQNQVVVVSGETGCGKTTQLPQYILESEIDAARGATCSIICTQPRRISAIAVSERVAAERGEKIGESVGYKVRLEGMKGRDTRLLFCTTGVLLRRLLVDRNLKGVTHVIVDEIHERGMNEDFLLIVLKDLLPRRPELRLVLMSATLNAELFSSYFGGAPMIHIPGFTYPVRSRFLEDILEITGHRLTPYNQIDDYGQEKSWKMQKQALRKRKSQIASVVEDTVQAADLRDYSARTRDSLSCWNPDSIGFNLIENVLCHICQKERAGAVLVFMTGWDDINALKEQLQANPLLGDPSKVLLLACHGSMASSEQKLIFDRPEPGVRKIVLATNLAETSITINDVVFVVDCGKAKETSYDALNNTPCLLPTWISKASARQRRGRAGRVQPGECYHLYPQCVYEAFADYQLPELLRTPLQSLCLQIKSLRLGSISEFLSRALQSPESLSVENAIEYLKVIGAFDRNEELTILGKHLSMLPVEPKLGKMLIFGAIFNCLDPILTIVSGLSVRDPFLTPFDKKDLAESAKLQFSCRDYSDHLALVRAYEGWREAERDRNGYDYCWKNFLSVQTLKAIDSLRRQFLFLLRDTGLVDENMTACNKWSRDENLVRAVICAGLYPGVSSVVNKEKSISLKTMEDGQVMLYSSSVNGKETKIPFPWLVFNEKVKVNSVFLRDSTAISDSILLLFGGNIKQGGLDGHLKMLGGYLEFFMSRDLASTYLSLKSELDNLIHCKLQNPRMDIQTSEELLSAIRLLVTEDPCNGRFVYGRQEQRSKKAKTMFSAAPMSHGGGGNGGDNAKNQLQTLLTRAGHDNPSYKTKQIKNSLFRSTVEFNGMQFVGQPCANKKLAEKDAAGEALNWLTGGAPSDSRDPQDMDHMSMLQKPPRRKRHHHRRG

SEQ ID NO: 8718 - protein, 627 aa, Mycoplasma pulmonis UAB CTIP
MYKFKFADIGEGLHEGKVAEIYVKLGDTVKEGDSLFSVETDKITSDIPSPTGGVINKILFELGGTVHVGEEIFWIDDGSGPASDSPEPAAAEAKPAAEEHKSSAGDLFGSRRRKPGGSAAAAAPSPAPAPVAAPAPAAVAAPSVAGKVAGKAYTGAVEAEYDVIVIGAGPGGYLAAEEAGKYGLKTLIIEKQYWGGVCLNVGCIPTKALLHATEELYNLEHSHEHNGIVADFKALKIDRQKTWINIQKNKKSVVDKIVGGVKFLMKAAKATSIEGEAKFVGSHELEVNGKVYRGKNIIIATGSLDRKLNLPGFEQAYKDEVVLSSDKLINLDSHLPETLGIIGAGVIGVEFAEVFAMAGTKVTIIQNTDAILANAPLAKEIKTELTNHLKKYGVEFKFNASTTKIEKNQLFFEVGGKEESMKFDKILAAVGRIPTPLNAGEVGIEIGQRNEIIVDDKLMTNVENVYAIGDVTGKNMLAHVAYRHAIRVVESIVGEEEVYPKQEIPGCIYTKPEIAFVGLTEQQAKEAGYDVVTSKYSFSTLGKALASSEGNGFVQLVVDKKYGRILGCHIIGKNSTDYIAEIVLAMDNEISVFEIAATIHPHPTYGEIVWEAARALSLKLNIEKHKK

SEQ ID NO: 8719 - protein, 444 aa, marine gamma proteobacterium HTCC2143
MKDVHLQKTMGPFTATMLGVGAMVGAGIFVLSGIAAGYAGPAVILAFFLNALIALAIGSCYAELGSAMPRAGGSYFWVKTALGRSAGFAVGWIGVYANTIVSALYALGFGAFFVALLQRLGVGISDDYVLVFAALITVAITYLQYRGIRDLGVVENSVTVIKVLLLCALVVGGLIIISSSNGGVGKLTPFAPHGMTGVLMAMAVIFVAFEGFEVITRTGEEMHQPEKNIPLAIYASIGISVSLYLLIAVILIVAVTGPDDQPSWQYLGDLGELGMATTARQLLPYGDVIFYIAGIASTASAMIAATYSAVRVTFALGRAGDLPALLGYIHPLHNSPSNAAIASGAIVLAIVMILPISEVAGAASQMFALLFAVVCFAAWRLRFTQPRMIRPFRARLLPLCASVGMLAGSVVMITLLNISPLAWWISFVWLAIGGVIFVIRSPAR

SEQ ID NO: 8720 - protein, 315 aa, Mycoplasma pulmonis UAB CTIP
MALISPIARRLAKEKQVDISLIKGSGHDGKILESDVLKFIAEQQNAPKAAEPAPAPAATSAAPAAAPAAAAAPVSPSKEVAKLEARREKVTTIRKAIARAMKNSQDNVAYVSLVHEIDMTKLWDLRKSVVEKVKDLTGIKLTFLPFILKAIAIAIKDFQIFGAKYDEKTEELVYPDTVNLGVAVDTDHGLMVPVIKNAQSLNLVEFSQEIIRLANLARTKTIKPADMSGATFTITNYGSVGSLFGTPVINYPELAIAGVGAIVDKVYWKNGAAVPGKVMWITIAADHRWIDGATMGKFISKVKSLLEQPEILGVF

SEQ ID NO: 8721 - protein, 495 aa, marine gamma proteobacterium HTCC2143
MGNPTGFMKVERALPEDREPAARLNDWLEVHEHMDMADIELQASRCMDCGVPFCQSAKSEYAPVVAGCPVNNLIPEWNDLIYRGRWEDALKSLHKTNNFPEFTGRVCPAPCEGACVLGINADPVTIKHHEVAIIDRGFEEGWVVAQPPSSRSGKTVAVIGSGPSGMAAAAQLNKAGHLVTVYERADRIGGLLMYGIPNMKLQKEIVQRRVDLLAEEGVVFVTNTEVGKTISAEKIEQDFDAVVLCVGATVPRDLQAPGRELKGIHFAMDFLRTNTKSLLDSEHKDGNYISAEGKNVIVIGGGDTGTDCVGTSLRHHCESVIQLEIMPQPPGSRASSNPWPQWPKRLLIDYGQEESIAVQGADPRDYLVQTTKIEGDENGNVTAVHTVDIEWERTSDGHMIPKEVAGSEKVHPADIILLAMGFMGPEGPLVDQFGLEKDPRSNILAEYDQFATSKPGIFAAGDGRRGQSLIVWAIDEGRRAAREVDSYLMGKSYLP

SEQ ID NO: 8722 - protein, 417 aa, Rickettsiella grylli
MSFSPVLKTHRTPKKCLLWLSLLGPGFVVMLADTDAGSLITAAQSGAVWGYRLLALQFLLMPILYIAQELTVRLGITTGMGHGELIKHYFGKVWAWLSVTTLVVSCIGAILSEFSGLAGVGALFNIPAWETLSLVVTFLTIVAWTGSYRSVERVAILLGLFELIFLWVAWDARPVGREILSGLIHIPWQNKSYLYLLAGNIGAVIMPWMIFYQQSAVLDKGLNASHLRIARWDTAIGAIITQLIMASLLIATAATIGKINPEASLNTVQQISQAITPSLGCTVGRVLFALGMTGAALVASIVVSLTAAWGLGEVMGFRRSLEHRPKDAPWFYGIYTLILVLGGLLVASGRVNLVHLSVGVEVMNALLLPFVLGFLYLLALRALPKEVSLKPLYAILVGIILLVTSSFGLFGGLSGIL

SEQ ID NO: 8723 - protein, 153 aa, Desulfotalea psychrophila LSv54
MKHEILLLGKIKDSFIAEGVEEYLKRLQHYTKVELRYLKGKGKKGALLSTEQEGELLLANVPANAFVVALDVQGKNLSSEGLAEQVINWENTGTRSVCYLIGGPLGLSPSLLARADLRLSFSKMTFTHDMVRLLLVEQLYRAYTIKAGEKYHK

SEQ ID NO: 8724 - protein, 581 aa, Oryza sativa
MAGRSELVVSFGEMLIDFVPTVAGVSLAEAPAFVKAPGGAPANVAIAVARLGGGAAFVGKLGDDEFGRMLAAILRDNGVDDGGVVFDAGARTALAFVTLRADGEREFMFYRNPSADMLLTHAELNVELIKRAAVFHYGSISLIAEPCRSAHLRAMEIAKEAGALLSYDPNLREALWPSREEARTKILSIWDQADIVKVSEVELEFLTGIDSVEDDVVMKLWRPTMKLLLVTLGDQGCKYYARDQKKLEEAIKFANACGAITATKKGAIPSLPTEVEVLKLMEMLEAWKYCDAVMLLLLYMMQKLPWCLVWYEVDATSHVFGWKPEAAWPREPARVPEPRHSIRRASRCKPRARAVVADRPVAAAVSLCTRLSPVSPLRSKPPRRHRRRHRPAPPLRAQAAKGQRQHPSSLCRVAPAHLLLFPESAKGQAPFLPLLFPFFLLAGVILPVAALAATAERQLAPLTAQVGSQTDIAAHLNPSLPFPSSSIRLRAIAAAPVLCLASAVLRRAPGEPVRSRTRKGTSAALSSSSSPARGRRDYSRAVGLSSQRPVPHGATSAPAQPRSGRADPGQSLPVRAFHREP

SEQ ID NO: 8725 - protein, 338 aa, Rickettsiella grylli
MTIRVAINGYGRIGRNILRAFFENPTLHDIQIVAINDLGNIDINAYLTSYDTTHGKFAGSITIDKDCLIINHQPIKIFSERDPKNLPWKALDIDVVHECTGLFTSAEKAGKHIKAGAKKVIISAPAGKEVDATIVYGVNHHILKKSHTIISNASCTTNCLAPLAKALHENLGIVHGLMTTIHAYTNDQVLIDTYHSDLYRSRSATHSMIPTKTGAASALGLVYPELDGKLDGLAIRVPTLNVSLVDLSFQAERKTTSDEVNALLKKASEHNPLKGLLNYSELPLVSIDYNHNPASATVDAVQTRVIGNFVKVLAWYDNEWGFSNRMLDVTTALMNVST

SEQ ID NO: 8726 - protein, 409 aa, Nostoc sp. PCC 7120
MKAVVFHGIGDIRLDNVPEPKIKEPTDAIIRLTSSAICGTDLHMIRGTFTGMKPGTILGHEGVGIVEELGSNVRNLQVGDRVVVPSTIACGYCSYCRSGYHAQCDNANPHGHNAGTAFFGGPEAAGPFDGLQAEYARIPYANAGLVKLPKEVTDDQAILLSDIFPTAYFGADIAEITPGDTVAIFGCGPVGQFAIVSARLFGAGRIIAVDTIPSRLEMARDLGAEVIDYNAEDPIEAIRELTGGIGVDRVIEAVGVDANAPDSGPAAKKARQEAQQFQQQLQQIAPETNPQNGNWHPGNAPSQALEWSIQALAKAGTLSIIGVYPPTHNFFPIGTAMNKNLTINMGNCNHRKYIPLLVDLVRNGTVDPTKVLTQVEPLMSVIDAYKAFDQRQPGWVKVELVPGAALANV

SEQ ID NO: 8727 - protein, 173 aa, Oryza sativa
MSAAPIPREWVGLQQFPAATQTKLHELLGKLKEENVSTLTILVMGKGGVGKSSTVNSIVGERVATVSAFQSEGLRPMMCSRTRAGFTLNIIDTPGLIERGYINEQAVEIIKRFLLGKTIDVLLYVDRLDAYRMDTLADHVIRAVPNIFGNGRLWANNWGVLPLAQVLPPDGLD

SEQ ID NO: 8728 - protein, 477 aa, Bradyrhizobium japonicum USDA 110
MAAQSGRVTQVIGAVVDVQFEGHLPAILNSLETKNGGNRLVLEVAQHLGESTVRTIAMDTTEGLVRGQEVTDTGSPIRVPVGEGTLGRIINVIGEPIDEAGPVKSEGLRAIHQEAPTYTDQSTEAEILVTGIKVVDLLAPYAKGGKIGLFGGAGVGKTVLIQELINNVAKAHGGYSVFAGVGERTREGNDLYHEFIESKVNADPHNPDPSVKSKCALVFGQMNEPPGARARVALTGLTIAEDFRDKGQDVLFFVDNIFRFTQAGSEVSALLGRIPSAVGYQPTLATDMGALQERITTTQKGSITSVQAIYVPADDLTDPAPATSFAHLDATTTLSRSIAEKGIYPAVDPLDSTSRMLSPLVVGEEHYAVARQVQQVLQRYKALQDIIAILGMDELSEEDKLTVARARKVERFMSQPFHVAEIFTGSPGKFVDLADTIKGFKGLVEGKYDHLPEAAFYMVGTIEEAVEKGKKLAAEAA

SEQ ID NO: 8729 - protein, 335 aa, Dichelobacter nodosus VCS1703A
MAFNIRNRHLLSLANHSYRELRYLLDLARDLKRAKYNGTEQPRMRGKNIALIFEKTSTRTRCSFEVAAYDQGANVTYIDPTSSQIGHKESMKDTARVLGRLYDAIEYRGFKQTIVQELADYAGVPVFNGLTDEWHPTQMLADVLTMMEHSDKPLHEISYVYLGDARNNMGNSLLMIGAKLGMDVRIAAPKELQPTAELQAMCQEFAKESGARILVTDDVAKAVKGVDYVHTDVWVSMGEPIEAWGQRISKLMPYQVNRKLMELTGNPRVKFMHCLPAFHNSETKVGKQIAEQYPDLANGIEVTEDVFESPYNIAFEQAENRMHTIKAVMVASLGD

SEQ ID NO: 8730 - protein, 471 aa, Silicibacter pomeroyi DSS-3
MTLSQFRNVIEADVRAGRLADGLIGEKIMIPGLNGDVPLVYADYVASGRALRQVEQYVSEYVLPFYANSHTEASYCGAYITGLRRAARAEIARLVGAAEDDAVIFAGSGATAGLNRLVSLLGIAQAARPVVFIGPYEHHSNILPWRESGAKVVEIPEAPEGGPDLVVLQTALRAHAGSDLMIGAFSAASNVTGIITDTVPVTRLLKAHGALSIWDYAGGGPYLPIDMGEGGLRKDAIVVSPHKFPGGPGASGVLVVNRGAVRRDVPTWPGGGTVSFVSPWGHDYSPDLAAREEAGTPNVIGDIRAALAFVVKDAVGADEIARREAHYNAMALEGWAGNPHLILLGTDKGHRLPFFSFQVRDGVGRPVHQQLFTRMLSDVHGIQARGGCACAGPYGHRLLGIDRATSEALHADLAAGREMHKPGWVRLNFSYLMDEATVRFIIDAVNDLSRRTGDYVPLYQGDPATARFKAA

SEQ ID NO: 8731 - protein, 509 aa, Bradyrhizobium japonicum USDA 110
MDIRAAEISAILKDQIKNFGQEAEVSEVGQVLSVGDGIARVYGLDNVQAGEMVEFENGTRGMALNLETDNVGVVIFGADREIKEGQTVKRTRAIVDAPVGKGLLGRVVDALGNPIDGKGPIQADKRMRVDVKAPGIIPRKSVSEPMATGLKAIDALIPIGRGQRELIIGDRQTGKTAIALDTILNQKPLNAQPDENIKLYCVYVAVGQKRSTVAQFVKVLEEQGALEYSIIVAATASDPAPMQYIAPFTACTMGEFFRDNGMHAVIIYDDLSKQAVAYRQMSLLLRRPPGREAYPGDVFYLHSRLLERAAKLSKDHGSGSLTALPIIETQANDVSAYIPTNVISITDGQIFLETDLFFQGIRPAVNVGLSVSRVGSSAQTKATKKVAGKIKGELAQYREMAAFAQFGSDLDASTQRLLNRGSRLTELLKQPQFSPLKMEEQVCVIWAGTNGYLDPLPVNKVRAFEDGLLSLLRGKNVEILNSIRDSRDLSDDTAAKLKSVVEGFAKSFA

SEQ ID NO: 8732 - protein, 145 aa, Streptococcus pyogenes MGAS8232
METSDELKQRIGDLSYEVTQHAATESPFTGEYDDFFEKGIYIDIVSGEVLFSSLDKFNSGCGWPAFSKPIENRMVTNHDDSSYGMRRVEVKSREAGSHLGHVFSDGPKEAGGLRYCINSAALKFIPYEQMEKEGYAQWLTLFDET

SEQ ID NO: 8733 - protein, 459 aa, Emericella nidulans
MSNLPVEPEFEQAYKELASTLENSTLFEQHPEYRRALQVVSVPERVIQFRVVWENDKGEVQINRGYRVQFNSALGPYKGGLRFHPSVNLSILKFLGFEQIFKNALTGLNMGGGKGGSDFDPKGKSDSEIRRFCTAFMTELCKHIGADTDLPAGDIGVTGREVGFLFGQYRRIRNQWEGVLTGKGGSWGGSLIRPEATGYGVVYYVQHMIKHVTGGKESFAGKRVAISGSGNVAQYAALKVIELGGSVVSLSDSKGSLIVKDESASFTPEEIALIADLKVARKQLSELATSSAFAGKFTYIPDARPWTNIPGKFEVALPSATQNEVSGEEAEHLIKSGVRYIAEGSNMGCTQAAIDIFEAHRNANPGDAIWYAPGKAANAGGVAVSGLEMAQNSARLSWTSEEVDARLKGIMEDCFKNGLETAQKFATPAKGVLPSLVTGSNIAGFTKVAEAMKDQGDWW

SEQ ID NO: 8734 - protein, 348 aa, Tropheryma whipplei str. Twist
MTDLLSCAPHARGANNRPGFSDRDVQNDGPMRNLVLIAGRSHPDLARATAESLGVGLLQTDIRTFANGEIYTRFNSSVRGKDVFVLQTGCDPVNDGLVELLLLIDSCKRASAKHISAVTPCYPYSRQDRKGYGREPISARLVADLIACAGADRIITVDLHASQIQGFFNGPVDHLTGVPALIKHVKSLRIDNLTIVSPDIGRVKVADVWSDKLNAPLAIIHKRRDPRVHNNVTMHEIVGDVRSRVCLVVDDLIDTGDTLAKAAIALKKAGAVKVIAAATHGIFSTPERLVSCGEIDHVIVTDSVPASKVFDRVKTVSIAPLLACAICEVVTEGSISEMLDCVSKRIDN

SEQ ID NO: 8735 - protein, 155 aa, Schizosaccharomyces pombe 972h-
MANVELQTSLGKILIELYTEHAPKTCQNFYTLAKEGYYDGVIFHRVIPDFVIQGGDPTGTGRGGTSIYGDKFDDEIHSDLHHTGAGILSMANAGPNTNSSQFFITLAPTPWLDGKHTIFGRVVSGLSVCKRMGLIRTDSSDRPIEPLKIIKAVAL

SEQ ID NO: 8736 - protein, 605 aa, Schizosaccharomyces pombe 972h-
MTTGYESVPTSEPSDNLAPRAELWQRHLLEKKEGDQSISVSAFNISSMHNELSGLSEKSRQRVEAVWAAFSEASCSERKLALQGILNNCSSSLLSFASSTLDSLVRLDFLSLLPVEISFRILSFLDARSLCQAAQVSKHWKELADDDVIWHRMCEQHINRKCEKCGWGLPLLERNTLYAAKASIQKRYERLTKRGVDQAHESSPVKKAKLDDYPTSSNEETISSVKPPSPNSDSKFFLPFKTRPWKEVYAERCRVECNWRHGRCRQVVLSGHSDGVMCLQLVRNILASGSYDATIRLWNLATFQQVALLEGHSSGVTCLQFDQCKLISGSMDKTIRIWNYRTSECISILHGHTDSVLCLTFDSTLLVSGSADCTVKLWHFSGGKRITLRGHTGPVNSVRIIRDRGLVLSGSDDSTIKIWSLETNTCLHTFSAHIGPVQSLALADSRLFSCSLDGTIKQWDIEKKKCVHTLFGHIEGVWEIAADHLRLISGAHDGVVKVWEACECVHTLKNHSEPVTSVALGDCEVVSGSEDGKIYLWLFNNAPNESPVSTQSVPISSLNGQRSNSSVQRALSSVPNYSSSLSNISTRNLNIPPSNANNDDVSIQS

SEQ ID NO: 8737 - protein, 451 aa, Sinorhizobium fredii
MITPVPQHNSLEGTPLEPAISSLWSTAKRIDTRVVRGRITRAVGTLIHAVLPEARIGELCLLQDTRTGLSLEAEVIGLLDNGVLLTPIGGLAGLSSRAEVVSTGRMREVPIGPDLLGRVIDSRCRPLDGKGEVKTTEVRPLHGRAPNPMTRRMVERPFPLGVRALDGLLTCGEGQRIGIYGEPGGGKSTLISQIVKGAAADVVIVALIGERGREVREFVERHLGEEGLRRAIVVVETSDRSATERAQCAPMATALAEYFREQGLRVALLLDSLTRFCRAMREIGLAAGEPPTRRGFPPSVFAALPGLLERAGMGERGSITAFYTVLVEGDGTGDPIAEESRGIVDGHIVLSRALAARSHFPAIDVLQSRSRVMDAVVSETHRKAASFFRDLLARYAECEFLINVGEYKQGGDPLTDRAVASIGELKEFLRQSEDEVSDFEETVGWMSRLTS

SEQ ID NO: 8738 - protein, 664 aa, Zea mays
MSPSNPLPPPGETRVGCSLPSPVTPQAMGGGPARHVAMRALRARFLSRQREGGPAAASTWWWCASGSAKGDMESTLKGIRGSDAPCVLDLDDAATVAGGVEDTYGEDRATEEQLVTPWTVSVASGYNLLRDPRYNKGLAFTERERETHYLRGLLPPAIVSQELQERKIMNNIRQYQLPLQRYMALMDLQEGNERLFYKLLIDNVEELLPIVYTPTVGEACQKYGSIFSRPQGLYISLKEKGKILEVLKNWPERSIQVIVVTDGERILGLGDLGCQGMGIPVGKLSLYTALGGVRPSACLPITLDVGTNNEELLNDEFYIGLRQRRATGQEYTDFLQEFMTAVKQNYGEKVLIQFEDFANHNAFDLLARYGTTHLVFNDDIQGTASVVLAGLIAAQTLLGGSLADHTYLFLGAGEAGTGIAELIALEISRQTKAPIEECRKKIWLVDSKGLIVSTRKESLQHFKKPWAHEHKPLSNLLDAVNAIKPTVLIGTSGKGQAYTKDVVEAISSFNERPIILALSNPTSQSECTAEQAYTWSKGQAVFATGSPFDPVEYNGKIHVPGQANNAYIFPGFGLGVVMSGAIRVHDDMLLAASEALAQQVTEENFEKGLIYPPFSNIRKISAHIAASVAAKAYELGLASRRPRPKDLVKYAESCMYSPIYRNYR

SEQ ID NO: 8739 - protein, 298 aa, Schizosaccharomyces pombe 972h-
MSTEEQKEEIKDISSKQENSSEVPKAEEAGKVVESQKDTTSEEKKEETTEKKEDDGKKDLSFDEAEVLKQVEFYFSDTNLPHDKFLWTTSQKNDGWVPIQTIANFKRMRRFQPLEAIVNALRKSPELLEVDEAGEKVRRMIPLVRVDNKSVMERSVYCKGFGDEKDDTQIALEKFFEENAGPISAVRMRRDDDKKFKGSVFVEFKEPDVANKFLEKVKTAPLKWGEDELTIMSKKEYVDMKAELHKNDPPKFSSKRRRFDAFKEMDRQRPGKYSNRGRKFKKQRSSNASEEKPSAASE

SEQ ID NO: 8740 - protein, 465 aa, Aspergillus oryzae
MADVGDRMFCHACGGVWLRRDHGLECPHCHSEFTEIIEIPPDTEEEVPDPPTSVPEDRSAPPRNPWADHNPWDHDNMNTDTPDWGSGNGFRHHTYRSPDGRFTFSSTTYTRRGSSGQQMPVDPLMPMVRGLDTIFHGLADTYRQTEYRQPNERDSSPGLWRTDRQNQGFGPNGSRIYSTSFDIDMNTRSNGGVGSEFHTTGGLHPRDADGPQPMGTPLRTLGEYVLSLGCGEIEKVTDLYSILELFRADFGNNGPPGGGPGVRVMTGPNPIAILSTLLNLDRHGDAVYSQEELDRVISQLIDQNARGTAPPPAAPNEIQSLPKKKVDQEMLGSEGKAECSICMDPVELGTEVTVLPCKHWFHYNCIEMWLSQHNTCPHCRRGINIPAGPEGSSDNPVVINSSPETSPRRPSGAAPEHSGQSPPRWNGPGPETGGQEQDQGQSSRNDNQGGGFAGWVRSHFGGGNQ

SEQ ID NO: 8741 - protein, 324 aa, Picea sitchensis
MDWYEEMNKGAHSQGQPTVPRAGALLKKKPGAPPSGARGWFEVRLFYVRVSSCPLEGAPQSLTLRHHHRTVGVALEINGTRIPPAESVSLTLRRDRVDKESAEATYVSTDSVRTTGTLDFEVCYDEETLLLCGALERLEQGSDHQGVKELWGMDCCSAIGPGVCPFGKLGKQQQDFSSGPPTLEVYVAGCCGGSPIILTKTVQLVSRRKPHRRGTLDVIPEDEDETEKAQIKTIVLSGHHSHSHQISEDRDYEELDGKVESSLGSFYPEGGYIEGEDGELTWFNAGVRVGVGIGLGMCLGIGIGVGLLMRTYQATTRTFRRRLF

SEQ ID NO: 8742 - protein, 485 aa, Picea sitchensis
MQTLAAVLLFLAALSPVFARELSTQKDIYSTLDVQATLRVARGEVVQPAKEETLEIKPWSIPLVHRDAMKGNSNKNNELSYAERMQQRLKRDAARVAAINSRLELAVNGIKRSSLKPDSSSSFTMAESDFQSPVVSGMDQGSGEYFSRIGVGAPRRDQLMVLDTGSDVTWIQCEPCSDCYQQSDPIYNPALSSSYKLVGCQANLCQQLDVSGCSRNGSCLYQVSYGDGSYTQGNFATETLTLGGAPLQNVAIGCGHDNEGLFVGAAGLLGLGGGSLSFPSQLTDENGKIFSYCLVDRDSESSSTLQFGRAAVPNGAVLAPMLKNSRLDTFYYVSLSGISVGGKMLSISDSVFGIDASGNGGVIVDSGTAVTRLQTAAYDSLRDAFRAGTKNLPSTDGVSLFDTCYDLSSKESVDVPTVVFHFSGGGSMSLPAKNYLVPVDSMGTFCFAFAPTSSSLSIVGNIQQQGIRVSFDRANNQVGFAVNKC

SEQ ID NO: 8743 - protein, 466 aa, Bradyrhizobium japonicum USDA 110
MATYDLVVIGTGPGGYVCAVRAAQLGMKVAVVEKNATLGGTCLNVGCMPSKALLHASEMFEEAAHSFAKMGVSVSEPKLELPAMMNFKQQGIDGNVKGVEFLMKKNKIDVLKGTGKILGTGKVEVSADGKSQVVETKSIVIATGSDIARLKGIEIDEKRIVSSTGALSLDKVPGKLLVVGAGVIGLELGSVWKRLGAEVVVVEFLDRIMPGMDGEIAKQFQRILEKQGFAFKLGAKVTAVDTSGKTLKATIEPAAGGAAETLEADVVLVCIGRVPYTDGLGLKEAGVALDNRGRVQIDPHFATSLKGVYAIGDVVAGPMLAHKAEDEGVAVAEIIAGQAGHVNYDVIPGVVYTTPEVSSVGKTEEELKQAGVAYTVGKFPFTANGRSKVNQTTDGFVKILADAKTDRVLGVHIIGREAGEMIHEACVLMEFGGSAEDLARTCHAHPTRSEAIKEAALAVGKRAIHM

SEQ ID NO: 8744 - protein, 542 aa, Triticum aestivum
MPPQLRFPTVLPNLYPHLLLPRSLPSRRLRLPPPPTPRHPLRRLLFRGMASSATGEAAPAAGTSGAGEASARPRRALEELAWDETFVRELPGDPRSDNIPRRVLHACYTKVSPSAPVENPKLVAWSESVADLLDLDHKEFERPDFPRFFSGETPLVGSVPYAQCYGGHQFGSWAGQLGDGRAITLGEVLNSRGERWELQLKGAGKTPYSRFADGLAVLRSSIREFLCSEAMHGLGIPTTRALCLVETGKSVVRDMFYDGNAKEEPGAIVCRVAPSFLRFGSYQLHATRGKEDLEIVRRLADYTIRHHYPHLENIKKSEGLSFEAAMGDTPAIDLTSNKYAAWAVEVAEHTAYLIARWQGVGFTHGVLNTDNMSVLGLTIDYGPFGFLDAFDPSFTPNTTDLPGKKYCLANQPDVGWWNIAQFTGPLSAADLISKDEANYVMERYGTKFMDEYQSIMTKKLGLSKYNKQLISKLLNNLAVDKVDYTNFFRLLSNVKADRDIPETELLVPIKAALLDMGKDRKEAWISRVQTYIEELVATGVSD

SEQ ID NO: 8745 - protein, 414 aa, Bradyrhizobium japonicum USDA 110
MTEIRVPTLGESVTEATIGRWFKKAGDPVAVDEPLVELETDKVTIEVPAPSAGTLSEIIAADGATVAVGALLGQITEGAAGAAKPAAAPAKPAAAPAAAAAAAAPAPAAKAPPADAPLAPSVRKLSAETGIDASTVPGSGKDGRVTKGDMLAAIERAASAPTPVNQPAAAVQVRALSPADDAAREERVKMTRLRQTIARRLKDVQNTAAMLTTFNEVDMTNVMALRAHYKDAFEKKHGSKLGFMGFFTKAVVQALKDIPAVNAEIDGTDLIYKNYYHIGVAVGTDKGLVVPVVRDCDHKSIADIEKGIADFGRRARDGQLKIDEMQGGTFTITNGGIYGSLMSTPILNAPQSGILGMHKIQERPMVVAGKIEVRPMMYLALSYDHRVIDGKEAVTFLVRVKESLEDPARLVLDL

SEQ ID NO: 8746 - protein, 200 aa, Synechococcus sp. RS9916
MQACQSDDSSLICGMPANSASSSLSGLQKGLLVVTALVLAVVLFLLRNGLSAESPMDQLARRSLAPEVALSNQKPTMLEFYADWCEACREMAPAMLETERRTNGQMDVVLVNIDNPQWQDLIDRYEVNGIPQLNLFAADGSLRGRSLGVRTPQQLEALSTALIANTPLPQFAGIGSVSRLEDGDGIATATPTSAGPRSHG

SEQ ID NO: 8747 - protein, 398 aa, Bradyrhizobium japonicum USDA 110
MNIHEYQAKALLGEFGVPISKGVPVLKAADAEAAAKALPGPVYVVKSQIHAGGRGKGKFKEASAGDKGGVRIAKSAAEVSEFAKQMLGATLVTIQTGPAGKQVNRLYIEDGSDIDKEFYLSLLVDRETSRVSFVVSTEGGVNIEDVAHNTPEKIVTFSVDPATGIMGHHGRTVANALKLSGDLAKQAEKLTAQLYAAFVAKDMSMLEINPLVVTKQGQLRVLDAKVSFDDNALFRHPEVLALRDETEEDAKEIEASKYDLNYVTLDGNIGCMVNGAGLAMATMDIIKLYGMAPANFLDVGGSASKEKVAAAFKIITADPNVKGILVNIFGGIMKCDVIAEGVTAAVREVGLSVPLVVRLEGTNVELGKKIILESGLNVVPADNLDDAAQKIVKAVKGG

SEQ ID NO: 8748 - protein, 406 aa, Tropheryma whipplei str. Twist
MTAHNTPKVHCVIRQALRGQRIGPRQLAEQIGVDIKQLWSWLEPTWSQTLDIPQSILHDLEDAIDDTSAFYNTQHLLSIDQINRRSLERLFYVTDMFQPLARRQVRCNILNGAVLVCLFYEASTRTRFSFSTAFSRMGGAVVTEADMLQSSSVAKGESTSDTSRVISGYADIVVVRHSELGFAERYASDSLVPVINAGDGSGEHPTQAILDVYTIESEFLYREKTIDGSCIAIIGDLKHGRTVHSLIKLLSLYEGLTFKIFSITDLELPNDFHDLLSGRGHTLEVCDSLRNAVNAADVIYATRVQTERIAQDLTAVTGCRLTREVLDDCKKDVIVLHPLPRDSRPDALDIGTDLDSYSGFMPFGQANNGVPVRMAIFSEILGITDKIEFADSIPWARRIPYPQALP

SEQ ID NO: 8749 - protein, 577 aa, Gibberella zeae PH-1
MAVEKVTSDAPVVGEKSVVRDVDERAPEAFTATGEEYEQEDFMTRTGLNAKSFTRKHYGLGLVELDRKMKPRHLQMVAIGGSIGAGFFVGSGSALSKGGPATLFIDFFLVGVMVFNVVYAMGELAVMYPISGGFYTYAARFIDPAFGFAMAWNYCLQWAATLPLELTVCAITIQYWAPDSNPGIWIAVFLIAIIILNMFGTMGYAEEEFWAACFKLTSISIFMIIALVLVCGGGPSSGSYSTYQGFKLWEDPGAFKNGFKGFCSVFVTAAFSFAGSELVGLAAAESRNPTESVPKAIKQVFWRICLFYIVALLFVGMLVSCNDENLLSSSSYSNSAASPFVLVGKYSGLKGLDHYMNAVILSSVLSLGIASVYGGSRTLLALAQQGFAPKIFTWVDRAGRPLPSVGFIIAFGCLAFLNLDAAGPVIFDWLLALSGLAMLVCWGSICLAHIRFRAAWKYNGHTLDEIPFKAIGGVYGSWVGLIFVVVILIAQFYVAIVAPVGESGMGTVEDFFMQYLGLPIVLAFWAGGVIWKRTSWISIDKIDIDTGRREHDWDSINAWRAELATFPWWKRLMYTLF

SEQ ID NO: 8750 - protein, 359 aa, Glycine max
MANFTSFSSSLTHIPPISAPSSSAAFDDSSEDSCSICLEPFSVHDPSTVTCCKHEYHLHCIIEWSQRSKECPICWQSLALKDPASQELLAAVEDEKCMRSRNIANSRAPLGQLNESHDDSCSDDSDFDDQIMKRLVSAARRAHFVQRQERKRSPSAGPSEALGVNSSMHVSEVQTTLTTSSSGGSLPASGVPSTVSIQPPALNTTPESARRPNTSEISFPESFKSKFSAASARYKESISKSTLGLKEKLLAHNVSVKELSKGVQREMNAGIAGVARMIERLDLSSKRSSAPLIAVHSVATSDFPSSGKSVEENGIGGSPSKENGGAVHDVSSDVPPLVTNMQSFRTKTPPFLQSGHGMV

SEQ ID NO: 8751 - protein, 438 aa, Magnetococcus sp. MC-1
MRITMIGTGYVGLVSGACFSEFGVDVTCVDKDVSKIERLNKGEIPIFEPGLDQLVVRNKDAGRLHFTTDTNTAVANSDVVFIAVGTPERRGDGAADLRYVFDAARDVARAMQGFTVVVTKSTVPVGTGARVAEIIRETKPDADFAMASNPEFLREGSAIEDFMRPDRVVVGVDSDRPVALLKELYRPLYLIETPILFTNIATAELTKYAGNAFLATKIMFINQIANLCEKVGADVHDVAKGMGLDRRIGRKFLHPGPGYGGSCFPKDTAALANTARDHNTPMTIVENVIEANKWQKQRMITKIRDAMQGKLRGKTIGVLGLTFKPNTDDMRDSSSLTILPALAGDGARIQAFDPEGMHEAKRMMPELHYCDDAYSACQGADAVVILTEWNQFRNLDLDRIKAGMQTDSEGLYPFFDLRNIYVPADMRAQGFAYVGVGR

SEQ ID NO: 8752 - protein, 557 aa, Schizosaccharomyces pombe 972h-
MDFNNIPLATIKSSDDKGKDFIVEMTTRPSETKKKVPFSEDMREIPSLPNEEEANATDPQANEVADENGEGFEAEKISSWIWVLSAVAGISGLLFGYDTGVISGALAVLGSDLGHVLSSGQKELITSATSFAALISATTSGWLADWVGRKRLLLCADAIFVIGSVIMAASRNVAMMVVGRFIVGYGIGLTSLIVPMYITELAPARLRGRLVIIYVVFITGGQLIAYSLNAAFEHVHQGWRIMFGIGAAPALGQLISLFWTPESPRYLLRHNHVEKVYKILSRIHPEAKPAEIAYKVSLIQEGVKVDFPEGNKFQHFFHSLKVLFTVPSNRRSLFIGCFLQWFQQFSGTNAIQYFSAIIFQSVGFKNSISVSIVVGATNFVFTIVAFMFIDRIGRRRILLCTSAVMIAGLALCAIAYHFLPADTTQNTNSGWQYVVLASIIIFLASYASGIGNIPWQQAELFPMEVRALGAGFSTAINWVGNLIISASFLTMMESITPTGTFALFAGFCFVGLVTSYFTYPELAGMSIENIHKLLEKGFWQAVKESTKRVRKGRIDEA

SEQ ID NO: 8753 - protein, 93 aa, Oryza sativa Japonica Group
MKEATSSGGGGGGGAGVNDPRQPSTARQYTPPKLSPQDLPIDYAGFLAVVFGVLGVMLRYKVCSWIAIIFCAQSLVNMKNFENDLKQLSMAFM

SEQ ID NO: 8754 - protein, 268 aa, Oryza sativa
MVGGGRRGAAAEEVKLSTGNVFAALETLKKKKKGGDKAKDDYFATTAPPRPVWGTGHGDDGAKEEDEEDDDDAVHAALQEEVESEDEDLDDEVDDGAVDEPEHEVDDTSAEPAGKKAAVPVAPPKDTERQLSKKELKKKELAELDAVLAELGISGGSSNAAQDENNAEKKGSNQTGDGDAPAPSESKSSKKKKNKKAKEAKESQEPADGTEETASAEPDEDTTSVDVKERLKKMASMKKKKSGKESDTAAKIAAAEAAARSASSLLPP

SEQ ID NO: 8755 - protein, 77 aa, delta proteobacterium MLMS-1
MAVEQKLIDIIAEQLSVDKDKVVPKASFIDDLGADSLDLVELIMAMEEAFDIEIADEVAEKITTVQDAIDHIKQISE

SEQ ID NO: 8756 - protein, 439 aa, Shewanella sp. MR-4
MSKSANKIGVVQLTIITIVNMMGSGIIMLPTQLAQVGTISILSWLVTAAGSTALAYAFAKCGMFSKKSGGMGGYAEYAFGRSGNFMANYTYAVSLLIANVAIAISAVGYAAVLLEVNLSPMAICLATIGVLWLATVANFGGARITGRVSSVTVWGIILPVIGVSLIGWFWFDIDLYKGAWNPHDMPFFKALGGSIAMTLWAFLGLESACANSETVDNPEKNVPIAVMGGTLGAALIYIVSTNVIAGIVPNAELANSNAPFGLAFAQMFNPVVGKIVMACAIISCTGSLLGWQFTIAQVFKASADEGFFPKVFSKVSKADAPIWGMTIIVSIQTLLSLMTISPSLSKQFEALVNLAVVTNIVPYILSMAALGVMQKQLKVPANKARVANVIAVIGALYSFYALYSSGETAVMLGAIATFFGWTIYGVISNKTPTAEIKAA

SEQ ID NO: 8757 - protein, 40 aa, Glycine max
FAAEEFKVPPQTSAIITNGNVFLKHGSELRLIPRDRVGAF

SEQ ID NO: 8758 - protein, 386 aa, Haemophilus influenzae 86-028NP
MSVIKMTDLDLAGKRVFIRADLNVPVKDGKVTSDARIRATIPTLKLALEKGAKVMVTSHLGRPTEGEFTPEDSLQPVVDYLKNAGFNVRLEQDYLNGVDVKDGEIVVLENVRINKGEKKNDPELGKKYAALCDVFVMDAFGTAHRAQASTYGVAEFAPIACAGPLLAAELDALGKALKEPARPMVAIVGGSKVSTKLEVLNSLSKIADQIIVGGGIANTFIAAAGHNVGKSLYEADLMPVAKELAANTDIPVPVDVRVGLEFSETAAATEKAVNEVKDDESIFDIGDKSAEQLAEIIKNAKTVLWNGPVGVFEFPHFRKGTEIISHAIANSDAFSIAGGGDTLAAIDLFGIADKISYISTGGGAFLEFVEGKVLPAVEILEKRAKN

SEQ ID NO: 8759 - protein, 393 aa, Desulfotalea psychrophila LSv54
MLKENKIVYMDNNATSKVAPEVLEEMIPYFSEYYGNASSMYTFGGQVAAAVNTARQQVADLLGASADEITFTSCGTESDSTAILAALRTHPEKRHIITTRVEHPAVKSLCDNLEVATGHRYRITRLKVDAEGMLDMDAYREALCEDTAIVSVMWANNETGVIFPVEEMAQLAKSRGALFHTDAVQAVGKIPINMAENEINFLALSGHKLHAPKGVGVLYVRKGTMFTPFLIGGHQEHGRRGGTENVASIVGLGKACELAGQMLETENSRVRALRDRLEEGLLASVPKALLNGNKTHRLPNTSNISFEFVEGEAILLYMNEHNICASSGSACTSGSLEPSHVLRAMGVPFTAAHGSIRFSLSVYNTEEEVDFVLDKMPAIIASLRKMSPFWKEA

SEQ ID NO: 8760 - protein, 277 aa, Desulfotalea psychrophila LSv54
MWEYTNKVQQHFLQPQNVGEIENASGTGDVGSLACGDALKLTIAIDANDIITDAKFKTFGCASAIASSSVLTEMIVGMSVEEAVKVTNEDIAERLGGLPKEKMHCSVMGREALEAAIADYRGTILPMAEGEVICDCFGVTDVEVIRAITESNLHSVEEITNFTKAGGGCGKCEDKLRELLVKTMKEQAGTAVVAKEPKRMTALQKIKKIEEVLDKVIRPVLKKDDGDIELVDVDGDFVTVSLRGACKSCSNSQTTIKEYVEKKLRELVLESLIVEED

SEQ ID NO: 8761 - protein, 320 aa, Lactobacillus reuteri
MAKRKMILDLDTGVDDALAIAYALADPEVDLIGIVSSYGNNLLDVCAENSLKLLELLGHTDIPVFKGLPHSCTTEHFDVMQVSKDIHGDNGIGDVELPAPSRALEEQSGVDFYIEAAHKYGKDLIIIPTGPMTNLAAALKKDPEIADLIGNVTFMGGALTVEGNVTPVAEANINQDPKAADEVMKSNLPLTMVGLDVTLRTLLTKNETKQWRELGTASGKAFADITDFYIDAYYNLDIDKRGCALHDPLAVGVGIDPSFVSTISLFMKVVYQEGPYYGRTIGDNAKLNDPNPNVKVAVNVDKERYLKAFMDHLNKLFKEN

SEQ ID NO: 8762 - protein, 272 aa, Desulfotalea psychrophila LSv54
MTTENIGFIGGGQMAEALIKGLTQSGSYPAENIYVLDPSPERKDFLTATYNINTIEDCGAAFATCQKIFLAVKPQVMSLVLQNCQGIINEDHLLITIAAGLPISSYVKTLALPRLKIIRVMPNTPALVGQSASALTASPYVSQEELDKVQNIFNQIGTTTVLEECHLDAVTGLSGSGPAYVFSFIEALIDAGVAEGLNRQVSTNLALQTVAGSVELLRQNGEHPAVERARVSSPGGTTIAASKILERSGFQAIIMDAVAAATEKSKELGKGK

SEQ ID NO: 8763 - protein, 313 aa, Arabidopsis thaliana
MAALQTLREWIGIQQFPPATQSKLLEILGKYKEEDVSSLTVLVIGKSGVGKSSTVNSVIGEKAAAVSTFQSEGLRPTLVSRTRSGFTLNIIDTPGLIEGGYVNDQAINIIKRFLLNMTIDVLLYVDRLDVYRVDDLDRQVVGAITDAFGKEIWKKSALVLTHAQFSPPDGLNYNHFVSKRSNALLKVIQTGAQLKKQDLQGFSIPVILVENSGRCHKNESDEKILPCGTSWIPNLFNKITEISFNGNKAIHVDKKLVEGPNPNERGKKLIPLMFAFQYLLVMKPLVRAIKSDVSRESKPAWELRDSGLASRRS

SEQ ID NO: 8764 - protein, 243 aa, Ralstonia metallidurans CH34
MLQSREGQRVPNVTFRVRANNEWKDVTTAELFDGKTVVLFSLPGAFTPTCSSTHLPRYNELAPVFAKQGVDAILCVSVNDTFVMNEWAKDQESENIVMIPDGNGEFTDGMGMLVDKADLGFGKRSWRYSMLVKDGVVDKMFIEPEEPGDPFKVSDADTMLNYIAPTAKQPDQVVVFSKIGCSHCAKAKQLLSDNGFEYIDVPLENKIRGKVLGAVSGEMTAPQVFINGKLVGGAEALEQYLAR

SEQ ID NO: 8765 - protein, 445 aa, Oryza sativa Indica Group
MAMSSSRSAAAIRGRRVGALARARRHATRAMASLFGHVEPAPKDPILGVTEAFLADPSPDKVNVGVGAYRDDNGKPVVLECVREAERRIAGNLNMEYLPMGGSIKMIEESLKLAYGEDSDFIKDKRIAAVQALSGTGACRLFADFQRRFLPNSQIYIPTPTWSNHHNIWRDAQVPQRTFTYYHPESRGLDFAGLMDDIKNAPNGSFFLLHACAHNPTGVDPTEEQWREISYQFKIKNHFPFFDMAYQGFASGDPERDAKAIRIFLEDGHQIGCAQSYAKNMGLYGQRAGCLSILCEDEMQAVSVKSQLQQIARPMYSNPPVHGALVVSIILNDPELKSLWLKEVKHGKEFNIATGLSQGMADRIIGMRKALRENLEGLGSPLSWDHITNQIGMFCYSGITPEQVDRLTNEYHIYMTRNGRISMAGVTTGNVAYLANAIHEVTKTK

SEQ ID NO: 8766 - protein, 385 aa, Pseudomonas aeruginosa
AVCAGCLSARGHEVIGVDVSSTKIDLINQGKSPIVEPGLEALLQQGRQTGRLSGTTDFKKAVLDSDVSFICVGTPSKKNGDLDLGYIETVCREIGFAIREKSERHTVVVRSTVLPGTVNNVVIPLIEDCSGKKAGVDFGVGTNPEFLRESTAIKDYDFPPMTVIGELDKQTGDLLEEIYRELDAPIIRKTVEVAEMIKYTCNVWHAAKVTFANEIGNIAKAVGVDGREVMDVICQDHKLNLSRYYMRPGFAFGGSCLPKDVRALTYRASQLDVEHPMLGSLMRSNSNQVQKAFDLITSHDTRKVGLLGLSFKAGTDDLRESPLVELAEMLIGKGYEFRIFDRNVEYARVHGANKEYIESKIPHVSSLLVSDLDEVVASSDVLVLG

SEQ ID NO: 8767 - protein, 318 aa, Synechococcus sp. CC9605
MATASAGVAAVLSPLCGRDFLSSADCSAEETAALLDLAEQLKSGDRRIDLGNRVLGLIFSKASTRTRVSFQVAMARLGGQTVDLNPSVTQLGRGEPLEDTARVLSRYCDVLAIRTFAQQELVDYAHWASVPVINALTDLEHPCQALADFLTMREAHGALPGQTLAYVGDGNNVAHSLMLCGALLGVNVQIGCPEGFEPLPGVLEQAQSLAQHGASIEVMSDPREAVAGAQAVYTDVWASMGQEAEQAQREQAFAGFCVDHVLMEQAAADAIVLHCLPAHRGEEISAEVMEGSASRIFDQAENRLHAQQALLAVLMGGL

SEQ ID NO: 8768 - protein, 430 aa, Yarrowia lipolytica CLIB122
MDRTRTHDENSLHEYRKPTAAGGAPTKRVALGTVTNTASVATKAKVAISKPPQRITRQPLVAQNQNIPPLAAQTSTTSLVQPCPGSDDTVDEEVDTQTADVEPTQIEDDFYESDEEGPTQRFAVSESNPQALYPVVDKESMAELNRVATYFSTNNGVDLDENDDDTYDISMVAEYAEEIFTYMKELEVRFQPNPGYMDSQTEIHWAMRSILVDWLVQVHHRFSLLPETLFLTINYIDRFLTIKTVSLSKLQLVGAVALFVAAKYEEINCPSVQEIAYMVDNGYHVDEILKAERYMIDLLDFNLGWPGPMSFLRRTSKADDYDLETRTLAKYLLEVTIMEKTFVGAPPSWLAAAAHFLSRRMLNRGHWTDGHTYYSGYTEKQLLPAVMRIIQCCRDPLTHHKAIFEKYKDRKFKRASVYVQEWMDHEENNH

SEQ ID NO: 8769 - protein, 367 aa, Pseudomonas fluorescens Pf-5
MFDYRPESAPIESCTRHGALWQGSRARIFFGTRFHKTQNNGLPAASIFRAFSARQCCPTFSNTPAARIVTRPSTGCALLSTGRLPMPHTLDCPVLTHSGLHMPKLGLGTWPMLDQECTRAVEQALELGYRHIDTAQAYNNEEAVGQALANTPVPREQIHVTTKVWWDQLQPTAMRHSLERSLKALQTDYIDLFHIHWPTSDWELERSIETLVSFKEQGLVKHIGVANFPLALLRRVIEGLGAPLSAIQVEYHVLLGQSGLLDYARERDMVLTAYTPLARNKVSEMAEIQQVAAKHGVLPTQVALKWLLDQDNVAAIPKASSRANQLANLESLKIHLDDADRALIAALPKDQRQVSPDFAPVWDHFDH

SEQ ID NO: 8770 - protein, 293 aa, Magnetococcus sp. MC-1
MMKVRKAVFPVAGLGTRFLPATKVVPKEMLSVVDTPLIQYAVEEAWDAGIEEVILITGRGKSLLMDQFDHMYELEDTLRRQGKEVLLSVSHEPIPFPGTVVATRQQDPLGLGHAVWCARYLVGDEPFAVILPDDLVHAQKPVLKQMVERFEELQSSIVAVMEVAPDQTNKYGILDSEPEQNGVWRIKGLVEKPDPSVSPSNLAIIGRYILTPEIFCLLESIPRGAGGEIQLTDAMAALLKHQSIYGMRFEGTRFDCGDKAGFQMASLALSMERPELKDQMLAFIQENLPKWQA

SEQ ID NO: 8771 - protein, 355 aa, Borrelia garinii PBi
MKIFLTGIAGFIGFHVAKKLVEEGHEVLGVDILNDYYELKFKNERLEALGFCPKDVKTHKIIKSKKYNNLSFAYLDILNKDKLLKLFKEYKFTHVCHLAAQAGIRDSLENPDSYVSINIVGFFNVLDVCRVYKENIKHFVYASTSSVYGINENIPSSEDSITDHPLNLYAASKKSNEMIAHAYSASFNIPTTGLRFFTVYGTYGRPDMALYLFSDGIKNCEPINIFNNGNMARDFTYVSDIANGVYKVLKNPAKSDCNFDVKNPNSSTSSFPYRIYNIGTGHATKLLDFIRELEANFDKKALKNYMPMQKADVVESCCDIVKLKNDVGYEAKISIKEGIKEFSQWYKMLESTEKV

SEQ ID NO: 8772 - protein, 626 aa, Yarrowia lipolytica CLIB122
MPEWKAIWKTIFNPEVTIAQDAPDLDGPGGVKEIENVTSIWSKKGLWIAWGSMLLLAVAIALDAQTVFVYSTFATSSFNQMSLLSALGVVQSVMYIATRPVMAKIADVLGRFEGLLLSIVILTVGFIMLAASPNIGTYFAAQIFYVFGQVGIQFMQQVFAADTSDLKNRTFFVILPNLCYLFVPWCAAPITNAVLKHTTWQWGYGMWCIIVPVVSIPVLTTMFVNKLKARRLGLQAGLAVKNFKKTVQHFDFIGLILLTAGLVTLFLAATLVKTSADWNKPHVLGMIIVGPICLTLFPIWEIFPKYPFLPFRVLRNRVLLTCCFYIALYFLAFYLYQPYYYSWLMVCKNLSVTAATNTSVTTTVSSTAGGLFTAIAIRYTKRIKPFIVVGSCIYLLGLGLSYNYRQPYHSLAQFIVSQAVEGVGAGMLGSPTQVMVQAVVSHNQVAAATAVYLSSTSIGNVVGDAISGAMYRQMYPKRLREYASFLNETEIDTIINNINEPLKYTWGSPERTQIVTAFNKVYRHMLYGPLIVAGAMIVISLTLPNINLDEIEQQVKGVVFGKSQKANQADENPVGDFGGNPVGGFGAEPVAAFAPEYNGQHDIEKNAYEQKLELDTESDKKSETRV

SEQ ID NO: 8773 - protein, 490 aa, Pseudomonas aeruginosa PAO1
MARFEEQKLYIGGRYVEASSGATFETINPANGEVLAKVQRASREDVERAVQSAVEGQKVWAAMTAMQRSRILRRAVDILRERNDELAALETLDTGKPLAETRSVDIVTGADVLEYYAGLVPAIEGEQIPLRETSFVYTRREPLGVVAGIGAWNYPVQIALWKSAPALAAGNAMIFKPSEVTPLTALKLAEIYTEAGVPDGVFNVLTGSGREVGQWLTEHPLIEKISFTGGTSTGKKVMASASSSSLKEVTMELGGKSPLIIFPDADLDRAADIAVMANFFSSGQVCTNGTRVFIHRSQQARFEAKVLERVQRIRLGDPQDENTNFGPLVSFPHMESVLGYIESGKAQKARLLCGGERVTDGAFGKGAYVAPTVFTDCRDDMTIVREEIFGPVMSILVYDDEDEAIRRANDTEYGLAAGVVTQDLARAHRAIHRLEAGICWINTWGESPAEMPVGGYKQSGVGRENGLTTLAHYTRIKSVQVELGDYASVF

SEQ ID NO: 8774 - protein, 506 aa, Oryza sativa Japonica Group
MASQPPALDILVREPDGFSVWSGPPYPTGSAPPVRLPKTACSATYFSSDGSRLLATVASASATVYDCRTLSVVRSFELPGLLAAALSPAGTFLQTFQKSSSPQEKNVTVWHVDTATALYQHYQKNMSKATWPMVQFSADESVACRMMTNEIQFFDPKDFTKGFVYKLRMPGIAAMQLASAPGSHVAGFVPEAKGVPASVQIFSCDKDAQGQAVARRSFFRCSTVQFHWNKGSTGLLVVAQADVDKTNQSYYGETKLNYLTTDRAFEGIVPLKKDGPVHDVQWSYSGSEFAVVYGCILAVSVFTCNAVSHDLPGDILDLILSTSYRFSRAFWDYSEKKLVGKTKAECSVTSEWSPDGRHFMTATTAPRLQIDNGIKIFDHNGSLQFKKMFEKLYQADWKPEAPEKFSDIADLTISLGSIKIEETKKQAQGSKSAQPSSKAPANIAAKPTAYRPPHSKNSADVQDKLFGGLASTGGEMSKNALRNKKRREKQKEKKAAEGSGASADDN

SEQ ID NO: 8775 - protein, 219 aa, Tropheryma whipplei TW08/27
MKIRISPSILSADFCNLERDLQLISSADMVHVDVMDGHFVPNITFGLPVVKRICEVSPVPLDVHLMVENPDYWALQYADLGVYSVTFHFEAAKDPIATARNIRSNKSKVGLAVSPDTDIGECVHVLPEVDMLQVMTVYPGFGGQKLIRRVLDKFSRITRSEFENLSFSVDGGVTLGNISEIASVGVDTFVAGSSVFLSQLPADSVESLRKLAKVAYKRS

SEQ ID NO: 8776 - protein, 428 aa, Neisseria meningitidis Z2491 [sequence omitted]

SEQ ID NO: 8777 - protein, 413 aa, delta proteobacterium MLMS-1
MISPIEDVVADIQAGKMVILVDDEDRENEGDLCMAAEMVTPEAVNFMATHGRGLICLTLTPEQLERLQLPMMVRDNRSPFETAFTVSIEARTGVTTGISAADRARTIQVAVNPEAKPADLISPGHIFPLRAKRGGVLVRTGQTEGSVDLARIAGLNPAGVICEIMKDDGTMARMPDLQEFAQKHELKIATIADLVAYRVRKDKLVHRAAEVQLPTMHGEFQAIVYNNDVDELEHVALVKGEIDPEKEVMVRVHSACLTGDVFGSKRCDCGGQLFNALRMIDREGCGVLLYMQQEGRGIGLINKLKAYALQDQGMDTVEANLKLGFKPDLRDYGIGAQILRDLGVRKMRLMTNNPKKIIGLEGYDLQVTDRLPIEMEAEPENVSYLTTKKDKMGHLLERLAYSKAATQMARNEP

SEQ ID NO: 8778 - protein, 155 aa, delta proteobacterium MLMS-1
MVKYIEGNLQATGKKIGIVISRFNSFIAEKLLEGAIDTLTRSGANPQDIEVARVPGAYELPLVAGKMAGSGRYDAVICLGVIIRGSTPHFDFVANEAAKGIAQVGMESGLPVIFGVLTTDTIEQAIERAGSKAGNKGSECAAAAVEMVDLLSKLS

SEQ ID NO: 8779 - protein, 394 aa, Leuconostoc mesenteroides subsp. mesenteroides ATCC 8293
MHFEESDLLKTLPKQFFATLVAKVNAKIAAGKDVINLGQGNPDQPTPEYIVESLQAAAENPADHKYSLFRGEERFKKAIAEFYADEYGVSIDPETEVAILAGSKIGLVELPWALMNPGETLLLPDPGYPDYLSAAALGRVNYEAVPLKQENNFLVDYEAIPNSVAEAAKFLYLNYPNNPTGAIATSEFYQQTVRFAEENQVGIVSDFAYGAIGYDGHKPLSFLQTENSKSVGIETYTFSKTFNMAGWRVGFAVGNAEMIEALNLIQDHLFVSLFPAVQDAAIEALTNRAAREKAVTDLTNLYQRRRDVFINAVREFGWEPYVPRGAFYVLMPVPKGYTSSEFADLLLEEANVAVADASGFGKGGQGYIRVGLTIVEERLAEAAKRISKLPIFSK

SEQ ID NO: 8780 - protein, 389 aa, Xylella fastidiosa Temecula1
MSRDLPVIRLKNAWRSSHPWLFQKLLEKPSVRLKPGTIVDVVGVDGEWVGRGFYNGHSRIAVRILETRQDVVVDEAWFVRRIAEAVGLRREVLKLDAVSDAWRVVHSEGDGLSGLVVDRYGDLLVVQFFAAGMFRHREWIYTALRQQFPGARFHSFADEHVQKQESFDFHSTIDTESAVITEHGVKFLVDPMGAHKTGFFADQRENRQWLSQGVAGKTVLDLCCNTGGFAVYAALRGAADVVGVDIDQDVIQIAKANAKLNSVRPKFLQTDIFPYLRDAAVRGDQYDVVILDPAKMTRDRDQIINALKKYLDMNKLALGVVKKGGLFATFSCTGLISEEQFLEMLRRAAFYSGRTIQILKVAGAGPDHPFMAHVQESRYLKATFCRVLD

SEQ ID NO: 8781 - protein, 297 aa, Bacillus halodurans C-125
MHVKKAIIPAAGLGTRFLPATKAQPKEMLPIVDKPTIQYIIEEAIESGIEDIIVVTGRGKRAIEDHFDKSFELEETLEKKNKSKLLEEVKAISSMTNIHYIRQKEANGLGHAIWCARKFIGNEPFAVLLGDDIVQSDVPCLKQLIDVFDRYHSSVVGVQEVPNEDVSKYGIVSPKGSEIEANVIHAAGFVEKPKLEEAPSNYAIMGRYVLRPEIFDILENLPPGAGGEIQLTDAIKVLNESQVVLAYNFDGVRYDVGDKFGFIKATIDLALQRDDLSEDVAQYIKDIYEKQVGQLKQ

SEQ ID NO: 8782 - protein, 579 aa, Triticum aestivum
  misc_feature (110)..(110): Xaa can be any naturally occurring amino acid
MGGGNGIVDGFRRLFHRRTPSGSVLGSSNQSSAGEDSSDVEAAEGLDLVGLRSIRVPKRKMPLPVESHKKNIMEKEFFTEYGEASQYQIQEVVGKGSYGVVAAAIDTRTXGERVAIKKINDVFEHVSDATRILREVKLLRLLRHPDVVEIKHIMLPPSRREFQDIYVVFELMESDLHQVIRANDDLTAEHYQFFLYQLLRALKYIHGANVFHRDLKPKNILANADCKLKICDFGLARVSFNDAPSAIFWTDYVATRWYRAPELCGSFFSKYTPAIDIWSIGCIFAELLTGRPLFPGKNVVHQLDIITDLLGTPSSETLSRIRNEKARRYLSCMRKKHPVPLTQKFPNADPLAVRLLGRLLAFDPKDRPSAEEALADPYFASLANVEREPSRHPISKLEFEFERRKVTKDDVRELIYREILEYHPQMLEEYMKGGDQISFLYPSGVDRFKRQFAHLEEHYSKGERGSPLQRKHASLPRQRVGASNDGNNEQHISDQEMSAEPDAHGTVSPQKSQDAAGVGQNGLSPTSLSSRTYLKSASISASKCVVVNPNKQPEYDDAISEETEGAVDGLSEKVSKMHA

SEQ ID NO: 8783 - protein, 250 aa, Desulfotalea psychrophila LSv54
MKEVYIKSPAEIELMRQAGQLLAKVFEMLDGFVKPGVTTMEINNRVEDFITVDLAARPASKGQYGYKYVLNSSVNEVVCHGVPSTRQKLKLKDIVNLDITLEKSGFISDSSRMYVMPEASAQARKLVETTYQAMWEGIKMVKPGARLGDVGHAIQTFAENYGYSVVRDYCGHGIGKEMHEAPQVLHYGSPDTGLVLEEGMTFTIEPMINQGTSGIRTSKDGWNVVTRDKKLSAQYEHTILVTADGYEVLT

SEQ ID NO: 8784 - protein, 249 aa, Rickettsiella grylli
MFQGKTIIITGGSSGIGAATVALFSAQGAKIYILDKKKLKDRPSQSVYYLKCDVANTKEVQFAVESIIQKTHKVDYLFCNAGIHLFANLEESSLSAMHNVFATNVWGTVYCLQHLLPHMKRHQRGSIVLMASDQAFIAKEQCAIYGASKAAIAQLAKSTALDYARYGIRVNCVCPGSIDTPMYHAVLEQFKQKTGLSCQALKERIAEKLPLKRVGKPEEVAQLVGFLCSDAASFMTGALVSIDGGYTIQ

SEQ ID NO: 8785 - protein, 395 aa, Rickettsiella grylli
MYFTQLDDLGLKNKRVLIREDFNVPLDNGKITSDARIRAALPTIQYALKKGAAVILLSHLDRPPEGNMTPEFSLAPIAVRLGQLLGQPVRFITHWLDGFEITPGEVVLCENVRFQRGEKKNDPILAKKIAQLGDIFVMDAFATAHRVEASTVGAAQFSPQVCAGFLLTSELNALSVGLENPSRPLLAIVGGSKVSTKLTLLSSLLNKVNFLMLGGGIANTFLVAQGYFIGRSLYEPAQVHRAKRLLDLSKTLHVKIILPTDVIVANEISNHAKTAIRKVTHIKNEEMILDIGPESMKQYTDYVNRSASILWNGPLGAFEWTPFQQGTRCVSEAIANSPAFSIAGGGDTLAAIEKYGVAHKLSYISTGGGAFLEFLEGKTLPILTILHKRQKEKQR

SEQ ID NO: 8786 - protein, 326 aa, Saccharomyces cerevisiae YJM789
MAEVLTVLEQPNSIKDFLKQDSNIAFLAGGVAGAVSRTVVSPFERVKILLQVQSSTTSYNRGIFSSIRQVYHEEGTKGLFRGNGLNCIRIFPYSAVQFVVYEACKKKLFHVNGYNGQEQLTNTQRLFSGALCGGCSVVATYPLDLIKTRLSIQTANLSSLNRSKAKSISKPPGIWQLLSETYRLEGGIRGLYRGVWPTSLGVVPYVALNFAVYEQLREFGVNSSDAQPSWKSNLYKLTIGAISGGVAQTITYPFDLLRRRFQVLAMGGNELGFRYTSVWDALVTIGRTEGVSGYYKGLAANLFKVVPSTAVSWLVYEVVCDSVRNW

SEQ ID NO: 8787 - protein, 187 aa, Brassica napus
MARNIAFGRIQEDMNKTGFFKILADEDLSSESMRLIPNEFWRSSECKNLPPKVTLKVAWGSSWPVNLSTFMGCYLMERKGWDKFLNDNHLGDNEFLTFTNEGNNCITVDIFHKNCVQILKPLNTSSSNVKNEEMSCVDPVIAESKKQKVDSNVYGASSSSSSAATFSLTIKKSHLTLLSIPVTFAKE

SEQ ID NO: 8788 - protein, 125 aa, Triticum aestivum
  misc_feature (103)..(103): Xaa can be any naturally occurring amino acid
TVDTRAVFSFAMASGTDEKAKMESLTSPAAFVEGGVQDACDDACSICLEAFCESDPSTLTGCKHEFHLQCILEWCQRSSQCPMCWQPVSMKDPTSQELLEAVXRERNIRTNQTRNTTIFHHPALG

SEQ ID NO: 8789 - protein, 327 aa, Chlorobium tepidum TLS
MGEKITIEQTAKYTSRGNKATRTGFGEALLEAGRENPSVVALCADLTGSLNMHLFRKEFPERFIQTGIAEANMISMAAGLATIGKIPVASSFAVFATGRVFDQIRQSVCYSNLNVKICASHAGLTLGEDGATHQILEDIGLMRSLPRMTVVVPCDYSETKRATKAIIEHEGPVYLRFGRPNVPDFTADEDGFEIGKSIELHPGKDVTVIACGIMVWKALEAARILEKEGVSVRVINMHTIKPIDTLAIVRAANDTGAIVTAEEHQMYTGLGEAVANVCARNIPVPIEMVAVEDTFGESGKPDDLLRKYKLTTEDILEKIYLVLRRKD

SEQ ID NO: 8790 - protein, 345 aa, Zea mays
MDEASTSASGAATRRGFVPARSGVFYRFTQQNLPAWKPAMTPGCIIAMFLIIGIIFIPFGLLCLQTSNHIAEIIYRYDVDCVPDAYRGNRQAYIKDSSISKNCTLEAKVLEYMRAPIYVYYELENFYQNHRRYVKSRSDKQLRFGAKYTADSCSPVEWDNNGSPIVPCGLIAWSLFNDTYGFTRGSKEIKVNRKNISWKSDREHKFGKHVFPSNFQNGTLIGGGKLDPTVPLSEQEDLIVWMRTSALPKFRKLYGVIEDDLHADETIAIFVGNNYNTYTFGGKKSIVLSTASWLGGKNDFLGHAYIVTGSLSIIISILFALIHVKYPRPQGDPNCLSWNRKNSNS

SEQ ID NO: 8791 - protein, 503 aa, Picea sitchensis
MASKVPIRQLFIDGEWRAPLKGKRLPVINPTTEETIGEIPAATAEDVEIAIKAARVAFTRNRGKDWARTPGAFRAKYLRAIAAKVIERKSELAELEALDSGKPLDETAWDMDDVAGCFEFYADLAEALDSEQRAPVSLPMEAFKSHVLKEPIGVVGLITPWNYPLLMAAWKVAPALAAGCTAILKPSELTSVTCLELASICKEIGLPPGVLNIVTGLGPEAGAPLPAHPDVDKVAFTGSTATGRAIMTAAAQVIKPVSLELGGKSPILVFEDVDIEKAAEWAMFGCFWTNGQICSATSRLLVQESIADEFIKKLVNWTKSIKISDPFEKGCRLGPVVSEGQYKKILNFISVAKEEGATVLCGGRHPEHLKKGYFIEPTIIGNVNPSMQIWREEVFGPVLTVMTFRTEEEAIDIANDSHYALGGAVLSNNADLCNRVSEHLQAGIVWVNCSQPCFCQAPWGGNKRSGFGRELGKWGLENYLIVKQVTEYVSNDPWGWYPPPSKL

SEQ ID NO: 8792 - protein, 544 aa, Picea sitchensis
MEKAVGEWICGLRASANGALRQYEPVILVIFPFVASLLSLVVGRLIHLFLQLAQDNGFKGAFLIILMNNIRLIPGLRGYIEREKGKVVGKLQSSVKSGRENWQTELPRAGLGIGVIERLKFEKSKDVQWQGRCSGTVYIGGSESEGHFSLINEAYSMFAHTNPLHLSIFPSIARFEGEVVAMTASMFGSREKASGGQVCGNMSSGGTESILLAVKSSRDYMKVKKGIMKPEMIIPESAHSAYDKAAQYLKIKLWRVPVNEDFQADVKAIQRYLNKNTVMIVGSAPGFPHGIIDPIEELADLALRWGICFHVDLCLGGFVLPFARKLGYPIPPFDFTVQGVTSISVDIHKYGLGPKGTSVVLYRNHEIRKQQFVAVTEWSGGLYVSPTVAGSRPGGLIAGAWAAMMTVGEEGYLEAVRKVMEVSKTIQQGIKQIPELFIVGRPDMTVIAFGSDKLDIFKVNDVLSTQGWHLNALQRPNSIHICLTLQHTLIAEDFLKDLKKAVTTVQENPSAFEDGMAPIYGAAAKMPDRGMVQDLLIEYMDNTC

SEQ ID NO: 8793 - protein, 94 aa, Triticum aestivum
AGVPADSVMKKTKAVEDNWVPVWGEEFSFGLTVPELALLRVEAHEYDMSEKDDFAGQTVLPVSELQPGIRAVALFDRKGNKFPNVKLLMRFEFV

SEQ ID NO: 8794 - protein, 742 aa, Physcomitrella patens subsp. patens
MASSGKNTPDGKAAKAPSSTASVAPSSSSLNVEKWDSLMSSIKNFKLKTKQQELLIRIAVLVLIYILAFATRLFSVLRYESVIHEFDPYFNYRTTLYLTEKGFSEFWNWFDYESWYPLGRIVGGTLYPGLMVTAAIIYWTLRFFSFAVHIKDVCVLTAPFFASNTAMVAYFFGTELRDRGTGLVAAILLAICPGYISRSVAGSYDNEAVAIFALVLTFYLFVKAVNTGSLVWSLFSAFAYFYMVSAWGGYIFIINLLPIYVLVLLVTGRYSVRLYIAYNTVYIIGMLLAMQIRFVGYQHVQSGEHMAAMGVFYLVEYVKKQLGDPKLFKAFLRVTVTLAVGAGALALIVGLATGYISPWTGRFYSLLDPTYAKIHIPIIASVSEHQPTAWSSFMFDFHILLILFPAGLYFCFKNLTDGTIFIIIYGMTSLYFAGVMVRLILVATPAVCLISAIAISATLKNLSGLLREKAPIYTSTKITAKQKASAKSGADQPLPFQKEGAMLLLLGSLYLMISFVIHCTWVTSEAYSSPSIVLAARQSNGDRVIFDDFREAYYWLQHNTPPDAKVMSWWDYGYQITAMGNRTVIVDNNTWNNTHIATVGRAMASNEDDAYEIMRQLDVNYVLVVFGGITGYSSDDINKFLWMVRIGSGVFPVIQEADYLNNGEYRIDKEAAPKMLECLMYKLCYYRFGEMQTEYGRPSGFDRARGVEIGNKEFELKHVEEAFTTQNWIVRIYKVKPPVNRK

SEQ ID NO: 8795 - protein, 586 aa, Yarrowia lipolytica CLIB122
METEKTFTTTTVDSDPDTHGEVVVNTKKMNAWQRFKDGFGPADVSHIDTEGLTPMEIAALKTANAPLNRGLKGRHLQMIAIGGSIGTGLFVGSGASLATGGPAALLIAYGIIGCMLLCTVHALGELAVAFPVSGAFSTYFTRFIDPAWGFAMGWNYTLLWFAILPLELVAASITVEYWNEQNGTNINPAAWISLFWALIAGINLFGVKGYGEAEFVFSIIKVAAVIGFIIMGIVFVCGGGPKGYDYDKYIGGSMWQNPGAFAHGFKGVCSVFVTAAFAFAGTELVGLAAAETEDPRKMLPTATKQVFWRICLFYLISLTLVGLLVRFDDPRLLNGTSNVDIKASPFVIAILNAGVKGLPSVMNVVIMIAVLSVGNASVYGFSRTIAAMALRGEAPAFWGYIDKNGRPIYGIFAVLAFGLFAFIAAASADIRNKVFMWLLALSGLSSILVWGSINLAHIRFRQALKFRGRDTSELTFVAGFGVWGSVFGLTLNCLVLVAQFWIALYPIGGEPNAEAFFAAYLAAPIVIVFWIFWKVWKRPPFLKVSDLDIDTGRRDTDLDRVRAETTAEREYIASRNFFYRVYKFWC

SEQ ID NO: 8796 - protein, 360 aa, Pseudomonas syringae pv. syringae B728a
MSKQILILPGDGIGPEIMTEAVKVLELANEKYQLGFELTHDVIGGAAIDKHGVPLADETLERARAADAVLLGAVGGPKWDTIERDIRPERGLLKIRSQLGLFGNLRPAILYPQLADASSLKPEIVAGLDIMIVRELTGGIYFGAPRGTRVLDNGERQAYDTLPYSESEIRRIAKVGFDMAMVRGKKLCSVDKANVLASSQLWREIVEQVARDYPEVELSHMYVDNAAMQLVRAPKQFDVIVTDNLFGDILSDQASMLTGSIGMLPSASLDTANKGMYEPCHGSAPDIAGKGIANPLATILSVSMMLRYSFNLTDAADAIEKAVSLVLDQGIRTGDIWSEGKVKVGTQEMGDAVVAALRNL

SEQ ID NO: 8797 - protein, 353 aa, Chlamydomonas reinhardtii
SHRYTVHSLIGKGSYGLVCAAKDNLTGEMVAIKKIQNVFDNVADAHRILREITLLRVLRHPDIVEIKHIMLPSDPNTFKDLYVCFELMESDLHTVIGANDDLTADHHKVFLFQLLRGLNFMHSNGVLHRDLKPKNILANSNCKLKICDFGLARPHLLDGAGAAPLTPVLWTDYVATRWYRAPELCGCFYGRYSSAVDMWSIGCIFAEVLLGKPLFPGRDAVHQLQLITDLLGKPPPHVVDAIGNVKARAFLNALEPKRPRQLSSKFPAADPLALDLLGHLLAFDPADRPTAAEALAHPYFAGLPSAVNQVRGQPSVRIADDFQFESCRLSEGDVRHLIYREALQYHPHVMCAY

SEQ ID NO: 8798 - protein, 296 aa, Prochlorococcus marinus str. MIT 9515
MINLEMKKRKGIILAGGLGTRLSPISLAISKQLMPVYDKPMIYYPLTTLMLADINDILLISSPDHLNSFKRLLGDGKSLGINIEYASQEKPQGIAQALIIGEKFLNGSPSVLILGDNLFHGNELLPKLESANLKKDGATIFAYPVSDPERYGVVYFNKSGKACSIEEKPSNPKSRFAITGIYFYDDTVISKAKKIKPSLRGELEISSINKLFLQESNLNVEIMGRGMAWLDTGTFDSLNEASNYIRALEKRQGLKIGSPEEVAWRKGWIKDSQLKELGNALKSSSYGKYLLELLKN

SEQ ID NO: 8799 - protein, 270 aa, Zea mays
  misc_feature (221)..(221): Xaa can be any naturally occurring amino acid
MKFNIANPSTGCQKKLEIDDDQKLRAFYDRRISQEVSGDALGEEFKGYVFKIMGGCDKQGFPMKQGVLTSGRVRLLLHRGTPCFRGYGRRNGERRRKSVRGCIVSQDLSVINLVIVKKGENDLPGLTDTEKPRMRGPKRASKIRKLFNLAKDDDVRKYVNTYRRTFTTKNGKKVSKAPKIQRLVTPLTLQRKRARIADKKKRIAKKKSEAAEYQKLLAQRXLKEQRDRRSESLAKRRSKLSAARQGFCCHLCLRMISALRCFQGLFCYSL

SEQ ID NO: 8800 - protein, 1161 aa, Ustilago maydis 521
MCYSIGVDPLSSSTRSSGGLAGLWSDMLGLGDWQYELGVQIIDVCVSTRDVNGGVISMDDLITRVTRLRTGSTSTSTAKGKADKDASSEITQDDIVRSIKMLAPLGCGYEVFSLGNGGQKMVRSVPRELDTDTMVVLGMLLSSSSSTATVAAAAGRAAELPFLTEDTLVTRQKARGWTRDRARAVLENMALREGFPTTLLLIGHSRDRMNHANVHHRGCMTAMLRPFHSPSASSTMRLSYRRSPLVPALHLATLCLVSTALPSPAYEAPLGLASMLLAPVGNSSLINANNTADCTNCTNLGNFINPIPVSWLDPVIQLRNGSYAGITIQPIAASATLSGFGTNRTQEAFLGIPYAQQPVDELRFRRPYSLNESWDEVRSAKRYSELCFGAGVDDDYQPPYVTYKLGERCLTLNVVRPAGVSSENGDKLPVFVWIYGGGFSYGGSADRRYNGSFIVDKSVELEQPLIFVSFNYRVNVLGFPVGDGAKQAGIENLGLYDQRLALNWIRENIAAFGGDQDKVSIVGESAGGASILFHLSAYGGRDDRLFRSAVVQSGYWASQLETKSNRVRWNQQWGSLVEYANCSARADAIGCLRTTPLDTIKQWSQRNNATVNAFSPVVDGDLVAGDLQHSFLQARIVKDASVLLNNNLDEGLSFGRRGVNNSGDIVEALSVSQALPDGWLSRDTESNLTRAYPDNEDIYPPFQAGAGVLPRTHGVLGTNDRRSCAIFGDLLFVGPRRQAAELLAKSSNKPIYVSRFDQLSYKSAITSGAQHFQEVAYMFRNALDTQNALGPLAKDTQLAEEMSSYWINFVASGDPNGAKKQGRRTQGASRVGEYCISETRTGDKPRGASASAVVSRSEGRDYGVIKVSAGWESLDHHCHHPARRRVVCKLDTSHGLFVGHAIQDHYYATTLLRYYATTPLRDRSLPASVRAITMALVLLHLPTLALNAAATLVYPLYSSYKAVTSSKTSLPDMEVWLVYWSVFACWTLLESVFGFLWSWLPFYYEFRLLFNIWLVAPQTRGATYIYTNHLHPFLQSNQQQIDAWIEDAKRNVKAKMDDSLGGLLSAWSGGSAAEGGAAPQPNDARHRAPAMTNAAAPTPAPAPPTQHNPAQASIDCVGQGVAGNQTAATKRVGIYDPRFRIVVETDGSPKTARSDGAPTTT

SEQ ID NO: 8801 - protein, 197 aa, Crocosphaera watsonii WH 8501
MSSFEYNQERDSEDIDRVTLSDEKGSTLDCYIENAVEGNDGTYLLLMPVDVPVVILSWDGEEEDSSDGYEISNAVLLEDPTEIEEIFADAKAVLAELDLTLKLTAFTVTLTGELPPIEDDGVLTLEVDSDEPSIDSEELQFLKDFYHNKHKYSIYTPLSPLLFLAKYNLLGKIELVSPEDKQMQVILEELLFDEMEE

SEQ ID NO: 8802 - protein, 332 aa, Xylella fastidiosa Temecula1
MIPVINQEKQGISGDFRLSVAPMMNWTDRYCRVFHRVLAPSARLYTEMVHAKAVIYGDRERLLGFASVEQPVALQLGGSEPALLAKAASIAVDWGYSEINLNCGCPSDRVQAGSFGACLMREPALVADCVAAMAAVVSVPVTVKCRLGVNEDDDYGRFAKFVDWVIGASSSRMIVVHARNAWLQGLSPKENREIPPLRYDWVYRLKRECPELAVVLNGGITSVEAGLDHLLMVDGVMLGRAAYQDPYILHQFYCALSNAPVLPRALLLRALRPYVEAWLEQGVTLRHIVRHLLGLFHGQPGGRVFRQVLTQGGQRSDADWSLVEQALSIIEG

SEQ ID NO: 8803 - protein, 178 aa, Rhodobacter sphaeroides 2.4.1
MAGSETHFTLPLPAFERPAKLLIVVAPYYRDIADDLIAGAKAVIESCGASWELIEVPGALELPTAIAMAERQANFDGYVALGCVIRGETTHYDTVCNDSSRGLMLLGLQGACIGNGILTVENRAQAVVRAAPSEQDKGGGAAAAALHLIALSRRWSGQRKGMGFKPVDEFRVAGTSEA

SEQ ID NO: 8804 - protein, 894 aa, Oryza sativa Japonica Group
MERSLLPWLLLLLCFADGVFQSRAQPDSKGFISIDCGIQPNTSYVHNTTKISYVADDDFTDGGSNYNVSPEYIKPQLSQRYYNLRAFPDGARNCYTARSLAPGIKYLIRASFLYGNYDGLNKLPVFHLYIGVNFWTMVNITSLGLGGSRYEEAIVVVPDDFVQVCLINTGTGTPFISSLELRPLDKRLYPQTAVTPRNASGNIYFFWEPWPQPNDPTPPYTVIFHFSELEILTNNASRQFYINLNGEPLIDTAYEPTYLTARYLYGLEPLERTSRYNITINATANSTLPPLINAAEIFSIISTAVIGTDSQDASSMMAIKDKYQVKKNWMGDPCMPKTFAWDKLTCSYPNSSGARIISLNLSSSGLSADISSAFGNLKALQYLDLSNNSLTGSIPDVLSQLPSLRVLDLTGNQLSGSIPSGILKRIQDGSLNVRYGNNPNLCINGNSCKAAKKKSKLAIYTVIPAVLVVLIASVTTLFCLLRRKKQGPMNNSLEQQNEMSTSTSHVLINSGYGDNVSLRLENRRFTYKELEKITNKFKRVLGRGGFGYVYHGFLEDGTEVAVKLRSESSSQGAKEFLIEAQILTRIHHKNLVSMISYCKDGIYMALVYEYMPEGTLEEHIVGENKKGKILNMEREAQYRIGICTRCIILTIPMDPYALQQTLLGLEYLHKGCNPPIIHRDVKATNILLNTRLEAKIADFGLSKASSYDNITHVSTNALVGTLGYVDPEYQMTMQATTKSDVYSFGVVLLELVTGKPAILHEPNPISVIHWTRQRLARGNIEDVVDTCMPSDYDVNGVWKAMDIAFTCTAQASTQRLTMTEVVMQLQECLELEDARCAIGDAHNEFYPDPRSDHNLSYNTYVSDRSNDVSQNSGVSMMEHNFGRVPTMASGPAAR

SEQ ID NO: 8805 - protein, 367 aa, Rhodobacter sphaeroides 2.4.1
MSHSKTEYSDAISSIEEIIDDARNGRMFILVDHEDRENEGDLVIPAQMCTPAAINFMATHGRGLICLALPSARIDQLGLHLMTPKNSSRHETAFTISIEAREGVTTGISAADRARTVAVAIDPSKGPADIATPGHVFPLRARDGGVLVRAGHTEAAVDVSRLAGLNASGVICEIMNDDGTMARLPDLVAFAQRHGLKIGTISDLIAYRRRHDNLVKEKAVKHVTSCYGGDWLMRIFSDDTQGAEHVILSKGNVTDGEPVLVRMHALNPLEDVLGIGPAHAGDLHGAMRLIAQEGRGVVVLLRDVTMKLPMDDEASPQTLRQYGLGAQILSALGLSQIVLVTNSRAPKVVGLEAYGLSIVGTHHISEV

SEQ ID NO: 8806 - protein, 477 aa, Crocosphaera watsonii WH 8501
MSESGFDYDLIIIGAGVGGHGAALHAVKCGLKTAIIEAKDMGGTCVNRGCIPSKALLAASGKVRELQDTKHLHNLGIEIDGVDFQREAIADHATNLVNKIRGDLTNSLKRLKVDTIHGWGKIVDTQKVSVLGDDGEKIITAKDIMLCPGSVPFVPRGIEVDHKTVFTSDEAVKLEVLPQWIAIIGSGYIGLEFSDIYTALGCEVTMIEALDTLMPGFDPEISKLAERSLIKARDIETYSGVFATKITPGAPVTIELTDAQSKEVIDVLEVDACLVATGRVPATKNLGLENIGVETNRGFIPVNDKMEVLRDGEPVPHLWAVGDANGKMMLAHAASGQGEIAVENMCGREKTIDYRSIPAAAFTHPEISYVGLTEPAARELGEKEGFEVSSVKTYFKGNSKALAEGETDGIAKVVYRKDNGELLGVHIMGIHASDLIQEAANAIAQRQSVKNLSFNIHTHPTLSEVLDEAFKRAEATV

SEQ ID NO: 8807 - protein, 284 aa, Polaromonas sp. JS666
MTSGTVLFPPDLERRFSGLARLYGVAGARRIREAHIVVVGLGGVGSWAAEAAARSGVARLTLIDFDHIAESNINRQVHALDSTLGQAKVLAMRDRIAAIHPACQVDCIEEFVDESNWPGLLALDSSFDGKQLAVIDACDQVRAKTAMAAWAIRSRTTLISVGAAGGKRLAHRVDIEDLSLVTHDPLLAQLRYRLRKQHGASRKGKIGVACVFSREPVLQPAAVNSLDEQEDSNAEALAMQCDAPLQGVTQSDGSLNCHGYGSVVSVTSTFGLCATGWVLSKIAG

SEQ ID NO: 8808 - protein, 214 aa, Guillardia theta
MNDDKNIQHLFKVRRTVLQMIRDRGYVVFDSKDDLNISRSSFEEFYMKNHAICRKSLEIKRPRWDNPENRILIVFVEGEKDKMNIGVKSIRLFCERIKNEGFSRVLMILNGKLTPHAKQAVSSINSNNDLIEYFSENELIVNITHHMLVPKHEILSKNESKSLLERYSIKFDHLPKILKNDPVAKYLGLQRSEIVKITRVSETSGKFITYRICI

SEQ ID NO: 8809 - protein, 400 aa, Rhodobacter sphaeroides 2.4.1
MAFLSDTLARVKPSQTIAVTNKARELAAAGRDVIGLGAGEPDFDTPDNIKAAAKRAIDAGRTKYTAVDGIPELKRAICEKFERENGLKYTPAQVTVGTGGKQILYNALVATLNPGDEVIIPAPYWVSYPDMVLLAGGTPVSVAAGMETGFKLTPEQLEAAITPRTKWFIFNSPSNPTGAAYTRAELAALCEVLMRHPQVWIMSDDMYEHLVFDDFDFTTPAQIEPGLYDRTLTCNGVSKAYCMTGWRIGYAAGPVELIRAMGTIQSQSTSNPCSIAQYAALEALSGPQEFLATNREAFQRRRDLVVSMLNEAKGVTCPNPEGAFYVYPDISGCIGKTSAGGAKITDDEAFASALLEETGVAVVFGAAFGLSPNFRISYATADEVLREACARIQAFCAGLS

SEQ ID NO: 8810 - protein, 1703 aa, Zea mays
MESAVNPKAYPLADAQLTIGIIDIIQQAANYKQLKKGANEATKTLNRGISEFVVMAADTEPLEILLHLPLLAEDKNVPYVFVPSKQALGRACGVTRPVIACSVTSNEGSQLKQQIQGLKPPAPQPPASLSLPAAGFPAAGLPIPPSRRLHRRSPAQARSAPLPLRARRRPPSSPTRLPTPLPCVLVAPRAPAPARSPPPDPTPDAAGGLPRPPVFLPCALVAPRASAPARPPPPAFPLGAAPDVPPRPGTRPAGSGARRPCTSSTRRLARLRPCPCVSADMDDSTTAATGTIAPAAIGSEPAHGGAPYIIGLGPLHASSPLPLHRTSPPGFPAFASPTWSHRVAPSTIPTTDPPLVSTLASIQAAVMASRERERAASLALERERALGAALATQMATTQRLLGHPTLADAEPPEDPHASDLDADLIAALHAQAVGLHNIRALVSVVLDPASPHYSRWRGQVLLTLRRFVLDDHVLIDHDTPSPRSWCLMDSVVLSWLHDTITVELQDIIRDQADTARQAWLALEDQFFGNRDARALHLDAQFHLFSQEGLSVGEYCRQMKGLADSLRDLGEPVADRTLVLNLLRGLSPRYGHLKALIKRSVPFPTFHVVRNELLLEELTMANEAPTPASALYTTPTSGPPPSGGQATRPPSTRAPTRPPPAVPAAPRPTSTTDGGRRSRKGGRGSGGSSRGGPSGRGGGPAWPSFYNPWTGTIAMWPGQAPSTPRPPAPALLATPHYGTPPYGVPVVPQAPPALLPPGTHTSTPWSPPTGGWDSASLAAAFNTMTMTPPSSDWVIDSGASYHTTPMAGTLSRSHPPLPSYPSSIVVGNGSTLPVTSVGASVLPGPFYLNDVLVAPHITHNLLSVRRFTTDNSCSIEFDPSGFSVKDLATRTLLARCDSSGPLYTLQPSTAGVSPPPALAFDLVHCDLWTSPVLSLSGYKYYLVILDDFSHFLWTFPLRLKSDTFTTLTHFFTWVSTQFRRPVRALQCDNGREFDNNASRSFFLTHGVQLRLSCPYTSAQNGRAERMIRTTTNMLRCLLFQASLPASYWAEALHTATHLLNRLPSKAVRHPTPHFALYGTPPSYDHLRVFGCACYPNTSATAPHKLSPRSTRCLFLGYSPDHKGYRCLDLTSHRIIISRHVIFDEDVFPLAGSTPPTDLDFLLESDSIPPPPPAPRLAPLPAPRAAPKTSSAPRAAPSTPPAPRAAPSTPPTPHAAPSILPAPRAAPPTSPAPRVAPSILPAPRAAPSTPARFANPALVYHRRGHATTSAPPDSSPSTSAARFADPAVVYHRREPAPPAAPDVPAVHSESSVYHPVVIHRDPRHVHPMVTRRAAGVLRPVDRLILAAATTSTPPDASPVPSSVRTALTDPHWRRAMEEEYAALLANHTWDLVPRPPGTNVVTGKWLFRHKLTSDGSLDRYKARWILRGFTQRPGVDILERAGMSDCKPCSTPVDTQAKLSEDDGPPVADATSYRRFTGALQYLTFSRPDIAYAVQQVCLHMHTPREPHLTALKRILRYLRGSLDYGLLLRPSPTSELVVYTDADWAGCPDTRRSTSGYAVFLGANLVSWAAKRQPVVSRSSAEAEYHAVANGVAEASWLRQLLHELHSPLQRATLVYCDNVSAVYLSTNPVQHQRTKHVEIDLHFVRERVAAGDVRVLSVPTTLQFADIFTKGLPSSKLAEKLSVWQSAAAFGGQKLPEAETNMA

SEQ ID NO: 8811 - protein, 421 aa, Oryza sativa Japonica Group
MDEEQLRALLRDLDALKQRPDPAAIDRMRERVAGMVTPAAAARSKIKDMSSEVVDSNPYSRLMALQRMGIVDNYERIRDYSIAIVGIGGVGSVAAEMLTRCGIGRLLLYDYDTVELANMNRLFFRPDQVGMTKTDAAVQTLSGINPDVTLESYSLNITTVKGFETFLGSLKARSSDGRNTGVDLVLSCVDNYEARMVVNQACNELGQTWMESGVSEDAVSGHIQLLVPGETACFACAPPLVVASGVDERTLKREGVCAASLPTTMGVVAGLLVQNALKYLLKFGQVSPYLGYNSLKDYFPTMEMKPNPQCSNPACVQRQKEYMQSKPARDAAAKAKMEAEASAADECPVHLDNDWNISVVDDSDTVTPSILSTGADSLPEGLVRELPTADSYQEPVAPVTSGAIDDDLEELQRQLDALNSS

SEQ ID NO: 8812 - protein, 297 aa, Aspergillus oryzae
MASSAKLEVSQPPRAAVPVKKVHYPFWFGGSASCFAAAVTHPLDLGTFGHVIKSDGILGLYRGLSAALLRQMTYSTTRFGIYEELKSRFTSPDAPASTLTLVGMACTSGFLGGIAGNPADVMNVRMQSDAALPVEQRRNYRHAFHGLVQMTRHEGPASLFRGVWPNSTRAVLMTASQLASYDTFKRLCIDRFGMSDNLGTHFTASFLAGFVATTVCSPVDVIKTRVMTASPAESRGHSIVGLLRDITRKEGFAWAFRGWVPSFIRLGPHTIATFIFLEEHKKLYRLLKGVSEEKHTA

SEQ ID NO: 8813 - protein, 3656 aa, Streptomyces rochei
MTDNDKVASYLRRATLDLRAARRRIHELEADPVAIVGTACRLPGGIETPEAFWEVLAAGEERLSAFPEDRGWDLTGLYHPDPDHPGTTYVRTGAFLERAGEFDAAFFGVSPREAAAMDPQQRLLLETSWELIENAGLDPHSLRGTDTGVFLGVARHGYGDTGGSAEDAEGYTVTGAAPSVASGRIAYTLGLEGPAITLDTACSSSLVALHLAVASLRRGECGLAIVGGAAVMAGPEVFVDFARQRALAADGRSKAFGAGADGFGFGEGVAVLLLERLSDARRRGHTVLAVVRGTGINQDGASNGLAAPSRAAQRKVIEQALANAGVAPGDVDAVEAHGTGTTLGDPIEAHALLDTYGRGRGPQRPLWLGSAKSNIGHTQGAAGAVGVLKMVLALRHERLPRTLHAEEASPHVDWSSGAVALLAEEQHWPRGERPRYAAVSAFGISGTNAHVVLQEAPAPEETGERAAPRPATPQHPVPLVVSARSEEALRAQARRLSDVLADTDAELPGIGLTLATARARHEHRAVVVAGSRDLALHGMREVAAGAARLTGTVESGGRSAVFLFPGQGSQWAGMGADLLAWSPVFAETIRACDEAMAPWQDWSVAAVLRQQPGAPGLDRVDVVQPALFAVMVSLAALWRSYGVEPAAVAGHSQGEIAAAYVAGALTLEDAARLVVLRSRLLRSLAGKGAMAAVALDEAAVRELLVPYAGAVEVAAVNGPASVVVSGEPAAVDSLVADCAGRGARARTIDVDYASHSAQMEEVREELAAALRDLRPGRARVPFYSTVTGRPMDGGELDAGYWYRNLREPVRLHDVVRLLADAHHDTFIEVSPHPVLAATVEETLEAAGREPGAALALGTLRRGAPGPESFLTFAASAHVEGVDVRWQPAFGDDARPVALPTYPFQRKHYWTAPAGPARATGGVTYRVSWTPLPAPEPADARGPWLIVGPAASPAWAGLLPAAVREAGGTPLECALDPGLDRAGAAAALTAALAGTTGVRGVLSLLAADESDHPGRPGVPVGAVATLTLAQALADAGVDAPLWCLTRGAVQTDEDDGIGSYAQNAVHGLGRVAGLELGRRWGGVLDLPHPDGADAALLGRVPGLLAGAHAAEDHLALRPGGLYGRRLVPVRTPATTDGTGPRLHGTVLLTGADSPIGARLARWAADSGADHLLLVGEADEELLNALRERGTTATRCAADEDALRAAVEAAPHDISTVVHAATRTEFGPVLATDPEDFAATLQAKTGLALTLAAVLDGRPVEREIHCSSVAGVWGGAGMAGYAAGSACLDAFAAHRRAQGHPSTAVAFSPWALPGTVPSAPQAAQRGLRGLSADRALAALTSALDSGESAVAVSDVDWPAFAAGFGAVRPTALFAEISEARETAEPPAAPAAPDGSPAADLAARLTARTPAQREELLIGVVAEATAAVLGHDSAEDVSARRAFTELGLDSLGSVQLRKRLSAATGLRLPASLVFDHPTVTRLARHLLSLLAADSGPELAAAVGSAPPSAEDEPIAIVGMSCRFPGGIGSPEELWRAVVDGQDLTGELPRDRGWELGALYHPDPDHPGTSYSDRGGFLADAAGFDAEFFGITPREALAMDPQQRLMLEVAWEAVERGGIDPDALRGSRVGVFVGSNGQSYMPLLRGEADRVEGYQGLGNSASVLSGRLAYTFGWTGPALTVDTACSSSLVGIHLAIRALRDGECAMALAGGVTVICDPYTFVDFSRQRGLAADGRCKPFSAQADGFGLAEGAGALLLEPLSRAIESGHPVLAVLRGSAVNQDGASNGLAAPNGPAQEEVIRQALADARLSAADIDLVEAHGTGTRLGDPIEAGALQATYGAPRARPLALGSVKSNIGHTQAAAGVAGVIKAVLAMRHGVIPRSLHAEELSPEIDWSPGTIRVQRENEDWPAGPRVRRAGVSSFGVSGTNAHVVLEEAPAVPESAPAGAEAAPVLPEAVAANVAAPAGRPGGRGLAADTAALVLSARTPSAVRAQAGALAALLRTSPATPLADTARTLATGRTRLDIRAAVLGDDRDSVCAALDALAAGEAAADVVPPRTAAPRKAVLVFPGQGSQWAGMAADLLGQSEIFAAAMADCAAALAPYTDWDLLATLRGDGPEDAFERPDVVQPLLFAVMVSLAALWRAHGVEPAAVVGHSQGEIAAACVAGALTLDTAAKVVALRSKVLGELNGQGGMASVTAAPGELREALAPWDGRLSVAAVNGPRSLVVAGEAAALDEFLGSPRAEEMSPRRIAVGYGSHSPQVAQVEQRLADVLGTVPARSAAVPFCSTVTGAPLDTAGLDAAYWYRNLRGTVRLDQAVRTLMEQGFDTFVEVSPHPVLLPGIEQTAEDLGRDVVTLASLRRDRPGARTFLRNLLEAHADGLPVDLLPALEPGGTAELPTYPFEHTSYWPRPCRTRADAAPSGMDSVAHPVLSAALETPDGGHVLTGRITLGDQPWLADHAVGGETLLPGSALVDLALTAGRHAGTPAVAELVLCAPLLPGAATAVRVTVGAPAADGTRTVDIHARDTDAPGTPWTRHATGVLGEAAPPPATPAVWPPADARPIDLDAAYARLADRGYGYGPAFRALRAAWQRGAEVFAEAELPAAAGPDDAESAGYLLHPVLLDAAAQTLGLGPLADRDGAFLPFSWTGTTLYASGATTIRVSAAPAGADAMSLSVTDPAGAPVAVVSAVTVRPVGGEPGPRAGEETGADDLYHLTWRPLPETTGRAVGCATIGGPCGLGKDHPDLAALAAAVAAGEPEPEAVVVPCRPWQAADPAGSVRESVLHAAGLVRQWLDAPERTGRLVFLTRNAVSTGPADTAADPAQAAVWGLVRSAQAESPGNFALVDIADGADPAVLAALPAVLDHPQLAVRGDLALVPRLASTRTAPALLPPRTPARLEPAGTSLDALAFAAAPDAGRQPGPGEVRVELRSCGVNFRDVLIALGMYPGAAVMGTEGAGVVTAVGPDVTGVAVGDRVMGLFEGAFGPVAVTDHRLVTPVPPGWSTTEAAALPIAFTTAHYALHDLAGVRPGQAVLVHAAATGVGMAAVRLARLAGAEVFATASPAKQGVLRSLGLDDDHIASSREPGFGRRFRAVRGGRGMDVVVNSLTGALLDESAELLAEGGAFVEMGKTDLRDADRFRGRYLPFDLAEAGADRLGAILAEVASLAAGGELGRQTVTAWPLQRASAALQHMSTGRHTGKLVLVQPAPLDPEGTVLVTGGTGTLARLLARHLVTEHGVRHLLLLGRRGPDAPGAARFEAELGELGATVTTRACDVSDRAALAAALDGIPAGHPLTGVVHTAGVLADGLAASLGEDELGTVLAPKADAAWHLHELTADREPNFFVLFGSGASVLAGPGQGAYAAANAALDALARYRQARGLPATSLGWGLWEEASGLTGALDERDTRRMARAGMRPLPTARALALFDLAIRRGDAVAYPLHLDTARAQGAQDAPEVLRGLLHTPLRRAARDQSGGDGLAARLAPLPRPDRLAALTHAVQAQAAAVAGYDTADAVAARRQFKDLGFDSLASVELRNRLGSALGLRLPSTLVFDHPTPEAVAVFVDGRLFAGADAAGAPAPEPGRSVAEHLAALEAVLEGWQEAGEDTAGERRAIGARLTALSDRWSAVAAGDSRTAVDTVDDEELFALLDQRFGEGNEER

SEQ ID NO: 8814 - protein, 388 aa, Streptococcus pyogenes MGAS8232
MKNQLGQLALEQAKTFGGKLEVQPKVDIKNKHDLSIAYTPGVASVSSAIAKDKTLAYDLTTKKNTVAVISDGTAVLGLGDIGPEAAMPVMEGKAALFKAFAGVDAIPIVLDTKDTEEIISIVKALAPTFGGINLEDISAPRCFEIEQRLIKECHIPVFHDDQHGTAIVVLAAIFNSLKLLQKSLDEVSIVVNGGGSAGLSITRKLLAAGATKVTVVDKFGIINEQEAAQLAPHHLDIAKVTNREFKSGTLEDALEGADIFIGVSAPGVLKAEWISKMAARPVIFAMANPIPEIYPDEALEAGAYIVGTGRSDFPNQINNVLAFPGIFRGALDARAKTITVEMQIAAAKGIASLVPDDALSTTNIIPDAFKEGVAEIVAKSVRSVVLKS

SEQ ID NO: 8815 - protein, 678 aa, Polaromonas sp. JS666
MITLKNVVLRRGAKVILDSASVSLNPGEKIGLVGRNGAGKSSLFAMLNGTLHEDGGEYTIPAQWRMSQVAQDMPETEQSATSYVVEGDVVLLAAQAEVEASEASGDGDRMAHAYMELYDAGAHDAQARAQALILGLGFKVSELDNPVNSFSGGWRMRLQLARALMCPSDLLLLDEPTNHLDLDALVWLEAWLKRYQGTMLVISHDREFLDAVTDVTVHIENAKLTRYGGNYSKFEDLRSEQMALQQTAFAKQQDKIAHLQKFIARFKAKASKAKQAQSRVKALDRMEKIAPLLAEADFTFEFKEPANLPNPMLSMQNVYFGYPPPADAPEGTPPTVIVQNVSKSVLAGQRIGILGANGQGKSTVVKTIARALAPIQGEMTEGKGLNIGYFAQQELDVLRPADNPLEHMIRLVKEVTAAGKISGQATREQDLRSFLGNFNFGGDMVKQAVGSMSGGEKARLVLCMIVWQRPNLLLLDEPTNHLDLATREALSMALNEFEGTVMLVSHDRALLRAVCDEFWMVSRGGVAPFDGDLDDYQRYLLDEAKRQREEAKKSTSSAAAPATATSTSATKPIAGNVNSTGAKAGSDAKKSSGKKDEAQRRQQQSDVTKPLRKELDKIDSRLQSLNTERDSLQTALTTITAPAEIAQAGKRLKAIDSEIGTLEERWLELTEQIETATV

SEQ ID NO: 8816 - protein, 557 aa, Arabidopsis thaliana
  misc_feature (90)..(90): Xaa can be any naturally occurring amino acid
MGKSKSATKVVAEIKATKPLKKGKREPEDDIDTKVSLKKQKKDVIAAVQKEKAVKKVPKKVESSDDSDSESEEEEKAKKVPAKKAASSSXESSDDSSSDDEPAPKKAVAATNGTVAKKSKDDSSSSDDDSSDEEVAVTKKPAAAAKNGSVKAKKESSSEDDSSSEDEPAKKPAAKIAKPAAKDSSSSDDDSDEDSEDEKPATKKAAPAAAKAASSSDSSDEDSDEESEDEKPAQKKADTKASKKSSSDESSESEEDESEDEEETPKKKSSDVEMVDAEKSSAKQPKTPSTPAAGGSKTLFAANLSFNIERADVENFFKEAGEVVDVRFSTNRDDGSFRGFGHVEFASSEEAQKALEFHGRPLLGREIRLDIAQERGERGERPAFTPQSGNFRSGGDGGDEKKIFVKGFDASLSEDDIKNTLREHFSSCGEIKNVSVPIDRDTGNSKGIAYLEFSEGKEKALELNGSDMGGGFYLVVDEPRPRGDSSGGGGFGRGNGRFGSGGGRGRDGGRGRFGSGGGRGRDGGRGRFGSGGGRGSDRGRGRPSFTPQGKKTTFGDE

SEQ ID NO: 8817 - protein, 349 aa, Streptococcus pyogenes MGAS8232
MKAATYLSTGNLQLIDKPKPVIIKPTDAIVQLVKTTICGTDLHILGGDVPACKEGTILGHEGIGIVKEIGDAVTNFKIGDKVIISCVTSCHTCYYCKRGLSSHCEDGGWILGHLINGTQAEYVHIPHADGSLYHAPDTIDDEALVMLSDILPTSYEIGVLPSHVKPGDNVCIVGAGPVGLAALLTAQFFSPANIIMVDLSQNRLEAAKTFGATHTICSGSSEEVKTIIDDITNGRGVDISMECVGYPATFDICQKIISVGGHIANVGVHGKPVDFNLDELWIKNITLNTGLVNANTTEMLLNVLKTGKIDATRLITHHFKLSEVEKAYETFKHAGANNALKVIIDNDIS

SEQ ID NO: 8818 - protein, 146 aa, Oryza sativa Japonica Group
MKVGLLDKSMGEKEKKKRSKKPPRPPRPPSASPLDAADQKLISELSELASLKRARIERMKALKKMKNTKPASSIGNLVALIITIIFCLVILWQGVFSKYGAGIIFHGSPISSGRSHGSLFSIQFYKKNETATSPRSSSSAPKCDSL

SEQ ID NO: 8819 - protein, 544 aa, Picea sitchensis
MAAGRGFSSLVARAVRSAGARPSAFGTSVSSHQASIRNDGIRRLGTAASALEEPIAPPVQVKHTQLLIDGQFVNAASGKTFPTFDPRTGDVIANVAEGDAPDVNRAVKAARKAFDVGPWPKMTAYERSCIMLRFADLLEKHNDEIAALETWDNGKPYEQASLVEVPMAVRLFRYYAGWADKIHGLTVPADGPYHVQTLHEPIGVAGQIIPWNFPLLMFAWKVGPALACGNSIVLKSAEQTPLTALYAAKLFHEAGLPPGVLNIVSGFGPTAGAAIARHMDIDKVAFTGSTETGKAVLELASKSNLKPVTLELGGKSPFIVCEDADVDQAVELAHFALFFNQGQCCCAGSRTFVHESIHDEFVEKAKARCLSRVVGDPFRKGVEQGPQIDQEQFNKILRYIKAGKESGAKLVTGGDQIGTKGFYIMPTIFSEVQDDMAIATDEIFGPVQSIIKFKTLDEVIKRANASRYGLAAGVFTQNIETANTLTRALRVGTVWVNCFDIFDAGIPFGGYKMSGTGREKGIYSLQNYLQVKAVVTPLKNPAWL

SEQ ID NO: 8820 - protein, 329 aa, Silicibacter pomeroyi DSS-3
MGLLIEGIWHDTWYDTKSSGGAFRRSAAQFRNWVTPDGAPGPTGKGGFAAASGRYHLYVSYACPWAHRTLIFREIKGLSAHIPVSAVHPDMLDQGWTFAPEPQGRTGDRLYGLNYAHQVYTRADPTYSGRVTVPILWDSERQTVVSNESSEIIRMFNSAFDGLTGNRDDFWPEALREAIEPVNARIYDTVNNGVYKCGFATTQEAYDAAIEPLFDTLDWLDSHLAQNRYLMGDRLTEADWRLFTTLIRFDPVYHLHFKCNRRRLVDYPNLWAYTRELYQWPGVAGTVHMDHIIRHYHYSHDSINPHRIIPVGPALDLLEPHRRDQRTVA

SEQ ID NO: 8821 - protein, 282 aa, Schizosaccharomyces pombe 972h-
MFYSDYLKLLKIFVVGVFPCTLFVNAPHGKLAKQSKLFSKGYISGRVGWVLMELVAPLTFLYAIRNNRHFESTLPSLGDGSNRDYLDSCRKVLAGMFLVHYANRALVSPLLMAPQVSPMHWTVFVSAVLFNFLNGMSIGLYLVQASVQHHPVSIIRRYIGMFLWLMGWLGNMYHDNILYDLRRSSNKKKDPDNLDTVQSENSYYRIPYGGLFQYVSCPNYFCEWIEWFGCYLAAGPSAEPFWWFFLSEILLMLPRALKAHQWYCKKFPKYPANRRAIIPFLM

SEQ ID NO: 8822 - protein, 465 aa, Prochlorococcus marinus str. MIT 9515
MNITKTSNIKNICCIGAGYVGGPTMAVIAANCPDLIINVVDINIDRINSWNIDDLSKLPVFEPGLKDIVEKCRGKNLFFSSNVEENIANADIIFISVNTPTKTKGIGAGYASDLKWIESSTRTIAKFARNHTIVVEKSTLPVKTAETIKNILLSSDESLDKNVKKTFSILSNPEFLAEGSAINDLQNPDRVLIGGDDNYAINLLVNIYEKWVDTKKIITTNLWSSELSKLVANAFLAQRISSVNSISALCESTGANIQEVKEAIGSDTRIGNKFLNAGPGFGGSCFKKDILNLVYLCRYYGLNEVAAYWEQIVQINLWQQKRISALVIKNLFGTLSNKKLVILGFSFKANTNDTRESPSINISKEFLKEGAELNFYDPKVEKKQILREFDDFKDSKISVSKSALGAAEGADAVLVMTDWEDFKYLDWISIYKVMRKPAWVFDTRICLNREEISNIGFNIWTLGRI

SEQ ID NO: 8823 - protein, 484 aa, Haemophilus influenzae 86-028NP
MSVKGDIGVIGLAVMGQNLILNMNDHGFKVVAYNRTTSKVDEFLQGAAKGTNIIGAYSLEDLASKLEKPRKVMLMVRAGDVVDQFIDALLPHLEEGDIIIDGGNSNYPDTNRRVKALAEKGIRFIGSGVSGGEEGARHGPSIMPGGNQEAWQYVKPIFQAISAKTEQGEPCCDWVGGEGAGHFVKMVHNGIEYGDMQLICEAYQFLKEGLGLSYDEMQAIFAEWKNTELDSYLIDITTDILGYKDASGEPLVEKILDTAGQKGTGKWTGINALDFGIPLTLITESVFARCVSSFKDQRVAANQLFGKTITPVEGDKKVWIEAVRKALLASKIISYAQGFMLIREASEQFGWDINYGATALLWREGCIIRSRFLGNIRDAYEANPNLVFLGSDSYFKGILENALSDWRKVVAKSIEVGIPMPCMASAITFLDGYTSARLPANLLQAQRDYFGAHTYERTDKPRGEFFHTNWTGRGGNTASTTYDV

SEQ ID NO: 8824 - protein, 451 aa, Pseudomonas aeruginosa PAO1
MAGGEKAGKRGMGFWTCSALVIGNMVGSGVFLLPSSLAAFGGLSLFGWLVSSTGAVLLALTFARLARVNPGAGGPYAYTRDGFGSFAGYLCAWTYWKAAWIGNAAIAVTLVGYLRVFIPALADPLLMVSVAIAAIWLCTLINLRGIGTFSVVQNLLTILKLLPLLLVGILGWFHFNPEHLAIPARSELPNMGYAQAIATTAALTLWSFIGLESATVPADDVEDPRRTIPRATLFGTLAAAALYILSITAVQGLMPPEVLARSTSPFADAARILMGDWGYYLVAAGAVIACLGALNGWVLLQGQIPVAPARDGLFPESLGQLNKNGAPAHGLLASGLLVTALVMVDGHGDLVDVFNVIILLGTMTGVVPYAFCTAALLQLLAVRPDEFSPRSRRQLLVIGSLGFAYSLWALYGTGQQAIFWGFLVLMAGIPMYTWRQWRNQVNGVPTLKAND

SEQ ID NO: 8825 - protein, 308 aa, Prochlorococcus marinus str. MIT 9515
MIKPIKLANKNFLSSLDLSTDEIINILDLAKNFKNNKLNVDLKNKVLGLIFDKSSTRTRVSFQVAMSRLGGTTIDLNPTTSQIGRGELIKDTARVLGRYCDVIAIRTFSHSDLEEYAKWSTKPVINALTDLEHPCQALADYLTIQEEFTDFKDVVLTFIGDGNNVANSLILCGALLGVEVRIACPKGYEPNSFVINKAYEIYNNKNLLKISDDPNTAVLGANVLYTDVWSSMGEEKQKEEKDKVFNGFTIDSDLVKKADKEAIILHCLPAYRSKEITDEVFESKKNRIFDQAENRLHAQQALLSCLLH

SEQ ID NO: 8826 - protein, 553 aa, Crocosphaera watsonii WH 8501
MQITNRIHFRNVKGDVFGGVTAAVIALPMALAFGVASGAGPAAGLWGAVLIGFFAALFGGTPTLISEPTGPMTVVMTAVITKLTADNPENGLAMAFTVVMIAGVFQIILGLLKLGKYITLMPYTVISGFMSGIGLILIILQFGPLLGTANPKGGVIAALKNLPLVVQSVSTNMGEVILGVLTVAVLFLMPSALKKYVPPQLVALIGCTLISLFFFSGSNIRTIPEFSTGLPSLVMPSFTIEQVNVMIIDGLVLGMLGCIDALLTAVIADSLTQTQHNSDKELIGQGVANLVSGLCGGLPGAGATMGTVVNIQAGGQTALSGLSRSFILLIVVLWAAPLTQNIPLAVLAGIAFKVGIDIIDWKFLGRAHKLSWKAASIMYGVMLLTVFYDLIIAVGLGVFVANVLTIQKLANIQADAVKAIDTHEDDTISCDIAKHLLQQAKGKIMVLDLSGPMSFGAAKAITQRQAILDNYKMLVIDLTDVPLLGVTATLALEKTIDDAYAKGLEVFIVGGEGKVQERLEKFNILDRVPSNHQVSDRVNALQMAVAQLDDVPI

SEQ ID NO: 8827 - protein, 1274 aa, Ajellomyces dermatitidis
MTRGDETLLAVAGILQGLAKDVPDSASLPFNSYKSNNATNGDVAKINLPGENSDGKAVLERELEDLIRRIGTMQCFVPPSRRSTRAAISSGQDTNSHGSPKPLPGSDVNYEDDIHFLQNRVQLQAQEIQLQKDVISRVREELKEQEKNTEKALGKVKKEDVGILERELRKHQQANEAFQKALREIGGIITQVANGDLSMKVQIHPLEMDPEITTFKRTINTMMDQLQVFGSEVSRVAREVGTEGILGGQAQITGVHGIWKELTENVNIMAKNLTDQVREIATVTTAVAHGDLSQKIESRAKGEILELQQTINTMVDQLRTFATEVTRVARDVGTEGVLGGQAQIEGVQGMWNELTVNVNAMAENLTTQVRDIAMVTTAVAKGDLTQKVQANCKGEILALKTIINSMVDQLKQFAQEVTKIAKEVGTDGVLGGQATVHDVEGTWKDLTENVNGMAMNLTTQVREIADVTTAVAKGDLTKKVTADVKGEILDLKNTINGMVDRLNTFAFEVSKVAREVGTDGTLGGQAKVDNVEGKWKDLTDNVNTMAQNLTSQVRGISEVTQAIAKGELAKKIEVHAQGEILTLKVTINNMVDRLANFAHELKRVARDVGVDGKMGGQANVEGIAGRWKEITEDVNTMAENLTSQVRAFGEITDAATDGDFTKLITVNASGEMDELKRKINKMVSNLRDSIQRNTAAREAAELANRTKSEFLANMSHEIRTPMNGIIGMTQLTLDTDDLKPYPREMLNVVHSLANSLLTIIDDILDISKIEANRMVIEKIPFSMRGTVFNALKTLAVKANEKFLSLAYQVDSSVPDYVTGDPFRLRQIILNLVGNAIKFTEHGEVKLAISRSDREECKDNEYAFEFSVSDTGIGIEEDKLDLIFDTFQQADGSTTRKFGGTGLGLSISKRLVNLMGGDVWVTSEYGLGSSFHFTCVVELADQSISMISASLMPYKNHRVLFIDKGQTGGHAEEITEMLKQLDLEPIVVKDESQVPPPEIQDPTGKDSGHAYDVIIVDSVDTARNLRTYDEFKYIPIVLLCPVVSVSLKSALDLGITSYMTTPCQPIDLGNGMLPALEGRSTPITTDHTRSFDILLAEDNDVNQRVAVKILEKCNHGVTVVSNGLQAVEAIKKRRYDVILMDVQMPVMGGLEVLRTPIIALTAHAMLGDREKCIQAQMDEYLAKPLKQNQMIQTILKCATLGGSLLEKSKEPRMSSSGEPPHHVPNSNGMKSLDTKNQRPGMDSQATSASGGPNPNQKSDVVSTRQTRVASSWTKD

SEQ ID NO: 8828 - protein, 269 aa, Haemophilus influenzae 86-028NP
MLTLNEHLLNQVLLIAYQAGKHLQQFYQKQVHVELKEDNTPVTEADLFVSQFLTEKLTALFPNVPVLSEENCHISFEERKNWKEYWLIDPLDGTQQFINRTDQFSVLITLVRKNKPVLSIIHAPILSITYYAMRDFGAFKKQLDQVKKLTKNTTNFDRPLRIAVGATTSQEKVRSILPKDFTCEFVVVGSSSLKSGLVAEGAVDCYVRLGQTGEWDTAGAEVLLNETHGAIFDSHFEPLTYNQRETLINPHFVMVGDQSFDWRSVFQFN

SEQ ID NO: 8829 - protein, 308 aa, Solanum lycopersicum
MKNLDHIAASVDWEKESLPEYQDLIFLLFFALFFPVLRFILDRFVFEALAKRMIFGKKTVVNINGREERKKINKFKESAWKFVYFLSAELLALSVTCNEPWFTDSRYFWAGPGDVVWPNLKMKLKLKLLYMYAGGFYFYSIFATLYWETRRYDFAAQIIHHVTTVSLIVLSYVYGFARIGSVVLALHDGSDVFMEIAKMSKYSGFDLIADIFFSLFALVFTSLRIICYPFWIIRSTCYELLYVLDIQKERTTGIILYFVFNALLICLLVLHLFWFKIILRMVKNQILSRGHITDDVREDSESDDDHKD

SEQ ID NO: 8830 - protein, 656 aa, Crocosphaera watsonii WH 8501
MENIKMGEEWSILAPEEIGSQDFFTDLLEDLYQRFLEVKEGENATYIPELAKADPDLFGISIMTTEGRIYSIGDTSELFTIQSISKPLVYGMVLEELGEEYVINKIGVEPTGEPFNDIMEPREIQERKYNPMVNAGAIITTSLIKGDTLEEKQEKLFNMFSRYLGRNVNLKESIFWSRKTGDSWNRAIAYMMLNFGLIEGNVEEILDLYFQQCSILVNCQDLALIAAILANKGLNPITGQRTINENYTKNLLSVMFTSGLYDFSGQWAYRVGLPAKSGLSGSIIGVIPNKMGIAVFSPPLGTQNKSVRGVKIFEEISQRFKLHIFKPDYSNNPLNKKKKVISSLFKKQDYLPSFLQHLYDKYLPLQEGKIYVSEPDLVEHDPNCFSICIVTVDGTVYTVGESEKPFLIQSISKVFAYGMALEDHGRDYILTKVEVEPTGDSYNSIIKVEENSKRPYNCMVNTGAIAMTSLIKGKSPAHKLNRLLKMYQRYVGHPVYVDTSAVVSEQNQGDRNWAISYLLRNFGMISGDIKQTLDLYLQQCSAIINCRDLAVMAATLANQGINPITDQSAINPEYVKDLLSVMFTCGMYDFAGEWCYKVGFPAKSGVGGGILGVVPGVMGIGVFSPPLDKRGNSIRGIKVCEELSQQFQLHIFQPLN

SEQ ID NO: 8831 - protein, 429 aa, Zea mays
  misc_feature (226)..(226): Xaa can be any naturally occurring amino acid
MSSVSPARELPDPDGFLRRWSDSPPPPSQSFFPAMTKIVGTLGPKSRSVDTISSCLKAGMSVARFDFSWGDAAYHQETLENLKLAIKSTKKLCAVMLDTVGPELQVVNKSETPISLEENGTVVLTPHQGQEASSTLLPINFDGLAKALTPGATIFVGQYLFTGSETTSVWLEVSEVKGDDVVCIIKNTATLAGSLFTLHCSQIHIDLPTLSDEDKDVIKKWGAPKXIDFLSLSYTRHAEDVRQAREFLSKLGDLSQTQIFAKIENVEGLNHFDEILAEADGIILSRGNLGIDLPPEKVFLFQKSALHKCNMAGKPAVVTRVVDSMTDNLRPTRAEATDVANAVLDGSDAILLGAETLRGLYPVETISTVGRICAEAEKVFNQDLYFKQTVKYVGEPMTHLESIASSAVRAAIKVKASVIICFTSSGRAA

SEQ ID NO: 8832 - protein, 405 aa, Polaromonas sp. JS666
MNPLLSRLQPYPFERLRQLHAGVTPNPAYRPISLGIGEPRHATPQLVKDALTASLSGLASYPGTLGEPKLRQAMSDWLARRYGLSIDPATQILPVNGSREALFSLAQTVLDASKPGATVVCPNPFYQIYEGAALLGGAQTWFAPSDPARNFAVDWAGVPETVWAKTQLVFVCSPGNPTGAVMSLAEWELLFKLSDRYGFVIASDECYSEIYFREGDAGGAPLGGLQAAAQLGRHDFKNLISLTSLSKRSNVPGLRSGFVAGDAALIKPFLLYRTYHGSAMSPVVQAASIAAWNDEQHVVENRALYREKFARVTPLLASVMEVALPDAGFYLWAGIPDIFRGSDTEFSRELLALYNVVVLPGSYLARDAQGHNPGAGRIRMALVAETAECVEAAERIVQFIQSKAR

SEQ ID NO: 8833 - protein, 153 aa, Glycine max
  misc_feature (11)..(11): Xaa can be any naturally occurring amino acid
MAEYAKTIQHXQAAARKEILPLPGVGKEDLEDPQNLLVEGIIDRAEANDAAQRKQKMMILEQQYRDDLKKELQGVTCTSAGSIETSTEVVQTGESTTSVHENVDHDDMGKLMLSRKRRGLVKAIEKSRERNKAQTDLIKQRKKKIDEEQRQRS

SEQ ID NO: 8834 - protein, 137 aa, Chlorobium tepidum TLS
MLRLDRVLFSSVLYPENYGFIPKTLGEDHDPLDIVVISQCSIVPMCIVKSRVIGVMRMIDHGENDDKIIAVAADDMSVSDIHDIGDLGKHFKMELQHFFEEYKALEQKTVLVEEFQDAATAKQILLDSIKRYSETYA

SEQ ID NO: 8835 - protein, 274 aa, Triticum aestivum
  misc_feature (3)..(3): Xaa can be any naturally occurring amino acid
  misc_feature (15)..(15): Xaa can be any naturally occurring amino acid
  misc_feature (45)..(45): Xaa can be any naturally occurring amino acid
  misc_feature (146)..(146): Xaa can be any naturally occurring amino acid
  misc_feature (213)..(213): Xaa can be any naturally occurring amino acid
  misc_feature (215)..(216): Xaa can be any naturally occurring amino acid
  misc_feature (227)..(227): Xaa can be any naturally occurring amino acid
  misc_feature (252)..(252): Xaa can be any naturally occurring amino acid
  misc_feature (254)..(254): Xaa can be any naturally occurring amino acid
  misc_feature (260)..(260): Xaa can be any naturally occurring amino acid
GAXSTVVYCVSSSYXALLFIYIPVLRRAPATYRRGMAATATKLSXGHEMPAVGLGVWRMDSAAVRGLIHSALRAGYRHFDCAADYKNEAEVGDALAEAFETGLVKREDLFITTKLWNSDHGHVVEACKDSLKKLRLDYLDLYLIHXPVATKHTGVGTTGSALGDDGVLDIDTTITLETTWHAMEDLVSMGLVRSIGISNYDIFLTRDCLAYAXIXXAVNQIETHPYXQRDSFVKFCQKHGISVTAHTPLGGXTXNTEWVXLGLMPRRYCIQVPG

SEQ ID NO: 8836 - protein, 688 aa, Oryza sativa Indica Group
MAVSWPGMVQWWEEWQLRVLALTSLFLQCFLFVSATFRRYRIPALFRTCIWLAYLGSDALAIYGLATLFNRHRKPAPGAVAAAGGTSNGHGRSSMLEVLWAPVFLIHLGGQDTITAYNIEDNELWARHAVAMSSQAAVSVYVFCRSWSGGKVPVRCPVALFVAGFLKMGHRLWALRRASITWHATVSSDRRSRRKTTAEEEEGDMSLENYIRQAREQAATRNIDDAVNINDDGEARRAARRRSREQRAQLLAPNILEELMELFIDFPAPYARRIGYLTSFMALENYDAYYNLCNLLDLAFQFFYTKKNTNYTIVGIFLWVLFFLLGITAVAGFDGLDSNKDGLDRDDVKVTYILLCSAIVMEFSSLVWLNDWNWVPLWMLAPEMHRTIVQFNLIGFAARSRWPTMVMWIATLLGCKNYVNQHWYLEHRSSTAKIIGFIRKDLTSGWVSLRSVADHRRFNDRRGHWTLRREQCYGELGWSVTELPFDEAVLVWHIATAICLHCTDVPTAAAEDADGASAAARSMEISNYMMYLLLFQPDMLMPGTQQSLFTVACREIRRALRNQRQEQEQLSERELARWLLFSVEEPTTAAAEQGGEGRHLADARRLAGAMMELDADRRLRVIGGVWVEMICYSASRCRGFLHSKSMGVGGEFLTVVWLLLHRMGMEGLADKLQRPELTTGDVQDAVVV

SEQ ID NO: 8837 - protein, 339 aa, Photobacterium sp. SKA34
MRVLVTGGMGYIGSHTCVQMIEAGMTPIIVDNLYNSKETVLGRIENLTGIKPAFYQGDIRDRAFLDSVFVENEIDAVIHFAGLKAVGESVEKPLEYYDNNVHGTLMLVEAMRAAGVNALIFSSSATVYGDPASVPITEDFPTSATNPYGRSKLMVEECLTDIQHAHPEMSITLLRYFNPVGSHKSGTMGEDPQGIPNNLMPFISQVAVGRREFLSVFGNDYPTIDGTGVRDYIHVVDLADGHLAALNHKGSEAGLHIYNLGTGNGNSVLQMVDAFSKASGVEVAYRIAPRRPGDIAECWADPAKAKAELHWEAKLTLDDMTKDTWRWQSTNPNGYPDAE

SEQ ID NO: 8838 - protein, 172 aa, Yarrowia lipolytica CLIB122
FHVITTVPPQPQLTIAVPKSYILLGFVGFYFILIFLNIGGIGQLLSNIAGLVIPGYYSLLALETPGKADDTQYLTYWVVFATLNVFEFWSKAILYWVPFYYLFKTAFLLYIGLPQYGGAELVYKAIVKPLAQKLVNIQPHGGPSDSLKAQAQSAVDAAESHVPQGHSTGVSH

SEQ ID NO: 8839 - protein, 794 aa, Aspergillus oryzae
MQHHHRSTTKTSHKPFKTKHASKGALKEKAKGKVERGERGTRKTPHQQLMSKLDRRNQARQKQQVKHQEKAQATSIFSGQSGAPRHVAIVPLSADIDVAAIIRSLNESVDVSCEVSHDTISRVRIDRFRQSVQYIPAKFDLMNALDVCRMADFVVVALSSEVEVQEQGELILRSIEGQGISNVLAVVQGLDKINPPKKRPQVASSLKSFINHFFPSVEKVLSVDSRQECSNAIRSLCTATPKGIRWRDERSWMLIENVAWPETNSEVVDDVVVTGVVRGRGLKADRLVHIPGWGDFQIDSITAAPLPQARGKRDDAMNVDESESSQVLDTPTEDIDDLAVVAPEEIEMEDDDMEIPEEERRGVLLDEHHYFSDDDSHIPAKPKKLPKGTSEYQSAWFLDDVSVSGSDLSDGEDEEMAMDTAGAPEDGIFPDNHDAMTEAGATEYPQSEMFVDPSPEDEERELEEYRASRRKEAKEDLEFPDEIELHPNVLARERLARFRGLKNFKTSPWETREDRPHEPEDWRRLLQIIDYKGTKNRTVREALIGGVNPGIRVDVHLRAVSTSLRNKPQPLCLFSLLRHEHKNTVVNVNMTLTSNIEEPLKSKEELIVQCGPRRLVVNPIFSSNDNTPNNVHKFDRFLHPGRSAIATWIGPLTWGAVPVLVFKNKTVQDPEVMDGDEQPDVEQLELIATGTVVAPDTSRVVAKRAILTGHPYKIHKRVVTVRYMFFNPEDISWFKALQLWTRRGRSGFIKESLGTHGYFKATFDAKINPQDSIGISLYKRVFPRKARALEEVTA

SEQ ID NO: 8840 - protein, 187 aa, Streptococcus mutans UA159
MILLIDNYDSFTYNLAQFIGHFTEVKVLRNDDADLYEAAQEADGLVFSPGPGWPADAGRMEALIKDFTGEKPILGVCLGHQAIAESFGGKLGLAHQVMHGKQSQMAITKSSPIFKELAEKLEIMRYHSIVVDKLPENFEVTARTVDDGEIMAIQHKTLPIYGLQYHPESIGTPEGLKMIENFVRLVG

SEQ ID NO: 8841 - protein, 446 aa, Polaromonas sp. JS666
MATVPTHVFHRNLQNTPPVAVSGQGVYLTDAQGKRYIDASGGAAVSCLGHGHPDVLAAMHAQIDKLAYAHTSFFTTEVAEALADKLIQTAPQGMSHVYFVSGGSEAMEAALKMARQYFVEIGQPQRQHFIARRQSYHGNTLGALAIGGNPWRREPFAPILIEATHLSPCYPYREQQAGETPGQYGLRLAQELEQAIFEKGADRVIAFVAETVGGATAGVLAPVPGYFKAVREVCDRYGVLLILDEVMCGMGRTGTLHACEQEGVLPDLLAVAKGLGGGYQPIGAVLAQANIVDAMRDGSGFFQHGHTYLGHAVACAAALAVQQVIERDQLLAQVRVRGGFLQQLMRSNWGEHPHVGDIRGRGLFWGIELVQERASKTPFDPARKLHARIKQEAMARGLMVYPMGGTVDGRYGDHVLLAPPFIASEAELTMMVERLGSAMDAAIAAA

SEQ ID NO: 8842 - protein, 326 aa, Streptococcus pyogenes MGAS8232
MTERYADKQIKLFSLTSNLPIAEKIAKAAGIPLGKMSSRQFSDGEIMINIEETVRGDHIYIIQSTSFPVNDNLWELLIMIDACKRASANTVNIVLPYFGYSRQDRVAKPREPITAKLVANMLTKAGIDRVVTLDLHAVQVQGFFDIPVDNLFTVPLFAERYSKLGLSGSDVVVVSPKNSGIKRARSLAEYLDSPIAIIDYAQDDSEREQGYIIGDVSGKKAILIDDILNTGKTFAEAAKILERSGATDTYAVASHGLFAGGAADVLETAPIKEIIVTDSVKTKNRVPENVTYLSASDLIAEAIIRIHERKPLSPLFSYQPKGKNNA

SEQ ID NO: 8843 - protein, 462 aa, Ralstonia metallidurans CH34
MHAPDNQGTLKRGLKNRHIQLIALGGAIGTGLFLGIAQTIKLAGPSVLLGYALAGVVAFFIMRQLGEMVVDEPVAGSFSYFANKYCGHFAGFMSGWNYWVLYILVSMAELSAVGIYVQYWWPGIPTWISALAFFLIINAINLASVKSFGEMEFWFSIIKVAAIVGMIGFGGYLLATGTAGPDASIANLWQHGGFFPNGFSGLVMAMAVIMFSFGGLELVGITAAEADSPEKSIPKATNQVIYRILIFYVGALAVLLSLYPWEKVVTGGSPFVLIFHAMNSNVVATVLNIVVLTAALSVYNSGVYCNSRMLLGLAQQGNAPRSLMRVNRRGIPLTALAVSAIATGICVVINYFMPGEAFELLMGLVVSALIINWAMISIIHLMFRRAKAAAGKTTRFQSLGYPLTNYVTLAFLAGILVVMFLTPGLRISVYLIPVWLGVLGVSYRLRQKKAGSAMPAASAQIQ

SEQ ID NO: 8844 - protein, 628 aa, Chlamydomonas reinhardtii
MDVFQYTTLDKGAGSALFRAPRLTYIGAADVQTRRARMSTGVDYLGHGAVKATEGPPVNPSGRKYPYELDSEGKAKSIPVWRFTNPHMGAFHLSWFAFFISFLATFAPASLLPIIRDDLFLTKAQLGNAGVAAVCGAIAARVLMGVFVDIVGPRYGTAATMLMTAPAVFCMALVTDFATFAAVRFFIGLSLCMFVCCQFWCGTMFNVQIVGTANAIAGGWGNMGGGACHFIMPLIYQGIKDGGVPGYQAWRWAFFVPAVFYIATALATLALGIDHPSGKDYRDLKKEGALKSKGAMWPVIKCGLGNYRSWILALTYGYSFGVELTVDNIIVEYMFDQFGLSLTVAGALGGMFGMMNLFSRASGGMISDLIAKPFGMRGRICALWIIQTLGGIFCVILGRVHNSLTSTIVIMIIFSIFCQQACGLHFGITPFVSRRAYGVVSGLVGAGGNTGAAITQAIWFAGTAPWQLTLTKYQGLEYMGYQTIGLTLALFFIWFPMWGSMLTGPREGATEEDYYIKEWSAEEVADGLHHTSLRFAMESRSQRGTRTSTQTKVMSVGDGAGSNKAEVVVVAAAQQGAVPMASVEEGSSGRSSSSGGHQQQDAHILHCIRTVVQKAPRVGERESERERD

SEQ ID NO: 8845 - protein, 629 aa, Ustilago maydis 521
MNPPASGSGDGGEDAASATQRSSSINQMAFCHECGIEIRPLMTPDPTCPRCNGQFVEIIDENSAADGMSFALETDEDDEIPLPGHFASLSSVQGGGLLNHLLTAMATGRAAQRSPHTPGSSDSNPRTATAADSPGRNQSPYTTTRSGTTSFGPFGLQWNVQYGSGGGDPYQRAAEQQAEQDQRQQQNSNLQSPPTLSNFLRFAFGGADSTDDPATRPDTYFHEDGMGGAGGVADGRHFNHDNRGTFHQPDRSNDPSSRDSGTNAGSPNNDLPPELSALRNLFTSLFGEPGAQGGSLLDVLAAGAQGGGPRGQWGDYVLGQQGLDDIISQLMEQTQGSTAPPPATEDVIEKLERFTLEDKQRIQKARNQDCPTCKDDFLPSSEANKQDGSGEKGEDADEQQQDLISMPCGHIFHVDCLVPWLRMHGTCPVCRISIVKPTEGQEEQSSSNTTTQQPQGSSGGNTSDASAARATAIPGGWPSPPNPFASSFNHNMHQGVQVPRDSPEVSTMTIHPQPATSTTVTSTTYPAHVIGTPSTTGATGPAGIVINSIMSSPPIVSDREEFFAEPPSMDESQQQAHSGIREDMRETLRRAAEDRARNAGAQADGSTGGAGQRQRQRQRQPWLEPDELD

SEQ ID NO: 8846 - protein, 263 aa, Vibrio campbellii AND4
MLTDKQFLRYQRQVALPEIAEMGQERLSKSHVLIIGCGGLGSAASLYLASAGVGKLVVVDDDEVDSSNLQRQIIYREKDLQVAKTEAMVKQLSELNSMVQVRALNKRLDKAQLQLEVMLADVVLDCTDNMPTRQLINQACFEQNTPLISAAAIGWQGQFAVFDYPTPREQEAESRACYRCLYPFDELPHTQKCSESGVAGPVVGILGNYQALAAIQKLATGKFHVETAKLHLFDGLKMQWQTMAISKDKQCQVCTQTSLMTHG

SEQ ID NO: 8847 - protein, 311 aa, Cucumis melo
NFQDYHGLPEFRNAIASFMGKAGGGRVKFDPSRIVMGGGATGASETVIFCLADPGDAFLIPSPYYAAFDRDLQWRTRAQIIPVHCNSSNNFQITREALEVAYKKAEESNIKVKGLIITNPSNPLGTIYDRDTLKSLVNFVNDNNIHLICDEIYSATVFKSPSFTSIAEIIEEMDHCKKELIHILSSLSKDMGLPGFRVGILYSYNDTVVSIARKMSSFGLVSSQTQHLLAAMLSDKEFVDNFLVENSKRLAKRHARFTEELEKMGITCLNSNAGLFVWMDLRKLLKDQSFESEMELWRVIINEVKLNVSPG

SEQ ID NO: 8848 - protein, 331 aa, Streptococcus pyogenes MGAS8232
MSIRSLFGGLREKILGKNMKIVFPEGNDERVVRAAARLKFEGLLEPIILGQSEEVRNLLTKLGFADQDYTIINPNEYADFDKMKETFVDIRKGKATLEDADKMLCDVNYFGVMLVKMGLADGMVSGAIHSTADTVRPALQIIKTKPGISRTSGVFLMNRENTSERYVFADCAINIDPTAQELAEIAVNTAETAKIFDIDPKIAMLSFSTKGSGKAPQVDKVREATEIAKGLNSDLALDGELQFDAAFVPETAAIKASDSAVAGQANTFIFPDLQSGNIGYKIAQRLGMFDAIGPILQGLNKPVNDLSRGSSAEDIYKLAIITAAQAIESQG

SEQ ID NO: 8849 - protein, 318 aa, Listeria ivanovii
MSNEYFDPKLKIFSLNSNRELAEEIAKEVGIELGKSSVTHFSDGEIQINIEESIRGCHVYVIQSTSNPVNQNLMELLIMIDALKRASAATINIVMPYYGYARQDRKARSREPITAKLVANLIETAGATRMITLDMHAPQIQGFFDIPIDHLNAVRLLSNYFGERHLGDDLVVVSPDHGGVTRARKMADRLKAPIAIIDKRRPRPNVAEVMNIVGNVEGKVCIIIDDIIDTAGTITLAAKALREAGATKVYACCSHPVLSGPAMKRIEESPIEKLVVTNSIALPEDKWIDKMEQLSVAPLLGEAIVRVHENASVSSLFE

SEQ ID NO: 8850 - protein, 330 aa, Emericella nidulans
  misc_feature (216)..(216): Xaa can be any naturally occurring amino acid
MDCPIPQTELDEIYAFATDLARKAGQLLLERVNDRNSEQVYAEKENAVDLVTQTDEDVESLIKTAIQTKYPAHKFLGEESYAKGESREYLIDEQPTWCVDPLDGTVNFTHAFPMFCVSIGFIVNHYPVIGVIYAPMLNQLFSSCLNRGAWLNEMQQLPLIRKPSIPPLPATAPSKCIFACEWGKDRRDIPDGTLQRKIESFVNMAAERGSRGGKGXMVHGVRSLGSATMDLAYTAMGSVDIWWEGGCWEWDVAAGIAILLEAGGLVTAANPPEDIEGPIEPVKLGSRLYLAIRPAGPSETETGRETQERTVREVWRRVRQLDYERPARQS

SEQ ID NO: 8851 - protein, 591 aa, Bordetella pertussis Tohama I
MSRAVSNQRRRFVQGLAGGGVLAGLGLWRQAAWAQPGAAQPEVLSGTEFNLEIGRTPANFTGAARMATTVNGSIPAPILRWREGDTVTLRVTNRLDEDTSIHWHGILLPTGMDGVPGLSFPGIRPGETFTYRFQVRQSGTYWYHSHSGFQEQTGLYGAIVIEPRRADPVRAERDHVVLLSDWTDEDPMSVFRKLKVMPDYYNYIQPTVDNLIDDARKQGWASTLGERLMWQQMRMNQTDLADVSGATYTYLANGKSPAGNWTGLFKPGERVRLRFINGSAMTYFDVRIPGLKMTVVAADGLPVRPVEVDEFRIAVAETYDVIVEPAEDRAYTIFSQAMDRSGYARATLAPREGMQAEVPALDPVQVLTMMDMGMAHDMPGMDHGAAGQQGAAMDHGAMGGMDHAAMGHGSSEASGGMVEVRHPYPAEHGPANSMLPDIVTTRLDDPGVGLRDNGRKVLTYADLRSMVEPEDNRAPTREIELHLTGNMDRYMWSFNGLKFSQAKPIVLKYGERVRFVLVNDTMMTYPIHLHGLWSDLESPDGNFQVRKHTISLNPAQRISYRVSADARGNWAYHCHLLYHMEAGMFRAVVVE

SEQ ID NO: 8852 - protein, 413 aa, Mycobacterium sp. MCS
MIEHTRSHVAKWMRRTTLLRPARLAGLRAEVEPVPVGVVGIVGPWNFPVNLVVLPAAAAFAAGNRVMIKMSEITAHTAELLEARAPEYFDAAELTVVTGGPDTAAAFTALPFDHLFFTGSPAVGVHVQRAAAANLVPVTLELGGKNPAVVGPRADLRRAAVRIAQGRMVNGGQVCVCPDYVLVPEYLVDEFSATVLATWRRMFPSITGSEDYCSSVNDANFDRVVGLIDDARAGGARVNSVVPPGETLPDRRSRKIAPTLIRDVTPTMRIASEEVFGPVLSVLGYSTTDEVIDHINSRPAPLVAYWFGPDDQDFRTFVRRTRSGGVARNDFAAQMIPSDAPFGGVGRSGMGAYHGKAGFDTFSHHRSVVGSDLPFSITGSAAPPFGAAMRRSTEFRLRMARRRNHRRLRRSHG

SEQ ID NO: 8853 - protein, 210 aa, Escherichia coli K12 [sequence omitted]

SEQ ID NO: 8854 - protein, 356 aa, Tropheryma whipplei TW08/27
MRMKALVYHGPGKRSLDTVDDPTIKLGTDVILEMETTTICGSDLHILKGDVAAVKPGTVLGHEGIGKIVEVGKDVKSHSVGDRVIVSPMSSCGVCRFCRANNNGHCLGDSEGPGGWRLGGLINGVQAQFARIPLADNSLHKLPSGLDPKVGILVSDVLPTGHEVGAQAGQVTLGSVVAVIGCGPVGLGAIVTSLLYSPSKVIAVDADSNRLELARKLGATDTVRVNRERPLDAIEDVKKLTEGGFGVDVAIEAVGVPVTFSMALGIAAPGGRVANIGVHGAPVDFPLQDLWDKNIAVTLGIVSTHTIPLLLAALSEGKIDASQFVTHEFDLSDLERAYDVFSAAAQHNVVKVAIRA

SEQ ID NO: 8855 - protein, 317 aa, Xylella fastidiosa Temecula1
MHSVVVVGSFSIDHVWRCDTLPTPGATIAGRYSRGPGGKGFNQAVAACRAGARTYFICALGNDTDGNMARDIATKDGFTLIGESSTEPTGTGGIYVDSHGHNTIVTGAGANAVLSTHFITEQRALITSAWIVLAQLESPIETLETALSMAREAGRLTILNAAPANATATINLLKLADVLTLNETEFVALLSRHVGERISPDNVATTDGNTLHALCNKLLSGSTVVITLGSAGVFVSHSEENLRGDTQPYYRVAAEQAHTVDTTGAGDAFNGALAASLARQPNTAFIQHIRLANSYAARSTETEGGAVSMPILTTTQD

SEQ ID NO: 8856 - protein, 315 aa, Magnaporthe grisea 70-15
MFGFFETKFNPTKDIPDLSGKVILVTGGNIGLGQSSVLELARHNPKHIFLAARNEEKARKAIESVSWELGTDKASVVSFLPLDLSSFDSIRKAAETVNSKTDELHILLNNAGIMMTPATTTKEGYEEQFGTNHMGHALLTRLLLPVLEKTAQGGKVDVRIVNLSSAGEGLAPTNAFDDLSRYKSPMEDVASHTRYGVSKLANIYHAQMLARKYPSIKAVSVHPGVVNTNLTRGLKETYPWIVPYVAPIAGALFFKTPAEGAKNQLWASTNEKVISGEFYWPVGLLGKGSEKSKDTEAAEKLWDWTEKELDAYLKQ

SEQ ID NO: 8857 - protein, 234 aa, Haemophilus influenzae 86-028NP
MHSFSQRRTFMKPYLIAPSILSADLARLGDDVQNVLNAGADVIHFDVMDNHYVPNLTFGPAVCQALRDYGITAPIDVHLMVKPIDRIIPDFAKAGANYITFHPESSEHIDRSLQLIRDCGCKSGLVFNPATPLSYLDYVLDKVDVVLLMSVNPGFGGQSFIPATLKKLQQARKIIDESGYDIRLEVDGGVKVDNIAEIAAAGADMFVAGSAIFGKPDYKQVIDQIRTQLASVSA

SEQ ID NO: 8858 - protein, 1562 aa, Botryotinia fuckeliana
MFYTHAERMYAERPIEGREGAQIPLHSDNYRGEPIQPHDSSSSESEINNDGTWGEHEQGGPVNCSTAMHEYEDLRHQLTHLSKTRSQKSVATARKASAMKRTMTNASRRSRATAGEDIEAQEEEEKLEEAAADEDEFVLGDFLKDGHFEKRNTKGSAKKVGVIYKNLTVQGVGATSTYVKTLPSAIMGTFGPDLYKLLTRFIPALPKPGSNGQRRDLIHDFTGCVRDGEMLLVLGRPGSGCSTFLKAISNKRGDYAGVTGEVSYGGISAEEQAKHYRGEVNYNEEDDQHFPSLTVEQTLDFSLLNKTKKHEKGDIPTIITALLKMFGISHTRHTLVGDAFVRGVSGGERKRVSIAETLPTKKTVVSWDNSTRGLDASPALDYANSLRVMTDISNRTTLVTLYQAGEQIYELMDKVLVIDEGRMVYSGPAGDAKKYFERIGYYCPPRKTTADFLTACTDPAERRFQKDFEGPIPKGPVELEKAFRESEDYRLLQEDVESYERMLHETDHADARQFKASVEETKSKTVGPRSPYTVSFFRQVLACTKREVELTLGDKTTLYTKFFIIISNSLIVGSLFHGQSSNTLGNFSRGGTLFFSILFLGWLQLSELMKAVGGRPIISRHKDYAFYRPSAVVVARVVQDFPLLLLQVVPFSIVVYFITGLDVDAGKYFIYVLFIYLTTICITSLYRMFAALSPSIDDAVRFSGIGLNLLIIYTGYVIPKPQLVSEYIWFGWLYYINPLSYSFEAGISDEFYNKNITCAPDQIVPSGPGYTNPEFQGCASTGAEVGSLSVSGARYLEQSFNYSRSHLWRNFGVVIAWTVLYIIVTAIATEVFDFTTGGGGALEFKRSKAAKNKVKAENATPDEENSPASTSPVPTSGASSSNTLEPPQEEALKDITGSESVFTWENVEYTVPYLGGERKILNGVNGYPKPGIMVALMGASGAGKTTLLNTLSQRQKTGVVTGDMLVDGRPLGTAFQRGTGFCEQMDLHDGTDTIREALELSAILRQEHTVPRAEKIEYVDKIIDLLELGDMQDALVRSLSVEQRKRVTIGVELAAKPNLLLFLDEATSGLDSQSAYSIVRFLKMLSAAGQAIVWSIHQPSSVLIQEFDMILALNPGGNTSYFGPVGENGSAVVKYFGDRGVQCPPLKNVAEFILETAAKGGKRRDGKKINWNEEWLNSNENKTVMQEIVRIKSERGKIAAPEASSQREFGSPVTLQTTELTKRLFTQYWRDPSYLYGKLFTSVIIGIFNGFTFWQLGHSIIDMQNRMFTSFLIILIPPTIVNAVVPKFYQNRALWEARELPSRIYGWVAFCTANIVAEIPIAIVGVVIYWALWYWPTGLPSDSSTSGYVFLMTMLFFLFQASWGQWICAFAPSFTVISNVLPFFFVMFGLFNGVVRPYSQISVFWRYWLYYVNPATYWIGGIIAATLSNVPIECASNEAAYFNPPSGQTCSSYASDFVTSAGVGYLTNPDAPPKLRILPYPSGEEYMKTLHVTPQDKWRNFGIFLGILYQQLGVGLFLHQQRGESEDGVSDSPTLFGGLGKMVGKVKSPFKGKEKKSVPESK

SEQ ID NO: 8859 - protein, 55 aa, Populus trichocarpa
MAKHEETPIPCFSSLEAVYGDGSQLEEAKLRFDHLNSKFLQVFGHPPDVFARSPG

SEQ ID NO: 8860 - protein, 527 aa, Vitis vinifera
  misc_feature (221)..(221): Xaa can be any naturally occurring amino acid
  misc_feature (525)..(525): Xaa can be any naturally occurring amino acid
MAAFLRCPNLAALSVSGRIAGEFIVYRVFFSTDRLPIRYGVVFHGKSNDAFIVIRMSHESDNFFPFHIILQHKSLVACVMEWKSKLNIPYSIKRSCFSSHALLDLPASGIVSIPLAQTGEGIAECELLKWFVKEGDQVEEFQPLCEVQSDKATIEITSRYKGTVSQIIYVPGDIVKVGESLLKMVVEESQGSNLTSNAPDDMKSMGAEVCDSSIQSSDLRXSNTGGVLATPAVRNLAKQYGVDINHILGTGQDGRVLKEDVLTHAVQKGLCKEPSSLSVNSVEHFQGEEKYSHTLAADGWQYEDKTVPIRGFQRAMIKSMTLAAKIPHFHYVEEINCDALVKLKASFQEENRDPEVKHTFLPFMIKTLSMALSKYPLLNSCFNEELQEITVKGSHNIGIAMATPHGLVVPNIKRITKELARLQQLALANNLCPEDISGGTITLSNIGAIGGKFGSPLLNSPEVSIIAIGRLQKVPQFVDDENVYPASIMTVNIGADHRVLDGATVARFCNEWKLYIEKPEQLMLXMK

SEQ ID NO: 8861 - protein, 245 aa, Nostoc sp. PCC 7120
MYVYFRADSMIFLPQPSSYLDTQEIKKLKSGGETKISAVHLVNPTAKYTIIYAHGNAEDLGEIRQFLEQLRDLGFNVLAYDYRGYGTSAGRPTENNAYQDIDAAYNYLTKDLKILPKNIIVFGRSVGGGSAVDLAARQPVGGLIIESTFTSAFQVVVPIKILPFDKFNNLEKIKKVNCPVLIMHGQADEIIPFTHAQKLYAASPSPKLKLWVDNASHNDFYGVAGQRYKNILREFTNLVSSSQKS

SEQ ID NO: 8862 - protein, 510 aa, Ralstonia metallidurans CH34
MSNTNTTPAVPVPGLRRELRARHLTMIAIGGSIGTGLFVASGATIAQAGPGGALAAYILIGAMVYFLMTSLGELAAYMPVSGSFATYGALYVDEGFGFALGWNYWYNWAVTIAVELAAAQLVMQYWFPDTPGVLWSALFLGLMFALNAISVRGFGEAEYWCALIKVLTVIAFIVIGTLMIFGIMRGDFSHAGGLANLTTGDAPFVGGLPAMIGVAMIAGFSFQGTELIGVAAGESDEPAKNIPRAVRQVFWRILLFYVLAILIIGILIPYTDPSLLKTDVETVGVSPFTLVFRHAGLAFAAGVMNAVILTAVLSAGNSGMYASTRMLYNLATEGRAPRIFAQLTRNGVPLVALLATTAVGGLCFLTSLFESKSVYLWLLNLSGMTGFIAWLGIAVSHYRFRRGFMAQSLDLNRLPYRSPFFPYGPIFAFVLCMIVTLGQNYQAFSEGKIDWVAVTATYVGIPIFLLIWLGYRLVRKSRFVPYAEMKFPALPEIEKDDSPVTRPLAPASAE

SEQ ID NO: 8863 - protein, 543 aa, Ustilago maydis 521
MTEAIHSQYDSILILDFGSQYSHLITRRCRELNVYCEMLPCTQKIKDLDWKPKGIILSGSPYSVYDEVAPRVDPDVFTAGVPVLGICYGLQEIAWNHGGKVDPHDKREYGHAMVEVVKHGVPHLDALFKNWEGSVQVWMSHGDQLSKAPEDFVVIAKTPTAPFAAMAHKSKPIYGVQFHPEVTHSLRGVELFDSFVDICACRRDWTMETFIDKEIKRIREIVGPKGQVLGAISGGVDSSVAAKLMHEAIGDRFHAVMVDNGVLRTNEAAQVYEMLSKDLGVNLTVVDASEQFLSRLKDVEDPEQKRKIIGNTFIHVFEAEVAKLEKQAEDEEAAALAAGKPQEAKGKFEYLLQGTLYPDVIESISFKGPSATIKTHHNVGGLLEDMKLKLIEPLRELFKDEVRALGKLLGIPAHLVGRHPFPGPGLAIRILGPVTREQVKILQHADSIYIDEIRAAGLYDQISQAFAVLLPVRAVGVQGDKRTYDQVIALRAAATTDFMTATWYPFPAEFLSKVSNRITNEVQGVNRVVLDISSKPPATIEWL

SEQ ID NO: 8864 - protein, 714 aa, Oryza sativa Indica Group
MVQWWEEWQLRVLVLTSLFLQCFLFFSATFRKHRIPAILRASIWLAYLGSDAVAIYGLAAIFSRHGKNAGDDGGRGESSMLEVLWAPVFLIHLAGAQDSITAYDAAEDNALWARRAVAMSSQAAVAVYVFCRSWSGGKVPARCPVALFVTGFLKMGLMLWALRRASATRIATVGRKAAAVEANWSLERYLQWASKSAIEATRNVQTNDDGDGGVDGGGENRSAARRHRSATSELHLDLIDLEYQNDLMELFIDFPNTYTSRLSYLSSFLKLEPYDAYCRLCDLVDYAFQIFYTSRNAAYPFASLFLILRFIFFMLAATAIGGFDGLDSNMDGLDTNDVQVTYILLYSVFAVEFSNMVSLRYHKWPVCKLEPQIKRTIAQFNLIGCGKRSRWSMKMNSKLSRRYLLIHTCQTVLSRVAMLLRCNNQYYWYHVEHSSSTEKVVGLIREDLRSGWVEDDLRSAAAYRRFNNRRGQWTLRREQCYGEMGWSVAKLPFDEAVLVWHVATDICLHCTQNIDIDISSSPAAGADEVAAVTEISNYMMYLLAFQPNMLMPGARQGLFTAARHEIMHAIRHQGRHQQQLSERDLARCLAGGDDDDEYSTPATEEQAGAGSRLLERKGGGGGGRHLAHARRLAGAMMKLDAGKRLRVIGGVWVEMICYSASRCSGSLHLKILGVGGGEFLTVVWLLLHRMGMEVLADKLHRPELARDEPDAVGV

SEQ ID NO: 8865 - protein, 602 aa, Yarrowia lipolytica CLIB122
MNDIEKNQDAASVASYSKQDAPAYDDEPSAIGSVHEHKAGKWQNFKDSFKPADLSQYDTTGMTEVEKAALATANSPLSRGLKPRHLQMIAIGGSIGTGLFVGSGTSLATGGPAALLIAYGIIGVMLFCTVHALGELACTFPVAGSFATYSTRFIHPAWGFAMGWNYTMSWFVVLPLELVAASITVNFWQDMNHTDINNAAWIAIFWALIVCINLFGVKGYGEAEFVFSLTKVVAILGFCILGIVLVAGGGPHQGYIGGKWWHRLPEGTVGPRGGAFAHAFKGVCATFVSAAFAFTGTELVGLAAAETENPRKMLPSATKQVFWRILIFYIVSLTLVGLLVPFDEPHLLKGSSSVDATASPFVIAIRNAGISGLPSVMNVVIMIAVLSVGNSAVYGFSRTIAGLAAMGHAPKWFAYIDRQGRPIVGILVVSFWGLFAFICAAPVATQNAVFGWLMALSGLASIFTWGSINLCHIRFRLALKKQGRTTRELVFTAALGIWGSVLGLTLNCLVLIAQFWIALFPIGAPKPTAEAFFNAYLAAPVVLFFALVWLVWKRDPWLSIDQLDIDTGRRDTDLVKLEAELEQERYELSQRKWFYRVYKAWC

SEQ ID NO: 8866 - protein, 388 aa, Saccharomyces cerevisiae YJM789
MNRTLTDNTRAINVASNLGAPQQRTIFAKERISIPGYYEIIQFLGKGAYGTVCSVKFKGRSPAARIAVKKISNIFNKEILLKRAIRELKFMNFFKGHKNIVNLIDLEIVTSSPYDGLYCYQELIDYDLAKVIHSSVQLSEFHIKYFLYQILCGLKYIHSADVIHRDLKPGNILCTLNGCLKICDFGLARGIHAGFFKSHSTVQPHITNYVATRWYRAPELLLSNQPYSKSVDIWAVGCILAEFYARKPVFMGRDSMHQIFEIIKVLGTPDKDILIKFGTIKAWNLGKNSNNPVYKKIPWSNIFPFASHEAINLIESLLHWDSTHRLNVEQAISHPFLNEVRKPDDEPVCLQGPFDFTYESELNSMSKLRDYLVEEVKNFKTDLSSSSL

SEQ ID NO: 8867 - protein, 309 aa, Rhizobium etli
MADLQATLDSIYTDILPRIGEGKVADYIPELAKIDPRQFGMAIVTVDGQVFRVGDADIAFSIQSISKVFMLTLALGKVGEGLWKRVGREPSGSTFNSIVQLEHESGIPRNPFINAGAIAVTDVVMAGHAPREAIGELLRFVRYLADDESITIDDKVARSETQTGYRNVALANFMRAYRNLDHPVDHVLGVYFHQCALAMSCEQLARAGLFLAARGSNPMTGHSVVSPKRARRINALMLTCGHYDGSGDFAYHVGLPGKSGVGGGIFAVAPGIASIAVWSPGLNKVGNSQLGAVALEMLAARTGWSVFGD

SEQ ID NO: 8868 - protein, 411 aa, Pseudomonas syringae pv. syringae B728a
MAIEIKAPSFPESVADGTISKWYKKEGDAVKRDEMLVDIETDKVVLEVLAEADGVMGTITKEEGAIVLSNEVLGTLNDGATASAAPAPAAAPAAAPASAPAAAPAATAGEEDPIAAPAARQLAEENGINLASVKGTGKDGRITKEDIVAAVEAKKSAPAAAPAAKPAAAAAPVVAAGDRTEKRVPMTRVRATVAKRLVEAQSNMAMLTTFNEVDMTEVMALRSKYKDLFEKSHNGVRLGFMSFFVKAATEALKRFPAVNASIDGSDIVYHGYADVGVAVSSDRGLVVPVLRNAEHMSLAEIEGGIATFGKKARDGKLSIDEMTGGTFTITNGGTFGSMMSTPIVNPPQAAILGMHNILQRPMAVNGQVVIRPMMYLALSYDHRLIDGKEAVTFLVTIKNLLEDPARLLLDI

SEQ ID NO: 8869 - protein, 478 aa, Pseudomonas syringae pv. syringae B728a
MSQKFDVVVIGAGPGGYVAAIKAAQLGLKTACIEKYQDKEGKLALGGTCLNVGCIPSKALLDSSWKFYEAKNGFSVHGISTSDVSIDVPAMIGRKSTIVKGLTGGVASLFKANGVTTLQGHGKLLAGKKVELTAADGTVEIIEADHVILASGSRPIDIPPAPVDQKIIVDSTGALEFQQVPQRLGVIGAGVIGLELGSVWARLGAQVTVLEALDKFIPAADEAVSKEALKTFNKQGLDIKLGARVTGSKVEGEQVVVSYTDAAGEQSITFDRLIVAVGRRPVTTDLLASDSGVDLDERGFIYVDDYCTTSVPGVYAIGDVVRGLMLAHKASEEGIMVVERIKGHKAQMNYNLVPSVIYTHPEIAWVGKTEQTLKAEGVEVNVGTFPFAASGRAMAANDTGGFVKIIADAKTDRVLGVHVIGPSAAELVQQGAIAMEFGTSAEDIGMMVFSHPTLSEALHEAALAVNGGAIHIQNRKKR

SEQ ID NO: 8870 - protein, 388 aa, Pseudomonas syringae pv. syringae B728a
MNLHEYQGKQLFAEYGLPVSKGYAVDTPEAAAEACDKIGGTEWVVKAQVHAGGRGKAGGVKLVRSKEDAAAFAQQWLGKRLVTYQTDANGQPVTKILVESCTDIAKELYLGAVVDRSSRRIVFMASTEGGVDIEKIAHDTPEKILKATIDPLVGAQPFQGRDLAFQLGLEGKQVTQFAKIFTGLAKLFQDHDLALLEVNPLVIKADGDLHCLDAKINIDANAMYRQPKLKGFHDPSQDDPREAHAAKFELNYVALEGNIGCMVNGAGLAMGTMDIVNLHGGKPANFLDVGGGATKERVTEAFKIILSDANVAAVLVNIFGGIVRCDMIAEGIIGAVKEVGVKIPVVVRLEGNNAELGAKVLAESGLNIIAATSLTDAAQQVVKAAEGK

SEQ ID NO: 8871 - protein, 773 aa, Ustilago maydis 521
MLLWLVLLAFCAGLMPIVALLCICIYISAYRSCSHSSNSKPCLGRSAAVVVLGDIGRSPRMCLHVESLANEGWKVAIVGYAGSTLPPALQRSSIKQHHLRSPPSWIARMPRAAFIAVAPFKLLVQAVSLFVELTTQVHPPPELILVQTPPALPTLLVVKAAAALVKSRVVIDWHNLAYTILALRLGEKSKLVRLAEWLEKWSGRKAFAHLFVTEAMKNHLDLNWKLQGDKLVLHDRPPAHFRRATLEETHSLMCKVLPQIVPSIGDDWLPSCNLPDSTPFTQRTDGGELQWSQDRPALVVSSTSWTADEDFGLLLRAAKLYEYRARLLAIQSSLPPHSRSSSTAETVSATLSPVSASSCSSASTTSHFSYTDIADPIRTSKERRRPSIGALRTPTLPNEPASSLPKLLIIVTGKGELKARYLAEIAHLEATEAWQFVRIRTAWLESQDYPLLLGSADLGVSLHTSSSGLDLPMKVVDMLGCGLPVCALDFACLDELVCERWNGVVFRDAEGLARQWESLLANHPLPNWLSTGGGMQEPFDPPARSVLTPKTGWLCEPGNTSAPPMSPNPSLTLVPSPGFAPWSNETATNKAKKSPRSTWPGNWKHVMRPLLDPRTDMDEHDENTVDDYLSHTSAIKLNAISAGILQRRAVSKQGYVAAATSPASSDTQRGSASKRKNSTDPQIDHDDQIATRSAPWNGFGFVSQAAVISDGESQKGLRQRKSVSKPSTDLTQQQHAFNLTLLDDALHDNRSTTDSQDQSSIPAIQVSKPPSPP

SEQ ID NO: 8872 - protein, 366 aa, Neurospora crassa
MASFFDIKARKAAAANGTPNPEKQTKETPRAQPWVEKYRPKTLSDVTAQDHTITVLQRTLQASNLPHMLFYGPPGTGKTSTILALAKELYGPELIKSRVLELNASDERGISIVREKVKDFARMQLTNPSAAYKARYPCPPFKLIILDEADSMTQDAQSALRRTMETYSKITRFCLICNYVTRIIDPLASRCSKFRFKSLDQGNAKKRLEEIAQLEGVGLEEGAVDALIKCSEGDLRKAITYLQSAARLMEVDAKLVTVKVVEDIAGVIPDDTIQRLLEAMRPRAGVDTYPAVAKVVEEMVADGWSAGQTMTQLYQAVVFDEMIPDVQKNKIVMVFSEVDKRLVDGADEHLSVLDLALRISGIMAGR

SEQ ID NO: 8873 - protein, 574 aa, Oryza sativa Japonica Group
VFFKAAEREAFLGAPEMQQRRKSVFASAPFAMKQAALGAGVAARRNGAPLSLAAVVFALFVFATFLYNEDIKSIADFPFGAGALRAKSPDLHVLQETVGAAHLAAGSIAKRGEEVIVRVLDAPASTAMAAAAGSSSNNSTIEVAKANANANANAADAGVKVDEGQERERDVTLPSVKEGGADEARRREDEEAAEKESSAKAAAATAALRTVVSVPDTCDLYRGNWVYDEVNAPVYKESQCEFLTEQVTCMRNGRRDDSYQKWRWQPTDCDLPRFDARLLLERLRNKRLMFVGDSLNRNQWESMVCLVQSVIPKGKKTLTKFVNGGNSNIFYAHEYNATVEFYWAPFLVESNSDNPQVHSVPDRVIQWHSIAKHAHNWLGVDYLIFNTYIWWLNTLDMKVLKGSFDQGATEYVEVDRPVAYKEVLKTWAKWVDRNIDPNRTTVFFMSMSPNHITPEAWGNYGGIKCAMETLPITNRTTSLDVGTDWRLYAGAQEVLQTFRRVPVHLVDITALSELRKDAHTSVHTLRQGKLLTPEQQSDPKTYADCIHWCLPGLPDTWNQFLYARIASAPWSSDQ

SEQ ID NO: 8874 - protein, 503 aa, Physcomitrella patens subsp. patens
MAARICSRKAVKEVTQKFSLYRVVGHRGYAAAAGADAAENDVIVVGGGPGGYVAAIKAAQLGFKTTCIEGRGSLGGTCLNVGCIPSKALLQSSHMYHEAQHSFAAHGVKVGSVSIDLPAMMQQKDKAVTGLTKGIEGLFKKNKVTYVKGYGKITSPNEVTVDLLDGGSQTVKGKNIIIATGSAVKSLPGITIDEEKVVSSTGALKLKEVPEKLVVIGGGYIGLEMGSVWGRLGSQVTVVEFGDAIVPSMDAEVRKSFQRSLEKQKMKFKLKTKVVKVEDTGNGLTLHLEAAEGGSPSTLDANVVLVAAGRTPFTQGLGLEELGVKVDKFGRVEVDHSFATNVPGVYAIGDVIPGPMLAHKAEEDGVACVELLAGKAGHVNYDTVPGVVYTHPEVASVGKTEEQVKAANIKYNVGKFPFMANSRARSIDDAEGMVKIIAEKETDKILGVHIMGPSAGELIHEAVLAMEYGASSEDIARVCHGHPTLSEAVKEAAMATYDKPIHF

SEQ ID NO: 8875 - protein, 498 aa, Mycobacterium sp. MCS
MTDAQDWKETLEDLERRRAHTYGMGGPERVAKHHGKGKLDARARITRLLDPDTFCEFGTLVGGDIAADGLVAGSGRVGGVPVMVGAEDFTTLAGSIGPGGNAKRYRLAELALRNKIPLVMLLEGAGFRPSGEHYGRTPTDLIIQAQCSGKVPTVAAVLGPSAGHGALVAPVCDFTIMSAGGAIFTAGPPVVKESTGEDISKEDLGGPEVALASGVIHNYGEDDETVIDDIRRYLSYFPSSAWSYPPTRLADDTADPRPTPELLDIVSRDNRHIYDMRTVLDVIFDRPDWLEVQPRFGRAVICALAHLGGFPVAVVANQPEVMAGSIDADAADKAAHFITVADSFHLPIVFLADNPGMLPGSRSERSGVLRSGARMFAAQTAATTLKLHVTLRKAFGFGSMVMSLLGFDDQVATFAYPGATMGAMSAAAMSRATHAGEDYTEVLKRMELEASYRSAGHLGFDELISPVETRDRLLTALQHGIFSRQAVAEPVARTVIMP

SEQ ID NO: 8876 - protein, 603 aa, Arabidopsis thaliana
MGSVSPDAQKDDLELEDSLNIDENLSGGNGLLKSGNLLSQKRQQCSLVSNSGKWLQIVKNGPKGSFSRATSFFDNKIPRQLVSVDEKYLRRCLDLINISAFKSASCSLSLNLVGSKMSLSSRRFDLPVIPKENVARLVFDLPLVDDSGSPVISRAIIGCKRVTYMLDKPTLHSLEALDGDGNNIGTRRDHNGESELVSYDVVRKIEEKNTPDSQFLSYHSGNMPRKAVSLSSTNSLSSSSSEQSSSSWSPSSSVSQGTLQFTMKDNKTPHFVFSLDDQKEIYVASLSTTSVGSGFDRSSLDYSYLIHLKKGRGSEPQHLVGKLKVSTLFSVSSTNEKTVERQFVLFSSGGNPQLPCHKDIRKNRGLPKKVVDALKSTKRTSRQRSISRFSRTSSIPDFCSWEPFQEHDSDLEPISLLDNDLPPNLETSAVVVREQFPVEEEEEEEVEKVGGWGMKFLKKIPLARTKDASKCSKHSTSIDVVIPLGIHGGPRNRNGGPSSLIQRWKSGGCCDCSGWDLGCPLTVLKGQARKDQSEGQCNLFELFTEGLMQGSPGLRIMNVRDGLYFVQSQAKISVLQSFSIALAYIHSQSQRLRPWSSKKCTEA

SEQ ID NO: 8877 - protein, 211 aa, Brassica napus
  misc_feature (174)..(174): Xaa can be any naturally occurring amino acid
EKRWALRRLTAVMAVAFGIGLVYYGMPLALSNLDFNVYMSAAFNALMDLPANLITLFLVDKLSRRNALIGFTALGGVSSVLIFALPNMRIGSHGALQLVLDLISYFCACSAFNIEMIYTIELFPTCVRNSAIAMTRQALVLGGVFSPIMVAAGRKNGFWSFGLFGLAIGLLGLXFAVALPETRGSDLCDTMDEEECKDRQGNNDIISSVIA

SEQ ID NO: 8878 - protein, 407 aa, Prochlorococcus marinus str. MIT 9515
MTNLNFEVITLFPKAFELINNLGVITRALEKKLIKVNLHDLREYGEGSYRQVDDKPYGGGSGMVLKPGPIFKAHDSIKKLPNIKTLLMSPQGKVLKQQDLLRWSTLDQLIIICGQYEGFDERVRCLADEEVSIGDYVLSGGEIPAMTIINGLTRLLPGTLGDPRSLIDESHNSSLLEYPHYTRPLIFREMKVPDILVSGNHEEIELWRKQKMFERTLERRNDLISYEDYKKSPKSKRIDEDSNEMMKFRIGNGYDIHRLVKGRNLIIGGVKLQHPDDLGLDGHSDADVLSHSIMDALLGALSLGDIGKYFPPSDQKWKDVDSLFLLSKVIELIRNQGWEVNNIDSVIVAERPKIKPFVELMKNNISDILQIEDSFIGIKATTNERLGPEGREEGISCHSVVLLEKKE

SEQ ID NO: 8879 - protein, 944 aa, Cryptococcus neoformans var. neoformans B-3501A
MSSLASAPPTASIPASDSYNSPVQSSGPGLGNGNSTPSKWKSVFKLGRTATIGRGKENRSALGGESFVLDNKEQQSFAGEVSPAVPTEPYLPPRKTQLRAHTDPYPPKSPSVKNNPGSVSVEHFDSKVLHEEGMPKTREEGSSESFNVHLNSSNGNLQTTSTSGEQSRPYSSVTDSASASTTERTSHSSGGHFLPGDGSLHGVASSNTYGTASTRSPTGGPLGIGNLKSRFFSAPLSAPAGKNKHDKSKSEKYRGLGKVATDFPQSTAPPSSAGGASSSGGGRKKSDGSSSLSSRGAASPRTPAKSKREPSANSSRRMPFGQTNDNGSNSGSVAARFLRRVVSAPNTKALFSNNLFSNAPDVPPLPAPKNQPNSSTSSKEKSSSPVVIVGNSGGHIDLTSSPDSDHPPSISPLSNSSTMYTSQTSHTPSASASATPTPSPLKQKNHFLSPTASPSPGQGSGLSAKGTRASRSLTTGTAPVLKNIRQLQGYSGSSPGGGGYMDGESRHKQVFKRTYSSNSIKTKQVEVTASSFQKIKLLGKGDVGKVYLVREKKTDKLFAMKVLSKKEMIKRNKIKRALAEQEILATANHPFIVTLFHSFQSQDYLFFVLDYCMGGEFFRALQTRPGKCLSEEHAKFYAAEVTAALEYLHLNGYIYRDLKPENILLHQSGHIMLSDFDLSKQSGEAGGAPAAIRHGGPNGQTILVDTRSCIADFRTNSFVGTEEYIAPEVIKGHSHSSAVDWWTLGILVYEMIFATTPFKGPNRNATFANVMKNEVLFPESVPVSSNCKSCIRKLLIKDENKRLGSASGASEVKQHKWFASVNWGLLRNMTPPIIPEESNGIDTINFRPLRESKSIDFDRDDITTDIIHAKAGSPSVSGNSTPGMLTPKELVQTTSSSSPIGGGAGGTSGHSSSAMPIPGSMRGYDKEKNPFGEFSSVTRDFGEC

SEQ ID NO: 8880 - protein, 191 aa, Cryptococcus neoformans var. neoformans B-3501A
MMRNTILRSTAAMASTSFARPAVRARPVLAAARTMGAGAGVSKRGYHAKVIDHYENPRNVGNLPKGDFDVGTGLVGAPACGDVMKLQIRVGEDGVISEVKFKTFGCGSAIASSSYMTERVKGMTLDQAGAVKNTEIAKELCLPPVKLHCSLLAEDAIKSAIKDYQTKRAQRLASTNATLASSSSQPQQAAA

SEQ ID NO: 8881 - protein, 653 aa, Schizosaccharomyces pombe 972h-
MPSTDLKKQADAAVESDVNTNNEAVESSTKEESSNTPSTETQPEKKAEEPEAAAEPSESTSTPTNASSVATPSGTAPTSASLYVGELDPSVTEAMLFELFNSIGPVASIRVCRDAVTRRSLGYAYVNFHNMEDGEKALDELNYTLIKGRPCRIMWSQRDPSLRKMGTGNVFIKNLDPAIDNKALHDTFSAFGKILSCKVAVDELGNAKGYGFVHFDSVESANAAIEHVNGMLLNDKKVYVGHHVSRRERQSKVEALKANFTNVYIKNLDTEITEQEFSDLFGQFGEITSLSLVKDQNDKPRGFGFVNYANHECAQKAVDELNDKEYKGKKLYVGRAQKKHEREEELRKRYEQMKLEKMNKYQGVNLFIKNLQDEVDDERLKAEFSAFGTITSAKIMTDEQGKSKGFGFVCYTTPEEANKAVTEMNQRMLAGKPLYVALAQRKEVRRSQLEAQIQARNQFRLQQQVAAAAGIPAVQYGATGPLIYGPGGYPIPAAVNGRGMPMVPGHNGPMPMYPGMPTQFPAGGPAPGYPGMNARGPVPAQGRPMMMPGSVPSAGPAEAEAVPAVPGMPERFTAADLAAVPEESRKQVLGELLYPKVFVREEKLSGKITGMLLEMPNSELLELLEDDSALNERVNEAIGVLQEFVDQEPGFTE

SEQ ID NO: 8882 - protein, 348 aa, Xanthobacter autotrophicus Py2
MSASPFVLPYHGILPVYPDLLRAGPRAALIGRVTLGPRAALGTLALIRGDGHVVEIGADFHLGDWGTVHIAHEMHPAIVGDRVTVGPDAVVHACTVGDDCVIEEDAIILDGSVLENGVVMEAGTIAFPRSRLEADTLYAGAPAKPVRRIDAAERAARAARIRALASAPPPPPPAGGAARLDIHSTTFIAANSSVSGAFKADAHASVLFSCTLDARNSEISLGENSNIQDNSLVRCPDGPVVVAANAVVGHNVVLESCTVGTGSLVGTGSRVAPGTVVEPDVLLAAGARTQRGQVLESGFLWGGNPARRIAPLDDKKRQMIPWIISTYCEYTADFLASQHRAAQRASFG

SEQ ID NO: 8883 - protein, 400 aa, Agrobacterium tumefaciens str. C58
MAFLADILSRVKPSATIAVTQKARELKAKGRDVISLGAGEPDFDTPDNIKEAAIDAIKRGETKYTPVSGIPELRKAIADKFKRENGLDYKPEQTIVGTGGKQILFNAFMATLNPGDEVVIPAPYWVSYPEMVAICGGTPVFVNATLEDNFKLKPEALEKAITPKTKWFVFNSPSNPSGAAYSHDELKALTDVLVKHPHVWVLTDDMYEHLTYGDFKFVTPVEVEPSLYDRTLTMNGVSKAYAMTGWRIGYAAGPLPLIKAMDMIQGQQTSGASSIAQWAAVEALNGTQDFIPENKKIFEGRRDLVVSMLNQAKGISCPSPEGAFYVYPSCAGLIGKTAPSGKVIETDTDFVSELLEAEGVAVVQGSAFGLGPNFRISYATSETLLEEACKRIQRFCADCR

SEQ ID NO: 8884 - protein, 307 aa, Aspergillus oryzae
MSVIDWGVVAPWTRCSFVLTGASEGGLGGATALALASARPSHLVLLARTENKVRTVISTIKEISPETQPAFVHIELEDLDSVRRAAADVLSLTSKIDVLINNAGVMAIPWSKSKSGLEKTLAINHIGHFLLTKLLMPSILAAGPGSRIVNVTSAAYRMAPFFFDDWNFSDGQTYHPLAAYGQSKTANILFTVGLAQRYKEHGILSFAAHPGYIPGTSLLLHGPDLDPSAMDEVARKNTGFPFGPDPPKSLEQGISTTLVAALSPELTDASGAYMEDCQVCEAREYARDPKLADRLWSLSEELASEAF

SEQ ID NO: 8885 - protein, 405 aa, Aspergillus oryzae
MWPTRSLSSLFFLSLALGSPVSQTEKRYAILDNDWGAVSFLPFLIALKNDVQVLGLVSDTANSWQRQCAYHALANLEVGNLSCIPVYAGATYPLINTPERFQAWESVHGKLPWEGAFALENATAEALGNDPTSGDPNRIVKPAFIEGFPTTKINHSTSAANFMVEMVHKYPHQVSIYSAGALTNVALAVRMDSDFASLAKELVIMGGYVDVNMYQVTGDYLQADINSDINLMVDPEAAKIALNAEFPEIVIAGNVANQVQSTQEYLDEVYTVKNEYTKLFHDHYGTEFPFWDETAAALMVDRSLATNTTTAYIDVDISYGSPNYGNIHVYQAMLKPPGVRNITYVNRIDGKPEWISIHFLHQRQYHSLNSSTYTVNKPSPTFLNKYICFARISSCFGFTLGQELS

SEQ ID NO: 8886 - protein, 412 aa, Ustilago maydis 521
MLSVQQQPPPALASSTLPLESIARALPDQVPENAPAHCPGTESEQAGKADACAGCPNQDACASAPKGPDPDLPLIKERMSRIKHKILIMSGKGGVGKSTFTAQLGWAFSSRFSGNSVYEDHVAEETKHAANGQGQQAADWDAEKQVAIMDIDICGPSIPTILGLAGQSIHSTSQGWSPVYVSDNLCAMSIGFLLPSASSAVIWRGPKKNGLIKQFLKDVDWTAGLEEDQDEEHENPAVSSLESGCVPIPDSAAAAAAAATSTTPPTLIDYMLIDTPPGTSDEHLSIVSYLKQSGITGAILLTTPQEVSLQDVRKEISFCRKMDVPILGIVENMAGFVCPSCTGYSEIFYPSTGGAKALCDELALTLLGSIPLDPRIGKSCDLGLSFCDEYPDSPATKAYLEVIARVRALVDS

SEQ ID NO: 8887 - protein, 375 aa, Triticum aestivum
  misc_feature (331)..(331): Xaa can be any naturally occurring amino acid
PRVRANLQSRVRKGKMTEERYGKALSLLSGALGYEKFKEVDLVIEAVIENVKLKQQIFADLEKYCPSHCILATNTSTIDLNLIGEKTKSQDRIVGAHFFSPAHVMPLLEIVRTQHTSAQVVVDLLDVGKRIKKTPIVVGNCTGFAVNRMFFPYTQSALLFVDYGMDVYKIDRACTKFGMPMGPFRLADLVGFGVAVATGMQYLENFPERVYKSMLIPIMMEDKRAGEASRKGFYKYEDKRKATPDPEIMTYIQKSRSMAGVTPDAELMKLSDKDIVEMVFFPVINEACRVLDEGIAVKASDLDIASIFGMGFPPYRGGVMLWGDSIGAKYXIHGKLQEWANRYGSFFEPCSYLAERAAKGIPLSAPAASQVKARL

SEQ ID NO: 8888 - protein, 482 aa, Ralstonia metallidurans CH34
MQLKDPSLFKQLAYVDGQWISADSGATFDVTDPATGEVIARVADLGAAETTRAVAAAEVAQKAWAAKTGKERANILRRWFDLMLANTDDLAYLMTREQGKPLAEAKGEIAYAASFIEWFAEEAKRVDGEVLATPAADKRLVTLRQPVGVCAAITPWNFPAAMITRKVAPALAAGCAIVIKPAELTPLSAFALAELAHRAGVPAGVLQVVTGDARNIGGVLTASPIVRKLSFTGSTEVGRILMAQSAPTIKRLSLELGGNAPFIVFDDADVDAAVEGAIVAKYRNGGQTCVCANRFYIQDGIYDAFAAKFAERTAQLRVGNGLEAGVVIGPLIEDAAIEKVNSLVEDATSKGGKVLAGGGKHPLGGTYYTPTVIGNATADMRMAREEIFGPVAPLFRFKQDDEAVAAANATEYGLAAYLYTRDISRAWRTAEALEYGMVGLNTGLISNEVAPFGGIKQSGVGREGSRHGIEEYLEIKYLCLQM

SEQ ID NO: 8889 - protein, 223 aa, Streptococcus mutans UA159
MDLQANKEHVFQEVAAYAQKSGRSKDDVTVIAVTKYVDSDTAEKLVEAGVKHIAENRVDKFLDKYRALKSYDLTWHLIGSLQRRKVKDVINFVDYFHALDSVKLAAEIQKRADHQIKCFLQVNISEEASKHGFRLSEVDKALEEIQHFDKIKVIGLMTMAPIDASEQELTDIFQKANALRKNLKERKLKNMPFDDLSMGMSGDFPIAIRNGSTFVRIGSAFFK

SEQ ID NO: 8890 - protein, 1606 aa, Ustilago maydis 521
MEANTSAAHPAPPIANTSVNEYSDAVDVGGTAAATTFAGSPVINSDGQHSSTDHNHASSAPEMPPVERIKSGRGSVPLSSIDPQGMAELTRRLTEHSMRARSRTTDGDGGEEALGFDPFDKNGKFDLERFLRLVMQQAEGAGNEVREMGLVWQNLTVTGLGSGYALGDTVGSLPLKPFEALKNIKSLLHPPVKVIIDNFEGCIKPGEMLLVLGRPGAGCTSFLKTLASYRDGFQDITGTLLYQGMDHTVIDKRLRGDVVYCPEDDIHFPSLTVWQTLAFAVATRAPQARRRLNLLQSEDTQTRDGYIKTLVEVVATILGLRHTYNTKVGNDFVRGVSGGERKRVSVAETFASRAKVALFDNSSRGLDSSTALEFVKSLRVSTDIANTTTAASIYQAGEGLTQLFDKVLVINEGRQVYFGPTSEAPDYFKEMGYIPQERQTTADYLVACTDAHGRRLREGYEKRAPRTAEEMAKYWQASPQGHKNRQEVEAYLEELTSKVDDAAVKRYKEVAREEKAKNTRKGSAYIISLPMQIRLAVKRRAQITWGDIATQVIIACASMFQAIIMGSVFLLMPKNTSGFFSRGGVLFFALLYNSFTAMSEITAGYAQRPIVIRHRRFAMIHPFSDALANTLLDMPIRLMTLTLFDVILYFMVGLQYTAGQFFVFYSTTALITFTMVAFFRMLSAATKSESLATMLGGLAIIDFALYTGYVIPRPSMVVWWKWLSYCNPVAFAFEILLTNEFRTLNVPCANFIPAGQAYADVSDQYKTCAVASAQPGQDIVIGSEYLAQSYGYTWSNAGRNAGIIFGFWFFFLIVYSLASEFQKDPSASGGVMVFKRGAAPKEVVQAAKASGDVEAGDAAGHTERVDREQDEQADKAVGKLESSTSVFAWKNVNYDVLIKGTPRRLLNDVSGFVAPGKMTALMGESGAGKTTLLNVLAQRTDTGVVRGLFSVNGAPLPKSFQSNTGYCQQQDVHLGTQTVREALQFSALLRQPRETPKEEKLAYVENVISMLEMESWAEALVGEVGMGLNVEQRKRLTIGVELAAKPKLLLFLDEPTSGLDAMAAWSVVRFLRKLADAGQAILCTIHQPSGELFNQFDRLLLLQKGGKTVYFGDIGPNSTKLVEYFGERADKRCGENDNPAEYILDVIGAGATATTDKDWHELFRNSYLFTDMMKEVERIDSLGADHPATAEEEAMGMREYAEPFSVQMTQVMRRAFMHYWRDTTYIMSKLMLNIIAGLFIGSSFWGQGRTQTSASLQNKIFAIFMALVLSTSLSQQLQPVFIQFRALYEVRERPSKMYSWPVAVTAALVVEIPWNLLGGTLFWASWYFMVGFPYGKTAALVWGMYMLFQIYYQTFAAAVAAMSPNPMIASILFSTFFSFVIVFCGVVQPPPLLPYFWRSWMFVASPFTYLLESMLGAVLNNQPVRCSAQEYNRITPPPGQSCAAYLANFVTSLDGPNLGTGYYIDGPNGSCDYCQFRIGNDYLRSIELNASNRFRDIGIICIYIVFNVLLCFTLFYFFRVFKLSSFKKKDGEKQPTIADQDEKPTVAAETVSRADAGAEKAVHALTSTSAAAKGPGHEGASQPGLVANPFGGGAGQHGVQDVQAKL

SEQ ID NO: 8891 - protein, 1430 aa, Mesorhizobium loti MAFF303099
MRCASEIQHEVDRRNFDVPETKRLRFRIGVHLGYVVAEGDHIAGEAVEVVAHLQTLSRPGGICVTEAVHAQAQDRLSLEFLDLGEHNLKNVARALRIYRVPLASEQPVRSPFRGLDAFEFEDADLFFGRARAIAACTARLEQQAASGTAFLLIYGMSGCGKSSLLRAGLLPSLTRPGAVAGISLWRRCLIRLSEGPDAFAVLAAALLSEAAVPELSCEVTAAQFALLCRSAPDRALAMVRQALGKAAGSAHSQIRLLVAIDQLEELFTTEKQPATREALVRLMAALAASGLVWVVGAIRSDFFHRCGEIPGFSALKDGLSSYELLPPTGPEIAQIIREPAGVAGLRFDESAELGRLDDVLQEAAAADPGSLPLLEFVLDALYQAGRERRVLTFAHYRALGGLEGAIARRADEVVDLLAPEIQEALPAVLRALTTASPGDETVTARPALLTEVAGTPARSALVRALIDARLLVSDEDAGGHVFVRVAHEALLSRWPRAGDIVNANRNFLETRERLRADAHRWYMESRNRELLLPSGKRLAEGEELLLSRREEVDDDVVEYIEASLRAHRQKAEKDRQAQLALIEAAEEAKRERLEREAERRSLAAAAANLLARRTRNAAIVAIVLALMAGAGALVAFRAQQEARWQRDQALRNHSLSLSFLSQQSAATGNTEAAILLALEALSSKDQSERPYLFDAEAALYKALLSHHQIKIFRHAAGVADAAFNSSGDHIVTASYDKTAGVWDISSGAETAVLKGHEGTVERAEFSRDGNRILTAARDGTARVWNAISGQQLFILQPVGDYPTAIFSPNGNQVLTAGENSDAALWDARTGKKIVSVSSGGYARAGFSSDGRSFATARKHSVSIWNSADGALTRSIRVNSRPYSLAFSPDGSRLLAGACGPLSYGGTSSLLDVSKGTEIAKLVDQKSDTQLNGVIFSHGGQRIATVSLDGAARIWDGASGTLHDLLGQEVSGLKLADIGADERDEEMNGAFSPDDRFLATASVNGPIRIWDVERASLVTTIAGHESLVEHLEFSPVDSNILLTASHDGTARLWDVDGALTTTLSHEYRPTFAVFSPDNVHLLTGGGDSAAHLWDALSGREIIRLDTHEIVQTATFSPDGKHVATASLGGQVRIWEIARGVETAQFQSHGGLIQIQFGRDGKSLVSASIDGTAQLWDAATGAELAVIDTSSKLPQAILSPDGRLILAAREDNSGHLLKADGAELKALVGHRDRITAAAFNPNGQLVATGSRDHTARIWSTADGASVLTLEGHTGEVTVVAFSPDGQSLLTASRDRTVRIWSVSGGLERAVLRGHSSAVDSAQFSPNGLYLVTASSEDRTVRLWATQSGRQIAVLASQDEATVRPSLTRAAFSSDGTRVAIISGEERVRIVRVFQTPNDLIDFARRTVPRELTPCERRSFFLPADPATGICPS

SEQ ID NO: 8892 - protein, 472 aa, Guillardia theta
MNKLFSIKIGPYYLGKTLGVGSFGKVKLGEHELCGQKVAVKILNRKKIKNLKMEEKVKREICILKLFMHPHIIRLYEVIETPTDIFVVTEYITGGELFDYIVERGRLNEDESRKFFQQMISGIEYCHNHMVVHRDLKPENILLDAHLNVKIADFGLSNIMKDGNFLKTSCGSPNYAAPEVINGKSYLGPEVDVWSCGVIMYALLCGSLPFDDENIPNLFKKIKSGIYILPGYLSDLSRDMIAKMLITNPLLRITINEIRDHPWFNSRLPKYLSFPTFKKNFVIQKKLNIDDNILELVSNKTFLSKKYIKLGIMKHERNSTAIIYHLIRESITPFDMITVDNSYIRDIIKKENVIKKSNEKEHNTSLHQAFLGIESPRENLKDILNEIQRAIKTFRSKTHNLNHFSVIIVINTNSLFETKYKKKKEIILRTTTILIQIFKRSMKYLIDLQKINGDSFFFLSTCNFIKQELNLK

SEQ ID NO: 8893 - protein, 2119 aa, Yarrowia lipolytica CLIB122
MDHEEQQEYNPISYNENNGSWAGALPTKQGLYDPEYEKDACGVGFACNIKGQQSHKIISDAKNLLCNMTHRGAVGSDARDGDGAGVMTSIPHKFIKKEFKRLYDFELPPMGQYACGNLFFKNDQDVLAKSKDTFESIAKSLGLEVLGWRFVPRDSSILGPAALSREPLILQPVVVLSEAFKSGPHTEDEWDSKFEKLFELQLYVLRKQSTHTIGLHNWFYICSLSNKNMVYKGQLAPVQVYNYYYDLLNVDYEGHFALVHSRFSTNTFPSWDRAQPLRWAAHNGEINTLRGNKNWMRAREGMMKSGLFGDELERLYPIVEEGGSDSAAFDNVLELLVINGVLSMPEAVMMMIPEAWQNNTTMDSKKRAFYEWAACLMEPWDGPALFTFADGRYCGANLDRNGLRPCRYYITDDDRMICASEVGVILIESEKVIQKGRLRPGRMLLVDTKEGRVVDDRELKKKIAGRVDFKSWIHANVITMEDMRQKVESKMPSILEVKIDELSVQSDPRLPAFGYTAEQLSLLLAPMAATAKEALGSMGNDGPLACLAKQPKVLFDYFRQLFAQVTNPPIDPIREAIVMSLECYVGPQGNVLEMNPSQCNRLLLPSPILTIQETAMLHEMHRHYPKWTTDTIDITFDKSEGPAGYLKALDRICEEASNSIHAKHQIIILSDKKTSADRVPVSSVVACGAVHHHLVQQKQRSRVALIVETAEAREVHHFCVLLGYGADAINPYLAIETLAKMNREGLIKEPLSDDQIVANYKTAVDGGILKVMSKMGISTLASYKGAQIFEILGIDNSVVDKCFAGTASRIKGITFDFIAEDAIALHERGFPSRETVKTKSLPESGEYHYRDGGDPHVNTPVAISNIQDAVRNKNEKAYEAYSKAEYEAIKDCTLRGLLDFDFDAATPVPIDQVEPWTEIVRRFVTGAMSYGSISMESHSTLAVAMNRLGGKSNTGEGGEDPERSAVAENGDTMRSAIKQIASGRFGVTSYYLSDADELQIKMAQGAKPGEGGELPGHKVSEQIGKTRHSTPGVGLISPPPHHDIYSIEDLKQLIYDLKCSNPRSRVSVKLVSEVGVGIIASGVAKAKADHILISGHDGGTGASRWTGIKYAGLPWELGLAETHQTLVLNDLRGRVTVQTDGQIRTGRDVAIACLLGAEEWGFATTPLIAMGCIMMRKCHLNTCPVGIATQDPELRQKFKGTPEHVINFFYYIANELRGIMAQLGFRTIDEMVGHAEMLRVRDDLRNHKTKNLDLTPILTPAHTLRPGVATRKVRKQDHRLHVRLDNKLIDEAEVTLDKGLPVTIDCDIINTDRSLGSTLSYRISKRFGEAGLPDDTVHVNVKGSAGQSFGAFLAPGITLELEGDCNDYVGKGLSGGRIVVYPPKNSVFKAEENIIVGNTCLYGATSGTCFFRGVGAERFGVRNSGATAVVEGCGDHGCEYMTGGRVVVLGSTGRNFAAGMSGGIAYVLDMGQEFVNNVNSETVELGPVSDPQEIAFLRGLIEDHRHYTGSELADRVLTDFNRILPRFVKVLPTDYARVLEEQAAKVAEAKKREVSGYMHAIKEDPDADITNGELKRAATPKPCATPRSRKEPPVQDLEDAILDHNATKAKASKLVKLDKTRGFMKYTRRAEKYRDAKNRTKDWDEMNTRLTKEELKYQTARCMDCGVPFCQSDTGCPISNVIPKWNELVFQDRWQDALDRLLMTNNFPEFTGRICPAPCEGACVLGINEDPVGIKSIECAIIDHGFEQGWIKPKPPATRTGKTIAIIGSGPAGLAAADQLNKAGHSVTVYERADRIGGLLMYGIPNMKLDKRVVERRVQLMRDEGVTFITNTEVGEDKEVSVSGLRADNDAVVLCVGSTIPRDLPIKNRSLNNINFAMQLLRWNTKSLLDGDMDEVRESLKDKHVVVIGGGDTGNDCLGTSTRHGAKSVTNFELLPRPTPARPKDNPWPQWPRIFRVDYGHTEVAAHYGKDPREYGILSKEFVDDGEGNVKGIKTVRVEWKQSESGAWQMSEIPGSEEFFPADVVLLSMGFVGPEAQELAAERDGRGNIKTQTGDVKDLGLYKVQDNLFTAGDCRRGQSLVVWGIQEGRQCARAVDHFLMGCTRLPGNGSIEQRDLKLK

SEQ ID NO: 8894 - protein, 341 aa, Pseudomonas syringae pv. syringae B728a
MTTQQPVAVLGGGSFGTAIANLLAENGHQVRQWMRDPEQAEAIRVNRENPRYLKGIRIRPEVEPVTDLTAVLDASELIFVALPSSALRSVLSPHVARLNGKMLVSLTKGIEAQSFKLMSQILEEIVPQARIGVLSGPNLAREIAEHALTATVVASEDEALCQEVQAALHGRTFRVYASNDRFGVELGGALKNVYAIIAGMAVALDMGENTKSMLITRALAEMTRFAVSQGANPMTFLGLAGVGDLIVTCSSPKSRNYQVGFALGQGLTLDEAVTRLGEVAEGVNTLKVLKVKAQEVQVYMPLVAGLHAILFEGRTLSQVIEALMRAEPKTDVDFISITGFN

SEQ ID NO: 8895 - protein, 488 aa, Bordetella pertussis Tohama I
MFSSERAYMPVLRRTKIVATLGPATSTPERLDGLIRAGMDVARLNFSHGSAQDHRERVRLVRELAAEQGRFVALMGDLQGPKIRIARFTDQQVTLQAGQPFTLSRSHSKEAGDATIVGIDYPELVQDCRPGDELLLDDGRVVLVVDSVGAEEVHTTVTVGGPLSNNKGINRRGGGLSAPSLTDKDRTDIKLAAEMELDYVAVSFPRYGADIDEARALLRAAGSQAWIIAKIERAEAVADDDALDALIRASDGVMVARGDLGVEVGDAELVGIQKRIIQHARTLNKVVITATQMMESMVASPMPTRAEVSDVANAVLDYTDAVMLSAESASGQYPIEAVAAMARVCLGAEKHPTTTHSHHRLGETFTRCDETIALAAMYAANHFPGVKAIIALTESGHTPLIMSRIRSGVPIYCYSPHGPTQRRAALFRGVYTVPFAPAEYDPADLSNAAIDELKKRGRVAAGDWVILTKGDFYRDSGGTNGLKILKVE

SEQ ID NO: 8896 - protein, 104 aa, Synechococcus sp. RS9916
MAVNTTSPGPGGAAVLDKQTERVRKRSPRYKVLLHNDPVNSMEYVVSTLQQVVPQLSEQDAMAVMLEAHNSGVGLVIVCDLEPAEFYCETLKAKGLTSTLEPES

SEQ ID NO: 8897 - protein, 152 aa, Triticum aestivum
  misc_feature (15)..(15): Xaa can be any naturally occurring amino acid
  misc_feature (25)..(25): Xaa can be any naturally occurring amino acid
  misc_feature (48)..(48): Xaa can be any naturally occurring amino acid
  misc_feature (100)..(100): Xaa can be any naturally occurring amino acid
APGQVTISQKEMTRXQDMLPNLRSXVNQMLSALNMPSFANRNSLLGPXRKPEAMTRMVGLDNNGLVGLQRQIMKGHLMEICLEQLEETVARPKHIALAVXRRAASHSRIIDHLHQRVDLTDSRLRREHKNLAVLNKPIEGGCSCKCIATIGW

SEQ ID NO: 8898 - protein, 312 aa, Carboxydothermus hydrogenoformans Z-2901
MGGIATREAYGKALVELGQENPKIVVLDADLSKSTKTSDFAKAFPERFFNMGIAEQNLMGVAAGLSTVGKIPFASTFAVFAAGRAFEIIRNSICYPKLNVKIAATHAGLTVGEDGASHQAIEDLALMRVLPNMQVFVPADAAQTRAIVKKAAEIEGPVYIRLGRSGVPEVFSPDIRFEPGRGTVLKEGKDVTIVALGIMTAKALEAAKMLEAEGIAARVVDMASLKPIDRELLVESARLTGAVVTAEEHSVIGGLGSAVAEVLSEEYPIPVVKVGVNDVFGESGTPQALLEKYGLTARDVVAAVQKALTLKR

SEQ ID NO: 8899 - protein, 497 aa, Mycobacterium sp. MCS
MATISTPEYLLDQAKRRFTPTLNTIPGMGIVEKRLRDKLQNQEWKQFVLAEPPAGSGLKPVMGDSGLPVLGHMIETFRGGPDYLLQVYKTYGPLHYAYSPALPAVVALGPDATQAVFSNKNKDFSQRGWHPVIGPFFNRGLMMLDFDEHMYHRRIMQEAFTRTRLAGYVEHIDRVASQVIANDWVENDARFLFYPAVKELTLDIASVVFMGHEPGTDKELVTKVNDAFTMTTRAGGAIIRTGLPPFKWWRGLQARKVLDNYFEQRVKEKRGSEGTDMLTVLCHTADEDGNTFSDQDIVNHMIFLMMAAHDTSTSTLTTMAYHLSRNPEWQERCREESERLGDGPLDIEALEKLETLDLVINESLRLVTPLPFNVRQTVRDTELLGHYIPANTDVVLWPSVNHHLPELWTDPEKFDPARFTEPRNEHKQHRYAFAPFGGGAHKCIGMVFGQLEIKTVMHRLLRRYRLEPPRPGYVSKLDYAGMPVPMDGMPIVLRPLR

SEQ ID NO: 8900 - protein, 444 aa, uncultured archaeon GZfos12E1
MEEEKRKAGEKHLRTINKHEPEKVASEYHSYYRGKIEIGLKAPVRSYDDFAIWYTPGVAEPSREIKNSRERVFEYTNKGNSVAIVTDGTRVLGLGDVGAEAALPVMEGKAMLFKYLGGVDAFPLCLDTSDAEDIINTVKWVAPTFGGVNLEDIESPKCYYILERLQEELGMPVWHDDQQGTALVILAGAINALKVVGKRLSEIAISLVGAGAANMNVAKYLCLAGAKEGNIVMVDSKGILNRERMEDVKRDENKRDMCEKTNKEGRKGGIKEAMRDTDLCIALSTPGPGVIKKEWVADMANDAIVFACANPVPEIWPVEAEEGGARIVATGRSDFNNQVNNSLGFPAVFRGALDVRAARITDGMCIAAANAIARYTEEEGKGKEKGISESRIIPRMEESEMYVCEAVAVGMKAIEQGVAEKGMSMKALEERVREKISDKTTKPF

SEQ ID NO: 8901 - protein, 189 aa, Glycine max
  misc_feature (14)..(14): Xaa can be any naturally occurring amino acid
  misc_feature (77)..(77): Xaa can be any naturally occurring amino acid
  misc_feature (125)..(125): Xaa can be any naturally occurring amino acid
  misc_feature (129)..(129): Xaa can be any naturally occurring amino acid
  misc_feature (134)..(134): Xaa can be any naturally occurring amino acid
  misc_feature (180)..(180): Xaa can be any naturally occurring amino acid
PSGVTTGLILSLRXESLHNCSDALATSQSELYAAKSQIHNWHSTLKNNPSILAWITPDAMMCIYSLLALKSSDRSLXERLENAKINDAAFIVTFAKRQLYIAHLKPAVRDLIVQLKPPSLHAMRXILEXPVHEXFTHFKNLVEEKDITVEELQDNIAAGSFTPRSNMAKTPMAQWSTLHXETDQIGNQA

SEQ ID NO: 8902 - protein, 240 aa, Arabidopsis thaliana
  misc_feature (5)..(5): Xaa can be any naturally occurring amino acid
  misc_feature (199)..(199): Xaa can be any naturally occurring amino acid
KKYGXSAGNVGDEGGVAPDIQTAEEALELITEAIEAAGYTGKMQIAMDVASSEFYKVDAKRYDLDFKNPDSDPTKWITYEQLADQYQTLAKKYPIVSIEDPFAEDDWEAWSYFYKNSDFQIVGDDLTVTNPIRINKAIELKSCNSLLLKVNQIGTLTESIEAAKVSYAAGWGVMVSHRSGETEDVTIADIVVGIRAGQXKTGAPARSERLAKLNQILRIEEELGDKAVYAGANFRTAVNL

SEQ ID NO: 8903 - protein, 635 aa, Crocosphaera watsonii WH 8501
MVKTPISPAQKVSKLENIKEHSNFLREPLASELLEDTNRFSQDAIQILKFHGSYQQYNRDKRAKGQEKDYRMMLRTRNPGGFISAQLYSTIDGLSDEYGNNTLRVTTRQGLQIHGILKKNLKASISAIVKSMGSTLGACGDINRNVMAPPAPLKNRPDYGYAWEYADKIADLLRPQSNAYYEIWLDGEKAISVEEDPEVTAARQRNINGTNFEEGEEPLYGQHYMPRKFKCSVTVPGDNSIDLYTHDVSLVVITDDSGELLGFNVLTGGGMGRTHNREETFPRLADPLGYVAKEDVFDLMKAILATQRDYGDRVQRRHARMKYLIEDWGIDKFRSQVEEYLGKALEPFKPLPPWEYKDFLGWHEQGDGKLFLGISIENGRIQDQGDFRLKSALQKITKEYSLPMRLTANHNLIFYEINPIDQADIESILLHCGIVSDPEKIDSLTRYSMACPALPTCGLAVTESERALPGILERINNVLARVGLAGEEIVIRMTGCPNGCARPYMAELGFVGSAPESYQVWLGGDANQTQLAQPYIDKLPDKDIESFLEPLFAYFKQDKTKQETFGQFCQRVGFEALRTFSENYTPPKPRRVRKNQHRVSVQDAMFARLKQASQDEKRPMNQIVQQALEAYFAEE

SEQ ID NO: 8904 - protein, 98 aa, Oryza sativa
  misc_feature (34)..(34): Xaa can be any naturally occurring amino acid
  misc_feature (57)..(57): Xaa can be any naturally occurring amino acid
FFVFCSCVCGCHQVLAPLPIGFAVFMVHLATIPXITGTGINPARSIGAAVIFNNEKXWHNHWIFWVGPFVGAAIAAFYHQYILRAGAIKALGSFRSNA

SEQ ID NO: 8905 - protein, 577 aa, Chlorobium tepidum TLS
MNAESNPILDFATEYVYPAFSELTGTDKIVAFGDHSHKCPIYVPQTPPCTAECPAGEDIRAINRFLNGTDPSDDPLKSAWETATDTNPFPAVMGRICPHPCQSKCNRGVHDESVAINAVEQVLGNYGIEHNLKLKGPGADTGKRVAIIGGGPAGLSAAYQLRRKGHAVTIYDANEKLGGMVLYGIMGYRVDRKVLEAEIGRIIELGVETKMGVTIGKDITLEQLEAEYDAVFIAVGAQKGRALPVPGFEGTPGATNAIDFLKSYEVLGDDIPVGKHVVVIGDGNVSMDVARLALRLGSQATIISGVPREEMACFENEFDDAKNEGTTMHFLTGTVEVLGGASGVTGLRCTKMVKKEKGEEGWNSPIPFLRYKSNGESFEIEADMVVAAIGQATDLSGLGSAASGPWLKVDRNFRIPGREKLFGGGDALKVDLITTAVGHGRKAAYAIDAFLKGEPMPEEPYREITKPHKQDLLYFLHTPQAKRTSIKPEVVVGNHDELLEALTPEQAVTESKRCMSCGFCFDCKQCVSFCPQEAITRFRDNPAGEKVYTNYAKCVGCHLCSLVCPCGYIQMGMGDGL

SEQ ID NO: 8906 - protein, 326 aa, Streptococcus mutans UA159
MTKAKSFLKEIDYSKKEIEDFIDLAMQFKKLKKERIPHRYFDGLNIALIFEKTSTRTRSAFTVAGQDLGMNVSYLGKDDIQLGKKESLVDTAKVLGTMFDGIEYRGFKQESVELLAEFSGVPVWNGLTDTWHPTQMIADFMTVKEHFGKFEDLTLAYLGDGRNNVANSLLVTSAILGINVKIIAPKELQPESEIVALAKKHQTKGLITITDDTAAVADTDILYTDIWVSMGEKVDFKERIDLLLPYQINQALLNRVRKPNALVLHCLPAFHDLNTEIGREIYERYGYKELEMTDAVFQKHSQTIFQEAENRLHSIKAIMYHSLKNI

SEQ ID NO: 8907 - protein, 338 aa, Ustilago maydis 521
MSTFRIPSASGTNAGTLNAAKGALAGAGAGAAASSSSNNKAAPKTYPFWLGGAAGCCAASITHPLDLTKYRLQTATVKQGMFRTIVRSVQTEGVTSLWHGLTATLLRQFTYSVTRFAVYEDMKSRVSARSGKAPTTGELALCSGTAGAVAGVVGNPAEIVLVRMCSDLNLAKDARYGYKNCVDGLVRIVKDDGASTLFRGLSPNVFRSVVMNISQLGSYDLFKRILQKLDVIPDGALLQTAASFCAGTLSTTLCTPIDVVKSRVQNLKNSAGANMRVSSVIRDALAKDGPAVFFRGWTPAWLRLQPQTTLLFLFFEQFKQLVDKSRHIKQHTEVHVNN

SEQ ID NO: 8908 - protein, 393 aa, Picea sitchensis
MAASVLKAGVRLGSSQWTGQSLTQNIDSHKQPKAQRVSMPIRAGSYAEELVQTAKTVASPGRGILAIDESNATCGKRLASIGLENNETNRQAYRQLLLTTPGLGEYISGSILFEETLYQSTTDGRKFVDCLREQNIMPGIKVDKGLVPLPGSNNESWCQGLDGLASRSAEYYKQGARFAKWRTVVSIPNGPSDLAVKEAAWGLARYAAISQDNGLVPIVEPEILLDGDHSIDRTLEVAEKVWAEVFFYLAENNVFFEGILLKPSMVTPGAEHKEKATPQQVADYTLKMLKRRVPPAVPGIMFLSGGQSEVEATLNLNAMNQSPNPWHVSFSYARALQNTSLKTWKGLPENIEAAQRALLIRAKANSLAQLGRYSAEGESEESKKGMFVKGYTY

SEQ ID NO: 8909 - protein, 450 aa, Picea sitchensis
MAKFGLLSFLVCSCIIINAALPAQAQTASTVSKLSKTDPLNTVLLQGFNWQAAKSTSPWYNVLKGIVEDAADAGITDVWFPPPSQSHPGGPEGYLPQRLYDLNSNYGSEQELRDAVDAFHQKGIGCVSDIVINHRCGTKQDDKGMWCVFEGGAEDGRLDWGPSAVCVNDKPYACGSGQADTGGDFTRAPDIDHTNPAIQANLSEWMNWLKSHVGFDGWRFDFALGYEGKLLGIYAENTNPEFAVGEVWDPVANGSDGRIAYDQDAHRQRLVDWVHSTGDRATTFDFTTKGILQEAVKSNELWRLKDSNGKPSGLIGVLPQKAVTFIDNHDTGSTQQNTWPFPPDKLILGYAYILTHPGIPTIFYDHFVGNMKTEIKNLTAIRKRNNINANSNCRIITAEGDLYMAAIDEKIVMKIGSRYDVGNLAPPSPDFSIVTAGIDYCVWEKKSSSP

SEQ ID NO: 8910 - protein, 375 aa, Paracoccus denitrificans
MRTRAAVALEAGKPLEVMEVNLEGPKAGEVMVEIKATGICHTDEFTLSGADPEGLFPSILGHEGAGVVVEVGPGVTSVKPGNHVIPLYTPECRQCASCLSGKTNLCTAIRATQGQGLMPDGTSRFSMLDGTPIFHYMGCSTFSNYTVLPEIAVAKVREDAPFDKICYIGCGVTTGIGAVINTAKVEIGAKAVVFGLGGIGLNVLQGLRLAGADMIIGVDLNDDKKPMAEHFGMTHFINPKNCENVVQEIVNLTKTPFDQIGGADYSFDCTGNVKVMRDALECTHRGWGQSIIIGVAPAGAEISTRPFQLVTGRVWKGTAFGGARGRTDVPQIVDWYMDGKIEIDPMITHTLSLDDINKGFDLMHAGESIRSVVLY

SEQ ID NO: 8911 - protein, 399 aa, Pseudomonas putida
MSGNRGVVYLGSGKVEVQKIDYPKMQDPRGKKIEHGVILKVVSTNICGSDQHMVRGRTTAQVGLVLGHEITGEVIEKGRDVENLQIGDLVSVPFNVACGRCRSCKEMHTGVCLTVNPARAGGAYGYVDMGDWTGGQAEYLLVPYADFNLLKLPDRDKAMEKIRDLTCLSDILPTGYHGAVTAGVGPGSTVYVAGAGPVGLAAAASARLLGAAVVIVGDLNPARLAHAKAQGFEIADLSLDTPLHEQIAALLGEPEVDCAVDAVGFEARGHGHEGAKHEAPATVLNSLMQVTRVAGKIGIPGLYVTEDPGAVDAAAKIGSLSIRFGLGWAKSHSFHTGQTPVMKYNRALMQAIMWDRINIAEVVGVQVISLDDAPRGYGEFDAGVPKKFVIDPHKTFSAA

SEQ ID NO: 8912 - protein, 228 aa, Zea mays
MLASSRTALRQAATKQLSLKSSVRAVSAWSQVPQGPPDAILGITEAFKADSNPKKINLGVGAYRDDKGKPYVLPSVREAEKKVVDSALDKEYAGITGVPNFTKAALKLAYGADSKPLNEDCIAVTQSISGTGALRIGGAFLERHYPGPKTIYIPTPSWANHNAVFKDSGLKVEKYRYYNKDTIGLDFEGMIADIKAMPKNSIVLLHACAHNPTGVDPTEEQWTKIADA

SEQ ID NO: 8913 - protein, 119 aa, Haloarcula marismortui
PVYVDFDVPADLEDDALEALEVARDTGAVKKGTNETTKSIERGSAELVFVAEDVQPEEIVMHIPELADEKGVPFIFVEQQDDLGHAAGLEVGSAAAAVTDAGAAATVLEEIADKVEELR

SEQ ID NO: 8914 - protein, 205 aa, Brassica napus
MAVSSAFVACPKLETLLNHHKLETPLGRALPSNNRSRRGLIQRARCELSASDSAPNAANISALEQLKNSAADRYTKERSSIVVIGLSIHTAPVEMREKLAIPEAEWPRAIAELCGLNHIEEAAVLSTCNRMEIYVLALSQHRGVKEVTEWMSKTSGIPVSEICQHRFLLYNKDATQHIFQVSAGLDSLVLREGQILAQVKQVVKV

SEQ ID NO: 8915 - protein, 479 aa, Prochlorococcus marinus str. MIT 9515
MTDLNFDFDLIVIGAGYGGFDAAKHAAGKGLKVAIVESGDMGGTCVNKGCVPSKALLAASGKVREIANYEHLSRFGIHASPVRFERSKIADHANNLVSNVRENLTKTLKRSGVEIILGFGRLEGNQKVGVRDKNGIDKIFTCKNTVIASGSSPFVPPGINLDNRTVFTSDEAVKLEWLPRWIAIIGSGYIGLEFADVYTALGCEVTMIEALENIMPTFDPDITKIAKKNLIQSRDIDTKSNVFATKITPGCPVKIELTDAKSKEIVENLEVDAVLVATGRSPNSKNLNLDSVGIETVKGYIPIDDQMRVINGKKIIPNVWAVGDVTGKLMLAHTAAAQGTIAVDNICGKNIEINYGSIPAATFTHPEISSVGLSETDAKEKAIKEDFTLGVVKSYFKANSKALAELESDGILKLLFNKDSGKVLGAHIFGMHAADLIQEIANAISRNQDVIQLASEVHTHPTLSEVVEVAYKQAASQVK

SEQ ID NO: 8916 - protein, 388 aa, Bacillus halodurans C-125
MNITIAGTGYVGLSNAVLLAQHNDVIAYDIVQEKVDMINNRKSPIVDREIEEFLATKELNLTATTDKEKAFKDAQFVVISTPTNYDPEKNYFDTSSVEAVISDVLSINPNAVMVIKSTIPVGYTREVNERFNTKNIIFSPEFLREGSALYDNLHPSRIVVGERTQRAKIFAALLVQGAIKENIDVLFTDSTEAEAIKLFANTYLAMRVAFFNELDSYAELKGLDAKQIIDGVGLDPRIGTHYNNPSFGYGGYCLPKDTKQLLANFEDVPNNIIGAIVDANDTRKDHVANMILKREPKVVGIYRLTMKTGSDNFRQSAILDVMTRLNNAGAEVVVYEPALDATEFDGSKVIEDFAEFKKMSDVIVANRLSDDLKEVAEKVYTRDLYTRD

SEQ ID NO: 8917 - protein, 417 aa, Prochlorococcus marinus str. MIT 9515
MELVDAPHSKCGTFGFVGSSPTAPTLMNTYTRFNISFKKGEGCWLWDTRGKKYLDAVAGIATCSLGHSDRILRKKLVAQLKKLQHISNLYKIEEQEELSKYLTKQSCAESVFFCNSGAEANESAIKLIKKFGNKIYTGKETFILAAESSFHGRTLATLSATGQPKYQKGFEPMVKGFKFFKYNDIASVKKLFDECQKNDQKVSGVLIEPIQGEGGVIPGDKLFFKDLRKLCTQNNSLLILDEVQSGVGRTGKMWGYETLGIEPDGFTLAKGLGGGHAIGALLVKEKANIFSPGDHASTFGGNPFACRAALTVLEEITRRKILNNVISRGNQLNEGFIKLSDKFPNIINGIRGIGLIQGLVINNSYTDPKTITLKAFDKGLLLVPAGGNVVRFVPPLIISRNEIKILLKKLNLIFEEL

SEQ ID NO: 8918 - protein, 343 aa, Bacillus halodurans C-125
MKILVTGAAGFIGMYVAKRLLEEGHFVVGIDNLNDYYDPQLKNDRLLQLRELGNFEFHKMDLTERDRLRQLFLDKEITHVINLAAQAGVRYSLKNPHAYIDSNLVGFTNLLESCRELNVKHLIYASSSSVYGANRKMPFATSDEVNHPVSLYAATKKANELLAHSYSHLYHIPTTGLRFFTVYGPWGRPDMAYFSFTKNIVEGQTIKVFNHGEMMRDFTYIDDIVDGVVALLEQPPQADPNWDFEHPMASSSYAPYKIYNIGNNQPVKLMDFIETLEKHLGIEAKKEFLPMQPGDVQATYADIDDLQQATGFTPSTSIDEGLKKFVDWFKTYYNVEAGVLIQK

SEQ ID NO: 8919 - protein, 397 aa, Neisseria meningitidis MC58
MFFKHIEAAPADPILGLGEAFKAETRPEKVNLGIGVYKDASGATPLVKAVKEAEKRLLESETTKNYLTIDGVADYNAQTQILLFGKDHEIIASRRAKTAQSLGGTGALRIAAEFAKRQLNAQTIWISNPTWPNHNAIAKAVGIQDKPYRYYDAAKHGLDWDGMIEDLSQAQKGDIVLLHGCCHNPTGIDPTPEQWETLAKLSAEKGWLPLFDFAYQGFGNGLEEDAYGLRVFLKHNTELLIASSYSKNFGMYNERVGAFTLVAEDEETAARAHSQVKTIIRTLYSNPASHGANTIALVLKNDDLKAQWIAELDEMRGRIKAMRQKFVGLLKAKGASQNFDFIIKQNGMFSFSGLTPEQVDRLKNEFAIYAVRSGRINVAGITDNNIDYLCESIVKVL

SEQ ID NO: 8920 - protein, 168 aa, Oryza sativa Japonica Group
MDSSNNNNNNKRARDAEDEADEAKRLRAEDLLDMLDDDTDAGGAAGDLASVMRSFEEEIVAGDVAGDVAPTTQPELGFLLEASDDELGLPPATASSSEEEAGAGEPEDAIGFGGQIWGFEDEIGGGGYAGFALTSPEAVCRRLEVNGNAGEEFTKLPWNHPFFTTPNL

SEQ ID NO: 8921 - protein, 293 aa, Bacillus halodurans C-125
MKKIRKAIIPAAGLGTRFLPATKAMPKEMLPIVDKPTIQYIVEEAISSGIEDIIIVTGKGKRAIEDHFDHSFELEQTLAEKEKYDLLEKVNESTKVDIHYIRQKEPKGLGHAVWCARKFIGDEPFAVLLGDDIVQAETPCLKQLIDQYEQTESSVIGVQTVADHETHRYGIVDPIDQKGRTYTVKQFVEKPKPGTAPSNLAIMGRYVLTPEIFTFLGRHETGAGGEIQLTDAIERLNEIQHVYAYDFEGKRYDVGEKIGFVKTTVEFALHDEAIKDEFARFLEAILEQKKVNF

SEQ ID NO: 8922 - protein, 139 aa, Novosphingobium aromaticivorans DSM 12444
MAKFLIVEARFYDHLNDMLVAGAKAALKEAGHEVEVITVPGALEIPGAIALADQSEDYDGYVAIGVVIRGETYHFEIVAGESARGIMALTMDGVAIGNGILTVENEAQALVRADPKQKDKGGEAAKAALALLALRERWS

SEQ ID NO: 8923 - protein, 303 aa, Oryza sativa Japonica Group
MGVPPVDWEAESYPAYSDFAAIPLFAVFLFAVRYLLDRFVFEWLARRLIFEKDEKLDLATHAGRIKIRKFKESAWKCIYFLSAELLALSVTYKESWFTSTKNFWVGPGDQVWPDQRIKFKLKLVYMYAAGFYTYSIFALQFWEIKRSDFGISMVHHVVSVILIALSYIFRFARVGSIVLAIHDASDVFLELGKISKYSGYQLLADVSFLIFVCSWAVLRLIYYPFWILWSTSYEVVPMLDKKKHKFDGPLHYYVFNCLLFSLLVLNIYWWVLMYRMLVEQILSKGHVGDDVRSGRFSPPFIPP

SEQ ID NO: 8924 - protein, 428 aa, Novosphingobium aromaticivorans DSM 12444
MTAIIDIHAREILDSRGNPTVEVDVLLEDGSFGRAAVPSGASTGAHEAVELRDGDKARYLGKGVTKAVTAVNSDIAECILGLDAEDQRDIDLAMIELDGTENKSRLGANAILGTSLAVAKAAADARGLPLYSYVGGVSAHVLPVPMMNIINGGEHADNPIDFQEFMIMPVGAPSLAEAVRWGAEVFHTLKKGLHEKGLATAVGDEGGFAPNLASTRDALDFVMASIEKAGFKPGEDMMLALDCAATEFFKNGKYEISGEGLSLSPDAMADYLAALCDAYPIISIEDGMGEDDFEGWAALTAKVGKRVQLVGDDLFVTNPKRLEMGIGKGLANSLLVKVNQIGSLTETLEAVSIAQRNGYTAVMSHRSGETEDATIADLAVATNCGQIKTGSLARSDRLAKYNQLIRIEEELGVSARYAGKTAFGRLGA

SEQ ID NO: 8925 - protein, 178 aa, Debaryomyces hansenii CBS767
MTYKVNDKFPVSVSLQYVPYSKEKGEIIACSNPTTFNLEKELPGKKIVLTSAIGAFTPPCTEDHLPTYLNNIKNFKSKGVDKIIVLTDNDPFVNSAWGKALGYKDEENYVIFATDPNAALSKNLGKKFIADMTDDGFGVRTSRYAAIIDNGVIKYLESEDGGGFTSTTNANDLLKKLD

SEQ ID NO: 8926 - protein, 187 aa, Neisseria gonorrhoeae FA 1090
MPWNIPIFLTWLRVLLIPVLIVLFYLPFSWFSEEAVNVAAAVIFAVAALTDWFDGFLARLWKQTSDFGAFLDPVADKLMVAVSLLLLVKLDRTYVLFAMIIIGREITISALREWMAQMGKRSSVAVATVGKFKTAAQMLAIFFLLLNFPDFYGFNLVVIGNILMFIASLLTVWSMLYYLKMAWKEIA

SEQ ID NO: 8927 - protein, 227 aa, Rhodopirellula baltica SH 1
MSDPFGSPFPSLHDQNLNAQHAMASDHRLANAASYQSYQRQRQMTLGDLLLENRIVFMQGEIHYANANEIVMKLLYLQSENRRKDIHLYINSPGGSVTATLAIYDTMQMLSCPVATYCVGEACSGAAVLLIGGAKGKRFCLPNSRVMMHQPLGGVSGQVSDIEIQAAEMFRYRDKLNEIISSHCGKSVEQIAKDTDRDFFLDAQQAKEYGLVDDLLLGTPASEEDED

SEQ ID NO: 8928 - protein, 195 aa, Rhodopirellula baltica SH 1
MPVIPYVVESNGREERTYDIYSRLLKDRIIFLGQQVDDQISNALVAQMLFLQADDPKKDIHMYINSPGGSITAGMAIYDTMQFVSCDVATYCIGQAASMGAVLLTAGAKGKRFALPNARIMIHQPLAGMQGTAREVEIHVAELRRIKQRMNEIMIEHTGHSLEKIEEDTDRDRFMSADEACSYGLIDKVVKSVDD

SEQ ID NO: 8929 - protein, 369 aa, Iris x hollandica
MPARVESLASTGMASIPTEYVRPEWERDGSLGDALEEAKKSDQLEGHQIPTVDLKGFDSEDEKERSRCVEGVKEAAVEWGVMHVVNHGIPPELIERVRAAGKGFFDLPVEAKERYANDQSEGKIQGYGSKLANNASGKLEWEDYYFHLIFPPDKVDLSIWPKEPADYTEVMMEFAKQLRVVVTKMLSILSLGLGFEEEEKLEKKLGGMEELLMQMKINYYPRCPQPELALGVEAHTDVSSLSFILHNDVPGLQVFHGGRWVNARLVPDSLIVHVGDTLEILSNGRYKSILHRGLVNKEKVRISWAVFCEPPKEKIVLEPLAELVAEGSPAKYPPRTFAQHVQHKLFKKAQAQAQVQAQAGVHIPEAIQT

SEQ ID NO: 8930 - protein, 202 aa, Triticum aestivum
  misc_feature (82)..(82): Xaa can be any naturally occurring amino acid
  misc_feature (96)..(96): Xaa can be any naturally occurring amino acid
  misc_feature (146)..(146): Xaa can be any naturally occurring amino acid
MGRKLALLVGINYPGTKAELKGCHNDVDRMHKCLVDRFGFDEDNITVLLDRGSSGPQPTGANIRHALAKLVGDARRGDFLFXHYSGHGTRLPAETXGQDDDTGYDECIVPSDMNLITDQDFRDLVQKVPDGCIFTIVSDSCHSGGXLLDKAKEQIGNSTKQNQTPARGSEGRAISFLAAGSRSFPQENRSGTHLSPHSPPRK

SEQ ID NO: 8931 - protein, 445 aa, Bacillus pseudofirmus
MSADWSYLREKSASRLAPSMAKDHPNLPVVKEEGCYYYGVDGVKYLDFTSGIAVTNVGHRHPKIVQAIKEAADHLTHGPIGVIQYESILKLADELADILPGDLDCFFFANSGTEAIEGALKLAKFVTKRPYVVSFTGCFHGRTQGSLGVSTSKSKYRKFLQPNGLTYQVPYFKPSDPRILDEEGEVVESLACELLEEEFTNLFKYHVSSEEVAAVILEPVLGEGGYIIPPASWLAKVREICNRHDILLIFDEVQTGFGRTGEWFAAQTFGVTPDIMAIAKGIASGLPLSATVANHTLMQQWPLGSHGTTFGGNPIACSAALATLDVLKEENLLDNAREVGAYARERLNLLKEKYEMIGSIRSVGLMIGIEIIDPQTKKPDGAAVLRILDLALQEGVLFYLCGNEGEVIRMIPPLSVTKEQIDDGLDMLQRALVKYKEETHQPASL

SEQ ID NO: 8932 - protein, 234 aa, Oryza sativa
MAAAAATAAAHLLSTPPLRPLQYTPLPMPASRPPDQRRRNPLLPHEGVRLFPPRFLSFPAAAAAPRVEPRGRPYLREHSCLIFPPSPRGRRPLAVVKFLGGAFIGAVPEVTYSHFLKLLAQEGFLVVSVPYNVTFDHEAAAREVYERFHGFYGALLSSGLPAAGLSAMDIAELPLYSVGHSNGALLQLLVGSYFSEKIPKANAIVSFNNRPASEAVPYFEQIGPLFSQVMPMME

SEQ ID NO: 8933 - protein, 92 aa, Triticum aestivum
MGYLQEARENHVKKKVEEALRSKMKQKALKECDVLCSKYAECARGRTFSVVWTCRKQAKELNNCLHQFTNDAILEDMKKAYMAEEESKEKNK

SEQ ID NO: 8934 - protein, 145 aa, Solanum lycopersicum
VAQLLGSTVACLLLKYVTNGLAVPTHGVAAGMSGAEGVVMEIVITFALVYTVYATAADPKKGSLGTIAPIAIGFIVGANILAAGPFSGGSMNPARSFGPAVVAGDFSQNWIYWVGPLIGGGLAGFIYGDVFIGCHTPLPTSEDYA

SEQ ID NO: 8935 - protein, 137 aa, Rhodobacter azotoformans
HDDMPCMDDDDLRRGLPTVHRKWDECTAVLAGDALQTLAFELLADPALGPAEVRIRLVETLARASGAEGMVLGQALDIAAETAAVPLTLEQITHLQAGKTGALIRWSAEAGAILGQADTGPLRRYATALGLAFQVAD

SEQ ID NO: 8936 - protein, 276 aa, Kluyveromyces lactis NRRL Y-1140
MAGIGESRSELLSWLNDLLKLDYTKVEQCGTGAAYCQIMDSIYGDLPMNRVNFCAGSEYEYFTNYKILQSCFTKHKIEKSVLVERLVKCRFQDNLEFLQWIKKFWTQHKDESEYDAEVRRKGRAGPSNPSAVSGNKRPVSSSTASKPPIRHIRSNVIQNNIRKSSNEQLLSLQTELSETRNQLSELEKECSQYKELNTAYLKERDFYFGKLRDIEIIAQSTQDLCDEGVYENDKELRPFLNRIQQILYATEEQTEPFVEENVEQASTNPIIDEETF

SEQ ID NO: 8937 - protein, 317 aa, Bacillus halodurans C-125; identical to SEQ ID NO: 1275

SEQ ID NO: 8938 - protein, 141 aa, Pseudorhodobacter ferrugineus
HDDMPAMDNDDLRRGLPTVHRKWDEGVAVLAGDALQTLSFELLTDATLGPNRLALISSMARAAGARGMVLGQARDIAAETAATPLTLPQITRLQAGKTGALFEWSATAGPVLAGADTGPLGRFAAAIGLAFQIADDILDVE

SEQ ID NO: 8939 - protein, 110 aa, Brassica napus
MEFSSQDDDFGGDFSAANASRAASGSKRSFGDLEDDEDDDIFGSKKGRTKAEEAAPGVATAMILSLRESLQNCKDDLASSQNELESATAEILKWKSAFQNESFIPAGKSP

SEQ ID NO: 8940 - protein, 138 aa, Rhodovulum strictum
HDDMPCMDDDDLRRGLPTVHLKWDEGTALLVGDALQTLAFEMLADPACHPDPAVRIDLVAALARASGIDGMVLGQAQDIAAETAGRALSLAEITELQANKTGALIRWSAEAGARLGGADIAPLSAYATALGLAFRSRT

SEQ ID NO: 8941 - protein, 110 aa, Rhodovulum strictum
HDDMPCMDDDDLRRGLPTVHLKWDEGTALLVGDALQTLAFEMLADPACHPDPAVRIDLVAALARASGIDGMVLGQAQDISVETDGRALSLAEITELHANKTGALSAGRPR

SEQ ID NO: 8942 - protein, 231 aa, Glycine max
MAVSELEVDGVVFPPLARPPGSEHAHFLAGAGVRGMEIGGNFIKFTAIGVYLQADAAVSALAAKWAGKPAADLASDAAFFRDVVTGEFEKFTRVTMILPLTGAQYSDKVTENCVAYWKATGVYTDAEAAAVDKFKEAFGPHSFAPGASILFTHSPAGLLTVAFSKDSSVPESGGVAIDNARLCEAVLESIIGEHGVSPAAKLSLATRVAELLEGAALAGGEPAAEAVSVSV

SEQ ID NO: 8943 - protein, 461 aa, Rhodobacter sphaeroides 2.4.1
MPAHRKRPMADFSTLGLSERLMQGLAKAQFTQPTPIQVEAIPYVMQGRDLMGLAQTGTGKTLAFGLPLLHRLLGVGHPPPPRTIRALILAPTRELVTQIATNLELFTKGTPVKVVTITGGASINRQTERLARGADIMVATPGRLIDLLDRNAVVLDHTGYLVLDEADQMLDMGFIHSLRKIARFLPLKRQTLLFSATMPKLIEELAHTYLREPVKVQVAPPGKPVEKIAQGVHFTPQGDKAKLLESYLQKHPGEQALVFGRTKHGSEKLMKLLVSWGFKAGSIHGNKSQNQRDRTLTEFRDGSLDVLVATDVAARGIDIPGVRHVYNYDMPNVPENYVHRIGRTARAGAEGSAVAFVAPAEMEEFRAVEKLLKQPIPVIGGAPWAADIVAAAPRPGQKPRQGGRPKTGAKPQGKPQAKAQPKPQGAAKAHPRAGRPAGAPGGHAAPKRAARGPRRGDAARG

SEQ ID NO: 8944 - protein, 147 aa, Bradyrhizobium japonicum
HDDLPCMDDDVLRRGLPTVHVKFGEATAILVGDALQAHAFLTLASLNAPGDSPIALVRELAQAVSAEGAAGGQAIDLSLVGKHVELDRIVAMHRMKSGALVRASVRMGALCAVGVNAAHAALYCALDHYSACFGLALQVIDDILDAE

SEQ ID NO: 8945 - protein, 59 aa, Brassica napus
KKVKKGLFAEHSPLLDDISGVPNWKKVNSGLLKMYKVEVLEKVPIMQHFLFGCLIKWEE

SEQ ID NO: 8946 - protein, 391 aa, Novosphingobium aromaticivorans DSM 12444
MADPALSHAPQPDGATGVLVLADGSVAWGRGFGAAGAAVGEVCFNTAMTGYQEVMTDPSYAGQVVTFTFPHIGNVGTNPDDMESHDTPGAVGCVVREDVTAPANFRAAGTFQQWMEQQGKIGISGLDTRALTRRIRLSGAPNAVIAHDPKGQFDIPALIERARSWPGLEGMDLARVVTRDGQEAWEGSVWHLGEGFTKPQGTGRPHVVAMDFGAKDNIFRNLVKAGADVTIVPAETSLETILSLKPAGVFLSNGPGDPAATGAYAVPVIQKLLEMDMPVFGICLGHQMLALAAGARTTKMHQGHRGANHPVKRIEDGVVEITSMNHGFAVDNAPGALGDKVIETHVSLFDGSNCGIAVKGKKAFGVQYHPEASPGPQDSFYLFEKFVASLV

SEQ ID NO: 8947 - protein, 289 aa, Streptococcus mutans UA159
MKDKIKSINQAIKHYYAQTHVSQDLIEAVLYSVDAGGKRIRPLLLLEILQGFGLVLTEAHYQVAASLEMIHTGSLVHDDLPAMDNDDYRRGQLTNHKKFGEATAILAGDSLFLDPFGLLAKADLRADIKIKLVAELSDAAGSYGMVGGQMLDIKGEHVQLNLDQLAQIHANKTGKLLTFPFVAAGIIAELSEKALARLRQVGELVGLAFQVRDDILDVTASFSELGKTPQKDIEADKSTYPSLLGLDKSYAILEDSLNQAQAIFQKLALEEQFNATGIETIIERLRLHA

SEQ ID NO: 8948 - protein, 403 aa, Physcomitrella patens subsp. patens
MAASTSFSSFIYLLLVVAFMTLYLVSHSPSNLHTRSHRRTLPGKRIKVRAVHHDKKHHDPVAFDPIVADFERRKEDLAWEKQHFEDQYKKLGEQLQKNGGISHHEEPYRGEPLKILKNDQVDPHDVDPDYEDPEEYLNDEDQFNITERLTSLFPLIDINPRDDYVTSLELLEWHLVQGKKAMLHRSDREMESHDKNHDGLVSLEEYLPHVLGAEQGHNSTEFDDAGWYKQQFEVCDRDNDGLLNATEFNDFLHPDDSNNPRVRQWCRLEQIRTHDTNKDGKIGWEEFHHGLFDQLQDEQDYHHPKLAEQLEAEKLVQSKRKFAELDRNKDGYLTEDEIAPVMEKLRPGELYYAKQQSDYLLHEADENRDERLSLDEMLNHPYIFYSTAYDEDEFDPAIHDEFR

SEQ ID NO: 8949 - protein, 1152 aa, Ralstonia metallidurans CH34
MHTSIEHRRVSCRGVLISGCQEPYAQEASNRAEWCSRLLKMTTELKKLLIANRGEIALRVQRAARDLDIGTVAVYSQDDAGCRHRMLADEAIALDGAGPAAYIDIAGIIAAAKASGSDAVHPGYGFLSERADFAQACIDAGIRFIGPTVEHLALFGDKGRALQLAAECDVPVMPATHGGASLEEIERFFDAQGDAGIVIKAVGGGGGRGMRVVRRREDLAEAYARCRSEASSAFGVDALYAERLVSRARHIEVQIAGDGQHVIALGERDCTLQRRFQKLVEIAPSPVLKPELRAEIIKAALRLARRVNYQSLGTFEFLVEESESGEQKRFVFIEANPRLQVEHTITEQVTGVDLVALQIGLASGRTLVELGLDPASPPQPRGYAIQVRVNAEMTDAQGLARPAFGRLERFEPPAGPDVRVDSHGYAGYEPSPNFDTLLAKLIVSSAAPGFEAAVRRLQRSLAEFRIVGVPTNLNLLRALAQREDFLTQDVHTRLFESILPALMASAETIAEAERAQDARFGGASHATPVHASHATRAPEAEEELEEGLVAIRAPLTGRVVDIPVQLDEIVKPGQTVAVLDAMKMEHAIVAPCAGRVVDLRPEKGALVSEGHMLIVLEQAEADGVAVDAARNVDPNAIRADLQRVLDRHAYLYDAARPDAVAKRRSRGQRTARENIADLCDGDSFVEYGALALAAQASRRSKEDLIVNTPADGLITGIGEINRELVAKERARSAVMAYDATVLAGTQGKRNHIKTDRIVEVALRDELPLVLFAEGGGGRPGDVDFPSVSGLYQPSFAAFAELSGHVPVVGIVSGRCFAGNAAFLGCCDVIIADRSANIGMAGPAMIEGGGLGIFRPEDVGPASVQFANGVVDVLVENEAEAVVVAKHYLSMFQGRVTHWSAPDALALRQVVPENRLRVYDTRKAIEGIADVGSVLMLRGGFGAGIHTALARVEGQPVGIMANNPYHLGGAIDADAADKATRFMQLCDAHGLPIISLIDTPGFMVGPEIEAQAQVRHVSRMFLAAAKLRVALLAVTLRKGYGLGAMAMAGGGFRSANFTISWPTGEFGPMGLEGAVRLGFKKELEAVPDGPERKALFDKLVAQSYERGHAINTAAAVEIDAVIDPAETRKWIAQGIASADVRSRRARQSFVDAW

SEQ ID NO: 8950 - protein, 627 aa, Rhizobium leguminosarum bv. viciae 3841
MITLTDISARIAGRLLLDNASVSLPSGTKAGLVGRNGAGKSTLFRVITGDLGSESGTVSIPKAARIGQVAQEAPATEDALIEIVLAADKERTALVAEAETATDPHRIAEIQMRLVDIDAHSAEARAASILAGLGFDKEAQARPASSFSGGWRMRVALAAVLFSEPDLLLLDEPTNYLDLEGTLWLEDYVRRYPHTVIIISHDRDLLNNAVNAIVHLDQKKLTFYRGGYDQFERQKAEADELQTKAKAKNDAARKHLQGFIDRFKAKASKARQAQSRVKALERMGTVAAVIEAHVQPITFPEPEKQPASPIVAIQSGAVGYEPGNPILKNLNLRIDNDDRIALLGSNGNGKSTFAKFISGRLAPESGEVKLAPSLKIGFFAQHQLDDLIPEQSPVEHVRRLMPGAPEAKVRARVAQMGLATEKMATAAKDLSGGEKARLLMGLAAFNAPNLLILDEPTNHLDIDSRRALIEALNDYEGAVILISHDRHLIEATVDRLWLVNGGTVTTFEGDMDEYRDLIVTSGKKKEERPQLVEDATSKADQRKLNAERRASLTPLRKKINEIESLTAKLEKQIQALDAELADPALYEKTPAKAAEKAKQRGEAAAKLAAAEEDWLMLSAEYEEAMAG

SEQ ID NO: 8951 - protein, 350 aa, Vitis vinifera
MSNFSSITTASNPNPNKSIEVAQPPSDSVSSLSFSPKANILVATSWDNQVRCWEIMRNGPTVGSVPKASISHDQPVLCSAWKDDGTTVFSGGCDKQVKMWPLLSGGQPMTVAMHDAPIKEVAWIPEMNLLATGSWDKTLKYWDTRQPNPVHTQQLPDRCYALTVRHPLMVVGTADRNLIVFNLQNPQTEFKRITSPLKYQTRCVAAFPDQQGFLVGSIEGRVGVHHLDDAQQSKNFTFKCHREGNEIYSVNSLNFHPVHHTFATAGSDGAFNFWDKDSKQRLKAMSRCSQPIPCSTFNNDGSIFAYSVCYDWSKGAENHNPATAKSYIFLHLPQEAEVKGKPRIGTSGRK

SEQ ID NO: 8952 - protein, 496 aa, Vitis vinifera
MYVHMFDKILEAIRKILMGSALSLNGSKTRFEEHSEVSVDETCKRQRLSSSISEENENVRLIPNLPDEISFQILARVPRIFYLNVRLVSRSWKGAIMSTELFNLRKELGTTEEWLYILTKIKDDKLLWYSLDPLSRRWQRLPPMPNVAHEDGYRKGFSGLRMLNMVGSSNKIADVIRGWLGRRDELDRIPFCGSAIGTVDGCLYVLGGFSRASALTSVWRYDPVQNGWSEVSPMSIGRAYCKTGVLNNKLYVVGGVTRGRGGLIPLQSAEVFDPRTGVWSQIPSMPFAKAQVLPTAFLADLLKPIATGMTSYKGKLFVPQSLYYWPFFVDVGGEVYDPETNSWFEMPVGMGEGWPARQAGTKLGAIVDDELYALDPSSSADIATIKVYDYQCDSWKVVSTDVPIHDFAEAESPYLLASLLGKLHVITKDANNNFTVLQANMQNHLHSFPLTPLSPLGNNSSEQTESAAESETDVWKVIAARSAGACELVSCQILGI

SEQ ID NO: 8953 - protein, 227 aa, Neisseria gonorrhoeae FA 1090
MELVFIRHGQSEWNAKNLFTGWRDVKLSEQGLAEAAAAGKKLKENGYEFDIAFTSVLTRAIKTCNIVLEESDQLFVPQIKTWRLNERHYGRLQGLDKKQTAEKYGDEQVRIWRRSYDTLPPLLDKDDAFSAHKDRRYAHLPADVVPDGENLKVTLERVLPFWEDQIAPAILSGKRVLVAAHGNSLRALAKHIEGISDEDIMGLEIPTGQPLVYKLDDNLKVIEKFYL

SEQ ID NO: 8954 - protein, 140 aa, Rhizobium leguminosarum bv. viciae 3841
MAIERTFSMIKPDATKRNLTGAITKMLEDAGLRVVASKRVWMSRREAEGFYAVHKDRPFFGELVEGMTSGPTIVQVLEGEGAILKNREIMGATNPANADEGTIRKVHALSIGENSVHGSDAPETAAQEIKYWFSDTEIVG

SEQ ID NO: 8955 - protein, 512 aa, Triticum aestivum
MSDLLFCFSSFPLTAQAESIVKHVASGGSWHGLHSFSEASARGFSSEPSLQAHSTEEIGFKGHGMLAPFTAGWQSTDVHPLVIDRSEGAYVYDINGKKYIDALAGLWCTALGGSEPRLVKAATEQLNKLPFYHSFWNRTTKPSLDLANDVLSMFTAREMGKVFFANSGSEANDSQVKLVWYYNNAMGRPDKKKFIARSKSYHGSTLISASLSGLPALHQKFDLPAPFVLHTDCPHYWRFHLPDETEEEFSTRLANNLENLILKEGPETIAAFIAEPVMGAGGVILPPKTYFEKIQAVLKKYDVLLIADEVITAFGRLGTMFGCDMYNIQPDLVSIAKALSSAYMPIAAILVSPEIADVVHSQSSKLGSFAHGFTYSGHPVACAVAIEALKIYKERNITEHVNTIATRFQEGIKAFSGSPIIGEIRGLGLILGTEFADNKSPNDPFPAEWGVGSIFGAECEKRGMLIRVAGDNIMLSPPLIMTPDEVEEIVSKYGGALKATEERIEELKSAKR

SEQ ID NO: 8956 - protein, 512 aa, Rhizobium sp. NGR234
MNSHPLMRLLRSRHTVMKLPSNAIKNDTMLPKIIPAIMAGGRGTRLWPLSRATAAKQFLKLIGEETLFQDTLKRVSDAKVYGAPLVITNEEFRFLVAEQARELGVTLSSIVLEPVPRNTAAAVAVAARIVADRFGEDALLLVLPSDHAITVDDTYKKCVRSACIAAAEGKLVTFGIQPTWPATGYGYIERGTYLGKDVHAVQCFVEKPSLEKAAALLETGNYYWNSGMFLFQAASIIAELEEHAPDVLSAVHAAVRGSTVDADFIRLAPESFSQAPSISIDYALMEKTANAAVVCSDFAWSDLGSWDAVWKNEEQNADGNVLKGNVTACNTKNSLVLSHTAHLAVQGMDGVAVIASEDAVFVGRLEEAHEIGNLVKRLAADENTARLTELHPTLIRPWGGYTTMLNGDRFQVRRLFVRPGKMLSLHKHFHRSEHWICVKGTAEVTIEDRVTILHENQSIYIPEGAIHRLGNPGKIMLELVEIQTGAYLGEDDIIRVADESRNEMPDSRRTGP

SEQ ID NO: 8957 - protein, 626 aa, Zea mays
MGEVVAASSLALVLLFFCSCGPASGLLSPKGVNYEVQALMMIKNYLKDPHGVLKNWDQDSVDPCSWTMVTCSPENLVTGLEAPSQNLSGILSPSIGNLTNLETVLLQNNNINGLIPAEIGKLRKLKTLDLSSNHFSGEIPSSVGHLESLQYLRLNNNTLSGAFPSSSTNLSHLIFLDLSYNNLSGPIPGSLTRTFNIVGNPLICAATMEQDCYGSLPMPMSYGLNNTQGTVIPAKAKSHKVAIAFGATTACISLLFLAVGSLFWWRCRRNRKTLFNVDDHQHIENGNLGNMKRFQFRELQAATENFSSKNILGKGGFGIVYRGQLPDGSLVAVKRLKDGNAAGGEAQFQTEVEMISLAVHRNLLRLYGFCMTASERLLVYPYMSNGSVALRLKGKPPLDWITRKRIALGAARGLLYLHEQCDPKIIHRDVKAANILLDDCCEAIVGDFGLAKLLDHRESHVTTAVRGTVGHIAPEYLSTGQSSEKTDVFGFGILLLELITGQTALEFGKSSNQKGAMLDWVKKMHQEKQLDILVDKGLGSKYDRIELEEMVQVALLCTQFLPGHRPKMSEVVRMLEGDGLAERWEALQHTESHKFKVPEFSFSRCHSDLTDDSSLLVQAVELSGPR

SEQ ID NO: 8958 - protein, 518 aa, Oryza sativa Japonica Group
MEKERKQGFFAALKEEVVRGLSPARSRGKSPARSASPGRMLIPRRRKEKQQQPPPEKLLQQYFAEPLISRSGSLRPGGEALAPLIEGPDPERLAAGGDFAGGEESARREGFGRWVRGQLARTPSVASSAAAAAAASPGGSGDSFRRSDLRLLLGVMGAPLAPIPSKLADPLPLLSIKGTPIESSSAQYILQQYMAASGGYRLLQSVRNAYAMGKVRMVASEFETATRVVKNRGPSGRGAASVEQGGFVLWQMAPDMWYVELAVGGSKVHAGSNGRLVWRHTPWLGAHAAKGPVRPLRRVLQGLDPLTTAGLFAEARCVGEKKVNGEDCFILKLSADPQTLKQRSEGPAEIIRHVLFGYFSQRTGLIVHIEDSHLTRIQPHSGGDAVYWETTISSALEDYRPVEGIMIAHAGRSAVTLFRFGEAAMSHTKTRMEEAWSIEEVAFNVPGLSVDCFIPPADIRSGPVGESCELPPPAAAPHGERARHPARVAAVDRAPPHHNAGGANVGRRGDKIMWRVEV

SEQ ID NO: 8959 - protein, 238 aa, Zea mays
MAERGGERGGERGGFGRGFGRGGRGDRGGRRGGRRGPRQEEEKWVPVTKLGRLVKENKITKIEEIYLHSLPVKEHQIVETLVPGLKDEVMKITPVQKQTRAGQRTRFKAFVVVGDGDGHVGLGVKCAKEVATAIRGAIILAKLSVVPVRRGYWGNKIGQPHTVPCKVTGKCGSVTVRMVPAPRGSGIVAARVPKKVLQFAGIEDVFTSSRGSTKTLGNFVKHMRYVVSAVFVLSLHQM

SEQ ID NO: 8960 - protein, 169 aa, Arabidopsis thaliana
  misc_feature (145)..(145): Xaa can be any naturally occurring amino acid
MTSSDQSPSHDVFVYGSFQEPAVVNLILECAPVMVSAQLHGYHLYRLKGRLHPCISPSDNGLINGKILTGLTDSQLESLDMIEGTEYVRKTVEVVLTDTLEKKQVETIVWANKDDPNMYGEWDFEEWKRLHMEKFIEAATKFMEXKNPNGRSREEFEKFVQDDSSPASA

SEQ ID NO: 8961 - protein, 294 aa, Bacillus halodurans C-125
MKTPNITVVGSINMDMVTITDVVPVQGETVLGKDFRTVPGGKGANQAVAAARLGANVRMIGRVGDDPFGHVLTENLAKEGIITDSVKPVTDCTSGVATILLSDRDNRIIVTKGANEHVTPDYVAAFEQELAASDVVLLQLEIPLETVAYVLEFCAKHHVTTVLNPAPAQKLPDAAWTDATYISPNENECLQLFGDEPDANLRQKLIMTKGADGVQFYENDEQVQVESFRVEPVDTTGAGDTFNGAFAVALGGGTVKEAVRFANAAAALSVQSFGAQGGMPTKAQVQSFLQEQGG

SEQ ID NO: 8962 - protein, 467 aa, Coccidioides immitis RS
MGGDVLAGTDFVDALKVFEHDDDTHGIIIVGEIGGTAEMDAAEWIKDYRRRTANPKPIMALVGGIEAPHGRIMGHAGAWTAPGEPDAQMKIKALQDAGAVIVDHPEKFGEGMKTLLGSSAKRPVFEDSTPRIARQQRGFHTLRRPQILRSSSISAQRRSLYLQQSDSFVLLKERNIPVRESNEPGAFFLGVSIDRTAHSPSFIASPTIDAKRYIESAKKFPFEYGKREFSANSAEIQAIAAHVGLAEPVQKSLSTLLEALTDIFMTKEAFSLETKVAVSSAGALEVQGARFGFDDAAYRSAKRQEDIHKLRNKELEVPEEVEAEKDGIVYVRLEGEGTIGTLVNGAGLAMNTVDALTIRGGHCANFLDTGGKATSETVKSAFKIILSDPRVKAIFVNIFGGLTRSEMIAEGIIMAFRDLGMKVPVVVRLRGTNEELGQKMIAESKLPLHAFDSFEEAAAKVISFSHS

SEQ ID NO: 8963 - protein, 665 aa, Moritella sp. PE36
MKYLVTGGTGFIGRFLIERLVEREDAQVYVLTRQGSEHKFNALKDRVHKSVKSRIKMVTGDITKVNLGIDELWLAEHTDQIDNVYHLAAIYDMKADAESQETANIVGTRNAVEASVKIKAKSFHHVSSIAAAGLFNGTFYEDMFEEAENMDNAYLRTKHISEKVVRDECSIPFRIYRPGMVVGHSKTGEIDKVDGPYYFFKLLKKIRETIPTWMPMIGVEGRRLNIVPVDYVADAIDYISHKEDVHSNCFHLVDPKPFKVGEVLNIFATAGNAPRTAFRIDSRIANFLPASVRQAITHLPAVKQLTEGVLNDLGIPKDVLNFLNYPTTFDDRETARALEGSNIKVPRLDEYAPAVWDYWERNLNDDLINDMTLKGNVSGKTIVITGASSGIGEATALKLAPTGAKLILVARDVTKLEATQAQIQELGGDAHIYSCDISNMESCDELVKSVLAEHGFVDILINNAGRSIRRSIDLSFDRFHDYERTMQLNYFGSIRLIMGFTPSMLEHKKGHVINISSIGVLTNSPRFSAYVASKAALDAFTRCAASEFSDRNVNMTTINMPLVRTPMIGPTKVYDNVPTLAPSEAADLIVQAIIRKPKRIATKIGIMSEVLYSLFPKVSEIIMNTGYRMFNDSAAAKGKEEDKDAPTQASTEQVAFAAIMRGVHW

SEQ ID NO: 8964 - protein, 379 aa, Triticum monococcum subsp. aegilopoides
MATAGKVIKCKAAVAWEAGKPLSMEEVEVAPPQAMEVRVKILFTSLCHTDVYFWEAKGQTPMFPRIFGHEAGGIVESVGEGVTELAPGDHVLPVLTGECKECPHCKSAESNMCDLLRINTDRGVMIGDGKSRFSIDGKPIYHFVGTSTFSEYTVMHVGCVAKINPEAPLDKVCVLSCGISTGLGASINVAKPPKGSTVAIFGLGAVGLAAAEGARIAGASRIIGIDLNASRFEEARKFGCTEFVNPKDHSKPVQEVLAEMTNGGVDRSVECTGNVNAMIQAFECVHDGWGVAVLVGVPHKDAEFKTHPMNFLNERTLKGTFFGNFKPRTDLPNVVEMYMRKELEVEKFITHSVPFSEINKAFDLMAKGEGIRCIIRMEN

SEQ ID NO: 8965 - protein, 272 aa, Neisseria meningitidis MC58
MKKDHLNTTGFDLWHTIREETAAAVSAEPMLASFLHQTVLRHESLGSVLAYHLSSKLGSPIMDVRALFEIYQQALGSDTQIGKCVEADLKAIYERDPACDEYSLPLLYFKGFHAIQAHRINHRLYLDGRKTLAYFLQNRMSEVFGVDIHPAARFGYGLMLDHATGFVAGETAVLGNNISILHGVTLGGSGKEGGDRHPKIGDGVMIGANASILGNIRIGSNAKIGAGSVVVSDVPPSITVVGVPAKPVARSLKTPSADMDQNIQFTEIDFMI

SEQ ID NO: 8966 - protein, 522 aa, Triticum aestivum
KHLPTPLITMSISFSQELLISTLAIILLPLMLYLRSSRSKNPSVLPINWPIVGVFPYLIANFHNLHDYLAVVLAGSGHNFRAHGPPGTGLRFFITCEPANVRHIFTTNHANFPKGAEFAAIFDIAGGSFFTTEGEPWRRQRARAQRVLSNPRLLACMTACCRDKVENGLLPVLMHMASTGTTFDLQDLTIRLVLDMTATPLFGVDPGLLSSDMPPMDAAVAMDTVMEVALFRHIVPTSGWKVMRRLNIGPERKLAAAHTVLRGFIEEMMERRKRKEHAGNEGAPSVDILSSYIDDPDYQQNDGLLHATLINYMIAGRDTIGTALTWVFYNLAQNPHVVSFIRHELSPIASQKAATGANNSSTMVIFEPEETKSLVYMRAALHESLRLHPPVPIERKTAVANDVMPTGHVVHAGDTLLISLHSMGRMEGVWGKDCLEYNPDRWLSEDGKKLRYVPSHKFLAFSSGPRLCLGKDISFMQMNTIVAAMVWNFDMEVVEGQRVQPKMSCVLQMKNGLIVKLKKREM

SEQ ID NO: 8967 - protein, 107 aa, Gossypium barbadense
QTKAIAGKVTNWDNVVLAYEPVWAIGTGKVATPAQAQEVHCELRKWLHENVGGDIAASTRIIYGGSVNGANCKELAAQPDVDGFLVGGASLKPEFVDIIKAAMVKKN

SEQ ID NO: 8968 - protein, 147 aa, Rhodopseudomonas palustris
  misc_feature (145)..(145): Xaa can be any naturally occurring amino acid
HDDLPGMDNSDLRRGRPTLHKAYDDATAILAGDALLTFAFDIVTRDEVHKDPTVRLLLTRVLARCAGLGGMVGGQMLDLAGEGRFGDREPVDVARLQQMKTGALLRYGCVAGAILGQANADQYRALDDYGRALGEAFQIADDILXVE

SEQ ID NO: 8969 - protein, 206 aa, Clostridium tetani E88
MKIIDISKTISEDMIVYKNRDSKRIKRTIAMDYEKGHYYESRVDFDMHCGTHIDAPLHMIKGGNTIENIDLSKVIGHCKVFDLTNIEKYIVKDNIKDLDIKENDIIIFKTKNSYDIEYNPKFVYVEEDAAKYLVDIGIKCIGIDAMSLERDKPHHPSHKVILEKGIVIIEDLQLKDVKEGNYFLSCLPLKIKGSEASPVRAVLIKN

SEQ ID NO: 8970 - protein, 419 aa, Vitis vinifera
MSATAKCMQMAGVCTRVTRNLNMEKLRNGYLFPEIAMRELEHMKKYPNAKVISLGIGDTTEPIPDIVTSSMANHARRLSTVEGYRGYGAEQGNKALRKAIAETLYGDLPIKDTEIFVSDGSQCDISRLQLLLGSNVTIAVQDPTFPAYIDSSVIIGQTGDFQDETGKYQNIKYMPCRPQNNFFPDLTTTATTDVIFICSPNNPTGHAASRKQLEQLVEFARANRSIIIFDSAYAAYVTDESPRSIFEIPGAREVAIEISSFSKFAGFTGVRLGWTVVPDELLFSNGFPVIKDYNRIVCTCFNGASSIAQAGGLACLSSDGLMVMQSVVDYYKENAKILGDTFTSLGLDVYGGINAPYAWVHFPGMKSWDVFTELLEKTHIITVPGCGFGPGGEEHIRVSAFGHRECILEASRRLKSLLS

SEQ ID NO: 8971 - protein, 479 aa, Clostridium tetani E88
MKNKAITIFGGTGDLAYRKLFPSLYNLYMLGSINDEYSIIGIGRRDYTKEDYLTYIQAGVKKFARINYSDDKFDKFSKIITYYKMDIQKEEEYKGLIKYYKDKDIIKNHIYYYAVAPRFFIPITKGLKNNKCYLKDAKVIIEKPFGEDLESATYLNEQLSFVFKDKNIYHIDHYLGKEMIQNIINIRFANAIFKGIWNKDFIENIQINAFESIGVNNRGGYYDQSGALKDMVQNHLFQLLSIVAMEEPKEFNSDFIHEAQLKVLTEMKPIEDRDIDNYLVMGQYEGYREEKDVNLKSKTETYVAMKIIIDNERWQGVPFYIRTGKKLNKRETEIIIKFKSTNKNIEGNLLIIKIQPDEGIYLKFNIKKPGTVDEIQKVSMDFCQSCILENRINTPEAYERLLKACMDSDRSLFSKWEQIVVSWKYINKVLESYRSYSNKLYRYKPETIGPKEAEELVKKDNHYWINDESNSCLKQGEDS

SEQ ID NO: 8972 - protein, 473 aa, Clostridium tetani E88
MNKQDIGLIGLSVMGSNLALNMADKGYKVAIFNRTTTVIDEVLEKYKHSNLFGKYSLKQLMDSLERPRKIIMMIKSGEPVDMLIEQILPYLDEEDILIDGGNSYFKDTQRRSKYLKEKGIKFLGVGISGGEEGARFGPAIMPGGDFGSYEKVKCIFEDIAAKVNGEPCCNYVGENGAGHYVKMVHNGIEYADMQLISEAYMLLKHLGKFNNKELHGIFAKWNEGELESYLIKITSNIFTVKDRETNNYLLDMILDKASQKGTGKWTNMEAIDLGVDVSIITSALNGRFMSNLKEERLRASKILNGKVESSINIEKEEFAELVRRSLYLSKIACYAQGFQLLKVASKTYNWDLQYGNIARIFRGGCIIQARFLKDIISAYEENNNACNLMITKVFSKVINEYDKSLRKTISIAINQGIPVTAMSSALGYMDTYRSYNLGANLIQAQRDYFGAHTFQRIDKEGNFHYDWVNNYEK

SEQ ID NO: 8973 - protein, 244 aa, Clostridium tyrobutyricum
ELRKHKGMTPDKANKIVRDPLYFATMMVKLGDADGLVSGSIHTTGDLLRPGLQIVKTAPGTSVVSSIFMMEVPNCDLGDNGFLLFSDCAVNPVPNTEQLAAIAISTAETAKSLCGMDPKVAMLSFSTKGSAQHENVDKVREATKLAKQMQPDLKIDGELQLDASLIQEVANLKAPGSPVAGKANVLIFPELQAGNIGYKLVQRFAKAEAIGPICQGFAKPINDLSRGCSSDDIVNVVAITAAQA

SEQ ID NO: 8974 - protein, 73 aa, Zea mays
  misc_feature (47)..(47): Xaa can be any naturally occurring amino acid
  misc_feature (62)..(62): Xaa can be any naturally occurring amino acid
YLWALHRLDPTGEDILITELHVILYHSNIDLYQCSQKDLTGSLFDVXRNFNAQLHFIVMNRXHTDNLVDDLLS

SEQ ID NO: 8975 - protein, 196 aa, Rhizobium leguminosarum bv. viciae 3841
MASRAYSIPNLLTYGRILAVPLIVLCFFIEGRLSISNTARWVALWIFVIASLTDFLDGYLARIWNQTSNIGRMLDPIADKLLVASILLLVAADQTIAGWSIWAAITILCREILVSGLREYLAALKVSVPVTRIAKWKTTLQLVAIAFLLAGPAGDEIFPYTTQTGIALLWIAALLTIYTGYDYFRAGVKHIVDDEE

SEQ ID NO: 8976 - protein, 230 aa, Streptococcus mutans UA159
MVKLVFARHGESEWNKANLFTGWADVDLSEEGTQQAIDAGKLIKEADIKFDLAFTSVLTRAIKTTNLALEYSDQLWVPVEKSWRLNERHYGGLTGKNKAEAAEKFGDEQVHIWRRSYDVLPPAMAKDDPYSAHTDRRYANLDDTVIPDAENLKVTLERALPYWEDKIAPALKDGKNVFVGAHGNSIRALVKHIKQLSDDDIMGVEIPNFPPLVFEFDENLNVTAEYYLGK

SEQ ID NO: 8977 - protein, 468 aa, Zea mays
  misc_feature (34)..(34): Xaa can be any naturally occurring amino acid
  misc_feature (73)..(73): Xaa can be any naturally occurring amino acid
MPVPMNTSYPDVVKFMRSGFALRFPLSYGDNIRXVSQRIRACHGFAVLSMKNQEIVQASGNRSWTFLRSRHYXFCVLDQLGSTNNDVKSVLIDIIVGIIPFVLWGLKSAHVICRFVLMPLAVFVFLAYKYWKTRITIDAVEKFLRMQHMLVPMRYAYTNIIAITAHFRDKLGQGGYGTVYKGVLQPGEVHVAVKMLGNSNCNGEEFISEVATIGKIHHVNVVRLIGFCSEENIRALIYEFMPRGSLDKYIFSSEKTFSWDKLNEIALGIARGLNYLHHGCDMQIIHFDIKPHNILLDSNFVPKVADFGLAKLFPKDDNFVPLSAMRGTIGYIAPEMVSRSFGVISSKSDVYSFGMLLLEMTGGRRNADPHAGSSSQAYYPSLVYKQLSQGDANRISEGVDMHELEKKLCIIGLCCIQIKPQDRPTMSEVIEMLEAGVDGIQMPPRPYFCDEEGDSSYSIISELDIIEE

SEQ ID NO: 8978 - protein, 833 aa, Escherichia coli CFT073
MALIVEFICELPNGVHARPASHVETLCNTFSSQIEWHNLRTDRKGNAKSALALIGTDTLVGDNCQLLISGADEQEAYQRLSQWLRDEFPHCDAPLAEVKSDELEPLPVSLTNLNPQIIRARTVCSGSAGGILTPISSLDLNALGNLPAAKGVDAEQSALENGLTLVLKNIEFRLLDSDGATSAILEAHRSLAGDTSLREHLLAGVSAGLSCAEAIVASANHFCEEFARSSSSYLQERALDVRDVCFQLLQQIYGEQRFPAPGKLTQPAICMADELTPSQFLELDKNHLKGLLLKSGGTTSHTVILARSFNIPTLVGVDIAALTPWQHQTIYIDGNAGAIVVEPGESVARYYQQEARVQDALREQQRVWLTQQARTADGIRIEIAANIAHSVEAQAAFGNGAEGVGLFRTEMLYMDRTSAPGESELYNIFCQALESANGRSIIVRTMDIGGDKPVDYLNIPAEANPFLGYRAVRIYEEYASLFTTQLRSILRASAHGSLKIMIPMISSMEEILWVKEKLAEAKQQLRNEHIPFDEKIQLGIMLEVPSVMFIIDQCCEEIDFFSIGSNDLTQYLLAVDRDNAKVTRHYNSLNPAFLRALDYAVQAVHRQGKWIGLCGELGAKGSVLPLLVGLGLDELSMSAPSIPAAKARMAQLDSRECRQLLNQAMACRTSLEVEHLLAQFRMTQQDAPLVTAECITLESDWRSKEEVLKGMTDNLLLAGRCRYPRKLEADLWAREAVFSTGLGFSFAIPHSKSEHIEQSTISVARLQAPMRWGDDEAQFIIMLTLNKHAAGDQHMRIFSRLARRIMHEEFRNALVNAASADAIASLLQHELEL

SEQ ID NO: 8979 - protein, 290 aa, Oryza sativa
ERDGGGRKDGDGGAAAGSLAGARVHRQVRARPSSGSSVVPFALPPFAGDGRRQEGELKLLGTWASPYVSRVKLALHLKGLSYEYVVEEDHFNNKSELLLSSNPVHKKVPVMIHNGKPICESLIIMEYLDEAFPDTAAPLLPADLHDRAVARFWAAYIDDKLVPSWKQAFSGKTGEEKAEGMRHMLAAVDALEAAMEWSYKGKPFFGGDAVGFLDVALGGLLSWLHGTEELCGAKILDAAKTPLLSAWARRFGEMDAAKVALPDVCKLVEFAKMKRVQLEAAMAATTVSRN

SEQ ID NO: 8980 - protein, 269 aa, Escherichia coli CFT073
MRKRSLLFKGAMMNPLIIKLGGVLLDSEEALERLFSALVNYRESHQRQLVIVHGGGCVVDELMKGLNLPVKKKNGLRVTPADQIDIITGALAGTANKTLLAWAKKHQIAAVGLFLGDGDSVKVTQLDEELGHVGLAQPGSPKLINSLLENGYLPVVSSIGVTNEGQLMNVNADQAATALAATLGADLILLSDVSGILDGKGQRIAEMTAAKAEQLIEQGIITDGMIVKVNAALDAARTLGRPVDIASWRHAEQLPALFNGMPMGTRILA

SEQ ID NO: 8981 - protein, 316 aa, Streptococcus mutans UA159
MESLTQFSKKLSKWFTLVVVIWAVFNYFLPTTSRWVIPNTSYLLGIILFGMGLTLTTEDFVRISKRPVPVALGTVAHYVIMPSLAWLLCLIFHLKGATAAGVILVGSCPSGTSSSVMAFLSGGDVALDVSIEILSTLLAPVMLPLLLSVLAGQYIAVPALSLFLSTLRIVVVPIILGVLIHTFFGKKIAAVIKLMPLISQVAILLIIGAVVSANHANIFTAATALVIPVVMLHNLCGYSLGYAFAKLLHLEEPQQKAITFEVGMQDSSLGATLAMKYFVPQAAIPSTIFSIWHNISGSILSSWWKNHSQSHLTERK

SEQ ID NO: 8982 - protein, 284 aa, Physcomitrella patens subsp. patens
MSGGTPRAVALLQSVARTAIAVGVGGSLLNTSLYTVDGGHRAVLFDRFRGVLDETAGEGTHFLIPVLQKPYIFDVRTRPRNITTVTGTKDLQMVNLTLRVLSKPDPSMLPYIFKTLGNDYDDRVLPSIGNEVLKAVVAQFNADQLLTERPFVSALVRDALIKRAKDFNLLLDDVAITHLSYGAEFSRAVEQKQVAQQEAERSKFVVMKADQERRAAIVRAEGESEAAKLISDATASAGGGLIELRRIEASREIAATLAKSRNVVYLPSGNNMLLGINPSMSGAP

SEQ ID NO: 8983 - protein, 290 aa, Guillardia theta
MVKIVSKLLGCDYKNFFKINSFPNFLLYGSSGTGKTFTVENFLKTARNKNIISRILKLNASQNNSISIIRNKIKIFCRSSIQSKKLKVVVIDEADLLSVISQEALRRIIEKFSLSSRFILICNYPTRIIEPLQSRFILFKIENLNFENIIKLIKFYILKKNICYKLDFIENDIHSTNGDKRKLKNCLKLDLNRIFMHFNSNRNFIINDFNYRYLLELHDKNIDKEIIDDYLLNFFIKRELLKNISENILEYEIDLDYKIKFLRYISYKRFNKHFKSAVIKNYFQPGTPGN

SEQ ID NO: 8984 - protein, 487 aa, Arabidopsis thaliana
MQPWRRKFPLFETGVTMKQRKNSNLSIFVVVFSVFLFGIFMYNEDVKSIAEFPFSTSKPHDVHDEATPITEITTLPVQESIKNSDPIQESIKNADSVQDSVKDVAEPVQEEVSKTEEVKKIELFAATEDEEDVELPPEECDLFTGEWVFDNETHPLYKEDQCEFLTAQVTCMRNGRRDSLYQNWRWQPRDCSLPKFKAKLLLEKLRNKRMMFVGDSLNRNQWESMVCLVQSVVPPGRKSLNKTGSLSVFRVEDYNATVEFYWAPFLVESNSDDPNMHSILNRIIMPESIEKHGVNWKGVDFLVFNTYIWWMNTFAMKVLRGSFDKGDTEYEEIERPVAYRRVMRTWGDWVERNIDPLRTTVFFASMSPLHIKSLDWENPDGIKCALETTPILNMSMPFSVGTDYRLFSVAENVTHSLNVPVYFLNITKLSEYRKDAHTSVHTIRQGKMLTPEQQADPNTYADCIHWCLPGLPDTWNEFLYTRIISRS

SEQ ID NO: 8985 - protein, 236 aa, Glycine max
MVARGDLGAELPIEEVPLLQEDIIRRCQIMQKPVIVATNMLESMINHPTPTRAEVSDIAIAVRQGADAIMLSGETAHGKFPLKAVKVMHTVALRNESSVQSGVSYPSQLSSHESHMGEMFAFHATTMSNTLNTPIIVFTRTGSMAILLSHYRPYSTIFAFTNEARIKQRLALYHGVMSIYMQFSNDVEETFSRALKLLLSKSHLHEGQHVTLVQSGAQPIWREESTHHIQVRKVHG

SEQ ID NO: 8986 - protein, 198 aa, Brassica napus
  misc_feature (36)..(36): Xaa can be any naturally occurring amino acid
  misc_feature (54)..(54): Xaa can be any naturally occurring amino acid
  misc_feature (82)..(83): Xaa can be any naturally occurring amino acid
  misc_feature (86)..(86): Xaa can be any naturally occurring amino acid
  misc_feature (130)..(130): Xaa can be any naturally occurring amino acid
  misc_feature (133)..(133): Xaa can be any naturally occurring amino acid
  misc_feature (135)..(135): Xaa can be any naturally occurring amino acid
  misc_feature (138)..(138): Xaa can be any naturally occurring amino acid
  misc_feature (140)..(140): Xaa can be any naturally occurring amino acid
  misc_feature (146)..(146): Xaa can be any naturally occurring amino acid
  misc_feature (150)..(151): Xaa can be any naturally occurring amino acid
  misc_feature (153)..(155): Xaa can be any naturally occurring amino acid
  misc_feature (157)..(157): Xaa can be any naturally occurring amino acid
  misc_feature (159)..(159): Xaa can be any naturally occurring amino acid
MAAVESLPPGTPSAMRNAFGTVLSALILVLIGALAXSIRLFSVIKYESVIHEFXPYFNYRVTQFLSKNGIYEFWNWFDDRPXXPLXRVIGGTVYPGLTLTAGTIWWVLNSINIPLSVETVCVFTAPVFSXFAXWXTYXLXKEVKGXGAAXXPXXXLXMXRSYISRSVAGSYDNEAVAIFALIFTFYLYIKVRVFSNGM

SEQ ID NO: 8987 - protein, 379 aa, Triticum aestivum
MATAGMVIKCKAAVAWEAGKPLSIEEVEVAPPQAMEVRVKILYTALCHTDVYFWEAKGQTPVFPRILGHEAGGIVESVGEGVTELVPGDHVLPVFTGECRDCAHCKSEESNLCDLLRINVDRGVMIGDGQSRFTIGGKPIFHFVGTSTFSEYTVIHVGCLAKINPEAPLDKVCVLSCGISTGLGATLNVAKPKKGSTVAIFGLGAVGLAAMEGARMAGASRIIGVDLNPAKYEQAKKFGCTDFVNPKDHSKPVQEVLVEMTNGGVDRAVECTGHIDAMIAASECVHDGWGVAVLVGVPHKEAVFKTYPMNFLNERTLKGTFFGNYKPRTDLPEVVEMYMRKELELEKFITHSVPFSQINTAFDLMLKGEGLRCIMRMDQ

SEQ ID NO: 8988 - protein, 244 aa, Rhodopirellula baltica SH 1
MAGPSIYNVPNALTSARFVLAIAVMALIPLGMPLAAMIVFLIAASTDWMDGYWARKYGQVTKLGRIFDPFVDKIIICGSFIALVAVPDSPVASWMATIVVARELLVTSLRGIIEGAGGDFSASWLGKWKMVLQCAAVVAVLLTYIVTPVPMWLAWASWGLLWAAIALTVYSGVDYTLIAARVMQSDAGLEVPAESPVATANPDPTHAMPTDNNSHANRVATTKSNASSRDDAKRRAVSSELPTQ

SEQ ID NO: 8989 - protein, 320 aa, Leptospira interrogans serovar Lai str. 56601
MGAPSTSTATEKATRDGYGDALHELGASRPDVVVLDADLSGSTKTNKFAKAFPDRFFNVGVAEQNLVGHAAGLALSGLVPFASSFAMFLSGRAWEIVRNSVVYPFLNVKLVASHGGITVGEDGASHQCIEDFAIMRVIPEMTVICPSDYNECKQIIHAIADYKGPVYVRVGRPNVPIIERENYKFQIGKAEVMREGKDVLIIANGVLVNEAIKASEELSKEGIQVTLLNMATIKPIDKETILKYAKECGIVVTCEEHNVVGGLGSAVSEFLSEEYPVHVLKVGMKDQFGKSGTWKELLDYFGLRSKNIVETVKKAKTLKK

SEQ ID NO: 8990 - protein, 710 aa, Moritella sp. PE36
MSQQEKTFSLEIREDKIGVLTMDVPGETMNTLRAEFADEISDLMKEISANSDLQGLVLISGKKDSFVAGADVTMIDACETAADAEKLSLEGHRVMGELEALNIPVVAAIHGPCLGGGLELALACHIRVCTESTKTVLGVPEVMLGLLPGSGGTQRLPRLIGVAKSLDLMLTGKQVRGKQALKMGLVDEVVPETVLLEVAVKLAKKGKIQRKLKRDLTSKLLETNKFGRNIMFDQAKKQTLSKTRGNYPAPEAILEVVKLGQEKGFEAGLKLEAKRFSELAMTSESAALRGIFFATTAMKKEDGVEGVAPKKVKKAVVLGGGLMGGGIANVTATKAKVPVRIKDIAPQGLLNAQKYTYDILNKKVKRRFMSKAEMQSQLAMITGTTEYTGVKNADIVIEAVFEDLKLKHQMVADIEANCNENTIFASNTSSLPITQIASEAKRPENVIGLHYFSPVDKMPLAEIITHEGTSDQTISTTVEFARKQGKTPIVVKDGAGFYVNRILAPYMNEAARLVLEQEPIEAVDKALVDFGFPVGPVTLLDEVGIDVGAKIGPILTKELGSRFEAPAAFDKLLADDRKGRKNEKGFYLYGKKAKKGKKQVDESIYKLLNLKPEASMAPKALAERAVLLMLNEAARCLDEGILRSARDGDIGAIFGIGFPPFLGGPFHYMDSIGIAELVDKLERHQDKYGERFAPCESLKAMAKEGKKFYN

SEQ ID NO: 8991 - protein, 268 aa, Bacillus sp. SG-1
MEKNIGFIGSGNMAKAILGGLLTSGIAHAGNIMASALTEKTITSINHEYNIRTTRDNKEVAASADYLFLAVKPDQYAGVIEEVREHIQKDAIVITIAAGVTLHTLAEQFGTQVKIVRTMPNTPSLVGEGMSALCPNENVTDAELEEVLMLFESFGKAEVLEENLMDAVPAVSGSSPAYVFMFIEALADGAVKQGISRDKAYKMAAQAVLGAAKMVLETETHPGELKDAVCSPGGVTIEAVSTLEKTGFRASVLSAMESCYKKSSNMID

SEQ ID NO: 8992 - protein, 379 aa, Triticum aestivum
MATAGKVIKCKAAVAWEAGKPLSIEEVEVAPPQAMEVRVKILYTALCHTDVYFWEAKGQTPVFPRILGHEAGGIVESVGEGVTELVPGDHVLPVFTGECKDCAHCKSEESNLCDLLRINVDRGVMIGDGQSRFTIGGKPIFHFVGTSTFSEYTVIHVGCLAKINPEAPLDKVCVLSCGISTGLGATLNVAKPKKGSTVAIFGLGAVGLAAMEGAKMAGASRIIGVDLNPAKYEQAKKFGCTDFVNPKDHTKPVQEVLIEMTNGGVDRAVECTGHVDTMISAFECVHDGWGVAVLVGVPHKEAVFKTHPMNFLNERTLKGTFFGNYKPRTDLPEVVEMYMRKELDVEKFITHSVPFSQINTAFDLMLKGEGLRCVMRMDE

SEQ ID NO: 8993 - protein, 379 aa, Triticum aestivum
MATAGKVIKCKAAVAWEAGKPLSIEEVEVAPPQAMEVRVKILYTALCHTDVYFWEAKGQTPVFPRILGHEAGGIVESVGEGVTELVPGDHVLPVFTGECKDCAHCKSEESNLCDLLRINVDRGVMIGDGQSRFTIGGKPIFHFVGTSTFSEYTVIHVGCLAKINPEAPLDKVCVLSCGISTGLGATLNVAKPKKGSTVAIFGLGAVGLAAMEGAKMAGASRIIGVDLNPAKYEQAKKFGCTDFVNPKDHTKPVQEVLVEMTNGGVDRAVECTGHVDAMVSAFECVHDGWGVAVLVGVPHKEAVFKTHPMNFLNERTLKGTFFGNYKPRTDLPEVVEMYMRKELDVEKFITHSVPFSQINTAFDLMLKGEGLRCVMRMDE

SEQ ID NO: 8994 - protein, 394 aa, Zea mays
  misc_feature (351)..(351): Xaa can be any naturally occurring amino acid
  misc_feature (362)..(362): Xaa can be any naturally occurring amino acid
VRPAEGKPQQINRPITRSFGAQLVKNVQANAAIKNAAILPARHAPRQERKAPAKQPPPEDVIVLSSDSEQSRTQLESSASSVRSRKKVINTLSSVLSARSKAACGITDKRRQVVVIEDIDKLDVNNELAVVEYIEDIYTFYKIAQHDRRPCDYIDTQVEINPKMRAILAGWIIEVHHKFELMPETLYLTMYIIDQYLSLQPVLRRELQLVGVSAMLIACKYEEIWAPEVNDFILISDSAYSREQILSMEKGILNSLEWNLTVPTVYMFLVRFLKAATLGNKVEKEMENMVFFFAELALMQYGLVTRLPSLVAASVVYAARLTLKRAPLWTDTLKHHTGFRESEAELIECTXRCWSAHTRRPXADSKLRAVYKKYSSEQFGGVALRPPAAAVEIK

SEQ ID NO: 8995 - protein, 192 aa, Zea mays
  misc_feature (61)..(61): Xaa can be any naturally occurring amino acid
LVYTLATDGSPFRLELFTPWMVATLADFYVNVIAISAWVIYKEANWVSSAVWVVLLFCFGXDPLDLLFIRQGNLSQRKCSYVVIGRVIFSILGIFMAAVVTYTVITDGLPFRKELLTPWMAATLIDFYINVFAISVWVAHKESSWISTTIWIVLLICFGSITTCGYIVIQLFKVSYQDPIYHVLLNSHSKKI

SEQ ID NO: 8996 - protein, 358 aa, Clostridium tetani E88
MSMIDGIPSGKINGGGFYMKKILLLSTGGTIACSKGNEGLAPSLTAESLLTYTKEIQDICYIDTMQILNIDSTNMHPEYWVHITEYIETNYNNYDGFVITHGTDTMAYTAAALFYMIQDSHKPIVITGAQRPITFKETDAKRNLVDSIKFACNGIGGVFIVFDGKVICGSRAEKLRTKSYNAFESINFPHLATIEGNRIKYNDKISICKKKKELVFYKTLCTNIFLLKLTPATDPDILNYLSDKYLGIIIESYGSGGIPFKDKKDFLSKLKMLDQKGKIVVIKSQVLLEGTDLSQYEVGQKALKYPIIPAYDMSTEAIVTKLMWVLGQTKDKEKAREMFLTPVKNDLIIENIQQEMAK

SEQ ID NO: 8997 - protein, 327 aa, Triticum aestivum
  misc_feature (213)..(213): Xaa can be any naturally occurring amino acid
  misc_feature (256)..(256): Xaa can be any naturally occurring amino acid
  misc_feature (272)..(272): Xaa can be any naturally occurring amino acid
  misc_feature (305)..(305): Xaa can be any naturally occurring amino acid
LPRTSLYKKAGWYRSGIPGISSTHASADFNKLSAKLIFGADSPAIQENRVATVQCLSGTGSLRVGGEFLARHYHERTIYIPQPTWGNHPKVFTLAGLTARSYRYYDPATRGLDFQGLLEDLSSAPSGAIVLLHACAHNPTGVDPTLEQWEQIRQLMRSKALLPFFDSAYQGFASGSLDKDAQSVRMFVADGGELLMAQSYAKNMGLYGERVGXALSIVCGSADIAVKVESQLKLVIRPMYSNPPLHGASIVATILXDKAMVDEWTVELKAMXADRIISMKEQLFDALKIRKTPGEWSHIIKQIGXVTFNWLNSEQVAFMRAGISQFT

SEQ ID NO: 8998 - protein, 124 aa, Oryza sativa
  misc_feature (94)..(94): Xaa can be any naturally occurring amino acid
NEASEIRETNPDYAQGYKVLFADDFPFLLASQGSVDALNSILKEPVPMNRFRPNIIVDGCHPYSEDLWKTIKIGKLTFLGVKLCDRCKVPTINXLSAKDEGRIIKVGDPVYVLESFPSSDEVPA

SEQ ID NO: 8999 - protein, 158 aa, Physcomitrella patens subsp. patens
MRLPPLSTDPNRCERAFTGNTIGQANGVADKVLDLRMCDFSNDKTNLKGKTLSAALMSEAKFDGADLTEVIMSKAYAVGASFKGSVFTNAVVDRVAFDKSDMQGVQFINTVLSGSTFEGANLEGASFENALIGYVDIQKLCKNPTLPEESRIDLACKP

SEQ ID NO: 9000 - protein, 303 aa, Novosphingobium aromaticivorans DSM 12444
MSADTSEGPGLLKPALAAIAEDIDRSFDLLLPVPGDPRDRLVEAMRYAAIGGGKRLRPLLVCATGALHGVSREAAVRVGTAIEAIHVYSLIHDDLPCMDNDGLRHGKPTVHVAFDDATAVLAGDALHDFAFEVLSDPATSGDPFTRIELIRTLATASGMNGMCGGQMMDIVAETSSFDLPTVTRLQQLKTGALLGASVELGAILGKVPPEGRTHLRGYARDIGLAFQIADDLLDAEGDEAAAGKALRKDAAQGKETFLSLLGADRAREQARLLVNQAVEHLASYGPEADLLRELARFIVERNH

SEQ ID NO: 9001 - protein, 159 aa, Staphylococcus aureus
MKITILAVGKLKEKYWKQAIAEYEKRLGPYTKIDSIEVPDEKAPENMSDKEIEQVKEKEGQRILAKIKPQSTVITLEIQGKMPSSEGLAQELNQRMTQGQSDFVFVIGGSNGLHKDVLQRSNYALSFSKMTFPHQMMRVVLIEQVYRAFKIMRGEAYHK

SEQ ID NO: 9002 - protein, 247 aa, Onion yellows phytoplasma OY-M
MISIKTPHEIAIMKQAGKIINEAHRLLASFVIPGMSTFDLDLLAKNFYQKKSVISAFKGYNGFPKHICASVNEVVVHGIPSKKTILKQGDIITLDLGINYQGYYVDCAYSYVVGTFCQTTQNLLALTQKALFQGLLQIKPQNHFSDISHAIELFAKNNNLGIVEEFTGHGIGTSLHEEPYIPNFGKPHEGAILQPGMTFCVEPMLTLGNPEIAILQDNWTVVTTDKSLSAHFEHTVLVTPTGYEILA

SEQ ID NO: 9003 - protein, 376 aa, Glycine max
MVMHLNGTPCALGFHMPAEWETHAQCWMGWPERADNWRDGAVHAQRVFARVASAISRFESVTVCVSSAQWENARSQLPEHIRVVEMNMNDSWFRDIGPTFVMRRSTTPESGDAVSRIAGIDWNFNSWGGLEDGCYCDWSLDLLVAKKILGIEKIPRFSHSMVLEGGSIHVDGEGTCLTTEECLLNKNRNPHLSKNQIEDELKTYLGIRKVIWLPRGLYGDDDTNGHIDNMCCFVRPGVVMLSWIDDETDPQYERSVEAYSLLSNETDANGRKFEIIKLHVPSPLYMTEDEAAGVSLDNEAKPRLPGTRLAASYVNFYIANKAIIAPQFGDKKWDDEAVRVLSKAFPHHEVVGIEGAREIVLAGGNIHCITQQQPAI

SEQ ID NO: 9004 - protein, 258 aa, Triticum aestivum
  misc_feature (43)..(43): Xaa can be any naturally occurring amino acid
  misc_feature (66)..(66): Xaa can be any naturally occurring amino acid
  misc_feature (78)..(78): Xaa can be any naturally occurring amino acid
  misc_feature (107)..(107): Xaa can be any naturally occurring amino acid
  misc_feature (128)..(128): Xaa can be any naturally occurring amino acid
  misc_feature (183)..(183): Xaa can be any naturally occurring amino acid
  misc_feature (191)..(191): Xaa can be any naturally occurring amino acid
  misc_feature (206)..(206): Xaa can be any naturally occurring amino acid
  misc_feature (224)..(224): Xaa can be any naturally occurring amino acid
  misc_feature (234)..(234): Xaa can be any naturally occurring amino acid
MGRKFFVGGNWKCNGTVEQVESIVNTLNAGQIASTDVVEVVVXSPPYVFLPTVKAKLRPEIQVAAXQNCWVKKGRCFXPGEVSAEMLVNLRRSLGSFLGHSERRSLXGEESSEFVGEKVAYALAQGLXKVIACVGETLEQREAGSTMEVVAEQTKAITGKIKDWTNVVVAYEPMWAICTGKVXTPAQAQEXHCNLRELLKDHVKPXEVLHPHRSFIGGSGTGAXCKDWAGQPQXQGFLCWGSFLLNLGLYDIINGPHR

SEQ ID NO: 9005 - protein, 76 aa, Arabidopsis thaliana
MAVTSKLFWRTTAIHSRRRRRKTSKGYNDITFITSNGGRDNCMQVWPSIGKKKFETISYLPDLTDYELANESDYLI

SEQ ID NO: 9006 - protein, 502 aa, Silicibacter pomeroyi DSS-3
MPDLSTRLADLDRHLQRFRRDGVMNRIGGQDVPGGAGRFDSISPVDRSVICSVARGDAADMDAAARAAHAAFPAWRDMPATERRAILIRIAEGIEARAEEIALCECWDTGQAWRFMSKAALRGAENFRYFADQVVQARDGQHLKSPTLMNITTRVPIGPVGVITPWNTPFMLSTWKIAPALAAGCTVVHKPAELSPLSARLLIEIAEEAGLPPGVLNLVNGFGEDAGKALTEHPLIKAVAFVGESRTGSLIVKQGADTLKRVHLELGGKNPVIVFDDADTERALDAVIFMIYSINGERCTSSSRLLVQDTIREEFEARLVERVNNIKVGHPLDPTTEIGPLIGEEHFAKVTSYFDIARQDGATVAAGGEVVGDQGYFVRPTLFTGANNRMRIAREEIFGPVLTAIPFSTEEEALQIANDTPYGLTGYLWTNDLTRALRFTDKLEAGMIWVNSENVRHLPTPFGGVKASGIGRDGGDWSFEFYMEQKHIGFATGQHKIQRLGA

SEQ ID NO: 9007 - protein, 517 aa, Streptococcus mutans UA159
MKFTELHLAEDILSAVAKVGFVEPSPIQELTIPLALEGKDVIGQAQTGTGKTAAFGLPTLNKIDVTNNVVQALVIAPTRELAVQSQEELFRFGREKKVKVRSVYGGSSIEKQIKALKSGAHIVVGTPGRLLDLIKRKALKLNHVETLILDEADEMLNMGFLEDIEAIISRVPETRQTLLFSATMPDAIKRIGVKFMKEPEHVKIAAKELTTDLVDQYYIRVKENEKFDTMTRLMDVEQPELSIVFGRTKRRVDELTRGLKLRGYRAEGIHGDLDQGKRLRVLRDFKNDNLDILVATDVAARGLDISGVTHVYNYDIPQDPESYVHRIGRTGRAGKHGQSITFVAPNEMGYLQIIEKLTKKRMKGMKPATAQEAFQASKKVALKKIERDFADEKIRSNFDKFTKDAEKLAAEFSPEELAQYILTLTVQDPEMLPKVEIAREKPLPFKFAGKGKGGNRRREDRRGGRDSRRNHRDGGRREFKRTSNKNRKDFENKSNKRPHRTSSEKKSGFTIRNKGDR

SEQ ID NO: 9008 - protein, 466 aa, Escherichia coli CFT073
MPHSYDYDAIVIGSGPGGEGAAMGLVKQGARVAVIERYQNVGGGCTHWGTIPSKALRHAVSRIIEFNQNPLYSDHSRLLRSSFADILNHADNVINQQTRMRQGFYERNHCEILQGNARFVDEHTLALDCPDGSVETLTAEKFVIACGSRPYHPTDVDFTHPRIYDSDSILSMHHEPRHVLIYGAGVIGCEYASIFRGMDVKVDLINTRDRLLAFLDQEMSDSLSYHFWNSGVVIRHNEEYEKIEGCDDGVIMHLKSGKKLKADCLLYANGRTGNTDSLALQNIGLETDSRGQLKVNSMYQTAQPHVYAVGDVIGYPSLASAAYDQGRIAAQALVKGEANAHLIEDIPTGIYTIPEISSVGKTEQQLTAMKVPYEVGRAQFKHLARAQIVGMNVGTLKILFHRETKEILGIHCFGERAAEIIHIGQAIMEQKGGGNTIEYFVNTTFNYPTMAEAYRVAALNGLNRLF

SEQ ID NO: 9009 - protein, 379 aa, Triticum aestivum
MATAGKVIKCKAAVAWEAGKPLSMEEVEVAPPQAMEVRVKILYTALCHTDVYFWEAKGQTPVFPRILGHEAGGIVESVGEGVTELVPGDHVLPVFTGECKECAHCMSEESNLCDLLRINVDRGVMIGDGQSRFTIDGKPIFHFVGTSTFSEYTVIHVGCLAKIDPEAPLDKVCLLSCGISTGLGATLNVAKPKKGMTVAIFGLGAVGLAAMEGARMSGASRIIGVDLNPAKHEQAKKFGCTDFVNPKDHTKPVQEVIVEMTDGGVDRAVECTGNADAMISAFECVHDGWGVAVLVGVAHKEAVFKTHPMNFLNERTLRGTFFGNYKPRTDLPGVVDMYMRKELELDKFITHSVPFSQINTALDLMLKGEGLRCVMRMDE

SEQ ID NO: 9010 - protein, 400 aa, Oryza sativa Japonica Group
MKAMGYNNPYDSSGTDDDLPPTQNRGLRVRSFSANGRASVMPFSYIRPHGDLESEIHQVEQEAYTGVLRAFKVQSDAISWEKESLITELRKELRVSDDEHRELLNKVNEDVAIRRMREFRQGGGSLSAQHRGSRIFHDTEPGPAAKRQRTPLSIPSHSAGLQSPAMPSPSVPSSTKWGPFSGTKGKKTRTNTPLAVPSADPTSLINRKIYTRWPDDNNFYEATITDYNPATGKHALVYDMGTVAQTWESVRLSDLAPEDIIWDLDDQGISNRDGWGPHPGMRRHPGNNGTMAMASRGGGRFSRNEPTKDSAPPQNGINRNIGHIDVPNTRSVVIEVERVLSNPNMGEIEKAKKLLQDQEQSLLDAIARLDDASDSESEDMAVGAQMVSAGDHMGRNGVAC

SEQ ID NO: 9011 - protein, 247 aa, Acinetobacter sp. NCIMB9871
MSNKFNNKVALITGAGSGIGKSTALLLAQQGVSVVVSDINLEAAQKVVDEIVALGGKAAANKANTAEPEDMKAAVEFAVSTFGALHLAFNNAGILGEVNSTEELSIEGWRRVIDVNLNAVFYSMHYEVPAILAAGGGAIVNTASIAGLIGIQNISGYVAAKHGVTGLTKAAALEYADKGIRINSVHPGYIKTPLIAEFEEAEMVKLHPIGRLGQPEEVAQVVAFLLSDDASFVTGSQYVVDGAYTSK

SEQ ID NO: 9012 - protein, 379 aa, Triticum aestivum
MATAGKVIKCKAAVAWEAGKPLSMEEVEVAPPQAMEVRVKILFTSLCHTDVYFWEAKGQTPMFPRIFGHEAGGIVESVGEGVTELAPGDHVLPVFTGECKECPHCKSAESNMCDLLRINTDRGVMIGDGKSRFSIDGKPIYHFVGTSTFSEYTVMHVGCVAKINPEAPLDKVCVLSCGISTGLGASINVAKPPKGSTVAIFGLGAVGLAAAEGARIAGASRIIGVDLNASRFEEARKFGCTEFVNPKDHTKPVQQVLAEMTNGGVDRSVECTGNVNAMIQAFECVHDGWGVAVLVGVPHKDAEFKTHPMNFLNERTLKGTFFGNFKPRTDLPNVVEMYMRKELEVEKFITHSVPFSEINKAFDLMAKGEGIRCIIRMEN

SEQ ID NO: 9013 - protein, 477 aa, Bordetella pertussis Tohama I
MTESTSSDAPVTDAPTRTFADFGLHPLLLKLIADTGYTNPTPIQAQAIPVVVEGRDVMGAAQTGTGKTAAFTLPILHRLMPLANTSASPARHPVRALILTPTRELADQVYESVKRYSLHTPLRSAVVFGGVDIGPQKEALRRGCEVLVATPGRLLDHVEQKNVNLSQVGILVLDEADRMLDMGFLPDLERIIRLLPAQRQGLLFSATFSNEIRKLGRSYLNHPVEIEVAARNATADTVTQIAYQMHGDTKRAAVVHLVKSRGLKQVIVFSNTKIGTARLARQLERDGVKAESIHGDKTQGDRMKALEAFKAGDLEVLVATDVAARGLDVAGVPCVINYDLPYNAEDYVHRIGRTGRAGASGEAIALFTADEERYLLDIEKLIKRQVPRGKLELPADLVARSHGRDRDAPRERGADRHRGERCTSGAAAPRQPVDELFYKPYEPANGQPASPETPEQEGRSNAPKRQLAVLLGGSRKG

SEQ ID NO: 9014 - protein, 354 aa, Zea mays
MLPPPVPAWAAVGLARPASFPSTHAASLPILPPLSSSAPLRSCVAVECRPGLHSIPPVARSPRAAGAPVPSVPGIKMIGSFITGMLTLVLGYAYPAYDCYKTVELNRPEVEQLRFWCQYWILLAFLTVLERVGETFVSWLPMYSEAKLAFIVYLWYPKTRGTAYVYESFFKPYIAKHETEIDRNLLELRTRAGDMAVLYFQRVTNYAQTRSYEILQYIASQSPTQRQAHQQQQRPPPPRTRQVNPAPPPIPAPSAPPMPPQPAQAQVPPTPPRPLVPVVPPGAVPPAPPPTAPEATATNGLQDTETMQVDPPRASLSGPPPPLPPEETLIEEAIRLTRGRLRRRLAGGSGPPQN

SEQ ID NO: 9015 - protein, 379 aa, Triticum aestivum
MATAGKVIKCKAAVAWEAGKPLSMEEVEVAPPQAMEVRVKILFTSLCHTDVYFWEAKGQTPMFPRIFGHEAGGIVESVGEGVTELAPGDHVLPVFTGECKECPHCKSAESNMCDLLRINTDRGVMIGDGKSRFSIDGKPIYHFVGTSTFSEYTVMHVGCVAKINPEAPLDKVCVLSCGISTGLGASINVAKPPKGSTVAIFGLGAVGLAAAEGARIAGASRIIGIDLNASRFEEARKFGCTEFVNPKDHSKPVQEVLAEMTNGGVDRSVECTGNVNAMIQAFECVHDGWGVAVLVGVPHKDAEFKTHPMNFLNERTLKGTFFGNFKPRTDLPNVVEMYMRKELEVEKFITHSVPFSEINKAFDLMAKGEGIRCIIRMEN

SEQ ID NO: 9016 - protein, 201 aa, Idiomarina loihiensis L2TR
MSVLVGRKAPDFTAAAVLGSGEIVEDFKLSDAIKGKKAVVFFYPLDFTFVCPSELIAFDKRLDEFKKRGVEVIGVSIDSQFTHSAWRNTSTDAGGIGQVKYPLVADVRHSICKAYDVEHPQAGVAFRGSFLIDEEGMVRHQVVNDLPLGRNIDEMLRMVDALNFHEKHGEVCPAGWEEGKEGMKENAEGVASYLSKNADKL

SEQ ID NO: 9017 - protein, 526 aa, Vitis vinifera
  misc_feature (526)..(526): Xaa can be any naturally occurring amino acid
MGTQVESLWVLALAAKCRAFSSETVLVFGFALCLVWFAVVLSHWAYPGGQAWGRYWSKRGSKAEAIIPGPRGLPVVGSMSLMVNLAHHNLAAAAERLGAMRLMAFSLGETRAIVTSNPDVAKEILNSSAFADRPVKECAYSLMFNRAIGFAPYGVYWRTLRRIAATHLFSPKQITASETQRSEIAAQMVSLVGSCIGDIRVRDILKRASLHHMMSSVFGRKYQLGSSNSETDELSRLVEEGYDLLGKLNWSDHLPWLAGLDPQKIRFRCSKLVPRVNRFVNRIITEHRAQPGPTTRDFVDVLLSLQQPDKLLDSDIIAVLWEMIFRGTDTVAVLIEWILARMVLHPECQSRVHDELDRVVGKSRPVKESDIPAMVYLAAVVKEVLRLHPPGPLLSWARLSITDTTVDGYHVPAGSTAMVNMWAITRDPRVWSDPLDFTPDRFVTTPADVEFSLFGSDLRLAPFGSGRRTCPGKTLGLTTATFWVASLLHEFEWVPSDPNPVDLSEVLRLSCEMAHPLTVRVRPRRX

SEQ ID NO: 9018 - protein, 415 aa, Neisseria meningitidis MC58
MQLTAVGLNHQTAPLSIREKLAFAAAALPKAVRNLARSNAATEAVILSTCNRTELYCVGDSEEIIRWLADYHSLPIEEIRPYLYALDMQETVRHAFRVACGLDSMVLGEPQILGQIKDAVRVAQEQESMGKKLNALFQKTFSVAKEVRTDTAVGENSVSMASASVKLAEQIFPDIGDLNVLFIGAGEMIELVATYFAAKSPRLMTVANRTLARAQELCDKLGVNAEPCLLSDLPAILHDYDVVVSSTASQLPIVGKGMVERALKQRQSMPLFMLDLAVPRDIEAEVGDLNDAYLYTVDDMVNIVQSGKEARQKAAAAAETLVSEKVAEFVRQQQGRQSVPLIKALRDEGEKARKQVLENAMKQLAKGATAEEVLERLSVQLTNKLLHSPTQTLNKAGEEDKDLVHAVAQIYHLDK

SEQ ID NO: 9019 - protein, 379 aa, Aegilops tauschii
MATAGKVIKCKAAVAWEAGKPLSIEEVEVAPPQAMEVRVKILYTALCHTDVYFWEAKGQTPVFPRILGHEAGGIVESVGEGVTELVPGDHVLPVFTGECKDCAHCKSEESNLCDLLRINVDRGVMIGDGQSRFTIGGKPIFHFVGTSTFSEYTVIHVGCLAKINPEAPLDKVCVLSCGISTGLGATLNVAKPKKGSTVAIFGLGAVGLAAMEGAKMAGASRIIGVDLNPAKYEQAKKFGCTDFVNPKDHTKPVQEVLIEMTNGGVDRAVECTGHVDAMISAFECVHDGWGVAVLVDVPHKEAVFKTHPMNFLNERTLKGTFFGNYKPRTDLPEVVEMYMRKELDVEKFITHSVPFSQINTAFDLMLKGEGLRCVMRMDE

SEQ ID NO: 9020 - protein, 180 aa, Bacillus sp. SG-1
MAERMVGKQAPRFKMDAVLPNKEFGKVSLEENMKNDKWTVLFFYPMDFSFLCPTEITAMSDRYDEFEDLDAEVIGVSTDTIHTHLAWINTDRKENGVGDLRYALAADTNHMVSREYGVLIEEEGVALRGLYIISPEGELQYQTVFHNNIGRDVEETLRVLQALQTGGLCPANWKPGQGTL

SEQ ID NO: 9021 - protein, 379 aa, Triticum turgidum subsp. durum
MATAGKVIKCKAAVAWEAGKPLSMEEVEVAPPQAMEVRVKILFTSLCHTDVYFWEAKGQTPMFPRIFGHEAGGIVESVGEGGTELAPGDHVLPVFTGECKECPHCKSAESNMCDLLRINTDRGVMIGDGKSRFSIDGKPIYHFVGTSTFSEYTVMHVGCVAKINPEAPLDKVCVLSCGISTGLGASINVAKPPKGSTVAIFGLGAVGLAAAEGARIAGASRIIGVDLNASRFEEARKFGCTEFVNPKDHTKPVQQVLAEMTNGGVDRSVECTGNVNAMIQAFECVHDGWGVAVLVGVPHKDAEFKTHPMNFLNERTLKGAFFGNFKPRTDLPNVVEMYMRKELEVEKFITHSVPFSEINKAFDLMAKGEGIRCIIRMEN

SEQ ID NO: 9022 - protein, 257 aa, Stigmatella aurantiaca
MGTTSKVALVTGAAQGIGAAVVRALADNALVAALDTQEEKLSALIADLGQGRGRVSAFRADVRDSSAVETVIDRVERELGPIGILVNVAGVLRAGPAIALSDEDWETTFAVNTQGVFHVSRAVARRMVPRKTGVIVTVASNASGTPRMQMAAYAASKAASAMFTKCLGLELAQHNIRCNVVSPGSTDTAMQRALWTDERGGEATIHGSLETFRLGIPLRRLATPADIADAVVFLTSDRARHITMHDLCVDGGATLGV

SEQ ID NO: 9023 - protein, 322 aa, Moritella sp. PE36
MSQILQDNSFSIGNTPLVRLNRVTTGNVFAKVESRNPSASVKCRIGANMIWQAEKDGLLKEGIDIVEPTSGNTGIALAFVAAARGYKLTLTMPNTMSLERRKLLKALGANLVLTDGAKGMKGAIDKATEIRDANPETTILLQQFENPANPAIHEQTTGPEIWEATDGQIDVLVSGVGTGGTITGVSRYIKLNKGKDLVSVAVEPTNSPVITQAKAGEALTPGPHKIQGIGAGFIPGNLDLEMVDRVELVSNEDSIEMAQRLMKEEGILAGISSGAAVVAAARLAALPEFADKNIVVILPSSGERYLTTALFDGVFTEQELQQ

SEQ ID NO: 9024 - protein, 342 aa, Physcomitrella patens subsp. patens
MVGSAKIKIGINGFGRIGRLVARVALERDDIELVAINDPFITPEYMAYMFKYDSTHGQWKKSEVTLHSEGHLTFGGNPVAVYACRDPSEIPWGKHGAEFVVESTGVFTDKEKAAAHFKGGAKKVVISAPSKDAPMFVMGVNEEKYANEDIVSNASCTTNCLAPLAKVINDKFGILEGLMTTVHATTATQKTVDGPSNKDWRGGRSAAANIIPSATGAAKAVGKVLPELNGKLTGMAFRVPTTDVSVVDLTVRLEKPASYATIKAAVKEASEGSMKGILGYTEDDVVSTDFITDSRSSVFDAKAGIALSDTFVKLVAWYDNEWGYSNRVVDLILHMAKQGNTQ

SEQ ID NO: 9025 - protein, 415 aa, Mesorhizobium loti MAFF303099
MLSQRMSLLSGPGTVAAQEPAELAQLAAAAGRQIIDLAAGEIIIETPLSVREGAIAAINAGTNRYTDAIGLTLLRKAVAEKLAAQTHVGWNLEDIVITAGAKQALLNAALAVLDPGDEVIIIRPSWPTFASQILLAGAKPVFVDSRPSTYIPNIGAVRDALTQRTKAIIVNSPNNPTGIIYDPTTLRAIGDLAIDHHLWIVSDECYSCFVFAGRHESIVTAHPGVRSRTILVNTFSKELAITGWRLGYLAGPPEIVAAAKKLQSDMTSNANVIAQHAVLHHLEVGDCSFERKMHQRLSKARHTGLRILAGLEGVTVPRADGTFFFYLDLKRLISELSAEGPVRSADDIARLLLDETDVATVAGGFFGDMNGLRLSFGVPQDLLELGLKRVVETLNSLKTRQPSKGRVTKAHDPEK

SEQ ID NO: 9026 - protein, 189 aa, Chromobacterium violaceum ATCC 12472
MLLVIDNYDSFTYNLVQYFGELGQDVKVFRNDEITLQQIEELKPQYLVVSPGPCTPNEAGVSVPAILHFAGKLPIMGVCLGHQGIGQAFGGKVVHAKQLMHGKVSPVSHLDKGMFRGLPNPVTCTRYHSLVIERETLPDCLEVTAWTDDGEIMGVRHKTLPIEGVQFHPESILTEHGHRMLDNFLKEFA

SEQ ID NO: 9027 - protein, 508 aa, Burkholderia cepacia
MNAPAVAAETRHSSSTAPAAGTRVAVQPVILAGGSGTRLWPMSRERFPKQLIGLLGEHSLLQSTALRLDGLAADHPLNDDVLIVCGEDHRFTTAEQLRLTGKSASIMLEPIGRYTAPALTLAAFRLVAGGNDAVMTVMPADHAVADLPRFHAAVAAGVHCAMQGKIATMGIVPKHPETGFGYIRVGAPLGDAATGKLDVRRLDRFVEKPHLELAQQYVASGEYWWNSGIFIVRASVWLKAIRQLEPAIYAACEQAVAQGKADGDFFRIDREAFAASPSNSIDYAVMEPLASLPQLCESVVVPLDAGWSDVGSWDAIWQISPKDEAENVGRGHVLFEGAESTFAHSESRLVACVGTQNLVVVETPDAVLVADKSRVQDVKKIVGRIKAQRGTEATDHRKVHRPWGHYDSVDMGERFQVKRIVVKPGAQLSLQMHHHRAEHWIVVCGTARITRGDETFLLSENESTYIPLGVSHRLENPGKMPLELIEVQSGAYLGEDDIVRFDDTYGRQ

SEQ ID NO: 9028 - protein, 368 aa, Mesorhizobium loti MAFF303099
MEIVDLTAGEIWSELARMIRQGAIEAINKGVNRYTDPVGTTELREALARKVSLETRQIWKAEEIAVTCGAKQALFNAAMVLLDPGDEVIIPVPYWTTFPAQVLIAGGKPIFVDTRSNGYVPRIEDIEAAITERSRAIVINTPNNPTGSVYDTQTLTGIAQLAIARDLWIIFDECYADFVHGDEAHRPIVFLVPEVRSRTLIVNAFSKSLALTGWRIGYLAGPKEVIDAVKALQSHTTSNPNVVAQHAVLAHLQRSDGSYEAGLRAQLASARQVGLSMLSSLTQVPIPRAQGGFYFYLDISKLVWSARRENVTRAPDEIVSALLTDAGVGVVSGSVFGDPAGLRLSYGIPTDQLVSGLARLTRLLNSWN

SEQ ID NO: 9029 - protein, 373 aa, Cryptococcus neoformans var. grubii
MTQLKRVLVTGGLGYIGSHVVVSLLLTGKYQPIVIDNCHNSYPEALNRCAEIARDELGADAPQPILHDLDLRDASAIEQVFEQYAADGGIWAVIHLAALKAVGESAELPLSYYRVNVAGSISLLEIMAKYSCNNLVFSSSATVYGTPATIPIPETSPLIPESCYGRTKAMVEEIIHDLTKVGAEEGKPNLRAVSVRYFNPAGAHPSGKLGEEPRGKPGNLLPLLAQMAVGREKSQLKVFGTDFPTPDGTCVRDYLHIMDLAHGHVLALDALAVPSSRPNIFSEIDPKDGYFRAFNLGRGQGMSVLNMIEAMRKATGFDYQYEIVGRRKGDVPDLTADPSLAQKELGFVAKEDLESMCRDLWNFQTRHPTGYSS

SEQ ID NO: 9030 - protein, 303 aa, Erwinia carotovora subsp. atroseptica SCRI1043
MSIVNKKVKKAVIPVAGLGTRMLPATKAIPKEMLPLVDKPLIQYVVNECIAAGINEIILVTHSSKNSIENHFDTSFELEAILEKRVKRQLLEEIQSICPKHVTIMQVRQGLAKGLGHAVLCAHPLVGDEPVAVILPDVIIDEYESDLKKDNLSEMLQRFSTTGHSQIMVEPVENVSSYGVVDCKGVELKAGDSAPMVGVVEKPKASEAPSNLAVVGRYVLSADIWSLLEKTPPGAGNEIQLTDAIAMLMEKETVEAYHLKGVSHDCGNKLGYMQAFVEYGLRHDGLGEEFAQWLQEAIDAEEK

SEQ ID NO: 9031 - protein, 704 aa, Lentisphaera araneosa HTCC2155
MKELSKDERLKKNLGLFDVYAICTGAMFSSGFFLLPGLAAAKTGSSVALAYLVAGFLILPAMFSKAELSTALPRAGGTYYFLDRSLGPMFGTVGGLGTYLSLSLKTAFALIGIGAYASFFVDLPIKPVAIALTVGFVFINITGAKETASLQRFLVVTLVSILTYFVAQGAYDSLAVQPDELVDQRFEGFLTNGMEGFFATVGFVFVSYAGLTKVSSVAEEVKNPERNIPLGMILSLVSTTVFYVLGVLVMTALIDPAEFHQDLTPVATAVSKFDTFIPQNILVGFVVIAALSAFFSTGNAGVMAASRYPMAMARDKLLPDEFATLGKFKTPTRAVVLTGVIMIGFILVLDATGIAKLASAFQLLIFMLVNLSVIVMRESRIESYDPGYKSPWYPWMQIIGMMVSVVLIIYMGWMAILFTLGMIAVCLAWYFRYARKRVSRTGAICHWFQRLGKNQYDELDQEFRGILKEKGLRQDDPFNEVVARAQFLEIDKSETFEEVIKEASKMLAARLKVDASKLEENFLEGTRTGRTPVTRGVALPHMHLMGIDKPEMVIARSKSGMLVDIFDVMGDEMEQQTFAIFLLVSPEGNPGLHLRMLAELANRIDQDEFLSRWNEEPNSAHLKQLLLNDGHYMTLSLKSDNGSSKFIGKAIKELGLPEGSLVAMVQRGGQRIVPSGSTTLEEGDRLIIIGEPKVLSKLRLLIES

SEQ ID NO: 9032 - protein, 195 aa, Streptococcus pneumoniae TIGR4
MELNTHNAEILLSAANKSHYPQDELPEIALAGRSNVGKSSFINTMLNRKNLARTSGKPGKTQLLNFFNIDDKMRFVDVPGYGYARVSKKEREKWGCMIEEYLTTRENLRAVVSLVDLRHDPSADDVQMYEFLKYYEIPVIIVATKADKIPRGKWNKHESAIKKKLNFDPSDDFILFSSVSKAGMDEAWDAILEKL

SEQ ID NO: 9033 - protein, 227 aa, Chromobacterium violaceum ATCC 12472
MRTFRIAPSILSADFARLGQEVKDVVAAGADIIHFDVMDNHYVPNLTMGPMFCEAIRPHSSAPIDVHLMVKPVDALAAAFAKAGADIITFHPEGSEHIDRTLGLIKDAGCKAGLVFNPATPLSYLDHVMDKLDMILIMSVNPGFGGQSFIPHALEKIKLARRRIDEYTAKHGGEIWLEVDGGVKVDNIAQVAAAGADTFVAGSAIYGQKDYKAVIDAMRAELARVQA

SEQ ID NO: 9034 - protein, 582 aa, Novosphingobium aromaticivorans DSM 12444
MTTERSGAEILVESLVAKGVEFVFGYPGGAVLPIYDALFGDERLRHILVRHEAGAAHAAEGYARATGKPGVVLVTSGPGATNAVTGIADAFMDSIPMVVITGQVPTALIGSDAFQEADTIGITRHCTKHNYLVKDPSQLAATIDEAFRIATEGRPGPVVIDIPKDVQIATAAWSSAAPQQRNRYAPQTEGGAKEIAEAIELIAKAKAPVFYTGGGVINAGPEAARLLRELQSLTGAPVTSTLMGLGAFPADHPAWLGMLGMHGTYEANMTMNRADLVVCIGARFDDRVTGRLDAFSPNSKKIHIDIDRASINKTVQVDLPVIGDCGKVLAQLIEAWLERGYQKQDLTEWNARIDGWRARQSLAFPRRGKEIMPQLAIERLYELTRHKEPIISTEVGQHQMWAAQHFHFMKPNKWLTSGGLGTMGYGLPAAIGAQAGFPDALVIDIAGDASIQMNIQELGTATQYRLPVKVFVLNNEWMGMVRQWQELTYESRYSNSYSDSLPDFVKLAEAYGWKGIRITDESELDAGIQAMIDHDGPVFVDCLVAKEANCFPMIPSGAAHTDMILYGDEVAGTMDDEAKALV

SEQ ID NO: 9035 - protein, 172 aa, Novosphingobium aromaticivorans DSM 12444
MMHIAQEAQERHVLTITVDNEAGILAKIAGLFTARGYNIDSLTVADITDGHDVSRITIVTHGPPPIIDQIRAQLERLVPVHKVTDLTEVGPFVERELALIKVSGKGENRVEALRLADVFRAKVVDTTTSSFIFELTGAPDKIDSFVSLMKELGLVEVGRTGIVGMIRGATAA

SEQ ID NO: 9036 - protein, 419 aa, Thermus thermophilus
MPLKAYRPPEDPGLWDTYLEWLERALKVAGVHPTTLEYLAHPKRLVTLSLPVVMDDGKVRIFQGYRVVHDIARGPAKGGVRLDPGVTLGQTAGLAAWMTLKAAVYDLPFGGAAGGIAVDPKGLSPRELERLVRRYTAELVGLIGPDSDILGPDLGADQQVMAWIMDTYSMTVGSTVPGVVTGKPHALGGSEGRDDAAGLGALLVLEALAKRRGLDLRGARVVVQGLGQVGAAVALHAERLGMRVVAVATSMGGMYAPEGLDVAEVLSAYEATGSLPRLDLAPEEVFGLEAEVLVLAAREGALDGDRARQVQAQAVVEVANFGLTPEAEAYLLGKGALVVPDLLSGGGGLLASYLEWVQDLNMFFWSPEEVRERFETRVARVVDAVCRRAERDGLDLRMGALALALERLDEATRLRGVYP

SEQ ID NO: 9037 - protein, 252 aa, Streptococcus pneumoniae TIGR4
MSRKPFIAGNWKMNKNPEEAKAFVEAVASKLPSSDLVEAGIAAPALDLTTVLAVAKGSNLKVAAQNCYFENAGAFTGETSPQVLKEIGTDYVVIGHSERRDYFHETDEDINKKAKAIFANGMLPIICCGESLETYEAGKAAEFVGAQVSAALAGLTAEQVAASVIAYEPIWAIGTGKSASQDDAQKMCKVVRDVVAADFGQEVADKVRVQYGGSVKPENVASYMACPDVDGALVGGASLEAESFLALLDFVK

SEQ ID NO: 9038 - protein, 456 aa, Rhodopirellula baltica SH 1
MSLAVESKPDVDHQTTYFRCISGCSARHSIFDVIYTCPTCGSLLEVYHEREPLKKKNAYQWQQLFDSRASTSKWPFGSGVWGMREWVVPSLADENVVSMFEGNTNLFWAERLGAQLGVPDLWIKLCGNSHTGSFKDLGMTVLVSVVKQMMAQGSSVKAVACASTGDTSAALAAYAAYAGIPAVIFLPAGKVSTAQLIQPVANGAHVLALDTDFDGCMKIVQEVTKDNSIYLANSMNSLRIEGQKTVGIEMVRQFEWEVPDWIIIPVGNLGNISALYKGFKLMMDLGLINRMPRLVAAQTERANPFYTAYKNGFAEKVSVTAQDTLANAIRIGDPVSYAKAVKAVQETNGIVEQASENELAEASASADLTGMFTCPHTGVALAVLKKLIDRGEISPKDKTVVISTAHGLKFTDFKVGYHESTLEGIDSKHANPAVHLPADANAVKDEIARRLEQHNG

SEQ ID NO: 9039 - protein, 170 aa, Streptococcus pneumoniae TIGR4
MNLKDYIATIENYPKEGITFRDISPLMADGNAYSYAVREIVQYATDKKVDMIVGPEARGFIVGCPVAFELGIGFAPVRKPGKLPREVISADYEKEYGVDTLTMHADAIKPGQRVLIVDDLLATGGTVKATIEMIEKLGGVMAGCAFLVELDELNGREKIGDYDYKVLMHY

SEQ ID NO: 9040 - protein, 174 aa, Silicibacter pomeroyi DSS-3
MAPSSYQAPTRGDKAEKTTYSQSASSNLAQSQSTVADLLGGKGEAVFSVRPGDTIGQVVGVLKDKRIGAVLVTDQNGALLGILSERDIVRRMADTPGQTLPQQAEGLMTRAVQTCAPDETLNVVLKRMTEGRFRHLPVMRDGKLCGMITIGDVVNFRLRELEYEALKMKQMIVG

SEQ ID NO: 9041 - protein, 466 aa, Mesorhizobium loti MAFF303099
MSLDRSSIRAPERQLQPAPDDRLAALERVIRRFSNTDGLVKRGGLVTEVTQTHYKVRGLSDFARLGDMVEQRGQAGSRRGEIVKISRDEVVVAPFERSADAGIGDAVFRRGPLAVGPHNSWRGRTIDALTRAIDGGPPLIRGEDLSGGATTPGAMARQRVGTAFMTGVKVIDIFTPLCFGQRMGVFAGSGVGKSTLLAMLAGADAFDTVVVALIGERGREVREFLEDTIGDSMAKTVAVVATSDESAMMRRRAPDTAMRVAEHFRDQGHRVLLVLDSITRFAHALREVATGTGEPPVARGYPASVFTELPKLLERAGPGAEGKGSITAIISVLVDGDDHNDPVADSVRGILDGHVVLDRAIAEQGRYPPVNPLSSISRLAGKAWSVEQRALVTRLKSMISRFEDTRDIRLLGAYQGGADAELDIAVRQVPLIYEALTQSPRDRPSADPFSDLARHLKGKLNAESGD

SEQ ID NO: 9042 - protein, 474 aa, Leptospirillum ferrooxidans
RSGYDAFPPEVLNLRLRWWGVYPQGDGAGKAGGSVPFFMLRTRIAGGILKAAALRQMAYISERYAKSTADITVRQNIQFHWVTPSDLPEIFRLLGEVGIDSMGACGDVTRNITGCPVSDLSGDPLAQRHRNLLEEANAALKGHPDFWNLPRKFKITIASCKSQCSLPEINDVGIVPVTHPVHGDGYAIRVAGGLSTRPHFSVPLHFFFRYEEVIPVLRGVASLFRDRSELRENRDRARLKFLFLEHGWDRSRFEEALLPYLSFSPVVWEPSGIEVEGFKSARDHIGVHQVPDGSGRYYIGLSINQGALSPEVMRGLADLSESLGNGEIRLTSMQNLILTGVEEKNLSLVLEKIALLGLNASDGSFLSRTVSCTGNVFCRLALVETKEFSRDLASTLHERFGELSNPINLHVTACPNDCGQQRISEIGLQGVSIKNEEGAPVDGYELFLGGQTGSRKSFNQRTGVRLSGEQVAPV

SEQ ID NO: 9043 - protein, 713 aa, Escherichia coli
MSRIIMLIPTGTSVGLTSVAWRDPCNGTQRRSSERFQTYRSAAYRWRCADQTTTIVRANSSTTTAAEPLKMSYVEGLLSSNQKDVLMEEIVANYHANTKDAEVVLVEGLVPTRKHQFAQSLNYEIAKTLNAEIVFVMSQGTDTPEQLKERIELTRNSFGGAKNTNITGVIVNKLNAPVDEQGRTRPDLSEIFDDSSKAKVNNVDPANVQESSPLPVLGAVPWSFDLIATRAIDMARHLNATIINEGDINTRRVKSVTFCARQHSAHAGALRAGSLLVTSADRPDVLVAACLAAMNGVEIGALLLTGGYEMDARISKLCERAFATGLPVFMVNTNTWQTSLSLQSFNLEVPVDDHERIEKVQEYVANYINADWIESLTATSERSRRLSPPAFRYQLTELARKAGKRIVLPEGDEPRTVKAAAICAERGIATCVLLGNPAEINRVAASQGVELGAGIEIVDPEVVRESYVGRLVELRKNKGMTETVAREQLEDNVVLGTLMLEQDEVDGLVSGAVHTTANTIRPPLQLIKTAPGSSLVSSVFFMLLPEQVYVYGDCAINPDPTAEQLAEIAIQSADSAAAFGIEPRVAMLSYSTGTSGAGSDVEKVREATRLAQEKRPDLMIDGPLQYDAAVMADVAKSKAPNSPVAGRATVFIFPDLNTGNTTYKAVQRSADLISIGPMLQGMRKPVNDLSRGALVDDIVYTIALTAIQSAQQQ

SEQ ID NO: 9044 - protein, 297 aa, Triticum aestivum
  misc_feature (185)..(185): Xaa can be any naturally occurring amino acid
VSHDSRQGIRKFIAEVVSIGRLRHRNLTQLLGYCWRNGELLLVYDYMANGSLDKYLHNKNGPALCWPQRYLIVKGIASSLLYLHEDWEQVVIHRDIKASNVLLDREMNGRLGDFGLARLYDHGTNAQTTHVVGTMGYLAPELMRTGKATPSADVFAFGVFLLEVVCGRRPIGSDEHNNPMVLVDXVLEHHRNGSIIDTVDSRLEGKFNMEEVSIILKLGLLCAHPLPNTRPSMRKVMQYLDGDQAVPHLTPTYMSYNEMALMQSEGFDSYITPCPPPVTGICSRSGESLVTVLFDGR

SEQ ID NO: 9045 - protein, 339 aa, Zea mays
MGYLSCRADSSVATCRSITAIPPLPTSRRSGPGAGSSRPALPPAPAAIERFDYAEVEAATSHFADAALLGRGSHGAVYKAVLPSGRAVAVKRPSPRRPEVDNEIRILSSVSGPRFVNLLGFSDPGPAPAPAARLLVVEYMPNGTLYDLLHRNPRPPGWPRRLRLALQTARALRALHDADPPVIHRDVKSANVLLDANLGARLGDFGLALRVPKAAGVATPAPAGTLGYLDPAYVTPESLSTKTDVFSFGILLLEIMSGRKAIDVQHSPPFVVEWAVPLLRKGKVASLFDPRVAPPRDPLTRKDLAALAASCVRSCRERRPSMADIVQRLVVLSKAVSAK

SEQ ID NO: 9046 - protein, 352 aa, Bacillus cereus E33L
MTIDRVCTIGPASNNKETLAQLINNGMKIVRLNLSHGTHESHKDIIRLVKSLDASIKILGDVQGPKIRLGEIKGEQITLQAGDSFMLRTQPGTGSNREASIDYEGIANDVKVGSRILMNDGEVELIVEKVSTDKIETKVKTGGNISSHKGVNLPGAIVSLPAITEKDKKDIQFLLEEDVDFIACSFVRKPSHIKEIRDFIQQYKETSPNLIAKIETMEAIENFQDICKEADGIMIARGDLGVELPFQFIPLLQKMMIQECNRTNTYVITATQMLQSMVDHSIPTRAEVTDVFQAVLDGTNAVMLSAESASGEHPVESVSTLRLVSEFAVHVKKDGPFVMKDVLELLHKSLDE

SEQ ID NO: 9047 - protein, 575 aa, Moritella sp. PE36
MISGILASPGIAFGKAQLFINEEIVLNKQTIETAQIDEQIAIFLAARDKSAIQLEAITEMARQTFGDEKAEIFEGHMMLLEDEELEEDIVTFIKKNKASADFAIHSIIEENAEMMAALDDPYLRERAADFRDIGNRIVKNALGMEMVSLSAIKEQVILIASDLTPSETAQINLDKILGFVTDLGGRTAHTSIMARSLELPAIVGTGNVTQIVKSGDFVILDAINNNLIVNPSEDVIKEYKATQAQYLADKAELLKMKDLPAITLDGHHVEVCGNVGTVKDCAGVIRNGGEGVGLYRTEFLFMDRDSLPTEDEQFEAYKAVAESMNGQGVIIRTMDIGGDKDLPYLNLPKEMNPFLGWRAIRICFDRPEIMNAQLRAILRASAFGKVRIMFPMIISVEEVRQLKDIMTTLKAELTAEGLAFDEAIETGVMVETPAAAAIAHHLIKEVDFFSIGTNDLTQYTLAVDRGNEMISDLYNPMTPAVLTLIKQVIDASHAAGKWTGMCGELAGDETATLLLLGMGLDEFSMSGISIPKVKKTIRNANFADVKVLADQALSCATADEIQELIAQFTKQRAAC

SEQ ID NO: 9048 - protein, 302 aa, Bordetella pertussis Tohama I
MIARGGKKFAASTNFPALPPGVFMQVVRKAVFPVAGMGTRFLPATKAMPKEMLPVVDKPLIQYAVEEAVAAGITDLIFVTGRNKRAIEDHFDAAPELETDLEAKGKHELLALVRDILPAHVNCLYIRQSAPLGLGHAVLTAAPAVGNEPFAVLLADDLIDADTPVLKQLIDVAVARQGSVLGVQEVPREDTRKYGIVASQPVDARTERVTHIVEKPAPEQAPTTLAVVGRYVLEAAIFDHLRATTVGAGNEIQLTDGIAALLRERDVYAHRYDGKRYDCGSKAGMFQATVALGRKYHGLIPE

SEQ ID NO: 9049 - protein, 379 aa, Triticum turgidum subsp. dicoccoides
MATAGKVIKCKAAVAWEAGKPLSMEEVEVAPPQAMEVRVKILFTSLCHTDVYFWEAKGQTPMFPRIFGHEAGGIVESVGEGVTELAPGDHVLPVFTGECKECPHRKSAESNMCDLLRINTDRGVMIGDGKSRFSIDGKPIYHFVGTSTFSEYTVVHVGCVAKINPEAPLDKVCVLSCGISTGLGASINVAKPPKGSTVAIFGLGAVGLAAAEGARIAGASRIIGVDLNASRFEEARKFGCTEFVNPKDHTKPVQQVLAEMTNGGVDRSVECTGNVNAMIQAFECVHDGWGVAVLVGVPHKDAEFKTHPMNFLNERTLKGTFFGNFKPRTDLPNVVEMYMRKELEVEKFITHSVPFSEINKAFDLMAKGEGIRCIIRMEN

SEQ ID NO: 9050 - protein, 66 aa, Brassica napus
  misc_feature (38)..(38): Xaa can be any naturally occurring amino acid
  misc_feature (64)..(65): Xaa can be any naturally occurring amino acid
MAGGGNRRDEGSITIQSTNLFAALDTRKKKKKKTDKAXKSKGSSSSSSKPQVFWAPTPLKVKSXXD

SEQ ID NO: 9051 - protein, 379 aa, Triticum urartu
MATAGKVIKCKAAVAWEAGKPLSMEEVEVAPPQAMEVRVKILFTSLCHTDVYFWEAKGQTPMFPRIFGHEAGGIVESVGEGVTELAPGDHVLPVFTGECKECPHCKSAESNMCDLLRINTDRGVMIGDGKSRFSIDGKPIYHFVGTSTFSEYTVMHVGCVAKINPEAPLDKVCVLSCGISTGLGASINVAKPPKGSTVAIFGLGAVGLAAAEGARIAGASRIIGVDLNASRFEEARKFGCTEFVNPKDHTKPVQQVLAEMTNGGVDRSVECTGNVNAMIQAFECVHDGWGVAVLVGVPHKDAEFKTHPMNLLNERTLKGTFFGNFKPRTDLPNVVEMYMRKELEVEKFITHSVPFSEINKAFDLMAKGEGIRCIIRMEN

SEQ ID NO: 9052 - protein, 379 aa, Triticum monococcum
MATAGKVIKCKAAVAWEAGKPLSIEEVEVAPPQAMEVRVKILYIALCHTDVYFWEAKGQTPVFPRILGHEAGGIVESVGEGVTELVPGDHVLPVFTGECKDCAHCKSEESNLCDLLRINVDRGVMIGDGESRFTINGKPIFHFVGTSTFSEYTVIHVGCLAKINPEAPLDKVCILSCGISTGLGATLNVAKPKKGSTVAIFGLGAVGLAAMEGAKISGASRIIGVDLNPAKYEQAKKFGCTDFVNPKDHTKPVQEVLVEMTNGGVDRAVECTGHIDAMIAAFECVHDGWGVAVLVGVPHKEAVFKTSPMNLLNERTLKGTFFGNYKPRTDLPEVVEMYMRKELDVEKFITHRVPFSQINTAFDLMLKGEGLRCVMRMDE

SEQ ID NO: 9053 - protein, 244 aa, Moritella sp. PE36
MTTLISKEGQAVPQVTFPIRQGDAWVNRTTEELFANKTVIVFSLPGAFTPTCSSSHLPRYNELANVFSAHGVDDILCVSVNDTFVMNAWKDDQEAENITFIPDGNSEFSAGMGMLVDKSDIGFGKRSWRYSMLVKNGVVAKMFIEADEPGDPFNVSDADTMLGYVAPEYKVQESITVFTKPGCPFCAKAKQTLIDQGLNYEEVVLGKDATTVSLRAVTGQSTVPQIFIGGKHIGGSEALEAHFA

SEQ ID NO: 9054 - protein, 147 aa, Magnaporthe grisea 70-15
MTYPVQKSDDEWRAVLSKEQFRILREKGTERPGTGEFDKHSPKSGVYTCAGCDAPLYKASHKFSSGCGWPAYFDSVPGAVTRHEDRTLGMTRVEIVCSNCGGHLGHVFKGEGYPTPTDERHCVNSVSLKFSSEDQPVDKGEAKESKA

SEQ ID NO: 9055 - protein, 157 aa, Dechloromonas aromatica RCB
MKRLIPFLFLACLAASSFAENTSHDQPIHDAAREGSGDDVRRLLKADPKQRDVRTALGSTPLHLAATNPDTSAMQALIAAGADVNARDNDGATPLHMAAYSSRPKNTQLMLEAGADPQAKTDNGRDPGSMARKVKADETAGVISLWVLKGCKAGKPC

SEQ ID NO: 9056 - protein, 379 aa, Triticum turgidum subsp. dicoccon
MATAGKVIKCKAAVAWEAGKPLSIEEVEVAPPQAMEVRVKILYTALCHTDVYFWEAKGQTPVFPRILGHEAGGIVESVGEGVTELVPGDHVLPVFTGECKDCAHCKSEESNLCDLLRINVDRGVMIGDGESRFTINGKPIFHFVGTSTFSEYTVIHVGCLAKINPEAPLDKVCVLSCGISTGLGATLNVAKPKKGSTVAIFGLGAVGLAAMEGAKMSGASRIIGVDLNPAKYEQAKKFGCTDFVNPKDHTKPVQEVLVEMTNGGVDRAVECTGHIDAMIAAFECVHDGWGVAVLVGVPHKEAVFKTSPMNLLNERTLKGTFFGNYRPRTDLPEVVEMYMRKELDVEKFITHSVPFSQINTAFDLMLKGEGLRCVMRMDE

SEQ ID NO: 9057 - protein, 375 aa, Capsicum annuum
MVDANMGAAGGQFPEFPNIVTHGGQYVQYDIFGNFFEITTKYRPPIMPIGRGAYGIVCSVFNAELNEMVAVKKIANAFDNYMDAKRTLREIKLLRHLDHENVIGLRDVIPPPLRREFSDVYIATELMDTDLHQIIRSNQGLSEDHCQYFMYQLLRGLKYIHSANVIHRDLKPSNLLLNANCDLKICDFGLARPNLENENMTEYVVTRWYRAPELLLNSSDYTEAIDVWSVGCIFMELMNRKPLFAGKDHVHQIRLLTELLGTPTESDLSFLRNEDAKRYIRQLPQHPRQQLAKVFPHVNSLAIELVDKMLTLNPTGRITVEEALAHPYLAKLHDAADEPVCPVPFSFDFEQQGIGEEQIKDMIYQEALVLNPEYA

SEQ ID NO: 9058 - protein, 260 aa, Oryza sativa Indica Group
MEESDAAAASAKAPNGEASGGGGRPVEVEDTLPGVLRSFVDGVCSQGGGGGGGEPLLRRIRAASCETAPRLREALRNSARDLLEWTRRGSGLRAILVISNSVICSVIRKDGMNCTIFYRKHVIDYCRWSVSGYDRVGTITLIALTGLLIFMFFLLVATTNAVVVSVLMSLAAAGGFLAMFFACLVAVYIGVVSVAVFVISATVISAIVGVMIASGWLGFFWMIWFAARKSMDLTKHSIGVTNSAIQSYSASRHAKQKPID

SEQ ID NO: 9059 - protein, 394 aa, Capsicum annuum
MDGPAQQTDTVMAEAAAAQQPAPPSQPVAGIDNIPATLSHGGRFIQYNIFGNVFEVTAKYKPPIMPIGKGAYGIVCSALNSETNEHVATKKIANAFDNKIDAKRTLREIKLLRHMDHENIVAIRDIIPPPQREAFNDVYIAYELMDTDLHQIIRSNQGLSEEHCQYFLYQILRGLKYIHSANVLHRDLKPRNLLLNANCDLKICDFGLARVTSETDFMTEYVVTRWYRPPELLLNSSDYTAAIDVWSVGCIFMELMDRKPLFPGRDHVQQLRLLMELIGTPSEAEMEFLNENAKRYIRQLPLYRRQSFVEKFPHVNPAAIDLVEKMLTFDPRRRLTVEDALAHPYLTSLHDISDEPVCTTPFSFDFEQHALTEEQMKELIYREGLAFNPEYQHM

SEQ ID NO: 9060 - protein, 244 aa, Serratia marcescens
MSKLIPVVMAGGTGSRLWPMSRESFPKQFLSIDDSGVSLLQQTLQRLSGLTGIEVAAPLVICNEEHRFLVAEQLRGIGQLATNIILEPVARNTAPAVALAAHLAAEKDEGSMLLVLAADHLITKVENFHAAIQTAMSFADNNQLVTFGIIPEHPETGYGYIKRGSHLSNDCFKVDSFVEKPRLEKAIEYLASGDYSWNSGMFMFKTAKFLQELQQFSPDIFSTTQQSVSKSQRDMNFIRVEQDI

SEQ ID NO: 9061 - protein, 150 aa, Zea mays
MATVLGSPRAPAFFFSPSSLRAAPAPTAVALPAAKVGIMGRSASSRGRLRAQATYNVKLITPEGEVELQVPDDVYILDQAEEDGIDLPYSCRAGSCSSCAGKVVSGSVDQSDQSYLDDGQIAAGWVLTCHAYPTSDVVIETHKEEELTGA

SEQ ID NO: 9062 - protein, 307 aa, Campylobacter jejuni
MHNILFGNILNRSATMKGIILAGGSGTRLYPSTLTLCKQLLPIYDKPMIYYPMSVLMLAKIKEVLIISTPKDIDRFKELFKDGSFLGMQIQYKIQERPEGLAQGLILAQDFIQNDDIALILGDNIFYGQGFSDILENAKDDLKKGFASIFSYHVKDPERFGVVEMDQNGNVLSLEEKPKNPKSNYVATGLYFYNNDAIDIAKNIKPSARGELEITDVNIEYLRLNKLKSQHLGRGFAWIDTGTHDSLIEASSFVQTIELRQGYKIACLEEIAYNNNWIDNETLEKRALLLSKSNYGQYLYKILSQGK

SEQ ID NO: 9063 - protein, 193 aa, Lentisphaera araneosa HTCC2155
MAVLVGKQAPDFSEKAVKGQEVIENFSLSQFKGKYVVLFFYPLDFTFVCPTELHAFEAKRAEFEAKGVEVVGVSTDSWFSHLAWLNTPKNQGGIEGVGYPIVSDFNKTISADYDVLLGGGMALRGLFLIDKEGVVQHQVVNNLPLGRNVDEAIRMVDALQFFEANGEVCPANWNEGDKAMKPNDAGLKEYFAE

SEQ ID NO: 9064 - protein, 176 aa, Glycine max
MGAYRNEGCRSHRRESGIQPGHQFDYNASPQTLEELELEYKNEATELMKIRDREEDEENFKHREAIRDLREKYMSKVSLVRVTHAKQLEEFLQLDAQRRRQQVGQQMSSGYRGFKQQSFPEYDGSTANPPTYAGSNIPLESRNRFSGNMETYPNRPHDNFGEFHRRGDFAKAYNRY

SEQ ID NO: 9065 - protein, 133 aa, Triticum aestivum
MAAAPSPAVAAVSSSAPSSGLLPPRRAAPCSAVPLTSMRSAAPGGRMATVARAVGDVAAEGNTFLIAGAVAVALVGTAFPIFFSRKDTCPECDGAGFVRKSGATLRANAARKDQAQIVCANCNGLGKLGQIDK

SEQ ID NO: 9066 - protein, 498 aa, Zea mays
  misc_feature (334)..(334): Xaa can be any naturally occurring amino acid
MDAVWFTVSFLAIAAIATKIIAKRRATTSAPRSTIPAPPVVEGRSLVRFVHTLFTKGLRATIHDEHARMGSVFTVSFLGLMKTTFLVGPDVLNHFYNGPESDINHGNMLDFMVPMFGKEVGYGVDFATRYEQIRFYSDPLKRPSKLRIHVDPIVQEVEGYFAKWGEEGTVDLKHEFSQLLMLISSRCLLGKEVREKMFDEMHALFHELKSGMRLSSVLFPYAPTPTNRRRDRARAKLLKIFSEVVRSRRRRGEEEKEKEEDVLQSLIDSRYKDGRATTEEEVTGMIILLVFGGMDTSTLASTWTGARLLSTPAAMAAAVEEQRRILTDHGHGAXVGYSEFMQMTTLHWSIKEALRMHPPSAVFFRKARRSFGVRTRDGREYEVPGGHTVASPVLFNSHLPSVYKDPDVYDPTRFGPGREEDRAGGKFTYEAFSCGRHSCVGEAYAYLQIKVMLSHLLRNFQLELVSPFPQTDWGKLVPEPKGKVMVRYKRQRLLSVPS

SEQ ID NO: 9067 - protein, 535 aa, Daucus carota
MGDMEGSPGSSMHGVTGREPSLAFSVASRIDTSAEFHVPVDSEHKAKVFKFKSFSPPHGLQFQLTWISFPTCFVSTFAARPLVVIIRDNLNPTKMDVGNAGVASVTGSILSRGAMGAICDMLGPRYGCAFLIMLSAPKVLCMSFVSSAGGYVAVRFMIGFSLATFVSCRYWMSTSMHSDIIGLVNGTAAGWGNMTGGATQLIMPLLYDIIREAGATPFTAWRIALFIPGWLHVISGILVLTLGQDLPDGNAQNEASLRKKGRVHKDKFSKILRYAATNYRTWILVLLYGYSMGVELTTDNVIAEYFFDRFDLKLHTPGIIAATFGMANLLARPFGGWSSDVAAKHFGMRGRHWNSWDLQTLGGVFCLLLVRATTSPIDALAITWMIIFSIGAQAATGVTFGIIPFISRRYLGIISQMTGANGNFGSGQTQPLEFDSTKYNTGLGLTYMGMMIIACTLPPMLVWFWQDGSMFLPPSKDPIKGTEPEHYFGSEYTEDEKVKGMHQNSIKFAENSRTEFGKKRVGSAPTPPNVYPNRV

SEQ ID NO: 9068 - protein, 172 aa, Populus trichocarpa
MAYDVAKGMNYLHKRNPPIVHRDLKSPNLLVDKKYTVKVCDFGLSRFKANTFLSSKSAAGTPEWMAPEVLRDELSNEKSDVYSFGVILWELATLQQPWSNLNAAQVVAAVGFKGKRLEIPRDLNPHVAALIEACWANEPWKRPSFASIMDSLRSLIKPPTPQPGLAGMTLLA

SEQ ID NO: 9069 - protein, 295 aa, Acinetobacter calcoaceticus
MDLVMLKNSFYEKTARARIQAVVDENSFKEILKPTEIEVSPHLSALDIPGSFDDGVIIGTAAINQTPIHIIAQEGQFMGGAVGEIHGAKIVGLLHKAIQDQSQAVVFFVDSGGVRLHEANAGLIAISEIMRAMLQVRHAGIPIITVIGGTCGAFGGMGISACLSSTIIMTEEGRLALSGPEVIETVKGVEEFDSKDRALVWRVTGGKHRFLLNHAQVLVEDDITDIRDAISAQLNQAAPRLDLEHLLQQQQQLEQQQQRWFGKNDGLQIWHEMGIAHPEQIPMLSAQEVKLLKQG

SEQ ID NO: 9070 - protein, 326 aa, Myxococcus xanthus DK 1622
MVYGFWVSRSLQIMAELELADTIGDTPKTVEELAEASGTHAPTLRRLLRLLSGLGVLVKDESTQRWALTELGGMLRKDNPGSVYGSLRAHGHILSWQAWGDLVTALKTGKPTVEKFMGDTFFNYMTTHPDVAAIFNGSMAAYQTLNAPAVVNGYDFSSARSIVDVGGGTGMLLTHILKANPGVRGTVFEMPHVAVEARERIAEQGLSPRCDVVAGDFFECIVPEGKDVYILSQILHDWDDEQSLRILKCIRAAMRPDSRLLIVETVLPGDNVPHFGNLYDLAMLVLVGGRERTGPEYTALLEKAGLRLFNVFPTTMPPSVVEAVVA

SEQ ID NO: 9071 - protein, 524 aa, Streptococcus pneumoniae TIGR4
MKFNELNLSADLLAEIEKAGFVEASPIQEQTIPLALEGKDVIGQAQTGTGKTAAFGLPTLEKIRTEEATIQALVIAPTRELAVQSQEELFRFGRSKGVKVRSVYGGSSIEKQIKALKSGAHIVVGTPGRLLDLIKRKALKLQDIETLILDEADEMLNMGFLEDIEAIISRVPENRQTLLFSATMPDAIKRIGVQFMKAPEHVKIAAKELTTELVDQYYIRVKEQEKFDTMTRLMDVAQPELAIVFGRTKRRVDELTRGLKIRGFRAEGIHGDLDQNKRLRVLRDFKNGNLDVLVATDVAARGLDISGVTHVYNYDIPQDPESYVHRIGRTGRAGKSGQSITFVAPNEMGYLQIIENLTKKRMKGLKPASVEESFQSKKQVALKKIERDFADETIRANFEKFGKDARKLAAEFTPEELAMYILSLTVQDPDSLPEVEIAREKPLPFKPSGNGFGGKAKGGRGGRRGDDRRERDRRGNGRRDEFKKGSRGNDRFDKEKRYRKDNKKPRNTLSEKQTGFVIRNKGDK

SEQ ID NO: 9072 - protein, 116 aa, Zea mays
MSTTVSRASLDQKLALAKRCSREATLAGAKAAAVATIASAIPTLASVRMLPWAKANINPTGQALIVSTVAGMAYFIAADKKILSLARRHSFEQAPDHLKNTSFQGTGRPHPAFFRP

SEQ ID NO: 9073 - protein, 479 aa, Myxococcus xanthus DK 1622
MRVVKLEEARMPDGVQEAFDRLHAHRWEVARRGMKERLARLEQFKTLLVARREALAEALHADFRKPRAEVEATEVLPVLMELASIQKHLKTWMKPRKVSTPLLLTGTSSLVQYEPRGVVLVMAPWNYPFHLLVSPLVAAVAAGNAVLCKPSEKTPNTARFIAELVKDVFPPEEVAVVEGGPEVGEALLRLPFDHIFFTGGARVGRRVMEAAAKHLASVTLELGGKSPVIVDETADVAAAAERVVWGKFLNGGQTCIAPDHVWVHASKEEALLEAMKEALERFYGRTEEARRASLDLCRMVDDSAFTRVRQLMDRTVEAGARVVVGGGVGAESRYIAPTVLADVTPDTPIMAEEIFGPVLPVLRFESLDEVVSHVREDGKPLALYVFSNDEATVERLLRETRAGGTCINTVVLHNVNPNLPFGGVGASGVGAYHGETGFRTFSHERAVLRQGRTSLVHLFFPPFTGKAQKLARLAGRLFE

SEQ ID NO: 9074 - protein, 591 aa, Physcomitrella patens subsp. patens
MASMLINSSHFATRAVSGGEVAFLDRFQGLRKQSFGTTKSGLRVGRKGKGSSEAVRVAVLVRATSYRPGRYVKEKGGSIIPVSPEDGRINFLEDEVKLRLFQGLPDESRVGMWVKPSFQRKTKIVCTIGPTSNTKEMIWKLAEAGMNVARLNMSHGDHASHKEVIDLVREFNKEAHANVIALMLDTKGPEVRSGDLPQPIMLKKGDPFTFTIKRGVGTDTCVSVNYDDFVTDVEIGDTLLIDGGMMSLEVKGKTHEEVYCEVVDGGELKSRRHLNVRGKSATLPSITEKDWEDIKFGVENKVDFYALSFVKDAQVVHELKSFLKEKSADIHVIVKIESADSIPNLQSILDAADGAMVARGDLGAELPIEEVPLLQGEIIRSCRAMGKPVIVATNMLESMITHPTPTRAEVSDIAIAVREGADAIMLSGETAHGKYPLKAVRVMHTVAMRTEATMPEEEAPANLGRAFKTHMSEMFAFHATLMSNTLGTSILVFTRTGFMALLLSHYRPVGTIFAFTNDKRVQSRLALYHGVRAIHIKFTNDAEETFNYALSILQKKGMVQDGEEVALVQSGKQPIWRSEYSHHIQVRKVRA

SEQ ID NO: 9075 - protein, 240 aa, Arabidopsis thaliana
MCTLEKRGDLFLLTLTGDGEHRFHPDTIATILSLLEQAKSQSTRGSILITTANGKFFSNGFDLAWAQTAGSKTGAANRLHQMVESFKPVVAALLDLPMPTIAALNGHAAAAGLILALSHDYVFMRKDRGVLYMSEVDIGLSMPDYFSALVRAKIGTSAARRELLLSGKKIRGEEAVGLGIVDSAAYDSEEGVVVASVRLGEKLAAKKWSGEVYASIRKSLYPELCEILGLETRVFATPKL

SEQ ID NO: 9076 - protein, 354 aa, Petroselinum crispum
MKKGNLGPGLKLSLPPPDEDSLTKFLTQSGTFMDGDLLVNRDGVRIVSQTDVQAAPPIQATDNQLSLADFDAIKVVGKGSGGIVRLVQHKWTGQFFALKVIQMNIQESARKQIAQELKINQSSQCLNVVVCYQSFYDNGAISIILEYMDGGSLADFLKIVKNIPEPYLAAIFKQVLKGLWYLHHEKHIIHRDLKPSNLLINHRGEVKITDFGVSAILATTSGQANTFVGTYNYMSPERISGGQHGYSSDIWSLGLVLLECATGYFPYSPPEQDEGWSNVFELMDTIVNQAPPCAPPDEFSPEFCSFVSACVQKDPRKRPSANELLRHPFINMYEHLNIDLAGYFTEAGSPLATL

SEQ ID NO: 9077 - protein, 379 aa, Triticum turgidum subsp. dicoccoides
MATAGKVIKCKAAVAWEAGKPLSVEEVEVAPPQAMEVRVKILYTALCHTDVYFWEAKGQTPVFPRILGHEAGGIVESVGEGVTELVPGDHVLPVFTGECKDCAHCKSEESNLCDLLRINVDRGVMIGDGQSRFTIGGKPIFHFVGTSTFSEYTVIHVGCLAEINPEAPLDKVCVLSCGISTGLGATLNVAKPKKGSTVAIFGLGAVGLAAMEGAKMAGASRIIGVDLNPAKYEQAKKFGCTDFVNPKDHTKPVQEVLVEMTNGGVDRAVECTGHIDAMIAAFECVHDGWGVAVLVGVPHKEAVFKTSPMNLLNERTLKGTFFGNYKPRTDLPEVVEMYMRKELDVEKFITHSVPFSQINTAFDLMLKGEGLRCVMRMDE

SEQ ID NO: 9078 - protein, 357 aa, Candida glabrata CBS 138
MGKKIVFNISSDFQLKSLLGEGAYGVVCSAVHKPTGEIVAIKKIVPFDKPLFALRTLREIKILRRFQHENIISIFDIQKPESFEKFNEVYIIQELMQTDLHRVIATQTLTDDHIQYFIYQTLRAIKTLHGSNVIHRDLKPSNILINSNCDLKVCDFGLARIIDSGENGDNEVDKIGMTEYVATRWYRAPEVMLTNAKYSRAMDIWSCGCILGELFLKRPLFPGKDYRHQLLLIFGLIGTPDSSDKSMECIESRRARQYIASLQKYPPVRPLQKAFPGVNPVGVDLLSRMLVFDPRERISADDALAHPYLSTYHVPEDEPAGEPIPPDFFQFDQYKEVLTTKDLKKLLWNEIFHEQAT

SEQ ID NO: 9079 - protein, 667 aa, Zea mays
MRKKGRAVPEWLNSPIWSATPPAPAQPDPYGADLAPPPPPKPPPPPATASPVPPPPSYEQAVGVGGGRREEEDDEGAGAVIRAHLLSDFKAALSKKVVNMGELRRLACLGVPDGGTGVRPVVWKLLLGYLPTDRSLWTYELEKKRSQYSAYREEFLLNPSEKLRMIEETKLSRKKDTSIERIGFLSRFEVTNEEHPLSSGKSSLWNQYFQDSELLEQIDRDVKRTHPDISFFSSKSNQESLRRILIIFSKLNPSIRYVQGMNEVLAPLFYVFKNDPDPSNSLSCVFEKKDGLCAASVEKIEVSGDKGERWRSTLSSHGGQQLSNKYLVFFSLHDQRSHGQVLTTPQKDGYTAGTTSTIGQHGCDIPGQDMVGDVVVMVEVSKTALENSEQQEGDLANLRFPDRFMISHLALDCWYIFDEVYSNSNSATTTTHSYGVYTRRFLLDVSALPSSDVLNPSDASSSPGSTSLTKLFVEPSSPSNSSTELLLRCSHRSCQLLDLYGFGPVTWQGFVSTILSKTTSYWDVILHPKWQLMMAKEITPLELTSTWDHVPYPRILLPVNGFIRSRPALMVLLGVIKLILLLVVFNKSMIVIIARGALGLVSAFSSVITVAIFSIGAHDPALIVHTPSHGWTLLYIVFVKTRLSEQSLMSDLDPLRYFIGIEVSSTP

SEQ ID NO: 9080 - protein, 99 aa, Leptolyngbya boryana
MATYQVRLINKKRNLDITLPVDEDTTVLEAAEEAELDLPFSCHSGACSSCVGKVVEGEINQDDQTFLDEEQVAKGFVLLCVTYPRTDCTIRTHQEAYLV

SEQ ID NO: 9081 - protein, 379 aa, Aegilops tauschii
MATAGKVIKCKAAVAWEAGKPLSIEEVEVAPPQAMEVRVKILYTALCHTDVYFWEAKGQTPVFPRILGHEAGGIVESVGEGVTELVPGDHVLPVFTGECKDCAHCKSEESNLCDLLRINVDRGAMIGDGQSRFTINGKPIFHFVGTSTFGEYTVIHVGCLAKINPEAPLDKVCVLSCGISTGLGATLNVAKPKKGSTVAIFGLGAVGLAAMEGARMAGASRIIGVDLNPAKYEQAKKFGCTDFVNPKDHSKPAQEVLVEMTNGGVDRAVECIGHIDAMIAAFECVHDGWGVAVLVGVPHKEAVFKTYPMNFLNERTLKGTFFGNYKTRTDLPEVVEMYMRKELELEKFITHSVPFSQINTAFDLMLKGEGLRCVMRMDE

SEQ ID NO: 9082 - protein, 127 aa, Triticum aestivum
MAAAATATTTAAAAVGPGEVISVHSLEQWTMQIEEANAAKKLVVIDFTASWCGPCRIMAPIFADLAKKFPAAVFLKVDVDELKPIAEQFSVEAMPTFLFMKEGDVKDRVVGAIKEELTTKVGLHAAA

SEQ ID NO: 9083 - protein, 136 aa, Zea mays
  misc_feature (26)..(26): Xaa can be any naturally occurring amino acid
  misc_feature (45)..(45): Xaa can be any naturally occurring amino acid
  misc_feature (49)..(49): Xaa can be any naturally occurring amino acid
  misc_feature (52)..(52): Xaa can be any naturally occurring amino acid
MINLRRPEGLIGEIISLLRKGFYLKXLNLSRGESFAENTTPVAAXPFFXGLXDYIISGPVVAMVWEGKSVVTTGRKIIGATNPLASEPGTIRGDFAVDIGGGVFHGSDCFLSANKGIVLWFFRGPCCLSGGRHLFF

SEQ ID NO: 9084 - protein, 301 aa, Moritella sp. PE36
MENLLSVKDLSKQQILDLLALAKAMKANPAEYSQALAGKSIVTIYEKPSLRTRVTFDIGIHKLGGHAVYLDAQNGAIGERETVKDFAANISRWADAIVARVVSHKTLEGLVEHGSVPVVNSLCDLYHPCQALADFLTISEHYEDVSKVKLAYVGEGNNVTHSLMLTGAILGAEVTAVCPRGSSPDAQIVKQAMALAEISGGKINVTDNLDDIVDYDVIYGDTWVSMGDDTPLQQVKEKYMPYQINKALLMRTGIKHVLHCQPAHRELEITSEVMDGEQSLIFDQAENRMHAQNAVLLTLLK

SEQ ID NO: 9085 - protein, 379 aa, Triticum turgidum subsp. durum
MATAGMVIKCKAAVAWEAGKPLSIEEVEVAPPQAMEVRVKILYTALCHTNVYFWEAKGQTPVFPRILGHEAGGIVESVGEGVTELVPGDHVLPVFTGECKDCAHCKSEESNLCDLLRINVDRGVMIGDGESRFTINGKPIFHFVGTSTFSEYTVIHVGCLAKINPEAPLDKVCVLSCGISTGLGATLNVAKPKKGSTVAIFGLGAVGLAAMEGAKMSGASRIIGVDLNPAKYEQAKKFGCTDFVNPKDHTKPVQEVLVEMTNGGVDRAVECTGHIDAMIAAFECVHDGWGVAVLVGVPHKEAVSKTSPMNLLNERTLKGTFFGNYKPRTDLPEVVEMYMRKELDVEKLITHSVPFSQINTAFDLMLKGEGLRCVMRMDE

SEQ ID NO: 9086 - protein, 113 aa, Brassica napus
MSEKSQIPDNSNNNAASSSSAKKPATEIGSNSSFSGQRMTYPNRPESVNPDQATLREQWKFAIRQYSKWYSHAWGTAILAGGVFFGLGWIIKGSNPLPSLQSSSKSPKPDEEK

SEQ ID NO: 9087 - protein, 487 aa, Nocardioides sp. JS614
MRRAKIVCTLGPAVANPRRIRELVYAGMDVARLNMSHGSHEDHAEAYRLVREASDASGHGVGIFADLQGPKIRLERFANGPVVLTRGQAWTITTRDVPGDDRECGTTYKGLPGDVSVGDPILIDDGKVRLRVTKVDGPDVHTEVLVGGKVSDNKGINLPGVAVSVPALSEKDIEDLRFALHLTVDFIALSFVRDAKDVEDVRRIMDEEGVHLPVIAKIEKPQAIENLDEVIAAFDGFMVARGDLGVECPLEDVPFLQKRIVEKARLNAKPVIVATQMLESMIGNPAPTRAEASDVANAVLDGADAVMLSGETSVGEYPVHTVETMARIIAATEAHALAQPPGRAALAEIDWDPHTRGGVIAKAAEEVAERVGAKYVVAFTQSGDSARRMSRLRGPIPILAFTPVGVVRSQLALTWGIETFLTQPVEHTDEMVRQVDDQLLRIGRVREGDLVVIIAGAPPGIPGSTNALRIHRMGDAINQVAPAYRRS

SEQ ID NO: 9088 - protein, 258 aa, Moritella sp. PE36
MTTPLVLKLGGALLENETALEQLFTALSEYKLTSSRPLILVHGGGCFVDELLAKMNIVSEKKNGLRVTPFSDIGYITGALAGTANKVLMAQGLKSGAKVVGLSLADGGISTVTQSTAGLGAVGECEAGDPTLLTALLSGGFLPIISSIGIDAQGQLLNVNADQAATAICETLDADLVMLSDVAGILDADMQLIPEMNSSYADELITAGVIHGGMEVKVKAALKAAASLNRDIKLASWKVPERLVALLNGEAEGTKVSS

SEQ ID NO: 9089 - protein, 493 aa, Nocardioides sp. JS614
MADPRGFLKKGREVAARRPVEERIQDWNEVYPGSAGRALLPIITEQAGRCMDCGIPFCHQGCPLGNIIPEWNDLVWRDDWEGAIERLHATNNFPDFTGRLCPAPCETACVLGINQDPVTIKNVEVAIIDKAWDSGFVRPQPPEWLSGRTVAVVGSGPAGLAAAQQLTRAGHTVAVYERADKIGGLLRYGIPEFKMEKQHLDKRLEQMRREGTVFRSGVEVGAELTGDQLRDRYDAVVLAIGSTVPRELPAPGRELRGIHQAMDFLPQANRAALGEEVDGQITATGKHVVIIGGGDTGADCLGTSTRQGAASITQLEIMPEPPESRPAGQPWPTYPMVFRISSAHEEAAHQNLQSRVYAVSTKEFLGDQDGNVRALRLVEVRLEDGRFVEVEGSEQEIPAELVLLAMGFTGPQQAGLVEQLAVDLDERGNVARDAAYMTSVDGVFVAGDAGRGQSLIVWAIAEGRAAAAAVDTYLTGSTTLPAPIPPTERPLVV

SEQ ID NO: 9090 - protein, 379 aa, Aegilops speltoides
MATAGKVIKCKAAVAWEAGKPLSIEEVEVAPPQAMEVRVEILYTALCHTDVYFREAKGQTPVFPRILGHEAGGIVESVGAGVTELVPGDHVLPVFTGECKDCAHCKSEESNLCDLLRINVDRGVMIGDGQSRFTIGGKPIFHFVGTSTFSEYTVIHVGCLAKINPEAPLDKVCVLSCGISTGLGATLNVAKPKKGSTVAIFGLGAVGLAAMEGAKMAGAPRIIGVDLNPAKYEQAKKFGCTDFVNPKDHTKPVQEVLVEMTNGGVDRAVECTGHVDAMISAFECVHDGWGVAVLVGVPHKEAVFKTHPMNLLNERTLKGTFFGNYKPRTDLPEVVEMYMRKELDLEKFITHSVPFSQINTAFDLMLKGEGLRCVMRMDE

SEQ ID NO: 9091 - protein, 504 aa, Brucella suis 1330
MSKLDDNVAKAKTYLARFEKGVLNRIGGEDVAAADGATFETISPVDLKPLATVALGKAADIDRAARAAKAAFPEWAAMSGDARKKLLHKIADAIVARAEEIAFVECMDTGQSLKFMAKAALRGAENFRFFADRAPEARDGKTLRGPGQVNMTTRVPIGPVGVITPWNTPFMLSTWKIAPALAAGCTVVHKPAEFSPLTARLLVEIAEEAGLPKGVWNLVNGFGEDAGKALTEHPDIKAIGFVGESRTGSLIMKQGADTLKRVHFELGGKNPVVVFADADLERAVDAAVFMIYSLNGERCTSSSRLLVEASIYEKFTALVAEKAKRIKVGHPLDPETVVGPLIHPVHEKKVLEYIEIGRSEGATVAAGGAKFAGPGGGCYVSPTLFTAAHNGMRIAQEEIFGPVLTAIPFKDEAEALALANDVKYGLTGYLWTNDVTRAFRFTDALEAGMIWVNSENVRHLPTPFGGVKNSGIGRDGGDWSFDFYMETKNIAFANAAHAIAKLGG

SEQ ID NO: 9092 - protein, 379 aa, Aegilops speltoides
MATAGKVIKCKAAVAWEAGRPLSIEEVEVAPPQAMEVRVKILFTSLCHTDVYFWEAKGQTPMFPRIFGHEAGGIVESVGEGVTELAPGDHVLPVFTGECKECPHCKSAESNMCDLLRINTDRGVMIGDGKSRFSIDGKPIYHFVGTSTFSEYTVMHVGCVAKINPEAPLDKVCVLSCGISTGLGASINVAKPPKGSTVAIFGLGAVGLAAAEGARIAGASRIIGIDLNASRFEEARKFGCTEFVNPKDHSKPVQQVLAEMTNGGVDRSVECTGNVNAMIQAFECVHDGWGVAVLVGVPHKDAEFKTHPMNFLNERTLKGTFFGNFKPRTDLPNVVEMYMRKELEVEKFITHSVPFSEINKVFDLMAKGEGIRCIIRMEN

SEQ ID NO: 9093 - protein, 254 aa, Physcomitrella patens subsp. patens
MCSRKFFVGGNWKCNGTVDEVKKICCMLNNGEVPCPNHIETIISPPFVFIPLVKSMLRTDFQVAAQNCWKGKGGAFTGEISAEMLANLHVPWVILGHSERRQLCGETDAIVAEKTAYALDNGLKVCLCVGETLEERERNETGAVVARQTAAVASKICCWANVVIAYEPIWAIGTGKVATPQQAQEVHYNLRKWLDCYVSPHVAMNMRIIYGGSVTAANCKEIGANPDVDGFLVGGASLKVRRNARLGTKIHDLT

SEQ ID NO: 9094 - protein, 371 aa, Physcomitrella patens subsp. patens
MVQVVSFLETLDEIGEAAPHATPQSFFRVKEGSGVGKRVANKIADIGIVDEQELRDAIVKLPQKHEKEQAALLEGYRAFYHKWYFQLSCGFGLLMYGFGSKKKLLEDFASTELRDGAAVVVNGYLSNVNIKHVMTRTFDLFELNAVWEARKKGKPSNKVKQDAPASSNSLVDLLEFLTDDDDSTHIYVVVHNIDGPGLRDDDVQQTLASLASCKHVRLVASIDNINAPILWDKHMARNQFKWLWLHTPTYATYKVEGTCVPLLLTAGAATKSARSAILVLRSLTPNAQSVFRVLGEFQISHPDDQGLPLNRLYTACREQFLVSSEVTLRAHLTEFKDHELVKFRRGVDGQDCIYVPLPIDALTKLLEDITS

SEQ ID NO: 9095 - protein, 405 aa, Bacillus sp. SG-1
MVKYEASLKEKVLIMEHLLNKQVQEIEISGIRKFFNMVADIDDMVSLTLGQPDFPTPLHVKEAAKAAIDEGFTSYTHNAGFLELREAASEFYKKKYNVSFDPSSEVIITNGASQGIDSTLRTILNAGDEVILPGPVYPGYEPIVRLCGASPIIADTVPNGFKLDAGVLKKYITTRTKCIILPYPSNPTGVSLTADELKEIADLVRGKDIFILADEIYSELTYDRKHTSMASFLKEQTIVINGLSKSHSMTGWRIGMVFAPENLAKHILKVHQYNVSCASSISQKAAFEALTEGINDSDGMKAEYKIRRDYVSKRLTEMGFQVILPDGAFYFFLKIPDYFKADSFTFALTLAKQYKVGVVPGNSFSSAGEGFFRLSYACSMEELYKGMERLQAFVEDTKPTSEGSR

SEQ ID NO: 9096 - protein, 429 aa, Caldococcus noboribetus
MVSHPCTADEAKPPSEGQLARFENGKLIVPDNLIVAYFKGDGIGPEIVESAKKVLDAAVDKAYGGTRRIVWWEVTAGEEAQKECGSLLPDGTLQAFKLARVNLKGPLTTPVGGGFRSLNVTLRMVLDLYSNVRPVKWYGQPTPHCHPENIDWVIFRENTEDVYAGIEWPFDSPEAQKIRDFLKKEFGIELTPDTGIGIKPISKWRTQRHVRRAMEWAIRNGYKHVTIMHKGNIMKYTEGAFRQWAYDLILSEFRDYVVTEEEVNTKYGGKAPEGKIIVNDRIADNMLQQIITRPGEYNVIVTPNLNGDYISDEANALVGGIGMAAGLDMGDGIAVAEPVHGSAPKYAGKNVINPTAEILSGMYLLSDFVGWPEVKLLVEYAVKQAIAHKQVTYDLAREMGGVTPISTTEYTDVLVDYIRHADLKALKGQ

SEQ ID NO: 9097 - protein, 417 aa, Triticum aestivum
MVESPAAAVQELRERFAAGQTRPAEWRAAQLRGVLRMATEMEAEICDALHADLGKPKTEAHVHELSLIKSSCLFALKNLKKWMKPQKVPAKLMNFPSTARITPEPLGLVLVISAWNYPLLLSLDPVIGAIAAGNAVALKPSEGAPAMSSLLAELLPRFVDGTCIKVIEGGVKETTALLNHKWDKIFYTGNSRVGRVVMAAAAKHLTPAVLELGGKCPVVVDSNVDLHIAAKRIAAGKWGCNNGQACIAPDFIITTQAFAPKLLESLKNVLEKFYGKDPLLSADLSRVVNASHFGRLKGLMDEEMVSDKIVFGGQRDEQQLKIAPTIFLDVPLDSAIMKEEIFGPLLPILTVDKIHESFGLINSMAKPLAAYLFTRDSELQNQFEGAISAGGMPFNDTSIHLTNHTALEWNGRGLQGN

SEQ ID NO: 9098 - protein, 139 aa, Erwinia carotovora subsp. atroseptica SCRI1043
MTNDSASHTPSDNTEMTEMQRYVTQQRGTEPAFSGKLLHNKRTGAYHCLCCQAPLFYSDSKYDSGCGWPSFDQPVSSEAVRYLEDESHNMRRIEIRCGQCDAHLGHVFPDGPKTTGERYCVNSASLSFIDDVDGERVDG

SEQ ID NO: 9099 - protein, 344 aa, Daucus carota
MANYNFKYIFIFLLLISISAPAVLSVVEDCGWEEDNSCVNKMKARPLKIIADVSQLINSMIGVCYYLVTRSIPALSPEWNLFVICIVKKFALGIILATGFMHVLPDSFDMLSSSCLKEHPWHKYPFTPMLSRIVTMAFDSIAESLASKRHNGGVVNPEGDTEMAVAGNHDHSHHHHGSLSTKEGLDGKTLLFYRVGTMVLLGIIVHSIVIGLSLGASSNTCTNKGLVSALCFTQMFEGMGLGGCILQAEYKFMKKAIMACFFAVFWIALGILSTTYEENSPRALVTVGLLNASSLGLLIYMACVDLLAADFMGNKLQGSWKSQIKSYMAVLLGAMGMSVMAIWA

SEQ ID NO: 9100 - protein, 376 aa, Acidovorax sp. JS42
MSKRDFYEVLGVPKNASDDEIKKAYRKLAMKYHPDRNQGDAAKPAEEKFKEAKEAYEILSDAQKRAAYDQYGHAGVDPNMRGGMGGAEGFGGFAEAFGDIFGDMFGGARGRGGRQVYRGNDLSYAMEITLEEAAKGKEAQIRIPSWESCETCHGSGAKPGTSAKTCGTCQGSGTVQMRQGFFSVQQTCPHCRGTGKIIPEPCTACHGQGRVKKQKTLEVKIPAGIDDGMRIRSTGNGEPGTNGGPPGDLYIEIRIKKHDIFERDGDDLHCQVPVSFITAALGGEIEVPTLQGKAAIDIPEGTQAGKQFRLRGKGIKGVRSSYPGDLYCHIIVETPVKLTEHQRKLLKELDESLKKGGAKHSPSTESWTDRLKSFFS

SEQ ID NO: 9101 - protein, 427 aa, Brucella suis 1330
MSGNQELIARRERLLGRNMSLFYQDPVHLVKGEGVWLWDADGRKYLDCYNNVPHVGHCHPRAVEAICRQASTLNTHTRYLHEGILDYVERLTATFDKSLDAAILTCTGSEANDVALRMAQAVTGKTGIIATDFTYHGNTTAVSQLSTRMPPVGGYGGHVRHVPAPDSYRPLGGKGGEAFAQAWAAEVEKAIASLQESPFGFSGLIIDPFFANEGFPDLPENFLAPAVAAVRKAGGVVIADEVQPGFGRTGGHMWGHQKAGIVPDIVTLGKPMGNGHPVGAVVAGADTLNAFRKAFRYFNTFGGNPVSCAAAMAVLDVLEEEKLQANALEVGAYARQGLEKLAQKHGMIGNVRGSGLFFGAELVLDRAEKTPAAEMATRVVNEMRERGVLMNKLGIHQNATKIRPPMPFSRENADLMLSTLDDVLGGL

SEQ ID NO: 9102 - protein, 501 aa, Rhodococcus sp. RHA1
MTAVVHTPAGLDPRVVDFVSSPKRMFVDGRWVDSASGRTFETVDPATGQVITTVPHAGIEDVDRAVAAARRAFESGPWRSLTPAERQRILWKIGEGILARADQFAQLESIDNGKSVAVAKAVDVTWAAEIFFYYAGWATKIEGRTIPVSVPWAPGARFHAFTTREPVGVCAQIIPWNFPLVMAAFKVAPALTCSNTMILKPAEQTPLTALLLAEVIAEAGVPDGVFNVLTGFGDIGAALSSHDDVDKVAFTGSTEVGKKIVNAASGNLKKVSLELGGKSPQVIFSDADLEAAIPGVAGGFLFNHGQACTAGTRLLVEDRIFDEFTSGVADFAKSQKIGPGLDPTNDVGPLISQEQLGKVTGYIDAGLADGARALSGGHRHGDTGFYVEPTLLVDVNRDFSVYQEEIFGPVAVAVPFNREEGVRAAANDTPYGLAASVWTRDVSRAHEVAAEIKAGTVWVNCHNAFDTALPFGGYKQSGWGRELGEGAIAEYTQSKSVNIAL

SEQ ID NO: 9103 - protein, 561 aa, Oryza sativa Indica Group
MESTMKGIRGDNAPCVLDLDDAATVGGGVGDTYGEDCATEEQLVTPWTVSVASGYNLLRDPRYNKGLAFNERERETHYLRGLLPPAIVSQELQERKIMHNIRQYQLPLQKYMAMMDLQEGNERLFYKLLIDNVEELLPVVYTPTVGEACQKYGSIFSRPQGLYISLKEKGKILEVLKNWPERSIQVIVVTDGERILGLGDLGCQGMGIPVGKLALYTALGGVRPSAEYADFLHEFMTAVKQNYGEKVLIQFEDFANHNAFELLAKYGTTHLVFNDDIQGTASVVLSGLVAALKLVGGSLSEHSYLFLGAGEAGTGIAELIALEISRQTKAPIEECRKKIWLVDSKGLIVSSRKETLQHFKKPWAHEHEPVGNLLDAVKTIKPTVLIGTSGKGQTFTQEVVEAISSFNERPVIFALSNPTSQSECTAEQAYTWSKGRAVFASGSPFDPVEYDGKIYVPGQANNAYIFPGFGLGVVMSGAIRVHDDMLLAASEALAQQVTQENFDKGLTYPPFSNIRKISAHIAANVAAKAYELGLASRRPRPKDLVKYAESCMYSPLYRNYR

SEQ ID NO: 9104 - protein, 316 aa, Physcomitrella patens subsp. patens
MGSAISYCSPHHALTAAVCGDDIKLPEYTNLPCPVMYEEITREAYMSLKPEHFEGLRFDISRAVNNKFAMSNRVFMGLIDLPGNSGSVQKQSTGHFDVGANLVDQKVKIILVMRRILSEGRLSAKVKYDVNNRFSIKADAQLTNEPHFTLGMFNFDYKGYDYQARLTMGNNAYYGINYMQQSVTPKLSLGGEGIWLGHQRKSSMGLAARYKADTVICTGHVKSEGQINFTYVQRLSDKLSVASDFVYNWNSREANTSMAFDYLIRQCRLRGRVNTNYCTTAYLEEKLTSGLTFLLSAELDHIRKNYKFGFGMTIGD

SEQ ID NO: 9105 - protein, 452 aa, Brucella suis 1330
MRDSNFLIENNARHLWHPMAHPAEMQANPPRIVNGGEGVEVIDIHGKKVLDAVGGLWNVNLGYSCEPVKKAIRDQLDSLPYYSTFRGTTNSPLIELSYELAEFFKEDGLTRAFFTSGGSDSVETALRLARQFHKINGQPERTKFVSLKKGYHGTHFGGASVNGNANFRRNYEPLLPGVFHLAAPYPYRNPFNMDDPAAIAAAIARQFEDEIAFQGADTIAAFIMEPVLGAGGVIVPHESFMLLMREICDRHGILLIADEVITAFGRTGAWTGSRGWGVKPDMMTTAKAITNGYFPFGAVMISDKVASVFEANKNSLGAIGHGYTYSGHPVGAAAALATLKETARANTAANAGARGVELMAGLNQLKEKHELVGDVRGKGLMAALELVSDREKKSAAAKTVVQKVYDVAYEEGVMVRTSGANVIISPPLVITSADVNRIVSALDAGLSAAKGQ

SEQ ID NO: 9106 - protein, 334 aa, Erwinia carotovora subsp. atroseptica SCRI1043
MEYMTIKVGINGFGRIGRIVFRAAQERSDIEIVAINDLLDAEYMAYMLKYDSTHGRFNGTVEVKDGHLVVNGKTIRVTAERDPSNLKWNEVNVDVVAEATGLFLTDETARKHIAAGAKKVVLTGPSKDDTPMFVMGVNHKTYAGQEIVSNASCTTNCLAPLAKVINDNFGIVEALMTTVHATTATQKTVDGPSHKDWRGGRGASQNIIPSSTGAAKAVGKVIPELNGKLTGMAFRVPTPNVSVVDLTARLEKPASYKEVCAAIKAAAEGELKGVLGYTEDDVVSTDFNGEKLTSVFDAKAGIALNDNFVKLVSWYDNETGYSNKVLDLIAHISK

SEQ ID NO: 9107 - protein, 161 aa, Lactobacillus salivarius
LLNQSKDTIIYLCVLKKQHLFQSDKPESIETTLKNAADGRDIRLIVVTDAEGILGIGDWGVDGVDIAIGKLMVYTAAAGINPAQVLPVSIDAGTNNKELLNDPLYLGNKHKRVYGEKYNELIDKFVAAVQKLFPESMLHFEDFGRSNADVILNKYKDKILT

SEQ ID NO: 9108 - protein, 572 aa, Bacillus sp. SG-1
MSSMLNGIAASNGIAIAKAYLLVEPDLSVEKKEVGNTEEEVNRFREALATSKSELETIREKANEDLGADKAAIFDAHLLVLSDPELIAPIEDKISNEKVNAEAALKETADMFVSMFESMDNEYMRERAADIRDVTKRVLSHLLGVQVSNPSMITEEVIIIAEDLTPSDTAQLNREFVKGFTTDIGGRTSHSAIMARSMEIPAVVGTKEVTSEIKNGDLVIVDGLNGEVHINPTQEVVEQYKKEHEQYEKQKAEWAKLVNEKTVSADGTHVELAANIGTPKDLEGVINNGGEAVGLYRTEFLYMGRNELPSEEEQYEAYKAVLEGMGDKPVVVRTLDIGGDKELPYLDLPKEMNPFLGYRAIRLCLDEQSIFRTQLRALLRASSYGNLKIMFPMISNLNEFREAKSILEEEKSKLVEAGEKVADKIEIGIMVEIPSTAVMADVFAKEVDFFSIGTNDLIQYTMAADRMNEQVSYLYQPYNPAILRLVKMVIDAAHKEGKWAGMCGEMAGDEIAIPILLGLGLDEFSMSATSILKARSQIRNLSKSDMATLANEVLELDTNDSVIEAVKKAINL

SEQ ID NO: 9109 - protein, 162 aa, Lactobacillus rhamnosus
VVADSIEQYNELFLDPQNAAFVSVDAPEDIEATLKNAADGRDIRLVVVTDAEGILGMGDWGVNGVDIAIGKLMVYTAAAGIDPSQVLPVSIDAGTNNQKLLDDPLYLGNRHKRVSGEQYYDVIDKFVAAEQQLFPDSLLHFEDFGRDNAQVILDKYKDQIAT

SEQ ID NO: 9110 - protein, 358 aa, Haemophilus influenzae R2866
MQSYNIAVLAGDGIGPEVIAEAIKVLNKVQEKFGFKLNFNEFFVGGAAIDHCGYPLPAETLKGCDEADAILFGSVGGPKWTNLPPDQQPERGALLPLRKYFKLFCNLRPATLYKGLEKFCPLRADIAAKGFDMVVVRELTGGIYFGQPKGREGEGAQTKAFDTEVYYKYEIERIARAAFDAAMKRNKKVTSVDKANVLQSSILWRETVTEVAKEYPEVTLEHIYIDNATMQLIKAPESFDVLLCSNIFGDIISDEAAMITGSMGMLPSASLNEEGFGLYEPAGGSAPDIAGKGIANPIAQILSAAMMLRYSFNLNEAADAIENAVQKVLASGHRTADLADDSTPVSTAEMGILIAQAI

SEQ ID NO: 9111 - protein, 438 aa, Streptococcus pneumoniae TIGR4
MLTYDLIVIGFGKAGKTLAGKLASAGKKVALVERSKAMYGGTCINIGCIPTKTLLVAAEKDLSFEEVIATKNTITGRLNGKNYATVAGTGVDIFDAEAHFLSNKVIEIQAGDEKKELTAETIVINTGAVSNVLPIPGLATSKNIFDSTGIQSLDKLPEKLGILGGGNIGLEFAGLYNKLGSKVTVLDALDTFLPRAEPSIAALAKQYMEEDGIELLQNIHTTEIKNDGDQVLVVTEDETYRFDALLYATGRKPNVEPLQLENTDIELTERGAIKVDKHCQTNVPGVFAVGDVNGGLQFTYISLDDFRVVYSYLAGDGSYTLEDRLNVPNTMFITPALSQVGLTESQAADLKLPYAVKEIPVAAMPRGHVNGDLRGAFKAVVNTETKEILGASIFSEGSQEIINIITVAMDNKIPYTYFTKQIFTHPTLAENLNDLFAI

SEQ ID NO: 9112 - protein, 178 aa, Lactobacillus brevis
NPVVYDPTVADSIEQYSHLFTDPQNAAFISVDAPEDIEATLKNAAGDRDIRLVVVTDPKNFGYGPTGVLTGLDIAVGKLMVYTAAAGMIQHKSCQLALMAGTNNQTLLNDRYYLGNHHERVYGDKYHAVIDQFVAAEQKLFPESLLHWEDFGRSNAQVILDKYKDKIATFNDDIQGTG

SEQ ID NO: 9113 - protein, 367 aa, Lentisphaera araneosa HTCC2155
MSNLACGIVGLPNVGKSTLFNAIARAGAEAANYPFCTIEPNVGIVPVPDVRVDKLSEIVKPNKIQYATIEFVDIAGLVRGASSGEGRGNQFLENIQHTDAIVQVVRCFDNDDVVHVDGQVDPISDIETINLELALADLEKVNRNIERLGKKVRSGDKDAVKTVEVLQKIQPALNEGKAIRSVDLNDDEKQLIKHYMFITVKEMIYCCNVSEDDLPEMENDYVQKVRVCGAEENAGVVTICAQIEQEIAQLDKEEAAEFLADVGLTESGLDKLIHKSFQTLGLSTYLTAGEIEVRAWTIPIDCPAPQAAAVIHTDFEKGFIRAEVIAFDDVIEHGGRQGAKEAGKVRVEGKDYLVQDGDVILFLTNTK

SEQ ID NO: 9114 - protein, 180 aa, Lactobacillus fructivorans
NSVVYDPTIADSIENYSRLYVNPQNAAFLSIDHDDPETIRESLKNTAAGRNIKLIVVTDGEGILGIGDWGTQGIDIPVGKLMVYSAAAGIDPSEVLPVVMDVGTTNKSLLDNPLYLGNHQDRDYGQKYYDFVDKFVKEAEDLFPNLYLHFEDFGRRNASNILDKYKDDYLVFNDDIQGTG

SEQ ID NO: 9115 - protein, 289 aa, Staphylococcus aureus
MKENFWSELPRPFFILAPMEDVTDIVFRHVVSEAARPDVFFTEFTNTESCCHPEGIHSVRGRLTFSEDEQPMVAHIWGDKPEQFRETSIQLAKMGFKGIDLNMGCPVANVAKKGKGSGLILRPDVAAKIIQATKAGGLPVSVKTRLGYYEIDEWKDWLKHVFEQDIANLSIHLRTRKEMSKVDAHWELIEAIKNLRDEIAPNTLLTINGDIPDRKTGLELAEKYGIDGVMIGRGIFHNPFAFEKEPREHTSKELLDLLRLHYHCLTNMKKMKYDNSRVCVDSLKSMCVA

SEQ ID NO: 9116 - protein, 151 aa, Populus trichocarpa
MEKKHEMASSVKISMVVVMAVVFSSCTTTLTKAQESSTSCATKLTACQAFLATTTTPPDNCCNPIKEAVAKELPCLCKLYNDPNLFPSLGINVTQAVNLSQRCGVTTNLTSCGASTPTGTPPGVPVKDGGARMAWTGLSGLLVLLAASLLY

SEQ ID NO: 9117 - protein, 199 aa, Neisseria gonorrhoeae FA 1090
MALKTSNLEHAMLVHPEAMSVGALADKIRKIENWPQKGILFHDITPVLQSAEYFRLLVDLLVYRYMDQKIDIVAGLDARGFIIGAALAYQLNVGFVPIRKKGKLPFETVSQSYALEYGEAAVEIHTDAVKPGSRVLLVDDLVATGGTMLAGLELIRKLGGEIVEAAAILEFTDLQGGKNIRASGAPLFTLLQNEGCMKG

SEQ ID NO: 9118 - protein, 194 aa, Cyanophora paradoxa
MTILIQQYTNDENKKLELNNISKLLQNRIILFSQTVDDEICNSIVGQLLYLENEDSTKDIRLFINSPGGSVTAGLSVYDTIQNLSVDVSTICFGLAASMGAVLLAAGVENKRFAFASSRIMIHQPLSKVEAPWSHLDIQIRNGAYFKNLLNNILSFHTKQELKQIETDTERDFFLSATEAKQYGIIDHIFINNN

SEQ ID NO: 9119 - protein, 383 aa, Triticum aestivum
MGAVASTVAARFAFFPPSPPSYGVEPPPSPAAAAADGAVVELSGVPRRGGVEARRLPTKRGSEVVAMYVRQPGARLTLLYSHGNAADLGQMYELFVELSSHLNVNLMGYDYSGYGQSSGKPSEQNTYADIEAAYRCLIETYGASEENIILYGQSVGSGPTLDLASRLPHLRAVVLHSPISSGLRVMYPVKHTYWFDIYKNIDKVALVKCPVLVIHGTADDVVDCSHGRALWELSKVKYEPLWVKGGNHCNLELYPEYIKHLKKFITAIEKSPPLKDDSPESSGPSDLETGSESMESSRKSTDVRDKSRSSTDHRRSTDRREKPRSSIDRKDKGRKSVDHPDKPRASVDQSDKPRKSIDRFGGMMRSVKLCNIDCFKVTSTSGS

SEQ ID NO: 9120 - protein, 800 aa, Oryza sativa Indica Group
MSLLLCFLLFSLYPPRISAATDTVSPGHALTGSDRLVSNNSKFVLGFFKTESKNSSYASHNSYLCIWYSKLPMITPLWSANGENPVVDPASPELAISSDGNMVILDQVTKNIIWSTHVNTRTNHTIVVLLNNGNLVLQSSSNSSKVFWQSFDYPTDSLFAGAKIFRNKVTGQKNRLVSRKNSIDQAAGLYSVEFDINGTGHLLWNSTVVYWSTGDWNGHFFGLAPEMIGATIPNFTYVNNDREVYLSYTLTKEKITHAGIDVNGRGLAGIWLDSLQNWLINYRMPILHCDVYAICGPFSVCNDSNNPFCDCLKGFSIRSPKDWDLEDRSGGCMRNTPLNCGSTMNKKGFTDKFYCMQNIILPHNAMNVQTAGSKDQCSEVCLSNCSCTAYSYGKGGCSVWHDALYNVRQQSDGSADGNGETLYIRVAANEVQSVERKKKSGTVIGVTIAASMSALCLMIFVLVFWMRKQKWFSRGVENAQEGIGIRAFRYTDLQCATKNFSEKLGGGSFGSVFKGYLNDSIIIAVKRLDGACQGVKQFRAEVNSIGIIQHINLVKLIGLCCEDGKKLLVYEYMTNRSLDVHLFKDNDKVLEWNIRYQIAIGVAKGLAYLHDSCRDCIIHCDIKPENILLDASFVPKIADFGMAKVLGREFSHALTTVRGTIGYLAPEWISGTVVTSKVDVYSYGMVLFQIISGRRNSNQEYCRGHSAYFPMQVARQLINGGIENLVDAKLHGDVNLEEVERVCKVACWCIQDSEFDRPTMGEVVQFLEGLLELKMPPLPRLLNAITGGSHSTSLLPIDLQ

SEQ ID NO: 9121 - protein, 748 aa, Oryza sativa Indica Group
MSVLLGFLLLLSLHPPTSYATTDTVSPGQTLAGGDRLISNNSKFALGFFKMDSKNSSYTSRNSYLCIWYNKLPMITPLWSANGENPVVGPASPELTISGDGNMVIMDQATKSIIWSTRVNTTTNGTVVVLLNDGNLVLQSSSNSSMVFWQSFDYPTDSLFADAKIGWNKVTGLNRRLVSRKNSIDQAAVGIGMGNFLAQHQRCLVPPYPISQFVNNDREVYLTYTLNNEKPITHAAIDVNGRVCNDNNDPFCDCMKGFSIRSPKDWEIEDRTGGCMRNTPLNCGSTMNKTGFSDKFYYVQNIILPRNAMHVQEAASKDECSDVCLSNCSCTAYSYGKGGCSVWHDELYNVRQQSDASAVGNGDNFYIRLAANEVHEVQSAERKKKSGVIIGVAIGASTAAFCLMILLLMFWRRKGKLFARGAENDQGSIGITAFRYIDLQRATKNFSEKLGGGSFGSVFKGYLNESTPIAAKRLDGTCQGEKQFRAEVDSIGMIQHINLVKLIGLCCEGDKKLLVYEYMPNGSLDVQLFKDNDKVLDWNLRYQIAIGVARGLAYLHDSCRDCIIHCDIKPENILLNESFVPKIADFGMAKILGREFSHALTTMRGTIGYLAPEWISGTVVTAKVDVYSYGMVLFEILSGRRNSSQEYFKDGDHSAYFPMQVARQLINGGIGNLVDAKLHGDVNLEEAERVCKIACWCIQDSEFDRPTMGEVVQFLEGVLELKMPPLPRLLNAITGGSHSTPLSSLDLP

SEQ ID NO: 9122 - protein, 151 aa, Rhizobium leguminosarum bv. viciae 3841
MSRETAPHILIVEARFYDDMADALLEGATFALTEAGATFEVVTVPGALEIPAAIAMSLDGDDNGGTHYDGYVALGMVIRGETYHFDIVSNESSRALMDLAVSESLAIGNGILTVENDEQAWTRVRRSEKDKGGFAARAALTMIELKQKLGA

SEQ ID NO: 9123 - protein, 113 aa, Brassica napus
  misc_feature (32)..(32): Xaa can be any naturally occurring amino acid
  misc_feature (49)..(49): Xaa can be any naturally occurring amino acid
  misc_feature (51)..(52): Xaa can be any naturally occurring amino acid
  misc_feature (65)..(65): Xaa can be any naturally occurring amino acid
  misc_feature (94)..(94): Xaa can be any naturally occurring amino acid
  misc_feature (97)..(97): Xaa can be any naturally occurring amino acid
  misc_feature (100)..(100): Xaa can be any naturally occurring amino acid
  misc_feature (106)..(107): Xaa can be any naturally occurring amino acid
CYRSVIDGIEHIAMVKGEIGDGQDILVRVHSXCLTGDIFGSARCDCGDXLXXSMERIEKAGRGVXVYLRGHEGRGIGLGHKLRAYNLQDDGRDXVEXNEXLGLPVXXREYGIG

SEQ ID NO: 9124 - protein, 178 aa, Pyrococcus horikoshii OT3
MAPKILVEQIVKRKAVVVKPTDSVHKVAKVLSKNKVGSAVVMDKGEVLGVVTERDILDKVVAKGKDPKEVKVEEIMTKNPVKIEYDYDVQDAIELMTEKGVRRILVTKFGKPIGFVTATDLLAALASQNNEEEEKEEEEPQVYGICELCGQYGPLYKVYYEGHEIWVCENCKDLIEGK

SEQ ID NO: 9125 - protein, 807 aa, Moritella sp. PE36
MDAVKRSIHKFGGSSLADATCYRRVSAIISEHTQARDLIVVSAAGKTTNQLIELLQLAEDGDQAASERLIATCEYQAKLIAELLADDLCIQLTAALQDDIHTIGHLLEAHLDVYAKNQILAHGEVWSARLLAALLSQSELPANDLDSRLFLTTELAAQPVVDEMVSRQKLTACLANLHNRVVVTGFIAADGQLRTVTLGRNGSDYSATLLGALVDAEQTTIWSDVAGIFSADPRRVKDAELQTKLSLDEAAELARLGSPVLHARTLQPVVESKQHVQLRCSYTPSEGSTQIHRRLPKGKGAKIVTSVDDLHLIDIEFDQHADYQQQYNQLITLLAQQQLSPICIKRRPTEHVVRLGYTAEIVEFALTALQTYQLQQPQVRAINLLSGFCMVALVGSGVTENALQSHQFYQLISEHNLTFVQTGDNRLSICAVLQKVVLEPLLKELHTALFKQPKRIGVVLFGKGNIGAGWLSLFAKQTHKLPEQQNVDLCLCGVYGSQGGVLDFNGLDAATVLDAFQPESFVWEQLLSNLALHPFDELVIIDITASEAISYYYPEFAQHGFHLISANKFAGAASSEFYHRVKQSFSDNESHWLYNATVGAGLPIQSSMEMLQHSGDQVTAVSGIFSGTLSWLFQQYDGQIAFSQLVEQAWQQGLTEPDPREDLSGKDVQRKLLILSREAGYDMELSDIKLESLVSAELMAFKVDEFLEHCEALDDKILHMFNKAKKQGLVLRYVARFSRKEGAQVGLEFLEPTHPFANLLPCDNIFSINSHWYRHNPLVIQGPGAGRDVTAGAIQADLFQLCKLLAR

SEQ ID NO: 9126 - protein, 333 aa, Physcomitrella patens subsp. patens
MAFLKGNFHLPRKFSGGSGSSILDEVEHQQTHQELERLYTSTRAAKHFQKDVVKGVEGLVSTGKRQLEIEIRFGQDCTKYGLEGASVTESLSRATQHYGSARGRMEKERENFHRVISLQVAEPLKAMVQGSPLEDARHLKQKYDRLRESVDSHASEVQKRKTKDANGNPEHAAKLRAAEQKLDEIISAMNTMGKNATSAMSVVETQQQQTTLHKMLSMVEAERAYFQRVTSILDTLHHEIESEVKKSSNPSAGKVPAAPEPKSFYATATHDFVGEDEGELTISVGDEVLVRQVTSSGWSEGQCNGQSGWFPSTYVEKKQPIRKGRGKLGGSSR

SEQ ID NO: 9127 - protein, 413 aa, Moritella sp. PE36
MSDFRQQALDYHANPKPGKIAIQLTTSAETADDLSLAYSPGVAEPVREIAANPDDAYKYTAKGNLVAVITNGTAILGLGNLGPLASKPVMEGKALLFKRFADIDSIDIEVKHRTTEEFIDTVANIADTFGGINLEDIKAPECFEIEKALIARCQIPVFHDDQHGTAIVTAAGMINALDIQGKDIAEVIIVCMGAGAAAIACMELLISCGAQREKIYMLDRKGVIHTRRDDINEYKQRFANNTDKRTLQDAINGADVFVGVSGPNVLAAHDVKLMADNPIIFACSNPDPEIKPELAHGARQDLIMATGRSDYPNQVNNVLCFPFIFRGALDARASVINEAMKVAAVHAIREIAKEEVPQSVLTASGVESLEFGTEYIIPKPMDPRLLPRVARAVALAAVETGVARVELPENYML

SEQ ID NO: 9128 - protein, 276 aa, Glycine max
PSPGTDGRKIVDVLLEQNIVPGIKVDKGLVPLAGSNDESWCQGLDGLASRSAAYYQQGARFAKWRTVVSIPNGPSALAVKEAAWGLARYAAIAQDNGLVPIVEPEILLDGEHGIDRTFEVAKKVWAEVFFYLAENNVLFEGILLKPSMVTPGAESKDKASPQTVADYTLKLLHRRIPPAVPGIMFLSGGQSEVEATLNLNAMNQSPNPWHVSFSYARALQNTALKTWGGRPENVKAAQDALLFRAKSNSLAQLGKYTGEGESEEAKKELFVKGYSY

SEQ ID NO: 9129 - protein, 492 aa, Brucella suis 1330
MQDKIDRLRQQAVPPQSLFINGRWQPAADGNVMAVISPIDGTQLTTIAAATAIDVDRAAAAARHSFEKGTWAKAAPAERRKVLLKIAELIERNALELAVLGVRDNGTEISMALKAEPGSAANSFRYYAEAIDKVYGEIAPTAENILGLVHRAPVGVVGAIVPWNFPMMIGAWKIAPALAAGNSIVLKPAEGASLSLLRLAELCAEAGLPEGVLNVVTGAGPVTGEALGLHPDIDVLAFTGSGFVGRKLLEYSARSNLKRVHLELGGKSPNIVFADAPDLAQAAKVSAYGIFRNSGQVCVAGSRLLVERSIAGEVAEKVSTIAAAIKGGDPLGLTTEAGAISSEAQLRKNLDFAEQALSEGAGLRTGGKRILEETGGFYMQPTVFNVEPGMTLAREEVFGPILSIIPFDNEEDALKIANDSDYGFASAVWTSNLSRAHRMVRGIRAGVVHVNTYGGADNTVPLGGVKQSGNGHDKSLHALDKYIDLKTAWIQL

SEQ ID NO: 9130 - protein, 178 aa, Oenococcus oeni
PIVYDPTIADTIENYSELFVEPQGAAFLDINHPENIQSTLKNAANGRDIKLLVVSDAEGILGIGDWGVQGVDIAVGKLMVYTVAAGIDPSTVLAVVIDAGTNNEKLLKDPMYLGNKFNRVRGDKYYDFIDKFVNHAESLFPNLYLHWEDFGRSNASNILNSYKDKIATFNDDIQGTGI

SEQ ID NO: 9131 - protein, 165 aa, Oryza sativa
MEATGRLERTYAMVKPDAVGAGNAERIMQQIEQNGFTIVQQAKLQLTREMAEEFYAEHAGKPFFEGLVTFMSSGPTVALVLAKVNAIREWRTLAGPTNSNKAREEAPKSVRALYGTDGQRNSVHGSDSPSSAEREIPFFFPNLVLDPVPNSASATEYIQKNLQPI

SEQ ID NO: 9132 - protein, 155 aa, Zea mays
MGIGEHFEGVKQHWASNFAFLDYYKKVYGRAEPLPKWSDADVDEFIASDPVYGPQLKALRESRKFALAGAFAGAAHLGGVALKYSKAPHGVVLATGFGAITGAVLGSEVAEHWYQLYKMDKQGANLRFIYWWEDKVSGPSCPPCHLVLSDDPVPV

SEQ ID NO: 9133 - protein, 125 aa, Pinus taeda
ISGGAKDLVKRMLEHDPKKRLKAADVLSHPWMREDGEAPDKPLDSTVLVRMKQFRAMNKLKKVALKVIAESLSEEEIRGLKEMFKSIDADNSGTVTFEELKNGLARFGSKISETEVRQLMDAVST

SEQ ID NO: 9134 - protein, 178 aa, Lactobacillus hilgardii
PVVYDPTIADTIENYSHLFLDPQNAAFLSIDDQDDIEASLKNASAGCDIKLIVVTDGEGILGIGDWGVQGVDISVGKLMVYTAAAGVDPKSVLPVVLDVGTNRKELLADDLYMGNHTQRVTGDKYYNFVDKFVETAENLFPDMYLHFEDFGRSNAANILNKYKDNILTFNDDIQGTGI

SEQ ID NO: 9135 - protein, 178 aa, Leuconostoc mesenteroides subsp. mesenteroides
PVVYDPIVAESIEQYNEIYTNPQNAAFLSIDHPENIESSLKSVADGRDIELVVVTDAEGILGMGDWGVNGVDIAVGKLMVYTAAAGIDPATVLPVSIDAGTNNKILLENPLYLGNKHERIAGEKYLEFIDEFVTAEQKLFPASLLHWEDFGRSNAQVILDKYKDSIATFNDDIQGTGI

SEQ ID NO: 9136 - protein, 357 aa, Acidovorax sp. JS42
MKIAVLPGDGIGPEIVAEAVKVLEALDLKLEMETAPVGGAAYEAAGHPLPESTLNLAKSADAILFGAVGDWKYDTLARPLRPEQAILGLRKHLGLFANFRPAICYEQLTHASSLKPELVAGLDILIIRELTGDIYFGQPRGRRTAADGHFPGAEEAFDTMRYSKPEIERIARVAFEAARKRNKKVTSVDKANVLETFQFWKDVVTEVHKDYPDVELQHMYVDNAAMQLVKAPKAFDVIVTGNMFGDILSDEASMLTGSIGMLPSASLNDKKQGLYEPSHGSAPDIAGKGVANPLATILSAAMMLRFSLNQEEAARRIEAAVQQVLAQGLRTPDIYSDGTTKVGTAQMGDAVVKALAA

SEQ ID NO: 9137 - protein, 361 aa, Brassica napus
  misc_feature (201)..(201): Xaa can be any naturally occurring amino acid
MSENMEQPLSPSLPDDVIIDIVARVPRSYYPTLSLVSKSFRKLIASPTFYKRRSFPGITQHRIYAVLRNRKTRDDFSFYILHRKLKCSNRLVIVGSRTLHHMCSRGSYVLVGSKVYGFNDLHALSIDCTSHTSQPISDIPQLMTNKVANVIDKKIYLIGGSFLPDESGSREAWKNAVAVFDTETQSWECKLVKEDMHVGLXSLWSDSMVMEGKIYLKDYSHSNFFAYEPEERKWELMDEVLSSQAWVGACVVDDVLYYHDCRGKVLKAYDPKQMCWSVVNGLEEFLAVETAHSIWSNAVSYGEKKLALFFLKIHDGKQVICCAEIALERRQGGEIWGKMESCDVVIEDGLVDMVKFVSVTV

SEQ ID NO: 9138 - protein, 125 aa, Triticum aestivum
FTGLSFQIMAIGTCAICYNNVKVFRGVVKMRRGLTARVIDETKSISDVYSAFYEFSSLLESKIDDNDPNAALTRRRVDAIKKTCKSSGLLKRRGYDLEKSKYRMPMLIMIMLLLVAIILGVLYGK

SEQ ID NO: 9139 - protein, 177 aa, Lactobacillus plantarum
NPVVYDPVVADSIEQYNELFLDPQNAAFVSVDAPEDIEATLKNARGRRDIRLVVVTDAEGILGMGDWGVNGVDIAIGKLMVYTAAAGIDPSQVLPVSIDAGTNNQKLLDDPLYLGNRHKRVSGEQYYDVIDKFVAAEQQLFPDSLLHFEDFGRDNAQVILDKYKDQIATFNDDIQGT

SEQ ID NO: 9140 - protein, 667 aa, Nostoc punctiforme PCC 73102
MSSVSISDNSSKFSGNSRSLLKKRTLLFRYLAEINLIFGIWYLQWRVTHSINFDALWISIPLLIAEIYSYFGGVMFVIGLWRPLVRQVKSLDQMTPPLPRSDWPTVDVFVTCYNEPPKIVEETAKAALVMDYPPTKLRVYVLDDGNSADMRAMTERLCIEDLQSPQLQQEANRIDAEHSSLLQRLKELENLTPNTQGAEQWLQTSSSEPVVNQLATEFVQSLRQFILWLPPTHQSISDSPVETLRDRLTTERKALEETIRKKELELLELSRFRYIARPKTPGVAHHAKAGNINYAIFSGQTAGNFIVTLDADHIPKQNFLKRVVPYFYTYNLSTGRYDQNQIAFVQTRQDFYNIPPGDPFGHRANLFYGPLQQGKDGMNAAFYTGTNAILRREALVSVGLQNFADEFAKDEKRLDEFDLVGGVSSNSITEDMNTAMRLHSAGWKSIYHNELLAEGLAPDDLSSTLKQRLRWAQGTIQVLVRENPLTKSGLTFWQRLQYFKTMYSYFSGFATLVFISCPIIYFFTDIVPVKTYGSDFAIHFFPAFIINRLTFLAATWGIPATEVWRSEQYAIALFPLLIQAVWSVFTGQKLNFQVTPKQRQSGIYLRLVWPQLVIFILTILGILWSLYRFAIGHLNNPLVHLLNGAWAIYNLLLLSAIIRASVWQPPK

SEQ ID NO: 9141 - protein, 161 aa, Pediococcus parvulus
IADTIENYSDLFIQSQNAVFLSIDDPDSMKASLKNAADGRDIRLIVVTDAEGILGIGDWGTNGVDISVGKLMVYTAAAGIDPSQVMPVVLDVGTNNQDLLKNPMYLGNRHERITGDRYYKFVDQFVNTAEDLFPKLYLRFEDFGRDNAANILNKYKDQITT

SEQ ID NO: 9142 - protein, 332 aa, Myxococcus xanthus DK 1622
MMPTHPMPLSVAPMMDWTDRNCRYFHRQLSRHTLLYTEMVTTGAILHGDRERLLGYDAAEHPVALQLGGSEPAALAESARIGEQWGYDEINLNVGCPSDRVQSGRFGACLMAEPDLVARLVGAMREAVSIPVTVKSRIAIDELEEWPTLEGFIRKVSAAGCTRFIVHARKAWLQGLSPKENRDVPPLRYDLVHRLKVEFPHLDISINGGIKTLDAAAEQLRHVDGVMMGRAPYENPYLLAEADRRFFGATTPVPQRHEVVEAMLPYIEKAMLRGAPLGAITRHMLGLFQGLPGARAWRRHLSENAHKQGAGPEVVVAALAKVRREPEAEVAA

SEQ ID NO: 9143 - protein, 339 aa, Streptococcus pneumoniae TIGR4
MQEKILVTGGAGFIGTHTVIELIQAGHQVVVVDNLVNSNRKSLEVVEGITGVEIPFYEADIRDTDTLRDIFKQEEPTGVIHFAGLKAVGESTRIPLAYYDNNIAGTVSLLKAMEENNCKNIIFSSSATVYGDPHTVPILEDFPLSVTNPYGRTKLMLEEILTDIYKADSEWNVVLLRYFNPIGAHESGDLGENPNGIPNNLLPYVTQVAVGKLEQVQVFGDDYDTEDGTGVRDYIHVVDLAKGHVAALKKIQKGSGLNVYNLGTGKGYSVLEIIQNMEKAVGRPIPYRIVERRPGDIAACYSDPAKAKAELGWEAELDITQMCEDAWRWQSKHPNGFED

SEQ ID NO: 9144 - protein, 208 aa, Chlamydomonas reinhardtii
MFDDPGVLSLLMPWHWLWSEPLTEKVRWSICAKEVCFKNELLRHFFVNGKTLPVERGKVGVNQPVVSIAAHTLAKGGWVHLFPEGRINYDGKLGPLRWGVGKLICQARQLNGGRDPALLPFYHSGMGDVLPITMDRLNVGKQVEVRVGELIRLDDLTCNCDSADAGVQQETWKAITARVKDALLDLERRCPPNPDQSAVAPKRDPPPS

SEQ ID NO: 9145 - protein, 51 aa, Zea mays
GEDHNKTCGHNRFGRIYHTGHYPICYEHNPVHFVGHSAGAQRKLWWKRPKQ

SEQ ID NO: 9146 - protein, 395 aa, Silicibacter pomeroyi DSS-3
MKTTAITRRLTDLGGAKWGIYLRAKAMIAKGADVISLTIGAPDVPPPAELMDVAEAAMRAGRTTYSDGAGEPGLRAALAERYSASTGRAISADQVMCFPGTQTALYAVLMGVAEEGDEVLVGDPMYATYAGVIRATGADLVPVPLRPENGFRITAADIAARITPRSRAILLTTPHNPTGAILTPEDIAAIGDLACKHDLWIISDEVYEQLVFDGQGFSSPLAQPDLAERVIVVSSISKSHAAPGFRSGWCIGSEAFTAALLPLSETMLFGNQPFIADMTEAAVRNGSSVAPGMRARYAARADRLAARLNGRTCLHVLKPQAGMFAMIDVSGTGMTGEAYAAHLLDHAGVAVMPGASFGDTIDGWVRVALTADDAAFDTACERIAAHAAEFQSEDA

SEQ ID NO: 9147 - protein, 188 aa, Myxococcus xanthus DK 1622
MSVNIQLEWTPNPSTLKYVVDRRLLAGGAVNFTNPEDAQAKSPLARKLMDVRGVTAVMIGTNFVTVTKGEEGEWDELNDEVMSALDTHLTANEPVVDEAALAAAREAAGPSGGGTVEGRIQDILDNEIRPAVAMDGGDITLDRFEDGIVYLHMKGACAGCPSSTATLKMGIEGRLREMIPEVLEVVSV

SEQ ID NO: 9148 - protein, 159 aa, marine gamma proteobacterium HTCC2080
MTIAIGDTIPAANLMVMGENGPGGVSTSELFDGKKVLLFAVPGAFTPGCSMTHLPGYVAHADQIKAAGIDSIICLSVNDAFVMGAWGQAHNADHITMLADGNGELTGKLGLELDGSGFGLGTRSQRYAMVVDNGTVTHLNIEEGPGVDVSSAETMLAQL

SEQ ID NO: 9149 - protein, 271 aa, Coccidioides immitis RS
MSAIEDAKRAAAREAVANHYPQNPKFVGIGSGTTIVYVVEAIKALGIDTSSTSFVPTGFQSNQLIVNAGLTPIAFDALPEGAVLDIAFDGSDEVDDDLNCIKGGGACLFQEKLVALQAKEFIVVADYRKLQPRLLTAWPSIPIEVAPLASRRVITALQALGSPEPKLRQSLISQEGPVKTDQSFFLIDAPFPQLLTSSDIQSGKTASAKEGIWEVETLAKEIKQIPGVLEVGLFYGPTGPQAQATGGVGGQKPIAAYFGMADGSVSVRKVK

SEQ ID NO: 9150 - protein, 382 aa, Triticum aestivum
MHWNVVNKVQSYLNCGIHSTSQISFLAKMGVYLSTPKTDKLSEDGENDKLKFGLSSMQGWRASMEDAHSALLDLDNETAFFGVFDGHGGRVVAKFCAKYLHSQVLKSEAYSSGDLGTAVHKAFFRMDEMMRGQRGWRELSALGDKMNKFSGMIEGLIWSPRGSDSKNAEDDWALEEGPHSDFDGPTCGSTACVALVRNNQLVVANAGVNPRGCYLQGLAQAYNLSRDHKPELVAERERILKAGGFIRMGRINGSLNLARAIGDMEFKQNKFLPPEKQIVTSNPDINVVELCNEDDFLVLACDGIWDCMSSQQLVDFIHEHIHTESSLSAVCERVLDRCLAPSTMGGDGCDNMTMILVQFKKPVSDKKKADVGEQSAKGKEES

SEQ ID NO: 9151 - protein, 620 aa, Zea mays
MEPAENDTSSPPEYGAGKAAATVPARSYWRWRRDDFFPEPSFASWGAYRRALRETPARLRDRLAGRSTDAAELGALRRRSEHEMRRCLTWWDLTWFGFGSVIGAGIFVLTGQEARDHAGPAIVLSYVASGLSAMLSVFCYTEFAVEIPVAGGSFAYLRVELGDAAAFVAAANLILESVIGTAAVARSWTSYLASLVNRPASALRIHAPGLAGGYDELDPIAVLVIAVTATLAMLTAKGTSRVNWVASAVHVLVIAFVIVAGFAHADAANLRPFMPQGVPGVFRAAAIVYFAYGGFDNIATMAEETRNPSRDIPLGLLGSMTAITAIYCVMALVLSMMQPYTAIDRSAAYSVAFASVGMRWAQYVVALGALKGMTTVLLVGALGQARYTTHIARSHIIPPVFALVHPRTGTPVHATALIAVCSACIALFSSLDVLASLLSVSTLFIFMMMATALLVRRYYVRGVTSRTHALRLTALLLLIIASSIGIAACWGTSPERWQGYVVLVPAWAAGTLGIQLLVPAARAPKVWGVPLVPWLPSLSIATNLFLMGSLGKDAFIRFGVCTAVMLVYYVLVGLHATYDVAHGACGWEEEDDGDAAAADEDKKVVAAADVEKADAAGGTR

SEQ ID NO: 9152 - protein, 204 aa, Medicago sativa
  misc_feature (186)..(186): Xaa can be any naturally occurring amino acid
VLPSSNAMKKYNPKLVYPIQSAGSTGNLRDIAMDSLEKYGVGMIDPSKFYDFYNDYHSYLASCGVDGVKVDVQNLIETLGSGCGGRVSLTKRHQEALETSIARNFEHNNLICCMSHNSDSIYSSKKSAVARASEDFMPREPTFRTLHVASVAFNSLLLGEIFVPDWDMFQSKHETAEFHAAARAIXGCAVYVSDKPGNHGFLKS

SEQ ID NO: 9153 - protein, 132 aa, Brassica napus
  misc_feature (2)..(2): Xaa can be any naturally occurring amino acid
  misc_feature (11)..(11): Xaa can be any naturally occurring amino acid
  misc_feature (16)..(16): Xaa can be any naturally occurring amino acid
  misc_feature (32)..(32): Xaa can be any naturally occurring amino acid
  misc_feature (35)..(35): Xaa can be any naturally occurring amino acid
  misc_feature (40)..(40): Xaa can be any naturally occurring amino acid
  misc_feature (47)..(47): Xaa can be any naturally occurring amino acid
  misc_feature (51)..(51): Xaa can be any naturally occurring amino acid
  misc_feature (60)..(61): Xaa can be any naturally occurring amino acid
  misc_feature (64)..(64): Xaa can be any naturally occurring amino acid
  misc_feature (67)..(67): Xaa can be any naturally occurring amino acid
  misc_feature (70)..(70): Xaa can be any naturally occurring amino acid
  misc_feature (75)..(75): Xaa can be any naturally occurring amino acid
  misc_feature (84)..(85): Xaa can be any naturally occurring amino acid
WXSSMLSSAAXVTSPXQATMVAPFTGLKSSAXFPXHPAKXTTNITSXASNXRKELTCMKXXPPXWKXKVXNLSYXPDLTEIELXXEVEYPPPRGFPWVPWKGFPGSGKGLGFGKGENFPPFGRPQRGPKGKG

SEQ ID NO: 9154 - protein, 433 aa, Xanthomonas campestris pv. campestris str. ATCC 33913
MSSQGNESPALVRAVSRWQIVGLSINDVIGSGIYLLPAATAALLGPMSLWAVMLAGLAVALLVLCYAQAASYFDTPGGSYLYTREAFGPFTGFQIGWMIWLTRISSAAALSNGLADAVARFWPAAGSDGWERLLVVVGSLGLLTAINVIGVKSAARTGVALVIGKLVPLLLFVAIGLFYVDWSWAFAGSTPDLRDLGNLGEAALLLLFAYAGFENIPAAAGEYRNPRRDVPFALITMIVTVTLIYAAVQVVAQGTLPNLAASPTPLADAASRFGGEALALILTVGATISILGTTSNTVMLGPRFLFALAQDGYGPALLARVHPRFHTPAAAVLTQGVLSLALALSGSFTQLALLSMVTRLFAYIGTAAAVIVLARRYRARTDALRLPGGPLIPIAALLLSLGLLASASWQNLAAAGLALLVGCVFYLFPRKPA

SEQ ID NO: 9155 - protein, 641 aa, Oryza sativa Japonica Group
MSSKFLAMYLLLALLSHGTYSYSATTASGWEDQDFFRHCPVSRCSDGGPEIRFPHGLQSSNTSSACGASCAKLACSGQDTILHHPFLGPCKVTSIDYKEAIMSIIPLVYSSSPCPLQKLIFDNLQPYDYHRCKLYSWAPAKIVRCSKEFTPNGTSPVDGYAFMNNADYITGPISCPSEASHFSYLVDARLCMYVLPLDCRIVSRGSIPIPGPAYSDIGGPTFKERAEKFINFAETTVSWYSDDEVTINCTECERQKHRCAFSSQRNRTFCMSREHHGSSVKVISATSSAAAFVVLSLIIATVLYISLKSRYDEEVHLKVEMFLRTYGTSKPTRYNFSDVKKIARRFKEQLGQGGFGSVYKGELPNGVPVAVKMIEHTTGNGEEFINEVATIGQIHHINIVRLLGFCSDGTRHILIYEFMPNESLEKYIFLHDPNTSQELLAANKMLDIALGIARGMEYLHQGCNQRILHFDIKPHNILLDYNFNPKISDFGLAKLCARDQSIVTLTKARGTMGYIAPELYSRNFGEISYKSDVYSFGMLVLEMVSGRRNSDPSIQNQNEVYFPEWIYEKVITGQDFVLSREMTEEDRLKVRQMALVALWCIQWNPRNRPSMTKVVNMLTGRLQNIEVPPKPFVSYESHAVP

SEQ ID NO: 9156 - protein, 213 aa, Gossypium hirsutum
AADGYARSRGVGACVVTFTVGGLSVLNAIAGAYSENLPLICIVGGPNSNDYGTNRILHHTIGLPDFSQELRCFQTVTCYQAVVNNLEDAHEMIDTAISTALKESKPVYISISCNLPAIPHPTFDREPVPFSLSPKLSNKIGLEAAVEAAAEFLNKAVKPVLVGGPKLRVAKACEAFVELADASGYAVAVMPSGKGLVPEHHPHFIGTYWGAVS

SEQ ID NO: 9157 - protein, 442 aa, Pseudomonas putida GB-1
MRTLDVHPIIDNARFTPFHWMVMAWCGLLLIFDGYDLFIYGVVLPVIMKEWGLTPLQAGALGSYALFGMMFGALAFGSLADRIGRKKGIAICFALFSGATILNGFASSPSEFGIYRFIAGLGCGGLMPNAVALMNEYAPKRLRSTLVAIMFSGYSLGGMLSAGVGIFMLPRFGWESMFFAAAVPLLLLPVILYYLPESIGFLVRQGRSDEARKLLKRLDPNCDVQADDVLQAADRKGSGASVLELFRNGLAIRTLALWLAFFCCLLMVYALSSWLPKLMANAGYSLGSSLSFLLALNFGGMAGAILGGWLGDRYNLVKVKVAFFIAAALSISLLGVNSPMPVLYLLIFIAGATTIGTQILLYAGAAQMYGLSVRSTGLGWASGIGRNGAIVGPLLGGALMGINLPLQLNFIAFAIPGAIAALAMAVHLASGRRHAQAVAAQA

SEQ ID NO: 9158 - protein, 681 aa, Idiomarina loihiensis L2TR
MSYQVLARKWRPSQFAEVVGQQHVLKPLEHALDKQRLHHAYLFTGTRGVGKTTIARILAKALNCEEGITATPCGKCSACLEIEQGRFVDLLEIDAASRTKVEDTRELLDNVQYRPTRGRYKVYLIDEVHMLSRHSFNALLKTLEEPPEHVKFLLATTDPQKLPVTILSRCLQFNLKALSNDDITQQLSYVLSQEQVQADSEALPLLARSARGSMRDALSLTDQAIAQGGGSVSIDSVRRMLGNVPVADIAALLESVLEGDAEAVMQRVDSMVSMVPDLSSVLVELQSLLHQLALVQQVPSAANVFENSDVLKPLLRRMPAELIQVFYRTVLEGRREQAYAIDARSGLEMTLLRLLCFRPAEKGDYNITEPDSSAVDMPESKLTAPAQEVTETEAGSVAEVTPQAGPEPQPEAELSEPMQPSYSEHEEPPEFNYSEPDDDAGFYHNDAPPYHMEEAAKSEPVPEPTADQTAEPTPEPAAQSSSGVADLLRVREQLAEKKNPDNSNKTLNSQTENSSPVALTVPAEAEPEAQPEHQPESKDELNEELPELNDDIREAAEVDKWSAMIAGMDISGLARQVLLNSELQKLGDDDWLILVAEEQKSLLNESTSQAVRESLAGLLGATARVDFKVGVPSQPTPLMVQQHINEYRHQRACEILHGDAGVQDLQQRFQAQIDESSIQAR

SEQ ID NO: 9159 - protein, 217 aa, Physcomitrella patens subsp. patens
MNKKPLVGSVDLYERHIFLRYNQPSSWPSKVEASDYHPLPSKLVNALRNKKNDLPKKTRLTIAEGQDEPEKTNGDILMFPDMLKYKGIAESDVESFIDEVLVKGDAWALGEPEPLVGSYVFICGHGSRDKRCGVCGPPLRERFNQEIAVRGLGEQVFVNYCSHIGGHKYAGNVIVFRHDGGSGSCSGHWYGYVTPEDVPELLEKHIGLGQVVDRLWR

SEQ ID NO: 9160 - protein, 526 aa, Oryza sativa Japonica Group
MAVRRRRRRSRAAAVLVAALLLAASAATASAASSYPAKVVTGLLSSTASAVVKQLWSLKSTATRTGSAAAGRSMVKYEGGYAVETVFDGSKLGIEPHDVEVTPSGELLVLDSMNSNVYRVQLPLSRYSRPKLVAGSPEGLSGHVDGRLREAKMNHPKGFTVDDRGNIYVADAMNMAIRKISDTGVTTIAGGKSMRGGHLDGPSDDAKFSTDFEIRYISSSCSLLVIDRGNQAIREIALHNDDCEYQYEAGFPLGIALLFAAGFFGYMLALLQRQVLGMVSTADVHCFKDTEKEPQTPPRPSIASIPPYQKPLKPSLRPPLIPTEDQAGKHEAEEGFFTSIGKLIGGAKSSAVEIFSRKKRPTHQYHHHLQQQRANPWPVQESYAIPHDETPPPLDMRAATPRKNYAFMTKEPEKVHHVRHGRPYFNGWDMQHAPQQQPEQQMYHQQHLQQHRQYSAGPQTFYEQSCETTNEIVFGAVQEVDTKRRMVEIKAVNYGDTFYEQYGMRYRNNYIGYNNSSNGNNNSYYY

SEQ ID NO: 9161 - protein, 146 aa, Pediococcus acidilactici
TIADTIENYSELYVQSQNATFLSIDDPDNMETALKNAADGRDIRLIVVTDAEGILGIGDWGTNGVDISVGKLMVYTAAAGIDPSQVLPVVLDVGTNNEKLLKDPMYLGNRHERIKGDRYFEFVDQFVQTAENLFPNMYLHFEDFGA

SEQ ID NO: 9162 - protein, 343 aa, Populus nigra
MHISKAIVAAFFFVVLLGGTLACGQLTPTFYDQTCPNVSSIIRDVITETLVSDPRIGASLIRLHFHDCLVNGCDGSLLLDNTDTIVSEKEAGGNNNSARGFEVVDRMKALLESACPATVSCADILTIAAEESVVLAGGPNWTVPLGRRDSTTASRDAANAFLPAPFFTLDQLRESFTNVSLNNNTDLVALSGAHTFGRAKCSTFDFRLFDFNSTGAPDQSLNTTLLADLQELCPQGGNGSVITDLDLTTPDAFDSNYYSNLQGNQGLLQTDQELFSTPGADDVIALVNAFSANQTAFFESFAESMIRMGNLSPLTGTEGEIRLNCRVVNANLAGPDSMLVSSI

SEQ ID NO: 9163 - protein, 169 aa, Chlamydomonas reinhardtii
FPEELVMFWFVQLLMALHHLHGRKIMHRDLKPDNIFLAAARRVIKLGDLGVAKHMSGTFELAITCLGTPYYMSPEVLASRPYTYASDIWSLGCVLYEMAARRTAFEAFGLPQLMFKIIRVAYDPLPPAYSRPFQQLVNGMLRADPDDRPTTGDLLAQPYVRRHLARLLT

SEQ ID NO: 9164 - protein, 113 aa, Glycine max
MPRTSTLECSGCPPVRALTFDALGLIKVVEARDKQRGAPQVVERWGDPESSKCVMAVSMIDRESHPLLAVARKNNQIEVLSPVNGDIQATITDANDLDVQSEVNNIVGLHLFA

SEQ ID NO: 9165 - protein, 343 aa, Populus nigra
MHLSKAIVAAFFFVVLLGGTLAHGQLTPTFYDQTCPNVSSIIRNVITETLVSDPRIAASLIRLHFHDCFVNGCDGSLLLDNTDTIESEKEAAGNNNSARGFEVVDRMKALLESACPATVSCADILTIAAEESVVLAGGPNWTVPLGRRDSTTASRAAANASLPAPFLPLDQLRESFTNVGLNNNTDLVALSGAHTFGRAQCSTFDFRLFDFNSTGAPDPSLDPTLLAALQELCPQGGNRSVITDLDLTTPDAFDSNYYSNLQGNRGLLQTDQELFSTPGADDVIAIVNAFSANQTAFFESFAESMIRMGNLSPLTGTEGEIRLNCRVVNANLAGPDSMLVSSI

SEQ ID NO: 9166 - protein, 231 aa, Streptococcus pneumoniae TIGR4
MSRIEFSPSLMTMDLDKFKEQITFLNDKVASYHIDIMDGHFVPNITLSPWFIQEVQKISDTPLSVHLMVTDPTFWVDQVLDLQCEYICIHAEVLNGLAFRLIDKIHDAGLKAGVVLNPETPVSTIFPYIDLLDKATIMTVDPGFAGQRFLESTLYKIQELRQLRVQNGYHYIIEMDGSSSRKTFKQIDVAGPDIYVIGRSGLFGLDDDIAKAWDICSRDYEEMTGKTMPIK

SEQ ID NO: 9167 - protein, 146 aa, Zea mays
  misc_feature (33)..(33): Xaa can be any naturally occurring amino acid
  misc_feature (68)..(68): Xaa can be any naturally occurring amino acid
  misc_feature (79)..(79): Xaa can be any naturally occurring amino acid
  misc_feature (91)..(91): Xaa can be any naturally occurring amino acid
  misc_feature (107)..(107): Xaa can be any naturally occurring amino acid
QRCNEVLGSGNWKCKATTKERMKIAKTLNEGQXPPLHDAKVEVRHPYVLLAAHKNHIQQQQHVAVQNXCVNKVGALNAXRKSEMLGSLWVXWVILAHSEMTAMMVEXNEWVGHKGAYALSQALKDIACVGETLETRQAGCTMDVEG

SEQ ID NO: 9168 - protein, 472 aa, Yersinia pestis CO92
MSQNVYQFIDLQRVDPPKKPLKIRKIEFVEIYEPFSETQAKAQADRCLSCGNPYCEWKCPVHNYIPNWLKLANEGRIMEAADLAHQTNSLPEVCGRVCPQDRLCEGSCTLNDEFGAVTIGNIERYISDKAIAMGWKPDMSHVHPTGKRVAVIGAGPAGLACADVLARNGVQAVVFDRHPEIGGLLTFGIPAFKLEKEVMIKRRKIFSEMGIEFQLNTEVGKDITMEALLKDYDAVFLGVGTYQSMRGGLENEEANGVYDALPFLIANTKQLMGYEATAHEPYINMQGKRVVVLGGGDTAMDCVRSSIRQGATDVVCAYRRDEVNMPGSKREVKNAREEGVEFKFNLQPLSIEVNSNGKVCGVRMVRTQLGAPDAQGRRMAEQIPGSEHVLPADAVVMAFGFRPHSMEWLAAHDVKLDKQGRVIAPESTDNAFQTSNPKIFAGGDIVRGSDLVVTAIAEGRKAADGIMNYLEV

SEQ ID NO: 9169 - protein, 275 aa, Oryza sativa
MLVSPSPYRKYFGASGARKKTAGFLSIPQPKKPPNKTAKLARSLRAISPRDDAMATVSSLFLASPVATAPTARARSTPSASPARPSLRLRRPSTLAAAAVQAEHQPAVAAAPKPPALPFRVGHGFDLHRLEPGLPLIIGGIDIPHDRGCDAHSDGDVLLHCVVDAILGALGLPDIGQIFPDSDPRWKGADSSVFMREAVKLMHEAGYELGNLDATLILQKPKISPFKETIRSNLCDLLGADPSVVNLKAKTHEKVDSLGENRSIAAHTVVLLMRK

SEQ ID NO: 9170 - protein, 419 aa, Candida glabrata CBS 138
MVKISATVYNDVEPIKTDILFATKQRYLKDTRGFKVDLGVGAYRADNGKPWILPSVRKAERLVQEEDDYDHEYLNICGLDSLTNSAAKVILGEDCPALRESRVISVQSLSGAGALHVAAKFIKKYTPEKKIYLSNPTWPIHQSIFENVDLETDSYPYWDATNKSLDFEGFIKAIDHAPRGSIFVLHACAHNPTGLDPTQEQWHQIIESIQKGDHIPLFDSAYQGFASGDLERDAYAIRYTINQLRDCAPIFVAQSFAKNVGMYGERVGCLHLVLPAQKEDIVPIKDAITSQLSRIIRSEISTPPAYGAKVVSKIFTTPELKEQWYQDLVTMSSRIISVRTRLRDLLAEYNTPGNWDHIVQQCGMFSFTGLTPEMTKRLETEHAVYMVPTGRASVAGLNTGNVQHVAKAINEVVNHFMKD

SEQ ID NO: 9171 - protein, 473 aa, Bacillus megaterium
GAMTIKEMPQPKTFGELKNLPLLNTDKPVQALMKIADELGEIFKFEAPGRVTRYLSSQRLIKEACDESRFDKNLSQALKFVRDFAGDGLFTSWTHEKNWKKAHNILLPSFSQQAMKGYHAMMVDIAVQLVQKWERLNADEHIEVPEDMTRLTLDTIGLCGFNYRFNSFYRDQPHPFITSMVRALDEAMNKLQRANPDDPAYDENKRQFQEDIKVMNDLVDKIIADRKASGEQSDDLLTHMLNGKDPETGEPLDDENIRYQIITFLIAGHETTSGLLSFALYFLVKNPHVLQKAAEEAARVLVDPVPSYKQVKQLKYVGMVLNEALRLWPTSPAFSLYAKEDTVLGGEYPLEKGDELMVLIPQLHRDKTIWGDDVEEFRPERFENPSAIPQHAFKPFGNGQRACIGQQFALHEATLVLGMMLKHFDFEDHTNYELDIKETLTLKPEGFVVKAKSKKIPLGGIPSPSTEQSAKKV

SEQ ID NO: 9172 - protein, 562 aa, Acidithiobacillus ferrooxidans
MADTITFQIEGMTCDSCAVHTRQALERVPGVRSASVSYPQQRAEIEVDTGVGLDPLVAAVAALGYRARLPDTPNKPSGLLNKALGWQDGETSVACDDEALHIAVIGSGGAAMAAALKAVEQGARVTLIERGTIGGTCVNVGCVPSKIMIRAAHIAHMRRESPFDGGIAAAVPVIDRGKLLAQQQARADELRHVKYEGILDGNPAITVLHGEARFKSGHSLNVQLNDGGEREVAFDRCLIATGASPAIPPIPGLKDTPYWTSTEALVSDTIPERLAVIGSSVVALELAQAFARLGSQVTILARGTLFFREDSAIGEAITAAFRADGIEVLEHTQASHVAYAVGEFVLATGNGELRADKLLIATGRAPNTRSLALEAAGVAVNAQGAIVIDQGMRTNSPNIYAAGDCTDQPQFVYVAAAAGTRAAINMMGGSAALDLTAMPAVVFTDPQVATVGYSEAEAHHDGIETDSRTLTLDNVPRALANFDTRGFIKLIAEKGSGRLLGAQVVAPEGGEVIQVAALAIRNRMTVQELADQLFPYLTMVEGLKLAAQTFNKDVKQLSCCAG

SEQ ID NO: 9173 - protein, 379 aa, Gossypium hirsutum
MSTAGQVIRCKAAVAWESGKPLSIEEVEVAPPQKDEVRIKILFTSLCHTDVYFWDAKGQNPLFPRILGHEAGGIVESVGEGVTDLKPGDHVLPIFTGECKECPHCLSEESNMCDLLRINTDRGEMINDGKSRFSINGKPIYHFLGTSTFSEYTVVHVGQVAKINPEAPLDKVCVLSCGMSTGFGATVNVAKPKKGQSVAIFGLGAVGLAAAEGARVSGASRIIGVDLNPSRFELAKNFGVTEFVNPKDHKKPVQEVIAEMTGGGVDRSVECTGSIQAMISAFECVHDGWGVAVLVGVPNKDDAFKTHPVNLLNERTLKGTFFGNYKPRTDIPAVVERYMNKELELDKFITHSVPFSEINKAFEYMLAGEGLRCVIRMVA

SEQ ID NO: 9174 - protein, 317 aa, Candida albicans SC5314
MVELSDYQRQEKVGEGTYGVVYKALDTKHNNRVVALKKIRLESEDEGVPSTAIREISLLKEMKDDNIVRLYDIIHSDSHKLYLVFEFLDLDLKKYMESIPQGVGLGANMIKRFMNQLIRGIKHCHSHRVLHRDLKPQNLLIDKEGNLKLADFGLARAFGVPLRAYTHEVVTLWYRAPEILLGGKQYSTGVDMWSVGCIFAEMCNRKPLFPGDSEIDEIFRIFRILGTPNEEIWPDVNYLPDFKSSFPQWKKKPLSEAVPSLDANGIDLLDQMLVYDPSRRISAKRALIHPYFNDNDDRDHNNYNEDNIGIDKHQNMQ

SEQ ID NO: 9175 - protein, 368 aa, Pseudomonas aeruginosa UCBPP-PA14
MSNPTSTPRADGFRMPAEWEPHEQTWMVWPERPDNWRNGGKPAQAAFAAVAKAIARFEPVTVCASAGQYENARARLDDGNIRVVEISSDDAWVRDTGPTFVIDDKGDVRGVDWGFNAWGGFEGGLYFPWQRDDQVARKILEIERRARYRTDDFVLEGGSIHVDGEGTLITTEECLLNHNRNPHLSQVEIERTLRDYLAVDSIIWLPNGLYNDETDGHVDNFCCYVRPGEVLLAWTDDQDDPNYLRCQAALRVLEESRDAKGRKLVVHKMPIPGPLYATQEECDGVDIVEGSQPRDPSIRLAGSYVNFLIVNGGIVAPSFDDPKDAEARAILQRVFPEHEVVMVPGREILLGGGNIHCITQQQPAPRKA

SEQ ID NO: 9176 - protein, 177 aa, Idiomarina loihiensis L2TR
MESATTDIRDSIGSIPDYPKPGIIFRDITPLLQNPDAFRLTINTLKQRYAGQGITQIAAVEARGFIFGSALAYAMGCGVTLLRKPGKLPGKVTRQNYELEYGSDELQMHENALTENDRVLIVDDLLATGGTVVAASQLIKSSGADVVEAAFVVSLPELGGEDKLQQAGVACYTLCQF

SEQ ID NO: 9177 - protein, 611 aa, Zea mays
  misc_feature (606)..(606): Xaa can be any naturally occurring amino acid
METLLAGNPANGVAKPTCNGVGALPVANSHAIIATPAAAAATLAPAGATLGRHLARRLVQIGASDVFAVPGDFNLTLLDYLIAEPGLTLVGCCNELNAGYAADGYARSRGVGACAVTFTVGGLSVLNAIAGAYSENLPVVCIVGGPNSNDYGTNRILHHTIGLPDFSQELRCFQTITCYQAIINNLDDAHEQIDTAIATALRESKPVYISVSCNLAGLSHPTFSRDPVPMFISPRLSNKANLEYAVEAAADFLNKAVKPVMVGGPKIRVAKAREAFAAVADASGYPFAVMPAAKGLVPEHHPRFIGTYWGAVSTTFCAEIVESADAYLFAGPIFNDYSSVGYSLLLKREKAVIVQPDRMVVGDGPAFGCILMPEFLRALAKRLRRNTTAYDNYRRIFVPDREPPNGKPNEPLRVNVLFKHIKGMLSGDSAVVAETGDSWFNCQKLRLPEGCGYEFQMQYGSIGWSVGATLGYAQAAKDKRVIACIGDGSFQVTAQDVSTMLRCGQKSIIFLINNGGYTIEVEIHDGPYNVIKNWDYTGLVNAIHNSEGNCWTMKVRTEEQLKEAIAMATGDKKDCLCFIEVIVHKDDTSKELLEWGSRVSAANSRXPPNPQ

SEQ ID NO: 9178 - protein, 209 aa, Triticum aestivum
  misc_feature (147)..(147): Xaa can be any naturally occurring amino acid
DLHNAAACEAAGDDALGGLGGASVHCKVSGVSDHFAQDERHGLALGRNIVKNLHLAAKETSIHNSACDYQEPLYDVQELRSIAPADTKQSFDIRSIIARIVDGSEFDEFKKLYGTTLVTGFARICGQPVGIIGNNGILFTESALKGXHFIELCAQRNIPLIFLQNISGFMVGSKSEASGIAKAGAKMVMAVSCSKVRHFYCFPFLVLVN

SEQ ID NO: 9179 - protein, 461 aa, Moritella sp. PE36
MSTGIIVQIIGAVVDVEFPQQSVPQVYDALTFDDTDLSELVLEVQQQIGGGVVRCIVMGSSDGLRRGLKVTNTGSAISVPVGDACLGRIVNVLGNPIDGKGAIPTDVRYEIHRAAPSYEEQSLSNELLETGVKVIDLICPFAKGGKVGLFGGAGVGKTVNMMELINNIAKAHSGLSVFAGVGERTREGNDFYYEMEEAGVLDKVAMVYGQMNEPPGNRLRVALTGLSMAERFRDEGKDVLLFIDNIYRYTLAGTEVSALLGRMPSAVGYQPTLAEEMGILQERITSTKSGSITSIQAVYVPADDLTDPSPATTFAHLDATVVLNRNIASMGMYPAIDPLDSTSRQLDPLVVGQEHYDIARGVQGVLQRYTELKDIIAILGMDELSEEDKQIVSRARKIQRFLTQPYHVAEVFTGDPGVLVSLKETLRGFKGLLAGDYDDLPEQAFMYCGSIDDAVEAAKKM

SEQ ID NO: 9180 - protein, 125 aa, Pinus taeda
ISGGAKDLVKRMLEHDPKKRLKAADVLSHPWMREDGEAPDKPLDSTVLVRMKQFRAMNKLKKVALKVIAESLSEEEIRGLKEMFKSIDTDNSGTVTFEELKNGLARFGSKISETEVRQLMDAVST

SEQ ID NO: 9181 - protein, 471 aa, Blumeria graminis
MPTFGFLKKRKKVSLGHRDLDSPASTLSQPASPITPSTSRGLGEPIDTTSSKITSPGQKLGSNITKDHRGTRTTVEDLPSMTDVSHLQQAYRNLSQGSTASKSNLLTIHNLINPPQHDGAGQSKVMPEKHMNNKTERPVQGKAAVAQVRQTKGKYSLSDFEILRTLGTGSFGRVHLVQSKHNQRFYAVKVLKKQQVVKMKQVEHTNDERSMLQEVKHPFLITLWGTFQDSKNLYMVMDFVEGGELFSLLRKSQRFPNPVAKFYAAEVTLALEYLHKKDIIYRDLKPENLLLDRHGHLKITDFGFAKKVTDITWTLCGTPDYLAPEVVSSKGYNKSVDWWSLGILIFEMLCGYTPFWDNGSPMKIYENILKGRVKYPPYIHPDAQDLIQRLITADLTKRLGNLHGGAEGIKSHQWFAEVTWERLAKKDIDAPYVPPVKAGSGDASQFDKYPEETERYGQTGPDEHGSLFENF

SEQ ID NO: 9182 - protein, 147 aa, Oryza sativa Japonica Group
MMYMRATHRDEEGKKVTEKVAVPETRHPDTARHFERKLDQQGLHRMERHPANGSRGIGAPPPKSGRGGKFTWEGPDSIVDSQLDPLPAAIDRNDPNYEEEEGDHEREADVVGEVEVAKVAGDARDGVARVDVVAPPQLHEKLQLQPQ

SEQ ID NO: 9183 - protein, 480 aa, Rhodococcus sp. RHA1
MKYTRSHLFIDGRWHTPSTSDRITVISPTTEEPVGSAPDSTPADVDAAVSAARRALRAPEWSELEPAERADLLRRFADALDRRRIDTAAIVTDENGMPAAISLAAEGSGPAATLRYYADLTEKTPVETPRIAANGRSTTIVRREPIGVVAAIIPWNFPQSLTMFKLAPALASGCTVVLKPAPETVLDAFQLADAAEEAGLPGGVLNIVTGGREIGAYLVAHPEVNKIAFTGSTAAGRVIGETCGRLLRPVTLELGGKSAAIILDDADLVSVARGLSWASLLNNGQTCYLSSRILAPRSRYRETVDAVAHLASELVVGDPADPATRVGPLVSERQRRSVEAYIDTGRREGATVAAGGGRPKHLDRGWFVEPTVFADLDNSATVAREEIFGPVLTVLPYDDLDDAVAIANDSEYGLGGTVWTSDPEKGLDLARRIETGSVGVNFFDLDIGAPFGGVKASGLGRELGPEGLDAYVRTKSMYTR

SEQ ID NO: 9184 - protein, 365 aa, Rhodococcus sp. RHA1
MRIEAAVLRHHDAPFEIETVELADPTGGQLRVRIAGVGFCHTDVLPRDLSFLAQPPIVVGHEGAGVVEEVGAGVTGIEAGDHVLLSFDSCGQCENCAGGHPAYCFAFFARNLSGRGPEGPGPLTDLNGNALTSRWFGQSSLATHAVVSARNVVVVDKDLPLHLLGPLGCGIQTGAGSALIALKVGTGTTFAVFGAGAVGLSAIMAARVAGASRIIAVDLHANRLNLALELGATDVIEGSADDIARQIRKLTGSGVHAALDTTGVPQVIASAIDSLRPTGTVGLVGAATRELVLAPAVLAAGKNIMGILEGDAVPQLLLPRLIELWRQGRFPFDRLIRTYPLAEISVAEADAARGDAIKPVLLPHP

SEQ ID NO: 9185 - protein, 277 aa, Burkholderia xenovorans LB400
MSERLKDRVALVTGAASGIGAATARLMAQEGAFVVLADVDEHAGQALARELRDATFAYTDVSVEAQVAAAVDEALRLHGRLDCMVNNAGFVGAYGSILETSAAAWHATLGVLLDGVFYGIKHAARAMVKQGSGCILSVASTAGVMGGLGPHAYTSAKHAVIGLTRSAASELAPRGVRVNAVAPGTTVTEMMVQGRGSRQAAIDAATRASPLGTPLMPQEIAAALVYLASDDARHVNAHTLVVDSGVTVAGASGGAVFHNRPAGFMGRMPGGANADAR

SEQ ID NO: 9186 - protein, 536 aa, Oryza sativa
GMGMEVAAARLGALYTTSDYASVVSINLFVALLCACIVLGHLLEENRWVNESITALIIGLCTGVVILLMTKGKSSHLFVFSEDLFFIYLLPPIIFNAGFQVKKKQFFRNFMTITLFGAVGTMISFFTISIAAIAIFSRMNIGTLDVGDFLAIGAIFSATDSVCTLQVLNQDETPFLYSLVFGEGVVNDATSIVLFNALQNFDLVHIDAAVVLKFLGNFFYLFLSSTFLGVFAGLLSAYIIKKLYIGRHSTDREVALMMLMAYLSYMLAELLDLSGILTVFFCGIVMSHYTWHNVTESSRVTTKHAFATLSFIAETFLFLYVGMDALDIEKWEFASDRPGKSIGISSILLGLVLIGRAAFVFPLSFLSNLTKKAPNEKITWRQQVVIWWAGLMRGAVSIALAYNKFTRSGHTQLHGNAIMITSTITVVLFSTMVFGMMTKPLIRLLLPASGHPVTSEPSSPKSLHSPLLTSMQGSDLESTTNIVRPSSLRMLLTKPTHTVHYYWRKFDDALMRPMFGGRGFVPFSPGSPTEQSHGGR

SEQ ID NO: 9187 - protein, 110 aa, Chlamydomonas reinhardtii
MQVAAGSDGIQKLLAAEAEAQRIVGDARKAKADRLRQAKAEAEKEIGAYRAEREGAYQKKIAEGSTGSQATFQRLQSETGLAVQKIQADVKAKKGEVLDMLMGYVGGVKF

SEQ ID NO: 9188 - protein, 458 aa, Zea mays
  misc_feature (285)..(285): Xaa can be any naturally occurring amino acid
TIEQVCTKKQAGTGPEFPGSKHLAAMCRCSLLVLVLLCLGSQLAQSQVLFQGFNWESWKKQGGWYNYLLGRVDDIAATGATHVWLPPPSHSVAPQGYMPGRLYDLDASKYGTHAELKSLTAAFHAKGVQCVADVVINHRCADYKDGRGIYCVFEGGTPDSRLDWGPDMICSDDTQYSNGRGHRDTGADFAAAPDIDHLNPRVQQELSDWLNWLKSDLGFDGWRLDFAKGYSAAVAKVYVDSTAPTFVVAEIWSSLHYDGNGEPSSNQDADRQELVNWAQAVGGPXAAAFDFTTKGVLQAAVQGELWRMKDGNGKAPGMIGWLPEKAVTFVDNHDTGSTQNSWPFPSDKVMQGYAYILTHPGTPCIFYDHVFDWNLKQEISALFAVRSRNGIPPGSELNILPADGDFYVAKIDDKVIVKIGSRYDVGNLIPSDFHAVAHGNNYCVWEKPGLRVPAGRPP

SEQ ID NO: 9189 - protein, 473 aa, Bacillus megaterium
GAMTIKEMPQPKTFGELKNLPLLNTDKPVQALMKIADELGEIFKFEAPGRVTRYLSSQRLIKEACDESRFDKNLSQALKFVRDFAGDGLFTSWTHEKNWKKAHNILLPSFSQQAMKGYHAMMVDIAVQLVQKWERLNADEHIEVPEDMTRLTLDTIGLCGFNYRFNSFYRDQPHPFITSMVRALDEAMNKLQRANPDDPAYDENKRQFQEDIKVMNDLVDKIIADRKASGEQSDDLLTHMLNGKDPETGEPLDDENIRYQIITFLIAGHETTSGLLSFALYFLVKNPHVLQKAAEEAARVLVDPVPSYKQVKQLKYVGMVLNEALRLWPTVPAFSLYAKEDTVLGGEYPLEKGDELMVLIPQLHRDKTIWGDDVEEFRPERFENPSAIPQHAFKPFGNGQRACIGQQFALHEATLVLGMMLKHFDFEDHTNYELDIKETLTLKPEGFVVKAKSKKIPLGGIPSPSTEQSAKKV

SEQ ID NO: 9190 - protein, 301 aa, marine gamma proteobacterium HTCC2080
MSSPKHFLTLRDLTSDELRGIISRANELKTQQREGIPHAGYPGKVLAMLFSKASTRTRVSFEVGMRQLGGSALFLSSADTQLGRGEPVEDTARVLSSMVDLVMIRTHDHNSVERFADVASVPVINGLTDDYHPCQLLADMQTWFEHRGDIQGRRVCWLGDGNNMCHSYINAARLLDFELVVACPDGYQPASQLVSENSDRVHIVHDPREAVQNADLLVTDVWASMGQEDEQQARSAAMAPYQLNRKLLELAAPEALYMHCLPAHRDEEISAELMAAPDTVIWDEAENRLHAQKALIEFLLN

SEQ ID NO: 9191 - protein, 224 aa, Zea mays
KRTRWRPRRGFPPRRWRWTTRRGPGAVDKPRFDALTPNEMSGGRPQFRKVPVPQHRFAPLKRCWMEIYTPVYEHMKIDIRMNLKARRVELKTRQDTPDVSNLQKCADFVHAFMLGFDIADAVALLRLDDLYVDSFEIKDVKTLRGEHLSRAIGRLSGKGGKTKYAIENSTRTRIVIADTKIHILGSFVNIKVARDSLCSLILGSPAGKVYSKLRAVSARLAERY

SEQ ID NO: 9192 - protein, 468 aa, Rickettsia typhi str. Wilmington
MSFLRKKSFESVKEIGSSSGLSKTLGAFDLILLGLGAMIGTGVFVVTGIIAAKFSGPAVMISYMIAGITCIFVALVYTELAAMLPTSGSIYTYSYVAFGEVFAWMIGSVIILELGVSAGIVAAGWSGYVQGILEAGGIYLPKVLTTVPSNGGVINLPAFLISAFIGFILFLGTKDSKKINAILVFIKMAAIFAFVLASAPHFDATNWSNFMPFGFGSVVMGSSILFLAFTGFGTIATAAEECKNPKRDILIGIIGSLILTTLVYVIMSGLVTGIAPFDQLNNDRPLAYALTINNSKIGSAIVSTGAVCGMMTVLMMNIYGTSRIFYAIARDGLLPKSFAKLHPKYDSPYITIIIFSALAAFLGGFCPTEIITQLTSMGALIDYIVVAIIVMMFRIKLPTAQRSFKCPIVFIIAPFILLACIYLLLTQMYGDEIYKGNFNLLTSGRVLIYWFITIFVLYLIRSFFMKKE

SEQ ID NO: 9193 - protein, 391 aa, marine gamma proteobacterium HTCC2080
MSAVMRTYKQLPVAFVRGRGATLWDSQGKPYLDGLSGIAVTNLGHCHPRVTQAIEEQARELVHTSNLFRIPGQEQLGAELIAATAMDTAFFCNSGAEANEVAIKLARRYGHDRHVKTPTIVVLEGAFHGRTLGALAATAGEGMRKPFEPMVPGFIRIAPGDIEGLNSLTSQKDIVAVLVEPVQGEGGVRPLSREYLGALRSLCDQQNWLLMFDEVQTGNGRCGALYAYQRLGVIPDVLTTAKGLGNGYPIGACLAKGEASSALRAGDHGTTYGGSPLACAAASAVVNTLADPHLLARADVIRDHILKAFGDHLANPAHVVEIRGLGLMLGIEVSVPATGLVSAALEQGTIINVTAGNTIRLLPPLVMSNDEAHQLGHSVAEIINQAPEIAA

SEQ ID NO: 9194 - protein, 356 aa, Medicago sativa subsp. x varia
MKKGNLGLGLKLSVPQTDQVAFAKFLTESGTFKDGDLLVNRDGVRIVSETEVEAPPPIKATDNQLSLADIDIVKVVGKGNGGVVQLVQHKWTNQFFALKIIQMNIEESVRKRIAKELKINQAAQCPYVVVCYQSFYDNGVISIILEYMDGGSMADLLKKVKTIPEPYLSAICKQVLKGLIYLHHERHIIHRDLKPSNLLINHTGEVKITDFGVSAIMESTSGQANTFIGTYNYMSPERINGSQRGYNYKSDIWSLGLILLECAMGRFPYTPPDQSERWESIFELIETIVDKPPPSAPSEQFSSEFCSFISACLQKDPGSRLSAQELMELPFISMYDDLHVDLSAYFSDAGSPLATL

SEQ ID NO: 9195 - protein, 117 aa, Candida glabrata CBS 138
MFSRLVPRLATRALIPSTVIARPMLVTPMLMRQYSVKSKDEISQKLIEVVKNFVKGESSQNVTADSKFHKDLGLDSLDTVELIVSIEEEFDTEIPDDVADRLTSIRETIDYLASQKN

SEQ ID NO: 9196 - protein, 340 aa, Pichia anomala
MSHKASDEHHVDTDLITLSRFILTSQQKVAAQATGELTLLLNSLQFAFKFIANNIRKAELVNLMGLAGASNSTGDAQKKLDVIGDEIFINAMKASGNVKVLVSEEQEDLIVFDGPGNYAVVCDPIDGSSNIDAGVSVGTIFGIYKLLPGSKGSIKDVLRPGTEMVAAGYTMYGASAHLMLTTGQGVNGFTLDASLGEFILTHPNLTISDEKHIFSVNEGNTTYWTPEVQQFIADLKKPQFNGKPYSARYIGSMVADVHRTLLYGGLFAYPADAKSKAGKLRILYECFPMAFLFEQAGGKAVTDNGDRILELKPKAIHDRSGIWLGSKVEIDRFLKATGKI

SEQ ID NO: 9197 - protein, 163 aa, Gloeobacter violaceus PCC 7421
MLRSIELRALAASPTRNLTIVIDEPIAALPSLTPVQGELAVVHHGDFLEVTGRAQTIVTLACDRCLQHFNHRLVTDFEEVIWLEDASVEVPLELEVPPAHLDELLPRDGRLDPVDLIYQHLCLELPVRNLCSEQCQGVKTAQPEEQSLDRRWAALARLREELG

SEQ ID NO: 9198 - protein, 244 aa, Oryza sativa Indica Group
MAPAGCCLLLVLLIAAGGRAAANSAAAVATTNNKPQQLVQSTCNSTTYYDVCVAALAADPSISTAADVRGLCAIAVSAAATNASAAGASLLASAAAYQSQPQAPLLRACAARYADARQALISAQEAIKEEAYDYAFVHVSAAAQYPTMCRALFRRASSQQRAYPSDLAKREEDLIRCPIAVWSCCRHLPACVAGEAGGVEVNIFQIVARVHNKLRMTVRELRARMATGVHRSTFLYVQDQANAS

SEQ ID NO: 9199 - protein, 183 aa, Oryza sativa
MEKCPNWKFVWENKAPMKVQFFAWLLTKDRFPIKRNLHKKTIVPAPTCELCNSADETALHLCFQCPFAVTFWSAMNIPSQPDGKHSSDVLPVPALSQPSSSSRLRIFSGTANPTLAQEVAFYLGMELGRVKIKRFTDGGSVRGCDMFLVQATCPPPNENLMELLIMIDGRPPRILRFGRQQQH

SEQ ID NO: 9200 - protein, 234 aa, Nocardioides sp. JS614
MSNERRDQLAANLETVRDRIAAACADAGRDPADVRLVVVTKFFPASDVRLLAELGVTDVGENRHQEAESKAAECADLGLRWHFIGGLQSNKAAAVAEYADVVESVDRLKLVGPLGRGAQRRDVPVEVLLQVSLDPPGAEGRSGADPADLPALAGAVEQAAGLRLRGLMAVAPLGEDPAAAFARLADLRRDFLLERPDATWLSAGMSADLEDAVRVGATHVRIGSAVLGSRPRFK

SEQ ID NO: 9201 - protein, 363 aa, Dechloromonas aromatica RCB
MSDDLQKALAGVRTDIDRIDGELLKLLNERARCAQRVGEIKAEHGEAGHIYRPEREAQVLRRLQEANPGPLPGENITFFFREVMSACLSLEEPLGIAFLGPLGTFSESAATKHFGHAARLLPQSSIDDVFREVESGHAHYAVVPVENSTEGAVGRTMDLLLATPLKICGEVVLRIHQNLLTNETDLGKITKVYSHAQSLAQCHEWLNRVLPKAQRISVGSNAQAAQNAAAEPGTAAIAGEAAAARYNLPKLVENIEDEPNNTTRFLVLGKHDSGISGRDKTSLIMSAPNRTGALHELLLPLSTAGVSMCRLESRPARNALWEYVFYVDIEGHRDEPAIKAALEKLAGYAAYLKILGSYPVAVY

SEQ ID NO: 9202 - protein, 282 aa, Zea mays
  misc_feature (238)..(238): Xaa can be any naturally occurring amino acid
  misc_feature (257)..(257): Xaa can be any naturally occurring amino acid
  misc_feature (260)..(260): Xaa can be any naturally occurring amino acid
  misc_feature (270)..(270): Xaa can be any naturally occurring amino acid
MATTDAAAAAAPAPAVSLDETKAKNVLRQVEFYFSDSNLPRDGFLRKTVEESEDGLASLALICSFAKMRSHLGLDATVKEDGVPETTVLAVAKVLRCSAALRVSEDGKRVGRANKLLKPDEIIVQIDSRSIAVSPLPHNVKLEDVQSFFAQYGKVNSVRLPKHVSDKRQFCGTALVEFSEEDEANNIMNNKLSFAGADLEIKTKKEFDAEMEAKKEAYEKSHPNTHANKNGHDEGYPXGLILSFKLKRILADGDTEXNGXDKVDNSDDAXEGRFRLFGGIGE

SEQ ID NO: 9203 - protein, 230 aa, Glycine max
ICSTVEFLPWRSWEVISGGLDSMLMLWDFSKGRPYKVVDFATFDVSSGIAGRCVNPAFVHAIAIPEVDMLDKLDKICAVARGDGAIDVINIETEMAATKSKSSSNSRKGSHSRSKDGSSSSNTDADQNGKKRLHLDYTLGGHTAAVSSLAFSLFGERGKFLISGGNDKLVKVWNLSCYPDAGLSDDNNNNILHLNIEVPRKVNWLCTTSADTDNLVVCDTSKVVKVYSIT

SEQ ID NO: 9204 - protein, 371 aa, Idiomarina loihiensis L2TR
MSLHSTEEIIEDIRQGKMVILMDDEDRENEGDIIIAAECVTPETINFMARYGRGLICLTLTEERCEQLNLPLMVDKNNAPYATSFTVSIEAAEGVTTGISAADRAKTVLDAVKKDAKPEDLVMPGHIFPLKAKSGGVLNRAGHTEAGCDLARLAGFEPAAVIVEVLNEDGTMARRADLEAFSEEHGIKVGTIADLIEYRSIQEKTIERVAECNLPTAFGKFRLITYQDTIDEQVHYALVHGDLSQDKVTNVRVHLQDTFHDTFLTERAAKRSWPIQKAMSYIAEHDGVLVIIGRQQTPESIIAQVCEFEAQDKGEQKPTTSASNASRNVGLGSQILADLNIHKMHLMSSPKRYSALSGFGLEVVDFIEDKD

SEQ ID NO: 9205 - protein, 334 aa, Dechloromonas aromatica RCB
MILVTGGAGYIGSHTCVELLNSGQDVVVFDNFCNSHPESIKRVEAITGKKIAVVKGDIRDQAAVEAALRQYDCQSVIHFAGLKAVGESVEKPLAYYDNNVIGTHKLLQAMSNCGIKTLVFSSSATVYGEPQFLPLTEQHPLSGTNPYGRTKLVIEDMLRDLYRSDSSWRIGILRYFNPVGAHESGLIGEDPQGIPNNLMPFVAQVAVGRRERLSVWGNDYPTPDGTGVRDYIHVVDLAIGHLKALACLSESRCFEVNLGTGTGCSVLDVIKAFESASGRPIPYELAPRRAGDVASCYADPAFAAELLQWRAERNLEVMCVDAWRWQSNNPNGFR

SEQ ID NO: 9206 - protein, 291 aa, Oryza sativa
MKFSISYPTNGTTKSFEIDDDNRCRIFFEKRMGQEVEADTLGDEFKGYVFRINGGFDKDGFAMKQGVFCNNRIKLLLAPGTSGYRAKRKGEKKRKSIRGCIVGPDIKTLSLALIKKGEKEIPGLTDETKNRRLGPKRASGIRKLYGIEKIEGEKTSLTSCALIKKHAIRRTFKSKKNVEAARHKAPKVQRLVTESRLRRKRIQKEDKVKRSKRNQALTEEYKKVYDAFASERRAEDKQRKASKVSAHGETKPVEGKPVVPVKPTGVKAAAPAKAAAPKATPVVSPAKPTKH

SEQ ID NO: 9207 - protein, 523 aa, Medicago truncatula
MLVELAVTLLVIALFIHLRPTPTAKSKALRHLPNPPSPKPRLPFIGHLHLLDNPLLHHTLIKLGKRYGPLYTLYFGSMPTVVASTPDLFKLFLQTHEATSFNTRFQTSAISRLTYDNSVAMVPFAPYWKFIRKLIMNDLLNATTVNKLRPLRSREILKVLKVMANSAETQQPLDVTEELLKWTNSTISTMMLGEAEEVRDIARDVLKIFGEYSVTNFIWPLNKFKFGNYDKRTEEIFNKYDPIIEKVIKKRQEIVNKRKNGEIVEGEQNVVFLDTLLEFAQDETMEIKITKEQIKGLVVDFFSAGTDSTAVATEWTLAELINNPRVWKKAQEEIDSVVGKDRLVDESDVQNLPYIRAMVKEVFRLHPPLPVVKRKCTEECEINGYVIPEGALILFNVWQVGRDPKYWEKPLEFRPERFLENASQGEGEAASIDLRGQHFTLLPFGSGRRMCPGVNLATAGMATLLSSIIQCFDLQVPGPHGQILKGDDVKVSMDERPGLTVPRAHNLMCVPLARAGVAAKLLS

SEQ ID NO: 9208 - protein, 508 aa, Oryza sativa Japonica Group
MAVSSFSFLELLLSFLCFGFFYYYHVKSKQKNPVIPLQWPLVGMLPALLANCNHLHEWITSVLTVTPLNFRFIGPPSSDMRLFITSDPANIRHVFNTNFSNYPKGREFQEIFDILGDGIFSADGESWRRQRTKAQLLMSSPRFRAFVARYSRDKVEKALLPLLAHVAGTGDACNLQDVFLRLTFDTTTTLVFGVDPGSVAIDLPEVPFARAMDDAMTMLLLRHIVPLSWWRLARRLGIGYERKMPVAWRTMDRFVADTIAKRRAEKARTGIDDSADLLSSYINDDEEDAGTVDAFLRDTTINLMLAGRDTTGSALSWFFYLLTKNPRVLHKLLQELDSVKSTTAADGMVIFDPDETGRLVYLHAALCESLRLYPPVPMEHKGPAAADVLPSGHEVRPGDKIVVSLYAMGRMESVWGSDCMEFRPERWISDDGKLRYVPSYKFMSFNSGPRTCLGKDMAFVQLKTAAAAVMKNFEIEAVAGHVVEPKLSIILHMKNGFMVRVKRRLAVC

SEQ ID NO: 9209 - protein, 250 aa, Zea mays
MPISRIAVGTHHEVYHPGALKAALAEFISTLIFVFAGQGSGMAFSKLTSGGATTPSGLIAAAVAHAFALFVAVSVGANISGGHVNPAVTFGAFVGGNITLFRGLLYWVAQLLGSTVACFLLRFSTGGLATGTFGLTGVSVWEAVVMEIVMTFGLVYTVYATAVDPKKGSLGTIAPIAIGFIVGANILVGGAFTGASMNPAVSFGPALVSWEWGYQWVYWVGPLIGGGLAGVIYELLFISQTHEQLPTTDY

SEQ ID NO: 9210 - protein, 430 aa, Onion yellows phytoplasma OY-M
MPYIESILAREVLDSRGNPTVEVEVYTESGAFGRAIVPSGASTGQYEAVELRDGDAQRFLGKGVLQAVKNVIEVIQPELEGYSVLEQTLIDKLLIKLDGTPNKSNLGANAILGVSLACAKAAANYLNLEFYQYVGGVLPKQMPVPMMNVINGGAHASNSVDFQEFMILPTGPTSFKEALRYGAEVFHHLGKILKQKGLPTTVGDEGGYAPDLNSNEEALQIILEAIKSAGYEPGKDIFLGMDVAASEFYDKKLQKYVLASENNKAFSSQELVHYYETLVSKYPIISIEDGLDENDWDGWKYLTQKLGNQIQLVGDDLFVTNTQKLAQGIENKIGNSILIKLNQIGTLTETLETIEMAKKASYTAVISHRSGETEDTTIADLAVATNAGQIKTGSCSRTDRMAKYNQLLRIEDQLVEAPFLGLKTFYNLKK

SEQ ID NO: 9211 - protein, 436 aa, Anaplasma marginale str. St. Maries
MLYHQRFRVPLAKQFMNDTTSVTRLENNFSVVSEKVDGVNSVGISIWVKTGSRHEEKEKIGLAHFLEHMAFKGTDTRSALDIAMAFDCIGGNFNAYTDKEHTVYHVKVMKRDVHIALEVLEDIVLRSAFPEVEIEREKNVVLQEIYQTNDSPGSIIFDKYMEVAYKGQIFGAPILGSEQSVLGLSRADLVQYMSANYYGNNMTLSVAGDIAHEDVVRMSQGFAQIQDRNPQPVAPPVYTGGQYIEARDLDQVNIVIGFPGVSYLDERYYTMQVLDVILGSSMSSRLFQEIREKRGLVYSISSFNSSYSDSGLFSIHAATDEGNLQELLKTIAAEMKKLPETVKEEELLRAKSKLESEVLMSRESTVGKSEALGYCYSHYNKYITKEEMISKIRAVNLGDVINSADLLLQNRGKLTVAAIGKVGPLPSLETISNMLA

SEQ ID NO: 9212 - protein, 290 aa, Magnaporthe grisea 70-15
MSLSKVLSGKGGVGKSSVTTQLALSLSLAGHSVGVLDVDLTGPNIPRMFSVEDAKVTQAPGGWLPVPVHESNPASNTGSLRVMSLGFLLRDRGDAVVWRGPKKTAMVRQFLSDVLWGDLDFLLVDTPPGTSDEHISLAETLLQKTVPGQLAGAVVVTTPQAVATADVRKELNFCKKTAIPVLGVIENMSGYICPCCGEKTNIFMSGGGEVMANDFGVKFLGRIPIDPVFVELIETGRRPRYQAPAKPDPEAASESEARDPGLLVEKYTDSILAPIFGNIAAELIRGVSSG

SEQ ID NO: 9213 - protein, 309 aa, Ralstonia solanacearum GMI1000
MADILAYGEALIEFNQTDPGSAAWALGYGGDTSNFCIAAARQGARTGYVSAVGADRFGQALRTLWQAEGVDHTWVQTDLQAPTGLYFVSHDARGHHFDYLRAGSAASRFQTAQLPLQAIAAARVFHLSGISLAISDTACDAGLAAMAHARAAGVTVSFDTNLRLRLWPLARARAVMREAMRTCDLCLPSWDDVTVLLDCHDRDAIVDTLLGWGIRLVALKMGVEGCYVATPEARTLVPRHPVAAVDATGAGDCFGGAFVARIVAGDTPQDAARYANVAAALSTTGYSAVAPIPRAEAVRAALAGAAAAL

SEQ ID NO: 9214 - protein, 512 aa, Onion yellows phytoplasma OY-M
MTKKFVGLTILDGLGLTDQKENNAFHLAKTPYLDYLLKNFPNTTLKASGEEVGLPQGQMGNSEVGHLNLGAGRVVYQSLTQINKAIRDKSFFTNKQFLQAIEHVKKNNSKMHLLGLISDGGIHSHLDHFKALFDLLKENNLANNTFLHAFTDGRDTSPHSGINYIKDLLDYGFNIASVVGRYYALDRDNNWNRINLVYNMLTSKQAPVIDLPLEDTIQNFYNQGITDEFITPFITNPNGLINDNDAVIFVNFRPDRAMRLATALSNPCATNAFCSEGKTNFCGTKLLNNLFLVTMTKYSAQVKSVVAFEKITLKNIYGEVIANLGMHQLRIAETEKYPHVTFFFDGGKELQLKNADRILIPSPKVKTYDLKPEMSALEITTHAKTAILSGKYDTLILNFANPDMVGHTGFLDATIKAIQTVDSCLKEVLNAIFAVKGKACIVADHGNAEQMTDNQGNPHTAHTTNLVPFIVTDKNVVLKPGSLCDVAPTMLDLLEIKKPQEMTGNSLIKKLV

SEQ ID NO: 9215 - protein, 236 aa, Zea mays
MAGGGDELKLLGTFASPFVMRAKLALSFKGLSFEDVEEDLANKSQLLLESNPAEKKVPVLIHNGKPVCDSRVIVQYIDEAFSGNGAPLLPADPYERAVARFWAAYVDDKLLASWLQAARGKTEEEKAEGLKQTLVAVETMEAAFKTCSKGKPFFGGDRVGYLDVTLGGLVVWVHAGAALYGMRLFDDAKSPFLAAWVERFGALDAAKAVLPAVERVVEFAKMRQAQAAAPATAGGN

SEQ ID NO: 9216 - protein, 446 aa, Onion yellows phytoplasma OY-M
MNKTKIICTLGPASYDKNILQALIQTGLNVARFNFSHAQYEQTKLLMKTIKTISDKLDKNTGLMLDTKGPEIRTHEFDGVVTIQKDSEVKISMTEVLGNAKLFSVSYSNLYNELKVGDMVNIDDGYLSLEVVGKDEAKQQLVTKAKNTHSIKSRRGVNVPKVNLEMDFISPKDYQDIVFAAQQDFDYIAASFVRRAQDVKDIRKILQEQGNSNIQIISKIENQEGVDNLEEIIQESDGIMVARGDLGIEVDGELVPLYQTRMITKCLEYGKPVVVATQMLESMQRNPRPTKAETSDVFNAVREGTTFTMLSGESASGEYPVEAVTYMKKINYQAEKVVNYQALSQVYQPKNSKENLLLSAVELALRTDVKAIVVYDLKDAYNVSKFHPSVPVLALVKTEQEARRLVLNFGVCPFVSETKLQTKLEELTQNQSSNCLVVKDGMLYFK

SEQ ID NO: 9217 - protein, 317 aa, Pyrococcus abyssi GE5
MVVSLKGRDLLCLQDYTPEEIWTILETAKMLKIWQKIGKPHRLLEGKTLAMIFQKPSTRTRVSFEVAMAHLGGHALYLNAQDLQLRRGETIADTARVLSRYVDAIMARVYDHKDVEDLAKYASVPVINGLSDFSHPCQALADYMTIWEKKGTIKGVKVVYVGDGNNVAHSLMIAGTKLGADVVVATPEGYEPDEKVIKWAEQNAAESGGSFELLHDPVKAVKDADVIYTDVWASMGQEAEAEERRKIFRPFQVNKDLVKHAKPDYMFMHCLPAHRGEEVTDDVIDSPNSVVWDEAENRLHAQKAVLALLLGGVKTGF

SEQ ID NO: 9218 - protein, 381 aa, Zea mays
MASPTQGQVITCKAAVAYEPNKPLVIEDVQVAPPQAGEVRVKILFTALCHTDHYTWSGKDPEGLFPCILGHEAAGIVESVGEGVTDVQPGDHVIPCYQAECKECKFCKSGKTNLCGKVRSATGVGVMMNDMKSRFSVNGKPIYHFMGTSTFSQYTVVHDVSVAKINPQAPLDKVCLLGCGVPTGLGAVWNTAKVESGSVVAVFGLGTVGLAVAEGAKAAGASRVIGIDIDNKKFDVAKNFGVTEFVNPKEHDKPIQQVLVDLTDGGVDYSFECIGNVSVMRAALECCHKGWGTSVIVGVAASGQEIATRPFQLVTGRVWKGTAFGGFKSRTQVPWLVDKYMKKEIKVDEYITHNMNLADINDAFHLLHEGGCLRCVLAMQI

SEQ ID NO: 9219 - protein, 385 aa, Magnaporthe grisea 70-15
MSSQPEHPTLLIPGPIEFDDAVLQSMSHYSESHVGPAFVNVFGETLTLLRKLFQTTDSGSQPFVISGSGTLGWDLVSANLVEAGEDVLVLGTGYFSDGFADCLRTYGANVTELKAPVGSRPQLPEIEKALSAKKYKVLTVTHVDTSTGVLSELKDLSAMVHKVSPETLIIADGVCSVASEEIAFDEWGLDGVITASQKAIGCPAGLSISMFSSRAIKAFEARKTPPASYFASMKNWLPIMRNYEAKKPSYFATPSPQLIHALHTALTQIMSRPLAERFAKHKEASSKIKKAIADLGLKQVASNPADQANGMTAVYLPESVKPTDILPKLFSKGVIFAGGIHKEIAPKYIRFGHMGVSVLNPERGDLDRAIKALESGLSECGYQKA

SEQ ID NO: 9220 - protein, 96 aa, Zea mays
LGVSLAVCKAGAAEKGVPLYRHIADLAGNPDLILPVPAFNVINGGSHAGNKLAMQEFMILPVGASSFKEAMRIGAEVYHHLKGVIKAKYGKDATMW

SEQ ID NO: 9221 - protein, 460 aa, Klebsiella pneumoniae subsp. pneumoniae MGH 78578
MATGKIVQVIGAVVDVEFPQDAVPRVYEALEVQNGNEVLVLEVQQQLGGGIVRTIAMGSSDGLRRGLDVKDLEHPIEVPVGKATLGRIMNVLGQPVDMKGDIGEEERWAIHRAAPSYEELSSSQELLETGIKVIDLMCPFAKGGKVGLFGGAGVGKTVNMMELIRNIAIEHSGYSVFAGVGERTREGNDFYHEMTDSNVIDKVSLVYGQMNEPPGNRLRVALTGLTMAEKFRDEGRDVLLFVDNIYRYTLAGTEVSALLGRMPSAVGYQPTLAEEMGVLQERITSTKTGSITSVQAVYVPADDLTDPSPATTFAHLDATVVLSRQIASLGIYPAVDPLDSTSRQLDPLVVGQEHYDTARGVQSILQRYQELKDIIAILGMDELSEEDKLVVARARKIQRFLSQPFFVAEVFTGSPGKYVALKDTIRGFKGIMEGEYDHLPEQAFYMVGSIDEAVEKAKKL

SEQ ID NO: 9222 - protein, 278 aa, Oryza sativa
MDGVVAASADATRDEIKIMNVYIWDMDETLILLKSLLDGSYAGAFDGLKDHDKSVDIGKRWENLILELCDEHFFYEEIENYNEPFLSAVKEYDDGKDLTTYDFEADCFSSPYDDLNKRKLAYRHRAIGEKYTKGLEKILDHHMIKVWNDLYSATDKYTDGWLSSAHKLLEEAMGKSTAESTSQHSSINCIVTSGSLIPSLAKCLLYRLDDVVAFENVYSSWEVGKLQCFKWIKERYDGPNVRFCAIGDGHEECTAAQIMKWPFVKIEFHPDAPHRFPG

SEQ ID NO: 9223 - protein, 472 aa, Rhodobacter capsulatus
MASKGKVTQVIGAVVDVQFEDGLPAILNALETTNNGKRLVLEVAQHLGENTVRTIAMDATEGLVRGAAVSDTGGPITVPVGNATLGRILNVIGEPVDERGDVSKAEARAIHQPAPDFAAQSTESQILVTGIKVIDLLAPYSKGGKIGLFGGAGVGKTVLIMELINNIAKVHSGFSVFAGVGERTREGNDLYHEMIESGVINLEKLEESKVALVYGQMNEPPGARARVALTGLTLAEQFRDQSGTDVLFFVDNIFRFTQAGSEVSALLGRIPSAVGYQPTLATDMGALQERITSTKAGSITSVQAIYVPADDLTDPAPATSFAHLDATTVLSRAISELGIYPAVDPLDSTSRILDPQVVGEEHYQVARDVQGMLQRYKSLQDIIAILGMDELSEEDKLTVARARKIQRFLSQPFDVAKVFTGSDGVQVPLEDTIKSFKAVVAGEYDHLPEAAFYMVGGIDDVIAKAQRLAAAA

SEQ ID NO: 9224 - protein, 508 aa, Rhodococcus sp. RHA1
MTAIPHYTQFIDGQWVDTDRTFDIIDPANGELVATAARGSVENLDQAVAAAKAAHARGEWRTKTPDERADILSAIVADLSERMEELVALHVKENGVTIRQAMAFHVGYSISHLQYFADLARTYEFERSGPQLSYPTLASGIVRREPIGVVAGIVPWNFPLLLAVWKLGPALAAGNTIVLKPDEKTPLTLLELAKSAERAGLPKGVLNIVTGAGEEVGARLAAHPDVRKIAFTGSTAVGREISKLAAENIKKVTLELGGKGPNIVLADADIDSAVDGALFACFLYAGQACESGTRLLLPESLHDEFVDRLVQRAATIKVGDPSEFDTDIGPVISAEQHARILDYIEIGQKEGATLAFGGEPPTGTQFEQGHWVRPTIFTDVTPDMRIAREEIFGPVLSVLKYRTVDEAVAIANDSEYGLSAGVWSEDLEAALVVAARIESGTVWINDWHMVNALYPFGGYKQSGNGRELGPHALDEYTEEKFVHVDLSRSVDRKVYDLVLPAAQAAVNR

SEQ ID NO: 9225 - protein, 367 aa, Rhodococcus sp. RHA1
MSRARVALFEAPDEKLTVVDVQVGPLAEDEIRIRVAGVGICHTDLTALRGGVPLPLPAVLGHEASGIVEEVGAEVTALVPGDHVVVSFDSCRTCTQCTSGRPAYCELFAALNYFGTRLDGSTTMSRDGEPVHGNWFGQSSFGTHAVASARNAVKVDESLPLQLLGPLGCSLQTGAGTVMSVLRAKPGQSIAVFGLGAVGLSALMAANALGCTPIIAIDPNPERLNLATELGATHTLDPSAIDDIVWAVTDISANGVDFSVDAVGLESVVQQALGVLRSPGICATLGLQGLENEVRIDQGHLLLGRTLTGVIEGDVDPHQFIPQLVDLWKNGQFPFDKLIETYTLPEINEALAAAAAGSVIKPVIVFD

SEQ ID NO: 9226 - protein, 227 aa, Ralstonia solanacearum GMI1000
MPSGDASADPIEARFDPAAMPARMAAALDAMRLGIPVVVLDDADRENEADLIIAADRLTHAGMAMLIRECSGIVCLCLTAEKAAVLGLRPMVEHNRSQYGTAFTVSIEARVGVSTGVSAADRITTIRAAVAPDADAQSVVSPGHVFPLVAQAGGVLARRGHTEGSVDLARLAGLSPAGVLCELMLPDGTMARRDDAVRFADQHGLPVLTIEDIARYREQMARAVSFA

SEQ ID NO: 9227 - protein, 386 aa, Mycobacterium sp. JLS
MTSTVPDTDRAVDPLEDYLALCKETCDREIERLYSSGRPGSGFEALLLDYPRRGGKALRPALSIAVCLGLGGQLDAILPTAATLELYHNAFLIHDDIEDESWWRRGKPTMHIDHGIPIAVNVGDAMLSLSLQPLLDNVERIGLGPALRILRAVAHMTRRTVEGQAIELEWVRSNAWRLDDADYLTMVELKTSWYSFITPLQAGAIAAGVDPNRLEPLESLGRHLGAAFQITDDLLNLRADPEEYGKEIGGDLWEGKRTLMLLHTLRTAQPQDRIRALQILARRRPAGLEAGLAGLLDRLTARGELSPTGRAEIAARFDTAEAKSLDDIQWLYELMHDVGSLGHAREVAARHAQQAAAVLAGLDWFPPSRHREALTHLVDYVHGRTR

SEQ ID NO: 9228 - protein, 222 aa, Triticum aestivum
MGQQSLIYAFVARGTVVLAEYTEFTGNFTTIASQCLVKLPASNNKFTYNCDGHTFNYLVEDGFTYCVVAVESVGQQMPIAFLVRVKDDFSKRYAGGKAATAAPSSLNREFGSKLKEHMQYCVDHPEEINKLAKVQAQVSEVKNVMMENIEKVLDRGEKIELLVDKTENLRSQAQDFRQQGTQVRRKMWLQNMKIKLIVLGIIVALILIIILSVCHGFNCGKK

SEQ ID NO: 9229 - protein, 257 aa, Rhodococcus sp. RHA1
MPASLEGKVVIVTGSGGGIGAVIAARFAKEGARVVVSDRHRGAAEAVVSRIPGASAIPADVTREQDVSALIERTVEEHGALHHVVANAGIISASHPIAQTPLDVWRSTMSVNLDGVFLTIKHSAAAIANSGGGSILTLSSISGTGGTPLAAAYGASKAAVRNLTATAAGELRAQNVRVNALVPGYVDTPLIDSEVPVWESTMGLAPGGFAQVIDQKQGRLISPEDIADAALFLTSDQASMITGSALTVDGGFTSQLF

SEQ ID NO: 9230 - protein, 428 aa, Glycine max
MPMCSRLLDSRTKCRASAPTIFAPLFFSLFLTSSAACFNGNCQVLEACTAATDCGPGLYCGNCPALGRTRPVCTRGQATIVTSLVNGLPFNKYSWIMTHNSFSIVDAPPLPGGVQRLTFYNQEDTVTNQLRNGARGLMLDMYDFENDIWLCHSFRGQCFNFTAFQPAINTLREVEAFLTQNPTEIVTIVIEDYVHTPKGLTNLFRNAGLDKYWFPVSDMPKKGEDWPTVTEMVQVNHRLLVFTSDASKEAEEGIAYQWSYMVENESGDPGVEGGSCPHRKESKPLNSRSASLFLQNYFPTDPVEADSCKEHSVPLVDMVNTCYKAAGNVLPNFLAVNFYMRSDGGGVFDIVDKMNGHSLCGCNTISACQEGAPFGSCKNIAVPNTSPVTNTAGSFTGSVQFSRSASPVHSPNCWCFLVFYFLLIAVLL

SEQ ID NO: 9231 - protein, 447 aa, marine gamma proteobacterium HTCC2080
MQREVELFLKAYPSVEMIEALITDCNGVARGKWIPRGKIQSILDDGLKLPKSALGLDIWGRDIPELAHANGDIDGYCMAVEDSLKPVLTPRGTDQGQLIMTMVDETGAPYMGDPRQILAKVLEGFSERNLKPCMAAELEFYLLPDPGRDKPLRESLDSLDTLGGNLYALNELDHHSEMLDLLRETFKTQDLPYEGIIKESAPAQFEINMAHSDNVMLMADQIIRMQRCIRRVASQCNLIASFMPKPLDNEAGNGMHIHCSVLEERGLNIFNDGNDEGSPLLKQAIAGCLELMPDSMLIFAPSFNAYRRFQAGNHAPTVPTWGYDNRTTALRVPSGPQAALRIEHRVAGADANPYLVMAVMLAGILHGLENKMEPPAAIEGNAWDMKHDTPDLPCLMNVAVEKFLNSPLIEKYLSAEFQLLYGKTKEQELNEFQRRVTDFEIESYLRG

SEQ ID NO: 9232 - protein, 328 aa, Zea mays
MASAAAPPTSLSLAARAASRAAAAPLRRGGLAAARQPARSLAFAAGDARLAVHVASRCRQASSARGTRAMATMAKKSVGDLTEADLKGKRVFVRADLNVPLDENQNITDDTRIRAAIPTIQYLLGKGAKVILSSHLGRPKGFTPKFSLAPLVARLSELLGIQVQKADDVIGPEVEKLVAALPNGGVLLLENELDYLVGAVSSPTRPFAAIVGGSKAKEKGVSLMLPTDVVIADKFAPDANSQIVPASAIPDGWMGLDIGPDSIAAFNAALETTQTVIWNGPMGVFEYDKFAIGTEAVAKKLAELSRKGVTTIIGGGDSVAAVEKPLEM

SEQ ID NO: 9233 - protein, 200 aa, Rickettsia typhi str. Wilmington
MSVFVGKTAPDFTAKAIMPNNNIDDKFKLSDYAAGDNVVLFFYPLDFTFVCPSEIIAFHNKLGEFTERRTKVIAVSVDSHFSHLAWKNTPHNKGGLGQIQFPMISDITKDISSKYNVLNEDGIALRGTFLIDKDFIVRHMLVNDLPIGRDINYTLKVIDALTHHQKHGEVCPAGWHKGEEAITPSHEGIAHYLSSHAEKL

SEQ ID NO: 9234 - protein, 1554 aa, Oryza sativa Japonica Group
MAKATTGICLVDVILFSFFLVAPRAFAAAAAVTDTLRGGRNITDGETLVSADGTFTLGFFSPGVSAKRYLGIWFTVSPDAVCWVANRDSPLNVTSGVLAISDAGILVLLDGSGGGHVAWSSNSPYAASVEARLSNSGNLVVRDASGSTTTLWQSFDHPSNTLLPGMKMGKNLWTGAEWDLTSWRSPDDPSPGAYRRVLDTSGIPDVVLWQDGVERYRSGPWNGRWFSGNPEAATYTTNLITFQVTVSPGEISYGYVSKPGAPLTRSVVLDTGVVKRLVWEATSRTWQTYFQGPRDVCDAYAKCGAFGLCDANAPSTSFCGCLRGFSPTSPAAWAMKDASGGCRRNVPLRCGNTTTTDGFALVQGVKLPDTHNASVDTGITVEECRARCVANCSCLAYAAADIRGGGGGSGCVIWTGGIVDLRYVDQGQGLFLRLAESELDEGRSRKFMLWKTVIAAPISATIIMLVLLLAIWCRRKHKISEGIPHNPATTVPSVDLQKVKAATGNFSQSHVIGQGGFGIVYKGQLPDGRMIAVKRLHQSTLTKKGKKDFTREVEVMARLRHGNLLRLLAYCSEGSERVLIYDYMSNRSLDLYIFGDSGLRLMLNWRKRLGIIHGIANGIAYLHEGSGECVIHRDLKPPNVLLDDSFRPKIADFGTAKLFTADQPEPSNLTVVVSPGYASPEYAWRGEMTLKCDVYSFGVVLLETLSGQRNGPMYSLLPHAWELWEQGRVMSLLDAMIGLPLSVSGPDHTEMEDELARTTTGAELGDTLGKGRNITDGERLVSAGGSFTLGFFSPASSSSSSTSRRYLGIWFSVSDDVVCWVANRDRPLTDTSGVLVITDAGSLLLLDGSGHVVWSSNTTTGGGASMAAQLLESGNLVVSDRGNGGAGAVVIGKNLWTGAEWYLSSWRSSGDPSPGNYRYRTDTKGVPENVLWDGDGEVYRTGPWNGLWFSGIPEMGTYSDMFSYQLTVSPGEITFGYSANAGAPFSRLVVTGVGEVQRLVWEPSSRAWKNFFQGPRDLCDDYGKCGAFGLCDAGAASTSFCSCVEGFTPASPSPWKKMRDTSAGCRRDAALGCATDGFLTVRGVKLPDAHNATVDKRVTVEECWARCLANCSCVAYAPADIGGGGGCGAGSGCIIWADDLVDLRYVDGGQDLYVRLAKSELGKDGIRQRRPPAAVVIGASIASVVGVLLIILLVLLYVIRRRQRPRVSDDDAGVPAATAAVHARPNPALAAPSINLSSVKEATGNFSESNIIGRGGFGIVYQGKLPSGRKVAVKRLTQSLVTDKRKEDFIREVEMMSNTRHAYLVELLCYCQEGGEMILVYEYMENMSLDLYIFGEDRRLRASLNWVQRLDIIRGIAIGVEYLHNVKVIHRDLKPSNILLDDNRRPKVADFGTAKLFINDQTDPTLVLSAGYIAPEFAAQGNLTLKCDVYSFGVVLLEIISGKRNRTLPTFLRETWESWKQHEIEDILDLGLIKPEPDLLLGLDRCIQIGLLCVQQSPDDRPTMNQVVSMLTKYSSQIAMPKNPMINSRCEPSVSQVVSDTEPASHDRPGPSLN

SEQ ID NO: 9235 - protein, 504 aa, Silicibacter pomeroyi DSS-3
MQVARPDSLVSQILPAVADYLDSPAKLLLGGTSTAASDGRTMDVFNPATGKKLAEVPWGGAAEIDLAVKAAQAALEGDWSRMRPVERQRVLLNLADLIEANGEELAQLETLNNGKSVMLSRLVEVGNSSNYLRYMAGWSTKIEGSTIDVSIAVPPGAKYQAYTRKEPVGVVGAITPWNFPLNMAIWKLAPALACGNTVVLKPAEETPLTSLRLGELCLEAGLPPGVVNVVSGTGAEAGAALTAHPGVNKLTFTGSTEVGKIIGIQAMRDMKRVTLELGGKAPMVMFDDMDLDQLSEAARIGILFNSGQTCCAGTRIYAQRGIYDRICETMANVVGALSVGSGLDPANAINPMVSAKHQAHVSACIAGGVEEGATPLLDTGAYDGEGYFVRPQIFTDVRQDMRIMQDEVFGPVFTITPFDDPDEAIRMANDTRYGLGASIWTTNLNTMHRYVPQLQAGTVWVNSHNVPDANMPFGGYKQSGIGREHGRAALDAYLETKSVCIAVR

SEQ ID NO: 9236 - protein, 464 aa, Pseudomonas aeruginosa UCBPP-PA14
MASQRNNGILIGGKRPEYVHSAQGTGLRRILGLPALVFFGLVYMVPLTMFTTYGVVTEITGGRTASAYLITLAAMLFTAFSYSFMVKKYPIAGSAYSYTSLSFGPCVGFLAGWSLLLDYLFLPMINYLLIGLFLNIAFPMVPAWVFVLTAIGLVTVLNVIGISSVAGMSNVIVGAQFVFAVVFVAMAVKHLAGIPSLDLSLPFVGDGSQPGFAPLMAGAAVLCLSFLGFDAVSTLAEETRDPQRDIPRAIVITTVGAGLLFTVLAVFSQLVFPGSVFQDAESAANEVMLAAGGKFLASFFTAAYVAGAAGSALASQASVSRILYSMGRDGILPRRVFGSLSERFKTPVIAILVVSVISLLAVVIDLTTLASMISFGALVAFSAVNLAVIRSYLLLDGRRAPRDLLRYGLVPAIGLGLTLWLWTSLSALTLVIGLTWFAAGLAYLALHTGGFRRKAPTVTFSEQN

SEQ ID NO: 9237 - protein, 321 aa, Xanthomonas campestris pv. campestris str. ATCC 33913
MTILVTGAAGFIGAYTCRALAARGENVVGLDNYNSYYDPQLKHDRVAALCPQIDIRTLDLTDREGLAALFDEIQPTRVVHLAAQAGVRYSLENPHAYVDSNLVGFVNVLELCRHRGVQHLVYASSSSVYGDSATPPFSEDQRVDQPRSLYAATKAANELMGYTYAQLYGLRATGLRFFTVYGPWGRPDMAPLIFSRAVLAGRPIEVFNHGKMQRDFTFVADIVAGVLGALDTPSTEPVPHRVFNLGNHTPVELEYFIDVIAQAAGRPAEKVYRPMQPGDMIRTMADTSRAQAAFGFDPATPVELGLPQVVEWCQRYFASRA

SEQ ID NO: 9238 - protein, 296 aa, Leptospira interrogans serovar Copenhageni str. Fiocruz L1-130
MVIHADLEEAICEGLDKLGILNSGYRPKVTFHSSSLNEIYLAKLPDHSFGVKVISNKEMAETEKESLEQLYRIGVRVPECYGTVQTGNLWLLVMDYIEPGSVPTAREDLIRSLKLLYRKDSNSWGWKRNNFIGTLSQKNQWYSSFEKFFWESRLSIQLNLALSRKLITTKDTENVKEVFQKFTEEWSLNQSNPRLIHGDLWSGNILTGKNGHSYLIDPSISFSHPEQDLAMLNLFGSSLNLEEMQRILSHSGIENPEHFKDRIPFWQMYPILVHINLFGPSYLSSLRQILRYYGKS

SEQ ID NO: 9239 - protein, 297 aa, Pseudomonas putida GB-1
MTASPLLTAFLPLALGIIMLGLGLSLTLADFARVVKYPKPVVVGLACQILLLPLVCFLIANGFGLESALAVGLMLLAASPGGTTANLFSHLAHGDVALNITLTAVNSLIAILTMPLLVNLSLSWFMASDQAIPLQFAKVMQVFAIVLLPVALGMLIRHFAPAFAARMEKPMKLVAALFLAFTIVLALAKDWQTVVEYAPVVGLAALLFNLLSLTVGYWVPRLLNIPKRQAIAIGMEIGIHNGTLAIALALSPSLLNNATMAVPAALYSLIMFFTAAGFGWWVSRGQVAAQPKGETAN

SEQ ID NO: 9240 - protein, 289 aa, Thermus thermophilus
  misc_feature (1)..(1): Xaa can be any naturally occurring amino acid
  misc_feature (12)..(12): Xaa can be any naturally occurring amino acid
  misc_feature (16)..(16): Xaa can be any naturally occurring amino acid
  misc_feature (131)..(131): Xaa can be any naturally occurring amino acid
  misc_feature (240)..(240): Xaa can be any naturally occurring amino acid
  misc_feature (262)..(262): Xaa can be any naturally occurring amino acid
XEKVAFIGLGAXGYPXAGHLARRFPTLVWNRTFEKALRHQEEFGSEAVPLERVAEARVIFTCLPTTREVYEVAEALYPYLREGTYWVDATSGEPEASRRLAERLREKGVTYLDAPVSGGTSGAEAGTLTVXLGGPEEAVERVRPFLAYAKKVVHVGPVGAGHAVKAINNALLAVNLWAAGEGLLALVKQGVSAEKALEVINASSGRSNATENLIPQRVLTRAFPKTFALGLLVKDLGIAXGVLDGEKAPSPLLRLAREVYEXAKRELGPDADHVEALRLLERWGGVEIR

SEQ ID NO: 9241 - protein, 215 aa, Arabidopsis thaliana
MKLVEKTTTTEQDNGEDFCRTIIEVSEVNRNVFQAPGGEADPFRVVSGEELHLIPPLNFSMVDNGIFRSGFPDSANFSFLQTLGLRSIIYLCPEPYPESNLQFLKSNGIRLFQFGIEGNKEPFVNIPDHKIRMALKVLLDEKNHPVLIHCKRGKHRTGCLVGCLRKLQKWCLTSIFDEYQRFAAAKARVSDQRFMEIFDVSSFSHIPMSFSCSIR

SEQ ID NO: 9242 - protein, 611 aa, Triticum aestivum
  misc_feature (465)..(465): Xaa can be any naturally occurring amino acid
  misc_feature (525)..(525): Xaa can be any naturally occurring amino acid
  misc_feature (552)..(552): Xaa can be any naturally occurring amino acid
  misc_feature (556)..(556): Xaa can be any naturally occurring amino acid
  misc_feature (583)..(583): Xaa can be any naturally occurring amino acid
GTRLEVDPAPATPRWNLERPYLTGRFHQEAKVSAASQAPGSKPFSLDSFSRGAGGGAGSVLGSYAVSVQELLVIDDLLSALVGIEGRYISIKRVRGKEGYVVFQIDSSMDLALQELTRRIFPLCEDFVLASQFVESRSHFKTGLVNHALAAALRAFLLDYQAMVAQLEHQFRLGRLSVQGLWFFCQRMMSSLNALAVLIEKAMSNNTSGSATLNLLHSQAKAMAGDSAVRSLLEKMTDCASAAYLRMLERWVYEGVIDDPYGEFFIAENKSLQKESLTQDYDAKYWQQRYSLKDGIPSFLNNVAATILTTGKYLNVMRECGHNVQVSLSENSKLTSFGSNHQYLECIKSAYDFASGELLTLMKDKYDLIGKLRSLKRYLLLDQGDFLVHFMDIAREELTKKPEDISVEKLQSLVDIALRSTAAASDPSHEDLTCCVERSSLLKKLTTLKDLDCAYSSDKLAAADXDQPMTLNITGLETFCLGYKIPWPLSLGNSRKALTKYQLIFRLWFHCKHVSRQLCQAWQIXQQGFGSVKILGTPILRSSILGRSMLQXINWXYSLALRVLDQTGHSRHGRPQTGRGIDXVLHNTQFLLQKVLKELLLVFPEPLLKVE

SEQ ID NO: 9243 - protein, 641 aa, Shigella flexneri 2a str. 301
MSYQVLARKWRPQTFADVVGQEHVLTALANGLSLGRIHHAYLFSGTRGVGKTSIARLLAKGLNCETGITATPCGVCDNCREIEQGRFVDLIEIDAASRTKVEDTRDLLDNVQYAPARGRFKVYLIDEVHMLSRHSFNALLKTLEEPPEHVKFLLATTDPQKLPVTILSRCLQFHLKALDVEQIRHQLEHILNEEHIAHEPRALQLLARAAEGSLRDALSLTDQAIASGDGQVSTQAVSAMLGTLDDDQALSLVEAMVEGNGERVMALINEAAARGIEWEALLVEMLGLLHRIAMVQLSPAALGNDMAAIELRMRELARTIPPTDIQLYYQTLLIGRKELPYAPDRRMGVEMTLLRALAFHPRMPLPEPEVPRQSFAPVAPTAVMTPTLVPPQSAPQQAPTVPLPETTSQVLAARQQLQRVQGATKAKKSEPAAATRARPVNNAALERLASVTDRVQARPVPSALEKAPAKKEAYRWKATTPVMQQKEVVATPKALKKALEHEKTPELAVKLAAEAIERDPWAAQVSQLSLPKLVEQVALNAWKEESDNAVCLHLRSSQRHLNNRGAQQKLAEALSMLKGSTVELTIVEDDNPAVRTPLEWRQAIYEEKLAQARESIIADNNIQTLRRFFDAELDEESIRPI

SEQ ID NO: 9244 - protein, 557 aa, Escherichia coli
MILLSIEGMTCPSCVAHVKEALDAIEGVNKVEISYENARATITTNGGVSVTVLIGAIEALGYIAKESTGTAKEITSPNDCCDNENASNTESNQTQHVAIIGTGSGAFACAIKAAEGGAKVTLIEGADVIGGCCVNVGCVPSKILIRAAQLAQQQRNNPFTGLENHAPQLSRALLTQQQTARVEELRAAKYQNILETNPALSLLKGWAQFKNANTLIVRKNDGTEQAVHADKILIATGSTPTIPPIDGLTETPYWTSTEALFAQELPQHLVVIGSSVVALEIAQAYRRLGSEVTILARHTLLYREDPLLGEKLTGCFEKEGIRVLNSTQATKVTHDGSQFTELTNAGDLRCDRLLVSTGRHANTCQLNLGAVGVTTNKKGEIVVNERMETNVPGIYAAGDCCNMPQFVYVAAAAGSRSGINMTGGYAKLDLSTMPAVIFTDPQVATVGLTEEQANAQDIETDSRVLEMENVPRALANFETDGFIKLVTEKATGRLIGAQILAHEGGELIQSAALAIRNRMTVTLEADQLFPYLTMVEGLKLCAQTFNKDVKELSCCAG

SEQ ID NO: 9245 - protein, 496 aa, Vitis vinifera
MELNSFLLLCMPLVLCLFFLQFLRPSSHATKLPPGPTGLPILGSLLQIGKLPHHSLARLAKIHGPLITLRLGSITTVVASSPQTAKLILQTHGQNFLDRPVPEAIDSPQGTIAWTPVDHVWRSRRRVCNNHLFTSQSLDSLQHLRYKKVEQLLQHIRKHCVSGTPVDIGLLASATNLNVLSNAIFSVDLVDPGFESAQDFRDLVWGIMEGAGKFNISDYFPMFRRFDLLGVKRDTFSSYRRFYEIVGDIIKSRIKCRASNPVTRNDDFLDVILDQCQEDGSLFDSENIQVLIVELFYAGSDTSTITTEWAMTEFLRNPGVMQKVRQELSEVIGAGQMVRESDMDRLPYFQAVVKETLRLHPAGPLLLPFKAKNDVELSGFTIPSNSHVLVNMWAIARDPSYWEDPLSFLPERFLGSKIDYRGQDFEYIPFGAGRRICPGMPLAVRMVQLVLASIIHSFNWKLPEGTTPLTIDMQEHCGATLKKAIPLSAIPFIEEN

SEQ ID NO: 9246 - protein, 230 aa, Streptococcus pneumoniae TIGR4
MVKLVFARHGESEWNKANLFTGWADVDLSEKGTQQAIDAGKLIKEAGIEFDQAYTSVLKRAIKTTNLALEASDQLWVPVEKSWRLNERHYGGLTGKNKAEAAEQFGDEQVHIWRRSYDVLPPNMDRDDEHSAHTDRRYASLDDSVIPDAENLKVTLERALPFWEDKIAPALKDGKNVFVGAHGNSIRALVKHIKGLSDDEIMDVEIPNFPPLVFEFDEKLNVVSEYYLGK

SEQ ID NO: 9247 - protein, 244 aa, Oryza sativa Indica Group
MDTEFPGIVCRPVGNFRTTDEFNYANLEANVNMLKLIQLGLTLSDEGGDLPRRGTGGRRCIWQFNFRGFDPRTDPSNADSIQMLRTCGIDFDRFAAEGADPIRFAELLMSSGVVLNADVQWITFHSGYDFGYLLRLLTGRNLPDNMPAFFDLIRIYFPVLYDIKHLMRFCSNLHGGLSRLGELLDVKRVGTCHQAGSDSLLTLGCYNKIKEVYFKGSTEKHAGVLYGLVIEDGVNRPPPTQPNE

SEQ ID NO: 9248 - protein, 445 aa, Mycobacterium sp. JLS
MSDSLFDLPADGPVAAAGAPVSAPLAVRMRPASLDEVVGQQHLLKPNSPLRRLVEGSGAASVILYGPPGTGKTTLASLISHATGRRFEALSALSAGVKEVRAVIETARQGILRGQQTVLFIDEVHRFSKTQQDALLAAVENRIVLLVAATTENPSFSVVAPLLSRSLILQLQPLAPDSIAEVVRRAVADPRGLADSVDVSDDAVDLIVQLSAGDARRALTALEVAAESAAAADGRVTVDIVEQSLDKAAVRYDRDGDQHYDVVSAFIKSVRGSDVDAALHYLARMLVAGEDPRFIARRLMILASEDIGMADPTALPLAVAAAQTVQLIGMPEAQLTLAHATVHLATAAKSNAVTTALGAAMSDVRNGKAGQVPAHLRDGHYSGAAKLGNAVGYVYAHDHPDGVVPQQYPPDELVGVDYYRPTGRGAEREIGGRLDRLRAIIRKRR

SEQ ID NO: 9249 - protein, 281 aa, Anaplasma marginale str. St. Maries
MIYMSHLFCFGYGYTASFLAKQLLELQWKISGTYHTADRKEGFVSLFRYGDPALEHALRDASHVLVSIPPSGDDVLARYTTALRSAKWVGYLSATSVYGNHEGEWVDETSLTRPAEHSGIARLRHENMWLGSGLPVHVFRLSAIYGPGRSVIEGLLWGTISPNHAQRFSSRMHVEDIAGTILASMLNPKPASIYNCADDLPCRYAEVIAYGASLLGSEAKMGPELSSVCSNAAHAHFPAPERRVSNDKIKRELGISLQYPTYKTGLQAILRAHSDSSSLSH

SEQ ID NO: 9250 - protein, 162 aa, Pyrococcus abyssi GE5
MVSMCENEKERTLVIIKPDAVIRGLIGEIISRFEKRGLKIVGMKMIWISKELAEKHYAEHREKPFFKSLVEYITRTPVVVMVVEGRCAIEVVRKMAGATDPKNAEPGTIRGDFALEVSDAICNVVHASDSKESAEREIKLYFRDDEIFDYPRAEDWFYRKGI

SEQ ID NO: 9251 - protein, 596 aa, Oryza sativa Indica Group
MLRRSRHFLPPRPRRRPRPRREAPAAEPPTPTYTRDVVRRVDAILRGHPWSAARPLLLSLPGLAWDSHTVARVLKAHPPLHKAFLFFRLAAGAGGGFRHDRFTYTSMLHLLGEAGRVPAMMRLLAEMLRAGVDPDAATFTTVMHWLAHAGDVDAAMRVWEEMRARKGKCRPTLVSYTACVKILFDAGRPAEAREVFQEMVAEGLRPSCKTYTVLIEHLANVGEVFDQMPTMLFVTSTFCTALSLCTQYLSEVLHSLSHLCSTSCEEKIEQLLAFWNTLYIGKFEATMEIMDKMQEAGVEPDKALCNILVQKCSRACETSVMTRILQYMKENFIVLRRPIFLEALEALKANGESDNLLREVNPHLAFEGIECDPAFTDLGYITVRSTILYLLASRNWSAVEHMINEMTPKNIKVESHILSDIIQASCANCRPSCGLAVLRYSLRIGNELDRSAYGSLLGHYIRNGSFDLVFEIVEILIKSGCNLGTYLSSILIIKLACAGHSSTAVRIFGLLTTDKNVVTYTALMSAYFQDGKVDKALQLFSQMSANGVSACPAESFQHLLLPEHDDIDTQMSLNYGVHLGSPLCNTNALSEIAYTE

SEQ ID NO: 9252 - protein, 368 aa, Oryza sativa Japonica Group
MSQQEVYKFNVPTFGPGVVFDVDYSVRQEQFRFFTEALRANKLRSYVDQMVVEAEEYFSKWGESGTVDLKYELEHLIILTASRCLLGREVREKLFDDVSSLFHDLDNGMQPVSVIFPYLPIPAHRRRDRARQRLKEIFATIIKSRKASGRAEEDMLQCFIDSKYKSGRSTTEGEITGLLIAALFAGQHTSSITSTWTGAYMLRFKQYFAAAEEEQKEVMKRHGDKIDHDILAEMDVLYRCIKEALRLHPPLIMLLRQSHNDFSVTTKDGKEFDIPKGHIVATSPAFANRLPHIFKNPDSYDPDRYAPGREEDKAAGRLLIKAIWTHLLRNFEFELVSPFPETNWKAMVVGIKDEVMVNFKRRKLVVDN

SEQ ID NO: 9253 - protein, 220 aa, Mycobacterium tuberculosis H37Rv
MAEQPAGQAGTTDNRDARGDREGRRRDSGRGSRERDGEKSNYLERVVAINRVSKVVKGGRRFSFTALVIVGDGNGMVGVGYGKAKEVPAAIAKGVEEARKSFFRVPLIGGTITHPVQGEAAAGVVLLRPASPGTGVIAGGAARAVLECAGVHDILAKSLGSDNAINVVHATVAALKLLQRPEEVAARRGLPIEDVAPAGMLKARRKSEALAASVLPDRTI

SEQ ID NO: 9254 - protein, 504 aa, Pseudomonas aeruginosa UCBPP-PA14
MLEQYVKKILTSRVYDVAVETPLQPARQLSERLGNQVLLKREDLQPVFSFKIRGAYNKVAQLTEEEKARGVIAASAGNHAQGLALAAKRQGIRAVIVMPKTTPEIKVQAVRAHGAKAVLHGDAFPEALAHALKLVDEKGYTFVHPYDDPDTIAGQGTVAMEILRQQPGRLDAIFVPVGGGGLVAGIAAYVKYLRPEIKVIGVEPDESNCLQAAMAAGERVMLGQVGLFADGVAVAQIGQHTFDICKDHVDEVITVSTDEICAAIKDIYDDTRSITEPAGALAVAGIKKYVERERAEGQTLVAIDSGANVNFDRLRHVAERAELGERREAIIAVTIPERPGSFKAFCEAVGKRQITEFNYRYHSGSEAHIFVGVQTHPENDPREALVAYLREKGFPVLDLTDNELAKLHIRHMVGGHAVKVSDEMVFRFEFPERPGALFNFLTKLGGRWNISMFHYRNHGAADGRVVAGLQVPEDERHLIPQTLEAIGYPYWDETANPAYQLFLG

SEQ ID NO: 9255 - protein, 217 aa, Frankia sp. CcI3
MRHEQARQAAAQPQGRYVLPNIIEKTSRGEYGMDPYSKLLKERIVFLGVQIDDVSANDVMAQLLFLESEDPDRDISIYINSPGGSFTSLTAIYDTMQFVRPDISTICMGQAASAAAVLLAAGTPGKRFALENSRILIHQPSAQGEGQSSDIEIQAREILRMRSLLERMLAVHTGKKEEDIRKDIERDKIFSADEAKEYGLIDEVIKTRKSSRLATAR

SEQ ID NO: 9256 - protein, 469 aa, Oryza sativa Japonica Group
MVTTKLARVRRPITLNPKSKRPLPPVVNVIALLEHLPRLCTKGVIPVYKGSVFTVSLFGLKATFLVGPEVSAHFYQGMDSEISQGDLYEFTVPLFGKGVGFDIDNATRTEHLRFFIDAIKTSKLRNHVNSMVQEVEDYFAKWGENGIVDIKHEFEKLLMLISGHCLLGKEVRDNMFDEVFSLFHELDSGVGLGSVIFPYIPIPSHIRCDKAHAKLAKIFSKIVRSRRDSNRPAEQDVLQYLIDSKHRDGNSTTEQEVTGWIISMVFAGKHTSTNSTTWTGACLLTHDKFLTEALDEQKHMIQKHGDHIDYNVLLDMDILHCCIKEALRMHPVAPIIYRKAQKSFVVRTREGDAYDIPEGHNLLSPMIFNNRLPYIYKDPHMYDPDRFAPKREEDKVGGMFSYTSFGGGRHICIGEAYAYMQIKVIWSHLLRNFELKLESPFPKTNWSKILLEPWGKVMVSYKRRRLPTA

SEQ ID NO: 9257 - protein, 213 aa, Frankia sp. CcI3
MLGGGAPRARHVLPNIVERTSRGEYSMDPYSKLLKERIVFLGVQIDDVSANDVMAQLLFLESEDPDRDISIYINSPGGSFTSLTAIYDTMQFVRPDISTICMGQAASAAAVLLAAGTPGKRFALENSRILIHQPSAQGEGQSSDIEIQAREILRVRALQETMLARHTGRTETEIRRDTERDKIFSADEAEEYGLIDEVIMSRKAARLLSARSA

SEQ ID NO: 9258 - protein, 355 aa, Fusarium oxysporum f. sp. lycopersici
MSRSNPPNAAGSRKISFNVSEQYDIQDVVGEGAYGVVCSAIHKPSGQKVAIKKITPFDHSMFCLRTLREMKLLRYFNHENIISILDIQKPRNYESFNEVYLIQELMETDMHRVIRTQDLSDDHCQYFIYQTLRALKAMHSANVLHRDLKPSNLLLNANCDLKVCDFGLARSAASQEDNSGFMTEYVATRWYRAPEIMLTFKEYTKAIDVWSVGCILAEMLSGKPLFPGKDYHHQLTLILDVLGTPTMEDYYGIKSRRAREYIRSLPFKKKVPFRTLFPKTSDLALDLLEKLLAFNPVKRITVEEALKHPYLEPYHDPEDEPTAPPIPEEFFDFDKHKDNLSKEQLKQLIYQEIMR

SEQ ID NO: 9259 - protein, 601 aa, Mycobacterium bovis AF2122/97
MITAIGGPCDVQALPESQLPELAVQMRRRLIETVTATGGHLGAGLGMVELTIALHRVFTSPHDIVVFDTGHQTYPHKLLTGRGKDFATLRQADGLSGYPNRHESPHDWVENSHASVSLAWVDGIAKALALQGQCDRRVIAVIGDGALTGGVAWEGLNNLGAATRPVIVVLNDNGRSYDPTAGALAAHLEELRVGTPRGPNLFENMGFTYIGPVDGHNIPDTCAVLRKAAAAARPVVVHAVTSKGRGYPPAEADERDHMHAYGVVDIATGLASTPSQRSWTDVFEDEIARIADDRSDVVGLTAAMRLPTGLGALSRRYPHRVFDSGIAEQHLLASAAGLAAAGTHPVVAVYSTFLHRAFDQLLFDIGLHRLPVTLVLDRAGVTGPDGPSHHGLWDLALLACVPGFQIACPRDAPRLRQQLRTAIATAAPTAVRFPKGAPGEPITAEHTIGGLDVLHTPPPHWRPDVLLVAVGAMSRPCMDAARCLSEEQIGVTVVDPQWVWPISPALTELAGRHRITVCVEDAIADVGIGAHLSHHIGRTHPRTRTYTLGLPPAYIPHASRDHILSSHGLTGPAIRIRCKSLLNALHEVPGPEDHPDSGDSY

SEQ ID NO: 9260 - protein, 310 aa, Klebsiella pneumoniae subsp. pneumoniae MGH 78578
MMKTAGKLVVLGSINADHILNLDAFPTPGETVTGHHYQVAFGGKGANQAVAAGRSGADIAFIACTGDDDIGERIRRQLASDKIDVAPVRAVAREATGVALIFVNAEGENVIGIHAGANAALSVSQVEAEKERIASAQALLMQLESPLESVIAAAKIAHHHHTTVVLNPAPARELPDELLALVDIITPNETEAEKLTGIRVESDEDAAKAANVLHAKGIGTVMITLGSRGVWLSAEGESRRIPGFRVQAIDTIAAGDTFNGALVTALLEGTALPEAIRFAHAAAAIAVTRKGAQPSVPWRTEIDEFLAQQG

SEQ ID NO: 9261 - protein, 166 aa, Idiomarina loihiensis L2TR
MANVEAQTGELIEKLITVNRVAKVVKGGRIFSFTALTVVGDGKGKVGFGYGKAREVPAAIQKAMEKARRNMVTVQLKGDTLQHPVKGRHSGSQVYMQPASEGTGIIAGGAMRAVLEVSGVHNVLSKAYGSTNPINVVRATIKALNGMKSPEQVAAKRGLRVDEILG

SEQ ID NO: 9262 - protein, 539 aa, Triticum aestivum
MMDPDAKEGGPLEEAGGAGAESGPRDGGAECGVASPFRWLRRLSRELHWSFVLAVFAVYGACQGVGNAVGVVAASYYSKDVLRLQPSAAQFYQGIVDSPWVVKPIWGLLTDVVPVAGYRRRPYFLLAGVIGATSMLMISLQSNLGLIPAVLALTAQSAGAAIADVTLDALVAQNSITHPPLAADMQSLCGFCSSFGSLIGYSISGLLVHSMGAQGALGLLSIPSALVFSAGILLKESRVTNFSYKQVHKKFYKAIQSMGTTLKCPEVWRPCLYIYVSLNLSLDIQGGMFYWYTDRLTGPGFSEEFIGVIYAVGAVGSLLGVVLYQSALKDYNFRSMLLWGQVLSSLTGMLDLALVTRLNTKVGIPDYVFAVIDCGVSVMVGKLQWMPVLVLCSKLCPPGIEGTFYALLMSIQNVGLLMSAWWGGLLLHTLNVTRSEFSNLWAVVLIRNVSRLLPLMLLFLVPQSDQNSTLLPAEMLHNDEPTEAVKDGSGSAQFSVVVADDSSCHPSIEDVQDERIKVTDDVGDDVELMPLMNKTRTVG

SEQ ID NO: 9263 - protein, 362 aa, Glycine max
MAYHHHDHTNRKSLLDTLYCSEAEEDYGHFLNNSSPASPPFLLQSDMFSDEQELTSLLGKEHHNPLSTCLQTNPALDFARREAVEWMLKVNSHYSFSALTAVLSVNYFDRFLFSFRFQNDKPWMVQLAAVACLSIAAKVEETHVPFLIDLQQVDESRYLFEAKTIKKMEILVLSTLGWKMNPPTPLSFLDYFTRRLGSKDHLCWEFLSKSQGVLLSLLGDSRFMSYLPSVLATATMMHVVKSVEPGLEAEYKSQLFGILRIDKEKPEKVNSCCKLLLEVWSGYEEEEQEQGKQCMKRKFGIGSIPGSPNGVMDVSFSCDSSSNDSSVSSSPEPLSKKSRSEEQEQLLLPNPNHSNSDFLHRL

SEQ ID NO: 9264 - protein, 533 aa, Bacillus megaterium
MRGSLRIKYANVFFRGDGVQMFKRITIVGLSVVMFLPSIYGGSKAYADTVNNGTLMQYFEWYAPNDGNHWNRLRTDAENLAQKGITSVWIPPAYKGTTQNDVGYGAYDLYDLGEFNQKGTVRTKYGTKAQLKSAIDALHKKNIDVYGDVVMNHKGGADYTETVTAVEVDPSNRNVEVSGDYEISAWTGFNFPGRGDSYSNFKWKWYHFDGTDWDEGRKLNRIYKFRGIGKAWDWEVSSENGNYDYLMYADLDFDHPDVANEMKKWGTWYANELNLDGFRLDAVKHIDHEYLRDWVNHVRQQTGKEMFAVAEYWQNDIQTLNNYLAKVNYNQSVFDAPLHYNFHYASKGNGNYDMRNILKGTVVANHPTLAVTLVENHDSQPGQSLESVVSPWFKPLAYAFILTRAEGYPSVFYGDYYGTKGNSNYEIPALKDKIDPILTARKNYAYGTQRDYFDHPDVIGWTREGDSVHANSGLATLISDGPGGAKWMDVGKNNAGEIWYDITGNQTNTVTINKDGWGQFQVSGGSVSIYVQR

SEQ ID NO: 9265 - protein, 498 aa, Rhodococcus sp. RHA1
MRSEEALTSTQTSQQALLEAVPTGLYIGGQWRPSETGNTFPVHDPATGRELAVVADATVADGATALDAAATAQKAWSRTAPRERAELLRAAFDAVIARSDDFAMLMTLEMGKPLAEARGEVTYGAEFLRWFSEEAVRVSGRYSAAPDGKTRLLVHKRPVGPCLFITPWNFPLAMATRKIAPAIAAGCTMVVKPATLTPLTTLLFAQVLEEVGLPAGVLNVIPTSRAGAVTGPLIADPRLRKLSFTGSTEVGRRLLADSAEQVLRTSMELGGNAPFLVFADADIDAAVDGAVIAKLRNMGEACTAANRFIVHESVADEFATKLAGKMARLVVGPGIDADSQLGPLIDEESRAKVHDLVQDAVAHGAAIVTGGRPVPGDGYFYSPTVLTGVTTDARILREEVFGPVAPIMTFQDEEHAIQVANDTEYGLVAYVYTRDTARTLRMSEELESGMLGINVGVVSNPAAPFGGVKQSGLGREGGFEGIDEYLDIRYVGLADPYA

SEQ ID NO: 9266 - protein, 522 aa, Chlamydomonas reinhardtii
MQTTMQQRLQGRNVAGRSVAPSVPAHRSFHSHRAATQTATISAAASSTTKLPASHLESSKKALDSLKQQAVNRYAGDKKSSIIAIGLTIHNAPVELREKLAVPEAEWPRAIEELCQFPHIEEAAVLSTCNRMELYVVGLSWHRGVREVEEWLSRTSGVPLDELRPYLFLLRDRDATHHLMRVSGGLDSLVMGEGQILAQVRQVYKVGQNCPGFGRHLNGLFKQAITAGKRVRAETSISTGSVSVSSAAVELAQLKLPTHNWSDAKVCIIGAGKMSTLLVKHLQSKGCKEVTVLNRSLPRAQALAEEFPEVKFNIHLMPDLLQCVEASDVIFAASGSEEILIHKEHVEAMSKPSDVVGSKRRFVDISVPRNIAPAINELEHGIVYNVDDLKEVVAANKEGRAQAAAEAEVLIREEQRAFEAWRDSLETVPTIKALRSKAETIRAAEFEKAVSRLGEGLSKKQLKAVEELSKGIVNKLLHGPMTALRCDGTDPDAVGQTLANMEALERMFQLSEVDVAALAGKQ

SEQ ID NO: 9267 - protein, 370 aa, Rhodococcus sp. RHA1
MKIRGAVLEASGRPRPYADSTPISITELELDSPGPGEVLVRIEAAGICHSDLSVVDGNRPRPIPMLLGHEAAGRIEQLGDGVSGLVVGQRVVMAFLPRCNNCAECRTDGKLPCSPGSAANNAGTLLCGGIRLHRDDTDIKHHLGVSGFATHAVVDQHSVVPVGDDVPPDIAAVLGCAVLTGGGAVINAGRPTPGQAVMVVGLGGVGMAALITALSLGEGEVIGVDSNPDKLTQATKLGASATYTPQDVAELNIQAPIVIEAAGHPRAFETALAATAPGGTTVTVGLPAPDARSSISPLALVAGARTIIGSYLGSAVPARDIPVFAQLWRDGKLPVEKLISSRIALSDINSAMDQLADGNAIRQVIIFDEK

SEQ ID NO: 9268 - protein, 309 aa, Vitis vinifera
MAGFVPPPAPPAPPAPPKPDEKVDYLDLPCPIPYEEIHREALMSLKPELFEGMRFDFTKGLNQKFSLSHSVFMGPTEIPSQSSETIKIPTAHYEFGANFIDPKLMLFGRILTDGRLNARVKCDLTENLTLKANAQLTSEPHMSHGMVNFDYKGGDYRTQLQLGNGALFGASYIQSVTPYLSLGGEVFWAGQHRKSGIGYAARYNTDKMVATGQVASTGMVALSYVQKVSEKVSLASDFMYNYMSRDVTASFGYDYILRQCRLRGKIDSNGCTAAFLEERLNMGLNFILSAEIDHRKKDYKFGFGLTVGE

SEQ ID NO: 9269 - protein, 504 aa, Triticum aestivum
LYVQALVLAAVAVALLQLLKAALNPMRERAPPGPWKLPVIGSMHHLVNVLPHRKLRDLADAHGPLMMLQLGQTPLVVASSKETARLVLKTHDSNFATRPKLLAGEIVGYEWADILFSPSGDYWRKLRHLCTGEILSPKRVRSFRHIREDEVRMRVDQIRQAGPSTPVNLSVMFHNVTNSIVARAAFGKKRKNAAEFQAAIKSGVGLASGFNIPDLFPTWTTVLAKLTGMKRSLQDIHKTVDAILQEIIDERKAARVEKIKAGAENVDENLVDVLIGLQEKGGFGFHLDDSRMKAIILDMFGGGTGTSASAMEWGMSELMRNPRVMKKLQGQIREAFKGKAVVTEDDLQESNLQYLKMVIKEALRLHPPAPLLVPRESIDQCELEGYTVPAKSRVIINAWAIGRDPKYWEAPEEFRPERFEDSTVDFTGSSYEFLPFGAGRRMCPGFNYGLASMELALVGLLYHFDWSLPDGVAEVDMEEAPGLGVRRLTPLMLLATPFVPAAVA

SEQ ID NO: 9270 - protein, 411 aa, Zea mays
MNALAATSRNFKQAAKLLGLDSKLEKSLLIPFREIKVECTIPKDDGTLASYVGFRVQHDNARGPMKGGIRYHHEVDPDEVNALAQLMTWKTAVANIPYGGAKGGIGCSPGDLSISELERLTRVFTQKIHDLIGIHTDVPAPDMGTNSQTMAWILDEYSKFHGYSPAVVTGKPVDLGGSLGRDAATGRGVLFATEALLAEHGKGISGQRFVIQGFGNVGSWAAQLINEAGGKVIAISDVTGAVKNVNGLDIAQLVKHSAENRGIKGFNGGDAIDPNSLLTEECDVLIPAALGGVINKDNANDIKAKYIIEAANHPSDPEADEILSKKGVIILPDILANSGGVTVSYFEWVQNIQGFMWDEEKVNAELRTYMTRAFGDVKEMCRSHNCDLRMGAFTLGVNRVARATVLRGWEA

SEQ ID NO: 9271 - protein, 367 aa, Azoarcus sp. EbN1
MKIFKLPDLGEGLQEAEIVEWHVAAGDEIEADRPLLSVETAKAIVEIPSPHSGHIEKLFGQPGQIVHVGAPLVGFAGTAEDSDTGTVVGEVQVGHQLAPEAPAAVGGGAAAIKATPAVRALARQLNVELEMVTPSGPDGLITTADVQRVAKILADVGPPEVLRGVRRAMARNMALAQSEVAGATVVDDADIDAWLPDSDVTIRLVRALVAGCRAEPALNAWYESHTMGRRVLEKIDVGIAIDLAEGLFVPVLRDVANRDANDLRRGLDRMRADVIARKIPADELRGNTITLSNFGMIAGKYAAPIVMPPTVAILGAGRVHQQVLAIDGAPAVRRVLPLSLTFDHRVVTGGEAARFLAAVIADLALPE

SEQ ID NO: 9272 - protein, 467 aa, Vitis vinifera
MENYTYTSYADSGESSPRSRELEFENSGAASWEDQPLHQPSKVKFMCSYGGKIQPRPHDNQLSYTGGETKILSVDRSIKFSPLINKLCALCEADVCFKYQLPGEDLDALISVTNDDDLEHMMHEYDRLCRPSAKPARLRLFLFPATPPSVGSGDMKTERERFFEAMNSGPIQSVDATSPPATAPPSNVDFLFGLDKGVSPPAPVAKLPVPVPEPPVPAEIPSLVNPGGDGRVFAADLGVNQAEIQRQIQDLQRLQISAQEQGAYQRKSDDNMYGGYAGDYYVQKMPEKAPPQSTIPATVPATYWQEKRAPGGGFPGGVPATPGLQEQPVYMIPAPASVYHTPVARPVTGQSGQGYYAMRMGPDVYREQTPMYSVMQQPPVQATMPAPAPKLPNYSEGLGMGRPSGVGVADTGYTQVAYDSQGRQVYYTAPGGVVAPYQTMAAVSTTSGPLNQESGKVTAAKLSQASV

SEQ ID NO: 9273 - protein, 310 aa, Shigella flexneri 2a str. 301
MLDANKLQQAVDQAYTQFHSLNGGQNADYIPFLANVPGQLAAVAIVTCDGNVYSAGDSDYRFALESISKVCTLALALEDVGPQAVQDKIGADPTGLPFNSVIALELHGGKPLSPLVNAGAIATTSLINAENAEQRWQRILHIQQQLAGEQVALSDEVNQSEQTTNFHNRAIAWLLYSAGYLYCDAMEACDVYTRQCSTLINTVELATLGATLAAGGVNPLTHKRVLQADNVPYILAEMMMEGLYGRSGDWAYRVGLPGKSGVGGGILAVVPGVMGIAAFSPPLDEEGNSVRGQKMVASVAKQLGYNVFKG

SEQ ID NO: 9274 - protein, 310 aa, Zea mays
MQASVAVAEALDAGKLTPQPVAGVADFVAAGLAVAIGTLAVAASFVLVSFDARAGQGQLRRILDLGPSLCGPRLLLVFFVGLLAAAEMLRLPFFHSAMLPPHRHVMPCLAYPLVAHGIAEPGLLACVLLLLRASVGGARLPASALAVPLACLPFLTAHILVLATPATVAAYPGQLAHAADGIGHCAYPAYAATLLLALVAVYLPLLATACWDVAAVAINKRLRARAYALSVLILVPLPLQVLALTLTSVWDMHQYTSPTVGLVGFVAVAVAAEATLVILVMLPVHDALVLVQKLPSATTGLEETPDDPGR

SEQ ID NO: 9275 - protein, 430 aa, Shigella flexneri 2a str. 301
MMNTEGNNGNKPLGLWNVVSIGIGAMVGAGIFALLGQAALLMEASTWGAFAFGGIVAMFSGYAYARLGASYPSNGGIIDFFRRGLGNGVFSLALSLLYLLTLAVSIAMVARAFGAYAVQFLHEGSQEEHLILLYALGIIAVMTLFNSLSNHAVGRLEVILVGIKMMILLLLIIAGVWSLQPAHISVSAPPSSGAFFSCIGITFLAYAGFGMMANAADKVKDPQVIMPRAFLVAIGVTTLLYISLALVLLSDVSALELEKYADTAVAQAASPLLGHVGYVIVVIGALLATASGINANLFAVFNIMDNMGSERELPKLMNKSLWRQSTWGNIIVVVLIMLMTAALNLDSLASVASATFLICYLAVFVVAIRLRHDIHASLPILIVGTLVMLLVIVGFIYSLWSQGSRALIWIIGAILLSLIVAMVMKRNKTV

SEQ ID NO: 9276 - protein, 354 aa, Pyrococcus abyssi GE5
MKLRIAVIPGDGIGKEVVAEGLKVLKKLEELSRVSFEFKEYPFGAEHYLKTGETLPDWAIEEFKKFDAIYFGAIGDPRVKPGILERGILLKMRFELDLYVNLRPVKLYHPRLTPLKGKNKIDIVFVRENTEGLYAGAGGFLRKGTPQEIAVQEMINTRFGVERVIRFAFEYAKRSGRKKVTLVDKANVLTYAHDLWERVFAEVSQEYDLETDHYYVDAMAMKMIRSPESFDVVVTPNMFGDILTDLGAEIVGGLGIAASGNINPETTGMFEPVHGSAPDIAGKRIANPLAAILSASMMLEYLNLEKESKWIEEAVKRAIAENKVTPDMNGNLKTYEVGDWVVKFLEVVANEEEG

SEQ ID NO: 9277 - protein, 425 aa, Myxococcus xanthus DK 1622
MGPFQLLSLGVNGIVGVGIFFAPAEVAALAPGASAIAAFALTGLALIPVALAFAVLGRRFDADGGPVLFARAAFGERASFLVGWVAYVSAFLSTAAVVAGLSQAVAPSLGLEGALGRSVLASVLVTALAGVVASGIRVSAGTWTALTVFKLLPLAALLVAFLALSGPPPAAAVAAGPVVDVSWLRAGLTVMFAYQGFEIVPVIAGQVRSSSRTVPLATVGSLLVAVLLYVGLVWACVAALPELASQAAPLAAAAGVWGGPGLEGWVKAGTSVSALGICLGMMVTTPRYLSALASGAHTLLGLDGMSAGGVPVRALAVTWALVLLFVNLGDLSELFALSSIAVLMQYGVTSAALAALAWRRERGLRPLHALLAVPTLGLGLTLVAFGANPREGVTMALTLIAGVVLLRLSRPRASEPSAALRGEPL

SEQ ID NO: 9278 - protein, 411 aa, Arabidopsis thaliana
MNALAATNRNFKLAARLLGLDSKLEKSLLIPFREIKVECTIPKDDGTLASFVGFRVQHDNARGPMKGGIRYHPEVDPDEVNALAQLMTWKTAVAKIPYGGAKGGIGCDPSKLSISELERLTRVFTQKIHDLIGIHTDVPAPDMGTGPQTMAWILDEYSKFHGYSPAVVTGKPIDLGGSLGRDAATGRGVMFGTEALLNEHGKTISGQRFVIQGFGNVGSWAAKLISEKGGKIVAVSDITGAIKNKDGIDIPALLKHTKEHRGVKGFDGADPIDPNSILVEDCDILVPAALGGVINRENANEIKAKFIIEAANHPTDPDADEILSKKGVVILPDIYANSGGVTVSYFEWVQNIQGFMWEEEKVNDELKTYMTRSFKDLKEMCKTHSCDLRMGAFTLGVNRVAQATILRGWGA

SEQ ID NO: 9279 - protein, 181 aa, Zea mays
  misc_feature (40)..(40): Xaa can be any naturally occurring amino acid
MASSMLSNAAVATTVVNRNAGAQASMVGLKSVAAFPLTKXKSTNDLSSLPTNGGRVQCMKVWPTQNMKRYETLSYLPPLTTDQLARQVDYLLNNKWVPCLEFETEHGFVYREHHNSPGYYDGRYWTMWKLPMFGCTDPAQVLNELEECKKEYPNAFIRIIGFDSNRQVQCVSFIAYKPEGY

SEQ ID NO: 9280 - protein, 433 aa, Candida glabrata CBS 138
MKRTLNRMTKITPNKYFQKNTSKDVWTLTNEFAASAVGKSEGRELINLGQGFFSYSPPQFAINAAKSALDVPLVNQYSPTRGRPSLIKSLVELYKPVFGDFIDNQNVLVTTGANEGILSCLMGILNAGDEVIVFEPFFDQYIPNIELCGGVVRYVPIHPPKEMKTRNTTGDEWQIDWDALEKTFNNKTKAVIINTPHNPIGKVFTEQELTKLAQLCVEHNTVVISDEVYEHLYFTESFPRIANINEDIANLTLTVGSAGKSFAATGWRIGWIISKNDQLLNYVSKAHTRICFASPSPLQEACAGSIEHALKIDYFPKMREEYRKKFEILTTAFDKLGLNYTQPEGTYFILVDFSKVKIPEDYVYPEELLEKAKDFRISYWLINEIGIVAIPPTEFYIKEHEKDAETLLRFAVCKEDEYLAKAAERFQLLKDYL

SEQ ID NO: 9281 - protein, 840 aa, Pyrococcus abyssi GE5
MILGRSEPQKDEIKLRVAEALKRDVGRGIVRFDRKYQRMIGVEPGDIVEIEGERITAAIVANPHPDDRGLDIIRMDGYIRKNAGVTIGDFVTIRRAEVKEAKKVVLAPAQKGVIVQIPGDIVKNNLLGRPVVKGDIIVASGRSEMYYSSGTPFDEIFRGFFEAMSVGFGELKFMVVNTIPKGIVQITYNTEVEVLPQAVEVREEKIPEVTYEDIGGLKEAIEKIREMVELPLKHPELFERLGIEPPKGVLLYGPPGTGKTLLAKAVANEANAYFIAINGPEIMSKYYGESEERLREIFKEAEENAPAIIFIDEIDAIAPKREEVVGEVEKRVVSQLLTLMDGLKSRGKVIVIAATNRPDALDPALRRPGRFDREIEVGVPDKQGRKEILQIHTRGMPIEPDFEKETVIKALKELEKDDRFDKEKIKKIIEKVSKAKSEEEIKDILREDRNLYIEVRTKLIDKLLDELAEVTHGFVGADLAALAREAAMVVLRRLIKEGKINPEAETIPREVLEELKVTKADFYEALKMVEPSALREVLIEVPNVHWDDIGGLEDVKQELREAVEWPLKYPKAFKRLGITPPKGVLLYGPPGTGKTLLAKAVATESQANFIAIRGPEVLSKWVGESEKRIREIFRKARQASPAIIFIDEIDAIAPARGTAEGEKVTDRIINQLLTEMDGLVENSGVVVIAATNRPDILDPALLRPGRFDRLILVPAPDEKARFEIFKVHTRGMPLADDVDLKELARRTEGYTGADIAAVCREAAMNALRRAVAKLSPEELEEESEKFLKSLIVTRKDFEVALKKVKPSVTKYMMEYYRQFEESRKRMVGESTGREPDYFTG

SEQ ID NO: 9282 - protein, 122 aa, Brassica napus
MASKLIQVQSKACEASKFVAKHGTSYYRQLLEKNKHYIQEPASVDKCQELSKQLLYTRLASIPGRCETLRKEVDYAKNLWKNRTDLKVEDAGVAALFGLECFAWYCAGEIIGRGFTFTGYYP

SEQ ID NO: 9283 - protein, 524 aa, Solanum lycopersicum
MDTCCAAMKSTVHLGRVSTGGFNNGEKEIFGEKIRGSLNNNLRINQLSKSLKLEKKIKFGEAYSVITIENDTETVFVDMPRLERRRANPKDVAAVILGGGEGTKLFPLTSRTATPAVPVGGCYRLIDIPMSNCINSAINKIFVLTQYNSAALNRHIARTYFGNGVSFGDGFVEVLAATQTPGEAGKKWFQGTADAVRKFIWVFEDAKNKNIENILVLSGDHLYRMDYMELVQNHIDRNADITLSCAPAEDSRASDFGLVKIDSRGRVVQFAEKPKGFDLKAMQVDTTLVGLSPQDAKKSPYIASMGVYVFKTDVLLKLLKWSYPTSNDFGSEIIPAAIDDYNVQAYIFKDYWEDIGTIKSFYNASLALTQEFPEFQFYDPKTPFYTSPRFLPPTKIDNCKIKDAIISHGCFLRDCTVEHSIVGERSRLDCGVELKDTFMMGADYYQTESEIASLLAEGKVPIGIGENTKIRKCIIDKNAKIGKNVSIINKDGVQEADRPEEGFYIRSGIIIIAEKATIRDGTVI

SEQ ID NO: 9284 - protein, 598 aa, Leptospira interrogans serovar Copenhageni str. Fiocruz L1-130
MLDHNLLINLIVFLSAAVISVPLFKKIGLGSVVGYLVGGTIIGPWGIGLITDVDSILHLSEFGVVLLLFLIGLELKPQRLWILRRPVFGLGGLQVILTSLTFFILFSLLGLEKRQAIVISISISLSSTAFALQVLGEKNELNTTHGRSAFAILLFQDLAIIPIMATLSFLTESSSNPGSHGSIKEILFPIGTIIAVILAGRFLARPLFKLVASSANHEIFTALSLLIVIGVSILMNQVGLSMALGSFLGGVILADSEYRHELESNLEPFKGLFLGLFFLAVGMSINLGEVLKDPILVILLAFILILVKTIILYFIGIITKHSKEVSLNLSTIISQGGEFAFVILGVGVSLSILPKERADLVIAVVTLSMGLTPILGILKDKTSKWILKEDQNIKEDTIEEQNRVIVAGFGRFGQIIARMLFVHKIGFTALEHNPDQVNLARKFGYKIYYGDASKLSLLRSAGAEHADLFILAIQDIDVSVKIAELIKKNFPNLTIIARARNREHVFKLMELGIQIIRRDTFASALELAGETLSQLGFIDSEVEKKVKKFRAHDELTLKGQFQIRGDEKEFIQFSKNSMRQLEDAFEADRQEKEGKIAG

SEQ ID NO: 9285 - protein, 1499 aa, Mycosphaerella graminicola
MTARMASESKIDDFGDEKSNRHSPSNDTLMKEKNESPGDVSSPSSTSINERNKEVNCLARRFSEISGWNEIPSNPLEAAKGTELDPLSPNFKARTWVKSMLKFSKQDGRTPMRTGGVAFRNLSAHGFGLATDYQKDVGNIWLDSISIVKKLFGMEKSRRIDILQDFEGLLESGEMLVVLGPPGSGCSTFLKTLTGETHGFQVDKNSYMNFQGIPAGEMHSVFRSEAIYTAEVDIHFPQLTVGETLTFAARARTPRFIPGDVERNVYAEHMRDVVMAMYGISHTINTRVGNDYLRGVSGGERKRVTIAEASLSGAALQAWDNSTRGLDSANAVEFCKSVRLGCELGGSAAMVAIYQAPRAAYEQFDKVIVLYEGRQIYFGNIHAGKTYFEDLGFQCPDRQTTPDFLTSMTSAVERVVKPGWEDKVPRSPDEFAAAWKASPTRQKLIQDIEDYERRFPFKGEAYQQFVDSRKAQKAKSHRFKSPYTISYLQQCQVCLWRGYRRLCADPELLYTSLFMNSILALIVGTLFYNLKLTTASFYQRGAVIFFGTMMNAFGSSLEILTLYHQRPIVEKHERYALYHPSAEAVASMIMDLPYKISNCIIFNTVLYFMVNLRREPGAFFFFIFLAFITTLTMSMMFRTIASCSRTLSQAMTPSALILLWLLIFTGFAIPVDYMLGWCRWLNYIDPVAYAFESLMINEFSGRNYACKSDDLVPSYGTLAAQSQVCNAVGAVAGRDYVEGEAYINSAYSYYRSHKWRNIGIIFAFMVGFLTVYLVASENIRAKKSKGEVLLFQKGRIPAALKEKSQDEEMSEVNRVSSVMCRQMSNVEATDVILRQTAVFSWRNVCYDIKIKGEERRILDNVDGWVKPGTLTALMGVSGAGKTTLLDVLATRVTMGVISGEMLVDGRERDNSFQRKTGYVQQQDLHLATSTVREALNFSALLRQPASVSRQEKLDYVDEVIKLLDMQEYADAVVGVPGEGLNVEQRKRLTVGVELAAKPQLLLFLDEPTSGLDSQTSWAICDLMEKLKNSGQAILCTIHQPSAMLFQRFNRLLFLAKGGKTVYFGEVGPGAKILSTYFERNGGHPCPPDANPAEWMLEVIGAAPGSRTDIDWHQVWRASPEYAATQRELDHLKDNGALVRQPSMVESDNESFNAFAAGFWSQLREVLVRVALQYWRTPSYIYAKLSLCTLAGLFIGFIFYKAPLTHQGLTNQMLSIFMIFTLFSNVSQQIMPHFVLQRSLYEARERPSKTYSWQVFLISNILIELPWNAFAGLLFFLCYYYPIGLYANASPTDSVAERGGYFFLMILAFFLFTSTFTNLMIAGMDSAETSGNIATLLFSLCLIFNGILASPKTMPKFWLFLYRVSPFTYITGGLMSAGLMDQTTHCAANEFVTFQPDGGEGGGTTCGTYMDPYISGANGTVGKGGYILNPSADADCKYCSFNTTNHFLKLVSIDPADRWRDLGITWVYILVNVAGAVALYWLFRVPKGSKKKAEKKEKTG

SEQ ID NO: 9286 - protein, 571 aa, Arabidopsis thaliana
MAAYGQISSGMTVDPQVLSSSRNIGVSLSPLRRTLIGAGVRSTSISLRQCSLSVRSIKISEDSRKPKAYAENGAFDVGVLDSSSYRLADSRTSSNDSRRKTKIVCTIGPSSSSREMIWKLAEAGMNVARLNMSHGDHASHQITIDLVKEYNSLFVDKAIAIMLDTKGPEVRSGDVPQPIFLEEGQEFNFTIKRGVSLKDTVSVNYDDFVNDVEVGDILLVDGGMMSLAVKSKTSDLVKCVVIDGGELQSRRHLNVRGKSATLPSITDKDWEDIKFGVDNQVDFYAVSFVKDAKVVHELKNYLKTCSADISVIVKIESADSIKNLPSIISACDGAMVARGDLGAELPIEEVPLLQEEIIRRCRSIHKPVIVATNMLESMINHPTPTRAEVSDIAIAVREGADAIMLSGETAHGKFPLKAVNVMHTVALRTEASLPVRTSASRTTAYKGHMGQMFAFHASIMANTLSSPLIVFTRTGSMAVLLSHYRPSATIFAFTNQRRIMQRLALYQGVMPIYMEFSDDAEDTYARSLKLLQDENMLKEGQHVTLVQSGSQPIWREESTHLIQVRKIKIGG

SEQ ID NO: 9287 - protein, 1596 aa, Sordaria macrospora
MAPRRSAPEEEEELELEQEQEQGLVALEFNEPLTWRPGKPISVDTLLKRLDALSKELSDMDQETVDTDSLVKVAKDVASHQLIQHKDKGVRAYTACCIVDILRLCAPDAPFTPSQLKDIFNLSINSIIPALFDPSNPYNNQHKYVLRSFAEIKSIVLLLDVEGSEALLLKLFTTIFDGVSGLKSSKGEQVGKDVEFSMQEMLGALIDDSVTLPGKVVDVIMAQFLRAAAPGLGKERQDHVPIDDSQATLLLKEEPEAYQMVRNLCQTYDDKMARFASQYFSDVIVDATGFAGKPNGSRDEDDENDEGDGPTGPSESDLKELRKAHVLIREIWKAAPMILQNVIPQVDAELSADNVHLRQMATETLGDMISGIGAAGPPPLPILDPAAYPPLSLEEEDRAEPPVTNILTTPLCSISFSQTHSTTFHNFLSRKNDKAPSIRAAWTTAVGHILSTSAGGIGLSREDEATLIRGLGEKLSDSDEKVRLSAVKAVETFKFQDIIAKLGPNGGVGKDGSVLNTLADRCRDRKPAVRVAAMSLLAKLWAVGTGEMLAGNEAVTAALSGIPSRIYNAFYANDLELNVLMDRVIYEFLVPLGFPPAKKATRNSNANGNSQSQSANAASIDHDAIRAERILLLARSLDEPAKKAFFAMQSRRPQFAKILETYLDQCDRYNGGVMESNADKITSNLNKTADYIAQFLPEHVKSKTDLIKFAKIHDRRNYNLIKYVIGQENDFKTVYKALKELIKRCMASKDPSVIDTLLPLLYRSGCLLFNRSHLSTIMEYSKSDKDGLGSIAHEILNEISQRNPDLFKTHIGQLCKDLVDQAPTATKPNDPIVAETLKACSTYARKFPKDVAMDRKFVQTMINYALYGQPVKASKHAVNIVLCKQDDKSMVTATDILQRILKGWSYGSSNFLNKLTAVSQLELLAPKVTEDASDEILNLTFKEILLQVRTDAKDSDPDWVNGADMDEEIQAKCLSLKILVNRVRSIEGIEEAKEKASSVWKVLRKIIKEKGEIVEEKETPKHHKTRLRLLAAQLMLKLCTQKHFDDMLTPSDFNLLALTTQDMVEEVRHGFVRKLQKYLADGKLRSRYYTIIFLTAFEPSVEFKNRVETWIRSRARHFQNLKQPVLEAIMARLISLLAHHPDYSNEVEYLVDHARYILNYIVLVGTESNLGLIYKYAERVKQTQDGLNPNSDAHRVLSDLAQSIIRKWQEKKVWAFAAFPGKVGLPLGLYTALQSHSEAQAIAEKSYLPEGLDEKLDELLRAMDRKKKRKSTSAATGTNNRDGHKSKKVKSSGDRDGDREAKSSRKIATAKSKKTPAKKRSDRDDWSPGAAVPESERRQSSRRAANKAKGPYTERDSDDDDEEMLEGVAEWEYLDEDDEDKEGDDEEGSGEEAPPRRTAAKASATTRSSRREDKESEEEVNEEEPEKEQEEEADPEQEEEAPTAAAKRTSATAKGKKAAASLPVRNAAAASTRRSGRGKAAAAAASAKDKDDSDLSELSDVEMVDEPEAEAEAEAEEAVEAEEVEDEKEEQEQEAPPARANGRKAKAAAPAKAKAAAPKGKAKAADASAPARRSGRSTRGKQQEPEEDDEDAMDEE

SEQ ID NO: 9288 - protein, 616 aa, Vitis vinifera
MATTSTRLRRLGTVAAAVALSAGVTLRDPPISSSDRGGPSLDAVRRKIADSNGVVPSRAVQESALIGSSAVNPLDILVVGGGATGCGVALDAATRGLRVGLVEREDFSSGTSSRSTKLLHGGVRYLEKAVFNLDYGQLKLVFHALEERKQVIENAPHLCQALPCMTPCFDWFEVVYYWMGLKLYDLVAGSRLLHLSRYYSAQESVELFPTLARNGKDRSLRGTVVYYDGQMNDSRLNVALACTAALAGAAVLNHAEVVSLLMDEVSNQIIGARIRDNLSGKEFDTYAKVVVNAAGPFCDSVRKMADKESQPMICPSSGVHIVLPDYYSPEGMGLIVPKTKDGRVVFMLPWLGRTVAGTTDSNTSITMLPEPHEDEIQFILDAISDYLNVKVRRTDVLSAWSGIRPLAVDPKAKSTESISRDHVVCEDHPGLVTITGGKWTTYRSMAEDAVDAAIKSGKLSPTNECLTNNLHLSGSEDWDPASFTVLAQQYVLMDTAAAKHLSHAYGTMADRVAAIAQDEHLGKRLAHGYPFLEAEVAYCARNEYCESAVDFIARRSRLAFLDTDAASRALPRIIGILATEHNWDRTRKKKELQKAKEFLETFKSSRNAQFYDGKHK

SEQ ID NO: 9289 - protein, 428 aa, Vitis vinifera
MAQIPNLDNAPFNLTSLRDQSQKELLNILKNIRGRKCLVIDPKLGGSLSLIIQTSLLKEHGVELRYLSADPIQTECTKVVYLVRPQLNLMKFICSHIRNDISKGLQREYFVYFVPRRAVACEKILEEDNFHHLLTIGEYPLYILPVDEDVLSFELDLAYKECQVDGDTSSLWHIAKAIHKLEFSFGLIPNVRAKGKASVRVADILNRMQAEEPVNTSDMGMPEINTLILIDREVDMITPMCTQLTYEGLLDEFLHVNNGSVELDASIMGVQQQEGKKIKVPLNSSDKLFKEIRDLNFEVVVQVLRQKATSMKQDYTEMTTTTQTVSELKDFVKKLNSLPEITRHINLAQHLSAFTSKPSFLGRLDMEHTIVEAQSYDICFEYIEEMIHKQEPLVNVLRLLILFSITNSGLPKRNFDYLRQGFTPQLWI

SEQ ID NO: 9290 - protein, 353 aa, Oryza sativa Indica Group
MASFSTVFLLLSLVCLASPCAAQRVICEAPPCTASSQVKTTPTNRASHVRLPEGVTGAESLAFDSSNRGPFTGVSDGRVLKWGGDSAGWTTFAYSPNYRSSPTCAASSEETESTCGRPLGLAFHLKTGILYFADAYKGLMRVGPRGGQADVLATEADGVPFNYLNGVDVDQDTGDVYFTDSSTTITRRYQENIMRNRDATARLMKYDAKTKQVTVLKDRLPYANGVAVSHDGRYLVVAHTGPAQVFRYWLKGAKAGQYELFADLPGYPDNVRRDAKGGYWVGLNREKITFNVPAAAAAASPAKHLVGVRLNGDGVEVEELTAASRAVTLSEVVERDRKLWLGSVDLDYVGLLQ

SEQ ID NO: 9291 - protein, 167 aa, Vitis vinifera
MATLNNLEKAGLLKKQETKSNWLTIKRALQLVVEDTDTTNPNDIAYVFSGYAPLSIRLVQQAVRSGWRPIEEILKLLPGPHSETKRSGFASSQSIDNLAGAPASIDKVTDGRRSLVLVVFIGGVTFAEISALRFLSAQEGMAYDLIVGTTKIVGGHSLTETFIESLG

SEQ ID NO: 9292 - protein, 583 aa, Ralstonia eutropha JMP134
MPDQPYRPSAGEASEARPAKGWLRWLPGVQTLRQYEAAWLPRDVAAGLVLTTMLVPVGIAYAEASGVPGIYGLYATIIPLLAYALFGPSRILVLGPDSALAAPILAVVIQLSAGDPARAIAVASMMAVVSGAVCILAGLLRLGFVTELLSKPIRYGYMNGIALTVLISQLPKLFGISIEDAGPLRELWDLIQALGDGKANWYSAAVGGSALALILLLKRFERVPGILIAVILATLAVAWFGLQDHGVKVLGKMPQGLPVFHLPWLSGVDIAKVVAGGFAVAMVAFADTSVLSRTYAARMKRPVDPNQEMVGLGAANLAAGLFQGFPISSSSSRTPVAEAAGAKTQLTGVIGALAVAALLLFAPNLMRYLPNSALAAVVIASALGLFEFADLRRIFRIQQWEFWLSMACFAGVAVFGAIPGIGLAVALAVIEFLWDGWRPHYAILGRADGVRGYHDVERYPNARRVPGLVLFRWDAPLFFANAELFQTCVMQAVEGSPTEVRRVVVAAEPVTSVDVTSADMLRELDKTLDERGIELHFAEMKDPVKDKLKRFELFDHLGQDVFHPTVGAAVDDYLSDHNVDWKA

SEQ ID NO: 9293 - protein, 73 aa, Staphylococcus aureus
AAEKTEFDVELTSAGSSKIKVVKAVKEATGLGLKDAKELVDGAPKVIKEALPKEEAEKLKEQLEEVGATVELK

SEQ ID NO: 9294 - protein, 210 aa, Klebsiella pneumoniae subsp. pneumoniae MGH 78578
MTNWNYQLTHFVTSAPDIRHLPADTGIEVAFAGRSNAGKSSALNTLTNQKNLARTSKTPGRTQLINLFEVAEGKRLVDLPGYGYAQVPEEMKIKWQRALGEYLEKRLCLKGLVVLMDIRHPLKDLDQQMIEWAVESDIQVLVLLTKADKLASGARKAQVNMVREAVLAFNGDVQVEPFSSLKKSGVDKLRQKLDSWFNEIPPQEAVEDAE

SEQ ID NO: 9295 - protein, 135 aa, Burkholderia sp. 383
MSYSNKVLDHYENPRNVGSFAKDDDTVGTGMVGAPACGDVMKLQIRVGADGVIEDAKFKTYGCGSAIASSSLVTEWVKGKTLDEALSIKNTQIAEELALPPVKIHCSILAEDAIKAAVADYKKRHDTTEGDQAAA

SEQ ID NO: 9296 - protein, 355 aa, Selenomonas ruminantium
MAYKITVIPGDGIGQEITDSAVEVLKAADKKFNLGLEFDYHDAGGTAYDKFGTPLPQETIDACKAADGVLFGAVGGDKWDKVDPAKRPEKAILGLRKALGLYANLRPVKVADALVEYSPLKPELVKGVDLVIVRELIGGIYFGEKCESEQHNGAERAWDLENYSVPEVERIANLAFETAKLRRGKVTSVDKSNVLATSRLWRRTVAKVAENYPEVECNNLYVDNCAMQIAVNPTQFDVIVTGNLFGDILSDEAAVVGGSIGMLPSASIGECTSLYEPIHGSAPDIAGQGIANPIGTILSAAMLLRYSLHEEAAADAIEAAVDKALGEGYRTPDLWKEGFTKVNTSEITKIISERV

SEQ ID NO: 9297 - protein, 358 aa, Pseudomonas putida GB-1
MSQFHSLTIKQVRNETRDAVSIAFDVPEHLQDQFRFTQGQYLVMRTQLDNEEVRRSYSICSAVQDGELRVAVKRVPGGRFSAFANEVLKAGQQLEVMPPSGSFFVPLDPTRQGNYLGVAAGSGITPILSIIATTLASEPNSRFTLLYGNRSSSGALFRDKLEDLKNTYLDRLNLIFVFSREQQDVDLYNGRIDADKCGQLFSRWLDVPGLDAAFICGPQAMTETVRDSLQANGLEKQRIHFELFAAAGNEARREAREAARQVDAALSHITVISDGRALTFDLPRNTQNVLDAGNAIGAELPYSCKAGVCSTCKCRVIEGEVEMDSNHALEDYEVAAGYVLSCQTYPVSDKVVLDFDQL

SEQ ID NO: 9298 - protein, 554 aa, Selenomonas ruminantium
MNGAQAVVACLREQGVDTVFGYPGGMILPLYDALYDSKEIKQVLVTHEQNAAHAADGYARASGKVGVCIATSGPGATNLVTGLATAFMDSIPVVAITGQVDTTLLGRDAFQETDILDVTMPITKHNYKIKDARHLLSTIREAFTLAKKGRPGPVLVDVPRDLFFQEVAWEEVPACTKKVGKPDADFLICAAEAAREIVKAQRPVVIVGGGVVSAGATAEVTAFVEKYNLPVAHTLMGLGAIPREHPQSLGFAGMHGEKAANHAIAAADLIIAIGSRFGDRQTGNVKKYTQDTKFIHIDIDPAEIDKNIGNSLGLAGDMKVILGLLMKQEAVGNIDEWWQQIQSWKETYDYDYHVNRLTVPWALHQVAQNTKGKPYAFATDVGQHQMWAALHLRIEEPRTWLTSGGLGTMGFGLAAAMGAQMYYGDSRRVIHVAGDGGIKMTGNEFYTIARLNLPVISLIVNNTSLGMIRQLQKVMYKERYIACEFDYQMDYAAYAGSFGIKAETVSTQEEFAEALNRALADQDHPRVIVLNVWRSFVEPMIKGGARIDEFVEFK

SEQ ID NO: 9299 - protein, 184 aa, Selenomonas ruminantium subsp. ruminantium
IKPWETRQLMSKRKGRPLFLIDIAVPRDVDPEVGDIKGVTLYNIDALEEVVDEHIEERRQEAKQAEKIVAEEVASIEEKFQYLSFRPLMALLSDRCERIRQREVKRASSKLPELTEEEWRQVEHMSRMIVRKILRMPMMKLNSAAGTENEQFYIDAMRALFKLDTIGETATSEERHNRYRYAQQ

SEQ ID NO: 9300 - protein, 348 aa, Eucalyptus camaldulensis
MDANGVKQPLLSKPLNSPQTDKKELKRNRLRRCKSAPLAEAVPQEANLNGPVQPSNSILRNLHPSFKRVAIILVFYLGIGTMCFYLVRNEIDGEKTNDLFDAVYFCIVTMTTVGYGDLVPGSALTKLLACAFVFSGMAIVGLILSRAADYLVEKQEILLVKALHLRNKVGPTEMLKEIETNGVRYKCVTAFILLLLLIVAGTTFLALIENLDIVDAFYCVCSTITTLGYGDKSFSTEGGRIFAVFWILTSTICLAQFFLYIAELNTENRQRALVKWVPSRRMTNFDLEAADLDNDGVVGAAEFIIYKLKEMGKINQEDISLILEEFDDLDVDQSGTLSGSDITLAQSS

SEQ ID NO: 9301 - protein, 423 aa, Thermobifida fusca YX
MALIVQKYGGSSVADADAIKRVAERIVAQKKAGYDVVVVVSAMGDTTDELLDLAKQVSPLPPGRELDMLLTAGERISMALVAMAIGNLGYEARSFTGSQAGVITTSLHGNAKIIDVTPGRIRDALAEGAICIVAGFQGVSQDSKDITTLGRGGSDTTAVALAAALNADLCEIYTDVDGVFTADPRIVPSARRIPQISYEEMLEMAASGAKILHLRCVEYARRYNIPLHVRSSFSQKPGTWVVSEVEETEGMEQPIISGVAHDRSEAKITVVGVPDRVGEAAAIFKALADAEINVDMIVQNVSAASTSRTDISFTLPADSGQNALAALKKIQDKVGFESLLYNDRIGKVSLIGAGMRSYPGVTARFFDAVAREGINIEMISTSEIRISIVVAQDDVDAAVAAAHREFQLDADQVEAVVYGGTGR

SEQ ID NO: 9302 - protein, 441 aa, Ralstonia solanacearum GMI1000
MTGKATRIDLFSLRTPQMRAFHLTWLAFFVCFYAWFACAPLMPVLKGEFHLTPGQIANINIAAVAVTILVRLIVGPLCDRFGPRKTYTGLLVLGAVPVLGVALAQSYEAFLFFRLAIGAIGASFVITQYHTSVMFAPNVVGTANAAAAGWGNAGGGVAQGTMPLLLTAIVMLGVTQGMGWRLAMVVPGVAMLIVAVLYWRYTQDCPEGNFDDLRAAGKTIEGGKKGGWGSFVTAAGNYRVWLLFVTYGACFGVEIFIHNIAAIYYVDHFGLSLSAAGMAAASFGLLALFARALGGIVSDRVARSRGLDARTLLLCVLMVGEGLGLLGFAHAGTASLAVLAMLGFGLFTHMACGATYALVPFIDRRALGGVAGIIGAGGNVGAVAAGFLMKGLGDAQQTLSVLGVMVMLSAICAVAVRFSAEHKAREQALYDNTLAAGAANV

SEQ ID NO: 9303 - protein, 400 aa, Triticum aestivum
NDSRLNVGLACTSAVVGAAVLNYAEVVSLIKDESGERVIGARIRDTLSGKEFDAFAKVVVNASGAFCDSVRKMANNDVVPMIAPSSGVHIVLPDYYSPEGMGLIVPKTKDPRVRGRRPGRGGTVAGTTDSSTAITMLPEPHEDEIQFILDAICDYLNVQVRRSDVLSAWSGIRPLAMDPSAKNTESISRDHVVFEDYPGLITITGGKWTTYRSMAEDAVNAAIRSGNLKPANGCVTDHLHIVGAYGWDPASFTVLAQNYKRMKKTYGGKVIPGAMDSAVSKHLSHAYGTLAERVAAIAQNEGLGKRLAHGYPFLEAEVAYCARHEYCESAVDFVARRCRLAFLDTDAAGRALPRIIEILASEHKWDKARRKLEQQKGIEFLETFKSSKNAQFRDGKHNGQ

SEQ ID NO: 9304 - protein, 532 aa, Vitis vinifera
MAVASGSAASFAAFKSGLRCNASVSYPPGRISVRPGKTAGLGAVRCSVGSDDLAKAELRASSVSALELLKTSAADRYTKERSSIIVIGLSFHTAPVEVREKLAIPEANWPQAIVELCALNHIEEAAVLSTCNRMEIYVVALSQHRGVKEVTEWMSKTSGVSVSEICQHRFTLYNEDATRHLFEVSSGLDSLVLGEGQILAQVRQVVKTGQGVPGFDRKISGLFKHAITVGKRVRTETNISAGSVSVSSAAVELALLKLAESSYATVRPLVIGAGKMGKLVIKHLVAKGSTKIVVVNRSEERVAAIRKELKDVEIIYKPLSEMLACTAEADVVFTSTASENSLFLKEHVEALPPVSQEIGGLRLFIDISVPRNVGPCVSDLETVRVYNVDDLKEVVAANKEDRLRKAMEAQGIIAEELKQFKSWKDSLETVPTIKKLRAYAERIRASELDKCLSKMGDGISKKQKAALYDLSMGIVNKLLHGPIQHLRCDENENRTLNETLENMHALNRIFDLETDTSLLEEKIRAKVKQSQP

SEQ ID NO: 9305 - protein, 116 aa, Triticum aestivum
MASQEKPITPSPAPPAPPQPPTPEGAPRIRGFGGGAAGGGYPNPPDAALPDAATLRDQWRFAVRQYSRWYSQAWGTAILAGGAFFALGWLVKGSNPLPSRADPRPPNDANADEDKK

SEQ ID NO: 9306 - protein, 656 aa, Vitis vinifera
MVIPAFKIIRASPILGFFFAGVVLNQLGLIRNLTDVKVLSEWGILFLLFEMGLELSLARLQALAKFAFGMGLTQVVLSTLAFTAFELPPNGAIGTRILEFLFHSRPDLVNIRSVDEAVVIGAALSLSSSAFVLQLLAEKGELPTRFGSATLGILLLQVRFNICVTLYRYTNSSSNLVEESIWPMLAKESLKALGGLGLLSLGGKFFLRRFFEVVAEARSSEAFVALCLLTVAGTSLVTQKLGFSDTLGAFLAGALLAETNFRTQIEADIRPFRGLLLGLFFVTTGTSIDTQLLVREWPNVLSLLAGLIVIKTLIISAIGPRVGLTIQESVRIGFLLSQGGEFAFVVFSLANRLGVLPLELNKLLIIVVVLSMALTPLLNEVGRRAADFIDEKFVAEDKPDDTINFDVSEPVVILGFGQMGQVLANFLSAPLASGVDGDILGWPYVAFDLDPSVVKASRKLGFPVLYGDGSRPAVLQSAGISSPKAVMVMYTGRKRTMEAVQRIRNAFPAVPIYVRAQDLTHLLDLKKAGATEVILENAETSLQLGSKLLKGFGVMSDDVTFLSQIVRDSMEIQAQETLDKTDDPELDVLKPLQVLTYANHLNIIAKKAVTYCWSCPTGSLVGGGWVGYTILCCMFSMHQKMSPNLCIVAKHSSIPF

SEQ ID NO: 9307 - protein, 220 aa, Arabidopsis thaliana
MAPTIKRIRSFRTHQKHFVDFFGDDLIVTVTPTASVIRRWIRSVRSYNRNHSVHPLVVGIGVQWRPDSSDPDPPPKTLQLCVGSRCLIIQLGYNYGLPKVLRTFLADPKTTFVGVWNGQDQKKLEKCRHRVEIGKLLDIRMFVRDSRGARMCFCSFEQIVKERLGRVGVRLDPAICMSDWGVYNLNHYQVLQASIESYVCFKLAVEERLWNLKVAANLVI

SEQ ID NO: 9308 - protein, 310 aa, Yersinia pestis CO92
MMSVFILGSYAKALVMTTDRIPLAGETLIGYDFRQTWGGKGSDMAVQAVRLGAEVAYAGVVGDDTFGHEFVGLMQEEGVNIDALTISGELPTGAGLIVKDKEARNVIVVDMGANKLFTPALVDSALSQLKQSNVVLTQLEIPLETARYGLQRAKEFGKITILNPAPARDLRGLDLSAIDYLTPNETEARVALGLPPDDPRSNREIANLLLETGCQYVVMTLGESGSAVFGRNDTQEIPPCIIDVVDSNGAGDSFNAALAVALDEGLPISEAVLFANATAALCCMDWETVPSYRYREDVDAFMRSITVKEE

SEQ ID NO: 9309 - protein, 320 aa, Arabidopsis thaliana
MATAVGGGSDVEVGFAKLQGEDFEYYMQSYSIILGRNSKKATVDVDLSSLGGGMNISRNHARIFYDFTRRRFSLEVLGKNGCLVEGVLHLPGNPNVKLDSQDLLQIGDKEFYFLLPVRSILGGPLGPRHHVSGQTSVVPYHNYQSGPGSGSGKKGVRSRELYEYDDEDDDDDDDEEDDMRGSGKKTRRDGHEVVYASGEKKREGRSKVDREADDQQFLQLEEKDVVSSVATVLSDLCGPGEWMPMEKLHSVILKEYGNVWHHSRVRRYLSQEDWAIPEAKGKPWYGLLMLLRKYPEHFVINTRSKGRVTLEFVSLVTLLS

SEQ ID NO: 9310 - protein, 294 aa, Debaryomyces hansenii CBS767
MSTYSESNFNTTHYNLARPSYPDEFYNTLIEYHDSTNSAHELALDIGCGSGFVAFKLIDFFEKVIGTDISSTMVNQCRKTAKPGKNIQFLVGSAEQAPPEIQENSVDLITGAECCHWVDHEKFFKESFRILKPGGTLAYWFYKDPIFIGHDKANEIYTNYTYNSSMEMNKDDTFERYMGPYYQQPGHDYLRTLMKEIEVPTKYYKNVVRHEYDPVHHGADSTKTTLYISKKITLPAFLNYVKSWSAYHTWMTEHGSKYDIAEAFVNELKEAMNWDDTFEFEVVWATVYTFAKKK

SEQ ID NO: 9311 - protein, 294 aa, Brassica napus
MDSPFKPDVLKGKVALITGGGSGISFEISSQFGKHGASIAIMGRRKQVLDAAVSDLRSLGIPAVGFEGDVRKPEDARRVVESTFNHFGKVDILVNAAAGNFLAAAEDLSTNGFRTVLDIDAVGTFNMCREALKYLKKGGPGRDASSGGGSILNISATLHYTASWYQIHVSAAKAAVDAATRNLALEWGTDYEIRVNGIAPGPIGGTPGMSKLGPDEIENKAGDYIPLYKLGEKWDIAMAALYLSCDSGKYVNGLTMVVDNGQWLSRPRNLPKEAVKELSRVVEKRSRAKPTSKL

SEQ ID NO: 9312 - protein, 289 aa, Mimosa pudica
MEGKEQDVSLGANKFPERQPIGTAAQSQDDGKDYQEPPPAPLFEPSELTSWSFYRAGIAEFVATFLFLYITILTVMGVVKSDSKCKTVGIQGIAWAFGGMIFALVYCTAGISGGHINPAVTFGLFLGRKLSLTRAIFYIVMQCLGAICGAGVVKGFEGKTVFGDKGGGANYVHDGYTKGDGLGAEIVGTFILVYTVFSATDAKRSARDSHVPILAPLPIGFAVFLVHLATIPITGTGINPARSLGAAIVFNKHLGWHEHWVFWVGPFIGAALAALYHVVVIRAIPFKSK

SEQ ID NO: 9313 - protein, 287 aa, Mimosa pudica
MTKDVEVQEQGDFSAKDYHEPPPAPLIDPEELGKWAFYRAVIAEFVATLLFLYVTILTIIGHNSSTDSKKGPGVTDCDGVGILGIAWAFGGMIFILVYCTAGISGGHINPAVTFGLFLGRKVSLIRAVLYMVAQCAGAICGTGLAKAFQKAYYDRYGGGVNFVQPGYSKGTALGAEIIGTFVLVYTVFSATDPKRNARDSHVPVLAPLPIGFAVFMVHLATIPVTGTGINPARSFGAAVIYNGSKAWDDHWIFWVGPAIGALAAAIYHQYILRAAAIKALGSFRSNN

SEQ ID NO: 9314 - protein, 471 aa, Escherichia coli
MLLPVIMAGGTGSRLWPMSRELYPKQFLRLFGQNSMLQETITRLSGLEIHEPMVICNEEHRFLVAEQLRQLNKLSNNIILEPVGRNTAPAIALAALQATRHGDDPLMLVLAADHIINNQPVFHDAIRVAEQYADEGHLVTFGIVPNAPETGYGYIQRGVALTDSAHTPYQVARFVEKPDRERAEAYLASGEYYWNSGMFMFRAKKYLSELAKFRPDILEACQAAVNAADNGSDFISIPHDIFCECPDESVDYAVMEKTADAVVVGLDADWSDVGSWSALWEVSPKDGQGNVLSGDAWVHNSENCYINSDEKLVAAIGVENLVIVSTKDAVLVMNRERSQDVKKAVEFLKQNQRSEYKRHREIYRPWGRCDVVVQTPRFNVNRITVKPGGAFSMQMHHHRAEHWVILAGTGQVTVNGKQFLLTENQSTFIPIGAEHSLENPGRIPLEVLEIQSGSYLGEDDIIRIKDQYGRC

SEQ ID NO: 9315 - protein, 286 aa, Mimosa pudica
MGKDVEEVGEQREMRGKDYEDPPPAPLIDPVELTKWSLYRAVIAEFIATLLFLYVTVLTIIGNSSQTSGTAADAACGGVGVLGIAWAFGGMIFILVYCTAGISGGHINPAVTFGLFLGRKVSLIRAVLYILAQMAGAICGAGLAKAFQKSYYDRYGGGANFVQDGYSTGTALGAEIIGTFVLVYTVFSATDPKRSARDSHVPVLAPLPIGFAVFMVHLATIPVTGTGINPARSFGAAVIYNKDKIWDDHWIFWVGPAIGAAVAAIYHQHILRATAIKALGSFRSNA

SEQ ID NO: 9316 - protein, 487 aa, Synechococcus sp. WH 8102
MVASAPASAGTKGVIRQVIGPVLDVEFPAGKLPKIYNALRVETKNTAGQDVALTAEVQQLLGDHRVRAVAMSGTDGLVRGMEIADTGAPISVPVGEATLGRIFNVLGEPVDEQGPVNASATAPIHRDAPNLTELETKPKVFETGIKVIDLLAPYRQGGKVGLFGGAGVGKTVLIQELINNIAKEHGGVSVFGGVGERTREGNDLYEEFKESGVINADDLSKSKVALCYGQMNEPPGARMRVGLSALTMAEHFRDVNKQDVLLFVDNIFRFVQAGSEVSALLGRMPSAVGYQPTLGTDVGALQERVASTVEGSITSIQAVYVPADDLTDPAPATTFAHLDATTVLNRALASKGIYPAVDPLDSTSTMLQPAVVGDEHYRTARLVQSTLQRYKELQDIIAILGLDELSEDDRQTVDRARKVEKFLSQPFFVAEIFTGMPGKYVKLEETIAGFNQILAGELDHLPEAAFYLVGSIEEAKAKAEKIAAETK

SEQ ID NO: 9317 - protein, 288 aa, Mimosa pudica
MAKDVEVAERGSYSAKDYHDPPPAPLIDAEELGKWSFYRALIAEFIATLLFLYITVLTVIGYKSQTDTTVATGDVCGGVGILGIAWAFGGMIFILVYCTAGISGGHINPAVTFGLFLARKVSLIRAILYIVAQCLGAICGVGLVKAFQKAYYTKYGGGANTLGDGYSVGTGLGAEIIGTFVLVYTVFSATDPKRNARDSHVPVLAPLPIGFAVFMVHLATIPVTGTGINPARSFGAAVIFNQQKAWDKHWIFWVGPFIGAAIAAFYHQFILRAGAAKALGSFRSNPSV

SEQ ID NO: 9318 - protein, 538 aa, Bradyrhizobium sp. ORS278
MAIIDNTISPTGAAFQTNRDGMLGLIARMRELEARTRKASAAAKDRFHQRGQLLPRERVALVLDPGAPFLELSTLAGYMFDTPDPAKSVPGGGVIAGIGFVSGVRCMVSANDAAIDAGALQPYGLDKTLRVQELALENRLPYVQLVESAGANLLRYRVEDFVRGGNIFRNLARLSAAGLPVVTVTHGSSTAGGAYQTGLSDYIVMVRGRTRAFLAGPPLLKAATGEIATEEELGGAEMHTAISGLGDYLAEDDRDGLRIAREIMGRLNWDRPSHEACAAKPPRYDQEELLGIMPLDHKRPVDMRQVIARIVDDSDFVEMSPNYGPATVCGHARIEGEAIGIVTNNGPLDPAGANKATHFIQACCQSRTPILYLNNTTGYMVGRAYEEAGMIKHGSKMIQAVTSATVPQITIYCGASFGAGNYGMCGRGFHPRFCFSWPNAKTAVMGGEQAAETMAIVTEAAAARRGKPVERDKLDAMKAQIIGVFDSQMDVFATSARVLDDGVIDPRDTRAVLSEVLAICREAEARAPQRMQFSVARP

SEQ ID NO: 9319 - protein, 588 aa, Burkholderia sp. 383
MSLIEVKVPDIGDFSGVDVIEVNVKPGDVIEKEQTLITLESDKASMEVPSDVAGTVKEIKVKAGEKVSQGTVIAIVEAAAGAAAPAKAPEAAKPAAAAPAPAAAAPAPAPQAGSYAGAVDVECDMLVLGAGPGGYSAAFRAADLGMKTVLVERYSTLGGVCLNVGCIPSKALLHTSLVVEEAAALASHGITFGKPEVDLDKLRDFKGGVVKKLTTGLAGMAKARKVEVVTGVGAFVDPFHMEVQGENGKKVVKFKQAIIAAGSQAVKLPFMPEDPRVVDSTGALELRQLPKRMLVIGGGIIGLEMATVYSTLGAEIDVVEMMDGLMMGADRDLVKVWEKYNAKRFGNVMLKTKTVGAEAKEDGIYVKFEGEKAPAEAQRYDLVLVAVGRSPNGKKIGADKAGVAVTDRGFIDVDKQMRTNVPHIFAIGDVVGQPMLAHKAVHEGHVAAEAAHGEKAYFDALQIPSVAYTDPEVAWAGKTEDQCKAEGIKYGKAVFPWAASGRAIANGRDEGFTKLIFDEETHRVIGGAIVGLNAGDLISEVCLAVEMGADAEDIGKTIHPHPTLGESVGMAAELYEGVCTDLPPQRKK

SEQ ID NO: 9320 - protein, 305 aa, Klebsiella pneumoniae subsp. pneumoniae MGH 78578
MALEKGIASLVEAFIAAGRPSSRDQHIDDRRAGYIASAVLAGETETRVRVEDITLEGMHFRVVSPPTADGLLPTLIYYHGGCFVSGGFTTHDNQLRQLAMFSGCRVIAVQYRLAPEHTFPAAHDDAERGATIIHQHAKQLGVDASRITLAGDSAGGHLALVTALRLKAAGTWQPAQLILIYPMLDATASMASYASNGEDYIITRDTLLSGYEMYLAATPATHPDASPLWREDFHGLPPVHILTAEFDPLRDEGEVLYRRLTEQGVESSCQRYLGVIHGFFQLGGVSNAARDAMRDIAWRVASPGR

SEQ ID NO: 9321 - protein, 548 aa, Burkholderia sp. 383
MSQAIEVKVPDIGDYKDVPVIEIGVKVGDTVEPEQSLVTLESDKATMDVPSPVGGVVKEIKVKVGDSVSEGSLIILLEGGAAAQANGAAAPAAAPAPAAAPAPAAATPAAAPAATGGTLEVKVPDIGDYKDVPVIEIGVKVGDTVEKEQSLVTLESDKATMDVPSPAAGVVKEIKVKVGDSVSEGTLIVLLDAAGAAPAAAAPQASAPAPAAAAPAPAAAPAKAAAPAAAAPAPAAAPSGEYRASHASPSVRKFARELGVEVARVQGSGPKGRITKEDVTGFVKGVMTGQRTAPGAAAAPAGGGELNLLPWPKVDFSKFGPFEAKPLSRIKKISGANLHRNWVMIPHVTNNDEADITELEALRVQLNKEHEKAGVKFTMLAFVIKAVVAALKKFPTFNASLDGDNLVFKQYYHVGFAADTPNGLVVPVIRDADKKGLVDIAKEMAELSKAARDGKLKPDQMQGGCFSISSLGGIGGTNFTPIINAPEVAILGLSRGQMKPVWDGKQFVPRLTLPLSLSYDHRVIDGAEAARFNAYLGALLADFRRIIL

SEQ ID NO: 9322 - protein, 199 aa, Pseudomonas putida GB-1
MPCYRLDGLTPVVHPTAYVHPSAVLIGDVIVGPRCYIGPLASLRGDFGRIVLEEGANLQDTCVMHGFPGGDTVVERNGHVGHGAVLHGCRVGEDALIGMNAVVMDGAHVAPRCIVAATAFVKAGFECAVQSLVMGSPAQVKRPLTDQELAWKQRGTAQYQHLAQRCMNSMVECPPLAEAEPGRPRMEDSGVRPKGQASA

SEQ ID NO: 9323 - protein, 175 aa, Triticum aestivum
MAPTVMASSATSVAPFQGLKSTAGLPVSRRSNGASLGSVSNGGRIRCMQVWPIEGIKKFDTLSYLPPLSTEALLKQVDYLIRSKWVPCLEYSKVGFIFREHNASPGYYDGRYWTMWKLPMFGCTDATQVINEVEEVKKEYPDAYVRIIGFDNMRQVQCVSFIAFKPPGCEESGKV

SEQ ID NO: 9324 - protein, 404 aa, Ralstonia solanacearum GMI1000
MMSRHTELNRHLAAAQPSATYRVIDRVAARRASGAEVISLSAGEPDFDTPAHVREAGIEAIRAGMTRYTQVAGLRALREAVADKFRGENGLAVGWQDTIVCSGGKQVIYNALAATLNEGDEVVIPAPYWVSYPEIVQLCGARSVIVPCGAESGFKLTPGALEAALSARTRWLILNSPSNPTGAVYTAQELRALAEVLLAHPDVLVLSDDIYEHLIFDGARFHTLAQVEPRLQSRVLTMNGVSKAYAMTGWRIGFGAGPRWLLEAMEKLQGQQTSGACSISQHAAVAALRGPQDFIGASRAAFERRRDLVVGMINAVPGMRCETPAGAFYAFASCDGLIGKTTLDGTLLRSDEDVSNALLDERGIGVVPGSAFGLGPYLRIAYAIDDTALRTACTAIDTFARSLR

SEQ ID NO: 9325 - protein, 378 aa, Oryza sativa Japonica Group
MASGNQYLQVTGQWSQLAGEEDKLVVVAGRLAIIRQRRPMLVQPPNAVAVRATAAGKEPLFSFGVIADVQYADIPDGRSFLGVPRYYRHSLTILQRAVRSWNAHNHKHPVAGGGVRFCVNFGDIVDGFCPKDRSLAAVQAVVAEFDRFHGPAYHMLGNHCLYNLPRSKLVSLLRMPSGRAYYDFSPFPGYRFVVLDAYDFSAVGWPRGHPVAAAARRFLDERNPNADKNSPSGLAGVDRRFVMFNGAVGEAQLRWLDGVLRGAARRREAAVVCSHLPLHPGAASPSGLMWNYEEVMRVVHRHGCVAACLAGHDHRGGYGVDARGVHHRTLEAALECPPGTDAFGRVDVYPDGLTLVGAGRMGSTDMRLQLHSPVTELS

SEQ ID NO: 9326 - protein, 461 aa, Glycine max
MEEGNWVLFLTLAISLCVSGAFQIQTETLPLHTLPEPHILSETLSEPQETLSLSLHLHLHHIDALSSNKTPEQLFHLRLQRDAKRVEALLIQIHARRSAGSSFSSSIISGLAQGSGEYFTRIGVGTPARYVYMVLDTGSDVVWLQCAPCRKCYTQTDHVFDPTKSRTYAGIPCGAPLCRRLDSPGCSNKNKVCQYQVSYGDGSFTFGDFSTETLTFRRNRVTRVALGCGHDNEGLFTGAAGLLGLGRGRLSFPVQTGRRFNHKFSYCLVDRSASAKPSSVIFGDSAVSRTAHFTPLIKNPKLDTFYYLELLGISVGGAPVRGLSASLFRLDAAGNGGVIIDSGTSVTRLTRPAYIALRDAFRIGASHLKRAPEFSLFDTCFDLSGLTEVKVPTVVLHFRGADVSLPATNYLIPVDNSGSFCFAFAGTMSGLSIIGNIQQQGFRISYDLTGSRVGFAPRGCV

SEQ ID NO: 9327 - protein, 398 aa, Streptococcus pyogenes str. Manfredo
MAKLTVKDVDLKGKKVLVRVDFNVPLKDGVITNDNRITAALPTIKYIIEQGGRAILFSHLGRVKEEADKEGKSLAPVAADLAAKLGQDVVFPGVTRGSKLEEAINALEDGQVLLVENTRFEDVDGKKESKNDEELGKYWASLGDGIFVNDAFGTAHRAHASNVGISANVEKAVAGFLLENEIAYIQEAVETPERPFVAILGGSKVSDKIGVIENLLEKADKVLIGGGMTYTFYKAQGIEIGNSLVEEDKLDVAKDLLEKSNGKLILPVDSKEANAFAGYTEVRDTEGEAVSEGFLGLDIGPKSIAEFDQALTGAKTVVWNGPMGVFENPDFQAGTIDVMDAIVKQPGVKSIIGGGDSAAAAINLGRADKFSWISTGGGASMELLEGKVLPGLAALTEK

SEQ ID NO: 9328 - protein, 767 aa, Rickettsia typhi str. Wilmington
MNEMNKINYAEALEYHEKDKPGKIAITATKSLVTQQDLSLAYSPGVAAPCLEISKNLDAVYKYTSRSNLVAVISNGTAVLGLGNLGAAASKPVMEGKAVLFKKFADIDAIDLEINTEDPIEFINAVKYLSYSFGGINLEDIKAPECFLIEEKLKSLMDIPVFHDDQHGTAIITAAGLINAAYLTNRTLEDLKIVINGAGAAAIACIDLLIALGVDKSKIILCDTKGVIYKGRTSGMNKWKERYASDTKIRTLTESLNNADVFIGLSVKGAVTKDMISQMAHKPIIFAMANPDPEITPEDIKFVRDDAIIATGRSDYNNQINNVMGFPYIFRGALDVRASTINTEMKIAAARAIADLARRPVPEEVYKAYSGRKLVFGNEYIIPVPFDPRLITVVAAAVAVAAIETGVARVKDFSIGKYKQQLGSRLNPTANYMNFLAEKIHNVPLKRIVFAEGEEEEVISAALMMRDEKYGNPIIIGRVERIEVILKKIGKDISLDGIQIMNAALSDRLEQYTDYLYKRLQRKGYLYRDCAKLVKTDKNIFAACMVACGDGDALLTGVTKSYIDSLEDIMKVISPKQNRRILGYSIMIAKDHNIIIADNCITEYPNSLELAQIATQTAEIAKNMGITPRVALISFATFGNSSQEKTTRIREAVNILDNFSKDKKQLNDMKVDFEYDGEMSIKVALDHDLRKLYNFCRLSGSANVLIMPGLNSAAIATELLQKFSSNSFIGPITNGFEKPVQILQTTATANEILKIATFACVEAIKEV

SEQ ID NO: 9329 - protein, 287 aa, Gossypium hirsutum
MEGKEEDVKLGANKFSERQPIGTSAQTDKDYKEPPPAPLFEPGELKSWSFYRAGIAEFVATFLFLYITVLTVMGVSQSKTKCTTVGIQGIAWAFGGMIFALVYCTAGISGGHINPAVTFGLLLARKLSLTRAVFYMIMQCLGAICGAGVVKGFEGDSRYEMLGGGANVVNHGYTKGDGLGAEIIGTFVLVYTVFSATDAKRNARDSHVPILAPLPIGFAVFLVHLATIPITGTGINPARSLGAAIIYNKDHAWDDHWIFWVGPFIGAALAAIYHQIIIRAIPFKTRA

SEQ ID NO: 9330 - protein, 510 aa, Mycobacterium tuberculosis H37Rv
MTTQISHFIDGQRTAGQSTRSADVFDPNTGQIQAKVPMAGKSDIDAAVASAVEAQKGWAAWNPQRRARVLMRFIELVNDTIDELAELLSREHGKTLADARGDVQRGIEVIEFCLGIPHLLKGEYTEGAGPGIDVYSLRQPLGVVAGITPFNFPAMIPLWKAGPALACGNAFVLKPSERDPSVPVRLAELFIEAGLPAGVFQVVHGDKEAVDAILHHPDIKAVGFVGSSDIAQYIYAGAAATGKRAQCFGGAKNHMIVMPDADLDQAVDALIGAGYGSAGERCMAISVAVPVGDQTAERLRARLIERINNLRVGHSLDPKADYGPLVTGAALARVRDYIGQGVAAGAELVVDGRDRASDDLTFGLPEGDANLEGGFFIGPTLFDHVAAHMSIYTDEIFGPVLCMVRARDYEEALRLPSEHEYGNGVAIFTRDGDAARDFVSRVQVGMVGVNVPIPVPVAYHTFGGWKRSGFGDLNQHGPAAIQFYTKVKTVTSRWPSGIKDGAEFVIPTMS

SEQ ID NO: 9331 - protein, 360 aa, Glycine max
  misc_feature (109)..(109): Xaa can be any naturally occurring amino acid
MMSWACRSEESESPNNLIPYLPNDVALNCLARIPRSHHPTLSLVSKPIRSLLYSPLLFTTRSLLQCTQPLLYLTLRSRDSSLQWFTLHRTNPNPLLAPLPPIPSPAVGXSPTPVLGPTIYVLGGSIQDVPSPHVWLLDCRFHRWLRGPPMRVAREFAAAGVLHGKIYVLGGCVADTWSRSANWAEVLDPASGRWERVASPTEVREKWMHASAVVGDRIYAMADRGGIAFEPRSCAWESVGGELDHGWRGRACVVEGILYCYDYLGKIKGFDVGRGVWEELKGLENALPRFLCGATMADLGGKLCVVWECQCNGKEMEIWCAEIGVKKNSDGELWGQLGWFGKVLSVPKGSSIVNCSSVSL

SEQ ID NO: 9332 - protein, 350 aa, marine gamma proteobacterium HTCC2080
MSDIYQTQGRGQLYGDITRTVGDTPCVKLNRIAPDHVEVYVKVESFNPLGSVKDRLALNIIEAAERSGQLKPGQTVVEATSGNTGIGLAMVCAARGYPLVITMADSFSIERRRLMRFLGAKVVLTPKAEKGIGMYRKARQLAADNGWFFAAQFESNANADIHEATTGPEIVADFADSRLDYWVSGYGTGGTVSGVARVLRKERPECKIILSEPHTATLIGSGEAQVRNDDGSPNGSHPAWSPHLIQGWTPDFIPLVLQESIDHNGFDEILPVDAEDGMTWAKRLATEEGILTGVSGGSTLATAMEVAAGAEAGSVMLVMLPDTGERYLSTPLFEAIPAEMTPEEQALADS

SEQ ID NO: 9333 - protein, 339 aa, Magnetospirillum magnetotacticum MS-1
DRRRVVDALGRPVDGLGPLQEGGDSVALDADPPSAMTRARVKTPLLTGVRAIDLFTPLCAGQRIGIFAGSGVGKSTLLAMLAGAEGFDSVVVALVGERGREVREFLEGPIAAVRDRAVIVVSTGDESPMMRRQAPKVALAVAESFRDRGESVLLIVDSVTRYAHAARDVALAAGEPAVARGYPPSVFSDLPRLLERAGPGAEGKGAITGIFSVLVDGDDHNDPVADSIRGTLDGHVVLDRAIAEQGRYPAIDLLGSISRLAGEVWSGDQRELVRKLKTMMARFEETRDLRLMGGYRAGSDPDLDQAVTLVPRIYEALRQEPGQPPSRDAFLELAQSLRG

SEQ ID NO: 9334 - protein, 160 aa, Dichelobacter nodosus VCS1703A
MNQEVNRIEGDFVVDESARFALICARFNDLIVHKLETAAIDTLCRHGVKGKHIDVYYVPGAHELPLAAQRAAMLGKYDAIIALGAVIEGSTAHFDVVVNEQAKGLAQVALKYDLPVITGVLTTHNIEQAIERAGTKAGNKGADAARAAIEMVSLLKRMGS

SEQ ID NO: 9335 - protein, 281 aa, Mimosa pudica
MTKDLEGPPPPHKDYHDPPPAPLLDAAELGKWSFYRAVIAEFVATLLFLYITVLTVIGYKSQIDGGHDCDGVGVLGIAWAFGGMIFILVYCTAGISGGHINPAVTFGLFLARKVSLIRAIAYIVAQCLGAICGCGLVKAFQKAFYNRYGGGANTLSTGYSSGTGLGAEIIGTFVLVYTVFSATDPKRNARDSHVPVLAPLPIGFAVFMVHLTTIPITGTGINPARSFGAAVMYNNFEAWDDHWIFWVGPFIGAAIAAIYHQYVLRAQAAKALGSFRSSSHL

SEQ ID NO: 9336 - protein, 199 aa, Vitis vinifera
MEKEMIAKSFISSAAYAPSLLPLLSPSRNLNFRCLSPLKANPQRCVVGGTKRFWFLVFSFCGFLGNQTECLNWFAWLLLEEIWSRRVCRRRCRCAWRSSFFKLDIGIWTTPEEFSAGHASGAINVPYMLRFGSGMAKNPKFLVEVSSHFRKDDEIIVGCQKGKRSLMAVNDLLAAGFTAITDIAGGYDAWSQNGLPTDS

SEQ ID NO: 9337 - protein, 281 aa, Mimosa pudica
MSKEVSEEGQTQHHGKDYVDPPPAPLIDMAELRLWAFYRALIAEFIATLLFLYITVATVIGHKKQSGPCDGVGLLGIAWGFGGMIFVLVYCTAGISGGHINPAVTFGLFLARKVSLIRALAYMVAQCLGAICGTGLVKAFMKHSYNSLGGGANEVNSGYSKGTALGAEIIGTFVLVYTVFSAIDPKRSARDSHVPVLAPLPIGFAVFMVHLATIPITGTGINPARSFGAAVIYNNGKAWDDHWIFWVGPFVGALAAAAYHQYILRAAAIKALGSFRSNPTN

SEQ ID NO: 9338 - protein, 543 aa, Synechococcus sp. WH 8102
MDQSSGKGSGRDVGVAPVVLTILDGWGHRNDSEHNAIRQGDTPVMEALWHAYPHALIQASGSHVGLPDHQMGNSEVGHLTIGAGRIIRQELVRISDTVRDDQLNNTPALVELAEHLQNDTGTLHLLGLCSDGGVHSHVNHLCGLIHWAAAAGIKKVAVHAITDGRDTPTQSAMGSITLVQRAMEEAGVGHLASLCGRYWAMDRDKRWDRTEKAYDLYTDPTRSISDQSPQQLLAESYAAGITDEFLKPVRLSDDVMQDGDSVLVFNFRPDRARQIVQTLCLDDFDGFERRTTPKLDVVTFTQVEQDLPVSVAFPPEPLDDLLGQVVAEAGLRQYRTAETEKYPHVTYFMNGGIEQPLPGEERHLVPSPRVATYDLSPAMSADQLTDSCIDAIDQGTYSLIVINYANPDMVGHTGVMDAATEAIATVDRCIGRLLDAVGRRGGTMLITADHGNAELMQGPDGQAWTAHTTNPVPCILVEGEQRKLPGHGNDISLREDGGLADIAPTLLQILNLEQPAAMTGRSLIEPVSNVDPSPLSARLPLPV

SEQ ID NO: 9339 - protein, 251 aa, Mimosa pudica
MPVQNIAIGRPEEATHPDTLKAGLAEFISTLIFVFAGSGSGMAFNKLTDNGATTPAGLISAAIAHAFALFVAVAVGANISGGHVNPAVTFGAFIGGNISLLRGIVYWIAQLLGSVVACLLLKFVTGGLTTPAFGLSSGVGVWNAVVFEIVMTFGLVYTVYATAVDPKKGNIGIIAPIAIGFIVGANILAGGAFDGASMNPAVSFGPAVVSWTWDNHWVYWVGPLIGGGLAGVIYEVIFISHTHEQLPTTDY

SEQ ID NO: 9340 - protein, 393 aa, Saccharomyces cerevisiae
MDHYLVPYNQRANHSKPIPPFLLDLDSQSVPDALKKQTNDYYILYNPALPREIDVELHKSLDHTSVVCCVKFSNDGEYLATGCNKTTQVYRVSDGSLVARLSDDSAANKDPENLNTSSSPSSDLYIRSVCFSPDGKFLATGAEDRLIRIWDIENRKIVMILQGHEQDIYSLDYFPSGDKLVSGSGDRTVRIWDLRTGQCSLTLSIEDGVTTVAVSPGDGKYIAAGSLDRAVRVWDSETGFLVERLDSENESGTGHKDSVYSVVFTRDGQSVVSGSLDRSVKLWNLQNANNKSDSKTPNSGTCEVTYIGHKDFVLSVATTQNDEYILSGSKDRGVLFWDKKSGNPLLMLQGHRNSVISVAVANGSSLGPEYNVFATGSGDCKARIWKYKKIAPN

SEQ ID NO: 9341 - protein, 896 aa, Vitis vinifera
MEYHGPPVTYDIPRAVPINVEKIPVATVVAQVSLSDKLSLPVVQPLLAPDPRCKMLSKEIKLGSKSTVSPTSVIAFERGSEDDGGCVSKELDLGSEATVSPTSVIAYEERAAAEFSDRLYKSRDLSGSSGAFEVSNGCKESLDFNDLNAPDWVSTESQVSLDYPSSRVSSLKAGDCSNEPGCDVRRTPVVSFRGVALDDDTNEEFSSAEPEIVRPKKEPETKGKKGSCYRCFKGSRFTEKEVCIVCDAKYCSNCVLRAMGSMPEGRKCVTCIGYPIDESKRGNLGKCSRMLKRLLNELEVRQIMKSEKMCETNQLPPEYVCVNEKPLSQEELVLLQNCPNPPKKLKPGNYWYDKVSGLWGKEGQKPSKIISPNLSVGGPIRANASNGNTQVFINGREITKVELRMLQLAGVQCAGNPHFWVNEDGSYQEEGQKNTKGYIWGKAGTKLVCAVLSLPVPSKFLSPSGEQVNNFVTRTVPDYLEQRTLQKLLLIGNNGSGTSTIFKQAKILYKATPFSEDERENIKLKIQSNVYGYLGILLEGRERFEDESLIEMRKRKSYHKSDSIGNTDDENDDKTIYSIGTRLKAFSDWLLKTMVAGNLEAIFPAATREYAPLVEELWNDAAIQATYKRRSELEMLPSVASYFLERAVDILRTDYEPSDVDILYAEGVTSSNGLACVDFSFPQSEPGDDIDTADLHDSLLRYQLIRVQARGLGENCKWLEMFEDVRIVIFCVSLNDYDQYSYDANGSLVNKMMLSQRLFESIVTHPTFEQMDFLLILNKFDLFEEKIERVPLTQCDWFEDFHPVVSRNRSNSNSNNINNSPSLGQLAFHYIAVRFKTLYSSLTGRKLYVSLVKGLELNSVDETLKYAREILKWDEERANFSLSDSVYSTEPSSFSH

SEQ ID NO: 9342 - protein, 457 aa, Fulvimarina pelagi HTCC2506
MLDRNNELGAFDRDHFFHPSTHMGTHARGESPTRIIKTAKNATIVDRDGKESLDAFAGLYCVNAGYGRTEIADAIAKQAHELAYYHAYVGHGTEVSIRLAKMIVDRAPDHMSRVYFGLSGSDANETNIKLVWYYNNVLGRPEKKKIISRWRGYHGSGVMTGSLTGLHLFHNAFDLPRAPILHTEAPYYYRRPNRDQSEEEFATWCADKLEEMILAEGPETVAAFIGEPVLGTGGIVPPPATYWEKVQAVLDKYDVLLIADEVVTGFGRLGSMFGSEHYGMKPDLITIAKGLTSAYAPLSGTIVGKDMWNVLVSGSDQLGSIGHGWTYSAHPICAAAGVANLELIDNLDLIENVKTVGARFRNGLQDALGDHANVGEVRGEGLIAAVEFVKDRDDRVFFEADEKVGARITAALAERGVIGRAMPQGDILGFAPPFCLTAEEADTVVAKAKEAVASVLG

SEQ ID NO: 9343 - protein, 250 aa, Mimosa pudica
MVKIAFGSLNDSFSAASIKAYVAEFIATLLFVFAGVGSAIAYGALTKDAALDPAGLVAVAVAHAFALFVGVSVAANISGGHLNPAVTFGLVIGGNITVLTAIFYWIFQLLGSLVACLLLKFVTSAPTVPVHGLASGVGIFEGIVFEIVATFGLVYTVYATAADPKKGSLGIIAPIAIGFIVGANILAAGPFSGGSMNPARSFGPAAVSGDFTNYWIYWVGPLIGGGLAGLIYGDVFIGSYAPVPTSESYP

SEQ ID NO: 9344 - protein, 742 aa, Thermobifida fusca YX
MIEPLQPGDPGRIGPYRLVSRLGAGGMGQVFLARSPGGRPVVVKVILPEYANDDEYRIRFAREVEAARRVGGFHTAQVIDADPTADPPWMATAYIPGPSLRKAVTERGPLYGNNLRTLAAGLVEGLAAIHACGLVHRDFKPSNIVLAADGPRVIDFGVARPLDSSVMTQSGAVIGTLAYMSPEQTDGSQVGPASDVFSLGTVLAFAATGRSPFMADSIGEIIARISGPPPELPELPDDLRELVYACWEQNPDLRPTTAELLAQLSTDHTGDDWPPPHLSDLIGSMLPLGATTSPNPSLAIEPPPPSHGPPRPSEPLPDPGDDADEPSAEKPSRTLPEPEPPELEEKPIQVIHEPERPAPTPPRPREPARGAIKPKNPRPAAPQPPWSPPRVQPPRWKQLITKKPVAGILTAVATAGLVVSFLVWQWTLPETPLRPDSSTAPSESADPHELNEPRILTTDREAVAVAFSPGGSLLAGGSGDKLIHVWDVASGDELHTLEGHTDWVRAVAFSPDGALLASGSDDATVRLWDVAAAEERAVFEGHTHYVLDIAFSPDGSMVASGSRDGTARLWNVATGTEHAVLKGHTDYVYAVAFSPDGSMVASGSRDGTIRLWDVATGKERDVLQAPAENVVSLAFSPDGSMLVHGSDSTVHLWDVASGEALHTFEGHTDWVRAVAFSPDGALLASGSDDRTIRLWDVAAQEEHTTLEGHTEPVHSVAFHPEGTTLASASEDGTIRIWPIATE

SEQ ID NO: 9345 - protein, 479 aa, Leptospira interrogans serovar Copenhageni str. Fiocruz L1-130
MAGTHEVLSRKYRPQKFRDVIHQDLAIGALQNALKSGKIGHAYIFFGPRGVGKTTIARILAKRLNCQNPIDNEPCNECNSCSEITRGISSDVLEIDAASNRGIENIRELRDNVKFAPMGGKYKVYIIDEVHMLTDQSFNALLKTLEEPPAHIVFVLATTEFHKIPETILSRCQDFIFKKVPLSVLQDYSEKLCKIENVQYDQEGLFWVAKKGDGSVRDMLSFMEQAIVFTDSKLLGAAIRKMIGYHGIEFLTSFIKSLVDPDNHSKSLEIIESLYQEGQDIYKFLWDSIEFTHTLNLIRDSLADPESVNFPKEDLVKMKSDFENVDSSKLNFLSGKLFEIYERIKTIRLRNSFEIKVFTEIQIKKLVEELTYPSLAGLIDKINHLILMVQGSKNVLSDVNQNTAFALKDTLQPETSKKKDKLSSDVILESQFESNQQDSNLENTKPAELSSRKFDTSTEIKKKFLGTEVDPNQTPKLDS

SEQ ID NO: 9346 - protein, 1126 aa, Vitis vinifera
  misc_feature (113)..(113): Xaa can be any naturally occurring amino acid
  misc_feature (165)..(165): Xaa can be any naturally occurring amino acid
  misc_feature (550)..(550): Xaa can be any naturally occurring amino acid
  misc_feature (705)..(705): Xaa can be any naturally occurring amino acid
  misc_feature (934)..(934): Xaa can be any naturally occurring amino acid
  misc_feature (1027)..(1027): Xaa can be any naturally occurring amino acid
MAINSNTKNVRAYVQKALSLAFAGCTQRIASWGGSVMGVVENMQHKELLRAVPIVNGGYSEGRSERRSLENGDCSVVTTRYKRRKVSAIRDFPPGCGPLARRMPKEAFVCVGXSEKLDGGGKSEDALEVDGVNVPGTAVESKSPKELANSILTEMPDTSNELHSXVQMTVMSSDLAHGIELMHNEPEKTESLMSDARVFEPIKSLEQEASQILKDFHEVEEMPPPGSVKVSSPPNGPMNAPSVLEKTVTKKYPPRRKISAIRDFPPFCGRNAPRLSEEECLKAPAPSKGAPAPSKGAPAPSKGAPAPSKGTPAPSEGAPAPSKGKTVGQEESGVKEKPLTEPVSIDGKQMGEDVQDRDVLKEKLRANVSKNSRDKVQDEFKGSANKELKKQVTLVISSEVKMEFEVKREQSIGSPRENNLPRPDQKSQIVEKANEVLEGKVGKEIVIYSKDENSKRKVTSLSGRVNKVPAGDELSQERVTVLCLMAAQNCPWRRQGKGGLNLDSGMSGSKGKKDGLAGLEKSKSIVRAKTDRAEKSGGKSIKRKSSPTRXAENLGMGQLVVKDEEDSIEHYEEQGDFHVGQRLLDFNVSLPPFGPSSSSGKVEACDSIVTRNKVRETLRLFQAIFRKLLQEEEAKTKQGGNPVRRVDYLASRILKDKGKHVNTGKQIIGPVPGVEVGDEFQYRVELGIIGLHRPTQGGIDYRKHXGKILATSIVASGGYADDLDNSDVLIYSGQGGNLIGGDKQPEDQKLERGNLALKNSIDAKNLVRVIRGFKETKAPEYMDSRAKVVTTYIYDGLYLVEKYWQEIGPHGKLVFKFQLNRIPGQPELAWKEVKNSKKFKVREGLCVDDISMGKEPIPIFAVNTIDDEKPPPFTYITSMIYPDWCHRLPPNGCDCSNGCSDSEKCSCAVKNGGEIPYNYNGAIVEAKPLVYECXPSCKCSRSCHNRVSQHGIKFQLEIFKTVSRGWGVRSLTSIPSGSFICEYIGELLEDKEAEQRTGNDEYLFDIGHNYNEILWDGISTLMPDAQXSSCEVVEDAGFTIDAAQYGNVGRFINHSCSPNLYAQNVLYDHDNKRIPHIMLFAAENIPPLQELTYHYNYTIDQVRDSNGNIKKKSCYCGSDECTGRMY

SEQ ID NO: 9347 - protein, 1033 aa, Pseudomonas putida GB-1
MVHDKLLKKQFARSERDDMTDLSHPAPRFSASDAEGLAKDFFNVTGIATPLDGERDCNYRLKTGMDAGWILKIVNASEPRVESEFQTALLDHLAVHGAHLGVPHLRASVAGDYLPTVTSATGEQHAVRLVSWLAGTPLAEARRSFALMRNFGQALGELDRALQGFMHPGAVRELDWDLRHAARARSRLHCIKSPERRAIAERFITQFEQNVQPRLASLRAQVIHNDANDWNILVDAESTSNVTGFIDFGDAVHSVLIAEVAIASAYAILDMDDPIGAAAALVAGFHDKYPLQAQELDVLFNLIAMRLVISVTFSASRHDQAGDNPYLAISEAPAWRLLEQLDAMNPRLATGILRKACGFDAIDGAGEIRRWIADNHKAFADLVHPSAAILNKVIAPFGDASHEMTIASAEQRPADATRWWDAYSAAHKVPLAIGPWGELRTIYTDSAFESRFIKGQRRTLHVGVDLVMPAGTPLYAPIAGTVRSVEIEPDPLGYGGLVMIEHAPTGCPPFLTLWGHMAHEALGRLKAGDKLEAGDLVGYMGTDHENGGWIPHLHLQMATDTQLTASEVIGVGEPEYRDVWADLFPDASMLAGIPPETYDQQGMTKAQIIAKRKELLLPNLSISYTDPIKFVRGDGVWLIDNFGRAYLDCFNNVCHLGHSHPDVVEALTRQAARLNTNTRYLHDNIVEYAERLTGTLPEGLCVASFGCSGSEANSLMLRMARNYTGSDQAIVLDWAYHGTTQELIDLSPYKYKRKAGKGRAAHVYEAVVPDSYYAPEHWPVEEHGKRFAESVAEQLDAMRKAGKKPAFFLAESIPSVAGQVFLPEHYLQEVYAMVRAEGGLCLADEVQVGFGRVGSHWWAFETQGVVPDAVTMGKPIGNGHPMSAVVTTREVADAFNNGMEYFNTFAGNPVSCAVGLAVLDAIERDQLKENALNVGNYLLDGFRKLQQQFDVIGDVRGLGLFLGIVLVTDRQSKVPATALARKVADGARERGVLIGTEGPHDNVLKMRPSMIFSRANADFLLEVLKDSFIAALK

SEQ ID NO: 9348 - protein, 513 aa, Symbiobacterium thermophilum IAM 14863
MEDLVAELHGREARLRLGGGEKALAKRKEQGKLTARERLELLFDPGSFVEIDLHVRHRGTELGMDQRETPADGVITGFGTVDGRTVYAFSQDFTVMGGSLGEMHAQKIVKVQQMAMKAGCPIVGIQDSGGARIQEHIDALNGYGRIFYHNTLASGVIPQISVIMGPCAGGAVYSPGLTDFIFMVDKTSYMYITGPEVIKAVTGEATTHEDLGGARAHAEKSGVAHFRAPDEPSCLAAVRRLLSFLPPNNVDDPPPGPLTDPVDRMEERLLHVVPENPNKPYDVREVITAVVDHGDFLEVQPGWAMNMVVGFARLGGRTVGIVANQARVLAGCIDINASDKAARFIRFCDAFNIPVITFVDTPGYLPGTAQEHGGIIRHGAKLLYAYCEATVPKLVVVLRKAYGGAYLAMSAQSLGADFTVAWPTAEIAVMGADGAANILFKPGPEVEDPQAARAEWVARYKEKFNTPYNAAGRGFVEAVIDPRRTRPMLARALQALGTKRESRPAKKHGNFPV

SEQ ID NO: 9349 - protein, 506 aa, Azoarcus sp. EbN1
MLYELPGQPAAKVRFKSRYDNFIGGKWVAPVRGEYFDNVTPITGKPFCQVARSTEEDITLALDAAHAAADRWGRTSAADRANLLLKIADRLEGNLELLAYAETVDNGKAIRETLNADIPLTIDHFRYFAGCLRAQEGSISEIDEHTVAYHFHEPLGVVGQIIPWNFPILMAAWKLAPAIGAGNCVVLKPAESTPVSILVLVELIADLLPPGVLNVVNGFGREAGMPLATSKRIAKIAFTGSTATGRVIAQAAATNLIPATLELGGKSPNIFFSDIAAADDAFFDKAVEGMVLFAFNQGEVCTCPSRALIQESIYDRFMERVLARVRAIRQGSPLDTDCMMGAQASAEQMNKILSYMDVGREEGAQLLIGGERAHLGGELAEGFYVQPTLFRGHNKMRIFQEEIFGPVLAVTTFKDEAEALEIANDTPYGLGAGVWSRDGSVAYRMGRAIKAGRVWTNCYHAYPAHATFGGYKESGIGRETHKMMLDHYQQTKNLLVSYSPNALGFF

SEQ ID NO: 9350 - protein, 208 aa, Oryza sativa Japonica Group
MDHHQHHEQQQQRMVAACGWGWRWARRTSGGRQPGGGRGPAAAQALGAVVQLHFDPPLAPPRAADAQKQELWRLFLAFFLFPRHPPLRRRTKSPPSPASMCRHLLAPAGLLSLAHLAFYAAVAHHLRCLNGFRYQRRCHKLTLALAADRLRMLKSGGDVVAAADVEVPYQEPPESYLAKFKRSWAIHFAFLITTFAFSVAAAVAILCF

SEQ ID NO: 9351 - protein, 430 aa, Triticum aestivum
  misc_feature (252)..(252): Xaa can be any naturally occurring amino acid
MPRSWRPVLASATKCCSSEDAVVAGNGLTSCRPARSEFSRRLASFRRLSSMTNSPATPRDGKDDEAAGGMGMGPMQLHSFSLNELRGVTHDFSSGYLLGEGGFGTVHKGFVDAGMRPGLEPQPVAVKQLDIAGHQGHREWLEAEVIFLGQFRHQHLLKLLGYCCEDEERLLVYEFMPRGSLDNHLFKRISATLPWGTRLKVAIGPAKGVAFLHGGKQPVIYRDLKASNILLDSDFTAKLSDFGLAKMGPRGXETHVSTRVMGTHGYAAPEYVQTGHLAVKSDVYSFGVVLLELLTGRRAMEHVPGRTARAEQTIKLVEWTRPYLASSRRLRCIMDQKLSGHYSVKGARAMAHLAVRCTSPQPRDRPSMAAVVEALEQLEGLKDMAVSMGLFWPTAPAAGRNALSAKFRAEMKGAGTGAVPRRRTASANLS

SEQ ID NO: 9352 - protein, 539 aa, Vitis vinifera
MLRFSLQRVRNFKSLRPELFALGNSRFSTATEPSSKQRNPPRVPNLIGGSFVDSQSSEFIDVINPATQQVVSQIPLTSNEEFKAAVSAAKQAFPAWRNTPVTTRQRIMFKLQQLIRRDIDKLAMNITTEQGKTLKDAHGDVFRGLEVVEHACGMATLQMGEFVPNVSSGIDTYSIREPLGVCAGICPFNFPAMIPLWMFPIAVTCGNTFVLKPSEKDPGASLMLAELAMEAGLPDGVLNIVHGTRNIVNAICDDEDIRAVSFVGSNTAGMHIYSRASAKGKRVQSNMGAKNHAIVLPDASLDATLNALVAAGFGAAGQRCMALSTVVFVGDSKSWEDKLLERAKALKVNSGTEPDADLGPFISASAKERICKLIQNGVDSGARLVLDGRNIVVPGYEHGNFIGPTILSDVTADMECYKEEIFGPVLLCIQADSLDEAINIVNRNKYGNGASIFTSSGVDARKFQTEIEAGQVGINVPIPVPLPFFSFTGSKASFAGDLNFYGKAGVQFYTQIKTVTQQWKGLASGSGVSLAMPTSQKSQ

SEQ ID NO: 9353 - protein, 487 aa, Azoarcus sp. EbN1
MGKPTGFLEYQRLSEAYEPVAERVKKYKEFVLRLSDEQAAVQGARCMDCGIPFCNTGCPVNNIIPDWNDLVYRNQWRQAIEVLHSTNNFPEFTGRICPAPCEAACTLNINADPVGIKSIEHAIIDKAWEEGWVQPRPPKSKTGRKIAVVGSGPAGLAAAQQLARAGHDVTVFEKSDRIGGLLRYGIPDFKMEKSLIDRRIEQMQAEGVTFRTGIVVGSADLPAGIASDAKEVVSAEALKNEFDAVILAAGSEVPRDLPVPGRELDGVHFALEFLIPQNKAVAGGAPNPISAEGKNVVVIGGGDTGSDCVGTSNRHGAASVTQFELMPMPPEQENKALTWPYWPIKFRTSSSHEEGCERDFAVATKAFYGTNGKVEGLKAVRLEWKDGRMAEVPGSEFDVRADLVLFAMGFTNPVGSLLEAFGVDRDGRGNAKATTDGEGCYATTSPKVFAAGDVRRGQSLVVWAIREGRQCAREVDQFLMGQSVLPR

SEQ ID NO: 9354 - protein, 360 aa, Vitis vinifera
MSQRVPNLIGGRFVDSQSFASIDVTNPATQKVVSQVPLTTNEEFRAAIFAAKRAFPSWRDTPVTTRQRIMFKFQELIRRDIDKIAMNITTEHGKTLKDAYTDVHRGLEVVEHACGMATLQMGEFVSNVSNGIDTYSIREPLGVCAGICPFDFPAMIPLWMFPIAVTCGNTFILKPSEKDPGATIILAELAMEAGLPNGVLNIVHGTVDIINAICDDDDIKAISFVGSNTDGMYIYARASAKGKRVQSNIGAKNHAIVMPDASKDATLNALVSAGFGAAGQRCMVLSTVVFVGGSKSWSEDKLVECAKALKVNAGIEPDADLGPVISKQVKERICRLIQAGVDSGARLVLDGRNIEALVEA

SEQ ID NO: 9355 - protein, 282 aa, Oryza sativa Japonica Group
MSGWEPTSSRRGSRSARRRRAPTTRTTRSRRRRRCSSQGSSSRGPSTAQGSPSSWPPSSSSYITALNAMGVNNSTSKCATVGIQGIAWSFGGMIFALVYCTAGISGAHINPAVTFGLFLARKLSLTRALFYMVMQCLGAICGAGVVKGFQKGLYETTGGGANVVAPGYTKGDGLGAEIVGTFILVYTVFSATDAKRNARDSHVPILAPLPIGFAVFLVHLATIPITGTGINPARSLGAAIIYNRGHAWDDHWIFWVGPFIGAALAAIYHQVVIRAIPFKSRS

SEQ ID NO: 9356 - protein, 346 aa, Glycine max
MAHPTSSSGQSNDLTKEDCKETSSVVVCFGEMLIDFVPMVGGVSLAEAPAFKKAPGGAPANVAVGISRLGSSSAFIGKVGADEFGYMLADILKQNNVETSGMRFDSNARTALAFVTLRADGEREFLFFRNPSADMLLQESELDKDLLKKARIFHYGSISLIDEPCKSAHLAAMSIAKNSGCILSYDPNLRLALWPSADAARKGIMDIWDQADVIKISEDEITFLTGGDDPYDDNVVLKKLFHPNLKLLIVTEGSQGCRYYTKAFKGRVSGVKVKPVDTTGAGDAFVSGILHCIASDQTIFQDEKRLRKALYFANVCGALTVTQRGAIPALPTKEAILQFLLEAAVI

SEQ ID NO: 9357 - protein, 577 aa, Pseudomonas aeruginosa UCBPP-PA14
MSFLNLPVRTLVAACGLSLLSLAAHADSFRGDAHAPQQAAVATPHPAATVAGLETLANGGNAFDAAAAIAAALAVAEPYGSGLGGGGFFLLRQAGAQPTYRFLDARERAPKAAYADMYRRNGKVDPRLSVDGPLAAAIPGLPAALVELSGRYGRKPLADNLVPAIRLAVDGVSVDRVYRDRVAMRLEAMRKDPETARIFLDKGGIPDEWNLLRQPQLARTLERLGRYGRIGFYEGETADKLLTGVRAGGGIWSAADLRDYRVIERRPLEVKLANGRELISAPPPSAGGVALAQSLQMLEQLPWQKAEPVQRAHYVLEVLRRAYRDRGLLGDPDFVANPLPSLLAPDYLKRLAAGIDPRRATPSSALPEAPAWREGDHTTHFAVIDAQGNAVAATLSVNLPFGAAFTVPGTGVVLNNEMDDFAADTQGANSYGLAGSQANAVAAGKRPLSSMSPSFLESPTDFAAFGTPGGSRIPSMVLISMLQYFDGRPVGQWVAAPRYHHQYKPDVVEYEPRAFSDAEAAELRRRGYQLKRLERSYGNQQVLYWDKRSGRVDAASDPRGIGYSAFSPEMQAQPQAH

SEQ ID NO: 9358 - protein, 507 aa, Rickettsia typhi str. Wilmington
MNIVDSNCTIWHKARNSKFRHIVWPIRSYELTKFIPMALLMFFILLNQNLVRSLKDSFVVTLISSEVLSFIKLWGEMPMGVLFVILYSKLCNIMTTEQVFRIITGTFLFFFTIFGFILFPYKEFFHPDPELINQYITVLPHLKWFLIIWGQWSLVLFYIMGELWPVIVFTLLYWQLANKITKVEEAPRFYSFFTLFGQTNLLFSGTVIIYFAKSEHFLLPLFAHLNDTNEILLKSFITVILLSGLICLALHKLIDKSVVEADKNIKFKNQRTDILKLSLIESAKIILTSRYLGFICLLVMSYSMSINLIEGLWMSKVKQLYPATKDFISYHGEVLFWTGVLTLVSAFLGSSLIRIYGWFWGAIITPIMMFVAGVIFFSFTIFENHLGNIVNTLGYSSPLVIIVFIGGLWHVFSKSVKYSLFDATKEMVYIPLDNEIKTKGKAAVDVIGAKIGKSIGAVIQFISFSIFPNAVHNDIAGLLMFTFIIVCILWIYGVKVLSQYNNKMIQN

SEQ ID NO: 9359 - protein, 348 aa, Pyrococcus abyssi GE5
MSEKMVAIMKTKPAYGAELVEVDVPKPGPGEVLIKVIATSICGTDLHIYEWNEWAQSRIKPPQIMGHEVAGEVVEVGPGVEGIEVGDYVSVETHIVCGKCYACRRGQYHVCQNTKIFGVDTDGVFAEYAVVPAQNVWKNPKSIPPEYATLQEPLGNAVDTVLAGPISGKSVLITGAGPLGLLGIAVAKASGAYPVIVSEPSDFRRELAKKVGADYVINPFEEDVVKEVMDITDGNGVDVFLEFSGAPKALEQGLQAVTPAGRVSLLGLYPGKVSIDFNNLIIFKALTVYGITGRHLWETWYTVSRLLQSGKLNLDPIITHKYKGFDKYEEAFELMRAGKTGKVVFMLK

SEQ ID NO: 9360 - protein, 662 aa, Ustilago hordei
MAPKESGKHVLHVSQLYKENQWLTLLCSLLVIAASSKVAKPASKPASKAAAKKPATNGASKAKATTTKAAQTNDAKRGQKRAKEDDEEEDELLDDDVDVEVEAKDTAAPLPDVKKRPIKERGASAEPASDVEMADGTARPAKRTRRAPTPAGPINSLPRPIQPVHAGDVTEGIAVEVSVGSQSTSGKGAVLPRKLFVWGSGDAGQFGVGPPEDDKPNKLNKPKPFGNKGISLQIDDGNFGEGGIEVVVGGGMHSVMIDSLGRILTSGAEDYGTLGRKHRGDAADAEESYFNFAPVEGISPTGKGINPIDRKEGTVEKYRATRVASADAAGAALDDQGRLRSWGYFKDGEGRVCFADSDLPGRHREQWWPIALPGIEHEHFAAVAAGENHFLALSLAGKVYSWGTNTCYQLGRSSNPRKVAQKFSKGEPPKDCDLTPTTLTGLADCRRIFCGLTNGFAVEKSGKVVGWGLNTKGQTGTGLKAAKVATPHTIAALSPVRHNGAEVVQIVGGNFHTAFLLANGEVYICGDSDEGKLGLPADHPAMKGASASNPIVVREPTLVPFPAPPSWAPESAKTKDGKTKIVALSAGMRFTLALAADGTLYSWGTTSDDALGHPAEEAGGDQSKDTPTAIAMPGQPGAWRIMAASTAGQHSLAIAVKPPQDD

SEQ ID NO: 9361 - protein, 337 aa, Arabidopsis thaliana
  misc_feature (112)..(112): Xaa can be any naturally occurring amino acid
MGKIKIGINGFGRIGRLVARVALQSEDVELVAVNDPFITTDYMTYMFKYDTVHGHWKHSDITLKNSKTLLFGDKPVTVFGIRNPEEIPWGEAGAEYVVESTGVFTDKDKAAXHLKGGAKKVVISAPSKDAPMFVVGVNEDKYTSDVNIVSNASCTTNCLAPLAKVIHDNFGIVEGLMTTVHAITATQKTVDGPSAKDWRGGRAASFNIIPSSTGAAKAVGKVLPDLNGKLTGMSFRVPTVDVSVVDLTVRIEKGASYEDIKKAIKAASEGPLKGIMGYAEEDLVSTDFLGDSRSSIFDAKAGIALNDHFVKLVSWYDNEWGYSNRVVDLIRHMFKTQ

SEQ ID NO: 9362 - protein, 476 aa, Pseudomonas aeruginosa UCBPP-PA14
MVADIAYLQQSQQEINQLEALFARQRAAYLAQPMPDATQRVQWLKALRELLFKEQQALIEAIDRDFSARSADETLLAEIMPSLHGIHYAAKRVKKWMKPARRAVGLQFQPASAQVVYQPLGVVGVIVPWNYPLFLSIGPLTGALAAGNRVMIKMSESTPATGRLLKDLLARIFPEDQVAVVLGEVDVGVAFSKLPFDHLLFTGATSVGKHVMRAAAENLTPVTLELGGKSPAIISDSVPMKDAAERIAFGKSLNAGQTCVAPDYVLVPSRRVEEFVSQYKEVVQGFFPRLSDNPDYTAIINERQLGRLRGYLDDAREKGATLVPLFAEGQQRRLPQTLLLNVSDDMKVMQEEIFGPLLPVIPYERLEDALAYVNQRPRPLALYYFGYDKAQQQRVLHETHSGGVCLNDTLLHVAQDDIPFGGVGPSGMGHYHGHEGFLTFSKAKGVFSKPRFNAARMIYPPYGKSIQKLVYKLFVR

SEQ ID NO: 9363 - protein, 216 aa, Brassica rapa subsp. chinensis
MNTFPASTEMVGSENESPVTTVAGGDYYPMLAASCPKKPAGRKKFQETRHPIYRGVRLRKSGKWVCEVREPNKKSRIWLGTFKTAEMAARAHDVAALALRGRGACLNYADSAWRLRIPETTCHKDIQKAAAEAALAFEAEKSDVTMQNGQNMEETIVEAIFTEENNDVFYMDEESMLEMPALLASMAEGMLLPPPSVHFGHNYDFDGDADVSLWSY

SEQ ID NO: 9364 - protein, 248 aa, Zea mays
  misc_feature (55)..(55): Xaa can be any naturally occurring amino acid
  misc_feature (80)..(80): Xaa can be any naturally occurring amino acid
MDRYQRVEKPRNDTPISQNEIRITTHGRMRNYISYGMSLLEENGHDEISIKAMGXRVINKTVMVGALNSIRGGIGGLHQXITATESVDITDTWEPLEEGLLPLETTRHVSMITVTLSKNPLDTSSPGYQPPIPAEEVKPAFDYDHEESYPTGRGRGRGGGRRGRGRGMSNGPPPPAYGYNEEWEEEGDYYNRGRGRGRLRGRGGRGRGGYYGGGRRGGYGYDYGYSTSAAVPVQLVRASFVARSWFCS

SEQ ID NO: 9365 - protein, 338 aa, Fulvimarina pelagi HTCC2506
MRRLSRSCRIVTTISLADIEAAAARISGHVRHTPVEVSPSLSARAGVSVHLKLEHRQITGAFKLRGATNAVLRLAEKSRPTGVSCASTGNHGRALAHAAKAAGIPAVICMSKLVPQTKVEAIEALGAEARIVGRSQDEAQVEVDRLVAEEGFADIPPFDHADIIAGQGTIGLEIAEDCPDAETVVIPLSGGGLIAGIARAVRARLPGARIVGVSMERGAAMQASLAAGRPVEVEEMPSFADSLGGGIGLKNAYTFEMVRDLVDEVILLTEAEIAGGMRHAYFEEREIIEGGAAVGIGALLAGRLRPKGPTILLLSGRNVDMRQHRAVINGANSLEEIA

SEQ ID NO: 9366 - protein, 387 aa, Mycobacterium sp. JLS
MSNTSETRSGSRIDGAVALLVLEDGRVFTGVPYGAVGQTLGEAVFSTGMSGYQETLTDPSYYGQIVVATAPQIGNTGWNHEDAESRDDRIWVAGYAVRDPSPRASNWRATGTLDEELVRQGVVGIAGIDTRALVRHLRTRGAMKAGIFSGDESAAPMSELLERVRSQPGMLGASLADKVSTDDVYIVEPEGAHRFTVAAIDLGIKTNTPRNFARRGIRSHVLPARATFEQIADLKPDGVFLSNGPGDPAVADHVVEVTREVLGAGIPLFGICFGNQILGRALGRGTYKMVFGHRGINVPVMDHATGRVAITAQNHGFALEGEAGERFDTPFGAAVVSHTCANDGVVEGVKLVNGRAFSVQYHPEAAAGPHDANYLFDQFVDQMSEEK

SEQ ID NO: 9367 - protein, 417 aa, Symbiobacterium thermophilum IAM 14863
MTGQEFFRDTQETIRAAVAKLGHSEGVYKILRNPRRTLEVHIAVTMPDGSVETFLGYRSQHAAVFGPYKGGVRFHPNVTKEEVEALAMLMTLKNAVLGLPYGGAKGGVICDPNALPPTAVEQIARGYVRGLRDMIGPDTDIPAPDVNTNSRVMGWMLDEYLKCTNAIDFSVFTGKSLNLGGIEGRTGATGLGIAYVTREACKVRGVDLKGARVAVQGFGNVGRGAAQALTALGARIVGVTDITGGVYKEDGLDVAALTEYARDRGGVAGFPGAEPLTNEQLFALPVDVLIPAALEGQITGKVAETIQAPIVVEGANGPTTPEGAQVLADRGIMQVPDILANGGGVTVSYFEWVQGQQGGLRWSERTVHRRLDRYMTSAFAAVLAYSERYNVSMREAAYLFAVDRLATGMIERGWVPR

SEQ ID NO: 9368 - protein, 2153 aa, Oryza sativa Indica Group
MEPEREASSEWGDGVGALGFRVKASSREPAAQKAANVLEPDLRSHWSTATNTKEWILLELSEPCLLSHIRIYNKSVLEWEITAGLRYNKPDTFVKVRPRCEAPKRDILYPANHTPCRYVRISCMRGNPIAIFFIQLIGIPIPGLEPDLQPLVNYLLPHITAHKQSSQNIHLQLLKDIASRLPPFLPQIEADLASVTDTPESSVHFLALLAGPFYPILQLTNERDFTKSLISSADSDALKSSLASTPTMLVHFTINLVKLEEASKVLQELLEPDPLLDDASDQVLCTDYSSLFGDEFSLSENRFDASILNILDIAAVEEGILYILYAASSQPLLCCKLAEKGSDMWSVLPLVQALLPALRPPLSPGSTEQIDGCLSQWNHPNVHKALSQAKAACVLLDLCRGPLSPWVPMITAKVDLAIELLEDLLGIIQGVGQSLTRSRAALKYIALAISGHMDDVLTEYKVHSFFLLKDVKHKLLFILEMLDPFIDPSVSVMTDAMAFGDVSVVHLEKQASACNISLNIIRTAVKRPAVLPSLELEWRHGAVATSVILSTLDPHMPLPPDIDLCKSSMPEIDQICLIVPNCPPHSCSAEDADGRDTSETTPREDILEQCNSLFAPEELEQSELTKTLEEKKHEKISTDLDQNFPEDTKSNGKLPAGLFQLDNIFATDYYDAHADYLQLVNYQDCELRALEFQRLALNLCTQQEPTVEGHNAGIDAFLLAAECYVNPLFLLDFHSNSESLDEIERIHAELIQGNCFSEAKHLRAKDIDLMKIYNLENKRDKAVLDLLMQAARYDFEYQGKIPDGKPFPDDVEDGKQYIEISPEARHLADAVTLVRKNQAMLCHFIMKQFERKGHSPNEILLQSLLFLLHSATDLFCPPENVIDIILKSAEDLNGKLVCLYNSVNARNNKLDRVKLHYLRRRWALLQKLVLASSGSDNTRELVSIKEMVSVLKVWFLHQHGYIRYQIFPVSRYAKEYLNEQLFLASDFSQLTSLLSIFTDELSLMGGVTTQKAKSAKIEQSGCNNYVLLKKEPLLSDQPSMRLFQILLPELHFFFPSMSKKFDAFGQSILEAVGLQLKCLPKSAVHDVLCWFSEMCLWPYLGNIREHLAFANGVNSLKGNIAAKAKAVVIYLLESIVAEHLEVIVPEMPRMVHILVSLCLASYTDVTFLDSVLCLMKPMISHFLRKSTDNGDVSGDITECSDFELLCFEELFETIQFGKQSEDTPGNKNQVPFLIFILGSLFPDLSFKRRIEILGSLLVWVDFGSSDPSSLLCSYLQGFQAFIDGCETILVQNIELFGVHVLSERNQSTEFANSASPDDTMDNKKAQASVAQVQRRSTEYHENGENSKGVDSPHTVCIKEFCGALERLVSNLAPSIEGSWKWHLQLASRLSLSIAKCLLYAKCLKSIAEGGMIYSSIKQEVGTEISTDLSQKHWESALQGLAETILVNQKKQCWQVASVMLDYMIKLPNILAWDNVLNVMSSAMKHLCSHAPRISWRLQTEIWLSILVSYGIEGLKNSENSLIDLFCTLLSHAEPEQRSVALQQLGRIIMSTTKVDSEYTTYKQNSLSSGSTVTSLLVTHTWDRVAALAFYDSSMLLRKHALALLTEYIPFVDRNHLQSFLGSSNSILNGAEQFSYAIEQGYLTRMSLLLLSRACLYSAPEDIALIPECVWRKLENMQTSIPGCFGDMEKDLCRALCQLRSESDAKTVVKELLTESTAKPVETDFKGIRESILQVLSSLSSVESYFEFFSTRSDQEYQELEEAEIELEIVKNEKARHSFIVHPQDTMIPDMSSYYKDGNEVNKQLQQIQEDIRSLERSKLREEIIARRQKKLLIRHTREKYLEETSSREMELLQELDRRELQRELDQVELGRSSRREFSANTNSRSRERYRERDNGRGQQEGRSRGGGVEAGGSATRSFSGNLPTILQQPRERTTSDERTSTGGNYYEENAEGSGDASSVGDPESAAALEAGTRHGPRGGSKSSSSSSRQERRSVCGVHMDPFFRRASSDPLCLEDNSVQHGIERCPFLRNINEPTSFSFSSVNFPVPARGDKGPIFEDGPNFDMAFRVFHGQDGVVPLSHGSFERFEKPMPKPNPEFNPLAAKAATISLSAFGGFFSFGDFSNKRNKKNSNQKKPNNLPRSLSYGKEKQIPQK

SEQ ID NO: 9369 - protein, 362 aa, Photobacterium profundum SS9
MAGTYKIAVLPGDGIGPEVMLQAHKVLDAVEEKFGFTLERSEHDVGGIAIDNHGCPLPESTMKGCEESDAILFGSVGGPKWEHLAPNDQPERGALLPLRKHFQLFCNLRPAQIHSGLEGFSPLRADISERGFDIVVVRELTGGIYFGQPKGREGEGPQEKAYDTEIYHRYEIERIARIAFESAMLREKNVYSIDKANVLQSSILWREVVEEVAKDYPEVTLNHMYIDNATMQLIKDPSQFDVMLCSNIFGDIISDECAMITGSMGMLPSASLNQEKFGMYEPAGGSAPDIAGKNIANPVAQILSAALMLRYSLDEEKAARAIEQAVSQALEAGELTADLAGKGAALSTSEMGDKIAAYIRQA

SEQ ID NO: 9370 - protein, 970 aa, Vitis vinifera
MLMDGRIVIVKKLKIVGDRKLEQFIKEFVILSQINHRNVVKLLGCFLEIEVPLLVYEFIPNGTLSKHIHGQNEKFPITWKMHLRIATEVVGALSYLHSTASLLTRKKPILSTRSKEWKSLASYFILSMKEDPKTISEINYKEKVSWSFRSLGSSSFGKGGDSGSFPRIEDNNIKDVLSNFDMNQGNIIATSYFGQSKDKAYVKIIGMNQGNIIATSLQGTPYTESYKGMYQTQYSSCGPSWRAYWRRMSTVRWLLQISLLLWLSRGLAATQGKSGCLETCGDVDIPYPFGIGSAGCYFDEWFEVTCNNSIHPHIPKPFLKILNLEVLNVSLNRSTIRVNNPVLGYMNCSGKPSNDAQSWEGGPFSFSDTYTRFTAVGCSTLAYITQNDSVIGGCMSYCKQGTTAAKNGSCYGLKCCQTQFPPGLQYFTTMLGDFPSNSDDQDECKYAFMVDQEWFISMEQDPDKVKDVGHAPAVLDWRIYNATCNFCGANAICSADTQTPSLTCRCPRGYEGNPYLTEGCEGTQSTEDCTNYKLYENGTVCINRNANFSCYPVDKLIVDPRPRRMVCVGILAGVGTLLLVICAWWLYKVLKRRQKIKYKEKCFKRNGGLLLEQQLSSSEGNVDKTKLFTSKELEKATDRYNENRVIGQGGQGTVYKGMLMDGRIVAVKKLKIVGDGKVEQFINEVVILSQINHRNVVKLLGCCLETAVPLLVYEFIPNGTLSEHIHDQNEEFPITWEMRLRIAIEVAGALSYLHSAASIPIYHRDIKSTNILLDDKYRAKVADFGTSKSVAIDQTHLTTQVQGTFGYLDPEYFQSSQFTEKSDVYSFGIVLIELLTGKKPILSTASEEGKSLASYFILSMNEDRLSDLLDAQVVKEGKKEEINAIAFLARRCINLNGKKRPTMMEVAMELERIRKCQGDFNAQENFEEVGYDTIELTGPWDVASTSMGSCLNTNASSSSDVQPLLFQKSF

SEQ ID NO: 9371 - protein, 791 aa, Vitis vinifera
MMSTVQWLLQISLLLWLSKGLAATQAKPGCQERCGDVDIPYPFGIGSAGCYFDEWFEVTCNNSTDPPKPFLKGVNLEVLNVSLDGTIRVNNPVLLSQNCSGKPSNDTQWWEGGPFSFSNTYTRFTAVGCSALVYIMQDDTVIGGCMTFCKKDATAAKKASCYGLECCQTQVPPGLLSFTANLGTFSDGSADEQEQCKFAFMVDQEWFISNVPDPHTVKDMEYVPAVLDWRIYNATCAASTSNLNTSTSFCGENTLCSTDTQTSSLICSCFPVYEGNPYLPQGCQDQNITKDITKYNCWVLETSHVSPLFVSLPYYKPSHSTRYFPCAVITIGALGTLLLVLCAWWLYIVLKRRKKIKYKEKCFNRNGGLLLEQQLSSTEGNIDKTKLFTSKELEKATDRYNENRVIGQGGEGTVYKGMLMDGRIVAVKKLKIMSDSKLEQFINEVVILCQINHRNVVKLLGCCLETEVPLLVYEFIPNGTLSEHIHGQNEEFPITWEIRLRIATEVAGALSYLHSAASVPIYHRDIKSTNILLDDKYRAKVADFGISKFVAIDQTHLTTQVQGTFGYLDPEYFQSSQFTEKSDVYSFGIVLIELLTGKKPILSTASEEGKSLASYFILSMNEDRLSDLLDAQVVKESRKEEINAIAFLARRCINLNGKKRPTMMEVAMELERIRKCQGDFGAQENSEEIEYNTIELIGPWDVTSISTDSCLNTNASSSSDEGPDIISHRKSQTDAQLKSSWQLPQSQKYLKQMGKYDPVQDLMSKSRAFSPIFKEKLQDGHEIVVKRLSSS

SEQ ID NO: 9372 - protein, 701 aa, Borrelia garinii PBi
MNKKIFYTTILLHLPNLLFSYSTKYDIEAKMSYFVMSLAIIVISSISLGNLVTKIGIPKVIGQITAGIILSPNAFGKIKIPLLFPLGITQIGENYLIDEKIFAISTIASIILLFTAGLETDLKLFIKFLPRGGIIGITEVIGTFTSFVLMASIIFNVPLISPTSLFIGIIGTPTSAGIAASILSAKKKMSTSEGVTIISTSIIDDVLSMLMLTSVITISRSISDLDIASSIKTIIQSIVIWLCLTFSLIYVSETLSKLLKKLNSVTLATVITLSLALTIASIFQNLGMSFVVGAYVFGLAMSKTDIVYVIQDKLTIFERFFIPIFFTSIGLMSDINEILSKEVLILGLAISAIAIITKSIFCFIPALFLGFNKLGALKIATGMVPRGEVSLIMANVALSSGFISQKIFGIIIIMVFLPTIIVTPIINFLFKINKSGLKKELPIDQNTHICVYFEYDNLAKILIWDLKNELRKEGFFTQQIKNDSSQYINARKNNISFSIKREGSQITFECPNNHLIIIQDLFRETILNLEKITEEVKTVSLRAKKLDYSINYDKILSKINLNKRIKKENIILELKASNKADVIRELLSVINIEIDKKRIFQDLMEREKLITPALKEGFAIPHLKTNLISKIHIAIGISHEGIDFNALDKNLSHVFILILCPAKDYVSYPRILASVVGKVDLYKKEILNAKTDKEIYNIIVG

SEQ ID NO: 9373 - protein, 216 aa, Chorispora bungeana
MNSFSAFSEMFGSDYESPVSSGGDYSPKLATSCPKKPAGRKKFRETRHPIYRGVRQRNSGKWVCELREPNKKTRIWLGTFQTAEMAARAHDVAAIALRDRSACLNFADSAWRLRIPESTCAKEIQKAAAEAALNFQDEMCHMTTDAHGLDMEETLVEAIYTPEQSQDAFYMDEEAMLGMSSLLDNMAEGMLLPSPSVQWNYNFDVKGDDDMSLWSY

SEQ ID NO: 9374 - protein, 106 aa, Triticum aestivum
  misc_feature (9)..(9): Xaa can be any naturally occurring amino acid
  misc_feature (11)..(11): Xaa can be any naturally occurring amino acid
  misc_feature (14)..(14): Xaa can be any naturally occurring amino acid
  misc_feature (16)..(16): Xaa can be any naturally occurring amino acid
  misc_feature (23)..(25): Xaa can be any naturally occurring amino acid
  misc_feature (27)..(27): Xaa can be any naturally occurring amino acid
  misc_feature (30)..(30): Xaa can be any naturally occurring amino acid
  misc_feature (33)..(33): Xaa can be any naturally occurring amino acid
  misc_feature (37)..(37): Xaa can be any naturally occurring amino acid
  misc_feature (39)..(39): Xaa can be any naturally occurring amino acid
  misc_feature (63)..(63): Xaa can be any naturally occurring amino acid
  misc_feature (69)..(70): Xaa can be any naturally occurring amino acid
  misc_feature (88)..(88): Xaa can be any naturally occurring amino acid
  misc_feature (91)..(91): Xaa can be any naturally occurring amino acid
  misc_feature (97)..(97): Xaa can be any naturally occurring amino acid
  misc_feature (99)..(99): Xaa can be any naturally occurring amino acid
MAPTVMASXAXFVXPXQGLKSTXXXPXSRXSNXASLXSXSNGGRIRCMQVWPIEGIKKFETLXYLPPLXXTRPFLKHVDYLIRSKWPXCLXFIPGSXFXFPLPFLL

SEQ ID NO: 9375 - protein, 174 aa, Dichelobacter nodosus VCS1703A
MNMDWKNLIINIPDYPKAGINFKDITPLLANGAGFKAAIEEMAMICERQNAIPDVLACPEARGFIFAAALAHRLGIGFIPLRKPHKLPREVAHINYGLEYGEDCLEVHKQDIKKGMRIMMVDDVLATGGTMHACMNLLQSLGAEIIGAMFLLELTALKGREKLGTAAVYSLIQD

SEQ ID NO: 9376 - protein, 103 aa, Gloeobacter violaceus PCC 7421
MYYQRLGQAQPGRTICTLEAGMNEVEVYQRVKKIVVEQLSVEESEVTSESSFANDLGADSLDQVELVMALEQEFETEIPDEDAEKITTVGDAVTYVLKRGSEV

SEQ ID NO: 9377 - protein, 99 aa, Synechococcus sp. WH 8102
MASYKVTLVSESEGLNKTIEVPDDQYILDAAEEQGIDLPYSCRAGACSTCAGKITAGTVDQSDQSFLDDDQIEAGFVLTCVAYPTSDCTIKTHAEEELY

SEQ ID NO: 9378 - protein, 266 aa, Brassica napus
  misc_feature (245)..(245): Xaa can be any naturally occurring amino acid
RHDAKVVVYTLLTTIFIIGVLLFLTPCKHNEAQSVEALITRRLGRRLVMPVFDPIVTRIERLSHEKEANTTVEAVAKEGKDDMFDEYFSQERRLNTTMRIKFLFPLLDGAPRDGFVSLKELQTWMMQQTEDNMGYRTANELELQDKDKDGVITFEEYLPQFSREDIEKNEKSHGGAGWWMEQFKNADFDHNGYLDIEEFNNFLHPEDSRNGDVQRWVLRERMTGMDTNGDGKLEYKEFVKNAYEXMYKEFAKFETEEDENVPTAQL

SEQ ID NO: 9379 - protein, 407 aa, Gloeobacter violaceus PCC 7421
MAKKTVEALGAADLKGKRALVRVDFNVPLDESGQITDDTRIRAALPTIGMLTGGGARVILVSHLGRPKGFDDQLRLTPVAKRLGELLGQTVYKADDVIGPEVEEAVKKLEDGDVLLLENVRFYPEEEKNNPEFAQKLAGLAELYVNDAFGTAHRAHASTEGVARYLRPAVAGLLLQKELEYLGKALESPERPVLAIMGGAKVSDKIQLIQNMLTKVDSILIGGAMAYTFLKAQGVDVGASRCETSTTKKDGTTVDLLQLALDLLAEAKERGVTFLLPVDHRTNDKFGDLADPPVTPDANIPEGQMALDIGPKTEELYVAEVQKSGTVIWNGPMGVFELPGFSKGTFAVAHALAESDNLSIVGGGDSASAAEKAGVVDKLSHVSTGGGASLEFLEGKTLPGVAALDEA

SEQ ID NO: 9380 - protein, 286 aa, Magnaporthe grisea 70-15
MPPKKAKEEEKILLGRPGNNLKSGIVGLANVGKSTLFQAITKCNLGNPANFPYATIDPEEARVIVPDDRYDWLCQKYNPKSRVPANLTVYDIAGLTRLLAIWIVEVINPLFLLTAKPVVYLVNLSEKDYIRKKNKHLPKIAEWIKEHATGDPIIPISVSFEERLTRFETEAEALEECKNVGAESALPKVIIQMRKALNLGSFFTTGTDEVRQWTIRNGTKAPQAAGVIHGDFEKTFIQCIVYNYNVLKELGDEAEVKAKGKVMTKGKDYVVEDGDILLIKAGAAKG

SEQ ID NO: 9381 - protein, 427 aa, Vitis vinifera
MASHHPSELDSVASDSVASSPRSDYPTHDIQPRVRFMCSFGGKILPRPHDNQLRYVGGDTRIVAVHRATTFSGLLLKLSKLSGTTNISVKYQLPNEDLDALISVTTDEDVENMMEEYDRLALSGIGLKTARLRLFLFPSDDGSRASSISSLLDGSSKRENWFFDAINGGGLERGRSEASSIVSEVPDYLFGLDNSDDIQALPRESKLKTRTALAENVSVSDPGSPAPAITSPFCSTSSGPSVPAIPDLPPVKTKPDKSIPPVEVKDNPPEGFADVIEPAVPQSGGYAGNPMWHYNPDSHYPGQPVHQIPVYYVPGPVPPGNMPVQSVPVRPQYVPQYPGPPGQIPVGFRHPGPGMGQVYGGAIRAVGPMEGYDMPMRVVSDGMNQQVYYGVRTTGMVQAYPPGMVVPAGEEFQGNGSDKKPGRVSTT

SEQ ID NO: 9382 - protein, 168 aa, Oryza sativa
  misc_feature (121)..(121): Xaa can be any naturally occurring amino acid
MRSAAVFVYGDIGRSPRMQNHAVELSKIYQVYFMGYFETAPKSKVTDSPNIRIVDLQIGRLQFFRAISFYLYAIVTILLQILQILYLLRWKYRNLEVVLIQNPPFMPTCLPIWLGCVTRKXKIYIDFHNYRLPILNLNLKNRNNWQIGLRFMNRVFPHESPAPFFLFV

SEQ ID NO: 9383 - protein, 302 aa, Gloeobacter violaceus PCC 7421
MGSAKVVVAGSINMDIVVRAARHPQPGETLLGQSVQFFAGGKGANQAIAAYRLGTPVILIARVGDDGFGGSLRAFVSQEGLDTQRVLATAGASGTALITVADSGENTIVVVPGANDALSPVDVEVDIEPGDVLVSQCEIPAQTIEHFFVRGKRLGARTLLNAAPARPLAPTLAAAADVLVVNESELAILTGAAVDAEDAGTVIAAARSLQPAIENVVVTLGGRGAVACLGPVSETVPGRRVEVVVDTTGAGDGFVGALAARLAAGEPFAQALVFANAAASICVERPGAAASMPTMAEVLAVL

SEQ ID NO: 9384 - protein, 363 aa, Symbiobacterium thermophilum IAM 14863
MEDGTLFAGAGFGAPAVQAGEVVFNTGMTGYQEVVTDPSYYGQIVVMTYPLIGNYGVTAADGESRQPWIRGLVVKELCDRPSHWQAVGSLSDYLAGCGVPILAGLDTRALTRHLRSHGTMRGVIATLPEGAEPGPAQVAAWVETARAFRLEGAVRSVATAAPYRIPGPGPRVVAVDFGAKENILRELTARGCDVTVVPATASAEEVLSLRPEGVVLTNGPGAPTDVPEAVEMVRGLLSQGDLPIFGICLGHQIAALALGATTYKLPYGHRGANHPVKELATGRIHITSQNHGYAVAAESLPPEVEVTHVSLHDGTVEGLAHRRLPLFTVQYHPEACPGPRENRYLFDRFLALVDRSAVSTRTA

SEQ ID NO: 9385 - protein, 385 aa, Gloeobacter violaceus PCC 7421
MDDKLFLMIPGPTPMPERALLAMAKAPIGHRSGEFAKIMAEVSENLKWLHQTASEVLMLSSSGTGALEAAIINACSPGDRVLVGANGKFGERWVEVAQAFGLDVEVIFAPYGQPLSTDAFKAALEADTDKTIKAVVVTHSESSTGVINDLETIVGYIRAHGEALSIVDAVTSLGATSVPVDAWGLDFVGSGSQKAYMIPPGLGFLAVSERGWAACERSTMPRYYFDLRKYRKALKKNNTPFTTPVNLVFALQTTLQMLRAEGLDALFARHARLRDATRAALRALGLALFNPDDHSASPAITAVVPPEGIACDKLRATLKKHYDIVIAGGQGEMEGQIVRIGHLGFVGERDVLTAIAALEGALRTLGYDGFTPGSGVAAASAVLFG

SEQ ID NO: 9386 - protein, 490 aa, Clostridium perfringens ATCC 13124
MDNKNFQSKTGFNLENTYLTLPNIFFSEQNPKGSKNPKLIKFNTSLAEELGLNEEVLNSDFGLNIFAGNETFPGIVPIAQAYAGHQFGHFTMLGDGRALLLGEHVTKDSKRYDVQLKGSGRTIYSRGGDGKAALAPMLREYIISEGMHGLGIPTTRSLAVVNTGEEVLRERFEQGAILTRIASSHIRVGTFAYAAQWGTLEDLKSLADYTIKRHFPNIAKSENKYILFLEEVINRQAELIVKWQSVGFIHGVMNTDNMVISGETIDYGPCAFMDTYDTNTVFSSIDYAGRYAYGNQPNMALWNLARFSEALLPLLNPNLDEAVNIAKKSISNFSKLYKKYWFNKMRAKLGLFTEKENDELLIEGLLSTMQKYEADFTNTFVSLTLNKFEDEKVFSSDEFKTWYALWQNRLKEENRSQEEVRNLMMNNNPYIIPRNHLVEKALKNAEKGDFTFMDNLLEALKNPYSYSKDLEKYTKLPEKSDTPYVTYCGT

SEQ ID NO: 9387 - protein, 461 aa, Burkholderia sp. 383
MTDRNEAVPPHSTADYRALDAAHHIHPFSDMGALNRAGSRVIVKADGVYLWDSDGNKIIDGMAGLWCVSVGYGCKALADAAYRQIQELPFYNTFFKTTHPPVIELSAMLAEVSPKGFNHFFYCNSGSEGNDTVLRLVHQYWRVQGQPQKKYVISRKNGYHGSTIAGGTLGGMGYMHEQMPSKVENIVHIDQPYFFGEAAAGETPEAFGLARAQQLEAKILELGAENVAAFIGEPFQGAGGVIFPPSTYWPEIQRICRKYDILLAADEVIGGFGRTGEWFAHQHFGFEPDLITMAKGLTSGYVPMGAVGIHERVARPIIDNGEFNHGLTYSGHPVAAAVAVANLKLLRDEGIVERVKNDIGPYFQRRLRDALGDHPIVGEIAGAGLVAGVQLARDRDRRERFGASVDIGTICRDFCFNGNLIMRATGDRMLLSPPLVIREAEVDEIVDKAKRAFDATAERVG

SEQ ID NO: 9388 - protein, 544 aa, Desulfotalea psychrophila LSv54
MLYISALQERKQAVFNEKNFYPIKFTMKKTTGSPIIYKDAQLLVVDKPTGFSSQAMTEGEVGITEWLALHLQYQIDLYSSLTKSCSGVLLLRRKNQIEKAENDQPVKIAEKKYHFISAKRYRGQTEEDGSWLVERDNSITEESVRFRFLEEGRDYSLYEAATLSCCRRVQEFAEESGIAIVGDGADSPFARLFLHCHSIRLAESGHEFISSTPDSFSFVLKQRDKVLIDTAIAWERRLGWLQLITNSYRLIQRGELDLPVSIDLYDNTLSITGFSEEKTSTQLRTLLEPALDYLRDKLAWQGALLRRHAQNPHQKKLIHDVIQWGAPISSSNIAHEHLLDFEVNINESQHVGLFLDQRDSRRRVWQIAEGRRVANLFSFTCSFSAAALAGGAEVVFSVDLAGSTLARGKGNFALNHLDESGRGKFIKEDVCKWLQRQERKYARNPEEFTPWDLIICDPPVFASAGKGQAFHVEKQWPELARQIRMLLSVRGVALFANNHRGGNASYYRAELEKHFSLVRQMSPPMDFPRLAGSPEHVRIYWCQV

SEQ ID NO: 9389 - protein, 165 aa, Photobacterium profundum SS9
MRRIISVLLENEPGALSRVVGLFSQRGYNIETLTVAPTDDSTLSRLNITTHVEDDAVYEQIEKQLHKLIDILKVSNVTEAEHLERELMLVKVKASGFARAEVKRTADIFRGQIVDVTSQIYTIQLAGTSEKLDAFIAAVSEATDIVEVARSGVVGIARGERALKA

SEQ ID NO: 9390 - protein, 87 aa, Zea mays
VNQIGTVPESIQAALDSKAAGWGVMVSHRSGETEDNFIADLSVGLASGQIKTGAPCRSERLSKYNQLFRIEEELGNVRYAGEAFRSP

SEQ ID NO: 9391 - protein, 757 aa, Rickettsiella grylli
MLKMLRRIVQEISSVQGFEKALRILVRRIREALNIQSCTVFILDDEKNYVLLATEGLNPHCIRKIRFNFNQGLVGLVGQTRELINIENAPEHPDFLYITDVGEERYKAFLGVPIIHNRALLGVLVAQQEEQRCFDETEEAFLVTMAAQLGGVLAHAEATGEILSLFKENKKKLQQDIFFQGIASAPGIAIGEAVVVFPFADLEAVPCKKVDNLSAEIIQLKKAFKAARDDIHRLKKHMMVVLPEEEQALFDVYLAILNKASLEKEVITTIKTTHQWAQAALQLVINKHVQQFEKVDDDYLRERASDLRDLGRRILMHLQNNPFRPPRYPENTILIGEEVSPSALAEVPEGRLIGIVSVKGSSHSHFSILARSLGIPAVTGVENLPVNQLEAQTLIVDGSQGRIIIAPSERVKKSFTTLMRQQSEITNSLEALRELPAQTLDGYNIALWVNTGLMADASLSLTAGAEGIGLYRTEVPFLIRDCFPAEDEQYGLYRQLLAAFSPRPVVMRTLDIGGDKALPYFPIKEDNPFLGWRGIRVTLDHPEIFLIQIRAMLRANLEFNNLRIMLPMVSCIAEADHALRLIDQAYEKVVSEDSQACKPPIGIMIEVPSAIYQVRGLAERVEFLSVGSNDLTQYMLAVDRNNPRVANLYDPFQPAVLKALVHIVEAAHLAKKPISICGEMASDPLAVPLLLAMGFDALSMNSFSIPRIKSVIRQTSLSQAKNTLIHILAMDNAADIRKYLSEAVPQFNVDCLMPVTG

SEQ ID NO: 9392 - protein, 470 aa, Photobacterium profundum SS9
MKKTKIVCTIGPKTESVEMLTKLANAGMNVMRLNFSHGNFEEHGQRIVNLREVMATSAQPLAILLDTKGPEIRTIKLENGEDFALVAGQEFTFTTDITVVGNQDRVAVTYPGFAKDLTKGNIILVDDGLIEMEVLETTETEVKCKVLNNGDLGENKGVNLPGVSVKLPALSEKDKADLVFGCEQGVDFVAASFIRKEDDVKEIRALLAANGGEKIQIISKIENQEGVDNFDSILEASDGIMVARGDLGVEIPVEEVIFAQKMMIEKCNRARKVVITATQMLDSMIKNPRPTRAEAGDVANAIMDGTDAVMLSGESAKGKYPIEAVTIMAQICNRTDSALKAELGSRLDSSRLRITEAVCKGAVDTSEKLNAPLIVVATEAGKSARSIRKYFPTAKIIAVTTNQKTAAQLCLTKGVTPIVVDAIDNTDAFYSRGKEIALETGLGAKGDIVVMVSGALVPSGTTNTASVHVL

SEQ ID NO: 9393 - protein, 264 aa, Brassica napus
MEKYEKLEKVGEGTYGKVYKAVEKSTGKLVALKKTRLEIDEEGIPPTALREISLLQMLSTSLYIVRLLCVEHVLKPPAKSNLYLVFEYLDTDLKKFVDSFRKSANPRPLGDALIQKLMFQLCKGVAHCHSHGVLHRDLKPQNLLLLKDKELLKIADLGLGRTFTVPLKSYTHEIVTLWYRAPEVLLGSTHYSTAVDMWSVGCIFAEMVRRQALFPGDSEYQQLLHIFKLLGTPTEQQWPGVSSLRDWHVYPKWEPQDLARAVPS

SEQ ID NO: 9394 - protein, 340 aa, Pseudomonas fluorescens Pf-5
MRFLITGGAGYIGSHTVLELLQAGHEAVVLDNLCNSSMLSLQRVQQITGVAPVFVEGDVCDRAILDRIFSQHEIDGVLHFAGLKAVGESVKQPLPYYQNNVSGSITLCQAMASAGVYRLVFSSSATVYGDPVQIPLVESSPLGTPTNAYGTSKLMVEKILQDMAAADPRWSVALLRYFNPVGAHQSGLMGEDPNGLPENLLPYISRVAVGKLERLSIYGNDYPTPDGTGVRDYIHVVDLAKGHIAAVNYISQHTGINAWNLGTGVGYSVLEMIRAFEDASGCTIPYTLSPRRQGDIAQCWSDPSKALHDLGWKAERGLKEMMEDTWRWQSNNPDGYRSFE

SEQ ID NO: 9395 - protein, 444 aa, Pseudomonas fluorescens Pf-5
MTFATLGLIEPLLRALETLGYQTPTPVQAQAIPAVLGGRDLMAAAQTGTGKTAGFALPLLQLLTLEGPKVDSNSVRALILVPTRELAEQVHESVRQYAEHLPLRTYAVYGGVSINPQMMKLRKGVDLLVATPGRLLDLFRQNAVKFSQLQTLVLDEADRMLDLGFSEELKSIYAALPKKRQTLLFSATFSDAIRQLAGQMLNDPLSIEVSPRNVAANTVKQWVVPVDKKRKPELFSHLLRKNRWKQVLVFAKTRNGVDALVEKLQGQGVNADGIHGDKPQATRQRALDRFKASEIQILVATDVAARGLDIEDLPLVVNFDLPIVAEDYIHRIGRTGRAGSTGEAISLVCADEVNLLSAIEMLTRQTLKRHEEQDFEPEHRVPETDASGQVVKKPKKPKKPKTSGGGGKRNLGKWVDSGEVAEAPAVKPVRKVPAFNTGPRKRKP

SEQ ID NO: 9396 - protein, 319 aa, Triticum aestivum
MSWSVLSSLNLHFLSLVGSIENRCPRRVVSSQVDAFTAQPFKGNPAAVCFLEDDAAAPAGDGRWMQSVAVEFNLSQTAFFSRDSSCAADAATPRFHLRWFTRVTEVALCGHATLATAHFLFTSVLAERHGVVEFVTQSGVLTAKKVPAPEAEKQGKLFIELDFPMSDYVRCDPAGELPSIPETLNGAPVVSVHKSVTTNDFIVELSSGKEVADVLPNIEEIRKCAGRGVIVTAPAPAGSGYDFFTRFFCPKFGIDEDPVCGSAHCVLAPYWGGKLGKQKLIAFQVSPRSGTLYLELDVVNRRVRIQGEAVTVMAGTLFA

SEQ ID NO: 9397 - protein, 615 aa, Streptomyces coelicolor A3(2)
MNTGELVDLGQQLRVDSVRAAAAAGSGHPTSSMSAADLMAVLLANHLRYDFERPAHPGNDRFVLSKGHASPLLYSAFKAAGAIDDEELLTFRKQGSRLEGHPTPQRLPWVETATGSLGQGLPVGVGIALSGKRLDHTDYRVWVLCGDSELAEGSIWEAAEHAGHEHLDNLTVIVDVNRLGQRGPTRHGHDLDAYARRFRAFEWHTIEVDGHDVDAVDRAYGEALSTKGQPTAIIARTLKGKGVRAVEDREGQHGKPLPEAEEAVAELGGPRDIRVRVHAPEDARSLRSTGTGQTELPRYGLGDEVATRNAFGEALAAVGTARGDVVALDGEVGDSTRAEFFAKEHPERYFECYIAEQQMVAAAVGMAARGWVPFATTFAAFLTRAYDFVRMASISGAGINLVGSHAGVAIGQDGPSQMGLEDLAMMRAIHGSTVLYPCDANQAARLVAEMAGLEGIRYLRTSRGESKVIYGPDEEFPVGGSKVLRSSDADRLTVVAAGVTLHEALAAADALGADGIPVRVIDLYSVKPVDRATLRAAAEETGCLVTVEDHRREGGIGDAVLDAFSDGRPVPRLVRLAVTTMPGSATPAEELHAAGIDAESIEAAARMLVEQAIVP

SEQ ID NO: 9398 - protein, 837 aa, Oryza sativa Japonica Group
MAIHQLSFVLLLMLLAPATSRARDSIAPGEPLAGHDTLVSAGAGDGGGFALGFFTPPGSNDTYVGVWYARVSPRTVVWVANRADPVPGPVDGNAGATLSVSRACELAVADANSTVVWSVTPATTGPCTARIRDDGNLVVTDERGRVAWQGFDHPTDTLLPGMRIGVDFAAGNNMTLTAWKSPSDPSPSSVVVAMDTSGDPEVFLWNGPNKVWRSGPWDGMQFTGVPDTITYKNFSFSFVNSAREVTYSFQVPDASIMSRLVLNSSGGGLVQRWTWVEAAGAWNLYWYAPKDQCDAVSPCGANGVCDTNSLPVCSCLRGFAPRSPAAWALRDGRDGCARETPLGCANGTDGFAVVRHAKAPDTTAATVDYDAGLQLCRRRCLGNCSCTAYANANLSAPPGRRGCVMWTGELEDLRVYPAFGQDLYVRLAAADLDSTSKSKKKTHIIIAVVVSICALAIILALTGMYIWRTKKTKARRQGPSNWSGGLHSRELHSEGNSHGDDLDLPLFDLETIASATNGFSADNKLGEGGFGPVYKGTLEDGQEIAVKTLSKTSVQGLDEFRNEVMLIAKLQHRNLVQLIGYSVCGQEKMLLYEFMENKSLDCFLFDKSKSKLLDWQTRYHIIEGIARGLLYLHQDSRYRIIHRDLKTSNILLDKEMTPKISDFGMARMFGSDDTEINTVRVVGTYGYMAPEYAMDGVFSVKSDVFSFGVIVLEIISGKRNRGVYSYSSHLNLLARAWSSWSEGNSLDLVDKTLNGSFNQEEVLKCLKVGLLCVQENPDDRPLMSQVLLMLASADATSLPDPRKPGFVARRAATEDTSSSRPDCSFVDSMTITMIEGR

SEQ ID NO: 9399 - protein, 262 aa, Zea mays
MAGLGKAMYAVGFWIRETGQALDRLGCRLQGKYFFHEQISRHRTIMNIFDKTPHVHKDAFVAPSASLIGDVQVGSGASIWYGCVLRGDANIIQIGSGTNIQDNSLIHVAKSNLSGKVFPTTIGNNVTVGHSAVLQGCTVEDEAFVGIGATLLDGVVVEKHGMVAAGALVRQNTRIPCGEVWGGNPAKFLRKLTDDEITFIAESAANYSNLSKVHAAENAKPLEKIEFEKVLGKKFAHQDEYDSSIGVAEGAPPELTSPNPAQ

SEQ ID NO: 9400 - protein, 560 aa, Borrelia garinii PBi
MAPSRGTALKKRPRDFNSLEGQDFVVETLKHSIEKNKIANAYIFSGPRGVGKTSSARAFARCLNCKNGPTVMPCGECNNCKSIENDSSLDVIEIDGASNTSVQDIRQIKEEIMFPPAISKYRIYIIDEVHMLSNSAFNALLKTIEEPPNYIVFIFATTESHKLPETIKSRCQHFSFKLLSLEKIYNMLKKVCFEDHIKYEDEALKWIAYKSSGSVRDAYTLFDQVVSFTSSDIKLDQIRSKMGLTNDEFLEKLSASILSEDVKELICVLDSIFLSGVSYEQFLLDSIEFFREALFLKIGIKNFEFIGIKSEDLRKKLAEFDLNYLERIIVVLLETYRDLQFSVNPRYELEINFVKILRLKNYIPNHVLIKQIQNLEDNLLENMALDSSNFDVLANKKNKDDLAFISAKPGLEDEFPEIRPLEKEETSFDKNLSTKIDENLLEANSIEEIDEIFIEDDNSSEANDFINIRDKFIYVVSRYIQTLVHSGEVVIDDNVLYYKVFSEFEYNELQNYKGEIRSEFYKEFPNLSIVFQKNFKSLEKDFEKLETVKNIFGASEVLEG

SEQ ID NO: 9401 - protein, 169 aa, Borrelia garinii PBi
MSMLLQKTLCIIKPDGVRRGLIGDVVARFERVGLKIVAAKMLIIDESLAKKHYLYDDIVLRHSEAVWKSLIKFISNSPVFAFVVEGVESIEVVRKLCGATEPKLAIPGTIRGDFSYHSFRYSNEKGFSIYNVIHASANEVDAIREIPIWFKDNEILNYKRDDECEHYYC

SEQ ID NO: 9402 - protein, 198 aa, Triticum aestivum
PHIPIRVFPSCRIRPAVSARPRRAAHLHAMKVAKEAGALLSYDPNLREALWPSLDEARTKILSIWDQADIVKVSEVELEFLTGINSVEDDVAMKLWRPTFKLMLVTLGDQGCKYYTKDFRGTVPSYKVQQVDTTGAGDAFIGSLLRKIVQDPSALQDKTKLEGAIKFANACGAITATKKGAIPSLPKEDEVLRLMEKA

SEQ ID NO: 9403 - protein, 262 aa, Magnetospirillum magnetotacticum MS-1
MLIGAGKMGSALLRGWLADGLDPGAVTVVDPQPSPEIALLCAERGLRLNPTDAAPAGALVLGIKPQVLDEAAAALGAWIGPDTLVLSILAGKTLADLKRRLPGARALVRVMPNLPASIGRGATGAVGSPEVGPDARAGAEALLASSGLVAWLDDEGLIDAVTAVSGSGPAYVFLLAEALAEAGVAAGLPRDLSAQLARATVAGAGALLDADPREAGQLRRDVTSPGGTTAAALAVLMREGGLPALMTEAVAAARRRAGELSG

SEQ ID NO: 9404 - protein, 384 aa, Gloeobacter violaceus PCC 7421
MTFADLQLHPDLVRAVEQLGFTQPTPIQTLAIPPALAGRDVLACAMTGSGKTAAFLLPILQQLIAQPRSTTRALVLTPTRELAGQIEMHLGQLARYSALRGASIIGGVSPEPQARAFHKGVEVLIGTPGRLLDHFDQPYARLANLEILVLDEADRMLEMGFLPDIRRILRHTGHRRQTLFFSATMPGPIAKLATEILRNPVTLNQERKAAPAVGITHSVYPVAQNLKSKFLLELLEREGMRQVIVFTRTKHRANRLSEYLSKARISCERIHGNRSQGQRTEALAGFKSGKYRVLVATDIASRGIDIEALGHVVNFDVPQAAEDYIHRVGRTARAERTGDAFTFVSPEEEDQLRAIERAIGKRLPRLTLLNFDYAVAPQGSRLSG

SEQ ID NO: 9405 - protein, 313 aa, Zea mays
PRVRFSEVRKMTRRFSSRLGQGGFGSVYKGELPNGGVPVPVAVKMLEDSTGEEEFISEVATIGTIHHANVVRLLGFCSERSRRALVYEFMPNASLEKYIRCSSQEQSLITTASKMLEIATGIARGIEYLHQGCDQRILHFDIKPSNILLDYNLNPKISDFGLAKLCARDQSVVALTAARGTMGYIAPELYSRNFGTVSCKSDVYSFGMVVLEMVVVSAKRRKCSPAETEDQNDDVCVPEWIYEEIVTGQEPREMARGERDMVRKLAIVALWCIQWNPPNRPSMTTVVNMLTDSLQSLKIPPKPFVSSFVGQQP

SEQ ID NO: 9406 - protein, 286 aa, Leuconostoc mesenteroides subsp. mesenteroides ATCC 8293
MSLVDTYKLTNGIEIPIIGFGTWQSANGTEAYQSVRWALEAGYRHIDTAAVYGNEDSVGRAIKDSGIPRDELFVTTKLWNDAHTYERAIQALDTSLSKLGLDYVDLYLIHWPNPAALQKQGKDAWIDANADTWRALEDEYKIGKTTAIGVSNFQIEHLEALAKTQTIAPMVNQNFLNPSDNQQELVDYDKDHGMLNEAYSPLGTGKLVDLPQVVSLSEKYNKSVPQILIRWSLDKGFLPLPKSTHETYIKANADVFDFALTSAEIESLDSLTGVGGFHTDASSADF

SEQ ID NO: 9407 - protein, 597 aa, Oryza sativa Japonica Group
MDTTIGSVPTASDAAAPAPAANSAPREATLGRHLARRLAEVGARDVFTVPGDFNLTLLDELEAEAGAGHGGVRLVGCCNELNAAYAADGYARARGGGVGACAVTFTVGGLSAINAVAGAFSENLPVVCIVGGPNSNDYGSNRILHHTIGLPDFTQELRCFQTVTCYQAVVNNLEDAHEQIDAAISTAIKESKPVYISISCNLPSIPHPTFSRHPVPFFLSPRLSNQMNLEAAVETAAAFLNKAVKPVLVGGPKMRVAKACKSFVELADACGYPVAVMPSAKGLVPEHHPRFIGTYWGAVSTPFCAEIVESADAYLFAGPIFNDYSSVGYSLLLKKEKAIIVQPDRVVIGHGPAFGCVLMKDFLHALSARLKKNTAAYENYRRIYVPPGEPPLSEPGEPLRVNVLFQHIQKMLSANSAVIAETGDSWFNCQKLKLPEGCGYEFQMQYGSIGWSVGATLGYAKAAKDKRVIACIGDGSFQVTAQEVSTMLRWGQKSIIFLINNGGYTIEVEIHDGPYNVIKNWNYTGVVEAFHNGEGKCYTAKVRTEEELKEAIEEAQGPKKDCLCFIEVIVHKDDTSKELLEWGSRVSAANSRPPNPQ

SEQ ID NO: 9408 - protein, 244 aa, Leuconostoc mesenteroides subsp. mesenteroides ATCC 8293
MKKIVIKIGGNAATQLTPAFFDTIKFWQKQHYKIAIVHGGGDTISALMSQLNEPVQKINGIRFTTQNGINITKMALLGQVQPALLESCRVNGLSVIGLNAASDQLLTGHTIDQDTFGYVGNIHQVNTKLIHNLWEKNLIPIIAPMAITNSGQWLNVNADHAATALAKYLKADELYLLTDVSGVKIKGNVLQNLTSKTMEELQKKQMITGGMIPKVNSALFAARHGVRAVHITNTVTHPGTIVTI

SEQ ID NO: 9409 - protein, 204 aa, Neisseria meningitidis Z2491
MSFDNYLVPTVIEQSGRGERAFDIYSRLLKERIVFLVGPVTDESANLVVAQLLFLESENPDKDIFFYINSPGGSVTAGMSIYDTMNFIKPDVSTLCLGQAASMGAFLLSAGEKGKRFALPNSRIMIHQPLISGGLGGQASDIEIHARELLKIKEKLNRLMAKHCGRDLADLERDTDRDNFMSAEEAKEYGLIDQVLENRASLQL

SEQ ID NO: 9410 - protein, 212 aa, Brassica napus
MPGPVIEEVNIEEQLMDAIKEQMKLQNDDDVVVEDVKDGEEEDDIDDDEDDNVDGAGENESSKQSRSEKKSRKAMLKLGMKPVTDVSRVTIKRSKNVLFVISKPDVFKSPNSETYVIFGEAKIDDMSSQLQAQAAQRFKMPDVASMIPNADASEAVTVAQEEEDDDDVDETGVEAKDIDLVMTQAGVSKAKAVKALKTNDGDIVSAIMELTT

SEQ ID NO: 9411 - protein, 475 aa, Oryza sativa Japonica Group
MGALLSSPNSKNQPWEHGEASKADSSKKLRMSAPPLSGGYDHPGLIPGLPDEISLQILARMPRMGYLNAKMVSRSWKAAITGVELYRVRKELGVSEEWLYMLTKSDDGKLVWNAFDPVCGQWQRLPLMPGISHGGECKRGIPGLWLGDLLSAGIRVSDVIRGWLGQRDSLDRLPFCGCAIGTVNGCIYVLGGFSRGSAMKCVWRYDPFVNAWQEVSSMSTGRAFCKASLLNNKLYVVGGVSKGKNGLAPLQSAEVFDPRTGIWVEVPDIPFSKAQALPTAFLAELLKPIATGMTSFGGKLYVPQSLYSWPFFVDVGGEIFDPETNSWAEMPVGMGEGWPARQAGTKLSAVIDGDLYALEPSTSSDRGKIKIYDPQEDAWKVAIGQVPVGDFAESECPYLLAGFLGKLNLIIKDVDSKINIMQTDVLKPVELSAPGNGPTCQNQQLSSEQETNLWKVIVSKNLAAAELVSCQVLNI

SEQ ID NO: 9412 - protein, 85 aa, Glycine max
MAMRRFYNEIKGKRVSEVPEHVKPMLSLNYIKKAIQRGFDNYHAKYIETSSPDPIFHVCYGGMIFSYLVALPHERRHLQHAQQHH

SEQ ID NO: 9413 - protein, 454 aa, Glycine max
MRMDYLKQKFPFNHRNLFLKLLLTIFFIGLAFRILFFHSLSPQISPVLESPFPEKVTLPEPQTSTVPEEEHVPEPPPVIEHVSEPPPVLEHVPQTEDQLSPTDSEKCDYFNGDWIPNPSGPVYTNDSCDLIESHQNCLKNGRPDRDFLYWRWAPRECDLPQFDPKRFLNLMRNKAWALIGDSISRNHVQSLVCILSKVEKPALVYHDEEYKCKRWNFPSYNLSLSVIWSPFLVEAAIFEDINGVSSSEVELHLDRLDSKWTDQYLDFDYIIFSTGKWFLKSAIYYENETILGCHSCPKRNLTELGFNFAYRKALKLVMNFIVSSNHKGLIFFRTFTPDHFENMEWFNGGTCNRTAPIKEGEMEMKYLSKMLREIELEEFGKAASEASKNGVNFKLVDFASLSQLRPDGHPGPYRQFHPFEKDPNAKVQNDCLHWCLPGPIDSWNDIIMDMVVNG

SEQ ID NO: 9414 - protein, 307 aa, Ralstonia solanacearum GMI1000
MLTTMNLPQLVVFGEALTDFIREADGRWRSVAGGSCWNVARVCARLGAPTGFAGTVSRDVFGDELTALSRQAGLDMRFMRQVARPPLLAMVPAAHPPQYFFIGENSADLAFDTGVLPDGWIEAAQIVHFGSLSLARQPLAAHLLETATAVHAAGKRIAFDPNYRDAMAGPDYRPTLRRMAGLASYIKVSDEDLRGLFPELDETSALAQLRAWAPTAAILMTRGAAGMTLITPEGTLFQPALPTLVADTVGAGDASMGGWLASLLTRPEAMPASHLEFSAASAAAVCARQGAYAPTREEIVSALAVSR

SEQ ID NO: 9415 - protein, 408 aa, Listeria monocytogenes str. 4b H7858
MIDIQKIRADFPILAQEINEKPLAYLDNAATSQKPKQVIEALTHYYEFDNANVHRGVHTLAARATDAYESARGKVAKFIHAREVAEIIFTRGTTSAINLVVDSYAEANIEAGDEIVISYLEHHSNLIPWQQLAKRKGAVLKYIELEEDGTISVEQAKKTIGEKTKIVALAHVSNVLGTITPMKEIAAIAHQFGAVILVDGAQAVPHMEVDVVDLDADFYAFSGHKMMAPTGIGALYGKRELLDAMEPTEFGGEMIDFVELYDSTWKELPWKFEAGTPIIGGAIALGAAIDYLAEVGLANIHAHEQALASYAIEEMSKIEGITIYGPKDASKRCGLVTFNLEGAHPHDIATILDEDGIAIRAGHHCAQPLMKWLDVSSTARASFYIYNTKEEIDALIDGLKLTKEYFGL

SEQ ID NO: 9416 - protein, 662 aa, Thiomicrospira crunogena XCL-2
MFDHILLNIVFLLVITVGLVSISRRFHLPPILNYILVGIIVGPFGFGLIESEKSISFLAEFGIVFLLFSIGLEFSLTQMMSMRKMVFGYGGLQVLLTGAFVYLTCQMFGLDIETSIVVASAFALSSTAIVIKQLTEQSEIQTRHGRAAVGVLIFQDLMAIPLLILIPALGTASGDSLSSELGIAFLKGGIVVVVMLFAGRYLLRPLFHEVASSKSQELFTLTVLTVVLSAAAFTEEMDISMTLGAFLAGMMLGETEYRHQIEADIRPFQDILLGLFFITVGMMISPAVLQSDFFIIITITFSIMLIKAVVIFGIMKTFKKPEGVSIRAAVSLAQVGEFGLVLITLALSYELLSGELGQILLTSAVLSMMITPLLVKFNGRIANRLCRKSYQNNFSELENVIKEDTKYLADHVVLLGFGRVGQTTAKFLEQAHVPFVALDMDIKRVHEAQQSGEPVYFGDSAKHSIIKATNLSKAKVAIITFHNYHAAIKTLKTLKDVAPELPILVRTQDDSHINELMAAGATEVVPDTFESSIMLASHLLLMIGQPPSQVLRQTRAARKGRYSLLNGMYPGESDHTPFDNAQIGQVIQPIQINDSAFAVGKRLEELPFSKLNINIKSVKRGSVRGDDPDVRTRIRAADVLIVQGLPENVDKFENYLNSGKQP

SEQ ID NO: 9417 - protein, 1490 aa, Candida albicans SC5314
MADADTSSNSSKTNEDRSQEGFGTYQGYTDRVASEVQELARIISHASIQQLKLKRQHSRQESQKSNEQESELSGKLGVIPVDENGNFVDQRLNPNSPEFNAAYWIQNAHKLVSSDIDYFKPVTIGVAYKNLRAYGSASDADYQSTLVNLIPKYLSLFFREYILRHTGPTFDILKPMDGLIKPGELTVVLGRPGAGCSTFLKTIASQTYGYHIDKDSVIRYNSLTPHEIKKHYRGEVVYCAETENHFPQLTVGDTLEFAAKMRTPQNRPLGVSRDAYARHLAAVVMAVYGLSHTRNTKVGNDFIRGVSGGERKRVSIAEITLNNAMVQCWDNSTRGLDSATALEFIRALKASADIVHTTPLVAIYQCSQDAYDLFDKVVLMYQGYQIYFGSAKKAKQYFIDMGYECPQRQTTADFLTSLTNPAERIVRQGFEGKVPQTPQEFYEYWKKSPEGQQIVADVDQYLTEHSSAAEKEAIKEAHQARQSDHLKPASPYTVSFFMQVRYIAHRNILRIKGNPSIHLFQIFGNIGMSFILSSIFYNLPTATSSFYHRTAALFFAVLFNAFSCLLEIFSLYEARSIVEKHKKYALYHPAADAFASIVTELPTKFIIAIGFNLVYYFMVNFRRTPGNFFFYLLINFSATLAMSHIFRTIGAATKTLQEAMTPAAILLLALTIFTGFVIPTPNMHGWCRWINYLDPLAYAFESLIANEFHNRDFECSQYVPSGGSYPTAGPNRICTPVGSVPGQDFVDGTRYMEMSFDYRNSHKWRNFGIVIGFIVFFFCTYILLCEINKGAMQKGEILLFQQRALKKRKKANNDIESGEIEKVTPEFDNEYENNQDKMLQSGGDTFFWRDLTYQVKIKSEDRVILDHVSGWVKPGQVTALMGASGAGKTTLLNALSDRLTTGVVTEGIRLVNGRPLDSSFQRSIGYVQQQDLHLETSTVREALEFAAYLRQPKSVSRKEKNEYVDYIIRLLEMEQYADAVVGVSGEGLNVEQRKRLSIGVELVAKPKLLVFLDEPTSGLDSQTAWSICKLIRKLADNGQAILCTIHQPSAILLAEFDRLLFLQRGGQTVYFGDLGENFTTLINYFEKYGAPKCPPEANPAEWMLEVIGAAPGSKANQDYYDVWLKSSEFQEMNSELDLMSEELVKKPLDDDPDRLKPYAAPYWEQYLFVTKRVFEQNWRTPSYLYSKFLLVVTSSLFNGFSFYKADRSLQGLQNQMFSVFMFLVILHTLIQQYLPTFVSQRDLYEVRERPSKTFSWITFIAAQVTAEIPWNIICGTLGYFCWYYPVGLYQNATYTNTVHQRGAFMWFAIVLFFIYTSTLAQLCISFLEIDDNAANLSVLLFTMCLAFCGVLVTKEQLPGFWVFMYRCSPFTYLVSVMLSVGLVDAPVTCAAKEYLRFSPPQGYTCMQYMEPYMKVAGGYLLNENSTTECEFCTMKVTNVFLKMIGSDYSKRGRDIGIYIAFIGINIIGTFILYWFARVPKNFDIKLRRKR

SEQ ID NO: 9418 - protein, 335 aa, Dichelobacter nodosus VCS1703A
MQYWYQQQFLKIQDHSREHIIPLLALAARLKAAKKGNRESPVYLQGKNIALIFEKSGTRTRCAFEVAAADQGGSTSYISTRTSQLGRQESLVDTAIALGRIYDGIAYRGSHQYTLETLARHTGIPVYNALTDSAHPTQMLADLLTIREHTDKPFEEIQLAYLGDGQNSTAISLLFTAAIMGINIRIAAPASLQPDPETFRQAEKIAQQTGAKITITEEIAAAVQYCDFLYTDAWVSMEESDEIWEQRIPLLMPYRIDQDTLIACQNPDVKFMHCLPAFHDRTTPAGDRFFTIYKKAGIEVSHNAFMGKNSIVFDQVENRMHTIKALLVATLNEYL

SEQ ID NO: 9419 - protein, 336 aa, Glycine max
MHTKSAQSSFRDRTHEFQSIAERLKKTGPAPNGQSSSSSRSEEQRSAIANQSEFNRRASKIGFGIHQTSQKLAKLAKLAKRTSVFDDPTMEIQELTGVIKQDITALNSAVVDLQLLSNSRNESGNASTDTTSHSTTVVDDLKTRLMSATKEFKDVLTMRTENLKVHENRRQLFSATASKDSANPFVRQRPLATRSAASTSNAPAAPWATGSSSSQLFPKKQVDGESQPLLQQQQQQQEVVPLQDSYMQNRAEALQNVESTIHELSNIFNQLATLVSQQGEIAIRIDENMDDTLANVEGAQGALLKYLNNISSNRWLMIKIFFILIFFLMVFLFFVA

SEQ ID NO: 9420 - protein, 390 aa, Thiomicrospira crunogena XCL-2
MNLHEYQAKSLFQQYGIPVPKGVMINDLADLDAALGQIDSKGWVVKAQIHAGARGKAGGVKLVETAEEAEQAASELLGSSLATIQTAGKALPINALLIEQTLDIYQEFYLSLMVDRVTKTHTFVISAAGGMDIELVAEASPEKILSVHVDPTVGLMPYQCREIAFALGLTGTAFKQMASVMQGFYQLALDKDVSLLEINPLVLTAENELVALDAKVNIDSNALYRQPGLVEMRDISQEDVREAKAADHQLNYIALDGNIGCMVNGAGLAMATMDLIKLNGGEPANFLDVGGGATPERVAEAFKLILSSSDVQSILVNIFGGIVRCDLIADGIIQAVQEVGLTIPVVVRLEGTNVTLGKEKLANSGLSIITADGLADAAEKVVAVALEANQ

SEQ ID NO: 9421 - protein, 443 aa, Nitrosomonas europaea ATCC 19718
MQTYTPYSEAMVFSMLEHAHAAHLAWRQVPLHERTALLLKLADVLRENSESYARLMTEETGKTIRAARAEIEKCAWACEIYADKAAAWLAEEEIAADGIKHRVVIEPLGVILAVMPWNFPFWQVMRFLIPALLAGNGALLKHATNVTGSALKIQEAVNEAGFPKGLFVTLLVSHTVVEQVIAHPLCQGVSLTGSAEAGRAVASVAGRHLKKVVLELGGSDPFIVLGDADIPAAAKAAVIGRFQNNGQSCIAAKRLIVLKEIEEVFTSTLLAEVEKLVVGDPLDEATDIGPLVSEQAAETMEQFVLDAVAKGAMVRTGGTRKGAYFTPTVLTGVHSAMEVMTQEVFGPVLPVITADTVEEAITLANATRFGLGASVWSRDLEKGEQVARQLAAGATFVNSITKSDPRMPFGGIRESGLGRELSYWGVREFANIKTVNVYGGEEV

SEQ ID NO: 9422 - protein, 467 aa, Saccharomyces cerevisiae
MSTNTKHYDYLVIGGGSGGVASARRAASYGAKTLLVEAKALGGTCVNVGCVPKKVMWYASDLATRVSHANEYGLYQNLPLDKEHLTFNWPEFKQKRDAYVHRLNGIYQKNLEKEKVDVVFGWARFNKDGNVEVQKRDNTTEVYSANHILVATGGKAIFPENIPGFELGTDSDGFFRLEEQPKKVVVVGAGYIGIELAGVFHGLGSETHLVIRGETVLRKFDECIQNTITDHYVKEGINVHKLSKIVKVEKNVETDKLKIHMNDSKSIDDVDELIWTIGRKSHLGMGSENVGIKLNSHDQIIADEYQNTNVPNIYSLGDVVGKVELTPVAIAAGRKLSNRLFGPEKFRNDKLDYENVPSVIFSHPEAGSIGISEKEAIEKYGKENIKVYNSKFTAMYYAMLSEKSPTRYKIVCAGPNEKVVGLHIVGDSSAEILQGFGVAIKMGATKADFDNCVAIHPTSAEELVTMR

SEQ ID NO: 9423 - protein, 340 aa, Oryza sativa
MLVVVARKSSSSARVAAHQTRSHRAAMPAGQPHAHEPDGGGASHRRPQSPPSLPAEVVPAFAPPESEDEESWVWSQIKAEARRDADAEPALASFLYATVLSHPSLPRSISFHLANKLCSSTLLSTLLYDLFLASFTAHPSLRAAVVADLLAARSRDPACVGFSQCLLNFKGFLAIQAHRVSHVLWAQQRRPLALALQSRVADVFAVDIHPAAVVGKGILLDHATGVVIGETAVVGDNVSILHHVTLGGTGKAVGDRHPKIGDGVLIGAGATILGNVKIGAGAKIGAGSVVLIDVPARNTAVGNPARLIGRKNGEVEKDEDMPGESMDHTSFIRQWSDYTI

SEQ ID NO: 9424 - protein, 174 aa, Dichelobacter nodosus VCS1703A
MKLNKLMMSVLVAAGLLTACSEETKKEPQETAQKTQEAATTDAKADAKDTAGEAVEKAKEMAADAKEAAKEVSSEAAEKVKEIAEDAKEVAGEAVEKAKEVAGEAAEKAKDAAKDAKEAAGEAVEKVKEAVKDDKAQDAAKEKAAEAVEATKEAAADVKKEAENVVKEAEKSVQ

SEQ ID NO: 9425 - protein, 344 aa, Oryza sativa Japonica Group
MASFTAGGGGANNNPNKSLEVNPAPGDSVSSLSFSPKANHLVATSWDNQVRCWEIQPGGQCQAKASISHDQPVLCSAWKDDGTTVFSGGCDKQIKMWPLLSGGQPMVLSGHEAPVKELAWIPQMNLLVSGSWDKTLRYWDVRQPQPAHVQQLPERCYALSLSYPLMVVGTADRNVIVFNMQNPQAEFKRIVSPLKLQTRCLAAFPDQQGFLVGSIEGRVGVHHVDDGQQGKNFTFKCHRDGNDIYAVNALNFHPVHHTFATSGSDGGFNFWDKDSKQRLKAFNKCPSPITCSTFNQDGSIFAYAVCYDWSKGAEKHNPSTAKTNIFLHSVQESEVKGKPRVNKK

SEQ ID NO: 9426 - protein, 442 aa, Dichelobacter nodosus VCS1703A
MNNTFSELGLSTQILRTISRHGYEKPTPIQARAIPLALQGRDLLLSAQTGSGKTAAFVLPILQQLAAEPTKSKLPRALIVIPTRELAQQVQDSVFQYSREFKELYSITLVGGTAYQKQIRALKKGVSIVVATPGRLLDHVREGHLDLSQIRYLVLDEADRMLDMGFSDDMHAIIKQCPQNRQTIMSSATWDGNVGKIAAGFTHNAEKIIIAPETSHIEEISYFTDDQAHKNAVLDRLLADEAVTQCIVFTATKSTTETVAHHLYENGFQAQFLHGDLQQQKRNRIIERFRNGQINVLVATDIAARGIDIPAISHVINYDLPRQSEDYVHRIGRSGRAGRSGVALNLVSLTDRAAMAHIERYLKRAIKTDVLEGLEPTKVPSKKKPSSGRGKTWQARGAKNGSRANSEAKSARGNWHDRKTGKITVARKRSRAEGKSFAHRAS

SEQ ID NO: 9427 - protein, 230 aa, Symbiobacterium thermophilum IAM 14863
MSKIMENVSLVLERIRRAAERAARDPAGVRLVAVTKTRTVEEIEAVLAAGIRDLGENRVQELRSKAPFLQDRQPTWHLIGTLQTNKVKQALEWAELIHSLDRSALLSELVKQAERRGRPVDALVQVNVSGEASKHGLPPGDLEPFLRQVAQQRWVRVRGLMTMAPLSDNPEDARPHFRRLRQLRDQMQALGIEGVSLEHLSMGMSGDYEVAVEEGATLVRVGTAIFGPRD

SEQ ID NO: 9428 - protein, 218 aa, Streptomyces coelicolor A3(2)
MRRPGAVVRRAGGYVTNLMPSAAGEPSIGGGLGDQVYNRLLGERIIFLGQPVDDDIANKITAQLLLLASDPDKDIFLYINSPGGSITAGMAIYDTMQYIKNDVVTIAMGLAASMGQFLLSAGTPRQFALPNAEILIHQPSAGLAGSASDIKIHAERLLHTKRRMAELTSQHTGQTIEQITRDSDRDRWFDAFEAKEYGLIDDVIATAAGMPGGGGTGA

SEQ ID NO: 9429 - protein, 324 aa, Wolbachia pipientis
AAGEPDFDTPDHIKKAAIQAISEGKTKYTAVDGTRELKEAIINKLRKDNNLEYTLNQICVGTGAKQVLFNLFMATINSGDEVIIPAPYWVSYVDMVSLFGGLPVVVECKQNFKLTVELLKSRITKKTKWLILNSPNNPAGAVYTCDELKDIAQILLEYPHMNVVTDDIYEHIIYDEKFFTIAQVEPKLYDRVFVVNGVSKAYAMTGWRIGYIAGRSDVVKAISTLQSQSTSNPNSIAQAAAAAALNGDHSFLKERTRIFKSRRDFMVKELNSAPGLSASVPQGAFYLFVSCEGLLSKSTKSGKIINNDLDFTEYLLGDHLVAVV

SEQ ID NO: 9430 - protein, 330 aa, Oryza sativa Indica Group
MPLSYSAAAAAAPSPLAARSRGLLRRPPRSSPVVVQWYDDQYAVIDRVVDVAMRCKKIDQLRAVNGIPPYAPVSNRSLLSPVTLPIIRDANIKNDTRLRIFSGTANPSLSQEIASYLGLELGKINIKRRASAKNITAVIPYFGYARADRKSQGRESIAAKLVANMITEAGANRVLVCDLHSSQAMGYFDIPVDHVYGQVMNLIGDVRGKVAVMMDDMIDTADISLPNINILMKPIKLGTIAKGAELLHQEGAREVYACCTHAVFSPPAIERLSSGLFQEVIITNTIPLKEDKSFPQLTILSVANLLGETIWRVHDDCSVGHEPYSSLDID

SEQ ID NO: 9431 - protein, 191 aa, Brassica napus
  misc_feature (156)..(156): Xaa can be any naturally occurring amino acid
MMRRLSPSQMSGAGLGIAAISYVAVDYMRYVSPWGHSRLQPVLWSVLVLAVVTRVPFYKHWSKELRAAIPFLASIFFLLGALLFEALCVRSVTAVLGLDWHRDTSPLPDTGQWFLLALNESLPEAIVEILRAHIIGLHHFLMLFVMLGFSVVLDSXVKAPGLGLGARYIFTMGLGRLLRAITFVSTILPSG

SEQ ID NO: 9432 - protein, 98 aa, Triticum aestivum
  misc_feature (6)..(6): Xaa can be any naturally occurring amino acid
  misc_feature (13)..(13): Xaa can be any naturally occurring amino acid
MPEAGXAEAGGKXSFKVILTSDPKLPFKVFSVPEAAPFTAVLKFAAEEFKVPPQTSAIITNDGVGINPQQSAGNVFLKHGSELRLIPRDRVGATVPSF

SEQ ID NO: 9433 - protein, 523 aa, Glycine max
MAMANLARRKGYAVVLSSRSSLCLTRWRGFASGSDENDVVVIGGGPGGYVAAIKAAQLGLKTTCIEKRGTLGGTCLNVGCIPSKALLHSSHMYHEAKHAFANHGVKFSSVEVALPAMMGQKDKAVSNLTQGIDGLFQKNKVTYVKGYGKLVSPSEISVDTTEGENTVVKGKHIIIATGSDVKSLPGVTIDEKKIVSSTGALALSEIPKKLVVIGAGYIGLEMGSVWGRIGSEVTVVEFASEIVPTMDADIRKQFQRSLEKQGMKFKLKTKVVGVDTSGDGVKLTVEPSAGGEQTIIEADVVLVSAGRTPFTSGLNLDKIGVETDKLGRILVNERFSTNVSGVYAIGDVIPGPMLAHKAEEDGVACVEYLTGKVGHVDYDKVPGVVYTNPEVASVGKTEEQVKETGVEYRVGKFPFLANSRAKAIDNAEGLVKIIAEKETDKILGVHIMAPNAGELIHEAAIALQYDASSEDIARVCHAHPTMSEAVKEAAMATYDKPHSHLKSWLLLSSLVFIFVQEFTMTWR

SEQ ID NO: 9434 - protein, 356 aa, Arabidopsis thaliana
MPTLYKKAGCQFPLTTMVKKGGTKRKIAIETIQKRDSLRVTCTKRREGLYSKASQLCLLSDAQIAILATPPSSESNVSFYSFGHSSVDAVVSAFLSGQRPVPKDNKETREDVGICLTRNNLGLGFWWNDESLARSENPQEISEAIDSMRTLLRNLKELRADEALACNQAFVNDREDLKNNDKCDFVSDHETHDQTLILQSASPICCIPENLNEITQEPNQTLNIQSSTSAICCVPDNSPENFNEITEEQDQIRSICETFCVMDNNAALPEMNLDYDQDIGFDTPFESALNDWFSDNTTHQEISASILNAVVDDQVSVDLTPFSYFQRCLDGDNLRFSDCFKAFPIPCAPLRGNQTT

SEQ ID NO: 9435 - protein, 418 aa, Dichelobacter nodosus VCS1703A
MHNTIYVLGFRHQTTPASVREKLAFSPENILNTLPFLQAQCAGAEILLLSTCNRSEWYFASNTPPRLEEWLYQHTAISSEELKRHLFIYTDREAVQHLYRVACGLDSLILGEPQILGQLKAAYRLAKKAGSIGSWLERLFQHSFALAKHVRHQTDIGKNPVSVAYAGVQLTHQFFDDYSKRTAIIVGAGETAQLVARYLHDLKIKRLIIANRTLNRAQQLAESVGGYALSLPQLADHLHEADMIFGCARADVFLVTQNMAITALQRRQNTLQVYIDLGIPHNFDRNIDNKENAFLYDMDNLAQLIDKNRETRQKAAAEAETFIRLYSNDFLNWTQEKPQQHMIRHIRADAHNIRQKLLIMAYRQLAQGADPEKVLAEMSYKLTNKLLHQPCALIHAIPPDHKDWLAVVADTFNAELPK

SEQ ID NO: 9436 - protein, 370 aa, Bradyrhizobium japonicum USDA 110
MATHKLLLLPGDGIGPEVMGEVKRLIDWLNSAGIAKFETDTGLVGGSAYDAHKVSISEGDMAKALAADAIIFGAVGGPKWDAVPYEVRPEAGLLRLRKDLGLFANLRPAVCYPALADASSLKREAVEGLDIMIVRELTGGVYFGEPKTITDLGNGQKRAIDTQVYDTYEIERIARVAFDLAKKRKNKVTSMEKRNVMKSGVLWNEVVTQVHKREYPDVTLEHQLADSGGMMLVKWPKQFDVIVTDNLFGDMLSDIAAMLTGSLGMLPSASLGEVDVKSKKRKALYEPVHGSAPDIAGKGLANPIAMISSFGMALRYSFDMGALADKVDAAIAAVLASGLRTADIKSEGTTAASTTQMGEAILKELQKLHA

SEQ ID NO: 9437 - protein, 341 aa, Sinorhizobium meliloti
MRYLITGTAGFIGFHVAKRLIDEGHFVVGFDGMTPYYDVTLKERRHAILQRSNGFKAVTAMLEDRAALDRAAELAEPEVIIHLAAQAGVRYSLENPKAYVDANLVGSWNMLELAKAIAPKHLMLASTSSIYGANEKIPFAEADRADEPMTLYAATKKSMELMAHSYAHLYKVPTTAFRFFTVYGPWGRPDMALFKFVDAIHNGRPIDIYGEGRMSRDFTYIDDLVESIVRLSHVPPSEENRVAPEKATDTLSRHAPFRVVNTGGGQPVELMTFVETVEKAVGRPAIHNMLPMQQGDVPRTFASPDLLEALTGFKPSVSVEEGVARFVEWYDQNYRRAHTTV

SEQ ID NO: 9438 - protein, 130 aa, Microcystis aeruginosa PCC 7806
METTTMDDLINAPSPSPQDLEMTRTPPWGTVTVLEEGPRYRINRIVIKPGHHMSTQMHYHRSEHWIVVSGTARVICDEKETLLKQKESTYVPMNTRHRVENPGSIPLVMIEVQNGEYLGDDDIHRLDDAE

SEQ ID NO: 9439 - protein, 437 aa, Sinorhizobium meliloti
MKITMIGAGYVGLVSGVCFADFGHDVVCVDKDEGKISALKKGQIPIFEPGLDHLVASNVASGRLNFTDDLKTAVAASDVVFIAVGTPSRRGDGHADLSYVYAAAREIASNLQGFTVVVTKSTVPVGTGDEVERIIRETNPAVDVTVVSNPEFLREGAAIEDFKRPDRIVIGVDGSDGRAREVMTEVYRPLYLNQSPLVFTTRRTSELIKYAGNAFLAMKITFINEIADLCEKVGANVQDVARGIGLDGRIGSKFLHAGPGYGGSCFPKDTLALVKTAQDHDTPVRLVETTVAVNDNRKRAMGRKVIAAAGGDIRGSKYAVLGLTFKPNTDDMRDTPAIAVVQALQDAGARVTGYDPEGMENARKLIEGLDCARDPYEAAAEADALVIITEWNEFRALDFDRLKSTMKTPLLVDLRNIYRKDEVAKHGFRYASIGRPD

SEQ ID NO: 9440 - protein, 397 aa, Frankia sp. EAN1pec
MTGLDRQPAPPEREQARRGPGAPRRAVLMLEDGRSFAGDAFGSVGEAFGEAVFSTGMTGYQETLTDPSFHRQVVIMTAPHIGNTGVNDTDYESDRIQVAGFVVRDPSRLASNWRAQRTLDDELENAGVVGISGVDTRALTRHLRERGAMRCGVSSTDTDLDSLLDRVRESPEMVGADLAPEVSTDKPYVVEARSGLPLFTVAALDLGIKRNTPLSMAALGCEVHVLPARSTAAELLALSPDGVFLSNGPGDPARADYAVETLTGVLEAGVPVFGICFGNQVLARALGFETYKLTYGHRGVNQPVADTRTGRIAVTSHNHGFAVRAPLTGTTDTPYGRVEVSHVALNDDVVEGLTCLDVPAFSVQFHPEAAPGPHDAQGLFDRFCGLMAAGRRKRGEG

SEQ ID NO: 9441 - protein, 123 aa, Thiomicrospira crunogena XCL-2
MSVIDLKVEDFESTIENNDIVILDFWAEWCGPCKQFAPTFEAVSEKHPDIVFAKVNVEEQQDLAGMFQVRSIPTLVFMREKIVVFSNPGVIPESNFEEGIAQLKELDMEKVRQDLAKAQEENA

SEQ ID NO: 9442 - protein, 364 aa, Triticum aestivum
MDEKAAKMEKLSSAAAFVEGGVQDACDDACSICLEAFCDSDPSTVTSCKHDFHLQCILEWCQRSSQCPMCWQAISMNPLKYDPLSQELLEAVEQEKNVQADRSRTTAVFRHPMLGHFEVPVDTDDAELEERLMQHLAAAAVTRRSHRHGRREGHRGRSGPHGRTQIVVFSTTETTSSDPISSDSPQVGDSEYSPAIISAPVDAMEEASANILVHNNTSSNCPVGSNDRISGDEASPINQDGAGPSDPQSFSNTLKTRLQSVSVKYKDSITKNTRGWKERWLSRSDTISSLGSDVRREVNAGIAAVSRMMERLETRDGSGSGPSSASSDNVSSATDNQGAASSNFCASVNGASSSATCASRSGSQ

SEQ ID NO: 9443 - protein, 551 aa, Arabidopsis thaliana
MATTQSHTSDLTSEEQPASLDIMKEQTVPANNETSASFKSSQEAPVVVHPAKVAPLTGPYGLAGDFAGHLPSSILSPQAQGFYYRGYENPTGEWDEYSSYVNVEGLDITSPVGFNENASLVYQTGYGYNPQMPYGPYSPAASPLPSEGQLYSPQQFPFSGASPYYQQVVPPSMQYITSPTQPELTSLVGVDQQGDNIGPRQSYHPHPIGPFNGNQPNLGFPEWQQGFDGGIWSDWSKPSDMHRHSSSISPALSPQPLGSYGSYGQNIPMGSQRQRSFYGFGSGSNSYNRGYMHSGGRGQGSNYGSRLISNVGMGNQGWIGVDNSRGRGRVSDPSLGGAYNGTFDILNEQNRGPRASKPKTQVLEELDSAADSKKNNKGSAKEHEESNNADFVTDYTNAKLFIIKSYSEDNVHKSIKYNVWASTPNGNKKLDAAYREAKDEKEPCPLFLLFSVNASSQFCGVAEMVGPVDFEKSVDYWQQDKWSGQFPVKWHIIKDVPNSQFRHIILENNDNKPVTNSRDTQEVSSNLCLSSFLVHKIPLLSHTITTTKNYR

SEQ ID NO: 9444 - protein, 218 aa, Vibrio parahaemolyticus RIMD 2210633
MNQSSLLAEFGDPITRVENALIALKEGRGVLLLDDEDRENEGDIIYSVEHLTNEQMALMIRECSGIVCLCLTDAQADKLELPPMVVNNNSANQTAFTVSIEAKVGVTTGVSAADRVTTIKTAANPHAKPEDLARPGHVFPLRARPGGVMTRRGHTEGTIDLMQMAGLQPAGVLCEVTNPDGTMAKAPEIVAFGHLHNMPVLTIEDMVAYRNQFDLKLA

SEQ ID NO: 9445 - protein, 948 aa, Oryza sativa
MERSTPGTMAARSWLLLLCFVAVATAGVLQARAQPDSNGFISVDCGLPGKTGFVDDKTKISYAADDGFTDGGACHNISAEYITPGLAKRYHTLRSFPDGKRNCYTLRSLVAGLKYLFRTTFFYGNYDGLNKLPVFDLYVGVNYWTMVNITGPGDAVIVEAIVVVPDDFVQVCLVNTGAGTPFISGLDLRPLKNTLYPQSNATQGLVLLGRLNFGPTDYTDVIRYPDDPHDRIWFPWVDSTKWSQISSTKKVQDLDNDMYETPTAVMQTAITPRNASRNIEFSWDPVPLPNDPTPGYIAIFHFSELQLLPGNAVREFYINLNGKPWSLTAFKPEYLYNDATFNRNPFLRYPQYNISINATANSTLPPLINAVEVFSVIPTATIGTDPEDVAAITAIKEKYQVVKNWMGDPCVPKMLAWDKLTCSYAISNPARIIGLNLSSSGLSGEVSSYFGNLKAIQNLDLSNNKLTGPIPDALSQLPSLTFLDLTGNQLSGSIPSGLLKRIQDGSLNLRYGNNPNLCTNGDSCQPAKKKSKLAIYIVIPIVIVLVVVIISVAVLLCCLLRRKKQAAMSNSVKPQNETVSNVSSNGGYGHSSSLQLKNRRFTYNELEKITNNFQRVLGRGGFGYVYDGFLEDGTQVAVKLRSESSNQGAKEFLAEAQILTRIHHKNLVSMIGYCKDGEYMALVYEYMSEGTLQEHIAGKNNNRIYLTWRERLRIALESAQGLEYLHKACNPPLIHRDVKATNILLNTRLEAKIADFGLSKTFNHVNDTHVSTNTLVGTPGYVDPEYQATMQPTTKSDVYSFGVVLLELITGKPSILREPGPISIIQWARQRLARGNIEGVVDAHMHGDHDVNGVWKAADIALKCTAQTSTQRPTMTDVVAQLQECLELEDRRCGMEDTYNNFYAGNNNDPNSSYNMYNTDQSTDVSQNNTMEHNFERVPTMATGPVAR

SEQ ID NO: 9446 - protein, 324 aa, Wolbachia pipientis
AAGEPDFDTPDHIKKAAIQAISEGKTKYTAVDGTRELKEAIINKLRKDNNLEYTLNQICVGTGAKQVLFNLFMATINSGDEVIIPAPYWVSYVDMVSLFGGLPVVVECKQNFKLTAELLKSRITKKTKWLILNSPNNPAGAVYTCDELKDIAQILLEYPHMNVVTDDIYEHIIYDEKFFTIAQVEPKLYDRVFVVNGVSKAYAMTGWRIGYIAGRSDVVKAISTLQSQSTSNPNSIAQAAAAAALNGDHSFLKERTRIFKSRRDFMVKELNSAPGLSASVPQGAFYLFVSCEGLLSKSTKSGKIINNDLDFTEYLLGDHLVAVV

SEQ ID NO: 9447 - protein, 324 aa, Wolbachia pipientis
AAGEPDFDTPDHIKKAAIQAISEGKTKYTAVDGTRELKEAIINKLRKDNNLEYTLNQICVGTGAKQVLFNLFMATINSGDEVIIPAPYWVSYVDMVSLFGGLPVVVECKQNFKLTAELLKSRITKKTKWLILNSPNNPAGAVYTCDELKDIAQILLEYPHMNVVTDDIYEHIIYDEKFFTIAQVEPKLYDRVFVVNGVSKAYAMTGWRIGYIAGRSDVVKAISTLQSQSTSNPNSIAQAAAAAALNGDHSFLKERTRIFKSRRDFMVKELNSAPGLSASVPQGAFYLFVSCEGLLSKSTKSGEIINNDLDFTEYLLGDHLVAVV

SEQ ID NO: 9448 - protein, 210 aa, Vitis vinifera
MAKHEDLPVPVFSALEPVYGGGSQLEEAQLRFDGLKSKFVEVFGQAPDIFARSPGRVNLIGEHIDYEGYSVLPMAIRQDTIVAIRKHDAGESPKLLRIANVSDKYTMCTYPADPEQEIDLKNHKWGHYFICGYKGYYEYAKLKGVDVGVPVGLDVLIDGTVPTASQRCFTHFSDLQRSTLFCCILVLMRCHCPVLILCTQDPRMAELNAV

SEQ ID NO: 9449 - protein, 263 aa, Triticum aestivum
  misc_feature (246)..(246): Xaa can be any naturally occurring amino acid
RGKIIRLHILTDGRDVLDGSSVGFVETIENDLAQLREQGVDARIASGGGRMYVTMDRYENDWSVVKRGWDAQVLGEAPHKFQNALEAVKTLRAEPKANDQYLPPFVIVDESGKSVGPIVDGDAVVTFNFRADRMVMLAKALEFPDFDKFDRVRVPKIKYAGMLQYDGELKLPSKYLVSPPLIERTSGEYLVKNGVRTFACSETVKFGHVTFFWNGNRSGYFDETREEYVEIPSDSGITFNEQPKMXALEIAERTRDAILSGKV

SEQ ID NO: 9450 - protein, 618 aa, Oryza sativa
  misc_feature (224)..(224): Xaa can be any naturally occurring amino acid
MHRFLVTALLFSLLNYGAVMATESDEADFFRNCPPSRCSSDGPDIKFPFRLESSSSSCGAPGMQLSCSGQDTLLLHHVLGLSKVTGIDYIYGVINIVPLAESWSQCALQKIISANYSTSVYKQYGFQYASLVSCSEEFIWDSTDSIFGPISCLSNASQSLYLVAPYAFVSILPLYCKVVSTEIMIPYTSNQGRKDYNASASTEFNESAKRITTFSEITFTWSAXLISLMFASDCERQQRLCGFSSQRRTAFCKPHGSKSPAKVIIVAVSVPTIVVLTLVVASALYLSLKTKNDDEIQLKVEMFLKTYGTSKPTRYTFSEVKRITRRFKHKLGTGGFGSVYKGELSKGVPVAVKMLENSKGEGEEFINEVATIGRIHHVNVVRLLGFCSEGTRHALIYEFMPNNSLEKYIFSRDYISSQEVLVPDKMLKIALGIAQGIEYLHQGCSQRILHFDIKPHNILLDHSFSPKISDFGLAKLCARDQSIVTLTAARGTMGYIAPELYSRNFGAVSYKSDVFSFGMLVLEMLSGKRNSDPSINSQNEVFVPEWIYETIVSAQESEFAKDMTQEEKEKLRKLAIVALWCVQWNPANRPSMRKVVNMLTGSLQNLKNPPRPFVSSLS

SEQ ID NO: 9451 - protein, 452 aa, Synechococcus sp. CC9605
MGADLDLVVLGAGSGGLAAAKRAARHGARVAIVEGDRVGGTCVIRGCVPKKLLVYGAQARHQLADASAYGLEIGAVRSDVPDLLRRVRAEVDRLNALHLGFLEKAGVQLLSGWGRFTAPDRIGISDQRGGPVREELTAPRFLVAVGGRPERPDIPGTEKTWVSDDMFLREDFPPAMVVVGAGFIACEFACILRGLGVAVTQVVRGTRLLRGFDAELADTLLDGMREQGIDVLLGQTVVAVEGEPGSLTARLGNGQSLDCGGVLMATGRRPWLSDLGLDAAGVALDNGRITVDANSCTSVAHIHAVGDVTDRVNLTPVAIDEGRAFADSVFGSRQRQVNHDLVACAVFSDPELATVGLSEEQAIERHGVDGVVVHRARFRSMARALPASGPRCLLKLVVEKHTDRVLGCHMVGEHAAEIIQMAAIAVGMGATKADFDRTMALHPSVSEEFVTM

SEQ ID NO: 9452 - protein, 426 aa, Mycobacterium leprae
MPASAADLCEFINASPSPFHVCATVAGRLLDAGYAELSEVERWPDHPGRYFIVRAGSLVAWSAGQGVKAHAPFRIVGAHTDSPNLRVKQHPDLLVAGWRVVALQPYGGAWLNSWLDRDLGVSGRLSVRSAGKGSEITDRLVRIDDPILRVPQLAIHLAEDRKSLTLDPQRHVNAVWGVGDKAGSLLEYVAERTGVAVADVLAVDLMTHDLVPSMVIGADANLLSAPRLDNQVSCYAGMEALLASVPHDCLPVLALFDHEEVGSTSDRGARSNLLSTVLERIVLAAGGGRDDYLRRLPASLLVSADMAHATHPNYPECHEPSHLIEVNAGPVLKVHPNLRYATDGRTAAAFEVACQQAGVRLQRYEHRADRPCGSTIGPLASARTGIPTVDVGAAQLAMHSARELMGAHDVAVYSAALQAFFSADLF

SEQ ID NO: 9453 - protein, 112 aa, Triticum aestivum
RGLLALCGMLLKSLVDHADAWPFKEPVDSRDVPDYYDIIKDPIDLKTMSRRVESEQYYVTLEMFVADLKRMFINARTYNSPDTIYFKCSTRLEAYFTNRIQSHLAQAASTKN

SEQ ID NO: 9454 - protein, 429 aa, Saccharomyces cerevisiae
MSENNEEQHQQQQQQQPVAVETPSAVEAPASADPSSEQSVAVEGNSEQAEDNQGENDPSVVPANAITGGRETSDRVLYVGNLDKAITEDILKQYFQVGGPIANIKIMIDKNNKNVNYAFVEYHQSHDANIALQTLNGKQIENNIVKINWAFQSQQSSSDDTFNLFVGDLNVNVDDETLRNAFKDFPSYLSGHVMWDMQTGSSRGYGFVSFTSQDDAQNAMDSMQGQDLNGRPLRINWAAKRDNNNNNNYQQRRNYGNNNRGGFRQYNSNNNNNMNMGMNMNMNMNMNNSRGMPPSSMGMPIGAMPLPSQGQPQQSQTIGLPPQVNPQAVDHIIRSAPPRVTTAYIGNIPHFATEADLIPLFQNFGFILDFKHYPEKGCCFIKYDTHEQAAVCIVALANFPFQGRNLRTGWGKERSNFMPQQQQQGGQHL

SEQ ID NO: 9455 - protein, 200 aa, Thiomicrospira crunogena XCL-2
MSVLVTKKAPDFTSAAVLADGTIVDDFNLKSHIDGKYAVVFFYPLDFTFVCPSEILAFDHRVEKFKELGTEVIGVSVDSQFTHNAWRNTPVNEGGLGPVKFPLVADLGGSIMDAYGIVHPGNVALRGAFLIDKEGVVRHQVVNDLPLGRNVDEMVRMVEALQFHEENGEVCPAGWNKGDEGMKDSPEGVADYLSKHGEEL

SEQ ID NO: 9456 - protein, 514 aa, Magnetococcus sp. MC-1
MQEIIEKLDHLRNQARLGGGQARIDSQHARGKLTARERIDVLLDEGSFEELDMFVTHNCIDFGMADKRIAGDGVVTGHGTIFGRAVFVFSQDFTVFGGSLSEANATKICKIMDMALKVGAPVIGLNDSGGARIHEGVSSLAGYAEVFQRNVMASGVIPQISAIMGPCAGGAVYSPALTDFIAMVKDTSYMFVTGPDVVKTVTHEEVTAEDLGGAVTHATRSGVADFAFDNDMSMLKQLRRLMSFLPSNNTEKPPLVETHDPANRPDMTLDHLVPMDATKPYDMKELIEKVVDNNDFMEVQAGYAKNIIIGFGRMEGSTVGIVANQPLVLAGCLDINSAIKAARFVRFCDCFNIPIVTFVDVPGFLPGTQQELGGIIKHGAKLLFAYAECTVPKITVITRKAYGGAYDVMASKHLRGDLNYAWPNAEIAVMGPKGASEIIFRNEIKEADDPAAKLQEKTDEYTNKFANPFIAASKGFIDDVIMPHNTRYRVIRGLRLMKDKDLQNPWKKHANMPL

SEQ ID NO: 9457 - protein, 291 aa, Thiomicrospira crunogena XCL-2
MKTTLLRYQNRVNQKLKALLDQQTSYPASLLEAIKYATLNNGKRLRPALVYAVGESMNISLDKLDAAACAVELIHSYSLVHDDLPAMDDDDLRRGQPTCHIQFDEATAILVGDAQQTLAFEALSQDAFLADSDKVKLITLLSHASGGAGMIGGQIIDIQSNGHLPELSQLQKMHEMKTGALITASLLMGAAQSTHYPEKQPGLAKLGQKIGLAFQIHDDILDIEGSTEVLGKPQGSDEAADKSTYPKLLGVMQAKALRDELITDSLETLSALQLTNPFLNELIGYIGYRQH

SEQ ID NO: 9458 - protein, 549 aa, Synechococcus sp. CC9605
MLNRISTSNLRGDAFGGVTAAVIALPMALAFGVAATGDPAPGLWGAVIIGLVASLFGGTPTLISEPTGPMTVVFTSVILSFTATAPDKETAMAMAFTVVILAGLFQILFGVFRLGRYVTQMPYTVISGFMSGIGAILVILQLPAFLGQTASGGVMGTLSNLPGLIAGIQPMELALALITVAILWFTPASVKRFCPPQLLALMLGTVLSMTFFHNAGLKTIPPFNAELPSLHVPTFSGGQLRLMFVDAAVLGMLGCIDALLTSVVADSLTRTEHNSNKELVGQGLANIASGVFGGLPGAGATMGTVVNIQAGGRSALSGIVRALILMVVVLAAAPLASTIPLAVLAGIALKVGIDIIDWDFLQRAHHLSVKAAVITYGVIALTVLVDLITAVGIGVFVANVLTIDRMSALQSRKVKTISTADDDVELTDEEQVLLDQASGKVLLFQLAGPMIFGVAKAISREHNAIGNCQAVVFDLSEVSHLGVTAAIALENAVKEAIEEGRQVFMVGATGSTEKRLQKLKLLERLPQSHITGDRLDALRLAVNGMPLNV

SEQ ID NO: 9459 - protein, 474 aa, Microcystis aeruginosa PCC 7806
MTDHLTNPFLSLPYESAMQDLGDQYYDQVAAADFPRHILRFRNDALLPLVGIQPELTLDEHFIEAFGKFQALTPFLALRYHGYQFGEYNPFLGDGRGFLYGQVRGIDGKLYDFGTKGSGRTPYSRHADGRLTLKGGVREVLAGEALRGLGVNTSRCLSLVETGEPLWRGDEPSPTRSSVMIRVSNSHIRFGTFERLFHIKRADLIKRLLDHVIIYYYPEIDPQDSDRYLKFYAALIERTAKLAAQWMAAGFCHGVLNTDNMSITGESFDYGPYAFIPYYNPQFTAAYFDYGGRYSYGNQPFICRLNLELLQSPLAMVVSLLELDMALANYDQHYNFYYQKMMLKKLGFEDIFTPESALLVGKTVEVLQETGLGYHEFFYQLSEQFNYGWRENSSLILENMDLPKADWQRWRELYSLVLNQLPLDSLSQIDDTLTHYNPKTALLRPLIESVWEAITYKDNWQPFHELVIKLQNKQ

SEQ ID NO: 9460 - protein, 411 aa, Triticum aestivum
MNALAATSRNFRQAARLLGLTPPLEKSLLIPFREIKVECTIPKDDGTLASFVGFRVQHDNARGPMKGGIRYHPEVDPDEVNALAQLMTWKTAVAAVPYGGAKGGIGCSPGDLSRSELERLTRVFTQKIHDLIGTHTDIPAPDMGTNSQTMAWIFDEYSKFHGHSPAVVTGKPIDLGGSLGRDAATGRGVMYATEALLAEYGKSISGSTFVIQGFGNVGSWAAQLIHEKGGKVIALGDVSGTIRNKAGIDVPALMKHRNEGGQLKDFHGAEVMDASELLVHECDVLLPCALGGVLNRENAPDVKAKFIIEAANHPTDPEADEILTKKGVVVLPDIYANAGGVIVSYFEWVQNIQGFMWEEEKVNMELHKYMNSAFQNIKAMCKSQDCNLRMGAFTLGVNRVARATILRGWEA

SEQ ID NO: 9461 - protein, 254 aa, Frankia sp. EAN1pec
MLAADFGRIADAARAVAGHADWLHVDVMDYHFVPNLAFSPDTVDALRRVTDTPLDCHLMIENPDRWAPGFAERGAANVTIHAEAVGDIARTTDAIRAAGARTGLAVKPATPVEHYLDDLHRFDLLLLMTIEPGFGGQKFMDEVLPKIAAARRLIDERGLDLWLQIDGGVNRETIERSAEAGVDVFVAGTAVFGLDDPAAAVESLRALALAAAPRLTAPAAAFVSPPAPAPAPAPAPVADREAGGGAAAVGGVPA

SEQ ID NO: 9462 - protein, 159 aa, Tropheryma whipplei TW08/27
MQTLTAIVEIPRGSRSKYEIDKKTGRLFLDRVVSTAFGYPTNYGFIENTLALDGDPIDALILVQNQLFPGVALHIRPVGVLHMTDDGGEDDKVLCVALKDPYCDHINDLDDVPKHVLNQIEHFFQHYKDLEEGKWVKLGAWNGKDKAMEIITEGLSRFN

SEQ ID NO: 9463 - protein, 149 aa, Brassica napus
TKPITKTEDCESFFNFFSPPQVPEDEELLDDDMADELQGQMEHDYDIGSTIKEKIISHAVSWFTGEAVDPDDLEIDEDDDDEIDEDDDEDDEEDDEDEDDDVDEEDDEDEEAELGKRRRKKSSAGHKKSGRSQLAEGQQGERPAECKQQ

SEQ ID NO: 9464 - protein, 366 aa, Triticum aestivum
MARVRSNGRRAGGSGGGGGRGGKGKGKGKGPGKWKMPLSVARKQQAVLANVDQVTGERIPKSFVFSRGKLPSTLRHLQQDLRKLMLPYTALKLKEKKRNNLKDFVNVASPLGVTHFLILSNPKSLPHLRFAKSPQGPTYTCQILEYALAADIANSQKRPRCPAEIFKNSPLVVLSGFNGLGEPFKSFVTFFRHLVPAIDTDTVKLSTCQRLLLLQYDKETEAIDFRHYSIKLQPVGVSRKIRKLMQNNQVPDLRDLKDVSDYVTKAGYGSESEPDDEAATVSLASDIDKLNRASRKSAVRLQEIGPRMTMRLVKVESGLCSGDILYPQSVGKEDVKEGQEEEEIEDAEDMMELDDGTEEDDSVDEE

SEQ ID NO: 9465 - protein, 535 aa, Neisseria meningitidis Z2491
MSIVEIKVPDIGGHENVDIIAVEVKAGDTIAVDDTLITLETDKATMDVPADAAGVVKEVKVKVGDKISEGGVILTVETGAAAAEAAPAAAEAQPAPAAAPAAAGGATVQVAVPDIGGHTDVDVIAVEIKVGDTVAEDDTLITLETDKATMDVPCTAAGVVKAVFLKVGDKVSEGSAIIEVETVGSAAAAPAQAAQAAAPAAAPPPTAAAAPAAAPAPSAPAAAKIDEAAFAKAHAGPSARKLARELGVDLGQVKGTGLKGRIVGDDIKAFVKSVMQGGAAKPAAVGASLGGGLDLLPWPKVDFSKFGNVEVKELSRIKKISGQNLSRNWVVIPHVTVHEEADMTELEEFRKQLNKEWEREGVKLSPLAFIIKASVSALKAFPEFNASLDGDNLVLKNYFNIGFAADTPNGLVVPVIKDVDQKGLKQISQELTELSKKAREGKLKPQEMQGACFTISSLGGIGGTGFTPIVNAPEVAILGVCKSQIKPVWNGKEFAPRLMCPLSLSFDHRVIDGAAGMRFTVFLANLLKDFRRITL

SEQ ID NO: 9466 - protein, 293 aa, Tropheryma whipplei TW08/27
MLPKRAYPVQDSNVHSQEKKIIAGNWKMNINHSQAVSYLQELNWRLIDNGHDFDACEIAVFPPFTDLRSVQTLVASDDIQISYGAQDVSAFSDGAHTGQISAQFLKDLDCKYVLIGHSEQRCLPCYPGNNSAINELNNKHDGLIANKLLRSFAAGICPILCIGDISPGDHFDATLSRFRSVLSHLKAISDKKHSIGYALGSKTHFLDSDQLHMLVAYEPSSAINSGNCANSGDIVRMAAAIKDIVNVRVLYGGGVNLFNASAVFNEDLLDGILVGRASLNASDFASLIKTCCL

SEQ ID NO: 9467 - protein, 594 aa, Neisseria meningitidis Z2491
MSLVELKVPDIGGHENVDIIAVEVNVGDTIAVDDTLITLETDKATMDVPAEVAGVVKEVKVKVGDKISEGGLIVVIEAEGAAAAPKAEAPVAPAQEAPKAAAPAPQAAQFGGSADVEYDVVVLGGGPGGYSAAFAAADEGLKVAIVERYKTLGGVCLNVGCIPSKALLHNAAVIDEVRHLAANGIKYPEPELDIDMLRGYKDGVVSRLTTGLAGMAKGRKVDIIQGDGQFLDPHHLEVSLTTSEVYEQATPTGEKKIVAFKNCIIAAGSRVTKLPFIPEDPRIFDSSGALALKEVPGKLLIIGGGIIGLEMGTVYSTLGSRLDVVEMMDGLMQGADRDLVKVWQKQNEYRFDNIMINTKTVAVEPKEDGVYVTFEGANAPKEPQRYDAVLVAAGRAPNGKLISAEKAGVAVTDRGFIEVDKQMRTNVPHIYAIGDIVGQPMLAHKAVHEGHVAAENCAGHKAYFDARVIPGVAYTSPEVAWVGETELSAKASGRKITKANFPWAASGRAIANGCDNGFTKLIFDAETGRIIGGGIVGPNGGDMIGEVCLAIEMGCDAADIGKTIHPHPTLGESIGMAAEVALGTCTDLPPQKKK

SEQ ID NO: 9468 - protein, 684 aa, Zea mays
MEGSEAAAREALSTEKAFEGERLPAWSEQITVRSVVVSTALGLFLSFIVMKLNLTSGIVPSLNMSAGLLAFFLMKTWTSALERCGVFPKPFTRQENTVVQTCVISCSSIAFSGGFGTYILGMSKKIAEGFDEAKTSINVEEPSLGRIIAFLFLVSFVGLFSIVPLRKIMIISYKLTYPSGSATAHLINSFHTPQGAIQAKQQVSILFKSFVGSFLWSLFQWFYSAGPGCGFSSFPTFGMEAYRRRFFFDFSATYVGVGMICPYIINFSLLLGSVVSWGLMWPYIESKRGLWYDAELPRSSLHGLNGYQIFISIAMIIGDGLFNFLSILVRTSYDMYLKRTRPAEAAAKPFAGVDVTERQALSFDDRRRTQVFLKDQIPTSIAAGAYVLLAAISVVAIPHIFRQLQPRHVVWAYVVAPVFAFCNAYGTGLTDWSLSSSYGKLAIFIFGANVGAADGGVVAGLAACGLMMGIVSTASDLIQDFKTGYLTLTSPRSMFVSQVMGTGLGCVISPVVFWIFYKAYDIGMEEGYPAPYAKIYRGIALLGVNGWNQLPKYCLRFCLAFFLLAVAICALKEVAKARRWWVQDYIPSALGMAVPFFLGSFFTIDMCVGSIVLYLWSKSDRVRAHMFAPAVASGLICGDGIWSLPSSILSLINVNPPMCLRVFSADTNYQVEEFLWTLRNPAAT

SEQ ID NO: 9469 - protein, 308 aa, Brassica napus
MEEALKIQSLFIYPIKSCRGISVPQATVTQTGFQWDRYWLVVNYKGRAYTQRVEPKLALVESELPKEAFFEDWEPTKDSFLVVRAPGMSPLKIPLTKPSSIAEGVSMWEWSGSAFDEGEEAAKWFSDYLGKQSRLVRFNKETETRPSPPEFAAGYSTTFADMFPFLFASQASLDQLNTLLPEPVPINRFRPNFLVDNCDPFGEDLWDEIKINELVFQGVRLCSRCKVPLVNQETGVPGAAEPTETLMKFRSDKVLMPDKKARGKVYFGKEMVWNWNISNSEGKGSKTIRVGDTISVLRMMPSIAEAAV

SEQ ID NO: 9470 - protein, 324 aa, Wolbachia pipientis
AAGEPDFDTPDHIKKAAIQAISEGKTKYTAVDGTRELKEAIINKLRKDNNLEYTLNQICVGTGAKQVLFNLFMATINSGDEVIIPAPYWVSYVDMVSLFGGLPVVVECKQNFKLTAELLKSRITKKTKWLILNSPNNPAGAVYTCDELKDIAQILLEYPHMNVVTVEIYEHIIYDEKFFTIAQVEPKLYDRVFVVNGVSKAYAMTGWRIGYIAGRSDVVKAISTLQSQSTSNPNSIAQAAAAAALNGDHSFLKERTRIFKSRRDFMVKELNSAPGLSASVPQGAFYLFVSCEGLLSKSTKSGKIINNDLDFTEYLLGDHLVAVV

SEQ ID NO: 9471 - protein, 349 aa, Magnaporthe grisea
MSQFFLTPLKRASPGLARATGRKCRWASSSSSSSSTLSRKPTFPTIGACPPPTCSCQSTPTMVEGFEIDHGTKLNGLMPAYQQHVLVCTGKDDWPSKIEDEDGGENLAADLRGYFGRGGSLSDPYHNVSVLNASFPSSGTPGTSVFLLPDFKLVPSVERGSSSEQLEALAKGYLLPEKLHKAHDAMSTEHQEKFLRKPELQRLVRGVRGFDEILVRICGHGGRDQRCGIYGALLRTEFEKTLPRLGVDVLTGPVDSVSESGGNKKPSSRIGLISHIGGHKFAGNVIIYIPPSLQTDEGLPHPLAGHGIWYGRVEPKNVEGIIHETIRKGNVIEEHFRGGITPSREILRL

SEQ ID NO: 9472 - protein, 190 aa, Arabidopsis thaliana
MEILPIPAESFKVGFIGAGKMAESIARGVVASGVLPPNRICTAVHSNLNRRDVFESFGVNVFSTSEEVVKESDVVIFSVKPQVVKKAVTELKSKLSKNKILVSVAAGIKLNDLQEWSGQDRFIRVMPNTPAAATMVSKTGKHPGVLKDDVTSPGGTTIAGVHELEKGSFRATLMNAVVAAAKRSRELSQS

SEQ ID NO: 9473 - protein, 250 aa, Zea mays
MKLNIANPTTGCQKKVEIDDDMKLRNLYDKRISQEVVGDLLGEEFEGYIFKIMGGCDKQGFPMKQGVLTPGRVRLLLHRGTSCFRGHGRRVGERRRKSVRGCIVSQDLSVINLVIVKKGKNDLPGLTDTEKPRMRGPKRASKIKKLFNLGKDDDVRQYVNTYRRSFTNKKGKTVSKAPKIQRLVTPLTLQRKRARIADKKKRIAKKKSEAAEYQKLLAQRLKEQRDRRSESMAKRRSKLSAATKAPAASA

SEQ ID NO: 9474 - protein, 324 aa, Wolbachia pipientis
AAGEPDFDTPDHIKKAAIQAISEGKTKYTAVDGTRELKEAIINKLRKDNNLEYTLNQICVGTGAKQVLFNLFMATINSGDEVIIPAPYWVSYVDMVSLFGGLPVVVECKQNFKLTAELLKSRITKKTKWLILNSPNNPAGAVYTCDELKDIAQILLEYPHMNVVTDDIYEHIIYDEKFFTIAQVEPKLYDRVFVVNGVSKAYAMTGWRIGYIAGRSDVVKAISTLQSQSTSNPNSIAQAAAAAALNGDHSFLKERTRIFKSRRDFMVKELNSVPGLSASVPQGAFYLFVSCEGLLSKSTKSGKIINNDLDFTEYLLGDHLVAVV

SEQ ID NO: 9475 - protein, 505 aa, Vitis vinifera
  misc_feature (398)..(398): Xaa can be any naturally occurring amino acid
MELYSPSIWLCLLLLLLPLMYLIKRRIELKGQKKPLPPGPTKLPIIGNLHQLGALPHYSWWQLSKKYGPIMLLQLGVPTVVVSSVEAAREFLKTHDIDCCSRPPLVGLGKFSYNHRDIGFAPYGDYWREVRKICVLEVFSTKRVQSFQFIREEEVTLLIDSIAQSSSSGSPIDLTERLMSLTANIICRIAFGKSFQVSEFGDGRFQEVVHEAMALLGGFTAADFFPYVGRIVDRLTGHHGRLERSFLEMDGFYERVIEDHLNPGRVKEEHEDIIDVLLKIERERSESGAVQFTKDSAKAILMDLFLAGVDTGAITLTWAMTELARNPRIMKKAQVEVRNSIGNKGKVTEGDVDQLHYLKMVVKETLRLHPPAPLLVPRETMSHFEINGYHIYPKTQVXVNVWAIGRDPNLWKNPEEFLPERFMDNSVDFRGQHFELLPFGAGRRICPGMYMAIATVELALANLLYRFNWNLPNGMREADINMEEAAGLTVRKKFALNLVPILHHC

SEQ ID NO: 9476 - protein, 166 aa, Borrelia garinii PBi
MVDVQAQRKQIEKLISLNRVTKVVKGGRRFSFAAFMVVGDGEGYVGWGFGKANDASDAIKKSLTSARKNLRFVPIRKGTLPHEVIGCFKKAKVLIKPATHGTGVIAGGPVRAVMEALGVHDILSKSLGSNNSMNVVKATFKAFDLVLNAEKVAEMRGKKTLKTLWG

SEQ ID NO: 9477 - protein, 336 aa, Photobacterium profundum SS9
MAFNLRNRNFLKLLDFTPREIQHMLELAAELKKAKYNGYEQPRLKGKNIALIFEKASTRTRCAFEVAAYDQGANVTYLGPSGSQIGYKESMKDTARVLGRMYDGIEYRGFGQEIVETLGAHAGVPVWNGLTDEFHPTQILADFLTMQEHARGKQLSEVTFAYLGDARNNMGNSLMVGAAKMGMDIRLVAPKAFWPEEELVAQCREIAEETGAKITVTEDVQEGVEGCDFLYTDVWVSMGEAKEAWAERISLMMPYQVNMAMLKATGNPHVKFMHCLPAFHGEDTVVGKELAQEYPELKDGVEVTDEVVESKHSIVFDEAENRLHTIKAIMVATLGQ

SEQ ID NO: 9478 - protein, 218 aa, Polaromonas sp. JS666
MMVRNSIYGGAYAGPQAGAQDAQGLGMVPMVIEQSGRGERSYDIYSRLLKERVIFLVGPVNDQTANLVVAQLLFLESENPDKDISFYINSPGGSVTAGMAIYDTMQFIKPDVSTLCVGMAASMGAFLLSAGAKGKRFSLPNSRVMIHQPSGGAQGQATDIEIHARDILKTRDQLNRILAANTGQPIEKIERDTERDYFLFAEDAKEYGLVDQVISRRP

SEQ ID NO: 9479 - protein, 380 aa, Oryza sativa Japonica Group
MATAGKVIKCKAAVAWEAGKPLSIEEVEVAPPQAMEVRLKILYTALCHTDVYFWEAKGQTPVFPRIFGHEAGGIVESVGEGVTELSPGDHVLPVFTGECGDCRHCLSEESNLCDLLRINTDRGAMIGDGQTRFTARGGQPVYHFLGTSTFSEYTVVHVGCVAKIHPAAPLDKVCVLSCGISTGFGATVNVAKPPKGCTVAIFGLGAVGLAAMEGARISGASRIIGVDLNPAKFELAKKFGCTDFVNPKDYDKPVQQVIIEMTNGGVDRSVECTGNAAAMISAFECVHDGWGVAVLVGVAGKDAAFKTHPTNFLNERTLRGTFFGNYKPRTDLPGVVEMYMNKELELEKFITHSVPFSEINTAFDLMLSGESLRCIIRMED

SEQ ID NO: 9480 - protein, 352 aa, Candida albicans SC5314
MATSQELTADIQALATSFPKRLANDSDNSLLINVAPTGRQAKRHIQQINYSEEFGDDLDFDEFPSSTPGTRSLNENKAQIEAQRYSLAKNTPTPKRILEKPVLSELVEKPVVLIPIKIMIENLNTNQKLIDSFMWNLNESLITPTEFAEVVCSDLDLPFSMAAQIADSINQQIEEYSYASNLQLPNKGPYNVTIDLSVNLNKQLYQDRFEWDMNQNEVTPEIFAEIVVADLGLSLEFKNAISHALHEIIIRVKKEVIDGTFNNEMHNLHLVKGIMFEQGIRIFTENSVQNGNDRWEPLVEVLTSSEIERRENERVRNLRRLKRENMRRDYDDHSRRRQAGKRRYDELEGAWV

SEQ ID NO: 9481 - protein, 598 aa, Zea mays
MDDEDYSWVRRTRFSHSVVRSNSGREQFGAFVEQFNRGAALRQKGSASGFKLHGLNMEPGTRLSTSSLPTTSSFCAQPKPKPKDMSSSDAKPGQHAKAVSDRPSSQEASARKEDDAKASNGKKGIGKLSVAVPRVPAVQSAEVESPGALEFSFHPDEQSLKLQRACSSPAPFPRNKTPGDDALTRSSSLSVLGEAPKTKQRARSPLPSRHVAEVFQEAKSATKRFSTPPPPRRSASSLELNGCPPAPVTVRAPGKLKNRKEGHANGRMKVAATALEVLEKWSVDRSQLLIGHRFASGAHSRLFHGIYKEQPVAVKFIRQPDDEEDAELAAQLEKQFHTEVATLSRLNHPNVIKLVGACSSPPVFCVITEFLSGGSLRAFLHKLDHKALPLGKIISISLDIARGMSYIHSQGVVHRDVKPENIIFDDVFCAKIVDFGIACEEEYCDPLANDTGTFRWMAPEMMKHKAYGRKVDVYSFGLILWEMFSGTIPYEELNPFQAAFAVFDKNVRPAIPTSCPTPVRLLIEQCWASHPEKRPDFSQIVQILEKFKSVLDRDGTLDNMPSSICQETHDHKNWLAHWVQRLKHSQPDLSGPPPPKLL

SEQ ID NO: 9482 - protein, 329 aa, Oryza sativa Japonica Group
MSAPSDPAVATHPQAGAAAAASSSSGLTFKLHPLVIVNVSDHHTRVKAQAACSGDGASSAAAGGQPPRVFGCVIGVQRGRTVEIFNSFELVLDPVSGTLDRAFLEKKQELYKKVFPDFYVLGWYSTGSDVRDTDMQIHKALMDINESPVYLLLNPAINLSQKDLPVTIYESELHVIDGSPQLIFVRANYTIETVEAERISVDHVAHLKPSDGGSAATQLAAHLTGIHSAIKMLNSRVRVIHQYLVSMQKGDMPLDNSLLRQVSSLVRRLPAMESEKFQDDFLMEYNDTLLMTYLAMFTNCSSTMNELVEKFNATYERSTARRGGRGAFM

SEQ ID NO: 9483 - protein, 153 aa, Thiomicrospira crunogena XCL-2
MKIIEGNLTAQGLKVGLVIGRFNSFIVDSLVKGAIDTIVRHGGSEDNIEQVLVPGAFEIPIVAQKMAASGKYDAIVALGAVIRGGTPHFDYVAGECVKGIGQVALNSGVPVSFGVLTVDTIDQAIERAGTKAGNKGEECTLAAIETANVLKQI

SEQ ID NO: 9484 - protein, 372 aa, Thiomicrospira crunogena XCL-2
MQLNTIEELIEDYKQGKMIILMDDEDRENEGDLMMPASAVTADQINYMARYGRGLICLTLTKERCQQLHLPLMTRNNQDSLGTSFTVSIEAAEGVTTGISAADRAKTIQAAIQPEAQPADIVTPGHVFPIMAKPGGVLERAGHTEAGCDLARLAGLEPASVIVEIMNEDGTMARRDDLEIFAKEHGIKLGTVADLIEYRLKNEKTIERVSECHMPTEYGDFRLIGYEDVLEHRTHLALVHGPLKKDHPTMVRVHMLDTLCDLFDSQRDECGWSLRCAMKQIAQEESGVVVVLRKHEEGAELLDKIQQFQMKDRGISQPEIQTEDDAKTYGLGAQILSDLGLTQLKVIGSAWKMSALGGFGLEIVENIDKQKE

SEQ ID NO: 9485 - protein, 123 aa, Zea mays
MASEGKIFTITKTETVYLIHELGMKIAVLKSQNNELRNQFDVLYKHMDGVTNDVERSNELVAILQEELEAKELEVTRLKEETLSQKEGTQEAPAPAPAPVEEGDGAGNDLKPASDPLQVKLES

SEQ ID NO: 9486 - protein, 532 aa, Podospora anserina
MGAAQQIAYFLLHPNELRSIAQWKVWHEPVHRRDASKETPTEKSCFHFLKLTSRSFSAVIQELNPELLMPICLFYLVLRGLDTIEDDMTLDIKEKEPLLRDFHNIMEQDGWTFDKNGPNEKDRELLVHFDDIIFELKKVKKPYYDIIKDITEKMGNGMADYALNAEHNNIGVGTIKEYELYCHYVAGLVGEGLTRLFVESNLANPQLLVRMDLTESMGQFLQKVNIIRDVHEDWIDKRRFWPREIWSKYVDNWDDLFAPANREKALQCSSEMVLNALKHAEECLFYMAGIRDQSVFNFVAIPQSMAIATLDLVFRNPAIFERNVKITKGDACQLMIESTQNLRVVCDVFKKYARRIHKKNDPRDPNFLAISAQCGKIEQFIETIFPTQDPNKVRAGLKQEDPKMDALETFYLIAAALSTFILIGVLMVGLPLGAPHYSGPRRWSPHFFPPRKKKLTILSRLELHGTLVLGSTRSSKTSTKRSPALLPAQWLLLPALLTRNCEKRPGPASKFDPSARSFSPSSQRALIFATYT

SEQ ID NO: 9487 - protein, 444 aa, Frankia sp. EAN1pec
MSFATIETAIAEIAAGRPVVVVDDADRENEGDLIFAAEAATPELLAFMVRHTAGVVCVPLDPAEVDRLDLDQMVPQNTDRMGTAFTISVDARSGVTTGISAADRARTIRLLADPATQPGDLTRPGHIFPLRAKEGGVLRRPGHTEAAVDLARLAGLRPAGAICEIVNEDGSMARLPELTAFAREHGLALISIADLIAYRRRTEKQVVRVAEARIPTRYGSFRAVGYRGTLDGVEHIALIRGEVGDGENVLVRVHSECLTGDVFGSQRCDCGNQLDAALRAVAAEGRGVVLYVRGHEGRGIGLMHKLQAYQLQDAGHDTVDANLALGLPADARDYGTGAQILVDLGVRGLRLLSNNPTKRAGLEGYGLRIVEQVGLPVTHTPENLRYLTTKRDRMGHDLPGLPGLPDLPKVVGGDETAGAHEAHRWPVTAAPVADRADRACEEAR

SEQ ID NO: 9488 - protein, 745 aa, Bradyrhizobium japonicum USDA 110
MTNLRFVLLATTALTAMQLANTASHAQGASPLVVAQAQPQETGPDGKPKQPPKGPPGAAPPAAPARPAAPPPAAAPPHPPAAPPPAAAPPRPAAPPPPPPPPAARPAPPPPPPPPAAPKQPSPPPAAAPQQHAPTPPPPAPPAARPAPTPPAPPPAAAPQHAPPPPPPPAARPTPTPPPPPPAGPAARPTPAPTATPTPVAPPPAAPTARPGSPAPAATPAPTPTPAPTATPAPTATPAPGSTPGAPPAGRPGAPPPGVRPGSPPAAGSPPAPGATPAPTTTPAPGGTATPPSGRPGPASTPAPGAATPAPTATPAPGGALTPPPGRPGAGPTPGPQGGTPPAGAPAAGTPAAPPQAGGLPARPAAPAGAAAPSTVPGSAAATPPPNRAQFAPPTVTPAFQAAPTVVAPLPPPPRPPQRDLTPLAIGAGVVAGAVIGATIADLHNQRRESIEGGRTVYTEPDRIIIRDPGGQAYVRGNDLYRFRYGARDIRTDTVGGDTRTVVIRPDGSEIITVVAPDGRLLRRIRRDPGGRELIIIDNSYRDPQSVGGFYVDAPPPVVNIPYDRYIVDAEEASPDVIYQTMEAPPVQRINRRYTLDEIRYSPNIRMQMPSIDVNTITFETGSWTIPPDQAAKLQVIADGLNRAIQANPRVVFLIEGHTDAVGNEVDNLSLSDRRAQSAAELLTQQFGVPAENLTSQGYGEQYLKEQTQGPSAINRRVTVRNITPLLNGGQASLPPPPPGTAPPR

SEQ ID NO: 9489 - protein, 509 aa, Vicia faba
MDGSAGPGGGNVNAFLRNYKMGKTLGIGSFGKVKIAEHVLTGHKVAIKILNRRKIKNMEMEEKVRREIKILRLFMHHHIIRLYEVVETPTDIYVVMEYVKSGELFDYIVEKGRLQEDEARSFFQQIISGVEYCHRNMVVHRDLKPENLLLDSKWSVKIADFGLSNIMRDGHFLKTSCGSPNYAAPEVISGKLYAGPEVDVWSCGVILYALLCGTLPFDDENIPNLFKKIKGGIYTLPSHLSPGARDLIPRLLVVDPMKRITIPEIRQHQWFQLRLPRYLAVPPPDTLQQAKKIDEEILQEVVNRGFDRDQLVESLSNRVQNEGTVTYYLLLDNRYRVSTGYLGAEFQETMDPGLNRINSGEVVSPAGGHHFLAYQGVGMRQQFPAERKWALGLQSRAQPREIMVEVLKALQGLNVCWKKIGHYNMKCRWVVGIPGHQGGMVNNSVLNNNFLGNVGIIENEAVPKSSVVKFELQLYKTQEKYLLDLQRVEGPQFLFLDLCAAFLAQLRVL

SEQ ID NO: 9490 - protein, 160 aa, Frankia sp. EAN1pec
MSGAGAPAEELPDASGVRLAIVATRWHVEITDALLAGALRAAKDSGVTATPTVVRVSGAVELPVVVAALAARHDAVVALGAVIRGGTPHFEYVCRFVTDGLVRITLDAGVPVGFGLLTCDTVEQARDRAGLPGSTEDKGREATLAALDTAVILRGIGALT

SEQ ID NO: 9491 - protein, 433 aa, Nitrosomonas europaea ATCC 19718
MKVQPAVQTNDNPRFVSTLTRNTLALILAGGRGTRLKNLTDWRAKPAVPFGGKFRIIDFTLSNCVNSGVRRIGVVTQYKAQSLIRHIQRGWSFLDGRFQEFIELLPAQQRTEEGTWYQGTADAVFQNLDILRTHNPGYVLILGGDHIYKMDYGRILAEHVERQADLTIACLEVPVEDASAFGVMAVDDSWRTTSFAEKPEHPAPIPGKPGHALISMGIYVFNAKFLYEQLIQDHDMDQSSHDFGKDVIPRLVASNARVYAHRFQNSCVNMASGVPYWRDVGTVDAYWKANIDLTTITPDLNLYDEDWPIWTHQEQLPPAKFVFDDDDRRGQALDSMVSGGCIISGATVRRSLLFSNVQIRGYSTIEDSVILPNVSIDRHAYLKRVVVEKECQIPEGLKVGFNPDEDRKHFYVTDDGITLITPEMLGQGIHYIR

SEQ ID NO: 9492 - protein, 342 aa, Pseudomonas aeruginosa PAO1
MTLPQTMKAAVVHAYGAPLRIEEVKVPLPGPGQVLVKIEASGVCHTDLHAAEGDWPVKPPLPFIPGHEGVGYVAAVGSGVTRVKEGDRVGIPWLYTACGCCEHCLTGWETLCESQQNTGYSVNGGYAEYVLADPNYVGILPKNVEFAEIAPILCAGVTVYKGLKQTNARPGQWVAISGIGGLGHVAVQYARAMGLHVAAIDIDDAKLELARKLGASLTVNARQEDPVEVLQRDIGGAHGVLVTAVSNSAFGQAIGMARRGGTIALVGLPPGDFPTPIFDVVLKGLHIAGSIVGTRADLQEALDFAGEGLVKATIHPGKLDDINQILDQMRAGQIEGRIVLEM

SEQ ID NO: 9493 - protein, 106 aa, Penicillium chrysogenum
MGVTPIKSVAEYKEKVTDATGPVVVDFHATWCGPCKAIAPALEKLSETHTGIQFYKVDVDELSEVAASNGVSAMPTFHFYKGGERNEEVKGANPAAIQAGVKAILE

SEQ ID NO: 9494 - protein, 509 aa, Pisum sativum
MDGSAGPGGGNVNAFLRNYKMGKTLGIGSFGKVKIAEHVLTGHKVAIKILNRRKIKNMEMEEKVRREIQILRLFMHHHIIRLYEVVETPTDIYVVMEYVKSGELFDYIVEKGRLQEDEARSFFQQIISGVEYCHRNMVVHRDLKPENVLLDSKWSVKIADFGLSNIMRDGHFLKTSCGSPNYAAPEVISGKLYAGPEVDVWSCGVILYALLCGTLPFDDENIPNLFKKIKGGIYTLPSHLSPGARDLIPRLLVVDPMKRITIPEIRQHQWFQLRLPRYLAVPPPDTLQQAKKIDEEILQEVVNRGFDRDQLVESLSNRVQNEGTVTYYLLLDNRYRVSTGYLGAEFQETMDPGLNRINSGEVVSPAGGHHFLGYQGVGMRQQFPAERKWALGLQSRAQPREIMVEVLKALQGLNVCWKKIGHYNMKCRWVVGIPGHQGGMVNNSVLNNNFLGNVGIIESEAVPKSSVVKFELQLYKTQEKYLLDLQRVEGPQFLFLDLCAAFLAQLRVL

SEQ ID NO: 9495 - protein, 395 aa, Tropheryma whipplei TW08/27
MRTLGGFTFPCDAPVFVRVDFNVPMDEVGTITDDLRIRASLPTIESLLGRGAPLILISHLGRPVKNEQQGFSLKPCAERLSEYIGVNVPLVDFLDLDTKLYGELTRHLDKSGIVLFENIRFFAEETSKAQADRRILAEQLAPFAGAYVNDAFGASHRRHASVYELAQAFSNKAAGFLIESEMQAFSHLASEAKRPYTVILGGAKLSDKLRLIENILPTVDRLLLCGGMAFTFLAAQGCETGKSLLEESFISEANKIIDFAKQNNVELILPVDVIEARSLTSPLGVVSKAESISYMGLDIGPETQSIFRNVIQDSKTVFWNGPAGLFENPSFSNGTRALLDALSSSSAFTFIGGGDTAAAVSLLGFDYGDFSHVSTGGGACLELLEGKILPALEVL

SEQ ID NO: 9496 - protein, 337 aa, Tropheryma whipplei TW08/27
MTVKIAINGFGRIGRGFFRALSSPSCIDGPEIDVVAINDLTSPEVLAHLLRRDTIFGRFPESVCHDGTKLLVGKREVAVFSEKDPSSIPWNGVDIVIESTGLFTDANIASGHITAGSKRVIISAPAKNEDATFVVGVNHTDYDPNKHSIVSNASCTTNCLAPLAKVFDDTFGIERGLMTTVHAYTADQRLQDAPHSDLRRARAAAMNLVPTSTGAACAIGLVLPNLKGKLDGFAIRVPVITGSITDLSLVSKTDVSAPEVNEAYRRAALGPLKGILCYSEDPLVSSDIVADGHSCIYDANLLRISGNMVKLSAWYDNEWAYSRRLVDLAKYMASVGL

SEQ ID NO: 9497 - protein, 280 aa, Synechococcus sp. RS9916
MPISVAFLGPVGTYGEKAARALLQLEHQDEARLVPCVGLRSVVEHVADGRCDAAVVPVENSVEGGVTASLDALWSNPDLCIRRALVLPIRHALLSSGRMEEISEVLSHPQALAQCSGWLARHLPNALQLATTSTAEAARMVQGSRFRAAIASRSLHQECELTELAYPINDAAGNCTRFLFLQRGERRPHGDVASLAFSLHRNAPGALLEALAAVADLGLNMSRIESRPSKRELGEYVFFVDVDLPAGEGGHLQQLTERLMPLCEHLAQFGAYPSSEWVED

SEQ ID NO: 9498 - protein, 269 aa, Fulvimarina pelagi HTCC2506
MDQTLPSEDAELELLEDAAREAGRIAMSFFGKDPEIWWKDNNSPVSEGDYAVDRFLKERLLGARTEYGWVSEESVLERLTSTTYEDRFFIVDPIDGTRAYLRGEQTWCVSIALISGNRPLAGAIYAPVPDEMFTVTRSGHAKLAGDHLLTGDQPSERLAIAMPDKFRSAYSRLDRSGYRPVDAQRGAPSLAYRLCQVAAGRLDATLIRPRAHDWDVAAGDLLLEKANGALADADGAPILYTRLPRRHGLLVAASNAAMADARALADAVI

SEQ ID NO: 9499 - protein, 632 aa, Fulvimarina pelagi HTCC2506
MEHANSYFLEIILLLGGGIVAGTLFKRIGLGTVLGYLMAGIAMGPLLGLIHDGEEILHIGELGVVFLLFIIGLELKLSRLWAMRRRIFGLGAAQVLVTALGIGVIAFLLGFQVPTAIVIGFGLALSSTAFGLQILEEQGETNTRHGQSAFSVLLFQDLAVVPILAIIPFLAPYSSDTQIDVVQIAVSVAAVVGLIVGGRFLLNPLFRIMASAGAREVMLGAALFVVLGSAMLMAAAGFSMAMGAFIAGVLLAESSYRHELEANIEPFRGLLLGLFFIGVGLSIDIAVLFDDWQIILLATPMLMISKAALLYGLARLFGEGHDSAVRVSGLLSQAGEFGFVIFSAAAADRIFSAEISSLLIAITTLSMALTPLSTWFARLVLARGEDENEEEMDEDFEGAGSDVLLIGFSRFGQMVAQVLLSSGREVTILDSSAERIRTATNFGFRIFFGSGMRKDVLEAAGIRRAKIVAICTNKQETTNRVVDLIREEFPNVKLYVRAYDRNHALALRARGVDYEIRETVESALAFGGATLTSLGVEDPLARRIIEDVRRRDAKRLKLQESEGTTAGADMIMTQAVKPEPLVEPHAALQAVEDAGDGSENQGELVDNTAPRRRRRGRPFRGRRLSFRNQAQR

SEQ ID NO: 9500 - protein, 265 aa, Azotobacter vinelandii
MSLLTQWRDDIRCVFERDPAARTTFEVLTTYPGVHAIIGYRLANRLWRAAWRYPARLLSFVARMLSNVDIHPGATIGERFFIDHGACVVIGETAEIGNDVTLYHGVTLGGTSWNKGKRHPTLRDGVLVGAGAKILGPITVGAGARVGANSVVVQDVPDGCTVVGIPGKVVKVREAGRPNPYGIDLDHHLIPDPVGKAIACLLERIDALEKQVEAGGLVTVGSQQQFYQVCNSDNSICESDCAGGTTAQAQQSAGRRRAVPTPVAE

SEQ ID NO: 9501 - protein, 783 aa, Schizosaccharomyces pombe 972h-
MAHHHRSTFKAKKPFKSKHASKSSLKEKYKNEVEPHRSGPKNIVHTSTKADRRNTAKQIQLNKRTEVAMNNRIFGGKNGAPKVITIVPLCNNVDSWNVLTNLLRSIDPEASLPKFDKDSISYSTTIDRFKQNLLFLLPKREFYSLIDACKVSDYVIFVLSAVQEVDEFGELIVRTTQGQGISSVLSMVHDLSEVDSLKTRNEVKKSLQSFMNFFFSDQERVFAADVSQDALNVMRALCTSHPRGIHWRDSRSYLLSQEISYSNGNLLVRGIVRGKGLDPNRLIHIQGFGDFAINRIYEAPQGIQNSRGISMDEDTNLTGGLVELCSPTQEQDSLESLGPIIDDMDTDMDSEVGKEASRGVRLDDFYYFDDEEEPVAVAKRVPKGTSTYQATWIPDEDEESDQYSDVEDTEVIIEDQDNQEISNHVAEEKIDSDEEETIDDAKSEMFVDLSEEEEVRQYEEYRKKQKELQEELEFPDEVELQPNELARERFKKYRGLRSLYTSQWDADEYDPNEPREWRQLFKFENYRNLKNKFLKQPFIGEAKPGKAVYVELRNVPIEIFEYYNKPWNLLVLYSLLQYENKLTVSQFTAMQHSEYEEPIESKEELLLQIGPRRFMVRPLYSDPTASGASNNLQKYHRYLPPKQAVIASVISPIVFGNVPIIMFKKSSDNSLRLAATGSYVNCDTNSVIAKRAVLTGHPFKVHKKLVTIRYMFFNPEDVIWFKPIQLFTKQGRTGYIKEPLGTHGYFKATFNGKITVQDTVAMSLYKRMYPLPCELFKVTDIDS

SEQ ID NO: 9502 - protein, 285 aa, Vitis vinifera
MTVQFLGPHLYQSVIFHISLSRNRTYIDRSSSYSLSRGRTYIDRPSPCHDSSVSGTAPISIGHFPCQFESGPHLYRSVIRHVGLSRGRTYIDRPSSYQFSLSWDCTYIDRSLSCQLESGAAPISIGHLIFMLVQFLGPHLYRSVIIVRIYPKAKQTFEKKEDQKRNVEKMGSLGEILTHPGDIYLLLKLKMADCHVKKQLPPEPRWVFCYTLLHKASRDFSLVVQQLNTRFYNAIYIYIYFIWSFKHPTLLRMIRVFPTKVKAPILIAFYRHICDCGWHFACGVN

SEQ ID NO: 9503 - protein, 324 aa, Wolbachia pipientis
AAGEPDFDTPDHIKKAAIQSINEGKTKYTAVDGTHELKEAIINKLKRDNNLEYKLNQICVGAGAKQVLFNLFMATIDPGDEAIIPAPYWVSYIDMVSLFGGLPVVVECKQNFKLTPNLLESKITKKTKWLILNSPNNPAGIVYTYDELKNIAQILLKYPHVNIVTDDIYEHIIYDERFFTIAQVEPKLYDRTFVVNGVSKAYAMTGWRIGYIAGRSGVVNAISTLQSQSTSNPNSIAQAAAVEALNGDHSFLKERKKTFKDRRDFVIEKLNSAPGLSSSIPQGAFYFFVSCEGLLGKSTKSGKVISNDLDFTEYLLEDYLVAVI

SEQ ID NO: 9504 - protein, 175 aa, Triticum aestivum
MAPTVMASSATSVAPFQGLKSTAGLPVSRRSNGASLGSVSNGGRIRCMQVWPIEGIKKFETLSYLPPLSTEALLKQVDYLIRSKWVPCLEFSKVGFIFREHNASPGYYDGRYWTMWKLPMFGCTDATQVINEVEEVKKEYPDAYVRIIGFDNMRQVQCVSFIAFKPPGCDESGKA

SEQ ID NO: 9505 - protein, 210 aa, Brassica napus
MKKGGFSNNLKLSIPPAGEQSITKFLTQSGTFKDGDLRVNKDGVRIVSQSEPEALSPIKPADDKLGLSDLDMVKFIGKGSSGVVQLVQHKWTGQFFALKVIQLNVDEAIRKSIAQELKINQSSQCPYLVTSYQSFYDNGAISLILEYMDGGSLEDFLKSVKTIPESYLSAIFKQVLQGLIYLHHDKHIIHRDLKPSNLLVNHRGEVKITD

SEQ ID NO: 9506 - protein, 364 aa, Oryza sativa Japonica Group
MPDWRVGEFEGKLKDGFARSNNSEHENGAGTVSISSKKSKHRVDSEKKPHVDISGVIDSDSQKCNSEQIHSANGIVSRDVNHDHIENCKVESNDFPLNTISETRYPTDNWNSSQFALSNDGSPVLNNQSTPQTGHGYGDNDLTYIDWPAIDNFEDVDNLFRRCDSTYGQQQLPNTDELSWIPSSDAMYSSDVAMQPGFESSYSDYGILDDLSAFNCTEDKSLTTADPSSAVCDEQFDDSYLFNEQKPEDVYGEQAYQRDAMELLSSDQICTGQENLDMIGNRYSSENAMEQPEDQKFSIASGSQLSSSQNLLNQKNHLDSTSPSNITSESYPERNCQIIPSGASFAERNLKEESGQFGIRTTYQ

SEQ ID NO: 9507 - protein, 505 aa, Oryza sativa Japonica Group
MPDWRVGEFEGKLKDGFARSNNSEHENGAGTVSISSKKSKHRVDSEKKPHVDISGVIDSDSQKCNSEQIHSANGIVSRDVNHDHIENCKVESNDFPLNTISETRYPTDNWNSSQFALSNDGSPVLNNQSTPQTGHGYGDNDLTYIDWPAIDNFEDVDNLFRRCDSTYGQQQLPNTDELSWIPSSDAMYSSDVAMQPGFESSYSDYGILDDLSAFNCTEDKSLTTADPSSAVCDEQFDDSYLFNEQKPEDVYGEQAYQRDAMELLSSDQICTGQENLDMIGNRYSSENAMEQPEDQKFSIASGSQLSSSQNLLNQKNHLDSTSPSNITSESYPERNCQIIPSGASFAERNLKVQKKVASSASGQLISDNVTGHPGHQTLTRRASYPCENHEIGKRSLGKRGLGHSDVAMGTSMVVDGSFVSSISSDNSVEENSFRQLQDAVSQLDVKTKMCIRDGLYRLARSAQNRQVFPNTMNNNGDSHNVKDMQNAETSGKYVDFSENMLFVPL

SEQ ID NO: 9508 - protein, 259 aa, marine gamma proteobacterium HTCC2143
MSTTFSGQVALVTGGAAGIGRTTAAAFAREGLNVVVADMDKDGGEETVAAIKAAGGNAIFVPCDVTKESDVQWLIETTCSTYGSVDYAFNNAGIDIEKGELSKGTEDEFDSIMAVNVKGVWLCMKHQITQMITQGGGTIVNTSSIGGLGAAPNMSIYCASKHAVIGLTKSAAVENARNGIRINAVCPGVIDTNMFNRSRMFDRSEVSASETRARVNAIHPMDRIGTAEEISDAVLYLCSDGASFITGHTLSVDGGLNAK

SEQ ID NO: 9509 - protein, 571 aa, Oryza sativa Japonica Group
MPDWRVGEFEGKLKDGFARSNNSEHENGAGTVSISSKKSKHRVDSEKKPHVDISGVIDSDSQKCNSEQIHSANGIVSRDVNHDHIENCKVESNDFPLNTISETRYPTDNWNSSQFALSNDGSPVLNNQSTPQTGHGYGDNDLTYIDWPAIDNFEDVDNLFRCDSTYGQQQLPNTDELSWIPSSDAMYSSDVAMQPGFESSYSDYGILDDLSAFNCTEDKSLTTADPSSAVCDEQFDDSYLFNEQKPEDVYGEQAYQRDAMELLSSDQICTGQENLDMIGNRYSSENAMEQPEDQKFSIASGSQLSSSQNLLNQKNHLDSTSPSNITSESYPERNCQIIPSGASFAERNLKVQKKVASSASGQLISDNVTGHPGHQTLTRRASYPCENHEIGKRSLGKRGLGHSDVAMGTSMVVDGSFVSSISSDNSVEENSFRQLQDAVSQLDVKTKMCIRDGLYRLARSAQNRQVFPNTMNNNGDSHNVKDMQNAETSGKFVDPGSIETQTNPIDRSIALLLFHQPSEHVTGAVDEAASLKSHNDNHQAAAKNQRVMHASSVHSPRGQGDPMDAKSCRNN

SEQ ID NO: 9510 - protein, 410 aa, Picea sitchensis
MGSTDFSFKLADHPKIPKGKQLAVIILDGWGEEKPDQYNCIYVAETPTMDSLKKGAPEKWTLIKAHGPAVGLPTEDDMGNSEVGHNALGAGRIFAQGAKLVDYALASGKIYEGAGFKYIKESFENGTLHLIGLLSDGGVHSRLDQLQLLLKGAAQNGAKRIRVHILTDGRDCLDGSSIGYVETLENDLVELQKQGVDAQIASGGGRMYVTMDRYENDWGVVKRGWDAQVLGKAPHKFRSALEAVKKLREDPKASDQYLPPFVIVDENEKAVGPILDGDAVVTINFRADRMTMVAKAFEYENFSAFDRVRYPKIRYAGMLQYDGELKLPSHYLVSPPDIDRTSGEYLVHNGIRTFACSETVKFGHVTFFWNGNRSGYFNEELETYVEIPSDSGITFNVKPKNKRCHIEWPL

SEQ ID NO: 9511 - protein, 86 aa, Glycine max
  misc_feature (54)..(55): Xaa can be any naturally occurring amino acid
  misc_feature (75)..(75): Xaa can be any naturally occurring amino acid
GCEKTTDGTWKSKLKAQFPSLNEYSPILGDFSTATGIATFTMILVSQFICDNYXXAVVAIITPTVLLLTRAGFFXFILHGGPLAPG

SEQ ID NO: 9512 - protein, 277 aa, Streptomyces coelicolor A3(2)
MSSKVPPIILNNGVEMPQLGFGVWQVPDDDAQTAVALALEAGYRSIDTAAIYGNEEGTGRAIAASGLAREDLFVTTKLWNSDQGYDSTLRAFDTSMAKLGLEYLDLYLIHWPMPAKERYVDTYKAFEKLLADGRVRAIGVSNFLPEHLERLTAETSVIPAVNQIELHPHLQQHAAREVHAEQGIATEAWSPLGSGKGILDIPAIVAIAQKHGRTPAQVVLRWHLQLGNVVIPKSVTPSRIKENIDVFGFSLDTEDLAAISALNEDRRLGSDPADVNS

SEQ ID NO: 9513 - protein, 548 aa, Oryza sativa Japonica Group
MPDWRVGEFEGKLKDGFARSNNSEHENGAGTVSISSKKSKHRVDSEKKPHVDISGVIDSDSQKCNSEQIHSANGIVSRDVNHDHIENCKVESNDFPLNTISETRYPTDNWNSSQFALSNDGSPVLNNQSTPQTGHGYGDNDLTYIDWPAIDNFEDVDNLFRRCDSTYGQQQLPNTDELSWIPSSDAMYSSDVAMQPGFESSYSDYGILDDLSAFNCTEDKSLTTADPSSAVCDEQFDDSYLFNEQKPEDVYGEQIGNRYSSENAMEQPEDQKFSIASGSQLSSSQNLLNQKNHLDSTSPSNITSESYPERNCQIIPSGASFAERNLKVQKKVASSASGQLISDNVTGHPGHQTLTRRASYPCENHEIGKRSLGKRGLGHSDVAMGTSMVVDGSFVSSISSDNSVEENSFRQLQDAVSQLDVKTKMCIRDGLYRLARSAQNRQVFPNTMNNNGDSHNVKDMQNAETSGKFVDPGSIETQTNPIDRSIALLLFHQPSEHVTGAVDEAASLKSHNDNHQAAAKNQRVMHASSVHSPRGQGDPMDAKSCRNN

SEQ ID NO: 9514 - protein, 264 aa, Podospora anserina
MADRGTGARGGGFAARGDRGGDRGRGRGRGRGRRGGNKNDEKEWQPVTKLGRLVKAGKIKSMEEIYLHSLPIKEYQIVDYFLPKLKDEVMKIKPVQKQTRAGQRTRFKAIVIIGDSEGHVGLGIKTSKEVATAIRAAIIIAKLSVVPVRRGYWGANLGAPHSLPTKESGKCGSVTVRLIPAPRGTAIVASPAVKRLLQLAGIEDAYSSSSGSTKTLENTLKATFAAVSNTYGFLTPNLWKETKLIRSPLEEFADTLRDGKRYTN

SEQ ID NO: 9515 - protein, 568 aa, Picea sitchensis
MAARVAASPLASLHSNLGATTRLSGFNSTAISSRTDLSPKLSFSASFPSVDGFCGVVKVCNSGRKTAVIRSESIGVAVVEKSENVQKKSDEPEFTCVMKFGGSSVASAERMKEVADLILSFDQERPLVVLSAMGKSTNNLLQAGEKAVTCGIAMVPDIKELEFIKELHLRTVKELGIDESIISELLQECEQLLTGIALMKELTPRTKDYLVSFGERLSTRIFAGYLNNIGVKARQYDAFDIGFITTDEFTSADILEATYPAVEKRLRSDWQKDPAIPIVTGFLGKGWKTSAVTTLGRGGSDLTATAIGKALGLREIQVWKDVDGVLTCDPNIYPKAEPVPYLTFDEAAELAYFGAQVLHPQSMRPAREGDIPVRVKNSYNPQAPGTLITRTRDMSKAVLTSIVLKRNVTMLDIVSTRMLGQFGFLARVFSIFEELGISVDVVATSEVSISLTLDPSKMWERELIKQELDRMVEELEKVAVVKLLQNRSIISLIGNIQYSSLILEKVFCVFRTLGVNVQMISQGASKVNISLIVNESEAESCVKALHSTFFDEGDLLNIKSDTNGASCC

SEQ ID NO: 9516 - protein, 269 aa, Brassica napus
RPTRPHFPSTILFLVIFLLLAAFKRPKRLQHRPIPSPPTWPIIGNLHQLGELQHQSLWNLSKKYGPGMLLKLGKVPTVILSSSETARQALRDNDLNCCSRPPLAGARELSYNNKDMSFSPYNDYWKELRKLCARELFSAKQIHSFQPIKDEEIKRVIAQISESASLKNPVNLTKTFLALTVSVVCKAAFGVSFEGTVLSNDRFNKLVRDAFETLGSFSATDFIPHVGWIIDQFTGLQKMREKSVRDLDAFYEQLFDLHKEGDRKGVKIL

SEQ ID NO: 9517 - protein, 498 aa, Nitrosomonas europaea ATCC 19718
MSNDVTFAQLGLSSEILHAVNDEGYVNPTPIQAQVIPSILAGKDVMASAQTGTGKTAGFTLPLLYRLQAYANTSVSPARHPVRALIMAPTRELAMQIDESVRKYGKYLALRTAVVFGGINIEPQIAALQAGVEILVATPGRLLDLVEQKAVNFSKTEILVLDEADRMLDMGFLPDIKRVMALLSPQRQSLMFSATFSGEIRKLADSLLKQPVRIEAAVQNTVNESISHVIHWVKPDSKFALLLHLIRQQNLKQALIFVKTKHGASHLAQMLSRHEISAVAIHGDRNQQQRTQALAEFKHGDVQILVATDVAARGIDIEKLSHVINYELPGNPEDYVHRIGRTGRAGSKGKAISLVSEHEKELLANIEKLLNAKLETEQIAGFDAEQFARSLPDRKNRMSAGNSRYGNKPMENGSEKSRSEKHRKLPSSQKYSGSRRGGTQKYSDPIFTQPYVPQANSTQSTTPKQPEIQSLFLTYRQEKKTIPALFTALSKSKAGQEN

SEQ ID NO: 9518 - protein, 531 aa, Thiomicrospira crunogena XCL-2
MKPFPKTEMAKNGMVVAPHHSAADAGLDILKSGGNAIEAAIATAASLSVHYPHMTGIGGDAFWLIYDPEEGVSFIDASGYSGGEVKPEVYSDVSDIPFRGKLAANTVAGAVSAWSLAYEKSQVNWQGSMSASQLMSEAVLAAENGTIVTASLAETLKDKASELQLDPFFADVYYPQGNIPKAGDSLIQTALGNTLKTIGEKGFDDFYRGQVSEDIAFDFSHRQGLITHDDLKNHHAKWQPYLELETSHATLFNAPAPTQGVASLMILGLFDRWVEKLPDIDSADYVHLLVEATKIAFSHRNRMDTSATPEELQAWLTPDYLDQLSEQIDLNKARPWGEQTSPGDTTWFGAIDSKGRVVSAIQSIYHEFGSGFMLPKTGVVWQNRGCSFSLDPTNVRALAPHKKPFHTLNPAIALFKDGRVMAYGTMGGDGQPQTQAAVFSRYAYYEEDIQTAINKPRWLLGRTWGNSSETLKLESRFPDSFSLILREKGHDFEWLSSLDSSVGHAGALIRHTSSTIEGAYDPRSDGKSSGF

SEQ ID NO: 9519 - protein, 488 aa, Pseudomonas aeruginosa PAO1
MSTPATPTSCDILVFGGTGDLALHKLLPALYRLHREDRLPADTRIFALARSALDNAAFLALAERNVRAVVARSEFAAEQWKGFAARLDYLAMDASQSADFGRLARHLKSSEGRVLVHYLATSPSLFAPIAQNLSIAGLAGPQARIVLEKPLGHSLDSARAINQSIGRVFDESRVFRIDHYLGKETVQNLMALRFANALFEPVWRAAHIDHVQISVNETLGVENRGGYYDHAGAMRDMVQNHLLQLLCLVAMEAPVRFDAEAVRNEKLKVLQALKPISGLDVQDKTVRGQYAAGRIGGQEVPAYYFEKNVDNDSDTETFVALQAEVENWRWAGVPFYLRTGKRMARKCSEIVIQFKPVPHSLIDGGGGPANRLWIRLQPEERISVQLMAKTPGKGMQLEPVELDLNLAEALSRNKRRWDAYERLLLDVIEGDSTLFMRRDEVEAAWGWVDPILAGWREHYQSPRPYPAGSNGPEQAQLLLELQGRRWLE

SEQ ID NO: 9520 - protein, 471 aa, Tropheryma whipplei TW08/27
MRRAKIVVTLGPAVSDLDSVRDLISAGADVFRMNLSHGSLDFHREVFLNVRTAAAELDRHIAIFADLQGPKIRLGRFASGPYTLQEGDIFTITTEQVLGTKELSSTTLPTLPDNVSEGDLLLIDDGKVALRAIGNDGVRITTRVEVPGKVSNNKGINLPGVGVKVPALSEKDIDSLRWALSLPVDMIALSFVRCASDVDAVHKVMDEEGIRLPVIAKIEKPQAVSAIEEIALRFDAIMVARGDLGVELPLEDVPVAQKEIVKVARRFARPVIIATQMLESMISSSRPTRAEASDVANAVLDGADALMLSGETSVGEWPVEAVRVMSRVIEKTEEKAISQIVGFGTTPKTQGGALAWAAAKVAEFIDARYLCVFSESGDSIRRVSRLRHDIPIIGFSPVESVVRQVSLSWGVRCFLIERLHQTDQMMRKAEHVLLTNNLAEIGEKIVIISGSPVGVPGSTNHMRIHELGSTS

SEQ ID NO: 9521 - protein, 533 aa, Magnaporthe grisea 70-15
MFKTLLPSLRDGDSKKDTMLKTRTAHLSAHSPTSSSSHDDPENTADEEDSEDYCKGGYHPVQIGEKFKDGKYTIVRKLGWGHFSTVWLSRDNSSGKHVALKVVRSAAHYTETAIDEIKLLNKIVQAKPDHPGRKHVVSLLDSFDHKGPNGTHVCMVFEVLGENLLGLIKKWNHRGIPMALVKQITKQVLLGLDYLHRECGIIHTDLKPENVLIEIGDVEQIVKRVVKSEPSDKENNRNGRRRRRTLITGSQPLPSPLNATFNHANLFPSPSSQHSSLGQMLHDGAKSKSSTSPRRDGDDKQKQREKSADLLSREVSGISLDKTGEKRKADDNHGFDVISVKIADLGNACWVSHHFTNDIQTRQYRSPEVILGSKWGASTDVWSMAAMVFELITGDYLFDPQSGTKYGKDDDHIAQIIELLGPFPKSLCLSGKWSQEIFNRKGELRNIHRLRHWALPDVLKEKYHFKEEEAKRIAEFLLPMLELVPEKRANAGGMAAHLWLDDTPGMKGVKIPGLDAGSRGEGIDGWANEVRKR

SEQ ID NO: 9522 - protein, 418 aa, Debaryomyces hansenii CBS767
MAKRRQKTRTHKKVSEEELAKIPRSMVIRLGSSLRNHSLSQLVKDFRNIMQPHTAINLRERKSNKLKDFIVMAGPLGVSDLFIFNQSEETGSISLRIGKMPRGPTLQFRVNNYSLIKDVSRILKHPKSVGKDSPEFLNPPLLVLNGFLNKLNEVENHEKLLITVFQNMFPPIQPQLTKVSSIKRVLMVNKNAETGEIDLRHYAIDTKLVDGSRNVKKLLNSHHNLKKSLPNLSANSDVSDLLLDPYSVGGITSDSEVEDDAIVEIKNSEDANVLKKKTASEEKETANPQTRKRAIKLTELGPRINMTLMKIEENLTGSSKTLYHANINKSEAEQNELNRKHELRQKQKAERRAKQQANVDAKEETKKAKKERRKARQNGEEPEQGEDEPMTESDSDSDAPEIKAEDYENDSDLYSDVE

SEQ ID NO: 9523 - protein, 344 aa, Frankia sp. EAN1pec
MGWAGANIPAPPRGPAATARGHSALAKTTVLIEALPWLSRFHGATMVIKYGGNAMTRPELREAFAADIVFLRYAGIRVVVVHGGGPQITAHLERLGVRSEFVGGLRVTTPETMEVVRMVLVGQVNRDVVGMINNHGPFAVGLSGEDANLFTARRRPAMVNGSPVDVGLVGDVVDVQPATVNALLDSGKVPVVASVARGLDGGVYNVNADTAAAVLALSLGAAKLVVLTDVEGLYADWPASDEVISELTVGELERLLPTLSSGMIPKMEACLRAVSGGVPQAHVLDGRVAHALLLEIFTDEGIGTLIRADPPAAAGTVAVEGAVTATTSSSAGDPATADIIGGGS

SEQ ID NO: 9524 - protein, 317 aa, Frankia sp. EAN1pec
MTARHFLLDTDLTSSEQAALLDLADQLKATRRDRKPARRPLEGRSVALIFEKPSTRTRLSFDVAVAELGGHPIVIDSGSSQLGRGETIEDTAAVLSRYVDAIVIRTFAQDRVDRMAAAATVPVINALSDHTHPCQALADLQTIREIRGRLAGVTLAYLGDGNNVAHSLLLAGALAGLRVHVASPPGYEPIEQVVRHANEIGAVTGGEALVTHDALEAAAGADVLYTDVWASMGQDTESDSRALVFQPYRLDEKVVEAASPDAIVMHCLPAHREMEISAAVLDGPRSVVFDQAENRLHAQKALLSFLLDETTAGVGSR

SEQ ID NO: 9525 - protein, 535 aa, Oryza sativa Indica Group
MEEGRRGDREAKSAAGWTALSTTKTTLEEKRRLQANGSVGGDAGTSGFRRIVRLFFACMVAGGIQYGWALQLSLLSPYSQTLGISHSYVSLTWICGPIAGFVVQPIVGYYSDRCTMKMGRRRPFILVGCLIICISVMIIGFSADIGRHLGDTKEHCSTYTGPRWSAAMVYIVGFWFLDFANNTVQGPARAMMADLSAGHHGPNVGQSIFSLWMAIGSVLGYLSGANGKWHEWFPWLKTAACCDACANLKGAFFTAVLLIVVSMTVTMYLADEMPLDKQDVDTSGGGGCAVFVDLFKSLRNLPPAMFKVLAVTAVTWLSWFPFIQYNTDWMGREIYHGEPQGTAAKADVYDAGVREGAMGLLFCSVALGVTSFVIPKLCRRLTSKVVWSISNFLVFALMAVMVAVGMVSMRGYRPSLAAGLTGPDPTLKAVALVVFALIGIPQAVLFSVPWAVASEVTAEEGGGQGLAIGVLNIAIVVPQLVIALTAGPIDGAFNKGNTPAFGIGGAFAFICGVLALIWLPKTRGVSNAAVVAGGH

SEQ ID NO: 9526 - protein, 434 aa, Chlamydomonas reinhardtii
DVRDFYTFDKQLGKGNFGIVHLVFDKKTNEKYACKSISKRKLVTPEDVEDVRREIQIMNHLAGAGLMGPHGDTNFIHIAIEVCSGGGLRCRALGAGRGAEQGEGLASVMRTIVSVVHHCHTMNVVHRDLKPENFLLTERGPGGVIKATDFGLSRFFKEGNQLDEIVGSPFYVAPEVLKRSYGKEADIWSCGVILYILLCGWPPFHGDSTQVGGLGGFGVWAWVWHAADAKDCVRRMLARDPRKRLTAEQVLNHPWMRENGAAPDEAFVPEILIRMRQFTKMNMLKREALKVIARSLPHMELAGMREMFQEMDEDGSATITVDELREGLRRKGAEIALGEVQRILNDIDLDGNSKIDYEEFLAATMHLNKLSREENMIAAFEYFDKDKSGFITRDELMNAMKDIDAEVDVDAILAQVDQNGDGRIDYEEFCAMMR

SEQ ID NO: 9527 - protein, 233 aa, Oryza sativa Japonica Group
MDAGDAWGRSSSSSSSAAAAARRLQARYDLYMGFDDADAAGVEEVEARGGGEAYNCPFCGEDFDFVAFCCHVDDEHAVEAKSGVCPICATRVGVDLIGHLTMQHGSYFKMQRRRRVRKISSGSHSLLSLLRKDLRDGSLQSFLGGSSYVSNPPAAAPDPFLSSLICSLPVAEPSKDLHSDSSDNNFLLNKFPDDKTAERAEPSLSEKDQKERAQRSKFVRGLVLSTIFEDDNL

SEQ ID NO: 9528 - protein, 360 aa, Leuconostoc mesenteroides subsp. mesenteroides ATCC 8293
MSDQTLQKELENIEVTDTLQACPIDFSQSKVANPRAHQKQKEYDNGKDKSNFNEREKFSAYQGPQFKARFTDGTLPVTPNRYRLIWSRHCPWANRIAIGIDLLGLDQVISNGIVDPLRPAGVVGDWFFTLDDGDVDPVLGIHSLGEAYRLADPSYDKRTTVPALVDTQTGKVVNNDYNNLIKEFALAWQEYVPETAPDLYPKNLRSDIDALSDIILMDINYAVNEAGHGRSQADYKKWYDKVFNRLDWLEERLANQRYLFGDQITLVDINLYVTLSRFDLVFYQKYFVNKKRLVDYPNLWNYAKDLYAIPAFGDNTNFESMRQRFYEVDHTPQEDLPRIIPLGPDDSIWEEANDRAEKFG

SEQ ID NO: 9529 - protein, 532 aa, Schizosaccharomyces pombe 972h-
MQTPSSASAESEKDSGNTYVGPWLLGRTLGQGNLAKVKLGKHFQTNEKVALKMVYNDELEDKDTWKRLQREVTILRQLHHPNIITLYQVFRVPKYTVLALEYMDTDLHSMVVKHNRLDECTTRKIFRQIVHAIDYCHLHRVAHRDLKLENILLNKDLVVKLTDFGLSNFMLDGSFLSTSCGTPHYAAPEVIQGRYYDGCDVDVWGCGILLYLMLVGEFPFEDVTISNVLSRVCKGIYTIPSFVSSSASDLIRQMLMVLPTSRIKVAEIMQHPWFIADLPTHSRLPSRTSSFSSKHRSVTFSPPDLAILFDPSITSPSSSVGQIPQPTDHSALSPSKPMSISGTESPNPDPASLCYSSYEDLYSATSWHSDMAESSGFLDPTDIPPIPSNVETLRSSLPQRHASFMNKVYNHPLSRPPAPNRLRSLRWHYGIQTAKNPIEVLRKLCEALLELGARFRPCDEESFLKENKYKVFSCITCHNSPVYLVIELFSIGPSASVIDIRFSSSDDSIKYTSSYSPMPFLEVVKQLILKIA

SEQ ID NO: 9530 - protein, 284 aa, Triticum aestivum
  misc_feature (233)..(233): Xaa can be any naturally occurring amino acid
MVKLAFGSLGDSFSATSVRSYVAEFIATLLFVFAGVGSAISYGQLTQGGALDPAGLVAIAIAHAFALFVGVAMAANISGGHLNPAVTFGFAVGGHVTILTGLFYWVAQLLGATVACLLLQFLHPAVGDHDARLTGIFRWVAQLDGSTAACFLLKFVTHGKAIPTHGVAAGMNEFEGVVMEIVITFALVYTVYATAADPKKGSLGTIAPIAIGFIVGANILAAGPFSGGSMNPXARSFGPAVAAGNFAGNWVYWVGPLIGGGLAGFVYGDVFIASYQPVADQDYA

SEQ ID NO: 9531 - protein, 305 aa, Gibberella zeae PH-1
MDALNATSFASFNQTKDYFVVLEEVSKYNVQLNMVEKLWAAWYLWMQNDTLATGIMSFVLHELVYFGRCIPFMLMDFIPYFQQFRIQKQKIPTIKEQWDCAAIVLISHFTAELPQIWFFHPIATYFGMDYGVPFPPVWKMALQIAICFVMEDAWHYWFHRALHYGPLYKAIHKMHHTYSAPFGLAAEYASPIETALLGIGVVGCPIVLLAVTGELHLFTMYTWIVLRLFQAIDSHSGYDFPWSLRHILPVWAGAHHHDLHHEKFIGNYASSFTWWDYCLDTEAGADAHKRRREKKLAAIKAQKQQ

SEQ ID NO: 9532 - protein, 104 aa, Leuconostoc mesenteroides subsp. mesenteroides ATCC 8293
MVVKAITDEQYQEEVETGVSIVDFWATWCGPCRMQSPVLETVSEDRNDIHFFKVDVDISQETAASLGIRAIPTLVVHKDGKIVERLTGFHNSEQLVNILNKYVD

SEQ ID NO: 9533 - protein, 535 aa, Hordeum vulgare
MASTSTASATAMAGAFAAAGVNKPRGSAACPRVPAGGRQRLSCVVRCDAGPGVPAQMAAMAASVAALEQFKISADRYMKEKSSIAVIGLSIHTAPVEMREKLAVAEELWPRAVAELTNLNHIEKAAVLSPCNRMEIYVVALSWNRGIREIVDWMSMKSGIPAVELREHLFMFRDSDATRHLFEVSSGLDSLVLGEGQILAQVKQVVRSGQNSGGLGKNIDRMFKDAITAGKRVRSETNISCGAVSVSSAAVELALMKLPKSECLSARMLLIGAGKMGRLVAKHLAAKGCKKVVIVNRSVERVDAIREEMQGIEIVYRSLTEMYEAAADADVVFTSTSSESPLFTKEHAEALPPVSGALGGVRLFVDISVPRNVSACVSDVGHARVYNVDDLKEVVEANKEDRLRKAMEAQTIISEELKRFEAWRDSMETVPTIKKLRSYADRVRASELDKCLQKIGEDALTKKMRRSIEQLSTGIVNRLLHGPLQHLRCDGTDNRTLDETLENMHALNRMFGLDTEKAVMEQKIKTKVEKQKTQN

SEQ ID NO: 9534 - protein, 154 aa, Xylella fastidiosa Temecula1
MSHYEGDLRPAGARFVIVCSRWNARITDALVAGACHSLVDNGVPDDAVDVVRVPGAWEIPIVANLLAQAGQHAAIIALGCVVRGDTRHYEHVADLCAEGMMSVQMQTGVPVLNGVLAVECIKDAEMRAGGSHGNKGAETALAALEMVSLLEKLP

SEQ ID NO: 9535 - protein, 331 aa, Xanthobacter autotrophicus Py2
MEQPDMRLMEPPRLVLNPTVTPLLPAPQLTGTLGGPEIWIKRDDLIPFGCGGNKIRGLELIVADALRAGADTLVTGAGTLSNHVRATAAAAAFAGLGMSAVYWGDPPQKAKGNHLLSVLWGARTRFTGSSDRNSVDAMLEVEAADIRAAGGRPYVIPRGGACALGVIGHVHAVGEVMAQCRQAGIRPDCVVMAVGSGGTLAGWLLGSRLLGASWRVEGITVSRPAAEARVRVKDLADQAADHLGLARSVAADDVVIHDGFIGAGYGIASPAGMSAIERAARSEGVVLDPVYTGKAMAGYGALLGAGRYGDATTVLFLHSGGLPSLFVDGNA

SEQ ID NO: 9536 - protein, 443 aa, Leuconostoc mesenteroides subsp. mesenteroides ATCC 8293
MAENKITLSRSLSTKDLVVYGIIFMIPVAPIAFYGSFLSPAHGMVALAYLIGMIAMLFTGFSYASMASEFPYSGSVYTYVQKGTNPVLGFLSGWGITLDYILIPVITYLISASFGQSLLPAVPFWVWILGIAIFNTVINLLGIKVVSKFSWLLFGLQGVVLIAFIVGTIVALANGTVSFNVSSFYNASHFDLSGVVQATGIVIVSYLGFDAISTLSEEANDPTKSIGKAIVLSIILIGSLFVIVTFFAGFVAPNYSELNPDTAFLTILGKVGGSWLVHLAEFTLVLSFGLAGGQEGQTAVSRILYSMGRDGILPKRLSYLHPRYNTPWVAIILVGIVSVALSLSLSLTTVSNLISFGALFGFLSLNIAVIWHFYIKRPDKNIESFVKYLVSPFIGFSVSLWIFLSLALEAKLTGLFWLIIGLVILVYKTSIFKKPVPQFDFSE

SEQ ID NO: 9537 - protein, 377 aa, Xylella fastidiosa Temecula1
MNSFAAVPVLIEEIRAGRMVVIVDDEDRENEGDLIMAAELVAPKDINFMVTHARGLVCLSLTRERCAQIGLSPMVQRNTTRFQTNFTVSIEAAEGLTTGISAYDRAHTIRTAVRPNAKPSDLHQPGHIFPLIAQPGGVLTRAGHTEAASDLPMLAGLEPAGVLVEIMNADGTMARRPQLEVFAQQHGLKIGSIADLIAYRLANEHTVERVDERVIETEYGSFLLVTYRDRIAHDLHFALVRGTLDASIPTLVRVQVENPLADMLHWRREDFGVAASDALRMIAAAERGVMVMLAAPRDSDVLLARLRSEPEVVSNVKDVGQWRRNGAGGQILADLGLAKLRVLGTPRRQIALAGFGLEVLEYVECRGGVPVPSQGVD

SEQ ID NO: 9538 - protein, 403 aa, Arabidopsis thaliana
MASLGLSFPPAAKTPTYLASSSSTFFSNSSLSVRTSQFRSRNSVFACVKCDMPESLNVGNGNPSIPIINERTLPKFLESARMEKSVNRTNTRLKLFSGTANPALAQEIAWYMGLDLGKVNIKRFADGEIYVQLQESVRGCDVYLVQPTCTPTNENLMELLIMVDACRRASAKKVTAVTPYFGYARADRKTQGRESIAAKLVANLITEAGADRVLACDLHSGQSMGYFDIPVDHVYCQPVILDYLASKSIPSEDLVVVSPDVGGVARARAFAKKLSDAPLAIVDKRRSGHNVAEVMNLIGDVRGKVAIMVDDMIDTAGTIVKGAALLHQEGAREVYACCTHAVFSPPAIERLSGGLLQEVIVTNTLPVAEKNYFPQLTILSVANLLGETIWRVHDDSSVSSIFL

SEQ ID NO: 9539 - protein, 364 aa, Borrelia garinii PBi
MKKDYYEILGLSKGASKDEIKKAYRKIAIKYHPDRNQGNEEAASIFKEATQAYEVLIDDNKKAKYDRFGHSAFEGGGFEGFSGGFSGFSDIFEDFGDIFDSFFTGNKGQERNRKHARGEDLGYNIEISLENAYFGYKNNINITRQILCHSCLGKKSEKGTSPSICNMCNGSGRVVQGGGFFRVTTTCSKCYGEGKTISNPCKSCKGKGRITNQETIQLNIPSGIDNNQQIKMKGKGNVNPDNQEYGDLYVKILIRSHKIFKRNGKDLYAMLPISFTQAALGKEVRIKTIASKEIKIQIPKGIENEEQIIVKGAGMPILQTEKFGNLILITKIKTPKNLNSNAIKLFENLSKELRDGDEIDLLKV

SEQ ID NO: 9540 - protein, 298 aa, marine gamma proteobacterium HTCC2143
MINFYLQYEYWFAANQLFFAMLGMGATLAPKDFHEVIAEPKAFSVGIGTQLLAVPLVAFFFIYFGSFAASLTIGIALIAAIPGGTISNIFAHLAKGNTPLSISITAITTIGCLLTTPFILDVLVAEYLPQNFSMPVGKIALEIGVYLLMPLVLGMGIFRYLPKHAEPFARWCVRLSLLIIVFIVLGSLGAGRLNLALFGSENILILVCFFFVLAAVGHLIPRLFSLNQADRVAIEMEVVVRNVNLGLLVNASLFPATSTELAATGNIVLLALLLFGSMQLILGVILITINRRKANRSA

SEQ ID NO: 9541 - protein, 221 aa, Picea sitchensis
MGEQSLIYSFVSRGTVILAEYTEFTGNFTTVAYQCLQKLPATSNKFTFDCQRHTFNYLVEDGFTYCVVADESVGRQVPIAFLERIKDEFKKRYSDGRAEVAIANGLNQEFGPKLKQHMDYCAQHPEQINKFAKTKAQVAEVKGVMMDNIEKILDRGEKIELMVDKTEQLQFQAQDFQKQGTQIRRKMWFRNMKVKLICLSFLLFVILMIWISLCRGFKCHI

SEQ ID NO: 9542 - protein, 506 aa, Pseudomonas fluorescens Pf-5
MRYAHPGTEGAIVSFKSKYGNYIGGEFVAPVKGQYFTNTSPVNGQPIAEFPRSTAEDIDKALDAAHAAADAWGATSVQARSLILLKIADRIEQNLELLAITETWDNGKAVRETLNADIPLAADHFRYFAGCLRAQEGSAAEIDGNTVAYHIHEPLGVVGQIIPWNFPILMAAWKLAPALAAGNCVVLKPAEQTPLGITVLMEVIGDLLPPGVLNVVQGFGREAGEALATSKRIAKIAFTGSTPVGSHIMKCAAENIIPSTVELGGKSPNIFFEDIMQAEPKFIEKAAEGLVLAFFNQGEVCTCPSRALVQESIYDEFMQVVMKKIEQIKRGDPLDTDTMVGAQASEQQFDKILSYLDIAKNEGAQLLTGGKVEKLEGDLSSGYYIQPTLLKGTNKMRVFQEEIFGPVVSVTTFKDEAEALAIANDTEFGLGAGVWTRDINRAYRMGRGIKAGRVWTNCYHLYPAHAAFGGYKKSGVGRETHKMMLDHYQQTKNLLVSYDINPLGFF

SEQ ID NO: 9543 - protein, 295 aa, Triticum aestivum
  misc_feature (2)..(3): Xaa can be any naturally occurring amino acid
  misc_feature (11)..(11): Xaa can be any naturally occurring amino acid
  misc_feature (227)..(227): Xaa can be any naturally occurring amino acid
  misc_feature (236)..(236): Xaa can be any naturally occurring amino acid
  misc_feature (271)..(272): Xaa can be any naturally occurring amino acid
  misc_feature (278)..(279): Xaa can be any naturally occurring amino acid
  misc_feature (292)..(292): Xaa can be any naturally occurring amino acid
RXXVVAIEDKXLYEGDWISLNGSTGEVILGKQPLSPPALSADLETFMSWVDEVRQLKVMANADTPGDALAARKNGAEGIGLCRTEHMFFASDERIKAVRQMIMAPTVELRQKALDRLLPYQRSDFEGIFRAMDGLPVTIRLLDPPLHEFLPEGHVEDIVRELCAESGAAEDDVLARMEKLSEVNPMLGFRGCRLGISYPELTEMQARAIFEAAISMTNQGIQVFPEXMVPLVGTPXELGHQVALIRQIANNVFTNMGKTIDYKAGTMIEIXXAALVAXXITNRLSSSLSDNXLRR

SEQ ID NO: 9544 - protein, 335 aa, Podospora anserina
MTPVMLTEQELDEIYTFAVQLGKDAGKMLLEAAQLRFTGTQTADLEVEEKDSSVDIVTKTDEDVEAFIKSSIEAKYPHHKFIGEETYSKGASRSYLVSETTPSWCVDPLDGTVNYTHLFPMFCVSIGFIVAGRPTIGVVYAPFLNQLFTSCRGRGAWLNETQRLPLIRNPIPPMPADAPSGCVFSCEWGKDRKDRPDGNLYRKVESFVNMAAEVGGRGGKGGMVHGIRSLGSATMDLAYTAMGAFDIWWEGGCWEWDVAAGVAILQEAGGLVTSANPPKDIETAEIQEVKLGSRLYLAIRPAGPSKTETGREGQERTVREVWRRVKALEYARPGA

SEQ ID NO: 9545 - protein, 1079 aa, Frankia sp. EAN1pec
MPNDESPRSQPPSRAGRAATGGGGARRTEGRRDAPGARRGPSSSGSSGRDAGGEARRSGRVTRGDAGRTGFVRRADGGRGPAPAGASAAGTGAGGRGAPAWQGTGRAGGPSRQGGPGQGAGRPKAAWRPAGTGQGRGGAGGSGGPGGERWGRPASSREGGPREASGGRPAGDRWSGGAGRPGAHGRPEGQGRSEGGRPARRWEGSGRSAPASDSRGRQWSGSPSREAGDRPRQSDRPPYDAARGTTSRHDGPRHDGSRHDGPRHDGPRHDGPRHGGGRDESGRGDARRDGGGWAGGGSRAGSSPDRGGQRSYGDGGGRPSGGRPTSGQTARGSSGRPYGAGRPVGGGRDGSAGPGNGGSGENRFERRSRAQGSGQWRPSSGDAATRGAAGPRSGIRRDGPGRSDGTAAGRGPGADRRPPSAGSRPWQSGATGDARTSNGSGYDRGHRSDRASGPDRGYRPDRGAGSDRGYRSDRGAGSDRGDSRRSGPPSGGSSARPYTRPTHREQPASGTDRVDRAERTDRPDAPGTGADRARPDQTRSYEARANQGRPDEGRAEQGGPDRGRPDVGRSGQGRADTGRPYQERPDRAARPDRSGGSRFDANRAGAGGSYAGRRGPDARSGSSGGPRAGRGGVSGGPSRSGPGTRPAGGAGGRSSAGSAGRPNRDDVTARRRPPAPALPDEAKAELLDRDIRRDLRSVPAPLAETIARHLVATALLVDTDPVQALAHARAAAARLPRMAAVREAVGVAAYHAGEFASALLELRAARRIDGSSHNLPLMADAERGLGRPERAIDYLSDPGVAALDAAGRAELLIVVSGARRDMGQPEAAAVLLRDEVTARTEPKPWTPRLWYAYAEALLAAGRTMEALRWFTATAGIDEDTTDAAERVYELTIDDETEIDNGDGGAEDNGPESNRLEDELLGDERLEDDGPAAETHDGATVDEPDPDGLIASGTGAAVDAVADDAALADADDAGDAADDAGDADAEAEAADHGDTGGASDTGAAVDVTVDGEPAAPVEQPAPAEPAAAVEPTEVGFSAAEDTSAVPAAEVTADTPPIPEIIFSDAPGGADQAGAHRTSED

SEQ ID NO: 9546 - protein, 479 aa, Pseudomonas aeruginosa PAO1
MLIPVVLSGGAGTRLWPVSREGQPKPFMRLPDGQTLLGKTYRRAAGLLAGHGEIVTVTNREHYFQSKDQFHAARLGRHRGHFILEPTGRNTAPAIAVAALALQAEHGDAAVLVVMPADHLIRNEEAFREAVGHAARLAVAGHLVTFGVVPDAAETGFGYIELGDRLDEQGAAKVRRFVEKPDEETARRYVESGGFLWNSGMFCFTASTLVDELAQHAPALLEQARACLAASAAVKMADGIQHELAGEAFAALPDISIDYALMERSARVAVVPAAFDWSDIGSWGAMSALLDADAEGNRGSGDTLFVDTRNTFVQSDGRLVATVGVDDLVVVDTSDALLIARADRVQEVRRVVQRLKDERHEAYRLHRTVNRPWGSYTVLEEGPRFKIKRIVVRPGERLSLQMHHHRSEHWIVVQGMARVTNGDGARLVNSNESTYIPAGHRHRLENPGVIDLVMIEVQSGEYLGEDDIVRFEDQYGRVV

SEQ ID NO: 9547 - protein, 315 aa, Neisseria meningitidis Z2491
MTDITPFANRLGKNIKHLMKWAKRNGIEAWRIYDRDIPQFPFAVDVYGDQIHLQEYDTGWLMRSEEYEAWLAEVLEAVAFVTGFAPEQIRLKRRERQKGLQQYEKTGKAGDDFVITENGRKFWVNLDKYLDTGLFLDHRNTRKKVGETAAGKRFLNLFSYTGSFTVYAATGGAASSETVDLSNTYLDWARRNFELNGIDTERHKIVRADVFQYLQTAYGEGRQFDLIVMDPPSFSNSKKMSDILDIQRDHKKLIDGAVKLLASDGILYFSNNLRSFVLDDLVSEQYAVKDISKQSVPEDFRNKKIHRCWEIRHKS

SEQ ID NO: 9548 - protein, 178 aa, Bradyrhizobium japonicum USDA 110
MRIDAISIGKNVPQDVNVIIEVPVGGEPIKYEMDKEAGTLVVDRFLYTPMRYPGNYGFIPHTLSDDGDPCDVLIINTRAIIPGAVMSVRPVGVLFMEDEAGGDEKILAVPSSKLTQRYDKVKSYSDLPDITLQQIQHFFEHYKDLEKGKWVKILRWGGPEDAHKLILEGIEREKKKKG

SEQ ID NO: 9549 - protein, 462 aa, Neisseria meningitidis Z2491
MSIKFADLNLDKNILSAVSSEGYESPTPIQAQAIPFALEGRDIMASAQTGSGKTAAFLLPTLQRLTKRSEKPGKGPRALVLTPTRELAAQVEKNALAYAKNMRWFRTVSIVGGASFGYQTRALSKPVDLIVATPGRLMDLMQSGKVDFARLEVLILDEADRMLDMGFIDDIETIVEATPEDRQTLLFSATWDGAVGKLARKLTKDPEIIEVERVDDQGKIEEQLLYCDDMRHKNRLLDHILRDADIDQCVIFTSTKAMTEVIADELYEKGFAANCLHGDMPQGWRNRTLMDLRKGRCKILVATDVAARGIDVPTITHVINYDLPKQAEDYVHRIGRTGRAGRTGIAITFAEVNEYVKVHKIEKYINRKLPELTIEGMEPTRKRKSAGGKPKGKGGWGDRKSGGWRGDHKPSKEGFGGKTRGEGFKKEGFKRDGFKKTGEGFKGKRKAGDSFAGKGERRYKDR

SEQ ID NO: 9550 - protein, 473 aa, Tropheryma whipplei str. Twist
MFMRRAKIVVTLGPAVSDLDSVRDLISAGADVFRMNLSHGSLDFHREVFLNVRTAAAELDRHIAIFADLQGPKIRLGRFASGPYTLQEGDIFTITTEQVLGTKELSSTTLPTLPDNVSEGDLLLIDDGKVALRAIGNDGVRITTRVEVPGKVSNNKGINLPGVGVKVPALSEKDIDSLRWALSLPVDMIALSFVRCASDVDAVHKVMDEEGIRLPVIAKIEKPQAVSAIEEIALRFDAIMVARGDLGVELPLEDVPVAQKEIVKVARRFARPVIIATQMLESMISSSRPTRAEASDVANAVLDGADALMLSGETSVGEWPVEAVRVMSRVIEKTEEKAISQIVGFGTTPKTQGGALAWAAAKVAEFIDARYLCVFSESGDSIRRVSRLRHDIPIIGFSPVGSVVRQVSLSWGVRCFLIERLHQTDQMMRKAEHVLLTNNLAEIGEKIVIISGSPVGVPGSTNHMRIHELGSTS

SEQ ID NO: 9551 - protein, 397 aa, Neisseria meningitidis Z2491
MQNYLTPNFAFAPMIPERASGSRVWDTEGREYIDFSGGIAVNALGHCHPALVDALNAQMHKLWHISNIYTTRPAQELAQKLVANSFADKVFFCNSGSEANEAALKLARKYARDRFGGGKSEIVACINSFHGRTLFTVSVGGQPKYSKDYAPLPQGITHVPFNDIAALEAAVGEQTCAVIIEPIQGESGILPATAEYLQTARRLCDRHNALLILDEVQTGMGHTGRLFAYEHYGVVPDILSSAKALGCGFPIGAMLATETIAAAFQPGTHGSTFGGNPMACAVGSRAFDIINAPETLHNVRSQGQKLQTALLDLGRKTGLFSQVRGMGLLLGCVLDAPYRGRASEITAAALKHGVMILVAGADVLRFAPSLLLNDEDTAEGLRRLEHVLTEFAAANRP

SEQ ID NO: 9552 - protein, 326 aa, Schizosaccharomyces pombe 972h-
MDKKEGDQVHHDKTLLQDLSLPENVASEKRLPIDDVQCVNSPMLSPALDIEPKPNVVGTAERLPKVRCVVRARIPTVKGTEIFLHLYKNDFDNKEHLAIVFGQQIRSDSLDAVQEGETEMDRMVRGAYVGTLYPGRKSSYIDVNSSKTTEEQKEEARKTNFVPLVRIHSECYTGETAWSARCDCGEQLDEAARLISEEGNGVIIYLRQEGRGIGLSEKLKAYNLQDLGNDTVQANLLLQHPADGRSYAVATAMLMDLGQRDIRLLTNNPEKVNSIEGPNKEVRVVERISMIPKSWRGEKGIESAEVVLYLKTKIEKMGHLLDLPDS

SEQ ID NO: 9553 - protein, 157 aa, Vibrio parahaemolyticus RIMD 2210633
MIQQGQALPSATVSELTADGMVNHDVTELFANKKVVLFAVPGAFTPTCSEAHLPGYVVLADQLKAKGVDLIACVAVNDAFVMNAWGEAQNASEILMLGDGDASFTKALGLEMDTGGFGGVRSQRYAMIIENGVVTTLNVEKPSEFEVSNAETILAAL

SEQ ID NO: 9554 - protein, 570 aa, Gibberella zeae PH-1
MSNSSLQKPIDVAEYLFKRLYEVGVRSIHGVPGDYNLVALDYLPQCNLRWVGSVNELNAAYAADGYARVTKMAALITTFGVGELSAINGVAGSYSEHIPVVHIVGCPSTISQRDQMLLHHTLGNGDFDVFANMSSQISCNVAKLNKPSEIAEQIDTALRTCWLRSRPVYIMVPTDMVQEKVEGARLDTPIDLSEPKNDPGNEDFVVDEILKAMYAAKRPVILVDSCAIRHRVVEEVHQLVDKLDLPVFVTPMGKGAVNEDHPNYGGVFAGDGSHPPRAQTIVEESDLLLTIGALKSDFNTTGFSYRTSQINSVDFHSTHCKVRYSTYPGVAMRGVLRKIIDKVDPKSMPAPSIPEVRNEVEKNNDDSETITQAWFWPRVGEYLIPNDIVVTETGTANFGIWDTRFPRNVTALSQVLWGSIGWSVGACQGAALAAKDAGKDGRTILFVGDGSFQLTAQELSTMIRHGLKPTIFVICNDGFTIERFIHGMDAVYNDINNWKYKDLVSVFGGEKTCKTFQIKTKNELNELLTNKEFNAAECLQFVELYMPREDAPRALVLTAEASARNNAKKH

SEQ ID NO: 9555 - protein, 327 aa, Haemophilus influenzae 86-028NP
MPQNLPHFYRGRFSVAPMLDWTTRHCRYFHRQFSKHALLYTEMVTAPAIIHAKYDHLDFDLQENPVALQLGGSDPEQLKYCAKLAEERGYHEINLNVGCPSDRVQNGMFGACLMAKADLVADCVEQMQSAVKIPVTVKTRIGIDELDSYEFLCDFIEKVQGKGCQEFIIHARKAWLSGLSPKENREIPPLDYARVYQLKRDFPHLTIAINGGIKTIEEMKQHLQYVDGVMVGREAYQNPSLLGQIDQALFDPNAAIVTAHEAVQSMLPYIEQQLNQGIHLNHIVRHMLGAFQNCKGARQWRRYLSENAFKQGAGVEVIETALSFVEH

SEQ ID NO: 9556 - protein, 175 aa, Pseudomonas fluorescens Pf-5
MSYSKIPAGKDLPNDIYVAIEIPANHAPIKYEIDKDSDCLFVDRFMATPMFYPANYGFIPNTLADDGDPLDVLVVTPYPVAPGSVIRARPVGILNMTDDGGGDAKVIAVPHDKLSQLYVDVKEYTDLPALLLEQIKHFFENYKDLEKGKWVKIDGWGNADAARAEILKSVAAYKG

SEQ ID NO: 9557 - protein, 434 aa, Oryza sativa Japonica Group
MADLDFFHTVQWRRAGIGRRWFATEASAASTAAELVDVPLAQTGEGIAECELLRWFVTEGDQVDEFQRLCEVQSDKATIEITSRFKGKVHQIHFGPGDIVKVALGFFFNLNRVDAANPSGEGSVPSGTLSTPAVRHLAKQYGLNISDIQGTGKDGRVLKEDVLSYAASKGLCKEPTSALEENIDQVELLEGRGSLPDANSYEDRRISLRGYQRSMVKSMTLAAKVPHFHYLEEINCDALVELKASFQNANKDHTIKHTFLPFLIKSLSKALSKYPLLNSCFVEETNEVIFKGSHNIGVAMATEHGLVVPNIKNVQSLSILEITKELSRLHEMASHNRLSTEDIAGGTITLSNIGAIGGKFGSPLLNLPEVAIIALGRIQKLPRFDDDENVYPSSIINVTVGADHRVVDGATVARFCNEWKSLVEKPERLLLHMR

SEQ ID NO: 9558 - protein, 365 aa, Rhodobacter sphaeroides 2.4.1
MGFRMGIVGLPNVGKSTLFNALTRTAAAQAANFPFCTIEPNVGEVAVPDARLEILAEIAGSKQIIPTRMTFVDIAGLVRGASKGEGLGNQFLANIRECDAIAHVLRCFEDGDITHVEGRIDPVADAETIETELMLADMDSIERRLANLARKLKGGDKEAADQDRLLRVAMAALEAGRPARSVTVSADDQRAWRMLQLLTSKPVLYVCNVEEASAAKGNSQSARVAEMARAQGAATVVISARIEEEIAQLPPEEAGMFLEEMGLEEAGLDRLIRAGYELLGLQTYFTVGPKEARAWTITRGMLAPQAAGVIHGDFEKGFIRAETVAYADYVAGRGEAGAKEAGKFRVEGKTYEVQDGDVLHFLFNA

SEQ ID NO: 9559 - protein, 501 aa, Pseudomonas fluorescens Pf-5
MSSLGSRSSTSIQPVILCGGSGTRLWPLSRQSYPKQFMPLLGGRSLLALTLERVSGLSSHPWCVASTEHRFLVIDAFEQCQLNGQVLLEPSARNTAAAIAVAALHAEDDALLLFCPADHYIPDAPAFVERVRQAQVAALDGALVTFGVFPTYPSSAYGYIEASAPWQDSGALHVQRFIEKPSATQAAELLLKGNMYWNAGIFLGLAREWRRALELHAPDILAACRDALREAESPVISRSGQTTVQSVVLHEPSFDACRSQSIDYAVMEHHRPICAVPFNGAWSDVGSWNAVADLSSADDKGNSSQGDAHLFDCQRTYVHAAGRRPVVALGLEDVCIVDTDDAVLVMPMSRAEDIKSVVGQLTDRSVAQALLHRRVARPWGWYDSLDQGERFQVKRIGVKPGASLSLQLHHHRAEHWTVVKGTAEITCGDRVFLLSENQSTYIPLGQRHRLHNPGKVELEIIEVQSGSYLAEDDIVRLEDNYGRTAPHCPGPAEADSTLIEQ

SEQ ID NO: 9560 - protein, 431 aa, Picea sitchensis
MAMAMAMSRSNAGRGIRLMSTSGWWKAVEPAPKDPILGVTEAFLADTDPNKVNVGVGAYRDDQGKPVVLQSVREAERRILGKENMEYLPMGGSVKMVEESIKLAYGENADVLKDKRVAAVQALSGTGACRLFAEFQKRFRPESQIYIPVPTWANHHNIWRDANVPQRTFHYYHPETRGLDFASLMDDVKNAPNGSFFLLHACAHNPTGVDPTEEQWKEISYQFKVKNHYPFFDMAYQGFASGDTDRDAKAIRIFLEDGHQIACAQSFAKNMGLYGQRVGCLSVICDDAKQAVAVKSQLQQIARPMYSNPPVHGALLVYSILSDPDLKALWHKEVKVMADRIIGMREALRGNLENLGSPLSWNHVTDQIGMFCYSGMTPEQVDRLTSEFHIYLTRNGRISMAGVTTGNVEYLANAIHEVTKSSEKELKAGAV

SEQ ID NO: 9561 - protein, 320 aa, Yarrowia lipolytica CLIB122
MSTETQPAEKTKGLGFANKDGHYRRQVSQFRNAISSKPGAEFPPDKDRYHLYVSLACPWAHRVLITRKLKGLEDLITLNVVDWYMDEDGWKFNPEVPGCTPDTVNNAERIREIYFKVNPEYDGRFTVPLLFDKKQGKIVSNESAEIIRFLFTEMDSLIPEKYHVDYYPEKLRPEIDAVNEWIYNDINNGVYKSGFATTQEAYDQNVYQLFKSLDRVEKILGEHKYLVGDTLTEADIRLFTTIVRFDPVYVMHFKCNLGMIRHDYPNIHRWLRDLYWDIPAFKDTTNFEHIKKHYMISHLKQNPYQIVAAGPKENILPKDK

SEQ ID NO: 9562 - protein, 893 aa, Magnetococcus sp. MC-1
MSVFHHNQPRKVDRPIGRRLTLVMIGVSSLITLLATGFQLYDDYQGGINRIQSSLEMVQQSRLKALSHAVWVEDNEQIRLHLEGIMQLPDLDQAAIFVEGTMQWYRGIVSSAHYITRHFPLNYPYGDTIQELGSLRVVASVDRVRARLIHSIPFMLASNALKITAVALLLLLLFHLWVIRYLGQLAHYASSVDLEQPPPDSIVLRAPSHHTDELDTITDALLGMHHKIRTVYQDFKSREESLRTLLESTRAVGWRLNLTKKRLEYISPQIYTLLGYPPESWLDLAVWQSRIHPDDRLATLTSMERILAQPREHSMEYRMLAADGRTVWVRDMSSPLSGDKPGTFTHLGGFLLDISAQKDLERRLRTTTERAESASRAKSDFLAVISHEIRTPLNAIIGMGEVLLDDPLTTEQKHYAMVSQQAAHTLLDLINDVLDLSKIEAGEFQLEHAPYDLVGLIHSVVEVNTITANQQGLPIECNLPDTLPTLMHGDLRRVRQVLFNLLGNAIKFTEQGLIRVETERLETPVASWIRISVKDTGIGIAQEKQSLIFDAFTQSDGSITRRYGGSGLGLTISKRLVEMMGGKIGVDSQLGKGSHFFFTLPVTARWDVLEPLYPPPATLLQQQRILLIHSDVENRDRMQTLLEQAGATVILGGDCRQPTACLAQLDASLDGIVMNCGTLNSAGLNHLEQHLAHYPKLAKRTVILTNKVRGSLLDRTTPLGIHYLNTPVQAEQIYPLLKGISDTSSLYQTPFVGHTEGATPLLTQANVLVVEDSEDNRLLIRTYLKKSPYILDFASNGLEAIEKWQQNHYDLVLMDIQMPLMDGLTATRHIRKQERREQRPHTPIVALTAHAMASDHQNAMAAGCDDFLTKPIKRDTLFKALHHHLPALETNQS

SEQ ID NO: 9563 - protein, 435 aa, Ralstonia metallidurans CH34
MDVAIELTTRVGVLLFFIAICHVIAQRVRLPDPIILTAAGVTIGFGYVALEHVAPAFAANTIAPFLSPAMPPEAYLWIFLPPILFQAAIEVDSSGFVADLGPILLLAIGAVVAATLSVGAVAYLTSGQGLIACLLLGAIVSTTDPSTVIGLFQSSGAPARLIRLVEGESLFNDAAAIAITTLLTGVISVMPTHDAAHFPLAQFLLSLLGGCAVGWLVGVVLVFVSGAMRSPPFAEYSLSLALPNLIYPFAERVLHVSGVAAVVCAGLVVGRIMLSRRPASHVKLFRQLWLYQATIASASVLLLATAHVPSLLDDLRMIDVVILLLVLVAAVASRFGILSVSMPMMSRIGICKPLPVSHQLLIAWGGVRGPVTLTLAICLARNQDLAPDTRHFAAAMAAGFVLLNLFFNGLTLKLFARWLGVAAPGGRRPAAIEVD

SEQ ID NO: 9564 - protein, 443 aa, Picea sitchensis
MGSASLISYRIWLPADCKRFSIGSSCHWIRVTSALGYRKLQVKDKSIRAKTTMAHGHSSERGEGEGISRAFLSKFPYTPPPWATYLHPIPSHFYSLGHLPTPIHQWNLPGLPTNTEVWIKRDDLSGMQLSGNKVRKLEFLMADAKAQGADCVITIGGIQSNHCRATAVAARYLNLDCYLILRTTRAQVDEDPGLTGNLLVERMVGANIELVSKEEYARVGSVALGKLLEERLLKEGRKPYVIPVGGSNSLGTWGYIEAMREIEQQVQEKKVPGITFFDDIVVACGSGGSIAGLSLGSYLSNLKAKVHAFAVCDDPDYFYDYTQGLLDGLNAGLNSRDLVNIINAKGLGYAMSTAEELKCVTEIAETTGIILDPVYSGKAIYQMLKDIMENPSKWGGRRILFIHTGGLLGMFDKVQQLQPLIGKWQRLKVDESMFQADGIGKMF

SEQ ID NO: 9565 - protein, 200 aa, Glycine max
MATSEEVVAAAPEAAALEAGLKHKLERKWTFWCDNQSKPKQGAAWGTSLRKVYTFDTVEEFWCLYDQVFKPSKLQINADFHLFKTGIEPKWEDPECANGGKWSVTSNSGRKANLDNMWLETMMALIGEQFEDAEDICGVVASVRQWQDKLSLWTKTAANEAAQMSIGRKWKEIIDVNDKITYNFHDDSRTKGASKGRYTV

SEQ ID NO: 9566 - protein, 583 aa, Alnus glutinosa
MEESKKSCFISDRVDYKGDPADRNTTGGWVPAALIVGIEVSERLSTMGIIVNLVTYLKGTMHQSSTTSSNSTSNVAGTSFLLCLLGGILADSFLGRYWTIAIFSVIHALGTCMLAISAALPELRPSECNLHHDFPLKCEEPSSFQMGILYTALYSMALGVGGIKSSVSGFGTEQFDQNDEKEMSEMAHFFNRFYLIISFGTLLAVTVLVYVQDQVGRSWGYGICSASMFLSIVAFLVGTKRYRYRECTGSPIIQILQVIVAAIRKRKAELPTDLSFLYDKASDKESTISHTDKYSCLDKGAIITGMDRGADGLTISNPWGLCTVTEVEEVKMLIRILPIMASTIIFWTIRAQLLSFSVQQAATMERTIENFPIPPASFNGFFVGSTIITLIMYDRLLPFLRQSSNGVQGFTNLQKIGIAIFLSILGMAAASFAEMKRLEVVRANRGSTSTSSTLPITAFYLLPQFVLVGIGDGFMYTGQLDFFITESPKGMKAISTGLFLTTNALGFFGSSILVTIITKVTGEEVGHGWLLSRINDSRLDFFYALLAVLGFINLVFYLVLASWYKPSPVEDAHQKINGKEEKV

SEQ ID NO: 9567 - protein, 175 aa, Triticum aestivum
  misc_feature (19)..(19): Xaa can be any naturally occurring amino acid
MPPPVMASWATSVAPFQGXKSTVGLPVSLRSNGASLGSVINGGRIRCMQVWPIEGIKKFETLSYFPPLSTEALLKQVDYLIRSKWVPCLEFSKVGFIFREHNASPGYYDGRYWTMWKLPMFGCTDATQVINEVEEVKKEYPDAYVRIIGFDNMRQVQCVSFIAFKPPGCDASGKA

SEQ ID NO: 9568 - protein, 514 aa, Streptococcus pyogenes MGAS8232
MSILEVKQLSHGFGDRAIFENVSFRLLKGEHIGLVGANGEGKSTFMSIVTGHLQPDEGKVEWSKYVTAGYLDQHTVLESGQTVRDVLRTAFDELFKTENRINEIYASMADDKADIAVLMEEVGELQDRLESRDFYTLDAKIDEVARALGVMDFGMESDVTSLSGGQRTKVLLAKLLLEKPDILLLDEPTNHLDAEHIEWLKRYLQHYENAFVLISHDISFLNDVINIVYHVENQSLVRYTGDYYQFQAVYEMKQSQLEAAYERQQKEIANLQDFVNRNKARVATRNMAMSRQKKLDKMDIIELQAEKPKPNFEFKQARTPSRFIFQTKNLVIGYDYPLTKEPLNITFERNQKIAIVGANGIGKSTLLKSLLGVIEPLEGHIVTGDFLEVGYFEQEVTGVNRQTPLEVVWDAFPALNQAEVRAALARCGLTSKHIESQIQVLSGGEQAKVRFCLLMNRENNVLILDEPTNHLDIDAKNELKRALKAYKGSILMVCHEPDFYNGWVTDTWDFSKLT

SEQ ID NO: 9569 - protein, 615 aa, Podospora anserina
MASTNSNAPRHEGSVAEQTAGHVNGDYVVNGVPQLPTAFRNGNGGLGAGGLPRNMSLNSFALTEYSAKPTPPAEDKKDEVKKVVPDEYLLPNGNPDLIILRVQYLRLIITSYPRVREVCKETPLVHAVGLSNRLERKVLLKREDEQPVFSFKLRGAYNKMAHLDATESWKGVVCCSAGNHAQGVAYSARRLKIPATIVMPKGTPSIKHLNVSRMGGHVVLHGADFDEAKEECARREKQDGLINIPPFDDPYVIAGQGTIGMEILSQTNLQKLDAIFCCVGGGGLIAGVGVYVKRIAPHVKIIGVETYDADAMTQSLDKGERVLLKDVGLFADGAAVKITGEETFRICQEVVDEMVRVTTDEACAAIKDMFEDTRSIIEPAGALAIAGLKKWVAANPTPDPTRSVVAITSGANMNFDRLGFVAARATYGEGREALLAARIPESPGAFAELINAVMPHSVTEFSYRYASPTEANVLLGISLTAVGSERAQQLQSVISRIKESGTMDITDLSNDELAKSHIRYMVGGRSSVPNERLYTFRFPERPGALERFLQTLRVKYNISLFQYRNHGGDIGQVLTGIVCPNEEIGELETFLKKIGYPWEDCTDAPVFKTFLRSES

SEQ ID NO: 9570 - protein, 337 aa, Tropheryma whipplei str. Twist
MTVKIAINGFGRIGRGFFRALSSPSCIDGPEIDVVAINDLTSPEVLAHLLRRDTIFGRFPESVCHDGTKLLVGKREVAVFSEKDPSSIPWNGVDIVIESTGLFTDANLASGHITAGSKRVIISAPAKNEDATFVVGVNHTDYDPNKHSIVSNASCTTNCLAPLAKVFDDTFGIERGLMTTVHAYTADQRLQDAPHSDLRRARAAAMNLVPTSTGAASAIGLVLPNLKGKLDGFAIRVPVITGSITDLSLVSKTDVSAPEVNEAYRRAALGPLKGILCYSEDPLVSSDIVADGHSCIYDANLLRISGNMVKLSAWYDNEWAYSRRLVDLAKYMASVGL

SEQ ID NO: 9571 - protein, 522 aa, Glycine max
  misc_feature (313)..(313): Xaa can be any naturally occurring amino acid
  misc_feature (366)..(366): Xaa can be any naturally occurring amino acid
MEFFTKTSVVKLRSHLDKYLVADADGARVRQSRRSSGRGTWWTVEEVAAEGGINNKVRLRSCHGRLLTATETPFLLGMTGKTVLQTEFEAGADFKHEWEVIRDGFQVRLRSWSGKFLRANGGTPPWRNTVTVDEPHSSATRDWILWDVEPVEAVEELVDEFLCENDDVVSSFASDDVLSVDSEPASPMSVFSLSSPPARRNSKLMLMQNQTSSFSSNTSGATSIRSGMELFHRAKAVRLRSHHDKYLLADEDEESVTQDRNGSSRNAKWTVELIPEFDNIIRLKSCYGKYLTASNQPLLLGVTGRKVVQTLAXRLDSSVEWEPVRDGAQVKLKTRYGNFLRANGGVPPWRNSVTHDIPHRTATQGXILWDVDVLEIHVVSPAPPPIPHSDSLDFESNTPSAVNIKSTTFSRQESTDSNVGSPPKKMEGRTIYYHVAEDNGDVDDENVQGYSLNFKGNGVEQLARKFEEETGLEGVIVCTRSPLNGKLYPLRLQLPPNNVTMQVVLVLPSSKVAREFEEQGIL

SEQ ID NO: 9572 - protein, 395 aa, Tropheryma whipplei str. Twist
MRTLGGFTFPCDAPVFVRVDFNVPMDEVGTITDDLRIRASLPTIESLLGRGAPLILISHLGRPVKNEQQGFSLKPCAERLSEYIGVNVPLVDFLDLDTKLYGELTRHLDKSGIVLFENIRFFAEETSKAQADRRILAEQLAPFAGAYVNDAFGASHRRHASVYELAQAFSNKAAGFLIESEMQAFSHLASEAKRPYTVILGGAKLSDKLRLIENILPTVDRLLLCGGMAFTFLAAQGCETGKSLLEESFIPEANKIIDFAKQNNVELILPVDVIEARSLTSPLGVVSKAESISYMGLDIGPETQSIFRNVIQDSKTVFWNGPAGLFENPSFSNGTRALLDALSSSSAFTFIGGGDTAAAVSLLGFDYGDFSHVSTGGGACLELLEGKILPALEVL

SEQ ID NO: 9573 - protein, 484 aa, Leuconostoc mesenteroides subsp. mesenteroides ATCC 8293
MLKRKPISNNFIYFFGALGGLLFGYDTGVISGAMLFIGKELEIQTGSFEDGFITASVLLGAILGAAIIGPMSDKLGRKKLLLSAAIIFFVGALGSGIGFNYTLLVTSRVLLGIAVGAASALIPTYLAELSPADKRGGIGTLFQLMIMTGIFLAYVSNEWLSPSGWLGLNQNVGWHWMLGLAAVPAALLFIGGLSLPESPRFLVKQGKMSEAQKVLSTMNPNAKLVEEELYDIKLQANTPSGGFKELFGPMARPVLIMALGLAIFQQVMGCNTVLYYAPKIFISAGFSEHFALQSHIVIGLFNVIVTAIAVKIMDKIDRKKMLTYGAIGMGASLLTMSTAMLVLRAGNGNVGSWICVIALTLYIAFFSATWGPVMWVMIGEAFPLNIRGLGNSFGAVINWTANFAVSQSFPMLLIAFTPDHAINAEGQGIAKLFIIYGVLCFVAIWFIAKFTIETRNRSLESIESDLRSKAHAKGYLESDYVGIK

SEQ ID NO: 9574 - protein, 293 aa, Tropheryma whipplei str. Twist
MLPKRAYPVQDSNVHSQEKKIIAGNWKMNINHSQAVSYLQELNWRLIDNGHDFDSCEIAVFPPFTDLRSVQTLVASDDIQISYGAQDVSAFSDGAHTGQISAQFLKDLDCKYVLIGHSEQRCLPCYPGNNSAINELNNKHDGLIANKLLRSFAAGICPILCIGDISPGDHFDATLSRFRSVLSHLKAISDKKHSIGYALGSKTHFLDSDQLHMLVAYEPSSAINSGNCANSGDIVRMAAAIKDIVNVRVLYGGGVNLFNASAVFNEDLLDGILVGRASLNASDFASLIKTCCL

SEQ ID NO: 9575 - protein, 289 aa, Clostridium perfringens ATCC 13124
MRINRNDLCWCNSGKKYKKCHMEFDERIENLAREGFEVPTRDIIKNEEQIEGIRKSAEINNAVLDLVAEKIKAGMSTEDINKIVHDYTVSRGAIPAPLNYGGFPKSVCTSINDEVCHGIPDENIILKEGDIINVDVSTIYNGYYSDASRMFIIGEASENAKRLVKVAKECLEKGIEAVKPWGFLGDIGAAIQEHAEKNGYSVVRDFGGHGVGLKFHEDPFVYHYGDAGEGMVLVPGMIFTIEPMINEGKYDVFVDAENDWTALTMDGSLSAQWEHTILVTEDGIEIIAK

SEQ ID NO: 9576 - protein, 404 aa, Neisseria meningitidis Z2491
MTVKTPVYLDYAATTTVDKRVAEKMIPYLTETFGNPASNSHAFGWEAEEAVEKARADIAALINADPKEIVFTSGATESDNLAIKGAANFYKTKGKHLITVKTEHKAVLDTMRELERQGFEVTYLGVQENGLIDLEELKAAIRDDTILVSVMWANNEIGVVQDIPAIGEICRERKIVFHVDAAQACGKVPVDVEAAKIDLLSMSAHKVYGPKGIGALYVRRKPRVRLEAQMHGGGHERGFRSGTLPTHQIVGMGEAFRIAKEELEQDMAHYRKLRDIFLKGIEGIEEVYINGDLEHRVPNNLNVSFNFVEGESLIMAVKELAVSSGSACTSASLEPSYVLRALGRNDELAHSSLRITFGRMTTEEEVQFAAELIKSKIGKLRELSPLWEMFKDGIDLNSIEWAAH

SEQ ID NO: 9577 - protein, 282 aa, Oryza sativa Indica Group
MAGGGQAAASLLTKLAQAAAGLGIAASAASTALYTVDGGQRAVIFDRFRGVLPETSSEGTHFIVPWLQKPFIFDIRTRPHSFSSTSGTKDLQMVSLTLRVLARPDVDRLPDIFTSLGLEYDEKVLPSIGNEVLKAVVAQFNADQLLTERPHVSALVRDSLIRRAAEFNIVLDDVAITHLAYGPEFSQAVEKKQVAQQEAERSRFLVARAEQERRAAIVRAEGESEAARLISEATAAAGTGLIELRRIEAAKEIAGELARSPNVSYIPAGDSSQMLLGLSGAR

SEQ ID NO: 9578 - protein, 518 aa, Oryza sativa Indica Group
MAACVDDVGKPRASRKVCVIGAGMAGLAAARELRWEGHAVTVLEQAGDVGGQWLYDDPRADDDDEDPLAAAAAAAAAKPVRVHSSMYASLRLLGPREVMGFSDFQFVPARKSRCGGGDNPGGRDPRRFPGHREVYLYLRDFYRAAGLTDSVRFNTRVVRVAVAPPPCRGGPGDALRWVVRSMDAGLWKRCTDDQMAEAHCVEEVFDAVVVATGHYSQPKLPSIQGMGDWKRRQMHSHWYRVPDSFRDEVVVLVGCGDSGMDIALDLLAVAREVHLSAKSVEAAATPAMSKMLARHANLHLHPQIERLCDDGRVVFADGGGGVVAADTVMYCTGYRYSFPFLDTEGKVAVDDDDNRVGPLFEHTFPPSLAPSLSFVGIPRKVMVPWFFEAQGRWIAGVLSGRRALPSEEEMTRSVEEFYRARELAGVPKAHTHDVEPHKMYELGEKYCDFPRTEEWKRELMAIISRNTSDDMETFRDRDDDSDNVRRCLQEWYALAEHQAQDEEDPAAAAAQAPVHSSL

SEQ ID NO: 9579 - protein, 128 aa, Neisseria meningitidis Z2491
MAYSDKVIDHYENPRNVGTFDKNDESVGTGMVGAPACGDVMRLQIKVNDEGIIEDAKFKTYGCGSAIASSSLITEWVKGKSLDDALAIKNSEIAEELELPPVKIHCSILAEDAVKAAVADYRKRQENR

SEQ ID NO: 9580 - protein, 239 aa, Vibrio parahaemolyticus RIMD 2210633
MKSEKVAVVTGAARGIGQAICEQLLEDGFHVVGLDISPVEWSHSAQLSSYQVNLCDAAAVSEVVDSIVEQHGRIDALVNNAGITRDALLPDMLEQDWDSVIDVNLKAVFLLTQRVAPVMLEQGTGSIVSISSIVGTDGNIGQSNYGASKGGVIAMSKGWAKELSRKGAQIRVNCVAPGFITTDMTKNLPEKVIQMMESKTPLGRMGSVQDIANGVAFLVSDKSAFITGQVLKIDGGLVL

SEQ ID NO: 9581 - protein, 312 aa, Azotobacter vinelandii
MWDYSEKVKEHFYNPKNAGAVEGANAIGDVGSLSCGDALRLTLKVDPETDVILDAGFQTFGCGSAIASSSALTEMVKGLTLDEALKISNQDMADYLDGLPPEKMHCSVMGREALQAAVANYRGETIEDDHEEGALICKCFAVDEVMVRDTIRANKLSTVEDVTNYTKAGGGCSACHEAIERVLTQELAARGEVFVAAPIKAKKKVKVLAPEPAPAPVAEAPAAAPKLSNLQRIRRIETVLAAIRPTLQRDKGDVELIDVDGKNVYVKLTGACTGCQMASMTLGGIQQRLIEELGEFVKVIPVSAAAHAQMEV

SEQ ID NO: 9582 - protein, 356 aa, Oryza sativa Indica Group
MAHDASSPSAARDAKKKRGNRSAKLKQSKLDVRREQWLSLESDPSSVWIGLVKDGKEVKAVVSPGAAAGANSGSPILASPHPPLPRRRAEIRTREGDPEDFKEDSVGASQDVGSSDHESPLHSPVSYNPPIGCLQQKHCSGNGGGRSFSSGSSAWSSSRSVTDSDDDTGGSPENDDDGVLDDWEAVADALSVDDNHNHQDPVPADPPVVPASCPVPANAATRQEPIKSSTRAWSPDDAFRPQSLPSLSKQVSFPASMGNCWVAMGIGSAQKGVPSKPTSCPICYEDLDPTDSSFLPCPCGFHLCLFCHKRILEADGRCPACRKQYISASSGGETVGSEREMGNLRLSRSCSMGPRY

SEQ ID NO: 9583 - protein, 402 aa, Azotobacter vinelandii
MADVYLDNNATTRVDDEIVQAMLPFFTEQFGNPSSLHSLGNQVGMALKKARQSVQKLLGAEHDSEILFTSCGTESDSTAILSALKAQPERKTVITTVVEHPAVLSLCDYLASEGYTVHKLPVDKKGRLDLEHYASLLTDDVAVVSVMWANNETGTLFPIEEMARLADDAGIMFHTDAVQAVGKVPIDLKNSSIHMLSLCGHKLHAPKGVGVLYLRRGTRFRPLLRGGHQERGRRAGTENAASIIGLGVAAERALQFMEHENTEVNALRDKLEAGILAVVPHAFVTGDPDNRLPNTANIAFEYIEGEAILLLLNKVGIAASSGSACTSGSLEPSHVMRAMDIPYTAAHGTVRFSLSRYTTEEEIDRVIREVPPIVAQLRNVSPYWSGNGPVEDPGKAFAPVYG

SEQ ID NO: 9584 - protein, 383 aa, Arabidopsis thaliana
MAVISETSDEGSNGGAANKKPQEEEENIPPIPKELPEELIVIIVALVRRYHYPKLSLISKAYRDLISSPELFQTRSRLGFTEPVLYTSIGFPPFDLPSWYILHRISLQFKQITSLPSMLPGSAVVTIDYKMYVLGGFIGLNQPVSTMIVIDCRFHTYRELPSMQRDRGGAAAGVIDGKIYVIGGCKKRYNDWVEVFDVENESWETVPGPYPNVASESVEFSQYAVMEQKIYILDPLFCLTYEPRKRRFEAWGRRSQQRRYESCCVVNDMLCTVDSTCSHGYPIVVYDPKGMVWRPVKGVQSSDLPNLVYYESRMANFGGKLVILGGNQSRDRKDSYLEKDIWCIEIALEKREDGDIWGHVESRSVVLSSSKWPLIALSRSVTV

SEQ ID NO: 9585 - protein, 109 aa, Mesembryanthemum crystallinum
MEASRAQNGIQLLLAAEQEAQHIINAAKNAKTARLRQAKEEAEKEIAEFRAQMEADHQRRLAESTGDSGANVKRLEQETNAKIEQLKIQASTISPYVVEMLLRYVTSRE

SEQ ID NO: 9586 - protein, 546 aa, Desulfotalea psychrophila LSv54
MEQTVIEYVLSRLKDLGVKDVFGVPGDYAFPINDAVCNDKELRWIGNCNELNAAYAADGYARIHGLAALSTAYGVGELSAINGIAGAYAEHLPIFHLVGMPASRVQAAHRLVHHTLGNGEFDLFYKMTEPVVCARAIMTPDNCVAETERLIAAAFYHRRPVYMAFPGDYADMPVVGQAEAVVVATSEVGTLAAAVEAICHAVSVSKRACILPGIMATRFGLRDQAAAVVEASGLPFATMFMDKCVLNEAHPSYIGIYNGELMNEQVRAFVEGSDCLLAIGMMLTDFNSGSFTANIDPAASINIMPHRVRVGTAIYHNIEMKDVLVMLAEKLPRKYGLGPRVEGLGEPVGGEDDKITVDYLYPRWEQMLKADDILVAETGTCSMGLGFAKMPNGSLFLNQSLWGSIGWATPAALGAALAAPDRRTILITGEGSHQFTAQEISQFHRYGLKPIIFVLSNDGYLIERLLCRDPDIYYNDLAQWHYKDLPEVLGCDGWFSARVTTCGELDEAIRKAEACGSGAYIEVVTDKYEASELAQRLADSIATLYK

SEQ ID NO: 9587 - protein, 484 aa, Rhodobacter sphaeroides 2.4.1
MAPLSDLIHPVLLCGGSGTRLWPLSRKSYPKQFARLTGDESLYQASARRLSGAGFAAPTVVAASDFRFVVIEQLAALKIQPGCVLIEPEARNTAGAIAAAALALEARRPGALMLVAPSDHVIPDADRFRAAVQAAAPAARAGQIVTFGIRPDRPETGYGWLELSTPTADFAPEPQPLRSFVEKPDLATAERLLSGGMHLWNAGIFLFTTTAILEALERHAPEVLAPVRQAVEAAEKDLSFTRLAPGPWADLPDISIDYAVMERAENLTVVPYAGAWSDLGDWQAVWRDAPPQEGGVVLSGPATAIDCHDSLLQATNAAQQLVGIGLTDIIAVAMPDAVLVAHKDRAQEVKRAVAALKAKGVEQAETLPRDYRPWGWYESLVKGPRFQVKRIVVTPGATLSLQSHHHRAEHWIVVEGTAKVTIDNQVTLVTENQSVYIPLGARHRMENPGKVPLTLIEVQTGAYLGEDDIIRYEDVYARGQGARG

SEQ ID NO: 9588 - protein, 538 aa, Desulfotalea psychrophila LSv54
MLIGLSIFMISLCQPYSPGRGVTSYEDNMESIKKLHIKKANSGICTGTEWISPAGSKVIESISPVDGRIIAKIQAGGAPEYKRIITQAQKAFPLWRKIPAPERGEIVRQIGEALRKDKENLGRMICLEMGKSLQEGYGEVQEMIDVCDFAVGQSRMLYGATMPSERPSHRLYDQYHPLGVVGIITAFNFPAAVWAWNAMLSTVCGNVLVWKPSSQVGLTAIAIQHIIARVLKKNKLPEGIFSLICGSGKDIGDLMLADTRLPLISFTGSVRTGRHAAQIIAGRLGKSLLELGGNNSIIISPEADLAIAIPAVVFGAVGTAGQRCTTTRRLIIHESIYDKVRDGLTKAYKSLRIGSPLNQDNHMGPLVNQDAVANYLAAVETIKDQGGEILCGGHALQGEGFESGCYVAPTLVEVKSDIPIIKEETFAPILYLIRYSGDINQAIEINNSAHEGLSSAIFSNNLREAETFLSPWGSDCGIANVNIGTSGAEIGGAFGGEKDTGGGRESGSDAWKAYMRRQTVTINYGHELPLAQGINFTI

SEQ ID NO: 9589 - protein, 483 aa, Arabidopsis thaliana; identical to SEQ ID NO: 835

SEQ ID NO: 9590 - protein, 237 aa, Zea mays
MDPEKQRQHDGAVEADIERLPVDLLAHILSLLSPFRDLSMAGGVSRRWRWAVERSLASRRRLSFAGQRTGDDTAARLVRAAVNLRDLDISRSCWGCRITDDGLIKISSADCVGNLTSISLWGLAGITDKGVVRLVSRAYSLQHLNIGGTFITDESLYAVANSCANLKSIILWSCRHVTEGGLVALVNKCRRLECINVGGMRVPPESLVGLLSISPALEIRSTARILNLNLNAGVQVS

SEQ ID NO: 9591 - protein, 464 aa, Picea sitchensis
MMSSIGGEVVTCKVLSTRDGLGRSTLLGSRQSLQQGKFSHAKTIWGDRSFKENTRLYCRRSCRMQSFQVQKKPFDDQVDPSSKIPSSTAGEVITCKAAVGWGPGQPLKIEEVQVAPPQAMEVRIKVHYTALCRTDLVFWDAKGQDPLFPRIFGHEAAGIVESVGDGVTDLKPGDKVLPVFTGECGECRHCKSEESNMCDLLRINTERGVMINDGKSRFSINGKPIYHFLGTSTFSEYTVLHAGCVAKINPEAPLDKVCILSCGVSTGMGATLNVGKPKKGSTVAIFGLGSVGLAAAEGARIAGASRIIGIDLNNDRYEQAKPFGVTEFINPGDYDKPIQEVIAEKTDGGVDCSIECTGNIKAMIQAFEACHDGWGVSVLVGVPHSEAVFATNPVNFLNERTLRGTFFGNYKPRSDLPGLVELYLNKKLELDKFITHEVSFADINKAFDYMIKGESLRTVIKVAE

SEQ ID NO: 9592 - protein, 406 aa, Borrelia garinii PBi
MNLLKKKSIGIIACPGGRVFANKIIEELERIFINVENDIVDSICQDSKALKEEIFKIEKVLSPFLEGLSLSTFKSKEPLEIPVKFVKFANGEFKTEILKTIRNKDIFIVQDVANTYEVEINSSEKIIMTVNDHIMNLMTTIDACMQAKANSVSVIIPSYPYSRQDKKHSRECLTASLIGRFLEELGIRHILTLDIHSKAIENVFRKVYFENLNVSYEIFKSLGDLIDIRDSNLVIVSPDTGAVSRNKFFASSLKSPLALLYKERDYSRVSNDVADSNISVTKLLGDVEGKNVFMSDDMLATGGTLIKAMKLLKSMGAKKIICGISLPFFNGDAIKYFDKAYEEGYFYKIIGTNAVCHNDELINKPWYHETNVAHLFANAIFAIYNKVGLQKILDRRDDIQKLITKG

SEQ ID NO: 9593 - protein, 446 aa, Thiomicrospira crunogena XCL-2
MIKQLFNQYLHYKFSELSEQIPQKSNLQIEGRLVRMVGMTLEVVGTYAPIGSRCQVLSKNEPPIEAEVVGFNDDRLYLMPIGKIHGLEPNARVIPVSGGIKVGVSSSMLGRIIDGAGNPLDDKGPISFDKRVSLNGDKINPLHRAPIKEPLDVGIKTINGLLTLGKGQRVGLLAGTGVGKSVLLGMMTRFTDAEVVVVGLVGERGREVNDFVRNNLGEEGLKRSVVVATPADDPPLMRLHGAMLATSVAEYFRDQGKNVLLLMDSLTRFAQAQREIALAVGEPPASKGYPPSVFAKLPQLVERAGNGASHSGSITAIYTVLAEGDDQNDPVVDSARGVLDGHILLSRQIADSGRYPAIDIEASISRVMIDVVPQQQNKLARRFKQLYSTYQQNQDLISIGAYRKGTDAAIDEAIEKHPQLSHFLSQSIDESFSVKESLSALESVLS

SEQ ID NO: 9594 - protein, 221 aa, Triticum aestivum
GAMVTAKLSSPAAARLAPSAGSARRASRVRVRASGGSYADELVSTAKTVASPGRGILAIDESSATCGKRLASIGLDNTEVNRQAYRQLLLTTAGLGEYISGAILFEETLYQSTTDGKTFVDVLKDQNIMPGIKVDKGLVPLPGSNNESWCQGLDGLASRCAEYYKQGARFAKWRTVVSIPCGPTALAVKEAAWGLARYAAIAQDNGLVPIVEPEISSTVTM

SEQ ID NO: 9595 - protein, 526 aa, Ralstonia metallidurans CH34
MGGDHRSDRWTDGGTGRSRRAGARRTRRNQHSRCILPARGQNRVPLYSVDPTPSAVDSGTPDTMTPATPPIAVVGGQPVPDGHAGATSRNGAKVPFEAGIRLAGVGKFQYRLFVIFGLVWLADAMQVLSIGFSAPSIAKTFGITMPQALQTGTLFFVGMLVGAIVFGRLADRIGRRPVLMIAIVIDALSGIASAFAPELSWLLVLRFLTGVGVGGTLPVDYTMMAEFLPSDRRGRWLVLLESFWAIGTICLAVLALVALSHGDQAWRVIFLVTGIPALIGVVLRFYIPESPMYLNRSGRSDEARKVLQRVAKTNGRNVEIPALQSDIVAPKSVLTLFSGTFRRRSFALFAAWALISIAYYGVFVYLPIKLGAEGFAFMRGQVFLVVLAIVQLPGFALSAYGVERWGRKPTLIGFLLLSAVGCMLYSLGTSPTVVVGSTLLMSFALLGTWGALYAFTPEVYPTDLRATGMGAAGAVARFGGLFAPAIIAPVMATHFTLALALISSMLLAGAFAIGMVNVESKDRALD

SEQ ID NO: 9596 - protein, 383 aa, Streptomyces coelicolor A3(2)
MDLYEHQARELFKEHGIVVPRAEVTDSPERAREIARALGGRAVVKAQVKTGGRGKAGGVRLAADPAEAEEAARHILGMDIRGHTVDTVMLAEPCEIEREFYVSYVLDRASGGFLAIASAEGGTEIEEVAARRPEAVARIPVDPATGVHTATAVRIADAAGLPPQTVDTLVRLWKVLVREDALLVEVNPLVRTAEGRIVALDGKVTLDDNARFRQSRWGETRQEDADSLEARAGAKGLNYVKLDGEVGVIGNGAGLVMSTLDVVAGCGARPANFLDIGGGASARVMADGLSVVLSDPDVRSVLVNVFGGITACDAVADGIVRALDEVRLTKPLVVRLDGNNAARGRALLDARAHPLVEQATTMDGAARRAARLATAASTAGQAG

SEQ ID NO: 9597 - protein, 99 aa, Glycine max
MAAEGGGGGGGGKVSFKVILTSDPKLPFKVFSVPEAAPFTAVLKFAAEEFKVPPQTSAIITNDGVGINPQQSAGNVFLKHGSELRLIPRDRVGAPVASF

SEQ ID NO: 9598 - protein, 151 aa, Oryza sativa
MEYSNLRRQIIFMKKNLFDQGYLDEQFNQLEELQDESSPNFVEEVAALFFKDSSRLLTNIEQAIDKYPQDFYRLDSLVQQLKGSGSSIGALRMKNECSVFKVNCNDRNLEGCRRSLQKMKREHATLKQKLESYFQLLRQVGPRDYAVSSRK

SEQ ID NO: 9599 - protein, 289 aa, Tropheryma whipplei TW08/27
MTPKNAYGHLVPGDISAARWVDPKIARPNYVGKKRVPRYTGSDIYNKDEIERVRAAGSIASQTLDYLAEHIRAGITTDELDRLAHEFITSKGAYPSPLGYQGFPKSICTSINEVICHGIPDNTVLEDCDIVNVDVTAFFEGMHGDTNRTFIIGNAPEATKNLVKNTEEALHVAIKAVAPGRRVNVIGLTIERLAKRFNYGVVREFTGHGVGRAFHTGLVIPHYDATPYYDRILKPGMIFTIEPMLNLGTRHWNMWEDGWTAVTKDLLPSAQFEHTIVVTQNGAEILTLS

SEQ ID NO: 9600 - protein, 200 aa, Glycine max
MYVLKLCDKMVMVACGWRHTISVSSLGGLYTYGWSKYGQLGHGNFEDSLVPQKLQALSDKLISQVSGGWRHSMALTSTGLLYGWGWNKFGQVGVGDNVDRCSPVQVKFPHDQKVVQISCGWRHTIAVTEKENVFSWGRGTNGQLGHGDTVDRNSPKIIEALSVDGSSGPHIESSNTDLLSGALFCSSLICNIVPLFFSHY

SEQ ID NO: 9601 - protein, 174 aa, Glycine max
MHQAIPYRSWRHLHNPTTHFTPLPLITHSHNDDDKKTKNIIVNNNNTINIHSSSVLVSPKEKEGMKMVLNMVSENAVIVIARRGCCMSHVVKRLLLGLGVNPAVYEVEEKDEEGVATQLEATIRSDDGNTQQGKVQFPTVFIGGKLFGGLDRIMATHISGELVPILKKAGALWL

SEQ ID NO: 9602 - protein, 326 aa, Bradyrhizobium japonicum USDA 110
MTAFHSVAVIGAGAWGTALAMVAARAGRSVTLWARNAEHATRIASTRDNPRLPGVRLAPDIVVTSELALAARADMLLIATPAQHLRGAVNMLASHIARPTPVVACAKGIEHGTHKFMTEVIAEAALHAQPAILSGPSFADDVARGLPTAVTLAAKEEELASSLVQALGSPTFRPYHSTDVRGVEIGGAAKNVLAIAAGIVVGRNLGASALAALTTRGFSELARLGRACGARPETLSGLSGLGDLLLSCSTAQSRNFALGIALGRGEAAPAGKLAEGAFTAPVLVELAAARNVDMPVSQAVAAILDNKLTIDAAIEGLLTRPFKAEE

SEQ ID NO: 9603 - protein, 138 aa, Glycine max
PISHTTTHLASHTSLLAARKFTSLGSRATDLPPAKMSTVTPAYLDQRLAAAKRSSREAAMAGAKAAAVATVAAAVPTLASVRMLPWARAHLNPTGQALIISTVAGMAYFIVADKTILSMARKHSFDDAPDHLKNTSFH

SEQ ID NO: 9604 - protein, 269 aa, Oryza sativa Indica Group
MGVAAAAGRLLAAVDWEREDYPAYRDFFALPLFAVFFLVVRYLLDRFVFEWLVREYNGLRFKWIGRKLIFGKEKVDYEKEETRKKIRKFKESAWKCVYFLSGEILSLSVTYNEPWFTNTKYFWVGPGDQVWPDQKIKFARVGSVVLAIHDASDVFLEVGKMAKYSHCDLLANVAFLLFVVSWVLLRLTYFPFWILRSTSYEVLLTLDKKKHNFDGPIYYYVFNSLLFSLLVLHIYWWVLIYRMLVRQIKTRNVGDDVRSDSEGEDEHED

SEQ ID NO: 9605 - protein, 383 aa, Arabidopsis thaliana
MVVLSEIPGDPNEDNQNENPQEEVENLPILLQLPEELIASIVALIPRCHYPSLSLVSRAFRHLITSQELYVARSNLGFTEPVLYALIGFQAYTRPSWFFLRRSNFPLQLHRIRSLPPMLSGAAVVTIDYKMYVMGGCIGYNHPASSNVIVIDCRFHTWKYLPDMKRARCRAATGIIDGRIYVIGGCKKQDADWVEVFDVTTQSWETVPSECPNDANENGEFITYVVMQGRLFILDLECCFSYEPVQGLWESWDDGSELMRFWHSSSSCVVGDLLYALDLTCALEHPIVVYYPNELVWRPVMGVDTAHLPILTEYTSTLANFDGKLVILGGGDCSESSSEIWCVEIALETRQGDQIWGVVKSVSIVSRDLPMRHVIELCRTVMV

SEQ ID NO: 9606 - protein, 253 aa, Glycine max
MGRKFFVGGNWKCNGTTEEVKKIVTTLNEAKVPGEDVVEVVVSPPFVFLPFVKSLLRPDFHVSAQNCWVRKGGAYTGEVSAEMLVNLGIPWVIIGHSERRQLLNELNEFVGDKVAYALQQGLKVIACIGETLEQREAGTTTAVVAEQTKAIAAKISNWDNVVLAYEPVWAIGTGKVATPAQAQEVHADLRKWVHDNVSAEVAASVRIIYGGSVNGGNCKELAAQPDVDGFLVGGASLKAEFVDIINAATVKKN

SEQ ID NO: 9607 - protein, 548 aa, Neisseria meningitidis Z2491
MKHLHDLPAWSKLWNHFDDSKTLHMREMFEQDPQRAERYWLQVGGLTLDYSKNRINDETMSLLFELAHEAGVPERMRQMFHGKKINTTENRAVLHVALRNRTNSPIVVDGEDVMPKVNRVLQRMGEFAHEVRSGSWLGYTNQVITDVVNIGIGGSDLGPLMMCTALKPFGHPRLNMHFVSNVDGSQLRDVLSKVHPETTLFIIASKTFTTQETLTNALTAREWFLNHAGDEEAVAKHFAAVSTNQKAVAEFGIDTANMFEFWDWVGGRYSLWSAIGLPIMLYLGEENFIEMLNGAHLMDQHFINTPLERNLPVILALIGIWYINYYGGGSHVIAPYDQHLHRLPKFIQQLDMESNGKQVTLDGKAVGHETSPIIWGETGINGQHAFFQLLHQGTHITPIDLIASLEKRSNLPGHHEILLANVFAQAEAFMRGKTPDEVRAELKAQGMDEARIEELVPHKTFSGNRPTNLILMDKVNPRNMGSLIAMYEHKTFVQGIIWGINSFDQWGVELGKQLAKTILGELTGETGSQKHDSSTERLINLYLQTNRK

SEQ ID NO: 9608 - protein, 1372 aa, Coccidioides immitis RS
MERRRHSLHGSDSSTPTDFYPLHPPFVLPGQEDFEVDIRDADDQHDTPLVTSSGATVSQVSSGYRNSPVLAPPAIYPQWTPEIPRHSRSGSAGASAATFERHTPSDMSDRELRPQRPSGPARTPSNTYAPPRRPPQFSTHSSSQLSYSAKRPSRRDPNAQYRAQEKAYVQRVRQGPPNEWLNFGSQIPGVPDIDLDLEDESPSSEPFDSDPYDVEAHLVLEDENIQPTLEELQNPKIREKLEWHSMLASVLKGDVVKQEKRRLFGTGEPKSLTDINDEIWLGIRARSCGRLEALQKKIIEHERAQVGPILEEIISFKIKGETEIGKPPVKQVEGIVAKIEKVESLYSVMRELKAHHKRADSEEFTASCDAIISWHNTTQLINTQFAILQRWVGNEELNFNLPITKPSHAADLADEGSFLDRIMKEDGLKSLQGDGNVVDGNGQTRKNSMLDGIGEVIKKAKATLIENSEAFVERHLPPYIEELLILISFPSRLIVEVIRVRLSYAKKMKDPGQQSPMLLDQMIAQFQILMKIAVEIKQRYLVISEPEPGWELPPCFEESFDTVVVDALKYYFKLLNWKLSANKNTFKEAEILEQEWDFSNEIGRQFEGGDIEVAEQFSTLTAKALQRLMLHFERELLGKPEGDAVESEKRYKQILDSVRVRQRKLFRFSRFLRERFENATEFHLKDDIVETFSEALLASGHFLVTSLDSVGQKGVSLIASPSLYGRPKDIQSILGTSFRAEDVPEDPSNPYILVIRPEKPFPWSGKRMEVDLLEHPTDVRLGKLRLVADGSQKRLQSARAELTRLTGLEFDVTVEQRANLGRVNVELNKIKKTAWKLSNTIIDSVEIIRKQNQGAGNQELIQSCFAFATEFGKRSLMYLEPTRRSMNHGKLVRLGVDWVAFVCDDCDAADRRTFKWAVAALEFAMAITHGHSILSLSDEDYQLLRAKVAGCMSTLISHFDIMGARSTLAAKAEKLQLLSGKLDLSKAMDDAEAEQAVHEQRYLRVAELEQARAELDSKRRPLGRVLEGVNEADRSLTVLSSSATNVTLRWQQGQFIGGGTSGSVYAAIDLDTSYLMAVKEIKLQEPSVIPGVAQQIRDEMAVLEVLDHPNIVSYRGIEVHRDKVYIFMEYCSGGSMATLLEHGRIEDETVIMVYALQMLEGLAYLHQAGIVHRDIKPANILLDHNGVIKYVDFGAAMIIARQGKTLAAMDQYGGNHKDATKEPHAQRKNQKSVTGTPMYMSPELVRGEVGHAGGRHGSMDIWSLGCVILEMATGLRPWAGIDNEWAIMYKIAQGNQPHLPTPDQLSELGIDFIKRCFELDPAKRPSAVELLQHEWIVTIRRQVVAEPPTPSSEVANSQTSSSTSSRQNSSMF

SEQ ID NO: 9609 - protein, 491 aa, Gibberella zeae PH-1
MRRLIWRTALHQARSRWIQPNFVAEEKDLVVIGGGVAGYVAAIKAGQEGMKVTCIEKRGSLGGTCLNVGCIPSKSLLNNSHLYHQILHDTKHRGIEVSDVKLNLANFMKAKETSVSGLTKGIEYLFKKNGVEYIKGAGSFVNEHEVKVDLNEGGETSVRGKNILIATGSEATPFPGLEIDEKRVITSTGAIALEKVPETMTVIGGGIIGLEMASVWSRLGSKVTIVEFLGQIGGPGMDSEIAKNTQKILKKQGLEFKLNTKVVSGDKSGDKVKLEVDSAKGGKVESIESDVVLVAIGRRPYTAGLGLENIGLEADDRGRVVIDSEYRTKIPHIRCVGDCTFGPMLAHKAEEEAVAVVEYIKKGYGHVNYGAIPSVMYTHPEVAWVGQSEQDLKSQNIPYRVGSFPFAANSRAKTNIDTEGMVKMLADPETDRILGVHIIGPNAGEMIAEGTLALEYGASSEDIARTCHAHPTLAEAFKEAAMATHAKAIHY

SEQ ID NO: 9610 - protein, 495 aa, Kluyveromyces lactis NRRL Y-1140
MNEYDAVDRHTFKVFNQDFTVDKRFQLIKEIGHGSYGIVCSARFTEAADETTVAIKKVTNVFSKTLLCKRSLRELKLLRHFRGHKNITCLYDMDIVFQPDGMFNGLYLYEELMECDMHQIVKSGQPLTDAHYQSFIYQILCGLKYIHSADVLHRDLKPGNLLVNADCQLKICDFGLARGYSENPVENNQFLTEYVATRWYRAPEIMLSYQGYTKAIDVWSCGCILAELLGGKPIFKGKDYVDQLNRILQVLGTPPEETLKRIGSKNVQDYIHQLGYIPKIPFSTLYPNANPDALNLLEGMLSFDPQLRITVDDALQHPYLSIWHDPADEPICTEKFDFSFESVNEIEQLKQMVIDEVTDFRQYVRLPLLHEQQQQQGKTDGGFDDQIREDQRTFQAQLEEQVNNGRTASNVPSFDEPFSSQMMGSASQQDPLVGIHSDNLPSHELDFPPRPSENVLDSPMGLSHQQTHNGSPECQDINDLLGLERELEFGLDRQF

SEQ ID NO: 9611 - protein, 139 aa, Pinus taeda
MKKVAALCFIFMIQVATNMAPIMAACSGYTCILPPVIPGGPGSGGSTPGGSTAKCPLNALKLGACVDLLQGLVHVGLGDPVVNQCCPLIQGVAALEAALCLCTTIRAKVLSLNVLLPIALSLVASCGLTVPPDFKCPAN

SEQ ID NO: 9612 - protein, 261 aa, Xylella fastidiosa Temecula1
MRTMTQSRWRLDGRTALITGASTGIGLAVARELLGLGADVLLVARDADLLGRVRDELAEEFPERELHGLAADVADDVDRRAILDWVEDCSNGLHVLINNAGGNVTRAALEYTEDEWREIFEINLFSAFELCRYTQPLLACHASTAIVNIGSVSGLTHVRSGVPYGMSKAALHQMTRNLAVEWAEDGIRVNAVAPWYIRTRRTSEPLSDLYYYEQVIERTPMRRIGEPEEVAAAVAFLCLPASSYVTGECIAVDGGFMRYGF

SEQ ID NO: 9613 - protein, 138 aa, Triticum aestivum
  misc_feature (22)..(22): Xaa can be any naturally occurring amino acid
  misc_feature (50)..(50): Xaa can be any naturally occurring amino acid
MAAAGDAGEKKMITLKSSDGEXEFEVEEAVAMESQTIRHMIEDDCADNGXIPLPNVNSKILKNWDAEFVKVDQATLFDLILAANYLNIKGLLDLTCQTVADMIKGKTPEEIRKTFNIKNDFTPEEEEEIRRENQWAFE

SEQ ID NO: 9614 - protein, 638 aa, Haemophilus influenzae 86-028NP
MIVFSNLSLKRGQTELLENASATINPKQKVGLVGKNGCGKSSLFALLKKELTPEGGEVNYPANWRVSWVNQETPALDISAIDYVIQGDREYCRLQQELEQANECNDGNAIARIHGQLETLDAWTIQSRAASLLNGLGFSQEETTQPVKAFSGGWRIRLNLAQALLCPSDLLLLDEPTNHLDLDAVIWLERWLVQYQGTLVLISHDRDFLDPIVTKILHIENQKLNEYTGDYSSFEVQRATKLAQQTAMYRQQQQKISHLQKYIDRFKAKATKAKQAQSRMKALERMELIAPAYVDNPFTFKFRPPQSLPNPLVMIEQASAGYGSGESAVEILSKIKLNLVPGSRIGLLGKNGAGKSTLIKLLAGELTALSGTVQLAKGVQLGYFAQHQLDTLRADESALWHMQKLAPEQTEQQVRDYLGSFAFHGDKVNQAVKSFSGGEKARLVLALIVWQRPNLLLLDEPTNHLDLDMRQALTEALVDYEGSLVVVSHDRHLLRNTVEEFYLVHDKKVEEFKGDLEDYQKWLNEQNSTSENKVSEKVGDNENSVQNRKEQKRREAELRQQTAPLRKKITQLEEKMNKFSSELANIENQLADTELYNAENKEKLTALLAQQVDVKKALDDVETEWMTAQEELEEMLQA

SEQ ID NO: 9615 - protein, 437 aa, Agrobacterium tumefaciens str. C58
MTAITMNDALERAGAGAYQRRLMGIFGLVWAADAMQVLAVGFTAASIAATFGLTVPQALQTGTAFFFGMLLGAAGFGRLADRYGRRRVLIVTVACDALFGVLSIFSPDFTILLVLRFLTGAAVGGTLPVDYAMMAEFLPAKNRGRWLVFLEGFWAVGTLIVALAAWGASLAGVADAWRYIFAVTAFPAVLGLGLRFLVPESPLYLLRTGRSEEAKAVVNRMLVVNGRAPLDAGTGLFQPDVTKGQGIFSPALRQRSMMILAIWFLVSVSYYGVFTWMPAKLAGDGFGFVRGYGFLVLVALAQIPGYAIAAYGVEKWGRKPTLIGFCLLSALGCLLFTLASAGAMIAASLLIMSFALLGTWGALYAFTPELYPTESRATGMGAAGAMARLGGLLAPSLLGYAIAQGFGVAIGIFAGLLVLAAIAATMINAETRQVALT

SEQ ID NO: 9616 - protein, 221 aa, Rhodobacter sphaeroides 2.4.1
MLETIQTRIAAAEAAAGRAPGSVELIAVSKVQPLERVVAVLEAGHRIFGENYVQEAQGKWPDLRERFGPLSVHMIGPLQTNKAKVAVGLFEAIHTLDRPSLAEKLARLAQERGACPRLFVQVNTGEEPQKAGVLPADADGFVAACRAMDLPVEGLMCIPPEGCDSAPHFALLAAIAARNGLQGLSMGMSGDFEAAIAVGATHVRVGSAIFGARDYSGQARG

SEQ ID NO: 9617 - protein, 520 aa, Aspergillus oryzae
MASTAETTPLLPQHQQQPATSNTSPRANRRTVTFNPLTTVSTYHDTTSTNAPVKTLYSGPSSFPSSQETPQRPTGLSALNSKLRRRNSHGAPYSAAPSMPAAPKVGPQRTTKKAQKLKLLPDPITEEAAEGEFPSDVYSQIARIKEPTARSHAARLGKSDRERLPRVTAYCTANSYRLDGAVRFLKSRSKTRGANPKLYDECVYSPFDYQYEEKQRSTSENNVGMNNVGMRETFQRPSTERRFSDSVVEIEDNTKSRREDLIDLRDSQAHQSENAIAETQSETPDFDTTIHTPEVFLFDYGTVVIWGMSPAQESRFLSDVSKFATSILSPEDTQVENFNFYYAREYQARIYNDFISLREPRNHMIKLAISHALAQSVKTSLFEDLVSETISNTAPLPAQIAQTGSVNLTRRQINMQVGELFILRINIHLQGSVLDSPELMWAEPQLEPVYQAVRSYLEMDQRVSLLNERLDVIADLLAVLKDQLTHRHGEYLEWIVIVLIAAEILVAAINIVVDLYAGVD

SEQ ID NO: 9618 - protein, 362 aa, Rhodobacter sphaeroides 2.4.1
MSLSLGIVERLNRARGDLRMGVPVVLTEEGAGAVAVAVEALEPGRLADLRLLGEPVLAITARRAETLKARVYDDDLARIELPDAAGIEWLRAVADPADDLRLPMKGPLRALRGGGAGLARAALALAKSAHLLPAAVLVPVADPLRLAAQHALTVLPLEEARAELSRGSPLHPVVSARVPMVASQAGRVHVFRPEDGGEEHYAIEIGRPDRGLPVLARLHSACFTGDVLGSLKCDCGPQLRSALARMGEEGAGVLLYLNQEGRGIGLANKMRAYSLQDQGFDTVEANHRLGFEDDERDFRIGAGILRQMGFAAVRLLTNNPAKIRMMEANGIRVTERVPLHVGRNEFNAAYLATKAAKSGHLA

SEQ ID NO: 9619 - protein, 651 aa, Aspergillus oryzae
MSPRSVPEQLATAHTRTCSATDSVASLSSTHSRSLSSNKTITSIPPNLLPSAPASPPTPAPSPTPHQRPPTWQSADEDDDAFLLNARIHFSSLSNFKRQKFLEGILSLCDSQHLSFVSSYVSPRLRKDPFLVFPTELCLRVLSFIDDPKTLARASQVSRRWRELLNDDITWKNLCEKHAYASRKSSEDDRDFVDPFHTQHLHTISGTNSLAGSRSSLTSSHQSRDGHPGLTRSLSGDWLASASLSSRKRRVRPLSYRTHFKQKYMVESAWNKGGRCTQRHITPDQGVVTSLHLTPKYIVVALDNAKIHIYDTNGDNQKTLQGHVMGVWAMVPWDDILVSGGCDREVRVWNMATGAGIYLLRGHTSTVRCLKMSDRKTAISGSRDTTLRIWDLASGTCRNVLVGHQASVRCLAIHGDLVVSGSYDTTARIWSISEGRCLRTLSGHFSQIYAIAFDGRRIATGSLDTSVRIWDPHSGQCHAILQGHTSLVGQLQMRGDTLVTGGSDGSVRVWSLTKMTPIHRLAAHDNSVTSLQFDSSRIVSGGSDGRVKVWSLQTGQLLRELSSPAEAVWRVAFEEEKAVIMASRSGRTVMEVWTFSPPPEEDTDEIVPQSSSSTPGMLPVQDDSRQRAYHSDTPTIPLGNDDDQIMPDAPS

SEQ ID NO: 9620 - protein, 467 aa, Methanococcus maripaludis S2
MKSENYSKNDLEKWDKEYVWHPFTQMKEYREGKPLLIESGEGIYLIDVDGKKYMDAVSSIWCNFFGHSEKRIADAISKQALNIGHSTQLGCGNVPSAILAKRYVDFSPEQFKKVFFSEDGAEAIEIAVKMAFEYCKLKGFTNKTKFVSVKEGYHGDTVGAMSVGGSELFHGCFEPLLFEGYHASAPYCYRCKYCNFKNTDERNKQGCEMKCLKEMEDLIRTNKDEIFCVILEAGVMGSAGMIPYPKGYIEGVAKICKKLNIILILDEIATFGRLGRAFYSDMDELKELEKPDILCLGKGITGGYLPLALTLATDEIYNAFLGSFDECKQLFHGHTYAGNQIICASAIETLNILEETNICEEIRPNIKLLHENLDKLKEFPCVGDIRKSGYMIGIELVKDKETKEPYEYSYKAGYKVAGRLLEKGIYIRPIGNTLIFVLPLIIKPEEIKLLTEKIYESISELLDEKVL

SEQ ID NO: 9621 - protein, 629 aa, Oryza sativa Japonica Group
MHTKLLLLPILASLQLLPGAANGATVDPSCPPATCGNLTITYPFWLGSQNQSSCGPPSFQLTCNDRASGPFLRNSYIKVLGFDYGRRSLVAVHALLAADAACTVMFNVSSAFAITDRFSISQSNRELYVLSRCRERLPPPDAVPVTNCRANSSGMYAYLGGSYGTGQTPVNNGGCELSVFLVLGSSNAADMTAANYRQLIAGGFLLEWEPVGDCNACTASGGRCRYDASTSAFACLCSDGGMRPSICDGKNRGKLALIVSLSAAAGLVFAFLAWLMYRQRQKFRSAICGVYSGNTKNEEEMLKKCESLALKRYKYSELKKITKSFEDNLGEGGYGVVFKGRLQNGRMVAVKILTVSKGNGEDFLNEVMSISRTSHVNIVTLLGFCLEGPKRALVYEYMPNGSLKNYIHSESSNLATGWEMLLKIVIGIARGLEYLHQGCNTRIIHFDIKPRNILLDHEFCPKIADFGLAKLCHLNESILSMAEARGTIGFIAPEVFSRGFGVVSTKSDVYSYGMLLLEIVKVRKNIKGIADNFSETFFPHWVYDSLVSEMQCCETAYGTEEIARKMTIVGLWCIQMTPETRPSMSRVIEMLERSISELEMPPKPFLCSPIHSTNVSSYKSVNFTMSASS

SEQ ID NO: 9622 - protein, 332 aa, Magnetococcus sp. MC-1
MTIRIGINGFGRIGRSIFRAQRMDPAFKDIEIVALNDLTPKPSLAHLLKYDSVMGVLNAEVSATEKGVSVDGKEITVFEERDPAKLPWGELGVDYVVESTGLFRKRETAGAHLKGGAKRVIISAPAGGDIPTFVMGVNENDYNPATDDIVSNASCTTNCLAPMAKVIDDKFGIERGLMTTVHAYTNDQALLDQPHSDLRRARAAALSMIPTKTGAAAAIGLVMPNMKGRFDGLAVRVPTPNVSLVDAVMEVRAETTAEEVNAALKAATTRFLGYFDAPLVSIDMQGDPRSSIVDGGCTRVNGKQIKVMSWYDNEWGYSNRVLDLILHMASKA

SEQ ID NO: 9623 - protein, 214 aa, Synechococcus sp. RS9916
MTETNSQTNPNDVPAASDVPAAAEGQQQQEQRRGGRDRGDRRGGRRGDRRGQERDSEWQERVVQIRRVSKTVKGGKKMSFRAIVVVGNERGQVGVGVGKAGDVIGAVRKGVADGKKHLVKVPLTRHNSIPTLSNGRDGAASVLIRPAAPGTGVIAGGSIRTVLELAGIKNVLAKRLGSKTPLNNARAAMVALSELRTHKDTAKERGISLEQIYS

SEQ ID NO: 9624 - protein, 410 aa, Picea sitchensis
MASATLSMAAVANCSSTHASLQASGKGFSEYSGLKSSIGFPSLRKYNEDLVSVVAFQTNAVGSSGQKRGVVEAKIKVAINGFGRIGRNFLRCWHGRKDSPLDVVVINDTGGVKQASHLLKYDSILGTFDTEVKIAGTDGISVGGKVIKVVSSRNPQNLPWKDYEIDLVIEGTGVFVDREGAGKHIQAGAKKVLITAPGKGDIPTYVVGVNEGKYSPTDDIISNASCTTNCLAPFVKVLDQKFGIIKGTMTTTHSYTGDQRLLDASHRDLRRARAAALNIVPTSTGAAKAVALVLPNLKGKLNGIALRVPTPNVSVVDLVVQVEKKTFAEEVNAAFRESADKELNGILAVCDEPLVSIDFRCSDVSSTVDSSLTMVMGDDMVNVVAWYDNEWGYSQRVVDLADIVANNWKS

SEQ ID NO: 9625 - protein, 513 aa, Yarrowia lipolytica CLIB122
MILLYVLAFLVSYLIFTRLRYRYQSYKLAQKWKCSPVRDVSSFPMAFPEFLFFFKSGKNNVLLDEFVNFFTKRQPNLTVGLVLAGNDVTVTLEPENLKALLATQFKDFCLGVRHNQLAPILGDGIFTLDGQGWQHSRAMLRPQFARDQVSDVDMIERHVQNLVRKIPQGDSFDIQGLFFNLTLDTATEFLFGQSVSCQTVDNPAEDDSTVTDMPIPMRKSFQSDFNLAQHHGGYRVRLQMFYWLWRPQELFTASKSVRKFVDHYVKKALVESEKEKQADDKYVFLTELAREVKSPQVLSDQALNILLAGRDTTASLLSWCIYLLARHPETWNKLRDEILSTFGSGSDLSLITFESLKRCEYLRFVINETLRLYPSVPVNVRYATRDTTLPRGGGPDESQPILIRKNSVLVYSVFATHRLKKFWGEDADEFRPERWGEGISRGWEYLPFNGGPRICLGQQYALTETSYVLTRIVQLFGTLENADASPEPPMKLHALTMCHLTGVHVKMSTNNLP

SEQ ID NO: 9626 - protein, 111 aa, Glycine max
  misc_feature (98)..(98): Xaa can be any naturally occurring amino acid
  misc_feature (107)..(107): Xaa can be any naturally occurring amino acid
MASPSVFAGIAQGPEDPILGVTVAYNKDPSPVKVNLGVGAYRTEEGKPLVLNVVKRAEQMLIHNESRVKEYLPITGLADFNKLSAKLIFGADSPAIQXNRVATVQCXSGTG

SEQ ID NO: 9627 - protein, 576 aa, Schizosaccharomyces pombe 972h-
MDGTNNTIPLQFGKQAQTYDINALIARFIRPKESFLINSVEKESESKLNSKSTTLQSSDSEDWDSEENEDDITDVGVPGSHEIMFPGHSKIVTTTTFDKNGSRFYTGSLDNTIHCWDLNGLSATNPHPFKIIDPTDTNADNVGRYPVSKLSCSTKNQILALYTHSQPILYDRDGSLIVRFSKGDQYIRNMYNTKGHIAEITDGCWQPDSSQIFLTTGYDSTARIWDVNRTKSQLEVFVHVPEGSHTGLSRIPVTSCAWNPAKPDNFATAVLDGSIQFWQKGSRTKRPVMKIKDAHLPQQGISCLSFSQDGNYLLSRGEDNALRVWDLRNSNKCVNERIDILTPKAGGNAIFSPTQKLILAGSTAVNSMKAPLFVLDAMTLDTKATLFFDSKSTVTASVSAVSWNEKINQVSLGSADGNAYVLFSPNESIRGVKDAAMRPPKSKHIDDDLSSTVHINSLSGSAGTSDFGLVEETTESASAYFLEARRRRNAVRKDPKLSRQPQVGRLLEENSVDDIPLATMLNEDPREALLKYADVAKSNPMFTKMYSETQPTPIYQGVTEGDISSEEGNPSKKQKR

SEQ ID NO: 9628 - protein, 278 aa, Pseudomonas aeruginosa PAO1
MHRYVVIDAFASEPLQGNPVAVFFDCDDLSGERMQRMAREMNLSESTFVLRPQQDGDARIRIFTPVNELPFAGHPLLGTAIALGAETDKDRLFLETRMGTVPFALERQDGKVVACSMQQPIPTWEHFSRPAELLAALGLKGSTFPIEVYRNGPRHVFVGLESVAALSALHPDHRALCDFPDLAVNCFAGAGRHWRSRMFSPAYGVVEDAATGSAAGPLAIHLARHRQIPYGQQIEILQGVEIGRPSRMYARAEGAGERVSAVEVSGNGAAFAEGRAYL

SEQ ID NO: 9629 - protein, 439 aa, Kluyveromyces lactis NRRL Y-1140
MEANIISNQSNWNARQMPNVSRATKKLKKLLDPYVDHMKQSYELDQNNHIYVDPILTKRSIYSPANFSVPGRYEILQVLGKGSYGTVVSAVDKGNPTHEVQLAIKKVTSIFTREILLKRAIRELKFMSYFKGHRNIVSLIDLEIVNEEPYSGLYCYQELVDYDLARVIHSNVLFSEFHIKHFLYQILCGMKYIHSADVIHRDLKPGNILCSITGEIKICDFGLARGISPSFTVAGGISNHITNYVATRWYRAPELILSHKRYSKSVDMWAVGCILAEFYGRKPVFMGNDSLHQVMEIQKILGTPKQIVIRTYGSSRCYDIFSTSKPQYKKTPWCEIFPYASSEAVDLMERLIDWNPEARLTVEEALDHPFLQQVRNPEAEPICPHGPFDFTYEKHLYSMERLRECLCDEVSKFHNDRQTKDFVSPPLMTPHFIAESNSY

SEQ ID NO: 9630 - protein, 512 aa, Triticum aestivum
MDSLYWFVELLSVLCFVVFYYRHLQSKKISKAEPTEWPILGHLLGMVANLSHFHDWATGILAGTRYNFQARAGITGVRFFVTCDPANVRHIFTSNFTNYPKGDEFAEIFDVFGDGIFNADGESWRRQRAKSQLIMAGPRFRAFSARYSRDKVERSLLPFLAHAAEAGSTPCDLHDVFLRLTFDMTCNLVFGVDPGCLQIGLPVVPFARAMDDVLETLFLRHIISPACWKLMYRYEVGTERKMAAARRTIDRFAADTITKRRVDHKLRPNEGVTDSSDMLSSFICNGDASEYSDEFLRDTTVNLLLAGRDTTGAALSWFFYLLSKNPSVEQRILDELAPIASRKKKLDGMVVFDVSELSGMVYLHAALCECLRLYPSVPFEHKAAVADDVLPSGHEMKAGDKILIFSYCMARMEGVWGKDCMEFRPERWVTADGKLRYEPSYKFISFNAGPRTCLGKEMAFVQMKTAAAAVLWNFAVEAVPGHVVEPKLSIILHMKNGLAVTVKRRNVAGVHG

SEQ ID NO: 9631 - protein, 314 aa, Triticum aestivum
  misc_feature (62)..(62): Xaa can be any naturally occurring amino acid
MASRCAARLPHPPCAAPHHGWASSRVSARPAQSGASRGRAVVCAVSFRPCIDIHKVCFAKFXGKVKQIVGSTLRDASDDGTALVTNFESDKSPAEFANIYKEDGLVGGHVIMLGGDPASRSAALEALHAYPGGLQVGGGINLENAMSYLNEGASHVIVTSYVFSDGKMNIERLTQLVELVGKERLILDLSCRKKDGRYAIVTDRWQKFSDVFVDGPTLERLAAYADEFLVHGVDVEGKRLGIDEELVELLGSHSPIPTTYAGGVSTMDDLERIKKAGKSRVDVTVGSALDIFGGDLPYDDVVRWHKEQNLVSKR

SEQ ID NO: 9632 - protein, 222 aa, Neurospora crassa
MASDLKLVSHLYADWCGPCKMIAPVFESLSAKYSKPNKITFCKIDVDSQQEVAQQYGVRAMPTFLILHNGSVIETIQGANPPALTAAVDKAVKLAGGAAGGGAVFKTAGHRLGGSGVAGSRPGTSVARPFKWDFNSLIKTIIAFIGLYVTSLFSVRDHCHPSRIWTRFTNKVLIQLDPYKAAESSPFNKKNSPPQSQSYTGSAASKKPAPRATFKTLSDLGN

SEQ ID NO: 9633 - protein, 571 aa, Methanosarcina acetivorans
MTLSPEDLKTIEKYALQNAVKYEKAPQSKAVMGKVMGECPQLRANPGAVSTALKSIVSEIAKGNPEAWKTRLSEIAPELIEALNVKKEPEKGLKPLEGAEPGKVVMRFAPNPNGPGTLGSARGMVVNSEYVKMYKGKFVLRFDDTDPDIKRPMLEAYDWYLDDFKWLGVVPDRVVYASDHFPIYYDYARKLIEMGKAYVCFCKGEDFKRLKDAKQACPHRDTSPEENLMHWEKMLAGEYEDQQAVLRIKTDIEHKDPALRDWGAFRIRKMSHPRAEIGNKYVVWPLLDFAGAIEDHELGMTHIIRGKDLIDSEKRQGYIYKYFGWTYPKTTHWGRVKIHEFGKFSTSSLRKAIEAGEYSGWDDPRLPTIRAIRRRGIQAEALKKFMIEMGVGMTDVSISMESLYAENRKIVDPVANRYFFVWAPVELEIAGMEPTVAKLPLHPTDHSRGVREIAVGNKVLVCAEDVEKLELGSVIRLKDFCNIEITSLSPLQAKHSDVSLEALKKAKAKIVHWAPVDGISVKVRGPEGDLEGIGEKGIVGELDKIVQFERFGFCRIDAVSEEKVVAYFAHK

SEQ ID NO: 9634 - protein, 341 aa, Schizosaccharomyces pombe 972h- [sequence omitted]

SEQ ID NO: 9635 - protein, 99 aa, Prochlorococcus marinus str. MIT 9515
MASYKVTLISESEGLNSTIEVPDDQYILDAAEEQGVDLPYSCRAGACSTCAGKITTGTVDQSDQSFLDDDQLEAGFVLTCVAYPSSDVTINTHAEEELY

SEQ ID NO: 9636 - protein, 473 aa, Oryza sativa Japonica Group
MGPFLISRANKELVFVHNCTTTKRRPPQGFRRMPCSPDESFVFLGDGRPRLLLPGCSMSVVPVLGLQDGDYVASMRRGLLLEWMLVPGDCQKCSASGGQCEYSSDGMGFSCKCPSGVHNPTSCVAGDSKSNGRKKTLIVLIPVAVSLLFPCAYVLIWHRKGQILCYLLCNKTRSRNESNIQKLIVSYGSLAPKRYKYSEVAKITSFLSNKLGEGGYGVVFKGKLQDGRLVAVKFLHDSKGNGEEFVNEGSKRALIYDYMPNSSLDNYIYSEKPKETLGWEKLYDIAIGIARGLEYLHHGCNTRIVHFDIKPQNILLDQDFCPKIADFGLAKLCCTKESKLSMTGARGTIGFIAPEVLYRSFGVVSIKSDVYSYGMMLLEMIGGRKNVKSMVQNSSEKYFPDWIYDHFYQGDGLQACEVTSEVEEIAKKMTLIGLWCVQVLPMHRPTITQVLDMFEKALDELDMPPKQSFCESL

SEQ ID NO: 9637 - protein, 572 aa, Pyrococcus furiosus
MEVEKLALKYALINAIEHDGKANPKAVIGKILGENPELRKKAREIVPIVNKIVEEVNTLSLEEQKKKLEEIYPEYFMEGTKKEKEEKKQLPPLPKAEKGKVVTRFAPNPDGAFHLGNARAAILSYEYAKMYDGKFILRFDDTDPKVKRPELIFYDMIIEDLEWLGIKPDEIVYASDRLEIYYKYAEELIKMGKAYVCTCPPDEFRKLRDQGIACPHRDEPVEVQLERWKKMLNGEYREGEAVVRIKTDLNHPNPAVRDWPALRIVDEPNHPRTGNKYRVWPLYNFASAIDDHELGVTHIFRGQEHSENETRQRYIYEYFGWEYPVTVHHGRLSIEGVILSKSKTRKGIEEGKYLGWDDPRLGTIRALRRRGILPEAIRELILEVGLKKSDATVSWDNLAAINRKLVDPIANRYFFVADPIPMYIEEAEEFEAKIPLHPDHPERGYRVLKFEPGKPIYVSKDDLSLLKPGGFIRLKDLFNVEILEVGDTIKARFHSHEYEVARKNKWRMIHWVPEGKECEVIIPEGEELIIRKGLLEKNANVKEGEIVQFERFGFVRIDKIENDKVIAIYAHK

SEQ ID NO: 9638 - protein, 430 aa, Shigella flexneri
MSYIKLLTQLSFPNRISGPILETSLSDVSIGEICNIQAGIESNEIIARAQVVGFHDEKTILSLIGNSRGLSRQTLIKPTAQFLHTQVGRGLLGAVVNPLGEVTDKFAVTDNSEILYRPVDNAPPLYSERAAIEKPFLTGVKVIDSLLTCGEGQRMGIFASAGCGKTFLMNMLIEHSGADIYVIGLIGERGREVTETVDYLKNSEKKSRCVLVYATSDYSSVDRCNAAYIATAIAEFFRTEGHKVALFIDSLTRYARALRDVALAAGESPARRGYPVSVFDSLPRLLERPGKLKAGGSITAFYTVLLEDDDFADPLAEEVRSILDGHIYLSRNLAQKGQFPAIDSLKSISRVFTQVVDEKHRIMATAFRELLSEIEELRTIIDFGEYKPGENASQDKIYNKISVVESFLKQDYRLGFTYEQTMELLGETIR

SEQ ID NO: 9639 - protein, 603 aa, Oryza sativa Japonica Group
MAFQLLPAMIIAASLLHVAAAVGNETSSNNNTSCAPARCGNLTITYPFSLSGVQPLYCGYPVLDLTCDNRTGHAFLSRTFREHLFRIDNIFYENSSLVAAVQTTFAGDADCPIPDFNTTMGAYISDRWNSTPPSGIPGNCISVSLPVRGGDGMKLLDQHYEQLIADTIGGRTIIHGDGGGSIGGNGNGSIQQYERLISDGFVLEWQRAVTRDPDCDACRRNGGECRFQQLMFQCVSCHGLICSNSTSPCDQDDDCVKAFSLLLRELFSCIHPPVDEGCLRKLAWQPMTLSQEDWSNRKLNVRAILIAGVVFMCLVWIMHRRKQTLGFIIHHKYTGNESNTEEELKRYQSLSPKRYRYSDLKKITKCFKEKLGEGGFGTAFKGNLKDGRMVAVKLLKGAKGNGEEFLNEVTSIGRTSHVNIVNLLGFCLERSKRALVYEYMANGSLGKYIYSESLRLAIGLESLQKIAIGVARGLEYLHQGCSTRIIHFDIKPHNDSAISMAEARGTIGFIAPEVFSRGFGVVSTKSDVYSYGMMLLEMVEGRKNVKTNTDNSSAYFPNWIYDHLAKDLQSHEVTCENEEIARKITLVGLWCIQTAPRKSSFNE

SEQ ID NO: 9640 - protein, 757 aa, Bacillus halodurans C-125
MNSLRTAFLLGMTLVLFVVCLPNPYALAVEKPRQLAEDETVVIVLTNRDLETTIKDVERSIPSGELRMTFRLLNGFSFQLPEEEVEKLTTVSGVERVDHVMTYEATINESAPFIGAEQVRGMLDEEGVHLTGKGVKVAVIDTGIDYTHPDLQSSYKGGYDFVDYDDDPMETIASQGPPTLHGTHVSGIIAANGQVKGVAPEAEIYAYRALGPGGQGTTEQVIAAIEKAVEDGVDVINLSLGNTVNGPDWPTSLALDAAVEEGVVAVTSNGNSGPNMWTVGSPGTSKKAISVGASAPPLNTPYLTAFGEENEISLYPFSGGLPWAFKRDLPMIDVGYGTEKEWEGVDAEGKVVLIKRGMVPFTEKVMHAVAAKARGVIIYNNTPGPFTGMIEGGVNIPVVSITREDGEFLLEQLELQKNKELTLRTIYRKEEDFVALFSSRGPVTHTWDVKPDVVAPGVSIDSTIPNNGYLGLNGTSMAAPHVAGAAALIKQAHPEWTPEQVKAALMNTAKKLVDQEGVPHEIHEQGAGRIQVDKAVAATSLVYPGALSFGKWSKDDLREKRPVTLTIENHDTVKRTYHISPPFDVPDGVEWAVPFAITLKPGEAKEVTVEMDLMPSVLAAGIHQGEIVVQGGKEDIVVPYVFFIEEPDYPRVMAFHFEHGDKPNSYRYELYLPGGAEELSIDFYDPDTFEFVATLDKKVEVPRGMLQNEFEELDLKDGIYRVLVTAIQDGHQDTIETFIMIGEELLPPKAQEDEESK

SEQ ID NO: 9641 - protein, 511 aa, Capsicum annuum
MANIDIAGIMKDLPNDGRVPKTKIVCTLGPSSRSVPMLEKLLRAGMNVARFNFSHGTHEYHQETLNNLKIAMQNTQILCAVMLDTKGPEIRTGFLKDGKPIQLKEGQEITVSTDYTIKGNVEMISMSYKKLVVDLKPGNTILCADGTITLTVLSCDPAAGTVRCRCENTATLGERKNVNLPGVVVDLPTLTEKDKEDILEWGVPNNIDMIALSFVRKGSDLVNVRKVLGPHAKRIQLMSKVENQEGVVNFDEILRETDSFMVARGDLGMEIPVEKIFLAQKMMIYKCNLAGKPVVTATQMLESMIKSPRPTRAEATDVANAVLDGTDCVMLSGESAAGAYPELAVKIMARICLEAESSLEYEAIFKEMIRCTPLPMSPLDESSIISCPHGLTKLKQNSIVVLTRGGSTAKLVAKYRPAVPILSVVVPVLTTDSFDWSISDETPARHSLVYRGLIPILGEGSAKATDSESTEVILEASLKSATEKGLCQPGDAVVALHRIGAASVIKICIVK

SEQ ID NO: 9642 - protein, 592 aa, Oryza sativa Japonica Group
MHLFPAPASVVLCLAMLLLTLPIASSTVDAINTTNTTSPFCEPARCGNLTIGYPFWLAGKHPPECGYRAFQVTCDHRNASLKNGFWTYQIQHIFYHNSSFMVTNEQLTDGQCVIESFVNASSDLGLTPFKISPINRELIFLYNCNQSRLQQLPPSWAPVSCAENESPNSYAWLAGRYKPDDDLRQQPGNCTVSMIPVLGYDGAAAKDYERLIKGGFLLDYTAGPDDCEDCSRSGRWCRVNVTYDGLDCQCPEGITSSGFMCGTKKTGRKIILIAAAAGLLLPCLYVLIWHRKGKKLRHLLCTKTSSTSERNIEALIESYGSIAPTRYKYSEVTKITSFLNYKLGEGGYGVVFKGRLQDGRMVAVKFLHDSKGNGEEFVNEVMSIGRTSHINIVSLFGFCLEGSKRALVYEYMPNGSLDNYIYSENPKEILGWEKLYGIAIRVARGLEYLHHSCNTRIIHFDIKPQNILLDQDFCPKIADFGLAKLCRTKESKLSMTGARGTIGFIAPEVIYRTFGVVSTKSDVYSYGMMLLEMVGGRKNAKQMVENSSEKYFPDWIYDHFALDDGLQACQVTSEVEQIAKKMTLIETIQFMS

SEQ ID NO: 9643 - protein, 358 aa, Lolium perenne
  misc_feature (221)..(221): Xaa can be any naturally occurring amino acid
  misc_feature (230)..(230): Xaa can be any naturally occurring amino acid
  misc_feature (237)..(237): Xaa can be any naturally occurring amino acid
  misc_feature (243)..(243): Xaa can be any naturally occurring amino acid
MATAALPGMLLVEELAGGDLLPERYVLQVEDRPTVVGALPVAQVPVIDLGLLSQQVAAGGGEEVEKLRSALVSWGIFMVSGHGVDPCMMDAMWKAAKDFFGQPIEEKKKYANHADCEEGYEDYHQGYGTKQLKAEGETTLDWSDRMRLQVEPQDERKLELWPESFKDILHDYCVQQHRGLLDTLLPAMERVMGLGDGFLLGRLGGPATTYCRINYYLPCPXPDLVVGVAXHADATLXSVVMVXTPFGGCQVLKDDVWYDVPASTDPHGLLIMVGDFAEILTNGLLKSPVHRVVTNPHKDRTSVVMFYMPDIDKEIGPADELIGNTQRARYKKVKGSEYLIRNYGHMARGKRTLDSLMI

SEQ ID NO: 9644 - protein, 599 aa, Oryza sativa Japonica Group
MNPKLLFFPLLATLLLLCHHAHAVCEPATCGDLTIKYPFWLSGPDLNRSSLAIAACGHPSFELWCSRDGVASLRGSQILVLGIDYTNSSFVAGHKRVADGGDGVCRTDFNISSSLALSPFTISSSNRAICFLYSCNGTEPPEIDGLVNATISNCSKPIYAYLGGSYDRDKPPAIKAGNCTYSYLPVLWPESPVNLTAGTNYSPLFKKGFVLEWQKNGFGDCDACNASGGQCRYNNDSAAAFACLCSDGELRGTICAGSKKTGRRTILIVLTAAAAGLLLPCIYVLIWHGKGKQLRYFLYTKTSSTSERNIEALIISYGSIAPTRYKYSEVTKITSFLNYKLGEGGYGVVFKGRLQDGRLVAVKFLHDSKGNGEEFVNEVMSIGRTSHINIVSLFGFCLEGSKRALLYEYMPNGSLDDYIYSENPKEILGWEKLYGIAIGIARGLEYLHHSCNTRIIHFDIKPQNILLDQDFCPKIADFGLAKLCRTKESKLSMTGARGTIGFIAPEVIYRSFGIVSTKSDVYSYGMMLLEMVGGRKNAKSMVENSSEKYFPDWIYDHFALDDGLQACEVTSEVEQIAKKMTLIENIQLRRLTQKVRVLL

SEQ ID NO: 9645 - protein, 574 aa, Polytomella sp. Pringsheim 198.80
MALRYAAGLAKNVVQRQGASLNIARAFAAEPAPAIDAGYVSQVIGPVVDVRFDGELPSILSSLEVEGHSVRLVLEVAQHMGDNTVRCIAMDSTDGLVRGQKVVDTGSPIKVPVGRGTLGRIMNVIGEPVDEQGPIDAADIWSIHREAPEFTEQSTEQEILVTGIKVVDLLAPYQRGGKIGLFGGAGVGKTVLIMELINNVAKAHGGFSVFAGVGERTREGNDLYREMIESGVIKLGAERGNSKCTLVYGQMNEPPGARARVALTGLTVAEYFRDIEGQDVLLFVDNIFRFTQANSEVSALLGRIPSAVGYQPTLATDLGGLQERITTTTKGSITSVQAVYVPADDLTDPGPATTFAHLDATTVLSRSIAELGIYPAVDPLDSTSRMRNPNVIGAEHYNVARGVQKVLQDYKNLQDIIAILGMDELSEEDKLTVARARKIQRFLSQPFQVAEVFTGTPGKYVDLADTISGFQGVLTGKYDDLPEMAFYMVGDIKEVKEKADKMAKDIASRKEADNKKVSEELKDIPSLDKLVSEIKEVVIEEDDGLEEDFKAEALSSETVVLNEEGKSVPLPKKN

SEQ ID NO: 9646 - protein, 535 aa, Glycine max
MAALGRSSAAATTSLSSSSARFRRSLHLPPSQLSFPRARFSVNATCPFFSDNNGNKISLPQDVVASKPSPLELLKTSAADRYTKEKSSIICIGLNIHTAPVEMREKLSIPESHWAQVIKDLCALNHIEEAAVLSTCNRMEIYVVALSQHRGVKEVTDWMSKVSGISIPELREHQVLLYNAYAAQHLFEVASGLDSLVLGEGQILAQVKQVVKAGQGVPGFDKKISGLFKQAISVGKRVRTETNISSGSVSVSSAAVELALMKLPDSSFADSGVLVVGAGKMGKLVIKHLAAKGCRKMVVVNRTEEKVNAIRKELKDVEILFRPISDMLACAAEADVIFTSTTSESSLFSKENVQMLPLVSHGRRRLFVDISIPRNVEPSVSDLETALVYNVDDLKEVVAANKEDRLQKAEEARGIILEELNKFEAWKDSLETVPTIKKFRAYVERIRASEMEKCLSKMGPDVSKQHKDAIYALSMGIVNKLLHGPMQHLRCDGKNDSSLSEVLENMRALNRMYDLETETSLIEEKIRVKMERVQK

SEQ ID NO: 9647 - protein, 351 aa, Rhodobacter sphaeroides 2.4.1
MAEVKRIIGWFGEKRGVSFDVSEDLVGGAAYDAHGTPLADETMARAQEVDAVLLGAVGGPKYDVLDFSVKPERGLLRLRKEMDLYANLRPAQCFDALADFSSLKRDIVAGLDIMIVRELTSGVYFGEPRGIFPDNEGGRFGVNTQRYTTEEIRRVARSAFELARRRNNRVCSMEKANVMESGILWREEVQWVHDNEYPDVELSHMYADNGAMQLVRWPRQFDVIVTDNLFGDILSDCAAMLTGSLGMLPSASLGAPMANGRPKALYEPVHGSAPDIAGQGKANPIACILSFAMALRYSFDMGEEATRLEKAVETVLADGVRTADLMGPEGGTPVSTSGMGDAVLAALDASL

SEQ ID NO: 9648 - protein, 459 aa, Ralstonia metallidurans CH34
MAQRFDAIIIGTGQAGPALAARLAGAGMKLAVIERGRFGGTCVNTGCIPTKALIASAYAAQLARRAAEYGVTIGGPVAVDMRQVKARKDEISGRSSQGVEQWMRGLDNVTVHQGHARFEHARGVRVNGELLEADQIFINVGGRALIPPMPGLDQVSYLTNSSMMEVDFLPEHLIIVGGSYIGLEFGQMYRRFGARVTIVEKGPRLIQREDEDVSQAVREILEREGIEVRLDANCLSARKDGDHIAVGLDCAGGAPEVHGSHLLMAVGRVPNTDDLGLDKAGIETDARGYIKVDDQLRTSVPGIWALGDCNGRGAFTHTSYNDYEIVAANLLDNDPRAVTDRIPAYALFTDPPLGRIGMTEREARQSGRKVLVGTRPMSRVGRAVEKGESQGFMKILVDADTRLLLGAAILGLNGDEVVHSLLDVMYAGAPYTTISRAVHIHPTVSELVPTVLQGLRALT

SEQ ID NO: 9649 - protein, 412 aa, Photobacterium sp. SKA34
MSSSLPLSQHVDQLRKQFPALNCQVDGRQAIYFDGPGGAQQPLSVIESYGNYLKQGNTNLGGHFSVSRKAVELVDTCREKAAALFGAAKKEEIIFGANMTSMTFHFSRAISNDWKEGDEIILSTADHGSNRSSWAMAAQDKGVKVHYIPILDNTCQLDLEAFEHLLNDKTRLVAVTAASNLSGTLVDIEKITRLGKANGSVVYIDAVHLLPHKIINVTSLGADFVAGSAYKFFGPHLGVLYGRQQALEYYSPYKVEPAPSYSPNCWETGTLNFEALSAFSSTIDYLASLGSGTGLREQLESGYENISNYESFLASKFLTRLKDYPSIELFGEPSIDNRTATFALRFGELNPAEVAAHLGEQEIYTWSGHLYADMLTDALKITEKGGILRVGLMHYNTEEEIERFFIALEQIL

SEQ ID NO: 9650 - protein, 417 aa, Picea sitchensis
MGRRSRSRRNQMLARSNRVKTLAPLMEEPTAQPYDDEDSAKKYSPWGGLRDWLRNRSVANTGWLMYSNGRSSAGNCPDLKLLLGVLGCPLGPIGVANDPLPHLSIKDVPIETSSAQYIVQQYMAATGCLKFQNSIKSSYMVGRVKMVSTEAEMATKACRNYSLKASETGCFVLWQMMPDMWSVELVLGGSKVHAGSNGKIVWRHTPWLGSHAAKGRPRPLRRALQGLDPRTTAIMFANARCLGEKKIGDEDCFILKVAADPSTLHERSDGPAEIIRHVLFGYFSQKTGLLVYLEDSHLTRIEATGIDVVYWETTIETTINNYRAVDGVMIAHSGRSVVSLFKFGECSMSHTRTRMEETWTIDDVVFNVPGLSMDFFIPPADIIKNGSGGDACNYQSDGKPLSRKLRNGNLQQVPVGR

SEQ ID NO: 9651 - protein, 791 aa, Pseudomonas syringae pv. syringae B728a
MVEYVVSLDKLGVHDVEHVGGKNSSLGEMISNLAGAGVSVPGGFATTAQAYRDFLELSGLNEQIHAALDALDVDDVNALARTGAQIRQWIMEAEFPEQLNAQIRTAFAELSAGNPNLAVAVRSSATAEDLPDASFAGQQETFLNIRGVENVIRAAKEVFASLFNDRAISYRVHQGFDHKLVALSAGVQRMVRSETGTAGVMFTLDTESGFRDVVFITGAYGLGETVVQGAVNPDEFYVHKDTLAAGRPAILRRNLGSKAIKMIYGEEAKAGRSVKVIDVEPADRARFCLSDAEVSELAKQAMIIEKHYKCPMDIEWAKDGDDGKLYIVQARPETVKSRASANVMERYLLKETGKVLVEGRAIGQRIGAGKVRIIKDVSEMDKVQPGDVLVSDMTDPDWEPVMKRASAIVTNRGGRTCHAAIIARELGIPAVVGCGNATHTLQDGQGVTVSCAEGDTGYIFEGELGFDIKTNSVDAMPDLPFKIMMNVGNPDRAFDFAQLPNAGVGLARLEFIINRMIGVHPKALLNYSVLPPEIKESVDKRIAGYDDPVGFYVDKLVEGISTLAAAFTPKKVIVRLSDFKSNEYANLIGGKLYEPEEENPMLGFRGASRYISENFRDCFELECRALKRVREEMGLTNVEIMVPFVRTLGEASQVIDLLAANGLKRGENGLRIIMMCELPSNAILAEEFLEYFDGFSIGSNDLTQLTLGLDRDSGVIAHLFDERNPAVKKLLSNAIQACNKAGKYIGICGQGPSDHPDLARWLMDQGIESVSLNPDSVLETWFFLAEAQAPV

SEQ ID NO: 9652 - protein, 503 aa, Silicibacter pomeroyi DSS-3
MGGPTNSRRRHAMLDAATDLKSLLKTPDLLATKAYIGGQWVDGDNGTFAVTNPARGDVIAEVADLSRAQVAGAIAQAEAAQKEWAKYTGKERAVILRRWYDLMMEHAQDLGRILTAEQGKPLAEAVGEVAYGASFIEFFAEEAKRIYGETIPGHQRDKRITVLKQPIGVAASITPWNFPNAMITRKAGPALAAGCAFVARPAAETPLSALVLAVLAEKAGIPAGVFNVVPSSRSSEIGKEFCENPGVRKLTFTGSTEVGRILLKQAADQVMKCSMELGGNAPFIVFDDADLDAAVEGAMLCKFRNNGQTCVCANRIYVQAGVYDAFAEKLAAAVAKLNVGDGLSDGVTTGPLINAEAVEKVLEHLGDVTAKGGAVLTGGKPHALGGTFFEPTVVTGVTQEMKVAKEETFGPLAPLFKFDDVDEVIAMANDTIFGLAAYFYAKDLSRVYKVAEALEYGIVGVNTGIISTEVAPFGGIKQSGLGREGSHHGIEDYLEMKYICMSV

SEQ ID NO: 9653 - protein, 583 aa, Bradyrhizobium japonicum USDA 110
MMSSFSTRRTFFAFLATLALGLASATAQDARRGYVPPALDTVHAVAAEHGMVVAQEKISVQVGADILRRGGNAVDAAVATGFAMAVTYPRAGNIGGGGFMMIHSAERNEDIAIDYRETAPAATTPQIFLGPDGKPDIAKSRDSALGIGVPGTVAGLALALEKYGSGQFTLAQLLEPAIALARDGFVVSDDIADTLPGWHRRLTRWPSAARIFSRPDGAPLSDGDRLVQGDLADTLAAVAAQGPRGFYEGAVADKLAKAVSEAGGIMTPADLKTYQAVIRTPVRGTYRGYDIVSMPLPSSGGVVLVETLNILEGFQLADLKQGSPASLHLLIEAMKRAYADRARYLGDPAFVNAPIETLTAKDYAAKLRAGISTSRATPSKQLVSAAASPREGSNTTHFSVVDSRGNAVSNTYTLNFSYGVGLVAEGTGVLLNNELDDFTAAVGASNAYGLVGFEANLPGPGKRPLSSMSPTIVLKDGKPVLVTGSPGGSRIISTVLQVIVNVLDYKMDVAAAVATPRLHHQWLPDEVRVERGFPDDVLFELKAMDHPIVEPMGQTSANSIAVTPNGPLGAPDPRTRGAEAAGQ

SEQ ID NO: 9654 - protein, 357 aa, Tropheryma whipplei str. Twist
MVRMKALVYHGPGKRSLDTVDDPTIKLGTDVILEMETTTICGSDLHILKGDVAAVKPGTVLGHEGIGKIVEVGKDVKSHSVGDRVIVSPMSSCGVCRFCRANNNGHCLGDSEGPGGWRLGGLINGVQAQFARIPLADNSLHKLPSGLDPKVGILVSDVLPTGHEVGAQAGQVTLGSVVAVIGCGPVGLGAIVTSLLYSPSKVIAVDADSNRLELARKLGATDTVRVNRERPLDAIEDVKKLTEGGFGVDVAIEAVGVPVTFSMALGIAAPGGRVANIGVHGAPVDFPLQDLWDKNIAVTLGIVSTHTIPLLLAALSEGKIDASQFVTHEFDLSDLERAYDVFSAAAQHNVVKVAIRA

SEQ ID NO: 9655 - protein, 215 aa, Pseudomonas aeruginosa PAO1
MSEKNPIVGLCQKASFLISAAQVDQCPPDEGLEVAFAGRSNAGKSSALNTLTHANLARTSKTPGRTQLLNFFALDDSRRLVDLPGYGYAKVPIPLKQHWQRHLEAYLSSRASLAGVFLMMDIRHPLTDFDRLMLDWAQASQLPIHVLMTKADKLAFGAAKNALLKVRREVQQGWGDVATLQLFSAPKRQGVDEAQMVLAQWLGLLDEEQEAFEEA

SEQ ID NO: 9656 - protein, 320 aa, Schizosaccharomyces pombe 972h-
MINSKSKKKESNALVLKSLLREPYNKVCADCKRNEQPRWASWNLGVFICIRCSGVHRSLGVHVSRVKSVDLDSWTDEQTENMTRWGNERANLYWEAKLAGGHVPSDSKIATFIKTKYEFKKWVLYPEIPSPETLKPEQNTRPVSEVNASLDLNTASRSSSAHSVKSTSSATVTNVTSKKEAISATTSLAQSSPNLASLSKQPSTVHAPSTRQRDLKSSILSLYASPRPQVSSSSITTNATYQNLPSPVSTSTTSSQPYGAFHQPATTGSSFVADKWKMPMFTSNVTSAQPSARASPVQSNSSRPRSSLDSKIINSHDVWK

SEQ ID NO: 9657 - protein, 387 aa, Glycine max
  misc_feature (65)..(65): Xaa can be any naturally occurring amino acid
  misc_feature (103)..(103): Xaa can be any naturally occurring amino acid
MNALAATNRNFKLASRLLGLDSKLEKSLLIPFREIKVECTIPKDDGTLQSYVGFRVQHDNARGPXMKGGIRYHPEVDPDEVNALAQLMTWKTAVANIPYGGAXGGIGCDPAELSISELERLTRVFTQKIHDLIGTHTDVPAPDMGTGPQDLGGSLGRDAATGRGVLFATEALLNEYGKSVSGQRFVIQGFGNVGSWAAQLISNKGGKVVAVSDITGAIKNSNGLDIPSLLEHSKVHRGVKGFNGSDPIDPNSILVEDCDVLVPAALGGVINRENANEIKAKFIVEAANHPTDPEADEILKKKGVVILPDIFANSGGVTVSYFEWVQNIQGFMWDEEKVNNELKTYMTKGFIDVKEMCKTHECDLRMGAFTLAVNRVARATVLRGWEA

SEQ ID NO: 9658 - protein, 333 aa, Zea mays
HEFDVCPSVLLQGLESGTLSLISPTADIRPGFLPVFRSGSFADIGPKSFMEDEHVCVDNLVEHLGLRGPGIPAPGAFYGVFDGHGGSDAACFVRKNILKFITEDCHFPNSIEKAIRSAFVKADHAIADSQSLDRNSGTTALTVLISGRTLLVANAGDCRAVLGKRGRAFELSRDHKPSCSVEKLRIENLGGTVFDGYLNGQLAVARAIGDWHMKGSKGSACPLTPEPEFREVRLTEEDEFLIIGCDGLWDVMSSQFAVSMVRKELMEHNDPQRCSRELVQEALRRDCCDNLTVVVVCFSDDPPPQIEVPRFRVRRSISMEGLHTLRGALDSNV

SEQ ID NO: 9659 - protein, 1055 aa, Coccidioides immitis RS
MSTAASQASPVVVRNPATQHPHPSYRPPAADTPQRTRTSGGGAAQYSHSQSRSGSRSYGHDRSASNKGPPSGHPRRDYESLKAATAPRSASRDRTQEPNLPYRTDSRAHRRQSSKPTYSRNSTDMTGPSSGVADGYGSVHASHHPPNGSGITNQTRRRTTITASSGQWALGKTIGAGSMGKVKLAKNVETGEQVAVKIIPRHSTEEHRSTRESERADRSKEIRTAREAAIVTLLNHPYVCGMRDVVRTNHHWYMFFEYVNGGQMLDYIISHGKLKEKQARKFARQIASALDYCHKNNIVHRDLKIENILISKTGDIKIIDFGLSNLFSPKGQLKTFCGSLYFAAPELLQARQYTGPEVDVWSFGIVLYVLVCGKVPFDDQSMPQLHAKIKRGVVEYPQGLSSEDDCRNIISRMLVTDPKQRASLTEIMNHPWMTKGFSGPPENYLPHRDPLQLPLDSEVIRRMTGFDFGPPEFISAQLTKVIESEDYQSAVRAFVKEHHTPNPVNDKKRGVFDFYKRRNSTSKDTLSNTSLEAMPHGLDPANGYHPLIAVYNLVKEKLNREKQEVHPGGLAIPHSPGEAPVKFPDISAPEAAHTNQRSYEIPGERDTGGRSRPRARTHGDDEISEGIKNLKLAKPSGPASPAIVTPQIEQPPRKENAAVGLLRRLSTRRTRDKGREEKTTAHHAQTLNVQSPDSLPPPRKSFSMRRTRRGEASPATIHHGGSQPQQQEVSRGELSSRAINLLGRSTSVNSADFRSRKNPSRGGTDTLSPATAHDPPLTSGSDRSSLNVQRSKASDNANSDSRSGYKPQTLRTKSLGHARRESIQARRARREEAREANVPEETDAELAQASTNIENGTTAEESLKPVYLKGLFSVSTTSNKPLPFIRSDIIRVLRQLGVEYVEIRGGFSCRHAPSIDLKRVIDARPPSPEQQGMVAGHRRKISFGGLRGHEREENKDDAKSQQRSSRRHADQSFISNSDGSEDYAANREHNAGERVLGETTTRVQSDTGENLVLRFEILIVKVPLFSLHGIQFKKVSGGMWQYREMAKKILDALRL

SEQ ID NO: 9660 - protein, 685 aa, Oryza sativa Japonica Group
MDTPLLLLLPFLAACLLAPRHAAEAAVTSCAPRRCGNVTIAYPFWLPDSSPPPSSSSAPCGPAAFQVNCDNGSRASLARSFRSGYKILGVSYANRTVVVANDNVQTDASGCPVPKIDVSASLTLAPFTASPANSQLVFLFNCTSSSRPPPAGFVNVTCPGAKAVVRLDTSYNNTAARVVAGGCDYAAVPVVGVPGASPTDYPQLLRGGYMLEWRAPAGDCMACNASGGQCGYDADTEAFACICSDGSSRPGICGWLELTKGNAKKSGNKVILIVSLSICATGLVLLACIAIVYKCRRRMQNRFSFLNAMDGASRTDTAKVEKLLQSYGSLAPRRFRYSELKKITKSFSQRLGEGGYGTVFSGTLADGRAVAVKFLHHSKPNGEEFLNEVVSIGRTSHVNIVSLLGFCLEGSKRALVYEYMPNGSLDKYIYSTSAAAAAEAEEAEATASPDRDVLGWKVLQEIAVGVARGLEYLHDGCNTRIIHFDIKPHNVLLDEGFRPKIADFGMAKLCNPKESILSMADTRGTIGFIAPEVFSRGFGDISTKSDVYSYGMLLLEMVGGGSNVKAYAEKGASGTFFPLWVYDHLLEDGGVLQSVAAAAAATAGGGAGSPGGEEIARKMALIGLWCIQTVPANRPSMGKVLEMLERSVHELAMPPRPYHSNSSSPSRPSSYPSFASDFTQRSVSC

SEQ ID NO: 9661 - protein, 683 aa, Neurospora crassa
MSDHDPDHGPASPNEYDDESNPASPGSVDESSEASTPMDPPSSGSDAMPGFTPEGDLPRRVPSLRTISDPQHTNSMSPSSSVPGTLNAARRPAASAANLPTDLMAKARALHQQRMGMAPRPSMSPQNSGLGMGPMGSGMGGMGSMGGMGHSMNLNMNHGGPAPGGLPGGLRLPPGIARPPPQGFPKSAPAIAGLGAKKAPSLSERRAMKLGGLPGGPGSPVTATPKLSDMGAEDAKAPAINGEGRGSKLSDFKNYIDAEKGWITFADAATITRTGVNFANGQTFRISLDEVEVMDELGKGNYGTVYKVRHSKPKLPRFGQGLNTKQSLSRQASASDADVSDISPLSPVTAAARGISGKVMAMKEIRLELDESKFSTILKELVILHECASPYIIDFYGAFYQEGAVYMCIEYMDGGSIDKLYAGGIPENVLRKITYATIMGLKCLKEDHNIIHRDVKPTNILVNTNGQVKICDFGVSGNLVASIAKTNIGCQSYMAPERISGGGMSAAGGAAAGTYSVQSDIWSLGLTIIECAMGRYPYPPEVSSTIFSQLSAIVEGDPPGLPSEGYSGTAQDFVKSCLNKIPAKRHTYPMLLMHPWIKSLGRPETITEEVEAEEKAADDQLADATGSLDINSNGPINDQGDREVAEWVTNVLDRKLKGLLSDKAEKPALHAAPLDQVSPGIAA

SEQ ID NO: 9662 - protein, 158 aa, Haemophilus influenzae 86-028NP
MIRIGHGFDVHAFGEDRPLIIGGVEVPYHTGFIAHSDGDVALHALTDAILGAAALGDIGKLFPDTDMQYKNADSRGLLREAFRQVQEKGYKIGNVDITIIAQAPKMRPHIDAMRAKIAEDILCDIEQVNVKATTTEKLGFTGRQEGIACEAVALLIRQ

SEQ ID NO: 9663 - protein, 245 aa, Oryza sativa
  misc_feature (196)..(196): Xaa can be any naturally occurring amino acid
  misc_feature (201)..(201): Xaa can be any naturally occurring amino acid
HKIKFKRIPPKDLTGDWTRDAHNRIYTEKEAITEASRCMKCADSPCQKACSVGIDIRSFIYQIQNQNYYGAAKTILSDNPLGLSCGGLCPVSELCASTCNAFWLEGGTIEIGKLQEFACKVFKEMRVKQIRDPHLQPLDSKVAATKIALIGAGSASLSCAAFLGRLGYNNVHIYEKYDYSGGLVTREIPANRSNYXDVMWXIQMVEELGIKIHYNQEYGKDITEDSLKSDGYEIIFGRSGLTPPR

SEQ ID NO: 9664 - protein, 325 aa, Zinnia elegans
MVKAIRIHEFGGVEVMKWEDVEIGEPKAGEIKVQNKAIGLNYLDVYMRKGIVKEVPPFPFTPGMESAGVVIAVGPEVTTCKVGDVVAYAGYPVSAYAEEQILPADRAVPVPPSVDPVLAAAAIFKGLTAEMLVRRCFKVGPGHTILYHAAAGGVGSLACQWANALGATIIGTVSTKEKAVQAKEDGCHHVIIYKEENFVDRVMEITSGKGVDVVYDSIGKSTFQGSMECLKVRGYLVVFGMPSGAPEPPSFQQLAEKGIYCTMPSVMLYTKERNELVAASEELFSNIEKGVLRVRVNHKYPLSQAAQAHSDIESQKTTGSIVLIP

SEQ ID NO: 9665 - protein, 309 aa, Prochlorococcus marinus str. MIT 9515
MTATNLKNRNSNWTISDIPNLDGKTVFITGANSGLGYYTAKALAEKNAHVVLACRTLEKANSALHKLKSLNPEGKFTPIELDLADLNKVSEIGSKISTEFEKLDLLINNAGIMHPPKTLSPQGFEIQFAVNHLAHMLLTLKFLPLIEKQKGSRIVTVTSGAQFFGKVGWNNLKAENYYNKWESYANSKLANVMFALELNEKLEQKHILSLAAHPGIAKTNLFSAQKPKPNPIEIFSLELFSPIFQSAEMGALPQLFAATSPQAKGGEHYGPKFNFRGHPKLSPASPFATNKKERKSLWEKSMEILSNFL

SEQ ID NO: 9666 - protein, 630 aa, Schizosaccharomyces pombe 972h-
MGINTSSAQSSGAASIARSSVNVKSGNRHLSSNKKSATSALEERASRPSILVTFLVLAGTILSLYIWPILSPDLFFANQRCSFKYKNKGSQRVVVEGKNGVVATEEETCSQIGVGILKAGGNAVDAAIASGICIGAVNSFSSGIGGGGFMLIRHPNGTAHSLNFRETAPAGASKNMFHGNSTLSQVGGLSVAVPGEIAGYERAWKMYGSLPWHKLFEPTIRLMRDGMPMPKELASRIRRPEFSYFKTHPDWSKIFAPEGVFLHVGEKFYRPALASTLEEIAKFGPEVFYTGKIAERLVKFVQQQGGILTMEDMANFSVVVEEPIYGNFYDREVITCGSPCSGEALILGLNVLSKVDLSEGTSILGCEMTDIGVHHLIETMKWMSAGRTVLADPTFYNNTDHVEQLLSLEYADEIRNNISNERTFDFTHYKAEYDFPNDHGTTHLSVIDKDNMAVGLTASINLMFGSQLLEPETGIILNDHMDDFASPGIVNAFGLSPSPYNFIAPGKRPQSSAVPTILVYNGEVEMVLGGSGGSRIVTAVLDTIIKKYKWGKSLLESVESPRFHHQLMPNIVYIDETVEIEVLRALEKFGHIVDLIPVQYPFSEIQAVFRTNGTLYGLSDSRKQAVAAAY

SEQ ID NO: 9667 - protein, 133 aa, Triticum aestivum
YVRYGGGANELSAGYSKGTGLAAEIIGTFVLVYTVFSATDPKRNARDSHIPVLAPLPIGFAVFMVHLATIPITGTGINPARSLGAAVIYNKDKAWDDQWIFWVGPLIGAAIAAAYHQYVLRASAAKLGSYRSN

SEQ ID NO: 9668 - protein, 379 aa, Staphylococcus aureus subsp. aureus COL
MIYLDNAATTKAFEEVLDTYLKVNQSMYYNPNSPHKAGLQANQLLQQAKTQINAMINSKTNYDVVFTSGATESNNLALKGIAYRKFDTAKEIITSVLEHPSVLEVVRYLEAHEGFKVKYVDVKKDGSINLEHFKELMSDKVGLVTCMYVNNVTGQIQPIPQMAKVIKNYPKAHFHVDAVQAFGKISMDLNNIDSISLSGHKFNGLKGQGVLLVNHIQNVEPTVHGGGQEYGVRSGTVNLPNDIAMVKAMKIANENFEALNAFVTELNNDVRQFLNKYHGVYINSSTSGSPFVLNISFPGVKGEVLVNAFSKYDIMISTTSACSSKRNKLNEVLAAMGLSDKSIEGSIRLSFGATTTKEDIARFKEIFIIIYEEIKELLK

SEQ ID NO: 9669 - protein, 339 aa, Methanococcus maripaludis S2
MRNTPKICVINGDGIGNEVVPETVRVLNELGDFEFIHAHAGYECFKRCGDAIPENTIEIAKESDCILFGSVTTPKPTELKNKSYRSPILTLRKELDLYANIRPTYNFDNLDFVIIRENTEGLYVKKEYYDEKNEVAIAERIISKFGSSRIVKFAFDYAVQNNRKKVSCIHKANVLRVTDGLFLEVFEEMSKHYEKLGIKSDDYLIDATAMYLIRNPQMFDVLVTTNLFGDILSDEAAGLIGGLGMSPSANIGDKNGLFEPVHGSAPDIAGKGISNPIATILSAAMMLDHLKMNKEAEYIRKAVKKTVECKYLTPDLGGNLKTFEVTEKIIESIRSQMIQ

SEQ ID NO: 9670 - protein, 603 aa, Zea mays
  misc_feature (10)..(10): Xaa can be any naturally occurring amino acid
  misc_feature (25)..(25): Xaa can be any naturally occurring amino acid
  misc_feature (71)..(71): Xaa can be any naturally occurring amino acid
  misc_feature (178)..(178): Xaa can be any naturally occurring amino acid
MASISGAAAXRHLPPCAGFGCAGTXAPALPPPPPRAPLHRRPLPLLQFRPEPGPPSAGLRPGERQRRRPRXVEKDPIKLWERYVEWLYQHKELGIFVDVSRMGFTEEFLRQMEPRMQQAFVDMRELEKGAIANPDEGRMVGHYWLRDPALAPNSFLRNKIETALDRILAFSQDVVSGXGIGGSALGPQFVAEALAPDNPPLKIRFIDNTDPAGIDHQIAQLGPELATTLVIVISKSGGTPETRNGLLEVQKAFRDAGLQFSKQGVAITQENSLLDNTARIEGWLARFPMFDWVGGRTSEMSAVGLLPAALQGIDIKEMLVGAALMDEETRNTVVKANPAALLALCWYWASEGIGKKDMVVLPYKDSLLLLSRYLQQLVMESLGKEFDLDGNRVNQGLTVYGNKGSTDQHAYIQQLREGVQNFFVTFIEVLRDRPAGHDWELEPGVTCGDYLFGMLQGTRSALYANDRESISVTVQEVTPRAVGALIALYERAVGIYASLVNINAYHQPGVEAGKKAAGEVLALQKRVLTVLKEAICENPTEPLTLDEIADRCHCPEDIEMIYKIIQHMAANDRALIAEGSCGSPRSVKVYLGECSVDEDMQAA

SEQ ID NO: 9671 - protein, 167 aa, Arabidopsis thaliana
MATDDVNEPLPAAAELPATEAEKQPHKLERKWSFWFDNQSKKGAAWGASLRKAYTFDTVEDFWGLHETIFQTSKLTANAEIHLFKAGVEPKWEDPECANGGKWTWVVTANRKEALDKGWLETLMALIGEQFDEADEICGVVASVRPQSKQDKLSLWTRTKSNEAVLV

SEQ ID NO: 9672 - protein, 417 aa, Orychophragmus violaceus
YHHSFTFFLLVIFVLFRHVISINTLSPNEALTISSNQTIASPNDVFELGFFKTTSSRDGTDRWYLGIWYKTTSKRTYLWIANRDNPLYNPNGTLKFSHANLVLLTYFDIPVWSTNLTTTFKSPVVAELLDNGNFVLKDSKTKDSNRFLWQSFDFPVDTLLPEMKIGRNLKTGNDRYLTSWKSPTDPSSGDHSFKLETKGLPEFYLWQEDFIKYRSGPWNGIQFNGIPAMQNWSHIINSLIENREEVVYTFQDLNQNIHSRFRISSGGSLQVITWTSTVPQRNMFWSLVEDECDIYNRCGPYAYCDMNTRPTCNCISGFLPKNATAWASGDMSYGCVRKTLLSCGKGDRFLKLRQMKLPETSGAIVDKRIGLKECEERCVRDCNCTGFANTDVWNGGSGCVIWTGEAGELIDMRNNVV

SEQ ID NO: 9673 - protein, 451 aa, Vitis vinifera
MASPPDTSKTTKLERYNSYIRRVNSTKLMAASSKLLFRATLLVALVLIFFFTLNYPPLSDNPHHVLTHQNFLSSAFYGSGASWEKQVRHSSTPRRPNGFSVLVTGAGGFVGTHCSLALKKRGDGVLGLDNFNDYYDPSLKRARQAMLSKHQIFIVEGDLNDAPLLSKLFDMVPFTHILHLAAQAGVRYAMQNPQSYVRSNIAGFVNLLEIAKAADPQPAIVWASSSSVYGLNTENPFSELHRTDQPASLYAATKKAGEEIAHTYNHIYGLSLTGLRFFTVYGPWGRPDMAYFFFTKDILQGKPITIYQTQDDKEVARDFTYIDDVVKGCLGALDTAEKSTGSGGKKRGPAQLRIYNLGNTSPVPVGRLVGILEGLLNVKAKKHVIKMPRNGDVPYTHANVSLAYRDFGYKPSTDLATGLRRFVKWYVSYYGIQTRVKKETLKRSDQLEESD

SEQ ID NO: 9674 - protein, 410 aa, Erysimum cheiri
YYHSFTFFFFFVVLVLFPHVFSINTLSSTETLTISSNQTIVSPGNVFELGFFKITGDRWYLGIWYKAISERTYVWVANRDSPLPSSSGTLKISYANLVLLDHSDTPVWSTNVTKPVKSPVVAELLDNGNFVLRDSESNDRNRFLWQSFDFPADTLLPEMKIGRNLKTGHESFLRSWRSPYDPSSGDFSFKLQIHGLPEFYLYEKDFILYRTGPWNGVGFSGIPTMQNWSYFHFVNNFIENREEVAYSFKVTNKTLPSRFTMSSEGSLQMLAMSTTSEWNLFGVLPIEECDLYQICGSYSYCDMKTSPVCNCIKGFYPKNVTAWALGETFDGCVRKSRLSCRGDGFLLMKRMKLPDTSTSIVDKRIGLNECKERCSKDCNCTGFANKDIRNGGSGCVIWTGELRDMRNYVT

SEQ ID NO: 9675 - protein, 646 aa, Gibberella zeae PH-1
MTGTNTRTLLRVLILFFIAGAAISSRLFSVIRFESIIHEFDPWFNFRATKYLVANGFYNFWDWFDDRTWHPLGRVTGGTLYPGLMVTSGVIYHALRTLTVPVDIRNICVLLAPAFSGLTAYAAYLLTNEMTTTSSAGLLAAAFMGIAPGYISRSVAGSYDNEAIAIFLLVFTFYLWVKALKKGSMVIGGFCALSYGYMVASWGGYAFITCLLPVHAFTLICMGRYSDRLYLSYTAWYVAGTLASFQIPFVGFLAVKTNEHMPALGVFGLLQVIAFILFVKRVIPGRQITTVVIAAGVATCMIGLAGLILLTSLGYIAPWGGRFYSLFDTGYAKVHIPIIASVSEHQPTAWPSFFFDMNFLIWLFPAGVYMCFQNLRDEHVFVVVYAMFASYFAGVMVRLILTLTPVVCVAAAIAASQLLETYMQIEQPDAAAETKSEGSESSKKNKGALRALSKPSVGIYTVMSKVLVVGAMAIYLVMFVTHCTWVTSNAYSSPSVVLASRMPDGSQHIIDDYREAYQWLRQNTEKDDKVMSWWDYGYQIGGMADRPTLVDNNTWNNTHIATVGKAMSSREEVSYPIMRQHEVNYVLVVFGGLIGYSGDDINKFLWMVRIAEGIWPDEVKERNFFTARGEYKVNEEATETMKNSLM

SEQ ID NO: 9676 - protein, 285 aa, Porphyra yezoensis
MLTNSERVKVLSEALPYIQQFSSRIIVIKYGGAAMKNQKLKDQVISDLVFLSFIGLRPILVHGGGPEINFWLDRLKILPKFDDGVRVTDQPTMDIVEMVLVGRVNKDLVATINKQGGKSVGLSGKDGLLITPRPNGKANLGFVGEVQNIDTKLLKILINNNYIPVIASVAADKEGQSYNINADTVAGEIAARLSNAEKLILLTDTPGILRNSSDPSTLISHLNIQEARDLTQTAVISGGMIPKVNCCIRSLAQGVASAHILDGRIDHALLLEILTDQGIGSMLVV

SEQ ID NO: 9677 - protein, 401 aa, Picea sitchensis
MAMAFRCAYLPTWETQLLSSPDDGSCRRTKFAVTNALWTTRKTKPVFDPLKLPTVQRSGDLGTALLDRLERIYKEGMPGNNDGLLPMEPLWAGPLFQGKPMRVAYQGVRGSYCQEAAVRAFQRCDALPCEGGMDSAFEALESNDADRAVVPVENSLDGVIERNYDLMLRHPDLHVVGELLLPINHCLLAVRGAGKRSPAVKTVVSHPQALAHCQQRLVALGVQVEAVDNAARAARFVAENRLDDTAVIGSEIAGREYGLQVLEEEIQDDSSNTTRFLILSKPNNKNNNSSALPGSKTTVAFSLKEGTADLFKALSIFAVRDIEVTKIESRPQRKNPLRLVMNEEQDGGSSKCYFEYVFFVDLEEPATDDNPSSVKRALDQLRQISSFVRIVGSYSTISIVS

SEQ ID NO: 9678 - protein, 146 aa, Chlorobium tepidum TLS
MIARLVDRADFMEAQEHFARNIVIGFARIQGRSVDIVANQPAVMAGELDIDASDKTARFIRFCNALNIPLVTLVDVPGFLPGVEQEYGGIICHGAKMLFAYSAATVPKFTVVMRKAYGGAYLAMSLDILHSKREFRPQNKHGLIPL

SEQ ID NO: 9679 - protein, 131 aa, Vitis vinifera
MKENPMTTIYLMLLLLHAHLSICNGLVSVSVVGLNSVKNNEIEAIPKRDCGGEVGQCLGEEMDWEWEISSRRVLVMQKKYISYETLKKDMIPCARPGASYYNCRASGEANPYNRGCEVITGCARGVRDINS

SEQ ID NO: 9680 - protein, 527 aa, Picea sitchensis
MQGAHLLLEEPIRMASILEPSKANFFHAMTKIVGTLGPNSRSVEVIEGCLKAGMSVARFDFSGGDNDYHQETLENLKIAVKEIKKLCAIMLDTVGPELQVFNRSEEPIVLEIDAFVTLTPDQSKEASSEVLPINYAGLAKTVTKGDTIFVGQYLFTGSETTSVWLEVAEIKDQDVVCCVKNSATLAGALFTMHISQVHIDLPTLSDTDKHVIATWGVRNNIDFLSLSYTRHAEDIRQTRAYLDELGNLQQTQIFAKIETIEGLEHFDEILQEADGIILSRGNLGIDLPPEKVFLFQKAAVHKCNMAGKPAVVTRVVDSMSGNLRPTRAEATDVANAVLDGTDAILLGAETFRGLYPFETISIVGKICAEAEKVYNQAVYFKRTMKHSNEPMSHLESIATTAVSAAINVKASVIVVFTASGRTARLIAKYRPTMPVLSVVIPRLTTNQLRWSFTGAFQARQTLIVRGVFPMLADPRHSAESINATNESVLEIALDHGKTAGLIKPHDRIVVCQKVGDSAVVKILELED

SEQ ID NO: 9681 - protein, 189 aa, Vibrio campbellii AND4
MSSIRSYKGIRPQLGKRVYVDSTAVLVGDIQIGDDSSVWPFVAARGDVNHIHIGDRTNIQDGSVLHVTHKNADNPNGHPLIIGNDVTIGHKVMLHGCEIHDRVLVGMGTIVLDKVVIESDVMVGAGSLIPPGKRLESGYLYVGSPVRQARPLSDKERAFLQKSADNYVQNKNDYINEGEAINEHSDIVN

SEQ ID NO: 9682 - protein, 262 aa, Streptococcus pyogenes MGAS8232
METKYAFARQIIKEAGLFIKSKMSEQLDIQVKTQFDDLVTNVDQETQQLLMDRIHQTYPCDAILAEENDVRHPINQGNVWVIDPIDGTVNFIVQGSQFAVMIAYYEQGIGQFGLIYDVMADQLLAGGGDFEVTLNGDKLPAYQEKPLERSLIGCNAGMFARNDRNLAHLISKTLGVRVYGGAGICMVKVMKQELLAYFSFIQPWDYAAAKVLGDKLGYVLLTIDGYEPDFQTRQKIMFVPKCQLTRIASFLTKDSAVTLEDQ

SEQ ID NO: 9683 - protein, 403 aa, Pseudomonas syringae pv. syringae B728a
MDTSFWKAGHKPTLFAAFLYFDLSFMVWYLLGPLAVQIATDLQLTTQQRGLMVATPILAGAVLRFFMGLLADQLSPKTAGIIGQVIVIGALLAAWQLGIHTYGQVLVLGVFLGMAGASFAVALPLASQWYPAQHQGKAMGIAGAGNSGTVLAALIAPVLAASFGWSNVFGLALIPLVLTLIAFTLMARNAPQRSKPKSMADYLKALGDRDSWWFMFFYSVTFGGFIGLASALPGYFNDQYGLSPITAGYYTAACVFGGSLMRPLGGALADRFGGIRTLTVMYAVAAIGIAAVGFNLPSSWAALALFVAAMLGLGAGNGAVFQLVPQRFRKEIGVMTGLIGMAGGIGGFLLAAGLGTIKQNTGDYQLGLWLFAGLAVLAWFGLLNVKRRWRTTWGSAAVTAARV

SEQ ID NO: 9684 - protein, 428 aa, Ustilago maydis 521
MAQQLDAKALIVDEACGPFKLVDLKLDLGNLKPDEVIVRYHHTGVCHTDIHSRSHATPQLLPAIYGHEGAGVVEHLSPSYSGALKVGDSVLASFCSCGGCNNCQSSRPAYCDIFVPMNLAGFTKDMQQARVAYTAQDGSKGEALIKYFGQSSFSSRMIFLDFSHLCGSTLTSTLTFHMQLTKVSSNVPTKLVCALACGFQTGFATVFEKAPSDQPRSFELFESVGVPVPASARSSSRYERSKQTLLVTGMGGVGLGAIFGGKTLGFGSIIACDLNDSRLELAKEIGATHAINVKGLDTAAFAAKVKECSADSRGASLAIEASGSPIAMRNVIMALAVGGRSVVVGAPPPEAPLPVPHAHILAQASSVEGLLMGNSMPQVTLPFLVSKLEAGELAFLQKMVAVYKPDEMNQAVADQESGKVIKPVIEWI

SEQ ID NO: 9685 - protein, 252 aa, Cryptococcus neoformans var. neoformans B-3501A
MSVYVGESRGELLAWLNDLLAPTVVTKLEQCGTGSVYCQIIDSIYGDLPMSRVKFNARMEYEYLDNFKILQKAFTRHKIEKPIPVDRLIKCKMQDNLEFLQWMKKYWDMHSRGEGYDAQARAGGHIAGVRASTSRPTAARTRPAPAMAGSRTVSSASQQANSAQVAAMQARVAEIEAHSEGLLKERDFYFDKLRNIELIVQERLAVEGITPEESDVMTKIQDILYATIEGFEVPQEEDFIEEQPVEGEEETF

SEQ ID NO: 9686 - protein, 482 aa, Synechococcus sp. RS9916
MLEALAHQHLKHLLQRDQSTWPHHLTLSRLIARGLRRRDQALFQLVPGSQEQWWLGVLVPLCLQSRRAVLVLEEPLQKRLLQLELPRLRDAGFKLACWTAETPPEGDQLWVLSTARLVQAHQRGLLNADHQLVIPEAEHFSQRLREALSITIGPGDWEQLRQAHPCADAALLDLHERLSRRLFSQAPRCDAQVRLDGSELQALNDLVRMLGPLPDPWPKLLDTHGDRWVSWAALDHRLLQWQWHLDVLEPLQELQTLLQGQPNLLISANGQADQLQQELEATGVELDVCVHLREPSLLEPLPLFAPRRQPLPNSEIFAEHLLDQARRLILGRAGLTVVLLNDDALRHRLTSELAGEFGSRVIHETTGPDSNGVICCRWEWWHHHHHQLPLPEQLIVALLPLASLESPLTAARVEALKRQGRDWFRELLLPEALSQLAPAVSPLRRNGGRLAILDGRVRSRSWGEQVLTALQPWTPLQRLLPQ

SEQ ID NO: 9687 - protein, 420 aa, Vibrio parahaemolyticus RIMD 2210633
MLKYFFKVKESYQDTVICHVNIDTFVGQECFVHTITGERIRGEIVKVTGSKLEIKLLQPGSVQRGGKVEITPRRFCFPLNESALVGKVINCYGETLYGDSYLGQPGEFIDLPIAVEPIPLQMRAPIETVFPTKLKIIDGLFTIGEGQRLGLFAPAGAGKTTTVSIMANNMDADVVIFAMIGERAREVVEFLEGEIGPEVIRKSITIVSTSEANPLEKVRSGLVAVSIARYYMEQGKKVVLYFDSLTRFARAQAMLDGTPIKGGIPIGVSLALSRLVESCGNSIQGSVTGIFTVLIEKEIDDDPIAHEVKSLIDGHLVYSTTIAATGRYPAIDVLKSKSRLQNKVQEKYYVRLSEKIKDMVYRYFNVELLIRVGEYEKGNDLETDEAIERYPKIIEFLKQGFEGVEYEETLQEMERIWSNY

SEQ ID NO: 9688 - protein, 361 aa, Oryza sativa Japonica Group
MKALILVGGFGTRLRPLTLSVPKPLVDFGNKPMILHQIEALKEVGVTEVVLAINYQPEVMLNFLKDFESKLGIKITCSQETEPLGTAGPLALARDKLADGSGDPFFVLNSDVISEYPFAELIQFHKSHGGEATIMVTKVDEPSKYGVVVMEDETDKVERFVEKPKVFVGNKINAGIYLLNPSVLDRIELKPTSIEKEVFPRIAADNGLFAMVLPGFWMDIGQPRDYITGLRLYLDSLRKKAPAKLASGAHVLGNVLVHETAVIGEGCLIGPDVAVGPGCVVEAGVRLSRCTVMRGARVKKHACISSSIIGWHSTVGMWARVENMTILGEDVHVCDEVYSNGGVVLPHKEIKSSILKPEIVM

SEQ ID NO: 9689 - protein, 535 aa, Gibberella zeae PH-1
MGAQQSSETSNAEGSAPVAKTCYYELLNVERSATDDEIKRAYRRKALELHPDRNYNDVENATRRFAEVQTAYEILSDPQERAWYDSHRDAILSGRDADGDGGNPTTFRNVRLTSAEEIMGLIRKFNAAVPFDDEPTGFYGICRETFEHLALEEEVAADNDDLGVRDYPIFGSSDDDYEDVVKPFYNAWAGFSTVKSFAWKDKYRLSDAPDRRVRRLMEKENKKMRDDAIREFNDAVNFLVSFVRKRDPRYLPNSQTHDERQASLRNAAAAQAARSRAANQERMSAFEIPEWAQARSDENGVEGDFSESEEESEVEILECVVCNKTFKSEKQLEAHEKSKKHTKAVQQLRRQLKREGAELQLDEASPQSQETANQDGQGGDTTSSKYKEMEDEDEGGPIPVEQAAPSANDGLQEGVAAHSTDASDDTDYAPRDIVEERIANASKYKSDGNKTNEDKLSESVQNLSVDEPAQGKKVGKAKAKRAKKAAAAQTQQEISPQCGYCGESFTSRTKLFAHIRDEGHAALKPVTGGNGKKKR

SEQ ID NO: 9690 - protein, 240 aa, Synechococcus sp. RS9916
MLEAEQMGLAALHAAADPADLVVPEPLALLVDSAGSALLVLPWLEQQSGDQQALGRGLARLHRRSLAQGCGRFGWATDGFIGLGPQPAGWRDHWGEAFVELRLRPQLQLARSWGLSLAPLESWLARLAELLDQHGAEPVLVHGDLWGGNAGVLGDGRGLLIDPASWWADREVDIAMTHLFGGFSRSFYTAYEQEWALAPGASDRVAIYNLYHLLNHANLFGGGYQQQSRQAIRHLQQQFG

SEQ ID NO: 9691 - protein, 353 aa, Oryza sativa
  misc_feature (231)..(231): Xaa can be any naturally occurring amino acid
  misc_feature (252)..(252): Xaa can be any naturally occurring amino acid
  misc_feature (265)..(265): Xaa can be any naturally occurring amino acid
  misc_feature (281)..(281): Xaa can be any naturally occurring amino acid
  misc_feature (304)..(304): Xaa can be any naturally occurring amino acid
MSITSASRRAGAAALPILRRIGGAFRRPFSSEPDPASSPGYHVAGGPSFMRGAVFWEPGRPLTLEDFRMPRPKAGELLIKTKACGVCHSDLHVLKGELPFSSPCVVGHEITGEVVDHGTHTPAEIINRFPVGSHVVSAFIMPCGNCFYCVKGQEDLCESFFAYNRAKGTLYDGQTRLFLRSNGKPVYMYSMGGLAEYCVVPANALAVLPNSLPYTESAILGCAVFTAYGAXLRHAAEMRAGDSVTVIGVGGXGSGWLQIAQAFGXSRVIAVDVLDRNSECXTLGATLTGNAAKKKQVEKIREYXGKGGGVDLGEALGEGFGIFFSAPKGFPRGGKAVLIGPLGPQRGGGGGGE

SEQ ID NO: 9692 - protein, 957 aa, Hordeum vulgare subsp. vulgare
  misc_feature (467)..(467): Xaa can be any naturally occurring amino acid
MKIPFVTKWSHRSSEPAGPSNSAAAQQQQPPPLSPSAPSRSPPVASTEAAGDEFILQEEEYQMQLALALSASASGAEGAGDPDGEQIRKAKLMSLGKGDPVTNSDLGGGYTAESLSRRYRDYNFLDYNEKVIDGFYDIFGPSAESSGHGKIPSLAELHMSIGDLGYEVIVVDYKFDNALQEMKEVAECCLLGCPDITVLVRRIAEVVADHMGGPVIDANEMITRWLSKSIEQRTSHQTSLLHIGSIEIGLSRHRALLFKILADMVGIPCKLVKGSHYTGVVDDAINIIKMDNKREFLVDVMAAPGTLIPADVFNSKGTPFNFSQTLGQNQVVESASNIEDDPVALQSEHEHYQGHMFANNDRVSDNLSSYENTMTAGSSASEPGTLGKASTLAGAPSKQKKNLQLIPDSHEIDESRNLFAEFDPFNATESGKSSLAFKGLNNRNSDFRRRRENVVPPSARSQQPLVXKNWSACNDISNNKQYNVADGSVPRRNATDNASSSQLALSTAKHYNPNVRELNDRMYAAPARNYDNRIIGTSAMAKASTGDCLDRSQVPPGLYYDKMLGTSSMNTASSSGIGKVAEKDLQNDLEKGPIYSRFDGELSKNAQGFTPERDEHKENCGSYDHRMLHPDPRKSPLDRFMDRPRQNIECVSPSQVGSSKVDLVLDEVSECEILWEDLVIDERIGIGSYGEVYHADWNGTEVAVKKFLDQEFYGDALEEFRCEVRIMRRLRHPNIVLFMGAVTRPPHLSIVSEYLPRGSLYKIIHRPNCQIDEKRRIKMALDVARGMNCLHTSVPTIVHRDLKSPNLLVDDNWTVKVCDFGLSRLKHSTFLSSKSTAGTPEWMAPEVLRNEQSNEKCDIYSFGVILWELATLRKPWHGMNQMQVVGAVGFQDRRLDIPKEVDPIVASIIRDCWQKDPNLRPSFIQLTSYLKTLQRLVIPSHQETASNHVPYEISLYR

SEQ ID NO: 9693 - protein, 335 aa, Schizosaccharomyces pombe 972h-
MQQTYKPNTSALKDGAPKATVDQKQLLPCKYRVGRVLGGGTYATVREAVHIETNKMYAAKIMNKKMMEKKQDFVKNEIAILKRVSYEHPNILHLVDFFETVNNLYLITELATGGELFDRICAKGSFYEADAAALMRTTTSAVKYLHDNGIVHRDLKPENLLYRSKDPNSDLLIADFGLSHFYEDSQYYMLMTACGTPEYMAPEVFRRTGYGKPVDMWAIGVITYFLLSGYTPFARPSQVEVIEAILANEYTFNDPCWSGISETAKDFIKKCLENDPSKRLTAADALKHPFLSEKRPATSNLLPNVRENFNARKTFRTAYNAVRAFNTWKKLENKH

SEQ ID NO: 9694 - protein, 152 aa, Brassica napus
KFDLTMTTERRELPTSFKLYTGSAWIMLTKSFLEYCIWGWDNLPRNLLMYYVNFISSPEGYFQTVICNSDDFRGTAVGHDLHYIAWDYPPKQHPLILSMKDFNRMVKSGAPFARKFPKDDKVLDKIDRELLHRSEGWFTPGAWCDGSSEGGA

SEQ ID NO: 9695 - protein, 302 aa, Xanthobacter autotrophicus Py2
MSEPVMNEPLSTQVSEAQLQAEVLAKALPHMQRYDDAIVVVKYGGHAISGEEGARTFAQDIVLLEQSGVNPVVVHGGGPQIGAMLAKLGIKSEFAAGLRITDKATVEIVEMVLAGSINKQIVGFINEAGGKAIGLCGKDGNMVRARKANRVVVDNDHVVDLGFVGEPDTVDTTVLDQILGRELIPVLAPVAAAVDGGTYNVNADTFAGAIAGALGAKRFLLLTDVPGVLDKNKQLLPKLTIAEVRALIADGTISGGMIPKVETCIYALEAGVEGVVILDGKVPHAVLLELLTDHGAGTLITR

SEQ ID NO: 9696 - protein, 340 aa, Crocosphaera watsonii WH 8501
MFGLIGHLTSLEHAHSVADAFGYGPYATQGLDLWCSAPPQFVEQFHVTSITGQTIEGKYIESAFLPEMLMKRRIKAAIRKILNAMAFAQKNDLNITALGGFSSIIFEEFNLKGNRQVRNVSLEFDRFTTGNTHTAYIIARQVEQASAKLGIDLSRATVAVCGATGDIGSAVCRWLDRKTDTQELLLIARNQERLQRLQDELGRGKIMGLEEALPEADVIVWVASMPKGVEINPETLKKPCLIVDGGYPKNLDTKIKHPDVHILKGGVVEHSLDIDWKIMETVNMDVPSRQMFACFAEAILLEFEQWHTNFSWGRNQITVTKMEQIGGASVKHGLQPLLSW

SEQ ID NO: 9697 - protein, 484 aa, Nostoc punctiforme PCC 73102
MHLNELETTENLKEVEEAWLTLEKSILYYQGRPVGTVAAYDASVEALNYDQCFVRDFVSSALIFLIKGRTDIVRNFLEETLKLQPKEKALDAYKPGRGLIPASFKVVSENGQEYLEADFGEHAIARVTPVDSCLWWIILLRAYVVATEDFSLAYQPEFQNGIRLIMEICLANRFDMYPTLLVPDGACMIDRRLGIYGHPLELQVLFYTALRASRELLVCQGNSDIVAAIDNRLPLLCAHIRQHYWIDINRLNEIYRFKSEEYGKGAVNLFNIYVDSVPYYELDKWLPKKGGYLAGNVGPSQLDTRFFSLGNLMAIISDLATEEQAQAIMTLIEDRWDDLVGDMPMKICFPALEHEEYRIVTGCDPKNIPWSYHNAGSWPVLMWMLAAAAVKTNKISLAQKAIQTAQGRLSTDQWPEYYDGKKGRLIGKQARKYQTWTITGFLLAKELMANPTYLPLISFGKLPAEQVSRACEFEIASVDPYMPR

SEQ ID NO: 9698 - protein, 279 aa, Brassica napus
  misc_feature (50)..(50): Xaa can be any naturally occurring amino acid
MTETVWIMMWLPWVVMGLFVLKWLLKRVNVWIYGSKLGEKRHYLPPGDLXWPFIGNMLPFLRAFKTSDPDSFIRTYITRYGHNGVYKVHMFGNPSVIVTTPETCRKVLTDDDCFQPGWPKSTMELMGKKSFIGISFEEHKRLRRLTAAPVNGHEALSVYIKYIEETVVTALENWSKMGEIEFLTHVRKLTFRIIMYIFMSTESEHVMDALEREYTNLNYGVRAMAINIPGFAYHKALKARKKLVAAFQSSVNNRRKHRKQNVTTSSKKDMLDNLIDAKD

SEQ ID NO: 9699 - protein, 386 aa, Staphylococcus aureus subsp. aureus COL
MYYHQPLLLTPGPTPVPDAIMREIQAPMVGHRSKDFEDIAQQAFQGLKPIFGSQNDVLILTSSGTSVLEASMLNIVNPEDHFVVIVSGAFGNRFKQIAQTYYKNVHIYDVTWGEAVDVKDFINFLSTLNVEVKAVFSQYCETSTTVLHPIHELGNAINQFNSNIYFVVDGVSCIGAVDVDINKDKIDVLVSGSQKAIMLPPGLAFVAYSHRAKEHFKEVTTPKFYLDLNKYISSQADNSTPFTPNVSLFRGVNAYVETVKAEGFNHVIARHYAIRNALRSALKALDLTLLVNDKDASPTVTAFKPNTNDEVKIIKDELKNRFKITIAGGQGHLKGQILRIGHMGKISPFDILSVVSALEIILTEHRKVNYIGKGISKYMEVIHEAI

SEQ ID NO: 9700 - protein, 373 aa, Solanum tuberosum
  misc_feature (262)..(262): Xaa can be any naturally occurring amino acid
  misc_feature (328)..(328): Xaa can be any naturally occurring amino acid
MVDANMGGAQFPDFPKIVTHGGQYVQYDIFGNYFEITNKYRPPIMPIGRGAYGIVCSVFNAELNEMVAVKKIANAFDNYMDAKRTLREIKLLRHLDHENVIGLRDVIPPPLRREFSDVYIATELMDTDLHQIIRSNQGLSEDHCQYFMYQLLRGLKYIHSAHVIHRDLKPSNLLLNANCDLKICDFGLARPNLENENMTEYVVTRWYRAPELLLNSSDYTAAIDVWSVGCIFMELMNRKPLFAGKDHVHQIRLLTELLGTPXESDLSFLRNEDAKRYVRQLPQHPRQQLATVFPHVNPLAIDLVDKMLTLDPTRRITVEEALAHPYLXKLHDAADEPVCPIPFSFDFEQQGIGEEQIKDMIYQEALALNPEYA

SEQ ID NO: 9701 - protein, 186 aa, Acinetobacter radioresistens
LINTEVKPFKATAYQNGQFIEITEADLKGKWSVFFFFYPADFTFVCPTELGDLADNYAEFKQLGVEIYSVSTDTHFTHKAWHDSSEEIKKIEYPMVGDPTWTLAKNFEVLIEADGLADRGTFVIDPEGKIQIVEINAGGIGRDASELLRKVKAAQYVHAHPGEVCPAKWKEGDATLAPSIDLVGKI

SEQ ID NO: 9702 - protein, 310 aa, Methanococcus maripaludis S2
MFKTEPFIEESIEEIRKQINNRKTIIALSGGVDSAVAAVLTDRAVGDKLLAVYVDTGLMRKNESEEIWKIFKEQMGLNLKIVEAKDIFLKELEGVIDPEEKRKIIGRLFIEVFEKVAEEQGEEVLVQGTIAPDWIESEGQIKTHHNIALPGGMVLDVVEPLRELYKDEVRLLAVALGLPDQIAHRQPFPGPGLAVRILGEITDEKLAICKEANFIVSEEIEKTELKNELWQYFAAVLDTKATGVKGDIRDYNWVVALRFVSSLDAMTAHTPEIPFDLIKKISKRITSEIPNVTRVVLDVTDKPPATIEFE

SEQ ID NO: 9703 - protein, 657 aa, Saccharomyces cerevisiae YJM789
MSDNGSPAVLPKTEFNKYKIGKVKSTPAIQRDAKTNLTYIKLRKRSSEKVYGCTVFQNHYREDEKLGQGTFGEVYKGIHLETQRQVAMKKIIVSVEKDLFPITAQREITILKRLNHKNIIKLIEMVYDHSPDITNAASSNLHKSFYMILPYMVADLSGVLHNPRINLEMCDIKNMMLQILEGLNYIHCAKFMHRDIKTANILIDHNGVLKLADFGLARLYYGCPPNLKYPGGAGSGAKYTSVVVTRWYRAPELVLGDKQYTTAVDIWGVGCVFAEFFEKKPILQGKTDIDQGHVIFKLLGTPTEEDWAMARYLPGAELTTTNYKPTLRERFGKYLSETGLDFLGQLLALDPYKRLTAMSAKHHPWFKEDPLPSEKITLPTEESHEADIKRYKEEMHQSLSQRVPTAPRGHIVEKGESPVVKNLGAIPRGPKKDDASFLPPPKNVLAKPPPSKIRELHQNPRPYHVNSGYAKTAIPPPAAPAGVNRYGPNNSSRNNRFSGNSTAPSNSRNPVNRFHPETNVSSKYNKVPLPLGPQSRYQGNSSESRYKNSPNDSRYHNPRYVNKPETNFNRQPQKYSRQESNAPINKNYNPSNGSRNMAGDHHQGSRPSHPQFPISPSQGQHQLTSKPIEKKNGSFKDERAKPDESKEFQNSDIADLY

SEQ ID NO: 9704 - protein, 718 aa, Rhizobium leguminosarum bv. viciae 3841
MGGKSEMTILLCVIACGLLSVVYAAWATRSVLAADQGNSRMQEIAGYIREGAQAYLTRQYRTIAIVGVVVFILAWLLLSGEAAIGFLIGAVLSGAAGFIGMHVSVRANVRTAQAASVSLSAGLDIAFKSGAITGMLVAGLALLGVSIYYTVLTIGLGHESGSREVIDALVALGFGASLISIFARLGGGIFTKGADVGGDLVGKVEAGIPEDDPRNPATIADNVGDNVGDCAGMAADLFETYAVSVVATMVLAAIFFAGAPILQSAMVYPLAICGACIITSIIGTFFVKLGSNGSIMGALYKGLIVTGLLSIVGLGAATSLTIGWGSIGSVGGADISGANLFFCGIIGLVVTALIVVITEYYTGTGKRPVVSIAQASVTGHGTNVIQGLAVSLESTALPAIVIVGGILATYQLGGLFGTGIAVTAMLGIAGMIVALDAFGPVTDNAGGIAEMAHLPPEVRKSTDALDAVGNTTKAVTKGYAIGSAGLGALVLFAAYSYDLKYFAANGDKFPYFAGIGEISFDLSNPYVVAGLIFGGLIPYLFGGIAMTAVGRAASAIVEEVRRQFKEKPGIMQGTEKPDYGRAVDLLTKAAIREMIVPSLLPVLAPIVVYFGVLLISGSKASAFAALGASLLGVIINGLFVAISMTSGGGAWDNAKKSFEDGFVDKDGVRHMKGSDAHKASVTGDTVGDPYKDTAGPAVNPAIKITNIVALLLLAVLAG

SEQ ID NO: 9705 - protein, 541 aa, Zea mays
MGLGVVAELVRLGVLSSTSDHASVVSINLFVALLCACIVLGHLLEENRWVNESITALIIGLCTGVVILLTTKGKSSHILVFSEDLFFIYLLPPIIFNAGFQVKKKQFFRNFMTITLFGAVGTMISFFTISLGALGLISRLNIGALELGDYLALGAIFSATDSVCTLQVLSQDETPFLYSLVFGEGVVNDATSVVVFNALQNFDITHIDAEVVFHLLGNFFYLFLLSTVLGVATGLISALVIKKLYFGRHSTDREVALMMLMAYLSYMLAELFALSGILTVFFGCIVMSHYTWHNVTESSRITTKHAFATLSFLAETFLFLYVGMDALDIDKWRSVSDTPGKSLAISSILMGLVMVGRAAFVFPLSFLSNLAKKTEHEKISWKQQVVIWWAGLMRGAVSMALAYKKFTRAGHTQVRGNAIMITSTIIVVLFSTMVFGLLTKPLINLLIPHRNATSMLSDDSSPKSLHSPLLTSQLGSDLEEPTNIPRPSSIRGEFLTMTRTVHRYWRKFDDAFMRPMFGGRGFVPFVPGSPTERNPPDLSKA

SEQ ID NO: 9706 - protein, 148 aa, Oryza sativa Indica Group
MASKRILKELKDLQKDPPTSCSAGPVAEDMFHWQATLMGPSDSPYAGGVFLVTIHFPPDYPFKPPKVAFKTKVFHPNINSNGSICLDILKEQWSPALTISKVLLSICSLLTDPNPDDPLVPEIAHMYKTDRAKYESTARSWTQKYAMG

SEQ ID NO: 9707 - protein, 311 aa, Salmonella typhimurium LT2
MALPIIIDCDPGHDDAIALVLALASPELEVKAITSSAGNQTPEKTLRNVLRMLTLLKRLDIPVAGGAVKPLMRELIIADNVHGESGLDGPALPEPSFAPQSGTAVELMAKTLRESAQPVTIVSTGPQTNVALLLNSHPELHTKIARIVIMGGAMALGNWTPAAEFNIYVDPEAAEIVFQSGIPVVMAGLDVTHKAQIHAADIERFRAIGNPISTIVAELLDFFMEYHKDEKWGFVGAPLHDPCTIAWLLKPEIFTTVERWVGVETQGKYTQGMTVVDYYFLTGNKPNATVMVDVDRQGFVDLLAERLQYYA

SEQ ID NO: 9708 - protein, 464 aa, Synechococcus sp. RS9916
MGIHRSRHHLIDSGEQALVDAMVDPLPRDHFPVDGRAADTTVQLLKEELLLDGNSKQNLATFCQTYQGSAAMELMALGVDKNLIDKDEYPQTAEVERRCVSMMADLWNAPGEAIGCSTIGSSEASMLGGMAAKWRWRKKRQQAGLPTDQPNMVCGSVQICWKKFARYWDIEMRELEMRPGDLCITPERVLEAVDENTIFVVPTLGVTYHGLYEDVEAISRALDDYQARTGIDIPIHVDGASGGFLAPFCAPDLPPWDFRLERVKSINASGHKFGLAPLGVGWVMWRSPEDLPDELVFHVSYLGGDMPTFQINFSRPAGQVIAQYHEFVRLGREGYRLLHQASHSNAQYVAKALGQMGPFQLIHDGAPEKGIPTVVWTLKEGVDPGFNLYDLADRLRMRGWQVPAYPFTGDLAHHAFQRILVKRDFTREMADLLLDDIRTALAHFQKHPITSNLQASEAASYNHL

SEQ ID NO: 9709 - protein, 1333 aa, Vitis vinifera
  misc_feature (343)..(343): Xaa can be any naturally occurring amino acid
  misc_feature (512)..(512): Xaa can be any naturally occurring amino acid
  misc_feature (1029)..(1029): Xaa can be any naturally occurring amino acid
  misc_feature (1263)..(1263): Xaa can be any naturally occurring amino acid
  misc_feature (1281)..(1281): Xaa can be any naturally occurring amino acid
MTDGETAREDSPEVASPDPLHEFVPFQGQKSDDSPLSQYSSCGESEFDRYCSANSVMGTPSMCSSSFGTFNECIDSELGFMWSSGLGEDGSLENFSLGGGFDSNCENHGRIAFLGGSDICRNDHGIENREAQSDGERTIKNGSKLRDGEEGSSSQMASLRVESGCGDKGSLLSGLGNECHKENANAKFVEDAMFNDGIAEEDSSSHVVNEVDRYFYGLNLQSNFQFEEREDGNCCEEDGTSSRYEHSEDEDSMYKYGTDDELKTDLNRGKNVQYRQEEKAENGNPLLMNSSLAFGSEDWDDFEQKEQNLKAEKMLPNSSYVTPIGLQSISETTEGENVLDVPXAIKQVHNLDESEECIKRCSLVPISTGGSEQEEDVKDIYVTINQVQVTDESAEYLKNSSAVFNALRNLGKSEEGEAVRDICETBNQILIQGADGSEEYLQSCSVNNIFETEQDPLAEKATLRIGLNTSNGIMQREQQHGNTSEVLDLGDRQVSDSPELGKPKVQLDPLSXNTVDQVYAPSTEALENRQAGFFKGYKPDPHTSMLENDMWNESKDSPVSSDPFEGHSAPVKMENIELKESYDEVVLDMEEILLESSESPGARFTQGNRTFQSHLPLPLRDGGSTASTSGTDDVYPPLRQLQNIDGVEVIGAKQKKGDVSLGERLVGVKEYTVYKIRVWSGNDQWEVERRYRDFFTLYRRMKTVFSDQGWNLPSPWSSVERESRKIFGNASPDVVAERSVLIQECLRSILHFRFLSSPPNALIWFLSPQNAVPTSFASNTLMPSSTSFNRGVNIENVSALGKTISLVVELQPYKSMKQMLEAQHYTCAGCHKHFDDGKTLVREFVQTFGWGKPRLCEYTGQLFCSMCHTNDTAVLPARVLHHWDFTEYPISQLAKSYLDSIHDQFILLSIDICPCKSVDFTPESRPMLCVSAVNPFLFSKVPALLHVTGVRKKIGAILPYIRCPFRRSVNKGLGSRRYLLESNDFFALRDLIDLSKGAFSALPVMVETVSRKILEHITEQCLICCDVGXPCNGRQACNDPSSFIFPFQEGEVERCKSCELVFHKSCFRKLTNCPCGVQLRAEEVTGLTKKASGRGGGKEGEAVDLLGRKLSSTGLGGGFLTGLFARARQEKALDHKESDNLCQSFMCQLRDGSSHQGTVTSTDTNEATFVLQTDPFWKGKRRLIHLVDVPGQSHLRSKLDKYLPQAAGLIFLVDGLEFLRHCPAIAEYLLDILTNTTVVKRKIPVLIVCNKTDKVTAHTKEFXQKLLEREIQKLRASGTAXSEADIANEYTLGVTGEAFTFSQCCNMVTVEEASGLVGEISQVEQFITKHLKP

SEQ ID NO: 9710 - protein, 258 aa, Kluyveromyces lactis NRRL Y-1140
MIRRGLIVARRMSSDISYDAVRKEELIGAYQTMKDKINATAQEVGNVNVELLAVSKYKPAADIKILYDYGVRHFGENYVQEMITKSEILPQDIKWHFIGGLQSNKCKDLAKIANLYSVETVDSLKKAKKLEEARGKWNPDAPVITCNVQINTSGEEQKSGLFAEVEVYSIVEYLIKEAKHVSLNGLMTVGSWDVSHSGNEENQDFARLVEWKKKLDAKYGLDLKLSMGMTADFRQAIKQGTSEVRIGTAIFGSRPLKN

SEQ ID NO: 9711 - protein, 794 aa, Neisseria meningitidis MC58
MADNYVIWFENLRMTDVERVGGKNASLGEMISQLTEKGVRVPGGFATTAEAYRAFLAHNGLSERISAALAKLDVEDVAELARVGKEIRQWILDTPFPEQLDAEIEAAWNKMVADAGGADISVAVRSSATAEDLPDASFAGQQETFLNINGLDNVKEAMHHVFASLYNDRAISYRVHKGFEHDIVALSAGVQRMVRSDSGASGVMFTLDTESGYDQVVFVTSSYGLGENVVQGAVNPDEFYVFKPTLKAGKPAILRKTMGSKHIKMIFTDKAEAGKSVTNVDVPEEDRNRFSITDEEITELAHYALTIEKHYGRPMDIEWGRDGLDGKLYILQARPETVKSQEEGNRNLRRFAINGDKTVLCEGRAIGQKVGQGKVRLIKDASEMDSVEAGDVLVTDMTDPDWEPVMKRASAIVTNRGGRTCHAAIIARELGIPAVVGCGNATELLKNGQEVTVSCAEGDTGFIYAGLLDVQITDVALDNMPKAPVKVMMNVGNPELAFSFANLPSEGIGLARMEFIINRQIGIHPKALLEFDKQDDELKAEITRRIAGYASPVDFYVDKIAEGVATLAASVYPRKTIVRMSDFKSNEYANLVGGNVYEPHEENPMLGFRGAARYVADNFKDCFALECKALKRVRDEMGLTNVEIMIPFVRTLGEAEAVVKALKENGLERGKNGLRLIMMCELPSNAVLAEQFLQYFDGFSIGSNDMTQLTLGLDRDSGLVSESFDERNPAVKVMLHLAISACRKQNKYVGICGQGPSDHPDFAKWLVEEGIESVSLNPDTVIETWLYLANELNK

SEQ ID NO: 9712 - protein, 157 aa, Oryza sativa Indica Group
MAASASLPAATPAGRHAAAVYVAAVPLRGPKGPAQALMSAGYSLGLWDLQHFMVLLRPDPARAQALVFDFQPRDPEDALAAFAVLSRSEIPGVVRRRTLRRVPDTRCWLVGHHRSGGGAGAAAAVLAADAFTARWPTDLVVGRHDCRDFTNGWSATS

SEQ ID NO: 9713 - protein, 236 aa, Oryza sativa
  misc_feature (101)..(101): Xaa can be any naturally occurring amino acid
AAGGDGGESRQWVLVAGAGAAVGALSTAAVMRILSRSKRREGYVRSLLESNGVASGGAGSNVAGPDSDNSDLLDDEVVSQQITKHIPIFGLASPNKVTGPXVDAMGLGGVGSHAASRLLRSGVGRLLLVDFDQVSLSSLNRHAVATRGDVGTPKGLCLKKHFSMIYPECQIEAKVQLYDPSCEDEILSGQPDFVLDCIDNIDTKVALLAACVRRGLRVLSAMGAGARADPTRIRVA

SEQ ID NO: 9714 - protein, 551 aa, Xylella fastidiosa Temecula1
MTEIKEAFVPDIGDYSNVPVIEVLVAVGDTVSKGQSLITLESDKATMEVPSSTAGIIKEIKVKVGDTLSQGHVVALIEVSEETAEVTTPMTVNTPTTRAHNTAHPEDEGSLIEVRVPDIGDYTNVPVIEVLVAVGDTVSKDQSLITLESDKATLEVPSSATGVIKQLKVNIGDTLSQGDIVVVLQSAESTPLTPTTNKPALPPNSSPAGDAISAPASPAGTQSTPPITFDANTVLPSKVPYASPAVRLLARQLDVDLSRIKGSEKNGRITREDVQKFVNTTLGTGMAEGRTPSASITTNGGLNLLPWPNVDFSKFGEIETQPLSRIKKISGANLARNWAMIPHVTQFDQADITQLEALRVQINKENAASNKNGTGIKLTVLAFLIKASASALKKFPTFNASLDATGETLTLKKYFHIGFAADTPNGLVVPVIRNVDQKGIVEIAQETSDLAKKARDGKLTPADMSGGCFSISSLGGIGGTAFTPIINAPEVAILGVSKSLIQPIWDGTQFAPKMLLPLSLSYDHRVIDGALAAHFTTYLSQILADMRRVLL

SEQ ID NO: 9715 - protein, 603 aa, Xylella fastidiosa Temecula1
MTVIEIKVPDIGDYSKVPVIEVLVTVGDHLVKNQGILTLESDKATLEVPSMNNGIVKELKVNVGDLLSQGDVILLLETEDTTAPPSPSNAATSDTTSPPPPSPQPAASKPTAPDQQHSDIKCRMVVLGAGPGGYTAAFRAADLGLDTVLVERYPNLGGVCLNVGCIPSKALLHAAAVIDEAAHASTFGIDFGKPKITLDTLREYKQNVVNKLTAGLAGMAKQRKVRTVTGIAHFVSPNTLDITAADGSTQRLHFQQCIIATGSHPVKLPNFPWDDPRIMDSTDALELAEVPKKLLVVGGGIIGLEMATVYNALGSHVTIVEFMDQIIPGTDKDLVKPLADRMKKQGIEIHLNTKASHVKADKKGITVSFEAPTQGTQPALKTSTYDRVLVAVGRTPTGNNIGAEKAGVNVTERGFIPVDRQMRSNVPHIFAIGDIVGNPMLAHKATHEGKLAAEVAAAETESGKHREWVARVIPSVAYTNPEIAWIGITETEAKAKGLNIGVAKFPWVASGRAIGIGRTEGFTKLIFDEDTHRIIGGAIVGVHAGDLLAEIGLAIEMGAEAEDISHTIHAHPTLSESIAMSAEVYDGTITDLYLPKKSATSAK

SEQ ID NO: 9716 - protein, 128 aa, Arabidopsis thaliana
MSMAYSLNISNLQHFMVLIKPSSPIRQEVLVFDFQPRNPESIEAAISLLSGNLIPGVVLQRRLKNVPRQRCWMVGPSKGNDAMEMAMEFNKSWETDLRVGFHDCRHYTNELVQHLTGEMQIVERLPRS

SEQ ID NO: 9717 - protein, 176 aa, Neisseria meningitidis MC58
MNAIRTFQNRTPEIHETCMIDEACVVIGEVSLAEDVSVWPCAVLRGDVNSITVGARSNIQDGSVLHVSHKTAAKPEGSPLVIGEDVTVGHKVMLHGCRIGNRVLVGMGTTVLDDAVIEDEVMIGAGSLVPPRKRLAGGYLYVGSPVRQVRVLTDEEKAFLKYSAAHYVKLSKQYGM

SEQ ID NO: 9718 - protein, 132 aa, Triticum aestivum
  misc_feature (41)..(41): Xaa can be any naturally occurring amino acid
  misc_feature (55)..(55): Xaa can be any naturally occurring amino acid
  misc_feature (102)..(102): Xaa can be any naturally occurring amino acid
MHKTTAKMSSTATVTRAHLDNKLALAKRCSREATLAGAKAXAAVATVASAVPTLXASVRMLPWAKANLNPTGQALIVCTVAGMAYFVAADKAILSLARRHSXESAPDHLKDTSFHGGAAAAARPRPPAFFRP

SEQ ID NO: 9719 - protein, 333 aa, Triticum aestivum
HYRTSLYKKAGWYQGPEIPGISSTHASAIKLTKGQEITVSTDYDIKGDTNTISMSYKKLPQDVKPGHVILCADGTISLSVLSCDPAAGTVRCRCENTAMLGERKNCNLPGIVVDLPTLTEKDKEDIFVWGVPNDIDMIALSFVRKGSDLVTVRQLLGQHAKRIKLMSKVENQEGIVNFDDILRETDAFMVARGDLGMEIPVEKIFLAQKMMIYKCNLAGKPVVTATQMLESMIKSPRPTRAEATDVANAVLDGTDCVMLSGESAAGAYPEVAVKIMARICVEAESSLDNDAVFKEMIKAAPLPMSPLESLASSAVRTANKARATLIVVLTRGV

SEQ ID NO: 9720 - protein, 135 aa, Vitis vinifera
MAGRGKTLGSGAAKKATSRSSKAGLQFPVGRIARFLKAGKYAERVGAGAPVYLAAVLEYLAAEVLELAGNAARDNKKTRIVPRHIQLAVRNDEELSKLLGDVTIANGGVMPNIHNLLLPKKAGGSSKASGGDDDS

SEQ ID NO: 9721 - protein, 397 aa, Triticum aestivum
MHSTNLLLEEPIRMVSILEPSKPNFFPAMTKIVGTLGPKSRSVEAISACLKAGMSVARFDFSWGDAAYHQETLENLKLAIKATKKLCAVMLDTVGPELQVVNKSEVTISLEENESVVLTPHQGQEASSKLLPINFAGLAKAVKPGATIFVGQYLFTGSETTSVWLEVSEVQGDDVVCVIKNSATLAGSLFTLHCSQIHIDMPTLSDEDKDVMKKWGAPNKIDFLSLSYTRHAEDVRQAREFLSKLGDLSQTLIFAKIENVEGLNHFDEILEEADGIILSRGNLGIDLPPEKVFLFQKSALHKCNMAGKPAVVTRVVDSMTDNLRPTRAEATDVANAVLDGSDAILLGAETLRGLYPVETISTVGRICAEAEKVFNQDLYFKRTVKYVGEPMTPLGVY

SEQ ID NO: 9722 - protein, 278 aa, Populus trichocarpa
MTIEATVEPRREPTAHVNRLGFAKRPTKRKRSKKTKKCAPTMALQDLYVSCKEVFKGPGTVPLHQDVKRLCHMLDNMKLEDFGLSCKLEFFNPKAAVRGTPRVTYTIVYECDKFSMCVFFLPATAVIPLHNHPGMTVFSKLLMGTMHVKSYDWVDPPATDEPDSPAQVRLAKLEADSVFTAPCHTSVLYPTTGGNIHQFTAITPCAVLDVLGPPYSNEDGRDCSYYKDFPYTAFPNGEMGSEEEEGDCYAWLEEITVPENLQMFVIKYLGPQVDDSSS

SEQ ID NO: 9723 - protein, 394 aa, Rhodobacter sphaeroides 2.4.1
MLTALKPQPADKILQLIQMFREDARADKIDLGVGVYKDPTGLTPVMRAVKAAEKRLWEVETTKTYTGLADEPAYNAAMAKLILAGAVPADRVASVATPGGTGAVRQALELIRMASPEATVWISNPTWPNHLSIVKYLGIPMREYRYFDAETGAVDAEGMMEDLAQVKAGDVVLLHGCCHNPTGANPNPVQWLAICESLARTGAVPLIDLAYQGFGDGLEMDAAATRLLATRLPEVLIAASCSKNFGIYRERTGILIAIGEAAGRGTVQANLNFLNRQNYSFPPDHGARLVTMILEDETLSADWKAELEEVRLNMLTLRRQLADALQAETGSNRFGFVAEHRGMFSRLGITPAEVERLRTEHGVYMVGDSRLNIAGLNRTTVPVLARAVAKVLRG

SEQ ID NO: 9724 - protein, 279 aa, Populus trichocarpa
MSKDVIEEGQTHTKDYVDPPPAPLFDVGELKLWSFFRALIAEFIATLLFLYVTVATVIGHKKNQDACGGVGLLGIAWAFGGMIFILVYCTAGISGGHINPAVTFGLLLARKVSLIRAVGYMVAQCLGAVCGVGLVKAFMKPYYNSLGGGANMVAPGYSTGTAVGAEIIGTFVLVYTVFSATDPKRSARDSHIPVLAPLPIGFAVFMVHLATIPITGTGINPARSFGAAVIINDKKAWDDHWIFWVGPFVGALAAAAYHQYILRAGAIKALGSFRSHPTN

SEQ ID NO: 9725 - protein, 419 aa, Debaryomyces hansenii CBS767
MRKCKVFVGSSHPELGKLVCDRLGVEPAPCTLKKFSNGETSVQIGVSIRDEDVYIIQSGSPQINDHIMELLILISACRGGSASKITAVIPQFPYSKQSKMKKHRGAITARMLANLLIMAGADHVVSMDLHASQMQGFFTKPVDNLFGAPTLARWIRHNISDWANAVVVSKNPGGTKRVTALADSLKINFAMIHTDRRRTKDGYVSKNKKALKTSKPVRVQGIDEDEEEDNIVSEMQTARIVQGHVVDDDYPVPQTPITNGIAHDNLETASIIDSDALGGSYDATNSDDDDEPTSMNLEKLITLVGDVNNKVAIILDDMIDKPNSFIAAAEHLRLNCGAKAVYVVGTHGVFSDKCLETLNDSDCIDKIVVTNTYPIGNERIQKNEKLSVIDVSPIFAECIRRDHFGESISVLFDSLAAIE

SEQ ID NO: 9726 - protein, 476 aa, Novosphingobium aromaticivorans DSM 12444
MKDTTRGEMLAQLERQKAAFTQARPEPLSTRNDRLERCARLLLQHGEDFARAMSTDFGHRSHEQSMLTDIMPALSLVRYSQKRMKAWSKPEKRHVNFPLGLLGARAEVRYEPKGVIGIVAPWNFPVGLTLAPLAQAFAAGNRAMLKPSEFTERTSELMAELFPKYFGEDEVAVVLGGPQAGQDFCSLPFDHLLFTGATSIGKHVLHAAADNLVPVTLELGGKSPTILGRSANVEQAAQRIALGKMMNAGQICLAPDYMLVPEDMEERAIGAVSASVAQMYPTLLANDDYTSVINRRHRDRLVGLVDDAVAKGAEAIVVNPGGENFEGSNGNKLPLTILRNVDDGMKVMQDEIFGPVLPVKTYRGIDEAIDYINAHDRPLGLYYFGEDAGERERLLTRTISGGVTVNDVIFHVSADDLPFGGVGPSGMGSYHGIEGFRSFSHARAVYRQPKVNVAKLAGLLPPYGAATARTLKMQLK

SEQ ID NO: 9727 - protein, 432 aa, Cyanophora paradoxa
MNIIVVGLSHKTAPVDFREKLSIPKVRIGEAIRELCNYPHIEEVAILSTCNRLEIYLLTSDTYQGIREATQFLADSSDLSLPELRQHLFILLHQDAVMHLMRVTAGLDSLIIGEGQILSQVKQCYQLGQQYQGIGPVLNNIFKQAISAGKRVRTETQISTGAVSISSAAVELAQIKKQDLRTANITILGAGKMSRLLVQHLLSKRVKDINIVNRSVERAKLLVDQFKEANINIYNLSELKTILQNSDIVFTGTSSQEPIITPELINDCDNLPSELMLFDIAVPRNVDPNVSQFDNIKVFNVDDLKVVVSQNQQTRRKMAKAAEILLEEELSAFNIWWGSLEAIPTINKLREKAEIIRVKELEKAISRLGNEFVSDHQEIVESLTRGIVNKILHDPMVQLRAQQDIEIRGRALKILQTLFNLDTIKNGMSPTL

SEQ ID NO: 9728 - protein, 457 aa, Rhodopirellula baltica SH 1
MSITSVNPATNETIREFEPLHKDDAMQAIETAHKAFEEWRATSFDERKKCILKFAELLRADSDEYARMITLDMGKRISESQYEIEYCANIAEFYANGAEEFLADTPMERVDANAYLHYEPIGVLMGVMPWNFPFYQVVRFATPNIMAGNTVMVKHASNVPQCAAAIEELYNDCGLPNGVYQNLFIPSDFVDSIISDSRVQGVSLTGSEPAGRAVAAQAGKNLKRSVLELGGNDPFIVLEDADMELVIEQAAKGRMVNAGQSCVASKRFIVVKEVAEQFMNGFKEKLQALKLGDPMDEETTLSPLSTEDAAVKLQEQVQSSINAGATVVLGGDRPDREGAFFNPTILTDVTPDNPTFDQELFGPVATVYVVDDEAAAIELANHSSYGLGGSVYTTDIQRGRRVAEKVETGMMFLNQPTSSQAELPFGGIKNSGYGRELSHLGILEFVNKKLIHLGEKE

SEQ ID NO: 9729 - protein, 523 aa, Zea mays
MDAFMGSVLGALLAVLASTLLIGALFFLVWKPYVVTRWFRGQGIGGPSYRFLVGSLPEIKRMKAAGSKITLDVGSHDFVPIVQPQYRRWVSDYGKTFLYWFGAVPTICVAEVGLVKQVLAERTGLFPKDYMNDSMEVLLGKGLVLANGEDWKRHREVVHPAFKPDKLKTMSVVMADLVQRMMQQWRSQIQRASNHEAEIELSSEFSELTSDVIAHTAFGTSYKEGKEVFVAQKELQELTFSTWLDIPAPACLRKLKLPTSKSSRRVEELDKKVRSMLMAIIEGRLAARGTSGYGNDLLGLMLQARALEQEGHQMLTTEEIVDECKTFIFAGQDTTSHLLTWTMFLLSRYSEWQHRLREEVLRECGDAVPNPDTVTKLKLVNMVLLESLRLYSPVVFIRRAVGSDILLRSTRVPKGTMLSIPIALLHRDKDVWGQDADEFNPDRFEHGVSNAAAKHPNALLSFSQGPRACIGQNFAMLEARIGIAMILQRFSFELSPNYVHAPKEAVTLMPRFGLPIILRNLHD

SEQ ID NO: 9730 - protein, 245 aa, Streptococcus mutans UA159
MKDIIVIKIGGVASQQLSGDFLSQIKNWQDAGKQLVIVHGGGFAINKLMEENQVPVKKINGLRVTSKDDMVLVSHALLDLVGKNLQEKLRQAGVSCQQLKSDIKHVVAADYLDKDTYGYVGDVTHINKRVIEEFLENRQIPILASLGYSKEGDMLNINADYLATAVAVALAADKLILMTNVKGVLENGAVLEKITSHQVQEKIDTAVITAGMIPKIESAAKTVAAGVGQVLIGDNLLTGTLITAD

SEQ ID NO: 9731 - protein, 474 aa, Ralstonia metallidurans CH34
MGLRSQSRHPSGDSLKNLQRNLSARHIRFLALGSAIGTGLFYGSASAIQLAGPAVILAYIVGGAAVYMVMRALGEMAVREPVTGSFGRYASEYLGPLAGFLTGWTYILEMIIVCLADVTAFGIYMGFWFPEVPQWIWVLGIVMLICGLNLCNVKVFGELEFWLALVKILAIAAMIIGGTLILFLGVKMNGEHSPGLTNLWAHGGFLPHGAGGLIASLAVVMFAYGGIEIIGITGGEAQNPEKVIPRAINAVPARILLFYVLTMTVLMAIFPWTGIGSQGSPFVQIFSGLGIKSAAAVLNLIVISAAISAINSNIFGAGRMMYGMAEQGQAPRLFATTSRHGVPWVTVLAMAAALLGGVVLNYLIPEQVFVIIASIATFATVWVWLMILLSQVAMRRRLSAEEVRALKFKVPLWPVGPALAIAFMLFVIGVLGYVEDTRVALYVGAGWVVLLSLAWFLRAKPKADALLARETSVS

SEQ ID NO: 9732 - protein, 378 aa, Oryza sativa
MGGVTSQRGRRSMAFFPPTPPSYALVDDPAAGVTTMTGQPHRENVEVLRLRTRRGNTVAAVYVRHPDAATTLLYSHGNAADLGHLYQLFLHLSFNLRVNVLGYDYSGYGQSSGKPSEHNTYADIEAAYKCLIENFGAKEEEIILYGQSVGSGPTVDLASRLHRLRAVVLHSPILSGLRVMYPVKRTYWFDIYKNIDKIPQVTCPVLIIHGTADEVVDWSHGKQLWELCKEKYEPLWLKGGKHCDLELFPEYLRHLKKFVNTVEKSPSPRNAWRESLDRIEPSRKSVDCFEPSRRSVDFFEPSRKSTDRREKSRPTRDRMRGVEHRYSNVEKTDKLKFSFDHMEKSRRSIDIFERPKKNIEQLDCGRKSVDRLDRIWAS

SEQ ID NO: 9733 - protein, 379 aa, Streptococcus mutans UA159
MSNLFQNYTRADLEFIKAEGNYLFDTQGKKYLDFSTGIGVTNLGFHPQVQVALQKQAEQIWHTPNLYQNSLQEEVAAKLMAGKDYLAFFCNSGAEANEAAIKIARKATGKQEIITFQNSFHGRTFGSMSATGQDKIKVGFGDAVPHFHYAVFNDLNSVKALVTENTAAVMLELVQGESGVLPAEQDFVTALADYCQKNGLLLIIDEVQTGMGRTGKLYAFQHYGIEPDIFTLAKGLANGVPVGAMLAKKQFGSAFGPGSHGSTFGGNKLAMAASSAVLDIMTKAGFLEQAWENAHYLQEQLTSALQVADTVTQVRGLGYMIGIETTADLGQLVKATRDRGLIVLTAGTNVIRLLPPLTLTKDEIDQGIMILQEVFEQHN

SEQ ID NO: 9734 - protein, 67 aa, Triticum aestivum
TTSRRLADRKSAKFQKNITKRGSVPETTVKKSNDYPVGPIVLGFFIFVVIGSSLFQIIRTATSGGLA

SEQ ID NO: 9735 - protein, 420 aa, Glycine max
MKQPSKPWRPFTANCCSTEDQTIFKNFSRCKPSRSDLSKNIAPLPSFRRLSFSDLSRSSSTRINEDLAQSFGSDLFDFQLSELRAITQNFSSNFLLGEGGFGTVHKGYIDDNLRLGLKAQPVAVKLLDIEGLQGHREWLAEVIFLGQLRHPNLVKLIGYCCEDEERLLVYEFMPRGSLENHLFRRLTSLPWGTRLKIATGAAKGLSFLHGAEKPVIYRDFKTSNVLLDSEFTAKLSDFGLAKMGPEGSNTHVSTRVMGTYGYAAPEYISTGHLTTKSDVYSFGVVLLELLTGRRATDKTRPKTEQNLVDWSKPYLSSSRRLRYIMDPRLSGQYSVKGAKEMAHLALQCISLNPKDRPRMPTIVETLEGLQQYKDMAVTSGHWPVSSKSTKNRVSNNNKVNVKARAGANHKQPSPVPSRKT

SEQ ID NO: 9736 - protein, 449 aa, Pseudomonas syringae pv. syringae B728a
MTLSAGSPAPSTLDVQAFINAQPLSGYQWRVVALCFLIVFLDGLDTAAMGFIAPALSQDWGIDRASLGPVMSAALIGMVFGALGSGPLADRFGRKVVLVVAVLLFGLFSLASAYSSNIDQLLVLRLLTGLGLGAAMPNATTLLSEYTPERLKSLLVTSMFCGFNLGMACGGFVSAKLIPSMGWHSLLMLGGILPLLLGLVLMVWLPESARFLVVRNRGAERIRKVLAPIAPKALAGITDFSVPEQKTVSSRNVLKVIFSGTYSAGTLLLWLTYFMGLVIVYLLTSWLPTLMRDSGASMEQSAFIGALFQFGGVLSAVGVGWAMDRYNPHKVIGCAYALAGVFAWLVGQSLGNVALLATLVLLAGMCINGAQSAMPSLAARFYPTQGRATGVSWMLGIGRFGAILGAWAGATLLGLGWTFEQVLTALVIPAALAAIAVLIKGWVSHSDAT

SEQ ID NO: 9737 - protein, 226 aa, Triticum monococcum
MTSSCSAHGQARLLPGSKLALAFKGVSYEDVEENLYNKSELLLKSNPVHKKIPVLIHNGAPVCESMIIVQYIEDVFTGTGPSLLPADPYERAVARFWVAYVDDKLVAPWRQWLKGKTEEEKSEGKKQAFAAVEVLEGALRECSKGGGFFGGDGVGLVDVALGGVLSWMKVTEVLFGEKIFDAAKTPLLAAWVDHFSGLDAAKAALPDVGRLLEFAKAREVAAAASN

SEQ ID NO: 9738 - protein, 325 aa, Cryptococcus neoformans var. neoformans B-3501A
MSLGRTLKLNNGVVAPQIGFGTWQAAPGEVEKAVEEAIKVGYRHIDCALIYRVFDATGVYGIVAQGIKASGVPRKDLFLVSKLWNNSHRPEKVEADLDTSLKQLGTDYLDVYLIHWPVPFAPGDNLFPKTEDGKVAIDWDGPSVVDTWKELIRISKETKKVKAIGVSNFNVELLEKLIKETGVVPTMNQIECHPSLIQPELFKYCKEKNIVITAYSPLGNNTTGKPRIIDQPQIIDIAKKLNKEPAQVLINWAAHQGFAVIPKSVTPSRIKSNFEDFKLNDDVFEEINKVGKANAARANIPAEYNPSWPINVFGEKSEEQYKKVW

SEQ ID NO: 9739 - protein, 304 aa, Kluyveromyces lactis NRRL Y-1140
MTSAMSDLPKVQCIARARIPTVQGPDIFLHLYQNDRDNKEHLAIVFGENIRSRSLFRRNAGETQEERMIRGAYVGKLYPGRVKADVDEKQGLSLSFDEKTGELVVEPNTTWCDKDTLVRIHSECYTGETAWSARCDCGEQFDRAGKLISVEREGDIVGGNGHGVIVYLRQEGRGIGLGEKLKAYNLQDLGADTVQANLLLKHPADGRDFSIGRAILIDLGISNVRLLTNNPDKVAQVEQAPYLHCVERVPMVPLSWSGNHKDGIHSKEIEGYLRTKIERMGHLLQKPLTLHTNNDTNHQSTPIA

SEQ ID NO: 9740 - protein, 172 aa, Mycobacterium sp. MCS
MATTGNVRTHTLSVLVEDKPGVLARVASLFSRRGFNIQSLAVGATEQKNMSRMTIVVSVEEAPLEQITKQLNKLINVIKIVEQDEDNSVARELALIKVRADATTRGQVIEAVNLFRAKVVDVSTESLTVEATGTQEKLDALLRVLEPYGVRELVQSGVVSLSRGPRGIGTVK

SEQ ID NO: 9741 - protein, 493 aa, delta proteobacterium MLMS-1
MIEQREAGVMAEGRPRRTKIVCTIGPATASFEAICRLAEQGMNVARLNMSHGSREWHRGVIGNIKRYNKKYAGSLAVLLDTRGAEIRSGDLKQDLELRVGDGLTLTTRRQAELEPGCVEVSHDGFVAEVTPGDIILVDGGMLRLKVVEVGRTDVRCQSLDEGVLGSRRHLNIRGKSADLPAITEQDWADIEFGMEQRVDFIALSFVRTAEPIQVVQQHLAARGVTMEVMAKIESAASIAQLDAIIAAADGVMVARGDLGAELPYEEVPLLQDEIVAKCRRAGKPVVVATHMLESMIVNPTPTRAEVTDITHAVQQGSDAIMLSGETATGRYPYKALEVMDAVARRIERHQEQQGGQAGFGCACQLGRQGGGSDRLHAKMEISRSAAILGNNLGAAGTLVITRRGLMAALLSNCRPTAPILAFTNTTHVRRRLGIYWGVQAFVVKLSSDPEVSIQRAVEQLQRKGIVHRGQRIIVLSDILAGGLFVETVQVRVI

SEQ ID NO: 9742 - protein, 716 aa, Schizosaccharomyces pombe 972h-
MSVSVALKAKPIAYGAVACANYVNLSGAGSISVKYEDVALLDKQNKESNVSIQLNGSDSPVFGSKLALQTFSQVYPKLFIGENDRSLVESWVETASALAGNHNFLELSSLLAQLDDHLIMRSLFVGYSLTSADFSIWGALKSNNMAAGAVRTGQYFNLARWYKFMDSQNAVSVTMEEFTKAVNISKKQKSSGPNYEIGLPDAIDGKVVTRFPPEPSGYLHIGHAKAALLNQYFANKYHGKLIVRFDDTNPSKENSEFQDAILEDVALLGIKPDVVTYTSDYLDTIHQYCVDMIKSGQAYADDTDVETMRHERTEGIPSKHRDRPIEESLEILSEMDKGSDVGLKNCIRAKISYENPNKAMRDPVIYRCNLLPHHRTGTKYRAYPTYDFACPIVDSLEGVTHALRTTEYRDRNPLYQWMIKAMNLRKIHVWEFSRMNFVRTLLSKRKLTEIVDHGLVWGWDDPRFPTVRGVRRRGMTIEALQQYIVSQGPSKNILTLDWTSFWATNKKIIDPVAPRHTAVESGDVVKATIVNGPAAPYAEDRPRHKKNPELGNKKSIFANEILIEQADAQSFKQDEEVTLMDWGNAYVREINRDASGKVTSLKLELHLDGDFKKTEKKVTWLADTEDKTPVDLVDFDYLITKDKLEEGENYKDFLTPQTEFHSPVFADVGIKNLKKGDIIQVERKGYYIVDVPFDGTQAVLFNIPDGKTVNRYGVKN

SEQ ID NO: 9743 - protein, 500 aa, Neisseria meningitidis MC58
MAKVLIVPVSAGLDASAAAQAFAKALDAQIFQAVDATAETLLAQGKSDDWFDALVGKVAALDAANLVIEGIAPDADKIYLAGKNVELALSLDAAAVFAVRSDNADADELANRVNLAKQFFAAAPGVLEGFVVDGAAASVAEAAAEKTGLTFFGSSDALKDVSVLAGREAKRLSPAQFRYNLIDFARQADKRIVLPEGAEPRTVQAAAICHEKGIARCVLLAKREEVEAVAKERGISLPDSLEIIDPASLVEQYVEPMCELRKSKGLTPEDARKQLQDTVVLGTMMMAQNDVDGLVSGAVHTTANTIRPALQLIKTAPGASLVSSVFFMLLPNQVLVFGDCAVNPNPTAQQLADIAIQSADSAKAFGIDPKVAMISYSTVNSGSGPDVDTVIEATKLAREKRPDLAIDGPLQYDAATVPGVGKSKAPGSPVAGQATVLVFPDLNTGNCTYKAVQRNANVLSVGPLLQGLRKPVNDLSRGALVEDIVFTIALTAVQAKQMEG

SEQ ID NO: 9744 - protein, 308 aa, Pseudomonas aeruginosa PAO1
MQAKVLVVGSLNMDLVVRAPRLPRGGETLAGQSFITVPGGKGANQAVAAARLGAEVAMIGCLGDDAYGDQLYRALQAEGIDCQGVERVAGESSGVALIVVDDSSQNAIVIVAGGNGHLSPAVLARHEHLLEQAQVVVCQLESPLETVGHVLRRAHALGKTVILNPAPATRDVPAEWLPLVDYLVPNETESELLCRLPVDSLESAGRAAERLREMGAGRVIVTLGAQGALLVGEGRVEHFPVARVKALDTTAAGDTFVGGFAAALARGLDEAAAIRFGQAAAAISVTRLGAQTSIPSREEVERALVGEA

SEQ ID NO: 9745 - protein, 336 aa, Mycobacterium sp. MCS
MNLAIIAGDGIGPEVIGEAVKVLDAVLPEVEKTTYDLGARRYHATGEILPDSVLEELKVHDAILLGAIGDPSVPSGVLERGLLLRIRFALDHHINLRPAKLYSGVTGPLAGNPEIDFVVVREGTEGPYTGTGGAIRVGTPHEVATEVSLNTAFGVRRVVEDAFRRAQQRRKHLTLVHKNNVLTFAGALWWRTVQEVGAEYPDVEIAYQHVDSAMIHIVTDPGRFDVIVTDNLFGDIVTDLAAAVCGGIGLAASGNIDATRTNPSMFEPVHGSAPDIAGQGIADPTAAIMSVALLLAHVGETDAAARVDKAVEAHLSSRGDQELGTAAVGDRIVGLL

SEQ ID NO: 9746 - protein, 727 aa, Oryza sativa Indica Group
MATSTRALLLLPLLLLFLLSRSLSLRADPGAAVSRIAFGSCANQSAPQPVWEAVVGFDPQVFIWLGDNVYGDNKRPFRVFGRERTVGPWRNVPRFYPSTEAELRRRYEMAKAKPGYAKLRERAQVIGTWDDHDYGLNDAGKEFGGKVTSQRLLLDFLDEAEDSSRRQQAGVYASYMFGPEGKRVKVILLDTRYHRDPLSSDGAVLGDPQWQWLERELHGPRSEITIIGSSIQVISNLSATTGPLFYVESWARFPRERERLFRLIDSSKRNGVFFISGDVHFGEISRYDCGAQYPLYDITSSGLTQSVENSVPSVFQPLMRLVALLTPTTLRVFSPNCRYKSCTYGQPNFGAIEIDWNAVPPQIKLELRDVEGNSVGGVEFPISELDPSKAHAITKQGHSYQRHCALETELPWLVRHRLALLLFGTIAGPYGGEDPVIDLRLAGEAPGEAARLRDAARRLGCFRVSGHGVPRELQAGMRAAVRALFDLPGDAKRRNADVIHGSGYMAPSAANPLYEAFGLYDAASPADVDAFCSCLDAPPHAREAIRSYAEKAHELVVDVAAKLATSLGLDCSFGDWPCQFRINRYNYTPDTVGKTGVQVHTDSGFLTVLQEDDRVGGLEVADPDTGEFAPVDPLPGTFLVNLGDVATAWSNGELHNVRHRVRCVAGVQRVSIALFLLAPKDDVVRAPEAFVSAERPRRFRDFGYDDYRRLRQSTGEHAGEALARLAA

SEQ ID NO: 9747 - protein, 289 aa, Neisseria meningitidis MC58
MKPIRKAVFPVAGMGTRFLPATKASPKEMLPIVDKPLIQYAVEEAVEAGCTEMVFVTGRNKRSIEDHFDKAYELETELEMRHKDKLLEHVRNILPPNITCLYIRQAEALGLGHAVLCARAAIGDEPFAVILADDLIDAPKGALKQMVEVYGRSGNSILGVETVEASQTGSYGIVETEQLKQFQRITGIVEKPKPEDAPSNLAVVGRYILTPRIFDLLTNLPRGAGNEIQLTDGIAKLLDHEFVLAHPFEGTRYDCGSKLGYLEATVAYGLKHPETGEPFRRLLEKYRTE

SEQ ID NO: 9748 - protein, 383 aa, Coccidioides immitis RS
MKQAMYNIIINTGYLILVFEAVVAHNMVIDLTADTTSEEEQTSYPFKAIGTSLRTSQLLLTGFTQLGERNITNGKRELFARKQTRESLLELDILAARFSSSETETFYSTQKRRRDEEDSPASSLPPHHGLSQHYLVNDVQRCMSVMYMKAKKGKRSATKLPRATRTFRAGKPANHTALDLQNLYIEKLLSIDGPPVYFACNHATRDVDFNFEFVSCYKMHKGVTPVDASFHAGCSCFTEKCDLNICTCPSQEEGSDQRIVPYKVGDNGAVVLREDFMERKSMIYECSMLCSCSSTCMNRVVERGRKVRLEIFETRNRGFATYAQQTAGLRSKNSIQAGQYIDCYLGELLTKSEADNREKAISNKASYLFSLDFLVDDEEVTYI

SEQ ID NO: 9749 - protein, 250 aa, Agrobacterium tumefaciens str. C58
MVISTDEELDLLKDIGRLCAVAMQTMADALEPGITTAELDAIGRKVLEDNGAQSAPEFCYKFPGATCISVNEEVAHGIPGPRIIKAGDLVNIDVSAVKNGFFGDTGSSFAVPPVKKDIERLCRDGKRAMWTGLQQVKTGRPFADIGNAIGAFAKKNRYTLITNLASHGIGRSLHEEPKELATWPDKDERRIMQEGMVFTVEPFLSTGAYWAEDGDDDPWTLYSDPSAPTVQYEHTVVATKNGPLVLTLVE

SEQ ID NO: 9750 - protein, 155 aa, Xylella fastidiosa Temecula1
MNVTFDLTPPSPSQREALIATLNAEERRILLQHGTEAPFCNRLLDNNQLGTYTCRLCGLPLFHSNAKFKSGTGWPSFFEPYTHTHIRKQHDTSHGMIRTEILCARCNSHLGHLFPDGPPPTYERYCLNSVSLTFIPTGTLLPDQLHRGDNTTYRT

SEQ ID NO: 9751 - protein, 122 aa, Vitis vinifera
MASKLQQLQSKAAQASQFVVKHGCAYHKQLLEQNKQYVQEPPTVEKCNLLAKQLFYTRLASIPGRYESFWKELDYVKHMWKNRQELKVEDAGIAALFGLECYAWFCAGEIVGRGFTFTGYYV

SEQ ID NO: 9752 - protein, 424 aa, Glycine max
  misc_feature (154)..(154): Xaa can be any naturally occurring amino acid
NCLRSWGRNRDLFHWSSWTCPLCRICEACRRTGDPSKFMFCKRCDGAYHCYCLQPPHKSVCNGPYLCTKHARCHSCGSNVPGNGLSVRWFMSYTNCDACGRLFTKGNYCPVCLKVYRDSESTPMVCCDSCQLWVHCQCDNISDEKYHQFQLDGXLQYKCPTCRGECYQVKNPEDAAREIWRRRNIAERDLIASLRAAAGLPTQEEIFSISPFSDDEDSGPLKLKSESARSFKFSLKNLANDSPKKKSSSKKTAKKKDSQLFMTSKIDTHNSCEGHSDIKSLHSLDDDKNDDIQSQRNEGPDVYSSPAAGSLSQTEASFPIDQPGILKQKFVDEVMVSDEERKPRVVRIKSNKALIPDSEEESGKHSLKTQNVKGKKLVINLGARKINVASSPRSDTSSCQKDQDPVTVNGIHLSFCFSCHYIFA

SEQ ID NO: 9753 - protein, 162 aa, Rhodobacter sphaeroides 2.4.1
MVISVGDRLPEATLVRIGAEGPEQVQLSERLKGRNVVIFAVPGAFTPTCHSAHVPSFIRTKDQFAGKGVDEIICVSVNDPFVMKAWGESTGASGAGITMLADADGAFTKALGLAFDAPPVGLIGRSRRYALQAKDGVVAVIHLEESPGVCETSGGEALLAAI

SEQ ID NO: 9754 - protein, 187 aa, Zea mays
IKLKLKAVYMYAAGFYTYSIFALLFWETRRSDFGVSMSHHIATVVLIILSYIFRFARVGTVVLALHDASDIFLEIGKMAKYSSCEWLAVMAFLLFVASWILLRLVMFPFWILRSTSYEVLLTLDREKHRFYGPIYYYVFNCLLFSLLVLHIYWWVLIWRMLVKQIQSKGRVGDDVRSDSEGEDEHED

SEQ ID NO: 9755 - protein, 123 aa, Leptospirillum ferrooxidans
PNRQDGRIIEATSGNTVVALAQIAVLKGYAITIVMPEGVSGERVSHLKALGAEVLLTPSRDGMVGAIRKATEMEKSIKGLFMPRQFENPSNPESHYRTTGPEIFRQLGRVPDGFVAGVGTGGT

SEQ ID NO: 9756 - protein, 750 aa, Chlorobium tepidum TLS
MYGLVVCLFGMIFGLIQYQGINKLPVHAAMKEISDLIYETCKTYLITQGKFIIILWALVAAIIVAYFGGLNHLAPDKVVFILACSLLGIAGSYTVAWFGMRINTFANSRTAFASLGGKPFPTYAIPLRAGMSIGMLLISIELFAMLCILLFIPVDYAGPCFIGFAIGESLGASVLRIAGGIFTKIADIGSDLMKIVFKIKEDDARNPGVIADCTGDNAGDSVGPTADGFETYGVTGVALISFILLAIKDPSIQVSLLVWIFAMRLVMIVASAVSYWVNDALAKMKYGNADEMNFEKPLITLVWLTSIVSIVLTYIASYMLIAQLGDGTMWWKLASIITCGTIAGALIPELVDRFTSTECAFVRNVVQCSKEGGAALNILSGLVAGNFSAYWMGLAIIVLMGAAFGFSTLGLDVMMLAPSVFAFGLVAFGFLSMGPVTIAVDSYGPVTDNAQSVYELSLIETLPNISNSIESEFGFKPDFENAKRYLEANDGAGNTFKATAKPVLIGTAVVGSTTMIFSIIMILTGGLADTGAIAKLSILWPPFLLGLLMGGAVIYWFTGASMNAVTTGAYYAVAFIKKNIKLDGVTKASTEDSKKVVEICTRFAQKGMINLFLTIFFSTLAFACLESYLFIGYLISIALFGLYQAIFMANAGGAWDNAKKVVETELHAKGTELHDASVVGDTVGDPFKDTSSVALNPIIKFTTLFGLLAIELAIKLPTTISVSLAVVFFLLSLVFVHRSFFSMRIAVDKD

SEQ ID NO: 9757 - protein, 294 aa, Rhodopirellula baltica SH 1
MIQSPHPRTSFMSNADISIWQVDAFTSKPFGGNPAAICILPEFPSDEWMQNLAGEMNLSETAFLVRESDRSTYQLRWFTPNVEVDLCGHATLASAHVLWEQGLVAKGSEIRFQTRSGELVCSQSDRGITLDFPALDCSLVDDEKLSSDLKSAFGITKATVYQTAFDLMMVVQSGESVMELRPNYQALKDIPTRGVIVTSQDDRDGIDFVSRFFAPRCGIDEDPVTGSAHCCLAPYWSKRLGINPLVGHQASRRGGMVRCEVDDARVLLTGDAVTVLEGRLMISLADLRGERDKT

SEQ ID NO: 9758 - protein, 91 aa, Leptospirillum ferrooxidans
LDGTDTGKTLWQYFAVLLPVHSVGVMGDQRTYENAIAVRTVTSVDGMTADIGEIPHTLLCRISHRIISEVRGINRVVHDISPKPPSTIEWE

SEQ ID NO: 9759 - protein, 393 aa, Streptococcus mutans UA159
MAEKVSFEEGKLQVPDKPVIPYIEGDGVGQDIWKNAQIVFDKAIAKVYGGHKQVIWREVLAGKKAYNETGNWLPNETLEIIKTHLLAIKGPLETPVGGGIRSLNVALRQELDLFACVRPVRYFKGVPSPLKHPEKTAITIFRENTEDIYAGIEWNAGTAEVQKVINFLQDDMQVKKIRFPKSSSIGIKPISIEGSQRLIRAAIEYALANNLTKVTLVHKGNIQKFTEGGFRKWGYELAKREYAAELASGQLVVDDIIADNFLQQILLKPERFDVVALTNLNGDYASDALAAQVGGIGISPGANINYQTGHAIFEATHGTAPDIAGQDLANPSSVLLSGCMLFDYIGWSKVSDLIMKAVEKAIANGQVTIDFAKELGVEALTTRQFSEVLLTYL

SEQ ID NO: 9760 - protein, 577 aa, Streptococcus mutans UA159
MTEMLKGIAASDGVAVAKAYLLVQPDLTFETVSVTDTQAEEARLDAALEASQNELSLIRQKAVDTLGEEAAAVFDAHLMVLADPEMIGQIKETIRTKEVNAESALKEVTDMFVTLFENMEDNPYMQERAADIRDVAKRVLAHLLGVELPNPATISEESIVIAHDLTPSDTAQLDANYVKAFVTNIGGRTSHSAIMARTLEIAAVLGTNDITERVKNGDIVAVNGITGQVIINPTEDQIAEFKAAGETYAKQKAEWALLKDAETVTADGKHFELAANIGTPKDVEGVNNNGAEAVGLYRTEFLYMDSQDFPTEDEQYEAYKAVLEGMNGKPVVVRTMDIGGDKELPYFDLPKEMNPFLGFRALRISISETGNQMFRTQLRALLRASVHGQLRIMFPMVALLNEFRKAKGILEEEKANLKAEGVAVSDDIQVGIMIEIPAAAMLADQFAKEVDFFSIGTNDLIQYTMAADRMNEQVSYLYQPYNPSILRLVDHVVKAAHAEGKWAGMCGEMAGDQTAVPLLVGIGLDEFSMSATSVLRTRSLMKKLDTDKMQELAQRALTECATMEEVLELEKEYIDFD

SEQ ID NO: 9761 - protein, 475 aa, Streptococcus mutans UA159
MTKQYKNYVNGEWKLSENEIKIYEPASGAELGSVPAMSTEEVDYVYASAKKAQPAWRSLSYIERAAYLHKVADILMRDKEKIGAVLSKEVAKGYKSAVSEVVRTAEIINYAAEEGLRMEGEVLEGGSFEAASKKKIAVVRREPVGLVLAISPFNYPVNLAGSKIAPALIAGNVIAFKPPTQGSISGLLLAEAFAEAGLPAGVFNTITGRGSEIGDYIVEHQAVNFINFTGSTGIGERIGKMAGMRPIMLELGGKDSAIVLEDADLELTAKNIIAGAFGYSGQRCTAVKRVLVMESVADELVEKIREKVLALTIGNPEDDADITPLIDTKSADYVEGLINDANDKGAAALTEIKREGNLICPILFDKVTTDMRLAWEEPFGPVLPIIRVTSVEEAIEISNKSEYGLQASIFTNDFPRAFGIAEQLEVGTVHINNKTQRGTDNFPFLGAKKSGAGIQGVKYSIEAMTTVKSVVFDIK

SEQ ID NO: 9762 - protein, 353 aa, Arabidopsis thaliana
METYFWVEEGKTALEKHVSFFDRNGRFMSAFVAVFFNMGLSQKTRPVQLFGYILPLFLKPFVCTVVTTDVYDKDGRFVESKFEEIFNKHARTHKDALTAKEIKQMLKTNREPYDFIGWFVVYKLNKLNYNHNVTYHSDFHYFIEWKILHTLAQDNGLLTEDAVRGVYDGGKLDKEKMTALEKHVSFFDRNKDGTVYPWETYQGRLLAAFVAIFINMGLSKKTRPGKGFSPLFPIDVKNSHLCMHGSDTDVYDDDGRFVESKFEEIFNKHARTHKDALTAEEIQKMLKTNRDPFDITGWLSDYGEWKILHTLAQDKNGLLSEKSVRAIYDGSLFHQLEKKRSSSSSRGKKQKLP

SEQ ID NO: 9763 - protein, 777 aa, Silicibacter pomeroyi DSS-3
MSIKELFDTMEYGPAPESAAEALAWLVDQGDRFGHFIDGAFTAPGDGFDSRNPATGEVLATLTQATQADVEAAVAAARKAQPKWAALGGAGRARYLYAIARLMQKHSRLFAVLETLDNGKPIRESRDIDIPLAQRHFYYHAGMAQLMESELPDAEPLGVCGQIIPWNFPLLMLAWKVAPALAMGNTVVLKPAEFTSLTALLFADICQQAGLPKGVVNIVTGDGAVGEMIVAADVDKIAFTGSTAVGRHIREATAGRGLELTLELGGKSAYVVFDDADIDSAIEGLVDAIWFNQGQVCCAGSRLLVQEGIADRFYTKLRARMDGLRLGNPLDKCIDVGAVVDPVQLQTIERMVASNTAGQVHHAACALPENGCYYPPTLITGLSTSDPLMQEEIFGPVLVSTTFRTPAEAVELANNTRYGLAATVWTENVNLALDIAPKLVAGVVWVNATNLFDAAAGFGGVRESGFGREGGWEGLAAYTRPKGKRKALARIEPTMGHGAPVDPIDRTAKLYVGGKQARPDGGYSRPVWGKSGLLGHVGLANRKDVRNAVEAAAGASGWAKTTGHLRAQILYYIGENLSARAAEFTHRIDAMTGKRSGAKEVEASIQRLFTAAAWADKYDGQVHGVPIRGVALAMKEPVGVIGALCADEAPLLGLVSVMAPAIAMGNRVVLAASEPYPLAATDFYQILDTSDVPAGVVNILTGSHAELARPLASHLNVDAVWSFSSTDLSAEIETAAAGNLKRSWVNNATSLDWSVDHSKRFLQAATEIKNIWVPYGE

SEQ ID NO: 9764 - protein, 413 aa, Vibrio campbellii AND4
MTGAQLVVAALRQQGIKTVFGYPGGAIMPIYDALYDGGVEHILCRHEQGAAMAAIGMARTTQDVAVCMATSGPGATNLVTGLADAFLDSVPLVAITGQVASSHIGTDAFQEMDVIGMSLACTKHSYLVTEIEDLAPTLAEAFEVAKAGRPGPVIVDIAKDVQLAQAPTELLPPFVPPSTPKIGDADIQRAQQVLAASTRPVLYVGGGVQLAKATDSVREFLRLNPMPAVSTLKGLGTIERHDPHYLGMLGMHGTKAANLVVQECDLLIVVGARFDDRVTGKLDTFAPHAKVIHIDIDAAEIHKLRHANAPLRGEISQILPQLELTQDITPWVHHSESLRSGFKWRYDHPGELIYAPLLLKQLSDMMPDSSIVSTDVGQHQMWAAQHIQPRDPQNFITSAGLGTMGFGLPAAMG

SEQ ID NO: 9765 - protein, 452 aa, Candida glabrata CBS 138
MGQILSNPVIDKETESGSDKWTAYAVCAMQGWRMSMEDTHIAQLNLNADESSGHVALYSVFDGHGGSYVANFCGERMEKIVKSQKSYETGDLAQVLTDAYLAADEQLATQSSISDDHSGCTATSVLISKEKGVIICGNAGDSRTVLSSGGLAKALSFDHKPTLPGETARITAANGFVQMSRVNGNLALSRAIGDFEYKSNPKLLPHEQMVTCVPDVIEHKLDFENDEFVILACDGIWDCLSSQECVDMVHYGIQKTELSLLEITSRIVDICCAPSTEGSGIGCDNMSIIVVALLKDSETLEQWFERMRAKNYSYSTTFEQKRKEVFSFYNFAKNQETGDEDVFAITAPRSAPGSKLNGNQERGVTAKGPVDTSKNGKSPGVIDFTSLESLLEAGIKISQSPNNVQHFQGSALADMLASLSEAAAGETSPSEKNDDIEFTESTHANPEESIGH

SEQ ID NO: 9766 - protein, 270 aa, Silicibacter pomeroyi DSS-3
MDFTGKTVVVIGGTSGINRGIALAFARAGARLAVASRSQDKVNDTVAELRAAGAQEALGASFDVRDAEAVAAGLQGFRDRLGEFDVLVSGAAGNFPALTAEMSINAFKTVIDIDLMGTVHVMKGAYPHLKRPGASIINISAPQSWLPYEGQAHVCAAKAGVDQITRTLSLEWGPEGIRVNSVVPGFIEGTEGAKRLAPSPEAEKSFKKDVPLGRWGQPQDVANACLFLGSDMASYVSGTVLSVDGALYQRGSGRAGQMIGQMLRAMPKPG

SEQ ID NO: 9767 - protein, 657 aa, Arabidopsis thaliana
MEIVEVSPIHKHPLLPITRFSREHCKCNVCGSVGYIYGGYCCNEVGCESMFHKECVESLSEIKHTSHPDHPLKLLISDKASFCSRCEGRFENGYICSICDFKLDFRCAKGPAPLLILEKSNLHEHLLEFFVGWHSWKGHRECKACGGAGFRGYRWYGCYQCDTLFHGECAEFFPEAKHTSHPQHTLKHITSEEAPDYADNKCLLCEEEFDQQHPKIHHCDVCNFTICRACMKNAPPVRIESLTTHEHQLHLVPRRIDFTCNACGTLGDRSPYFCLQCNFMIHRQCIDLPRVININRHDHRISYTRRLGHGEWKCKVCRKKVDGFYGAYTCLKCPSFVVHSLCATRNDVWDMIELEGMQEEEEIAPYEMIDANTIKHFSHDHNLQINNDGHGRIQPENIVCEACVFQILSEPFYSCNQCSFILHEKCANHPRKKRHVCNNTSFILFTDSCNKANASCGLCKQHFTGFRYESGPYVTIDVRCAAILDTIEHGSHQHPLYYYTTFDWKPCSRCREEGAVLFRCDECDYILDGNCALFPKKVMRNRYDDHLLFLSFGDKNVSGDYWCEACETKVNPKEWFYTCNDCGTILHISCVVGDFSYIMPGSHITTWRANVVSNTSICRPVCYMCNSRCKLPSVLKLSDTKVDVYLCSFKCAYFIRK

SEQ ID NO: 9768 - protein, 380 aa, Pyrococcus horikoshii OT3
MNVLLELAIILVVAKLFGYLMVKLGFPAALGQLIGGIIIGPSLLNIVEYSQEVRFLAELGVIILLFLAGLETDVEEFKHVGLSAFIVATMGVFVPFLLGYLIAIVYGYRSLAALFLGGILTATSVGLTTSILMEMKKLRTKVGTTILAAAIVDDVLGIIILTILVAMSSRGRVEIFDIEIILAEVIIFFLLGIFIGHPIVKEVLMLSEKITLPETVTTFAIVIMLLFAYLAEKFQLAGITGAYLAGLLVSMSEGSKKVTDKMMTIGYSLFIPIFLVSIGIETDIKVLATAGVFAIVYSLIAIIGKIQGCGFGALVTKFKPAEALQVGIGMIPRMEVALIIANVGLKEGILTRGTLAIPVTMVVVTTLVTPFLLKLAFSRG

SEQ ID NO: 9769 - protein, 762 aa, Bordetella pertussis Tohama I
MKDTDRQAALDYHAYPHPGKISVTATKPLVTQRDLSLAYSPGVAAACEEIVDDPVNVFRYTGRGNLVGVITNGTAVLGLGNIGALASKPVMEGKAVLFKKFAGLDVFDIEINETDPDKLVEIIAGLEATFGGINLEDIKAPECFTVERKLRERMKIPVFHDDQHGTAITVCAAVVNGLAVAGKRIEDVKLVTSGAGAAALACLDLLVDLGLPLEHIWVTDIEGVVYEGRKKLMDADKERFARKTKARTLAEVIEGADVFLGLSAGNVLKPEMVATMAANPLILALANPNPEILPEAAHAVRDDIVMATGRSDYPNQVNNVLCFPYIFRGALDVGATTITREMEKAAVLAIASLAREEQNEVVAAAYGTYDISFGRDYLIPKPFDPRLIVRIAPAVAKAAMEGGVATRPIADLDAYAEQLQQFVYHSGAFMKPLFSQAKQIVRDGGRARIVFTEGEDERVLRAVQVIVDEKVAKPILVGRPQVLLSRIEKFGLRLRLGQDVEVCNPEYDERFHQYWTTYWDMMCRNGITKEMARVEMRRRLTLIGAMMVHLGDADGMICGAVSGFHDHLRFIDQVIGRKPGAQTYAAMNILLLNERTVALVDTHVNEDPSAEQIAEYTVAAAEEMQRLGLAPKVALLSRSNFGSGSSASGAKMRHALELVNRQAPGLEIDGEMHGDCALDESLRLRLLPDSPLKGSANLLVCPNVDSGNIAYNLLKTVAGKNVAVGPILLGANAPVHIVTSSATVRRIINMAALCVLDANRPQ

SEQ ID NO: 9770 - protein, 265 aa, Brassica napus
MFRVSNFVVGVANTLVMLVGASAIGYSIYMFVHQDVTDCESAIRAPLLTTGIILFLVSLIGVIGSCFKENVAMVSYLIILIAGIVALLVFSIFLFFVTNKGAGHVVSGRVYREYHTVDFSTWLNGLVGGKRWVGIRSCLAEASVCDDLSDGRVSQIADAFYHKNLSPIQSGCCKPPSDCNFTFRNATFWTPPAKNETAVATNNGDCSTWSNVQTELCFNCNACKAGVLANIKEKWRHLLVFNICLLILLITVYSCGCCARRNNQT

SEQ ID NO: 9771 - protein, 602 aa, Pseudomonas syringae pv. syringae B728a
MPHEGSLLQVAVVFLLAAVLTVPLAKRLKLGAVIGYLFAGVVIGPSVLGLIGDTESVSHISELGVVLLLFIIGLELSPKRLWVMRKSVFGVGMAQVLLTGLIIGGVAFAAFGQSLNTAAILGLGLALSSTAFGLQSLAERKQLNSPHGRMAFAILLFQDIAAIPLIAMVPFLAGADHAMDTGESINHGLRVLGSIAIVVIGGRYLLRPVFRIVAKTKIQEVSTATALLVVIGTAWLMELVGVSMALGAFLAGLLLADSEYRHELEAQIEPFKGLLLGLFFISVGMGANVGLLLSSPLIVLGLTLLLIAIKLPMLFLIGRTLGELNNRSALQLGLVLAAGGEFAFVVFKIGSAQGLFEAGLYDMLVLTITLSMAVTPLLFIALARWIKPKVKPVEVPEEYRDIQTDKPRVVIAGMGRMGQIVARILRAQKIPFIALDTAVESIEFSRSFGNVPVFYGDPLRPEILRAAKVDEAEYFVIATDDPDTNIKTAELIRKLYPHMKIIARARNRQHVHRLMDLGAHAVRETFYSSLEMSRQTLMGLGLSETQADARISRFKRHDEQVLAAQHEVYDDDAKVLQTAREARADLAQLFEADRLDEEAAKS

SEQ ID NO: 9772 - protein, 207 aa, Moritella sp. PE36
MSQFFNNITESPSNTLVPMVVEQTAKGERSYDIYSRLLKDRVIFLTGQVEDHMANLVVAQLLFLESENPDKDIFLYINSPGGSVSAGMSIYDTMQFIKPNVSTICMGMAASMGAFLLAGGEKGKRHALPNAKIMIHQPLGGYQGQASDIEIHANEIIKTKRKLNEILAEHTGQEYDRLARDTDRDNFMTSAEAMDYGLIDTVITKRD

SEQ ID NO: 9773 - protein, 177 aa, Neisseria meningitidis MC58
MADFNQILTPGDVDGGIINVVNEIPAGSNHKIEWNRKLAAFQLDRVEPAIFAKPTNYGFIPQTLDEDGDELDVLLVTEQPLATGVFLEARVIGVMKFVDDGEVDDKIVCVPADDRNNGNAYKTLSDLPQQLIKQIEFHFNHYKDLKKAGTTKVESWGDAEEAKKVIKESIERWNKQA

SEQ ID NO: 9774 - protein, 559 aa, Gibberella moniliformis
MPSLGFLKEKRTREGNSDPSASSPTSPVTPTTSRSKSISKAFHLPRTSRQSTSAPSAQPTNGQSQQQPDQIQEGAVSQSNQSSAPNEQTTAATDGQQQEDMSAINLHQPSYGAGSPMNHDHQNLPSINNLINPPQQQQQHNAQGNSYNNGQTNPQYLAATIDSHRPQTVSPGTDPAALQQQQQQALPQPSMPPQQQQSQAQQQHQQNQSQNQAQQQQQYQHQPHHQQNASTGSVMRVTKGKYSLGDFDILRTLGTGSFGRVHLVQSKHNQRFYAVKVLKKAQVVKMKQVEHTNDERRMLADVKHPFLITLWGTFQDPKNLYMVMDFVEGGELFSLLRKSGRFPNPVAKFYAAEVTLALEYLHSKNIIYRDLKPENLLLDRHGHLKITDFGFAKRVPDKTWTLCGTPDCLAPEVVSNKGYNKSVDWWSLGILIYEMLCGYTPFWDSGSPMKIYENILKGKVKYPAYVNADAQNLLERLITADLTKRLGNLYGGPDDVKNHPWFAEVTWDRLARKDIDAPYTPPVKAGAGDASQFDRYPEDPEKYGVVTAPDEYGHMFTEF

SEQ ID NO: 9775 - protein, 193 aa, Haemophilus influenzae 86-028NP
MSVIPMVVEQTSRGERSYDIYSRLLKERVIFLSGEVEDRMANLIVAQLLFLESEDPTKDINIYINSPGGSVTAGMAIYDTMQFIKPDIRTLCIGQACSMGAFLLAGGTAGKRAALPNARVMIHQPLGGFRGQASDIQIHAQEILKIKHTLNDRLAFHTGQGIERIEKDTDRDNFMSAEEAQAYGLVDEVLVKR

SEQ ID NO: 9776 - protein, 292 aa, delta proteobacterium MLMS-1
MITKVRKAVIPVAGFGTRFLPASKAIPKEMLTIVDRPTIQYIVEEVVASGIELIIFVTSEGKSAIENHFDYDFELDTLLKEKNKRDLRDEVQHISNLIDIIAVRQKKPLGLGHAIWSARNVVGNEPFLVLLGDDLVLSDQSPCCRQMLDLYEDLGESIVAIQRVAPEEVNQYGIVEGTPLRERVHQVQRMVEKPTPGTTDSDLAIIGRYLLQPDIFSLLEKTTPGHGGEIQLTDALLALAKKRPMYAYEFEGTRYDAGDKLGYLKAIVAFALRHPTLGKEFRQHLQEVCPNI

SEQ ID NO: 9777 - protein, 244 aa, Triticum aestivum
  misc_feature (186)..(186): Xaa can be any naturally occurring amino acid
  misc_feature (199)..(199): Xaa can be any naturally occurring amino acid
PGRSEPSQLSIDQNAQGLARYAIICQENVLVPIVEPEILVDGPHDIDRCAYVTEIVLAACYKALNDQHVLLEGTLLKPNMVTPGSDSKKVAPEVIAEYTVRTLQRTVPAAVPAIVFLSGGQSEEEATLNLNAMNKLQTKKPWNLSFSFGRALQQSTLKAWSGKTENEEKARAAFLGEVQGNSEATXGTTRATHLAEGAXEKLHVKDYNTDCLPSVLWPLGVRLYIALLVPDPIRYQIVLKYGLS

SEQ ID NO: 9778 - protein, 521 aa, Kluyveromyces lactis NRRL Y-1140
MSKFKFTDLKSIPGKIELAKQFYRSRQARLAQSKSPRATDINERIRSLQKLYWAVKDNEERLIAAASKDFHRARSETLTIELVPLYNNILYLIKNMKKEIEPKKIKVSLLAHWFGTTFVEKIALGTVLVISPFNFPILLALDPLAGAIAGGNSVVFKPSELTPACAEVMEEICNEAFEKGQVETVQGGAEETSALVESGKFDKIFYTGSTTVGTIIAEKAAKSLTPCVLELGGKSPVFISPNLPKSQWETAIRRIYYSSMGNAGQICVAADYVLCPDSIYDEFVDSCKKVLNEFYPSVTSDTEYTHMIHERAYNRIQTVIETTKGQKTVAQHSDNLPPLCIPPTIISDVSWDDPSMTGENFGPILPIMRYTDLDETIDTLIKRFDTPLVQYIFTNSKDEIDHILTRIRSGACVVNDTLLHVGIEEAPFGGIGTSGYGNYHGPYTFKTFTHERTIFKQPFWVDLLIYVRYPPFDKLNTRISQISLEDKPNFDRNGRRIYGIKNIGIILTSGVLLGFLINAMM

SEQ ID NO: 9779 - protein, 203 aa, Brassica napus
MAKQEEVTVPIFTSLDPVYGEGSQLQEANSRFDALKSKFNQAFGASPQLFARSPGRVNLIGEHIDYEGYSVLPMAIRQDTIIAIRKREGQNELRIANVDEKYSMCTYPADPLQEIDLKNHKWGHYFICAYKGFHEFAKSKGVNVDSPVGLDVVVDGIVPTGSGLSSPAALVGSSTMAIMAVLGESFEKKELAQLTCECEQHIG

SEQ ID NO: 9780 - protein, 470 aa, Streptomyces avermitilis MA-4680
MTAAGAAQAPIVAGHPLLGSMNDLLNDPLATYLRARRDHGDVVRFRAGPPGLRADIYAVFSAEGAQQVLATESGNFRKDNVFYGELRDSVGNGLLTSQDATYLRQRRLVQPLFTRRRVDGYAGQVADEAAGLAEAWRGIPGGGVELVGEMHRFALRVVGRILFGTDMETTFEVIERTLPLLQEYALKRGLAPVRTPRTWPTPANRRAARTQAELFALCDGIIDSRRNRKNEGDGGEESGEDLVTLLVRAGNAEDGSLDAAELREQVLIFLLAGHETTATALAFALHLLARHPEQQRRVRDEADRVLGGPGGRAPTAADMEALPYLTMVLKEAMRLYPSAPVIGRRAVADAEVDGVRIPAGADLFVSPWVTHRHPDYWPDPERFDPERFTPEAEAGRPRYAWFPFGGGPRACIGQHLSMLESVLGLAVLIREFEFEAVGEEEVPLGAGITLLAKGPARCRVIPRSSGPRSS

SEQ ID NO: 9781 - protein, 302 aa, Pseudomonas aeruginosa
MFVAEQPGELDRVEQFGKRIAGADSNVAIGLARLGFAVAWLSRVGDDSLGRFVLDSLTREGLDCRFVEVDAQAPTGFQMKSREVDGADPRVEYFRRGSAASRLGLAHIREEMLGARHLHATGIPPALSASACELSHELMRRMRGKGASLSFDPNLRPSLWPSERRMIAEINALAAHAHWVLPGLEEGRLLSGWQEPADIAAFYLDMGVDAVAIKLGPSGAYYRDAHGEGLVPGVPVATVVDTVGAGDGFAVGVVSALLEGLPLPDAVARGNWIGSRAVQVRGDMEGLPKRSQLLDRERRRSA

SEQ ID NO: 9782 - protein, 280 aa, Streptococcus mutans UA159
METVVLSNGVKMPILGFGVFQVPDLEECERVVTEAIKVGYRLLDTAQVYGNEEAVGNAVRKSGLAREEFFITTKVWISNAGYEKAKASLDESLRKLQTDYVDLVLIHQPFGDYYGTWSALEAYYKSGKIKAIGVSNFYPDRLVDLASFNEIVPMVNQVETHVFNQQIEAKKVSEEYGVQLESWGPFAEGKNNFFTNPTLTAIGEKYGKSAAQVGLRYLIQRGVVVIPKTVHQERMVQNFDVFGFNLSDDDMADILKLDQGESLFINHYDPETVKFLANYK

SEQ ID NO: 9783 - protein, 199 aa, Cyanophora paradoxa
MPIGYPLVKAMDKDRFISYFLINNALLNERVIFLCNYEDATDESIYIGMLLYLESENSQKPVSFYINSSITFPNLCFGLYDTILQIKADIVTICLGLAGGMSSLILAAGTKGQRFALPNSRIMMQEPLIDGGVNGQATDLAIEAKELMDTKEILINLYHERTGQPKPVIEKDLQRPRYFSAQAAKEYGFIDSLLMASNG

SEQ ID NO: 9784 - protein, 288 aa, Streptococcus mutans UA159
MEYITLNTGVKMPMEGFGVFQVTDPEICKESVLNAIKTGYRLFDTAAVYGNEKALGEAIHEAIEQGLVTRNELFITSKLWVQDMNYEAAKKGIERSLEKLGLDYLDLYLLHQAMRDYFGAYRALEEAYQAGKLRAIGVSNFYPNILTNFCETVSVIPAVNQIELHPFFTQEEALETARYYGVVPEAWAPLGGGRYDAFNNAILQEVASAHQKTVGQIMLRWNVQRGVVVIPKSTHKERIEENFAIWDFSLTDDEMTKIASLDMGYGDTRTKHFDPNFVRSVLNVKIHD

SEQ ID NO: 9785 - protein, 400 aa, Chlorobium tepidum TLS
MSVESFERFLSRRVLSMQESQTMKITGLAKKMQAEGKDVVSLSAGEPDFPTPENVCEAGIEAIRKGFTRYTANSGIPELKKAIIRKLQRDNGLEYAEDEIIVSNGGKQALANTFLALCDEGDEVIVPAPYWVSFPEMARLAEATPVIVETSIETGYKMTPEQLAAAITPKTRILVLNSPSNPSGAVYNEAEVRALMQVIEGKEIFVLSDEMYDMICYGGVRPFSPARIPEMKPWVIVSNGTSKSYSMTGWRIGYLAAPKWIINACDKIQSQTTSNANSIAQKAAVAALDGDQSIVEQRRAEFEKRRDFMFRELNTISGIECTLPEGAFYIFPSIKGLLGKTFGGKVMKDSTDVAEYLLTEHYVATVPGDAFGAPENLRLSYAASIEELAEAVNRIRKAFS

SEQ ID NO: 9786 - protein, 275 aa, Physcomitrella patens subsp. patens
MCLRCVQSAGTGSRGVVSMAGTGKFFVGGNWKCNGTTESIKKLVDELNSVMLEEGVEVVVSPPYLYISQVLGSLSNRIEVAAQNSWVGKGGAFTGEISAEQLADAGVKWVIQGHSERRHVIGETDAMIGKKSAYALSQGLGVIACVGEKLEDREANRTTDVVFEQLQAYADAVGSDWSNIVVAYEPVWAIGTGKVASPQQAQEVHAAIRQWLKEKVSDDVSSKTRIIYGGSVNGANSAELATQEDIDGFLVGGASLKGAEFGVICNAVTAKKVAA

SEQ ID NO: 9787 - protein, 444 aa, Neisseria gonorrhoeae FA 1090
MTDLNTLFANLKQRNPNQEPFHQAVEEVFMSLDPFLAKNPKYTQQSLLERIVEPERVVMFRVTWQDDKGQVQVNRGYRVQMSSAIGPYKGGLRFHPTVDLGVLKFLAFEQVFKNALTTLPMGGGKGGSDFDPKGKSDAEVMRFCQAFMTELYRHIGADTDVPAGDIGVGGREIGYLFGQYKKIRNEFTSVLTGKGLEWGGSLIRPEATGYGCVYFAQAMLQTRNDSFEGKRVLISGSGNVAQYAAEKAIQLGAKVLTVSDSDGFVLFPDIGMTEAQLAALIELKEVRRERVATYAKEQGLQYFENQKPWGVAAEIALPCATQNELDEEAAKTLLANGCYVVAEGANMPSTLGAVEQFIKAGILYAPGKASNAGGVATSGLEMSQNAIRLSWAREEVDSRLFGIMQSIHESCLKYGKVGDKVNYVNGANIAGFVKVADAMLAQGF

SEQ ID NO: 9788 - protein, 254 aa, Zea mays
MARCSNGLLGLLNAGVLVLAIVALGGGAWLSHRASTTDCERFLERPVIALGVLLLALSLAGLAGALCRASCLLWLYLLALFLLILLLFAFTVFAFVVTNRGAGWVVSGRGYKEYRLGDYSTWLQRRVENSQNWAKIRSCLQDGKVCQKLASRKETAAQFVNSNLSPIQSGCCKPPTGCNFTYQSETVWTKPAGFNTTTDDCMACKAGVLANLKNDWKKIATVNIVFLIFLVVVYSVGCCAFRNNRQDNSYPAWK

SEQ ID NO: 9789 - protein, 394 aa, Mesorhizobium loti MAFF303099
MLHTISAFDRLGEENAFAVLARATALAQQGRDIVNLGIGQPDFKTPQHIVEAAIKALRDGHHGYTPANGLLATREAVVRRTLTTTGVEVSPEAVMILPGGKPTMFAAILMFGEPGAEILYPDPGFPIYRSMIEFTGAAPIPVPMREENGFAFSAEETLALITSKTRLLILNSPANPTGGVTPRAEIEKLVKGLEKHPDVAILSDEIYDAMTYDGETHCSLLGYPEIRDRLIVLNGWSKTWAMTGWRMGWSIWPNGDRGAHLYDKVRKLAVNCWSCVNAPSQFAGIAAIDGPQDDVDTMMRAFDRRRKVVVEGLNALPNISCITPKGAFYAFPNVSKTGWKAKKLASALLDDAGVALIGGPDFGILGEGYVRLSYANSEENILRALERIGAFLSK

SEQ ID NO: 9790 - protein, 449 aa, Escherichia coli CFT073
MSEIVVSKFGGTSVADFDAMNRSADIVLSDANVRLVVLSASAGITNLLVALAEGLEPGERFEKLDAIRNIQFAILERLRYPNVIREEIERLLENITVLAEAAALATSPALTDELVSHGELMSTLLFVEILRERDVQAQWFDVRKVMRTNDRFGRAEPDVAALAELAALQLLPRLNEGLVITQGFIGSENKGRTTTLGRGGSDYTAALLAEALHASRVDIWTDVPGIYTTDPRVVSAAKRIDEIAFAEAAEMATFGAKVLHPATLLPAVRSDIPVFVGSSKDPRAGGTLVCNKTENPPLFRALALRRNQTLLTLHSLNMLHSRGFLAEVFGILARHNISVDLITTSEVSVALTLDTTGSTSTGDTLLTQSLLMELSALCRVEVEEGLALVALIGNDLSKACGVGKEVFGVLEPFNIRMICYGASSHNLCFLVPGEDAEQVVQKLHFNLFE

SEQ ID NO: 9791 - protein, 131 aa, Cicer arietinum
ERGVGLEHEDENIADLYLAVQDGIISGTTDYDILFGQLLENESGLKGSPPTAKSFVENLPLVELTEEELKGKDIVCAVCKDEVMLEEKVRKLPCSHCYHGDCILPWLSIRNTCPVCRFELPTDDADYERSK

SEQ ID NO: 9792 - protein, 363 aa, Oryza sativa
  misc_feature (131)..(131): Xaa can be any naturally occurring amino acid
MECWEKKPRNLGGSLPVPNVQDLAARPDHLTPTLLRRYLRPHHLSLPADDHHAMAMIPVVDFARLIDHHEEAAKLRHACEEWGFFQVINHGIADETVEEMKRDVMAFFNLPLADKAAFAQQPEWIEGYGQXAFVTSEDQTLDWSDLYFLTTQPPSYRDLRFWPPETSSTFRRSMDRYSLETQRVATELLRAMARNLGLRDADKMTRLAAAQSMRMNYYPPCPAKERDRVLGVSPHSDAVGLTLLLQVSPVKGLQIRRGDDWIPVDPIPGALVANVGDVVEMVTNGRYKSIEHRVVVDAAQERVSVAAFHNATFGSTYGPLEEMVGGGEARYRSISVEDYVRLVVSSKLQGKNILDAVKIITTT

SEQ ID NO: 9793 - protein, 275 aa, Rhizobium sp. NGR234
MTSDLDTRLDLLRNITSKVGAFALARFGNLSHIVIETKGEADYVSAADRDAESLARRLIHAQFPADAIVGEEQLGDAEVDHWLIDPIDGTANFLSGIPLWAVSIAFVRNKEPVLGAVALPALDTLLWASVDGPLHGTGSVSPLVGAQPIAFGIGRNRTWPLAHRLEVEAAFEARGYHIVCLGSCAAALAMVAAGRLAGYVEHGTHLWDCAAGHVLCRAAGAPSSILFEADGKVAIIAAPQHLRVTAKADARSLSEKHIFDPGSDRISHRMESSAD

SEQ ID NO: 9794 - protein, 351 aa, Ustilago maydis 521
MSTQEPATSSSSTDPAVSDVKLERKARKEAQKALKLQQAAQKKIAIKAEQPSTASSSISKSSSANASASASSSSSSSLKAPRKPPSSDEQLSRALAYILRHGAEKEALEIRADGYVLLEHVLQRPRVKSVTITLPDGKKTKPRLEDVRRIVESNEKKRFELSQQNSAEWWVRAVQGHSLKNVVELQHVALTLENLHLLKLTHDDPHNHSLTEEHHLKTNLDALQIASEHRVQVIHGTYAPAWDLILASGGLKPMTRNHIHLAKGKFGQQGVISGMRKSANRLIYIDIVKAITDGIPFYLSSNGVVLTPGDNQHHMLGVQYFTKVEDQNAQLVWSRPPSPSPSPSPSPSPTV

SEQ ID NO: 9795 - protein, 263 aa, Pseudomonas syringae pv. syringae B728a
MSSAIGIKTEQDLVQLRIAGRLAADVLAMITPYVKAGVSTEALDDICNEYIVKELKVIPANVGYHGFTKTTCISPNAVVCHGIPSATDILKEGDIVNIDVAVIKDGWYGDTSRMYLVGEVSPLARRLVETTYEATRAGIHAVRPGATLGDIGYAIQSVAHREGFSVVREYCGHGIGRKYHEEPQVLHYGAQGKGLRLKPGMVFTIEPMINAGRAGTRTLPDGWTVLTSDLSLSAQWEHMVAVTSTGFELLTPWPDGTGDYPAI

SEQ ID NO: 9796 - protein, 260 aa, Brucella suis 1330
MFAGMNASSRPFSPEELERYARHIVLPVIGGPGQQKLKAARVLVVGAGGLGAPALQYLAAAGVGTLGIVDDDTVSLSNLQRQIIHDTDSIGQPKVESALASIARINPHVKVEGHQLRLDAHNAEALIAGFDVVVDGSDNFATRYVLADAAAKVGRPLVTGAMGRFDGTVTVLMPYANGPDGAKNPSYRDLFPDAPLPGTVPSCAEAGVLGVLPGVIGSLQAMEVIKLVTGIGEPLVGRLLLYNALNVRFETIRYKARKPK

SEQ ID NO: 9797 - protein, 1498 aa, Emericella nidulans
MSFLGSISPNLPRSQSVVSHNLPQAHGLDENDDIYHNHSTTAQPGASEKDKSEDGETLHENEPDGEARVTLLARQLTRHSTRLTAKSTLENPFFLDDSDSTLNPNSPNFRVRDWMKMLLEIRSRDPERYPDRTAGIAFKNLSVHGFGSPTDYQKDVMNVLLEIGTIARRLAGMKMPKIQILRDFEGLVRSGEMLVVLGRPGSGCSTFLKTIAGEMNGIQVSDDAVLNYQGISSKNMQNSFRGEAIYTAENDIHFPQLSVGDTLMFSALARAPRNRLEGVSRKQYAEHMRDVVMAMLGLSHTINTRVGNDFIRGVSGGERKRVSIAEATLSQAPLQCWDNSTRGLDSANALEFCKNLALMSKYTGSTACVAIYQASQSAYDVFDKVTVLYEGRQIYFGNTKDAKKFFVDMGFECPERQTTADFLTSLTSPAERLVRPGYEGRVPCTPDEFAAAWKRSEERAKLMAEIEEYERQYPIGGPSYDAFVDARKAMQSKRQRVNSPYTISIWQQVSLCVVRGFQRLRGDFSLTTTSLIGNFMMALIIGSVFFDLPDDTSSFYYRGALLFFAVLLNAFSSALEILTLYSQRPIVEKQSRYAFYHPFAEAVASMICDTPYKLINSFTFNVPLYLMTNLRRDAAAFFTFWIFSVVTTFTMSMIFRTIASTSRSLSQALVPAAMLILGMVIYTGFTIPTQNMLGWSRWMNYINPIAYSFESFMVNEFDGRQFECVSIIPSGDEYNNVSMQYRICSTVGAESGSRIVDGGQYLELSYQYTKSHLWRNMGILIGFMVFFAFTYLLGTEYISEQKAKGEVLLFRRGRQPDLSTTEADPENPIQPSNAPKTEESAPQNTARIQRQTAIFHWEDVCYDIKIKGQPRRILDNVDGWVKPGTCTALMGVSGAGKTTLLDVLATRVTMGVVSGSMLVDGRLRDQSFQRKTGYVQQQDLHLATSTVREALRFSAILRQPAHLSRQEKLDYVEEVIKLLGMEAYADAIVGVPGQGLNVEQRKRLTIGVELAAKPQLLLFLDEPTSGLDSQTSWSILDLIDTLTQHGQAILCTIHQPSAMLFQRFDRLLLLASGGKTIYFGEIGPNSSTLSNYFVRNGSHGLPPGDNPAEWMLEVIGAAPGSNTEIDWVKTWRESPEYAKVREHLAELRATLSAKPADSSDPSALSEFAAPFSVQLWECLVRVFAQYYRTPTYIWSKAALCALTALYIGFSFFNAPTSIPGLQNQMFSVFMLMTIFGNLVQQIMPNFVTQRSLYEARERPSKAYSWKAFMAANIIVELPWNSLMAALIFFCWYYPIGLYNNAKPTDAVTERGGLMFLLIWTFLLFTSTFAHMIIAGIELAETGGNVAQLLFSLCLIFCGVLSTPDAMPGFWIFMYRVSPFTYLVSAMLSTGLSGTDVECEPVEYLTFAPPNNQTCGDYMRAYIDEVQSGYLLDPSATDQCSFCSMDKTDTFLLSVGSTFDEAWRNFGLMWAYILFNIVGAVFIYWLARVPKGKKMAGTA

SEQ ID NO: 9798 - protein, 332 aa, Mycobacterium sp. MCS
MVKAAVMGSGAWGTALAKVLADAGNSVTLWARRPEVAAEINDTHRNSGYLDEVDLPKTIHATADAAEALAGACTVVFAVPAQSLRSNLEQWKGLIADDATLVSLAKGIELDTLMRMSQVIVQVTGADPARVAVVTGPNLASEIADEQPAATVVACSDSGRAVALQRALATGYLRPYTNADVVGAEIGGACKNVIALACGMAVGVGLGENTVAAIITRGLAEIMRLGIALGAKPATLAGLAGVGDLVATCTSVQSRNRTFGERLGRGGTMESALRAAGGHVAEGVTSCRSVLALAASYDVEMPLTDAVNRVCHKGLSVDEAVVLLLGRSTKPE

SEQ ID NO: 9799 - protein, 550 aa, delta proteobacterium MLMS-1
MAFLGLIQGGQKAPDILGNHLGRVGGQYFPEILAGDLAGTQPHIGAGQLQPGPAGVGAAQQYPLVGHHRLFVAPGLKGGPAQQEVDLRVGGVFFKGGKKGVVGRFIIVGRHGLAAGGQRIVKGGSGDRPGPERQSQHQHAEQDGESKHDFPQNMVIWVDLQTALSSPLPHNSRCFPLVKHYMGQLFGKNWLDTPCEVGSCLALQPQDPFFPSIRRTMKILITGSAGFIGNALALRLLERGDEVIGVDNVNAYYDPTLKESRLNRVRGCAGFTEERVSLEDRPAMERVFRQHQPQRVVNLAAQAGVRYSLENPHSYVDANIVGFTNILEGCRHHGVEHLVFASSSSVYGANTEMPFSVHHNVDHPLSLYAASKKAGELMAHTYAHLYRLPVTGLRFFTVYGPWGRPDMALFLFTQKILAGEPIDVFNYGNHRRDFTYIDDIVEGVIRTLDHPAEPNPDWNGATPDPCTSTAPYRLYNIGAHRPVELMHYIEVLEENLGRKAEKNLLPLQPGDVPDTYADVADLKADVGYEPTTPVEEGVARFVEWYLEYYR

SEQ ID NO: 9800 - protein, 346 aa, delta proteobacterium MLMS-1
MAILTTGGAGYIGSHTTLELLNAGHEVVVLDNLSNSSPASLERVAALAGKAPVLVQGDINDPELLAELFARHQISAVIHFAGLKAVGESVAQPLAYYHTNVGGTVNLCRAMAAAGVFRLVFSSSATVYGEQQQMPLTEDCPTGKPTNPYGRSKLMIEELLQDLARADQRWSVALLRYFNPVGAHPSGLIGEDPRGTPNNLLPYISQVAIGKRPELQVYGNDYPTRDGTGVRDYIHVVDLARGHLAALDYLQRQTGAGVWNLGTGRGYSVLEMVEAFASAAQRPVPYRIVARRPGDIAECWSDPGKARRELGWQAEKGLPEMMADAWRWQSRNPDGYSSQTLLHCNA

SEQ ID NO: 9801 - protein, 209 aa, Vitis vinifera
MAAAARKATVPVSSVISSAKLGDAPVSVQRPSWELDDWEFASVEEEINIGTGEPLPRVVFGGVPTLQEAKEATSELKDALDQLYLSPSRSIRSGVQQLGLLQIANSDHLETKACVATTENTVATVPAHAIQAFAYLKDSPAAQNVVASIASDPNVWSAVMQNEALVEFLQAQKTLICALIMCSLPQYGSQCGGICCRYWVSRSGSPKEL

SEQ ID NO: 9802 - protein, 330 aa, Bacillus halodurans C-125
MSDLFRNIQEQVKRHQPTIVLPEGTDERILEAAANLAKDEVVKPILVGNVADIQARASELNIDLGSVEIIDPKSYGAFDDMVHAFVERRKGKETEETAREKLVDVNYFGTMLVYTGVADGLVSGAAHSTGDTVRPALQIIKTQPGIKRTSGVFIMVKEDQKLVFADCAINIAPTAEELAEIAVATAETAKVFDIDPKVAMLSFSTKGSAVSPETEKVAEATKLAQEARPDLVIDGEFQFDAAFVPAVAQKKAPESPLKGEANVFVFPSLESGNIGYKIAQRLGGYEAIGPILQGLNQPVNDLSRGCNASDVYKLSLITALQAINQKGDNN

SEQ ID NO: 9803 - protein, 286 aa, Brassica oleracea
MEGKEEDVRVGANKFPERQPIGTSAQSDKDYKEPPPAPLFEPGELASWSFWRAGIAEFIATFLFLYITVLTVMGVKRSPNMCASVGIQGIAWAFGGMIFALVYCTAGISGGHINPAVTFGLFLARKLSMTRAVYYIVMQCLGAICGAGVVKGFQPKQYQALGGGANTVAHGYTKGSGLGAEIIGTFVLVYTVFSATDAKRNARDSHVPILAPLPIGFAVFLVHLATIPITGTGINPARSLGAAIILNKDNAWDDHWVFWVGPFIGAALAALYHVIVIRAIPFKSRS

SEQ ID NO: 9804 - protein, 378 aa, Bacillus sp. SG-1
MLLAGGKGSRLSSLTKSLAKPAVPFGGKYRIIDFTLSNCTNSGIETVGVLTQYQPLLLNSYIGIGSAWDLDRKSGGVTVLPPYAESSEVRWYTGTASAIFQNLNYIEQFDPEHVLILSGDHIYKMDYEKMLNYHISKKADVTISVLEVPWDEASRFGIMNTSEDMRVVEFDEKPQFPKNNLASMGIYIFNWSLLKEYLEMDDRNPESSHDFGKDVIPLLLEEKKKLMAYPFKGYWKDVGTVKSLWEANMDLLDDDCDLNLFDHEWRIYSVNPNQPPQYISEQAEVEGSLINEGCYIEGIVDHSVLFQGTRVEAGAHIKQSVIMPDAVIGKGAYLEKVIVPPNVRIPDGVCIIPEEGSDEVILVSETFLESIMAEEEAQ

SEQ ID NO: 9805 - protein, 541 aa, Vitis vinifera
MGFELGSVVMKLGMVSTSDHSSVVSMNLFVALLCACIVVGHLLEEYRWMNESITALALGLCTGIIILLTTRGKSSHILVFSEDLFFIYLLPPIIFNAGFQVKKKQFFRNFMTIMLFGAIGTLISFGIISLGAIHFFKKMKIGSLDIGDYLALGAIFSATDSVCTLQVLNQDETPLLYSLVFGEGVVNDATSVVLFNAIQSFDLSHIDSSIALQFIGNFLYLFITSTMLGVFAGLLSAYIIKKLYFGRHSTDREVAIMILMAYLSYMLAELFYLSAILTVFFCGIVMSHYTWHNVTESSRVTTKHAFATLSFVAEIFIFLYVGMDALDIEKWRFVSDSPGKSIGVSSILLGLVLVGRAAFVFPLSFLSNLTKKSSSEKIHIKQQVTIWWAGLMRGAVSMALAYNQFTRAGHTQLRGNAIMITSTISVVLFSTVVFGLMTKPLVRLLLPSPKPFTSMISSEPSSPKYLVVPLIGNGEETETDQASQNVPRPTSLRMLLSTPSHTVHHYWRKFDDSFMRPVFGGRGFTPFIPGSPTEPNLGQWR

SEQ ID NO: 9806 - protein, 150 aa, Triticum aestivum
  misc_feature (58)..(58): Xaa can be any naturally occurring amino acid
  misc_feature (91)..(91): Xaa can be any naturally occurring amino acid
  misc_feature (96)..(96): Xaa can be any naturally occurring amino acid
  misc_feature (99)..(99): Xaa can be any naturally occurring amino acid
  misc_feature (120)..(120): Xaa can be any naturally occurring amino acid
  misc_feature (123)..(123): Xaa can be any naturally occurring amino acid
  misc_feature (130)..(131): Xaa can be any naturally occurring amino acid
  misc_feature (134)..(134): Xaa can be any naturally occurring amino acid
  misc_feature (138)..(139): Xaa can be any naturally occurring amino acid
MAPTVMASSATSVAPFQGLKSTAGLPVSRRSNGASLGSVSNGGRIRCMQVWPIEGIKXFETLSYLPPLSTEASSSRSDYLIRSKWVPCLRXSKLGXLPXEHNAPLGYYDCRYWDMLKLPXFGXTDAPSLXXLKXVKEXXLNLIPTIGTRK

SEQ ID NO: 9807 - protein, 154 aa, Staphylococcus aureus subsp. aureus COL
MNFEGKLIGKDLKVAIVVSRFNDFITGRLLEGAKDTLIRHDVNEDNIDVAFVPGAFEIPLVAKKLASSGNYDAVITLGCVIRGATSHYDYVCNEVAKGVSKVNDQTNVPVIFGILTTESIEQAVERAGTKAGNKGAEAAVSAIEMANLLKSIKA

SEQ ID NO: 9808 - protein, 393 aa, Staphylococcus aureus subsp. aureus COL
MQFDNIDSALMALKNGEPIIVVDDENRENEGDLVAVTEWMNDNTINFMAKEARGLICAPVSKDIAQRLDLVQMVDDNSDIFGTQFTVSIDHVDTTTGISAYERTLTAKKLIDPSSEAKDFNRPGHLFPLVAQDKGVLARNGHTEAAVDLAKLTGAKPAGVICEIMNDDGTMAKGQDLQKFKEKHQLKMITIDDLIEYRKKLEPEIEFKAKVKMPTDFGTFDMYGFKATYTDEEIVVLTKGAIRQHENVRLHSACLTGDIFHSQRCDCGAQLESSMKYINEHGGMIIYLPQEGRGIGLLNKLRAYELIEQGYDTVTANLALGFDEDLRDYHIAAQILKYFNIEHINLLSNNPSKFEGLKQYGIDIAERIEVIVPETVHNHDYMETKKIKMGHLI

SEQ ID NO: 9809 - protein, 169 aa, Cyanophora paradoxa
MANRQKMSKTRDKKPDWQERVVQIRRVSKVVKGGKKLSFRAIVVIGNERGQVGVGIGKASDVINAVKKAAADGKKHVVEVPLTRSNSIPHPIDGIGGAARVIMRPSAEGTGVIAGGAVRTVLELAGVRNILAKQLGSNNPLNNARAAMNALSRLKTFSQFAKDRGVIAE

SEQ ID NO: 9810 - protein, 91 aa, Brassica napus
MEIETHDSAVPVKNLVKVAFKLGTESYTVDAVQGDTVLDQLVSMKEVSMKILKEFITKHNVLDHVPDESLSDEGDEDDAVKCPVKPKKTKI

SEQ ID NO: 9811 - protein, 381 aa, Triticum aestivum
  misc_feature (209)..(209): Xaa can be any naturally occurring amino acid
NKFVQKSRLVPVRNSRDIVDPRVRSKAISLLKGALDYSDFKDVDMVIEAVIEKIPLKQSIFADIEKICPPHCILATNTSTIDLNIVGEKTNSQDRIIGAHFFSPAHIMPLLEIVRTEKTSPQAILDLITVGKIIRKVPVVVGNCTGFAVNRTFFPYTQGAQLLVSLGIDLFRIDRIISNFGMPMGPFQLQDLAGYGVALAVKDIYAAAXFGTRNFNSVLVDLMAETGRQGKSNGKGYYLYEKGAKPKPDPNVQLVIDEYRKQAKTMPAGKPVTLSDQDILEMVFFPVVNEACRVMDENVVIRAADLDIASVLGMGFPKYRGGLVFWADTVGASYIHSKLSKWAEAYGDFFKPSSYLEERAKSGRPLAAPRTAHQASTRSRM

SEQ ID NO: 9812 - protein, 118 aa, Populus trichocarpa
MPEEDLVDIKFRLYDGSDIGPFRYSSTSTVDMLKQRIVSDWPRGKTITPKAVNEIKLISSGRVLDNNKTVGQCRTPFGEAAGGVIIMHVVVQPSLAKTKTEKKIDKSPKKIVCSCSIM

SEQ ID NO: 9813 - protein, 439 aa, Salmonella typhimurium LT2
MSKPKSNKMGVVQLTILTMVNMMGSGIIMLPTKLSEVGTISIISWLVTAVGSMALAWAFAKCGMFSRKSGGMGGYAEYAFGKSGNFMANYTYGVSLLIANVAIAISAVGYGTELFGAALTPLQIGLATIAVLWVCTIANFGGARITGQISSVTVWGVIIPVVGLCIIGWFWFSPSMYVASWNPHHVPFFSAVGSSIAMTLWAFLGLESACANADVVENPEKNVPIAVLGGTLGAAVIYIVSTNVIAGIVPNMDLANSTAPFGLAFAQMFTPAVGKVIMALMVMSCCGSLLGWQFTIAQVFKSSADEGYFPKVFSRVTKVDAPVQGMLIIVIIQTGLSLMTISPSLNSQFNVLVNLAVVTNIIPYILSMAALVIIQKMANVPSSKAKVANFVAFVGAMYSFYALYSSGEEAMLYGSIVTFLGWTLYGLVSPRFELKNKHG

SEQ ID NO: 9814 - protein, 491 aa, Thalictrum flavum subsp. glaucum
MEVLSAAMVSLFFIFLFIFFILCDSRNKDLPPGPRPSPIVGNLLQLGEKPHAEFAKLAEKYGELFTLKLGSQTVVVASSPAAAAEILKTRDKILSGRYVFQSFRVYEHVLNSIVWSECNENWKLLRKVCRTELFSPKMIESQAYIREAKALDMVRFLRKKENQEVKIVEVVFNTLVNIFGNLIFSKDVFDLEDPTGGSAELKEHLWKLLDMGNSTNPADYFPIMGKFDLFGQRREVAKVLKQIYDVWGVMLKERRSITGHRENDFANVLLNAGLDDQKINALLMELFGAGTETTASTIEWAITELTNNLRVISKLRAELINVVGHKTVKESNIPHLPYLQAIVKETLRLHPPTPLLLPRRALETCKVMNYTIPKECQIMVNAWAIGRDPKTWDDPLTFKPERFMNSTVDYKGNDFELIPFGGGRRICPGLPLASQFLSLIVATLVQNFDWSFPQGMTPNEVPMDEKFGLPLQKDPPLLIVLKARTSMKLQD

SEQ ID NO: 9815 - protein, 67 aa, Glycine max
ARGENDLPGLTDVEKPRMRGPKRASKIRKLFNLSKEDDVRKYVNTYRRTFTTKAGKIPGAFMLCLIL

SEQ ID NO: 9816 - protein, 306 aa, Pseudomonas syringae pv. syringae B728a
MQAKIVIVGSLNMDLVIRAQRLPRPGETLSGETFDTVPGGKGANQAVAAARLGASVAMIGCVGADAYGEQLRAALLAEQIDCQAVTVVEGVSTGIASIVVDANSQNAIVIVAGGNGRLTPALLERFDALLADSQIVICQLEVPTETVFHTLARARALGKTVILNPAPASEPLPASWYALIDYLIPNESEAQTLTGVNVDSPAAAENAASVMLAAGARNVIITLGEHGTLFANASGMDHIPARRVQAVDTTAAGDTFVGGFAAALSAGHGELQAIRFGQAAAAISVTRAGAQPSIPTFEEVQEFNSL

SEQ ID NO: 9817 - protein, 904 aa, Phaseolus vulgaris
MWITFYVAVLAVLLLQAHAQPGFISIDCGAEAGVSYTERSLGINYVSDANFINTGERRTIASEEISRNNQQQQLWRLRSFPEGKRNCYKINVTSGSNYLIRTTFLYGNYDGRNKLPMFDLLLGANLWSTVTIDDASSGQSNEIIHVPSLDFVQICLVNTGSGTPFITAIEFRTLKNDTYVTESGSLQSSLRWDLGSNISYRYPTDVYDRFWNPQDNKDWTNLSASIPDDSLDQGDYQPGASNMRTAVTPANASAPLVISWEPKDETDEFYVYMHFTEIQELTTNQTRQFDIMRNGELWIPNFSPRYLVVDTLNTSSASAVNGKVITYSLVRTGNSTLPPIISAIEIYRVIDLQKPETLQADVDAITSIKSVYGVKRDWQGDPCAPVAYLWNGLNCSYHGIEFPRITALNLSSSGLSGKIDPSISKLNMLEKLDLSNNNLHDEVPDFLSQLQHLKILHLEKNNLSGSIPSALVEKSKEGSLTLSLGQNPHICEHGQCIDHRNNIVIPLVASICGGLILLVTVTAILWILRRRRKSKASMVEKDQSEISEQHTKQEGSLQQSKKQICSHSDICKITNNFNTIVGKGGFGTVYLGYIYDTPVAVKILSPSSFRGYEQFQAEVTLLLRVHHKNLTSLIGYCDEGSNKSLIYEYMANGNLLEHLSGTHSKSKFLSWEDRLRIAVDAALGKKANFRLCVLTVLLMWHLHKSNIGLEYLQNGCKPPIIHRDVKSSNILLNEHFQAKLSDFGLSKIIPDDGASHLSTVVAGTPGYLDPDYYTNNRLTEKSDVYSFGVVLLEIITGQLVIARNEERSHIIEWVRSLVAIGDIKAIVDSRLEGDFDINSAWKAVEIAMACVSLRPNQRPIMSVVVFELKETLVTELARTKPNSSAESIEPVNLDFSAQLIPLAR

SEQ ID NO: 9818 - protein, 391 aa, Bordetella pertussis Tohama I
MSAQISPLNAGAAPESFGIASVPEIIAELRAGRIVILVDEEDRENEGDLVMAAEFVTPEAINFMVTHGRGLVCLTLTEERCRQLDLPLMASRNGTRYGTNFTQSIEAAEGVETGISAADRARTIQVAVARDAQPSDLVQPGHIFPVRAVPGGVLVRAGHTEAGCDLTAMGGLTPAAVICEILKPDGTMARLPDLVEFAREHKLKIGTIADLIQYRSEHESIIARMGERMMQTPWGDFRCIAYRDDATRSPHLALVHGNIDPERETLVRVHEPASLFDVLDTGASPHSWSVGQALHAIAASPAGVLVLMNCQSSTEHLFGQIANWAGPAERAAAQEGDRFGLRTYGIGAQILRDLNVGRMKLLARPRKMPSMAGFALTITGYDCVPPNLRND

SEQ ID NO: 9819 - protein, 451 aa, delta proteobacterium MLMS-1
MTRPEPPKPGTDFKSVPSHISRLATRQSTIGIIGLGYVGLPLMLRFNGAGFAVLGIDVDPGKVTQLNNGESYIEHISAADIAAARAAGFEATTDFARAAEADALIICVPTPLNKSREPDLSYVTNTVDSLVPHLRPGQIISLESTTYPGTSEEELLPRLEKSGLTVGRDLFLVYSPEREDPGSKNFNPGNIPKVIGGHTPACLEAGRALYSPAIERLVPVSSTRVAEMTKLLENIFRSVNIALVNELKILCLRMEIDIHEVITAAATKPFGYMPFYPGPGLGGHCIPIDPFYLTSKAREYDISTRFIELAGEINTAMPYFVVQRVMEALNEQGKALKGARVLLLGAAYKKNVDDDRESPSYKLMDLLAQKGAEISYNDPHIPTLRPGRKYNFGLTSTPLTATNLAQADCILIATDHDAYDPAFISQHAQLIVDTRNLIPETPVTTGKLFKA

SEQ ID NO: 9820 - protein, 344 aa, delta proteobacterium MLMS-1
MTSYQQTIATLQAAPQSWLITGVAGFIGSNLLETLLKLNQQVTGLDNFATGHQRNLDEVQSLVSPAQWANFSFIEGDIRDPATCRRACRGSDYVLHQAALGSVPRSLEDPITTNGANIDGFLNMLVAARDAEVKRFVYAASSSTYGDHPALPKVEDAIGKPLSPYAVTKYVNELYAEVFARCYNFPSIGLRYFNIFGRRQDPEGAYAAVIPKWIAAMIQNETVFINGDGETSRDFCYIDNAVQVNLLAATSPNLEAANQVYNVAVGERTSLNQLYQHLRDHLAPSYPHLQNAQASHRDFRPGDVRHSLADISKAQTLLGYQPSHRIDEGLREAMGWYTNFLGEK

SEQ ID NO: 9821 - protein, 535 aa, Brucella suis 1330
MPVLKSEISTRSASFEANRKAMLAAIDVVAEASRIAIDGGGEKARDRHVSRGKLLPRERVAQLLDPGSPFLELGLTAAHGTYGGAAPAAGIITGIGRVSGRECMIVCNDATVKGGTYYPMTVKKHLRAQEIAGENRLPCIYLVDSGGANLPNQDEVFPDRDHFGRIFYNQAQMSAAGIPQVAVVMGSCTAGGAYVPAMSDETVIVRGQGTIFLAGPPLVKAATGEVVSAEDLGGGDVHTRLSGVADHLANDDAHALQIARAIAANLASEKRSFIPRGDGAAPLYDPEELLGVVSADTRIPYDVREVIARLVDGSDFDEFKARYGTTLVCGFASVYGMPVGIIANNGVLFSEAALKGAHFIELCCQRNIPLVFLQNITGFMVGRKYEAEGIAKHGAKLVTAVATANVPKITMLIGASYGAGNYGMAGRAYSPRFLWTWPNSRIAVMGGEQAAGVLATVKRDGIERTGGTWSAEEEAEFKRPTLEMFERQSHPLYASARLWDDGIVDPRKSREVLGLPLSATLNAPVEPTRFGIFRM

SEQ ID NO: 9822 - protein, 379 aa, Agrobacterium tumefaciens
MAKADFYETLGVSKTADEKELKSAFRKLAMKYHPDKNPDDADSERKFKEINEAYETLKDPQKRAAYDRFGHAAFENGGMGGGGGGFGGGGFANGGFSDIFEDIFGEMMGGGRARRSSGGRERGADLRYNMEITLEEAFTGKTAQIRVPTSITCDVCSGSGAKPGTQPKTCATCQGSGRVRAAQGFFSVERTCPTCHGRGQTISDPCGKCHGQGRVTEERSLSVNIPSGIEDGTRIRLQGEGEAGMRGGPAGDLYIFLSVRPHEFFQRDGADLYCTVPISMTTAALGGTFDVTTLDGTKSRVTVPEGTQPGKQFRLKGKGMPVLRSAQTGDLYIQIQIETPQKLSKRQRELLQEFEQLSSKENNPESTGFFARMKKFFDG

SEQ ID NO: 9823 - protein, 367 aa, Arabidopsis thaliana
MSRRSLTLLKNLARNANGSGIQTRSVTYMPRPGDGAPRAVTLIPGDGIGPLVTNAVEQVMEAMHAPIFFEKYDVHGEMSRVPPEVMESIRKNKVCLKGGLKTPVGGGVSSLNVQLRKELDLFASLVNCFNLPGLPTRHENVDIVVIRENTEGEYAGLEHEVVPGVVESLKVITKFCSERIAKYAFEYAYLNNRKKVTAVHKANIMKLADGLFLESCREVAKKYPSITYNEIIVDNCCMQLVAKPEQFDVMVTPNLYGNLVANTAAGIAGGTGVMPGGNVGADHAVFEQGASAGNVGKDKIVLENKANPVALLLSSAMMLRHLQFPSFADRLETAVKKVIAEGKCRTKDLGGTSTTQEVVDAVIAKLD

SEQ ID NO: 9824 - protein, 376 aa, Pseudomonas stutzeri
MAKRDFYEVLGVERGASEAELKKAYRRLAMKHHPDRNPGDKAAEEAFKEANEAYEVLSDPSKRAAYDQYGHAGVDPQMGAGAGGAGYGGANFSDIFGDVFSDFFSGGRGGSRGGAQRGSDLRYTLELDLEEAVRGTTVTIRVPTLVECKTCDGSGAKKGTSPVTCTTCGGIGQVRMQQGFFSVQQTCPRCHGSGKMISDPCGSCHGQGRVEEQKTLSVKVPPGVDTGDRIRLSGEGEAGTQGGPAGDLYVVVNVREHAIFQRDGKHLYCEVPISFADAALGGELEVPTLDGRVKLKIPEGTQTGKQFRLRGKGVAPVRGGAAGDLMCRVVVETPVNLSKRQREMLEEFRGTLQGDTSHSPKASGWFEGVKRFFGDV

SEQ ID NO: 9825 - protein, 394 aa, Fusobacterium nucleatum subsp. polymorphum
MAKRDYYEVLGVDKNASENDIKKAYRKAAMKYHPDKFANATDAEKKDAEEKFKEINEAYQVLSDNEKKQQYDQFGHAAFEQGGAGFGGGFNAGGFDFGDIFGDNIFGGGGGFGGFEGFSGFGGSSRRSYVEPGNDLRYNLEITLEEAAKGVEKTIKYKRTGKCEHCHGTGAEDDKMKTCPTCNGQGTIKTQQRTILGVMQSQSVCPDCHGTGKVPEKKCKHCRGTGTAKETVEKKINVPAGIDDGQKLKYAGLGEASQSGGPNGDLYIVIRIKPHDIFIRQGDNLYCEVPISYSTAVLGGEVEVPTLNGKKTVKVPEGTESGKLLKVSGEGIKSLKGYGKGDIIVKFTIETPKKLTDKQKELLQKFEESLNDKNYEQKTSFMKRLKKIFKDIID

SEQ ID NO: 9826 - protein, 426 aa, Neisseria meningitidis MC58
MENSLKEAALKFHEFPVPGKISVTPTKSLATDKDLALAYSPGVAAPCMEIHADPQNAYKYTAKGNLVAVISNGTAVLGLGDIGALAGKPVMEGKGVLFKKFAGVDVFDIEIDEKDPQKLVDIIAALEPTFGGINLEDIKAPECFYIERELRKRCKIPVFHDDQHGTAIITAAAVLNALRFTGRKIEEATLVCSGAGAAAIACLNQLLDLGLKRENVTVCDSKGVIYQTREDKDRMDESKQFYAIEDNGQRVLADAVKGKDIFLGLSGANLLTPEILNTMNEKPIVFAMANPNPEILPPLAKETRPDVVIGTGRSDFPNQVNNVLCFPFIFRGALDVGATTINEEMKRACVYALADLAMEEVTEEVVAAYGKKFEFGAEYLIPTPFDSRLLPRVATAAAKAAMESGVATRPIADLEAYAAKLSEWKL

SEQ ID NO: 9827 - protein, 348 aa, Crocosphaera watsonii WH 8501
MTSVQIPVIPEQSLDRECTTLSRHVLQQLQSFSPEAQDLSAIMNRIALAGKLISRRLSQAGLMADVLGFTGETNVQGESVKKMDVYANDVFISVFKQSGLVCRLASEEMDKPYYIPENCPIGRYTLLYDPIDGSSNVDINLNVGSIFAIRQQSGEDLDGEATDLLQDGRGQLAAGYIVYGPSTMLVYTIGHGVHSFILDPSLGEFILAQENIQIPDHGPVYSTNEGNFWQWDEAIRDYTRYVHRHEGYTARYSGALVGDIHRILMQGGVFLYPGTVKKPEGKLRLLYETAPLAFLMEQAGGKASDGVKPILDVVPDKLHARSPLVIGSKEDVSLVESFIQDHQRRGNA

SEQ ID NO: 9828 - protein, 163 aa, Populus trichocarpa
MLRQLASKRLFSQRTQILPRFYHEKVIDHFNNPRNVGSFDKTDPTVGTGLVGAPACGDVMKLQIKVDDTTGEIIDARFKTFGCGSAIASSSVATEWVKGKQMEEVMTIKNTEIAKHLSLPPVKLHCSMLAEDAIKAAVKDYQTKRAKSNVDSEAEPAVQAAKA

SEQ ID NO: 9829 - protein, 878 aa, Rickettsia conorii
MKKLIYYFGSNGSDGNASMKNILGNKGAGLAEMSNLKLPIPDGFTITTELCNYFYTHNNNFPKNFQSDLKKAITELEIITGKIFGSTSNPLLLSVRSGSKVSMPGMMDTILNLGMNNEVCNALADSCGDKRFALDSYKRFLEMYGSTVLSIPSDLFEQICEKHKMQADIHKDSDITVELLEKIIDDFKRLHIKYTKQLINDPYEQLESAIKAVLHSWMSNRAVIYRKINNISEDCGTAINIQAMVFGNLGKTSATGVAFTRSPSTGEKKLFGEFLINAQGEDIVSGTRTPMPIIANDSNSMQAMMPEVFKELSQIAQKLEEHYLDMQDIEFTIENNKLYILQTRTAKRTAIAAINIAVQMVEEKLISKEQALMRIDPESLNQLLHTRIDYSKGLTSIAEGLPASPGAATGIAVFSPYDAEKLSHHHKVILVRHDTSPEDINGMHVSSGIVTIRGGMTSHAAVVARGMGKPCVCGTSNLSIDEKKQILTAGDIVIKQGDIITIDGGSGKIFLGEMPLIQPTFSEESKLILDWADEISSLKVRANAETVNDALVSVKFGAQGIGLCRSEHMFFDKNKIPLVRDMIIAPDIERRKLAVQKLLPLQTEDFKALFRVMKDKPVNIRLLDPPLHEFLPTTEEDKKNLANSLNLPLSMINQRLHAMHEVNPMLGHRGCRLGICSPEIYQMQIEAIFTAIFELHKKEHIECNLELMIPLISNVGEIQKLKMDIYAVIEKLEQRYRYKFSFTLGTMIELPRAALGSKKIAKEVDYFSFGTNDLTQTTYGISRDDIASFLPYYLEEKIFESDPFTTLDEEGVGELIDIAIKRGKSSNANLKLGACGEHAGNPASIEFFHRMNLNYVSCSPYRIPIARIAAAQAKIKHG

SEQ ID NO: 9830 - protein, 462 aa, Silicibacter pomeroyi DSS-3
MTTTQHTPTPRDNFLRENNGRHQIHPMTHPLIIENRPPRIIVKGEGSYVTDIDGKTYVDGVGGLWNVNVGHNRPEVKAAITAQMEEISYYSSFAGTVTPPSIELSAKIMEMTADEDMARVLFSANGSDAVETALKLSRQYWKLEGEPERTGFISLKQGYHGIQFGGTSVNGSTLYRSAYGPLLPGCYQVDSPWTYRNPYSEDPEELAEAVITQIDRLIQHQGAHTIAAFIAEPVQGAGGIIVPPASFWPRLRQVLDKYGILLISDEVVTGFGRTGAMFGARGWGVKPDIMCFAKGITAGYIPLGATVINERVFAAWQKGIDPTGFIMHGYTATGHALGCAAANATLKIVEDEDLPGNAGRMGQRLMEGLKDIPNWSSLVGEVRGKGLMVGLDLVADKDTREPIDPGKGQGEMVATFARDEGVIVRPAGPVIIISPPLTLSEKETDKIVDALIKALRRYEEEK

SEQ ID NO: 9831 - protein, 355 aa, Thalictrum flavum subsp. glaucum
MALQEGVNYLSGLGLSRLICLPMALRAAIELNVFEIIFQAGPEAQLSPAEIVAKIPTKNPNAAIALDRILRMLGASSILSVTTMKDGRVYGLTEESRCLVADKNGVSVVPMLLFTSDKAVVESFYNIKDVVLEEGVIPFDRTHGMDFFAYAGKEQSVNKSFNQAMGAGSTIAFDEVFKVYKGFHDLKELVNVGGGIGTSLSNIIFKYPHIKGINFELPHVIADAPNYPGVEHIAGNMFEGVPNAQNILLKWVLHDWDDERSIKILQNCWKALPEGGTVIVVEFVLPQILGNNAESFNALTPDLLMMTLNPGGKERTTTEFDGLAKAAGFAETKFFPISQGLHVMEFHKATAGVAS

SEQ ID NO: 9832 - protein, 312 aa, Triticum aestivum
  misc_feature (212)..(212): Xaa can be any naturally occurring amino acid
MAIKKVFARSVYDSRGNPTVEVDVVTETGLHRAIVPSGASTGQHEACELRDGDKSKWNGKGVTKAVENVNTVIAPALIEKNLDVKDQSAVDAFLNELDGTTNKTKLGANAILGVSLAVAKAGAAEKGVPLYAHVSDLAGTKKPYVLPVPFMNVLNGGSHAGGRLAFQEFMIVPTDAPTFSEALRQGAEVYQALKGLAKKRYGQSAGNVGDEXGGVPPDIQTAEEALELITDAIEQAGYTGQMKIAMDVASSEFYKESEKKYDLDFKNPESDPPKWITYEELANMYSELCKKVPIVSIEDPFAEDNWEAWSYF

SEQ ID NO: 9833 - protein, 99 aa, Cyanophora paradoxa
MAVYKVRLICEEQGLDTTIECPDDEYILDAAEEQGIDLPYSCRAGACSTCAGKVVEGTVDQSDQSFLDDAQLAAGYVLTCVAYPSSDCTVKTHQEESLY

SEQ ID NO: 9834 - protein, 173 aa, Bordetella pertussis Tohama I
MNPYILTPDLNGEGLHIGIVRARFNEEIGQAQLQACLEELGKLGVDERDVMVVSVPGALELGVALARMAESYEFDALIALGAVIRGETYHFEVVSNESAAAISRIALETGIPVANGVLTVDTDEQAQARAAGKGADCAQVAVEMANLAAALEPEEDDEDDEDEDFDDEEDDGR

SEQ ID NO: 9835 - protein, 359 aa, Physcomitrella patens subsp. patens
AYIALKAWKKAITDDPKGILKTWVGKDVCKYEGVFCSPPEDPDLQYLEVVAGIDLNDADLKGTLVPELGLLREIGIFHLNSNRFSGEVPDSFRYMKTLFELDLSNNQLSGSFPLVVLDIPNLVYLDIRFNEFFGKLPRELFSKPTLDAIFVNNCNFEGDIPDNFGESPVSAVVLANNRFDGSIPSSIRNMSNTLNEIVALGNNFHGTLPSEIGSLKNVNLFDYSANYISGGLPTSIKNMRDLEVFDMSRNYLAGTVTAELCGLNNLTAVALDYNYFKGVDPTCARLGDILSLVGNCVPGAPGQKDEATCAQFYGLTPPRTPSNPTPSNPPRSSSPPPPTPSNPPRSPSPPPPSPSSPPP

SEQ ID NO: 9836 - protein, 367 aa, Rhizobium sp. NGR234
MKSRLQVRSAHVPLWSWIIPLFGCVIAAMTLAHVLPERSVVLLLMSAGLLTGAVFASVHHAEILAARVGQPSGAILLAVCVTIIEVAIIGSLMLSGAEGNEEVARDTVFAAVMIVLNGVIGLCLVLGGRRHREQSFQLNAASAALAVLGTLATLSLVLPNFVTAGKPQQFAAIQLVVIGLVSVVLYGVFLFVQTVRHRDYFIDDEDAASPPATHETPRNPLAAGALLVLALIAVILLAMLLSYPLDSAVEALGLPQAVVGVTIAGVVLLPEGITSVKAALMNRLQNSINLVLGSALASIGVTIPVVAAISVALGRDLALGLAPQNLIMLILTLFVGTITLGTGRTTVLQGAVHLAIFTVFLLLSAIP

SEQ ID NO: 9837 - protein, 768 aa, Rhodopirellula baltica SH 1
MSTSEAQTPTSIFSPSTILQDLISGLVVFLVALPLCLGIALASGADLFSGLLAGIVGGLVVAAISGSHTSVSGPAAGLTAIVAAQIASLGSFEAFLLAVLIAGVIQIIFGIARGGALSAFFPSSVIKGLLVAIGVILILKQIPHIFGHDTDPEGEMSFIQPDQENTFSELLTIFAGEIHIGAMVIGFLSIAILLVWERIPALKKSLVPAPLIVVVVGVLLNLGFTNMGQDWLVSESHLVQIPIAQSFSEFFGFLRLPDFSRTFDPAIYIAAVTIAVVASLETLLNLEAVDKLDKAKRNSPPSRELIAQGCGNMVCGLIGGLPVTSVVVRGSVNVASGSKTKMSAIFHGGLLLVSVAFLPTLMNKIPLSALAAILLVTGFKLASPAIFKQMWKEGRYQFTPFIITVIAIVVTDLLIGILIGLAISVLFILNSNLRRPIRRIVETQVDGDVTHIELSNQVSFLNRAALDRVLNESQPGGKLVIDASGSDYIDPDVLSLIRDFKQNVAPARNISVNLKGFRRKYQLSDSKQFADFTSRELQEKVTSDQVIKILHDGNQRFTSGTRLNRDLGQQVNATAAGQNPLAAILSCIDSRVPTELVFDLGVGDIFSVRVAGNIVGTKSLGSLEYAVGVAGVKLVAVLGHTRCGAVTSSVNLVAANQGAEAATGCQHLQPIVDEIAPCIPSDVTRAIENLSEEAMEQYVDKVAEDNVMHTVDEIVKRSRIIREAVEAGRVKVIGALYDVKSGHTKFLGDSVSGVIPDSSSGQTAEVAG

SEQ ID NO: 9838 - protein, 301 aa, Mesorhizobium loti MAFF303099
MKRVRKAVFPVAGLGTRFLPATKAVPKEMLTVVDRPVIQYVVDEAREAGIEHFIFVTGRNKAVIEDHFDIQFELYDTLAQRGKDEQLARLQRLQPAPGQTSFTRQQVPMGLGHAVWCARELVGDEPFALLLPDMIMQSEKSCMKSMVELYEETGNNIIAVQECDPAEAHKYGIVGRGEDTHHGFRITEMVEKPKTGTAPSNLYINGRYILQPEIFKILEGQEKGAGNEIQLTDAMLKLEKQQAFYGYHYQGRTFDCGSPEGFVEANVAFALWRSDMKENMAGVIRTLLDEMTPSERRVAVS

SEQ ID NO: 9839 - protein, 506 aa, Pseudomonas aeruginosa PAO1
MIYAAPGTPGAVVTFKPRYGNYIGGEFVPPVKGQYFTNTSPVNGQPIAEFPRSTAEDIDKALDAAHAAAEAWGRTSVQERSNILLKIADRIEQNLELLAVTETWDNGKAVRETLNADIPLAADHFRYFAGCIRAQEGSAAEINDSTVAYHIHEPLGVVGQIIPWNFPLLMAAWKLAPALAAGNCVVLKPAEQTPLGICVLLELIGDLLPPGVLNVVQGFGREAGEALATSKRIAKIAFTGSTPVGSHILKCAAENIIPSTVELGGKSPNIYFEDIMQAEPAFIEKAAEGLVLAFFNQGEVCTCPSRALVQESIYPAFMEEVLKKVRAIKRGDPLDTETMVGAQASQQQYEKILSYLDIAQQEGAELLAGGSVEKLEGNLASGYYIQPTLLKGHNGMRVFQEEIFGPVVGVTTFKDEAEALAIANDTEYGLGAGLWTRDINRAYRMGRGIKAGRVWTNCYHLYPAHAAFGGYKKSGVGRETHKMMLDHYQQTKNLLVSYDINPLGFF

SEQ ID NO: 9840 - protein, 425 aa, Arabidopsis thaliana
  misc_feature (9)..(9): Xaa can be any naturally occurring amino acid
MTTMISNLXPRVLIEEIFFRVPLKSLRAVRLTCKSWNTLSKSRSFRKLYISKRATREEESMMIAMMNFDLYSMRVVVDDDVDPSKAFKKKRNKKSIAFKRQPIFLDEQVKISQVFHCEGLLLCFLKEDDTRVVVWNPYCGQTRWIQLRYSHRPHKDRFIYALGYKDKESRGSFQLLRFVDYFLGAPKNQYFWYEIYDFNSDSWTTLDVTPHWCIYCCDRGVSLNGNTYWCAKERKAEDDIVDHIISFDFTNERFGPLLPLPSKVMEHEYEIVTLSYVKEEKLAALFQHYEADWNEFDIWITTKIDAEVVSWSMFLRMDTGPRIEVPHICEGFFIDEEKKVAMGFEEDFDRKTFIIIGEAGYVRKLDIKAHVDRKCRPTVCSYVPSLVQIKKPARGKRKRQSSLEKRLFDQNMLRLEAFKKLGGYF

SEQ ID NO: 9841 - protein, 178 aa, Cryptococcus neoformans var. neoformans B-3501A
MNFGLVEDGFYRSAQPSELCFSFLEKLNLKSIIWVGAEEPSDIFLSFIESQGIKLYNLAPQTSLNPHFPPPYTDSGVVPISGQYHLPPLPPPPEPLIIQALTLLLRPSTFPTLLCCNMGRHRTGTVVGCYRKLQRWALSSILEEYRRYAGMKVRVLNEQFIELFDTDLVSITAEQVTK

SEQ ID NO: 9842 - protein, 426 aa, Vibrio campbellii AND4
MKLYNIKENDQQVSFGQAVRQGLGRNQGLFFPSELPKFTDIDTLLAEDFVSRSTKILSALIGDELAEEQVNALVDAAFQFPAPINQVKDGIYALELFHGPTLAFKDFGGRFMAQSLAAVSDGGKITILTATSGDTGAAVAHAFYGMEDINVVILYPKGKISPLQEKLFCTLGNNIHTVAIDGDFDACQALVKQAFDDSALREEIGLNSANSINISRLMAQICYYFEAAAQMSKQERENLVVSVPSGNFGNLTAGLLAKALGLPIKRFIAATNANDTVPRYLETGQWQPKPTVATTSNAMDVSQPNNWPRIEELCRVKEWGLETLGKGAVSDSQSAESVKDLYALGYLCEPHGAIAYRVLEEQLQQGETGLFLCTAHPAKFKEVVDDILQTDIDLPAPLAKHAAMDLLSEDLDADFDALKQVLRRVQ

SEQ ID NO: 9843 - protein, 322 aa, Scutellaria baicalensis
MSFKVLAAFFCYYIVLSEAQLQKGFYQLSCGFAETIVKQEVRNAFFRDSGIAAGLIRLHFHDCFVRGCDGSVLIDSTGSNTAEKDSPPNNPSLRGFEVVDAIKRRLEVSCPGVVSCADILAYAARDSVEITRGLGYDVLAGRRDGRVSLASEALSNLPPPSFNVDQLTRAFANKGLSQDEMVTLSGAHTLGRSHCTSFNNRLYNFSTSSMQDPTLDLAYASQLKQQCPQGSANPNLVVPMDPPTPAVSDVSYYRGVLANRGLFTSDQTLLTSPQTRAQVLQNAQNQFLWWRKFAGAMVSMGNIGVITGGAGEIRRDCRVING

SEQ ID NO: 9844 - protein, 602 aa, Brucella suis 1330
MDTQSADGAYRVLARKYRPQNFDDLIGQEPMVRTLRNAFETGRIAQAWMLTGVRGVGKTTTARILARALNYKTDTVDQPTIDLSTPGEHCQAIMEGRHVDVIEMDAASHTGIDDIREIIEQVRYRPVSARYKVYIIDEVHMLSTAAFNGLLKTLEEPPPHVKFIFATTEIRKVPITVLSRCQRFDLHRIESGTLAQHLRRIAEAEKIEVDDASLAMIARAGEGSARDSLSIFDQAIAHGAGSVTAEAVRSMLGLADRARIIDLFEMLMRGDVAGALTEFRAQYDVGADPSVVLTDLADFNHLVTRLRFTPDVAEDVSLSEDERVRGREFAQTLSIRALSRTWQMLLKGIAEVDTATRPVQAAEMLLIRLAHAADLPTLDEAIRGLDNGSVSAPRPQPSATPRPNGGSAPQAHGAADAVGSSALAPAAGGPATAMRIVETPPIQVSAPKPSEAAPQPSVPINSLQDIVALADKYRDMQFKILVKNCVRPASIAPGRLEIGLTDDAPKSLPSDIAQHLLNWTGIRWVVTVARDVAGQTIAEAEAERRDNLVTDARADPDVAAILAAFPGAKIIDVRIAVPDKSEDEDIDLDAVAEVPDVLPEDD

SEQ ID NO: 9845 - protein, 277 aa, Staphylococcus aureus subsp. aureus COL
MEVKTFYNGNTMPQIGLGTFRVENDENCMESVKYAIEQGYRSIDTAKVYGNEEQVGAGIRAGLESTGIAREDLFITSKLYFEDFGRENVAAAYEASLSRLGLKYLDLYLVHWPGTNEAVMVDTWKGMEDLYKNNNVKNIGVSNFEPEHLEALLAQVSIKPVINQVEYHPYLTQHKLKLYLAAQRIVMESWSPLMNAQILNDETIKDIAQELGKSPAQVVLRWNVQHAVVTIPKSVTPNRISENFQIFDFELSDEQMTRIDGLNQDKRIGPDPKKFEG

SEQ ID NO: 9846 - protein, 549 aa, Zea mays
ATEAKDANNIKDPHLGWMIGFLFLVSFIGLFALVPLRKIMIVDYKLTYPSGTATAYLINGFHTPEGAKLAKKQVKTLGKYFVFSFFWGFFQWFYTAGDECGFKNFPTLGLEAYNNRFFFDFSPTYVGVGMICPYIVNVSVLLGGILSWGLMWPLIAKKKGSWYPANLEDSSLHGLQAYRVFISIALILGDGLYNFIKVLIRTIAGFISMVQQNSKSMLPVSDNGSSMSSMEAVSFDDERRIENFLKDQIPKSVAYGGYVAVAAISIGTLPQIFPQLKWYYILVAYVVAPVLAFCNAYGSGLTDWSLASTYGKLAIFVFGAWAGLSHGGVLVGLAACGVMMSIVSTASDLMQDFKTGYLTLASPRSMFISQVIGTGMGCVIGPCIFWLFYKAFGDIGESGTEYPAPYAIVYRNMAILGVDGFGSLPKNCLTLCYIFFAAAITINLVRDLTPYKVSRFIPLPMAMAIPFYIGSYFAIDMFLGSAILFVWERLNKAKADAFGPAVASGLICGDGIWTLPQSILALAKVQPPICMKFLSRSTNAKVDSFLGLS

SEQ ID NO: 9847 - protein, 379 aa, Acetobacter aceti
MATQLDYYAILEVSRTATADELKKSYRKLAMKYHPDRNPGDDAAEAKFKEINQAYDILKDEQKRAAYDQYGHAAFEGGGPGPGGFDFSGGFGGGGLGDIFEQMFGDMMGGRRGGRARTGNDIQTHVEITLEEAFSGVKKDVRVITLGVRTCHGTGSDDGASGVEVCPSCHGAGKVRAHEGFFVVERPCPTCHGAGKVVKNPCKFCHGEGTVEKERTVEVQIPAGVEDGTRIRLSGEGEAGGNGVPPGDLYIHVSVTEHGIFQRDGANIYCRVPFRMAQAALGTEIEVPVIDGSRTKVKIPAGTQTGATFSLRGKGFSVLRSTARGDMYIQVTVETPQNLSKRQRELLEEFEKEAGEDVKQSPEHTGFFRRVRDFFEGKE

SEQ ID NO: 9848 - protein, 322 aa, Lentisphaera araneosa HTCC2155
MSHFKEKIFKFINSQIIIIAVIAGTLPALAFPETSETWRLAGVTPWLIAGVFLCQGLGLNPKDKIDLSHNLKIISFSMLASFLIFPLLAFGVLELANLSQDNYFGLMLICCMPCTLVSGIVISDLAGGDRPAALFITIALNCSAVIISPLLIALYLSSTAEIDTLSLIKKLALTVFIPALCGWGIRKQLKTTKNNFNLSIKYLPVLFLGTVIFVNTGGQKDEILNGSLNEALYIAVLSAIIHLCALFLFNFFGKRTSMSDAQNRSFSICCSQKTLPLAIAIWSAHFAQDFPTALIATMIYHLIQIYLDSFIAQKWAQKKLSS

SEQ ID NO: 9849 - protein, 391 aa, Mycoplasma gallisepticum
MSSKRDYYEILEVSRSATQQDIKKAFRKLAMKYHPDRNKDSDAEEKFKEVNEAYEVLSDEEKRKLYDTYGHEGLNASGFHQGGFNPYDVFNSVFSGFDFEGGFGDVFSQFFGGGGSGFHNQEYIEEVDVNLVHEIKINFLEAANGCIKNVKYTRQVTCPDCNGSGSADGDVITCSDCNGEGFLVEQRRTLLGMFQTKKTCPSCKGEGQTIKNKCKKCKSRRMVDEVVERKVSIDSNVFYQDVVIVRGEGHIYKNLVGDLFLRVKIEPSRVFELRDNHVVVNVLVDPLVAITGGTILIPTLKEIKEINLKAGTKNGDIITIANGGINLKLDSRVYGANYNQKGDLIVVINYARPSEYSKQEITKLKEFIKPNKEVNLYETLMKKELNNKDSQ

SEQ ID NO: 9850 - protein, 267 aa, Populus trichocarpa
MSLESSSRDKRWGLQGMTALVTGGTKGLGYAIVEELAALGAIVHTCARNQDQINERVREWKEKGFKVTGSVCDVSSNAEREKLMKEVSSLFDGKLNILVNNAGTNIYKATLDYTAEDFTSLMNTNLQSAFHLSQLAHPLLKASGAGKIVFMSSIISVVSMNPQYPLYSASKGAMNQLTRNLACEWAKDNIRVNAVAPWFIRTPLTAHSLDDESIVKEVFNRTPMRRVGEPGEVSSVVAFLCLPAPGFLTGQVICIDGGMSVNGFSMG

SEQ ID NO: 9851 - protein, 223 aa, Streptococcus pneumoniae TIGR4
MNVKENTELVFREVAEASLSAHRESGSVSVIAVTKYVDVPTAEALLPLGVHHIGENRVDKFLEKYEALKDRDVTWHLIGTLQRRKVKDVIQYVDYFHALDSVKLAGEIQKRSDRVIKCFLQVNISKEESKHGFSREELLEILPELARLDKIEYVGLMTMAPFEASSEQLKEIFKAAQDLQREIQEKQIPNMPMTELSMGMSRDYKEAIQFGSTFVRIGTSFFK

SEQ ID NO: 9852 - protein, 480 aa, Medicago sativa
MRKSVTLKAGEVPSRLTRARAVALSTSGQLPPMKEVAPGTQNQKQPLRANSKRAVSDVTYLPHEMRAILQDVTNNCGENTNRSCLNPTEIQAKKRKVAKPAQPDVSNEVPSAAERPPFIADSKRVSSMEMRLRSSEDFRCLDDLEDNAPFRMSSNQSGTNNNLLQNQTSRISARLLSSQKKASQIVAAKKGNISELLDVSKHPDVADIDADFEDPQLCSHYAADIYDHLRVAELSRRPYPNFMETVQQDITPSMRAILVDWLVEVSEGYKLQANTLFLTVYLIDWFLSKNCIERERLQLLGITCMLIATKYEEINAPRIEDFCFITDNTYVVKLESLVLKSSSYQLFAPTTKTFLRRFLRAAQASYKRPSIELEYLANYLAELTLMNYGFLNFLPSMVAASSVFLARWTLDQSSHPWNPTLEQYASYKASDLKATVLALQDLQLNSNDDCPLTAIRKKYTQDKLNCVAALSSPKLLETLF

SEQ ID NO: 9853 - protein, 193 aa, Brassica napus
  misc_feature (26)..(26): Xaa can be any naturally occurring amino acid
  misc_feature (185)..(185): Xaa can be any naturally occurring amino acid
MSSTEAVDDPGQIKRALIDASAGAIXSGGVSRTVTSPLDVIKIRFQVQLEPTSSWSVVRGNLSGASKYTGMVQATKDIFREEGFRGFWRGNVPALLMVMPYTSIQFTVLHKLKSFASGSTKTEDHIHLSPYLSFVSGALAGCAATLGSYPFDLLRTILASQGEPKVYPTMRSAFVDIIKSRCVRXLYNGLTPT

SEQ ID NO: 9854 - protein, 419 aa, Physcomitrella patens subsp. patens
ESARNSGKLSMSRASAGSDSNESSCSSIGYGASKPHKANDKRWEGIQAIRVRDGALGLSHFKLLKRLGCGDIGSVYLAELRGSHSHFAMKVMDKGSLASRKKLLRAQTEREILQSLDHPFLPTLYTHFESEKFLCLVMEFCSGGDLHTLRQRQPGKHFTEQAARFYAAEVLLALEYLHMMGVVYRDLKPENVLVREDGHIMLSDFDLSLKCAVSPTLVKSIGHDSRDGKSSGSYCMQPTACAEPSCTGGFEVGQGAGFPSPGKPKTKSKAEGGQSVSPLPELIAEPTSARSMSFVGTHEYLAPEIIKAGDGHGSAVDWWTFGIFLYELLFGKTPFKGSGNRATLFNVVGQPLKFPESATGQVSFAARDLIRGLLVKEPVHRLASKRGAGEIKAHPFFEGSVNWALIRCTSPPEVPRPFE

SEQ ID NO: 9855 - protein, 725 aa, Vitis vinifera
  misc_feature (167)..(167): Xaa can be any naturally occurring amino acid
  misc_feature (172)..(172): Xaa can be any naturally occurring amino acid
  misc_feature (344)..(344): Xaa can be any naturally occurring amino acid
MDHLKKLSTVLCFLLLQFGVEGRGLSYSIYQKSCPQVEDIVRAALGPIFLSDPSSPPAFLRLLFHDCQVQGCDASILVDPAGGKTPLEMASSKNFGVRKRESISLIKSVVEAQCPGTVSCADILVMAARDAVAFSGGPWIKVPFGRRDSSRATSYKLADALLPPANXDVNGXLQIFTQKGMTIKEAVAIIGAHTIGITHCLNIRDRLQRPEGGGRARGMEPGFEAFLRLSCPEGSLISNSTFVVNDPSAFTFDNHYYSNAMHGRGILRVDAEVSSDSRTAPIVSSFAADQRRDIKEGWVGIPDYGGGSMVGSIVYPQKGSLGCVPFEGDKPFKSRSSPTTVLLXDRKGNVPANFVFGDSLVDAGNNNYIVSLSKANYIPNGIDFGKPTGRYTNGRTIVDIIGELCSFLLSLLLDSICHRFFELMGMLISFVLLLLNFHPPGQKVGFKDFTPPYLAPTTVGDVVLKGVNYASGGGGILNYTGKIFGGRINLDAQLDNFANTRQDIISRIGAPAALKLFQRSLFSVTIGSNDFINNYLTPILSAAEQKLVSPQTFVGTMISRFRLQLTRLYSLGARRIIVANVGPIGCIPYQRDTTPGVGDDCASLPNQMAQLFNTRLKSLVAELSTSLEGSKFVYADVYNIVDDIIQNYESFGFENANSSCCYIAGRFGGLIPCGPPSKVCSDRSKYVFWDPYHPSDAANEIMATRLLGGDSDDIWPMNIRQLIQS

SEQ ID NO: 9856 - protein, 919 aa, Debaryomyces hansenii CBS767
MVLIGIARRGLGFIPAKSSPLSNRNSKMSEEYGRDDAGRKQPKVTRQPEIRRKQGEGRETGKNTGELEGKSKNNVEYSNDIDGEQDKRPGEFLDILHTFPIFKQAPESFVMKIVSQLRFKVYKPKEYVIRKGEPSESMYWIMSGTVGISDGESIQAELGRGSFFGEVGVIFNRPRTATVVTRSRVVVGVLESEALSFVLQYYPSIERKIRDEAQGRLALQDKKCKSGASRCNQNNSYAGGYRDELQTDSVLSPRFLKGFSLFQQMPTYIVEELLSYSELVKIPLFDYVFNEGDNDLDVYFIVSGKVEIINKDLNSKSGRKLTVLEPGCSFGILSFLSHLKGNKGSRRHASAISISPVELLKIQSCKLKLLCKQFSFIIDELEHESLDRTFLVTDKRTDAAPNSPPTTRLSIGFLMNENEDKWSEVSNHSQKNLRIKLLLSYSTYGPRYQNVSPISPISPVENIYSLTTQSQNINTTEQQVNTKKRKLSTEKYPLDFFEARASTESTKNEFVDHGGVKYSDAPNDKKLKLNKNENSLLSTDKSGKKILLKVFEYLTIPELMKLRIVCKQWNDILSTAPGLCNKLDLTPWNTSIDDKSLISITDFVGARPQYIDISNCFHVTDEGFTYMVNEIGISGEIKDLKMESNWEISGMAIMDLSLSIVGRHLEKIDLANCRKVRDDVLERLTGWNPSEINQTNNGLKEDDKMSDVGCKNLKIIDVGYCKHLTDKIMYHISQNANTRLESLNLTRCTTITDQGFEHWNKRSFPNLKKLSLKDCTFLTDKSIISIANSANNLEILDLKFCCALSDVSIDMLCLGCPKLKHLDLSFCGSAVSDFSLVAISLHLRFLERIILKGCIRVTRSGIDSLLSGCSPLNYLNISQCKNAHVYPGGIPAQELKIHSQSKTAFVTAGSYRNIIEIAV

SEQ ID NO: 9857 - protein, 252 aa, Streptococcus mutans UA159
MSRKPIIAGNWKMNKTAAEAREFIDAVKNNIPSNNLVDTVIGSPALFLEGMKKGVKGTELQVAAQNCYWEDFGAFTGETSPAALAALGVDYVIIGHSERRDYFHETDQEINKKAHAIFKHKMTPILCCGESLETYEAGKTAEWIEGQITADLKGLSAEQVSSMVIAYEPIWAIGTGKSADANIADDICGVVRATVEKLYGKEVAQAVRIQYGGSVKPENVAEYMAKENVDGALVGGASLQADSFLALLDFVK

SEQ ID NO: 9858 - protein, 344 aa, Burkholderia xenovorans LB400
MNAKARESIPATLIPGDGIGPEVTQATVRVLEALGAPFKWDIQQAGMAGIDECGDALPQATLDSIRETKLALKGPLTTPIGGGFRSANVRLREAFELHANIRPVRTIVPGRYDDIDIVLVRENIQGLYVAHEHYIPIGDDPRAVAVLTGMNTREGGRRIARCAFDYALRHGRRKITVVHKANVLKALTGIFLEAAREVAADYAGRVALDDRIVDACAMQLVLNPWQFDMLLCTNLFGDILSDQLAGLVGGLGLAPGANIGKDTALFEAVHGSAPDIAGRGIANPVSQLLAAGLMLDHVGLDEDAKRLRRAIADTLNEDKVRTPDLGGQATTRTFTDALIERLGH

SEQ ID NO: 9859 - protein, 589 aa, Rhodopirellula baltica SH 1
MFSIETLILIAGSLLLLGIASNKFSARMGVPVLVVFLAIGMLAGSEGIGGIEFENYTLAHGFATTALCLILFNGGIGTPYAAFQSAWKPASLLATVGVIVTAVITGLAASWILGLSWLQGLLLGSIVGSTDASVVFSVLRGGGVHIRPRLANTLEVESGSNDPMAIFLTVGLIEVLTGQTPFGFGLVTLFLNQAVVGTAMGMAVGWAGAWVLQHIRLEAAGLYPVMATALGLFSFGMASELGGSGFLAVYLTGVVIGNRRPVFHRGIVLFHDALAWMCQILMFTALGILSFPSRLWDVTVPALLIASVLIFVARPIAVFLCGMPFRFTVRELSFLSWVGLKGAVPITLATFPMMAGLPAASVIFDTVFFVVLVSALVQGWTLPAVARFLKLEVPKNQKTPVTLEISSLQNVDGDIVDYYIDQDSRASGCMIKDLALPDGVVIALIVRDEQTVLPQGRSQLLQGDHVVVVLRPSIRAMVDRVFAPTRTHVKELPQELEFPLRGSIKVCDLEQFYELKLADDGDLTLDELVRQHLGENNVKIGAVVQIDQIALHLRELSSDGTVLYVGMSILAEPAEATDSSLSATSLPLE

SEQ ID NO: 9860 - protein, 331 aa, Escherichia coli CFT073
MPAESHTVYPAYRFSIAPMLDWTDRHCRYFLRLLSRNTLLYTEMVTTGAIIHGKGDYLAYSEEEHPVALQLGGSDPAALAQCAKLAEARGYDEINLNVGCPSDRVQNGMFGACLMGNAQLVADCVKAMRDVVSIPVTVKTRIGIDDQDSYEFLCDFINTVSGKGECEMFIIHARKAWLSGLSPKENREIPPLDYPRVYQLKRDFPHLTMSINGGIKSLEEAKAHLQHMDGVMVGREAYQNPGILAAVDREIFGSSDTDADPVAVVRAMYPYIERELSQGTYLGHITRHMLGLFQGIPGARQWRRYLSENAHKAGADINVLEHALKLVADKR

SEQ ID NO: 9861 - protein, 492 aa, Burkholderia xenovorans LB400
MNEATARKPHPLDKLKDPSLLRTQAYVDGRSQGGAQEFAVFDPATGAEIARVPNLAAAEARQAIDAANAALPAWRALTGKQRAAMLRRWYELIVAHAADLAAIMTAEQGKPLAEARAEALYGASFVEWFAEEAKRVSGDVLASPADDRKIVVIRQPIGVCVSITPWNFPLAMITRKVAPALAAGCTIVVKPAEQTPLSALALAELAHRAGLPAGVLNVLTGDAANAIEIGKVFCESEIVRHLSFTGSTPVGRLLMQQCAPTVKKVALELGGHAPFIVFDDADVDAAVQGAMVSKYRNAGQTCVCANRFYVHDAVYERFVRQFAEASRGVKVGNGFLEGVDQGPLIDDDAVAKVRQHVDDALAKGARQVMGGRIEGRFVEPVLLAEVTHDMLIAREETFGPVAAVFRFRDEAEVTRLANDTQFGLASYFYSRDIGRVWRVAEALEYGMVGINTGLISNEVAPFGGVKQSGLGREGSKYGIEEYLQIKYLCMGV

SEQ ID NO: 9862 - protein, 484 aa, Mesorhizobium loti MAFF303099
MGKVTGFLEIDRQVHKYQPASDRIRHFREFTLPMSDKEVEKQAARCMDCGIPFCHGPTGCPIHNQIPDWNDLVYNRDWDNAIRNLHSTNNFPEFTGRICPAPCEEACTLNLEDIPVAIKTVEQAIADKAYETGHIRPYPPEKKTGKRVAIIGSGPAGMAAAQQLGRAGHDVHVYERESRPGGLMRYGIPDFKIEKHYIDRRIEQMQGEGVTFHCGVNVGVDKPVAELLAEHDAVLYCGGSETPRAANIPGDDLGGVHDAMPYLVQQNRRVGGEPIQSVAWPSHPIIAGGQHVVVVGGGDTASDCVGTAFRQGAVRVTQLDIRPQPPEKEDKLAVWPYWATKMRTSSSQAEGAEREFQVATLEFIGEDGQLTGVKCCEVDEKRKPIAGTEFVIRADLAFIAIGFAGPAMVGVAKELEGEMKITTDSRRSRNVEANDRDYKTSVDRLYAAGDVRRGQSLVVWAIREGRQAARSIDEALMGTSVLPR

SEQ ID NO: 9863 - protein, 474 aa, Burkholderia xenovorans LB400
MSTHLRTSVAARLERLPDSRYLRTAVILISLGTFWDSYMLFSVGPISAHFFAYLGQPHLATELPLALFLGTFVGAVCLSTVADTIGRRAAFTLDLCTLAVGALVAAFSPNATVLLIALFVAGIGTGAELPLSTTYVQELSPAKARGKKSSFALTIGFFGGTVGGFASLLLVPLTNLPIQGFRIALLLAALGGFSSLLLRIRLPESPRWLERVGRHEEADRVVEEIERRVMRDTGLTALPPVPAGSHDVASGASPLRILISRAYLRRTISAGAIELLQGFGAYGFATFVPFFLYSRGYSVIHALAYTAIIQISYPTGCLISAYITDRIQRKWGMALAYTINVVFGLCFLLVDSTFLIVLFGFLTETMIFINGPLLHTYEAEIYPTGVRARGAGICFALSRLGGFLAPIVASILLAGGANGGWLIAIGAAAWFGCALVAAFVAVDTTNISLEDLEAKVGDASEADAAAGYGMVKKR

SEQ ID NO: 9864 - protein, 515 aa, Arabidopsis thaliana [sequence omitted]

SEQ ID NO: 9865 - protein, 327 aa, Escherichia coli CFT073
MATRIEFHKHGGPEVLQAVEFTPADPAENEIQVENKAIGINFIDTYIRSGLYPPPSLPSGLGTEAAGIVSKVGSGVKHIKAGDRVVYAQSALGAYSSVHNINADKAAILPAAISFEQAAASFLKGLTVYYLLRKTYEIKPDEQFLFHAAAGGVGLIACQWAKALGAKLIGTVGTAQKAQSALKAGAWQVINYREENLVERLKEITGGKKVRVVYDSVGRDTWERSLDCLQRRGLMVSFGNSSGAVTGVNLGILNQKGSLYVTRPSLQGYITTREELTEASNELFSLIASGVIKVDVAEQQKYPLKDARRAHEILESRATQGSSLLIP

SEQ ID NO: 9866 - protein, 479 aa, Physcomitrella patens subsp. patens
MPKPRPVNVAAGTVLGKPLSDVRSVYTLGKELGRGQFGVTYACTNIKTGEHLACKSIAKRKLISKEDIEDVRREVQIMHHLSGTPNVVELKGVFEDKHHVHIVMELCAGGELFDRIIAKGHYSERAAAALCRTIVSVVHRCHSLNVFHRDLKPENFLLANKAENSSLKATDFGLSVFFKPGEVFHEIVGSAYYVAPEVLRRNYGPEADVWSAGVIVYILLCGVPPFWAESEQGIFDAVLKGYIDFKSDPWPKVSAAAKDLVSKMLKQDPKERLTAQEVLKHPWMKEDGDAPDEPLDNAVLTRLKNFSSANKMKKLALQVIAQSLSEDEIMGLKEMFKAMDTDNSGTITFDELKEGLHRQGSKLVESDVKKLMEAADVDGNGKIDFSEFISATMHMNKVEKEDHLAEAFQHFDTDGSGYITVEELQEAMAKNGMGDPETINEIIREVDTDNDGRIDYDEFVAMMRKGNEVPQMTTRRHRR

SEQ ID NO: 9867 - protein, 188 aa, Leptospirillum ferrooxidans
PNMVLMSPKDENELRHMMYTASQPSGANSRALPERRRRREVVLDQSFREIPIGKAEVLSEGSDVTFLAYGQMVPVAVEVARQLSLEGRSVGVVNLRFAKPLDGEVLEKLIAQKKRLVSIEEGSLIGGVGAAILEWASDHGMLSSTNLLRLGILDEYVEHGGIKFLRDHVGLTPERILEKVRAWMSGGN

SEQ ID NO: 9868 - protein, 261 aa, Guillardia theta
MNVKYINVWKYNVKDIFKEINNLCKDTCLISLDTEFPGIVLKIKSFKYSSENASYHMLRKNVNILKTIQIGLTFDKNCNFKFSTTFQFNFVYDFENNCFAQDSIDLLSKSKLLFETNNKIGINLDLFKEFLTSSSLLCNKKLKWITFHSGYDFGYLINLITNKELPLSKKDFIEHLNFYFPCFFDLKHLGYFSSNFYGSLDKIAEKFNINRIGKSHQAGSDSLITLNIYKIISNDIKPREYFRKFKCVLYNSPSVVHNYYL

SEQ ID NO: 9869 - protein, 159 aa, Arabidopsis thaliana
MVSGLINENPIIYPKKERRLRTDTSITDELTPEPIDQLEIFDILSSSNIKDPEHPNTLEDLRVVTEDSVEVDDENSYVRVTFTPTVEHCSMATVIGLCVRVKLLRSLPSRYKIDIRVAPGSHATEDALNKQLNDKERVAAALENPNLVEMVDECLPSEE

SEQ ID NO: 9870 - protein, 497 aa, Oryza sativa Japonica Group
MAMGAASWAPIPAPARAAAAFYPGRDLAAARRRRGAAARRPFVFTPRAVSDSRSSQTCLDPDASTSVLGIILGGGAGTRLYPLTKKRAKPAVPLGANYRLIDIPVSNCLNSNVSKIYVLTQFNSASLNRHLSRAYGNNIGGYKNEGFVEVLAAQQSPENPNWFQGTADAVRQYLWLFEEHNVMEFLILAGDHLYRMDYQKFIQAHRETNADITVAALPMDEERATAFGLMKIDDEGRIIEFAEKPKGEKLKSMMVDTTILGLDTERAKELPYIASMGIYVFSKDVMLKLLRQNFPAANDFGSEVIPGATEIGMRVQAYLYDGYWEDIGTIEAFYNANLGITKKPVPDFSFYDRSAAIYTQPRYLPPSKVLDADVTDSVIGEGCVIRHCTINHSVVGLRSCISEGAVIEDSLLMGADYYETETDKKALSETGGIPIGIGKNAHIRKAIIDKNARIGENVKIINVDNIQEASRETDGYFIKSGIVTVIKDALIPSGTVI

SEQ ID NO: 9871 - protein, 991 aa, Tuber magnatum
EFKLSVEKQYKEGIEKMIKLYQMEGDRKSRQDAESKHTDSGQKIQLLKQALKRYEDLHVDMDFGDEADDDSINSPNIRRPLTGRLAIRVLAVKDVDHATTSRFARGPETFVIIKVEDVARVRTKSTRNDKWLDEAHDIDVDKANEIEMTVYDKPGDNHMPIGLLWIRISDIAEELRRKKIEQDISSSGWVSADKMAHGGAGRPSEGTYNYNQGFGGPAAAGGGGTGMYVNNSGQTQASGGSAGIDAWFALEPVGQIHLNLNFVKYNRNKRPLDLGLGRKGAVRARKEEVHEMYGHKFVQQQFYNIMRCALCSDFLKYSAGMQCSDCKYTCHKKCYPKVVTKCISKSNAETDPEEEKLNHRIPHRFEPMTNMGANWCCHCGYMLPVGKKNARKCTECGLTCHSQCAHLVPDFCGMEVANQILGEIKKTKRRGPGMADRNLRTSGPPAPSSPLSGRPTSDPYVSHLDPRNSVQGEPTQLSQRTHPYSPSSPTAVNAANVAYGTASSPARPQQPAPYSPEQRPNRVPDPTAVAAAAHAGQRPPSVVQSQIGYPPRQSAELYRGAPASPTQTKHPTELPSSPSPYQQGQGYDNPYQQHRTSIPQQPPAAPPKAPPAPSGYGQPQAAQYDQKRSYGQPPPAPVKVAPPAHAYTAEKKPPPPPALEPQHAVSRPTKIGLDHFNFLAVLGKGNFGKVMLAETKACKKLYAIKVLKKEFIIENDEVESTRSEKRVFLIANKERHPFLLNLHACFQTETRVYFVMEYISGGDLMLHIQRGAFGSRRAQFYAAEVCLALKYFHENGVIYRDLKLDNILLTLDGHIKIADYGLCKEEMWYGSTTSTFCGTPEFMAPEILMDKRYGRAVDWWAFGVLIYQMLLQQSPFRGEDEDEIYDAILADEALYPIHMPRDSVSILQKVLTKEPELRLGSGPTDAQEIMSHPFFANINWGDIYHKRYPPPFKPSIQSATDTSNFDQEFTSVTPVLTPVQSVLTQAMQEEF

SEQ ID NO: 9872 - protein, 198 aa, Physcomitrella patens subsp. patens
MPSAGLGRGLATPLLVINFCLYLIAACLAGWALNRNFDAGIGQGEGAVGNNVTQGFFLPVTLIACMVGLASCLAGIHHMRLFRSESLAAAAATSLIAWLLVLLAMGLACKQIHTGGNRPNRLKVVEAFIIILALFELLYLLSLHLGFGRAGHNHGTGAGTGAGIGMAGHAHNHHTDYGHHTDMKIPVGHVQNPAHPGY

SEQ ID NO: 9873 - protein, 331 aa, Bacillus cereus E33L
MNLAKFPRKKYTESYTPIEKLNNFSEALGGPTIYFKRDDLLGLTAGGNKTRKLEFLVADAQAKGADTLITAGGIQSNHCRLTLAAAVKEKMKCILVLEEGLEPEEKPDFNGNYFLYHLLGAENVIVVRNGADLMEEMHKVAKEVSEKGNTPYVIPVGGSNPTGAMGYVACAQEIMVQSFDQGIDFSSVVCVSGSGGMHAGLITGFAGTQSNIPVIGINVSRGKAEQEEKVAKLVDETSAHVGIPNFIPREAVTCFDEYVGPGYALPTPEMVEAVQLLAKTEGILLDPVYTGKAVAGLIDLIRKGTFNKEDNILFVHSGGSPALYANTSLFA

SEQ ID NO: 9874 - protein, 287 aa, Brucella suis 1330
MKTNRISFQGEAGANSDTACRNMFPDMEPLPCPTFEDAFNAVETGAADLAMIPIENTLAGRVADIHYLLPLADMHIVGEYFLPIHFQLMVLPGVRREEIKTVHSHIHALGQCRNVIRQNGWKGVIAGDTAGAARLVADVKDRSMAALAPRLAADLYGLDILEENVEDSENNVTRFVVLSKNKQWAARPENDERIVTTFVFRVRNVPAALYKALGGFATNGVNMTKLESYQLGGRFIATQFYADIEGHPEERSVQLALEELRFFTKEVRILGVYKGSDIRGTQLLAAE

SEQ ID NO: 9875 - protein, 853 aa, Arabidopsis thaliana
MQSFDLIKSALFSDKQIMDLMNDNSNNSQDGDHQNYRVGDNGLESKKEAIFPSYDFQPMRPNASAGLSHHALDLAGSVNSTAARVWDASDPKPVSASSARSYGSMDSLEPSKLFAEKDRNSPESAIISAIDRTMKAHADKLLHVMEGVSARLTQLETRTRDLENLVDDVKVSVGNSHGKTDGKLRQLENIMLEVQNGVQLLKDKQEIVEAQLQLSKLQLSKVNQQPETHSTHVEPTAQPPASLPQPPASAAAPPSLTQQGLPPQQFIQPPASQHGLSPPSLQLPQLPNQFSPQQEPYFPPSGQSQPPPTIQPPYQPPPPTQSLHQPPYQPPPQQPQYPQQPPPQLQHPSGYNPEEPPYPQQSYPPNPPRQPPSHPPPGSAPSQQYYNAPPTPPSMYDGPGGRSNSGFPSGYSPESYPYTGPPSQYGNTPSVKPTHQSGSGSGAYPQLPMARPLPQGLPMASAISSGGSGGGSDSPRSGNRAPVDDVIDKVVSMGFPRDQVRGTVRTLTENGQAVDLNVVLDKLMNGDRGAMMQQQQQQPPRENHRPGGKIHSVGFHRTDDLLVTSSEDDSLRLFDIANAKQLKITYHKKHGTDRVCFTHHPSSLICSSRYNLESTGESLRYLSMYDNRILRYFKGHKDRVVSLCMSPINDSFMSGSLDRSVRLWDLRVNACQGILHLRGRPAVAYDQQGLVFAIAMEGGAVKLFDSRCYDKGPFDTFLVGGDTAEVNDIKFSNDGKSMLLTTTNNNIYVLDAYRGEKKCGFSLEPSQGTPIEATFTPDGKYVLSGSGDGTLHAWNIENPSEVARWENNIGVVSCLKWAPRRAMFVAASTVLTFWIPNDGESPAPADPPTDQQQ

SEQ ID NO: 9876 - protein, 158 aa, Neisseria meningitidis MC58
MNTIAPNLDGKHLRIGIVQARFTNEIGSEMLKVCCRTLQELGVADENITVATVPGALEIPIALMNFASSEKFDALIAIGVVIRGETYHFELVSNESGAGVSRVALDYNIPIANAVLTTENDAQAIERIEEKASDAAKVAVECANLVNLLLEEQFEDEE

SEQ ID NO: 9877 - protein, 550 aa, Candida albicans SC5314
MASFKLATDLPEWKKLEETYKSVGEKFSVRDAFAKDPKRFEEFSWIYKNYDDSKILFDFSKNLVNKEILDQLVTLAKEAGVEKLRDAMFAGDHINTTEDRAVYHVALRNRALRKMPVDGKDTAQEVDDVLKHMKEFSDSIRDGSWTGYTGKSITDVVNIGIGGSDLGPVMVTEALKAYSKPGLNVHFISNIDGTHTAETLKNLNPETTLFLIASKTFTTAETITNATSAKNWFLATAKDSKHIAKHFAALSTNEKEVVAFGIDAKNMFGFESWVGGRYSVWSAIGLSVAIYIGFENFNDFLKGAEAMDQHFLTTPLENNIPVIGGLLSVWYNNFFGAQTHLVVPFDQYLHRFPAYLQQLSMESNGKSVTRANVFTNYQTGTILFGEPATNAQHSFFQLVHQGTKLIPADFILAAQSHNPIEKNLHQRMLASNFFAQSEALMVGKDEAKVKAEGATGGLVPHKEFSGNRPTTSILAQKITPATLGSLIAYYEHLTFTEGAIWNINSFDQWGVELGKVLAKVIGKELDDKKAVATHDASTNGLINQFKEWEE

SEQ ID NO: 9878 - protein, 383 aa, Zea mays
MAEDRSPKPIHCKAAVCRAAGEPLTIEEIVVDPPKAYEIRIRVICTSLCHTDITFWKAKVAPVFPRILGHEAYGVVESVGEHVEGFAAGDTVVPTFLGQCERCASCASEHSNVCDAVPFVIGPGMRRDGTTRFRDARGSPLHDLLAVSSFSEYTVVDVNQVVKVDPAVPPKLACLLSCGAGTGVGAAWRSAKVEPGSTVAIFGLGSVGLAVVQGAKMCGASKIIGVDLNPDKEEVGRSFGVTDFVNPSQLDKRSVVEVIVEMTGGGVDYSFECIGVPSVMTDAFRCTKMGKGKTIVLGLGRDSDEVCLPSLELLFGRCVMGSLFGGLKPKTHIPVLAKKCMDKELQLDALVTHELGLQDINKAFDLLLQGKSLRCILWMDKDK

SEQ ID NO: 9879 - protein, 458 aa, Erwinia carotovora subsp. atroseptica SCRI1043
MANDQQELVLKRGLKNRHIQLIALGGAIGTGLFLGISQTIQMAGPSVLLGYAIAGMIAFLIMRQLGEMVVEEPVAGSFSHFAFKYWGDFAGFLAGWNYWAMFILVGMAELTAVGIYIQYWWPDTPTWLSAAIFFVLINLINLVNVKMFGETEFWFAIIKVLAIVGMIVFGSWLLLSGNGGETATVRNLWIHGGFMPNGASGLIMAMAVIMFSFGGLELVGITAAEAADPKRSIPQATNQVVYRILIFYIGALSILLSLYPWGNVVGGGSPFVLIFQALNSNIVANVLNVVVLTAALSVYNSGVYCNSRMLYGLAKQGNAPKSLAKVNARGVPVRSIALSALATSLGVAINYVMPGKAFELLMALVVSTLVINWIMICFAHLRFRQAMMEKGIVPAFKAFWYPWSNYLCLAFLAGILVIMLLSPGIRISVMLIPFWIAVIWLGFRFSRKTYSPAKIVPR

SEQ ID NO: 9880 - protein, 501 aa, Vitis vinifera
  misc_feature (19)..(19): Xaa can be any naturally occurring amino acid
  misc_feature (277)..(277): Xaa can be any naturally occurring amino acid
  misc_feature (298)..(298): Xaa can be any naturally occurring amino acid
MELQIALLLLCITLFCFCXRHFLLPSYTAKLPPGPTGLPILGSLLQLGEKPHHTLAKFAESHGPLISLRLGSITTVVASSPQTAKLILQNHADNFLDRPVPDAIMAMPNPECTLAWIPGDHVWRNRRRVCASHMFTTQRLDSLQHLRQKKVDQLLQHITKHCVLGTPVYITDLASATILNLMSNTMFSVDLVDPRFESAQEFRELMWRIMEGVGKPNISDYFPIFRSLDLQGVKRGTVPSYKRLHEILDGIIQERMKLRASSSTTSMNDFLDVLLDXCQVDGSDFSSDTIKTLLVELXFGGSDTSSVTIEWAMAELLRNPHVMQKVRIELSEVISPGQSIKESDIDRLPYFQAVVKETMRLHPPAPLLLPYKAKNDLEICGFTIPKDSHVLVNIWAIARDPGYWEDPLSFLPERFLSSNIDFRGQDFEYLPFGAGKRICPGISLGLRMVHLVLASIIHSFSWKLPQGITPESLDMKEQFGVTLKKVVPLCAIPFIEEKCSP

SEQ ID NO: 9881 - protein, 439 aa, Dechloromonas aromatica RCB
MKITVVGTGYVGLVSGTCLAEVGNDVLCLDVDPEKIRILEEGGIPIFEPGLQDMVRRNVAAGRLHFTTDVEKAVQHGTVQFIAVGTPPDEDGSADLQYVLGAARNIGRLMTDYKVVVDKSTVPVGTGAKVHAAIADELQKRGVKTPYSVVSNPEFLKEGAAVEDFMRPDRIVVGAEDEQAIHLMRALYAPFQRNHERLIVTDIKSAELTKYAANAMLATRISFMNELANLAEVLGADIEMVRQGIGSDPRIGYHFLYPGCGYGGSCFPKDVKALIKTAQDDADITLKVLTAVEEANDAQKHILTKKLKARFGDLKGKHFALWGLAFKPNTDDMREAASRELIADLFEAGATVTAYDPVAMHETQRIYGDESRLKYAENPMGALTDADALVIVTEWKEFRSPDFEEIKKALKNPVIFDGRNLYDPKFVRASGIEYFAIGR

SEQ ID NO: 9882 - protein, 269 aa, Methylobacillus sp. 12S
MHPILINAVKAARRAGGIITRASQDVGSLKVRSKTYNDFVSEVDHAAEAAILDVLKDAYPTHGFIGEETGNDNIDAENVWIIDPLDGTTNFLHGFPQYSISIALMQQGQLTQAVVYDPNRNDLFTATRGRGAFLNDKRIRVSNRAKLQESIIGTGFPFRDFSHLDTYMGMFKDMVRKTSGLRRPGSAALDLAYVAAGYFDGFWEIGLSKWDIAAGALLIQEAGGIVGDFEGNESWIESGNIVAGNPKVFSQMLQTLAPHLTDSLRSKPV

SEQ ID NO: 9883 - protein, 462 aa, Chlamydomonas reinhardtii
MALSMKMRANARVVSGRRVAAVAPRVVPFSSASSSVLRSGFAAEVSVDIRRVGRSRIVVEAVKKSVGDLHKADLEGKRVFVRADLNVPLDKATLAITDDTRIRAAVPTLKYLLDNGAKVLLTSHLGRPKGGPEDKYRLTPVVARLSELLGKPVTKVDDCIGPEVEKAVGAMKNGELLLLENVRFYKEEEKNEPEFAKKLAANADLYVNDAFGTAHRAHASTEGVTKFLKPSVAGFLLQKELDYLDGAVSNPKRPFVAIVGGSKVSSKITVIEALMEKCDKIIIGGGMIFTFYKARGLKVGSSLVEDDKIELAKKLEEMAKAKGVQLLLPTDVVVADKFDANANTQTVPITAIPDGWMGLDIGPDSVKTFNDALADAKTVVWNGPMGVFEFPKFANGTVSIANTLAGLTPKGCITIIGGGDSVAAVEQAGVAEKMSHISTGGGASLELLEGKVLPGVAALDEK

SEQ ID NO: 9884 - protein, 1196 aa, Arabidopsis thaliana
MSSSNEPPRKTDQPSSSSASASASPSLFLSLPLEIISMILARVPKRYYPILCSVSKNMRSLVRSPEIHKARSLLGKDYLYIGFIDENYRPVYDYWYTLRRIENSTTENLFESIEFPYPSEPNRFSMNAVGPKIFFISESCTPSSRLSIFDTRFGELRQGPCLLVKRGYNCVGLVGGKVYVIGGYQDDEIAAESFDLNTQTWEAAPIPDEKESHRWICKANVSFDRKVCALRSREGMTCYDTRDGSCQRSEMPNDQWSRVGLCVIDNVLFVYFSRFGLMWYDSKLMLWRVVYGFDLDNARSVGIGEYYGKLAFIWEKPSLNVSESKEIWCRMIGLLRSEVGIHGAAEPSQLVEIVPNGYRMCHCLSLSVSASSSVPPNQVCVIIHWKAMPPKVVKRGGAARRGGRLTRSALKAQNPHVESSHDESVNIGELSGSDALEAKEVTPEVDKTVEEENPLDVPKSSDSIDDSEAAANPHVDVPSKKETEVEESVDDFGKDERLDLDDNEPEYEAEEYGGEEFEERELGQEDHELVNEEGEELEEEIEVEEEAGEFADEIGDGAEDLDSEDDDDDHAIEEVKHGETVDVEEEEHHDVLHERRKRKEFEIFVGSLDKGASEEDLKKVFGHVGEVTEVRILKNPQTKKSKGSAFLRFATVEQAKRAVKELKSPMINGKKCGVTASQDNDTLFVGNICKIWTPEALREKLKHYGVENMDDITLVEDSNNVNMNRGYAFLEFSSRSDAMDAHKRLVKKDVMFGVEKPAKVSFTDSFLDLEDEIMAQVKTIFIDGLLPSWNEERVRDLLKPYGKLEKVELARNMPSARRKDFGFVTFDTHEAAVSCAKFINNSELGEGEDKAKVRARLSRPLQKAGKGRQSSRSDQRSRHGAGRSGRSSFARLPPRSLASSRSARGAGSRAPSSSAKRASGSRGRRPRPPLPPPARARPLPPPARARPMPPPARARPLPPPARSYDRRPPVPLYPKASLKRDYDRRDELPPPRSRPAVSYSSRLSPERHLSYRDDYPPRGSGYSDLPRSSSRSEIRRPFVDDLYSPRFERPPSYSEGRPRAYEPLPGSKRPYAALDDLPPRYADVDVRHSRPRLDYDVGPSQYGESYGDRIPRSSLGYGSSRNSMSNHDSRGPYSSRQGMDYGGGSYSGSDVGGMYSSSYGGDLPRRDGGGSSYSSIYSSRGLGGSSYSGGGPGSYY

SEQ ID NO: 9885 - protein, 273 aa, Burkholderia xenovorans LB400
MKERLASKVAVITGAAQGIGASVARSFAQNGCFVYVTDINDELGRTVATSIGDCAAYLPLDVREEGDWQRVTTHVLEKHGRLDVLVNNAGITGFEARVVPHDPEHASLEEWRAVHRTNLDGVFLGCKYAIRAMRRHGQGSIINISSRSGLVGIPGAAAYASSKAAVRNHTKTVALYCAGQNLEVRCNSIHPAAILTPIWEPMLGTDAGREERMAALVRDTPLRRFGTPEEVAALALLLASDEATYITGSEFNIDGGLLAGSAATPAVIDDGEN

SEQ ID NO: 9886 - protein, 381 aa, Triticum aestivum
MASSTQGQVITCKAAVAYEANKPLVVEDVQVAPPQAGEVRIKILSTALCHTDYYTWSGKDPEGLFPCILGHEAAGIVESVGEGVTDVQPGDHVIPCYQAECRDCKMCNSGKTNLCGKVRGATGVGVMMSDRKSRFSVNGKPIYHFMGTSTFSQYTVVHDVSVAKINPQAPLDKVCLLGCGVSTGLGAVWNTAKVEAGSIVAVFGLGTVGLAVAEGAKSAGASRIIGIDIDTKKFDVAKNFGVTEFVNPKDHDKPIQQVLVDLTDGGVDYSFECIGNVSIMRAALECCHKGWGTSVVVGVAASGQEIATRPFQLVTGRVWKGTAFGGFKSRSQVPWLVEKYMNKEIKVDEYITHNMNLTDINKAFDLLHEGGCLRCVLAMEH

SEQ ID NO: 9887 - protein, 216 aa, Populus trichocarpa
MSDETKTQENEVVEAKRQAPRLNERILSSLSRRTVAAHPWHDLEIGPGAPHIFNVVVEITKGSKVKYELDKKTGLIKVDRILYSSVVYPHNYGFIPRTLCEDNDPLDVLVLMQEPVLPGCFLRARAIGLMPMIDQGEKDDKIIAVCADDPEYKHYTDIRELAPHRLSEIRRFFEDYKKNENKEVAVNDFLPSNSAVEAIQYSMDLYAEYILHTLRR

SEQ ID NO: 9888 - protein, 415 aa, Neisseria gonorrhoeae FA 1090
MQLTAVGLNHQTAPLSIREKLAFAAAALPEAVRNLARSNAATEAVILSTCNRTELYCVGDSEEIIRWLADYHSLPIEEIRPYLYTLDMQETVRHAFRVACGLDSMVLGEPQILGQIKDAVRAAQEQESMGAKLNALFQKTFSVAKEVRTDTAVGENSVSMASASVKLAEQIFPDIGDLNVLFIGAGEMIELVATYFAAKNPRLMTVANRTLARAQELCDKLGVNAEPCLLSDLPAILHDYDVVVSSTASQLPIVGKGMVERALKQRQSMPLFMLDLAVPRDIEAEVGDLNDAYLYTVDDMVNIVQSGKEARQKAAAAAETLVSEKVAEFVRQQQGRQSVPLIKALRDEGEKARKQVLENAMKQLAKGATAEEVLERLSVQLTNKLLHSPTQTLNKAGEEDKDLVHAVAQIYHLDK

SEQ ID NO: 9889 - protein, 211 aa, Glycine max
MPEMDERVVIQQPLSAIAEAFEKLSKRVKERNNGNDIRLDTFCEAASLVSVLFRSLGLAFKFAELEYVAKLHGLLEASKTCSTLPDILNLDVASDTVKTSGSFSRNLRRVRQGLDLVRAIFEQLLSTDDSSLKEVASTAYGQVCAPYHTWAVRTAVYAGMYTLPTRDQLLMKLNETEQSADKKMRRYIAASLPIIEYIDKLYLARNITLDW

SEQ ID NO: 9890 - protein, 601 aa, Chlamydomonas reinhardtii
MPSAATKKKELEKKKSGKLSKSQSTASMPHADSTASLASKGGPVEDDAFSSRTVTGVLSSRPTARDIKIDGFSMGLNGCELIQDCSIELTIGRRYGLIGQNGSGKSNFLKCIAKREVPIPDHLDIYHLDQEAEPSERTALQAVIDHIQRLHALEEEIMSTTGPEDERLEAIYDRIDELDPATFESRAAELLHGLGFSPAFQQRLTKDLSGGWRMRVALARALFAAPTLLLLDEPTNHLDLEACVWLEEYLKNYNKCLVVISHSQDFLNGVCTHIIWLTHNKLTYYTGNYDTFVKTVAENEVVQMKKYQKEQEDIKHIKEFIASCGTYANLVKQAKSKQKILDKMEEAGLTKPVQRERTFQFSFPECSKLPPPVLPFINVSFAYSGKPEEYLYKDLEFGIDCDSRVALVGPNGAGKSTLLKLMTGDLTPSVGTVTRHPHLSIGRYHQHSVDQLDEEKTVLEFFKSMYPNTPTFKREEDEWRGYVGRFGISGRLQTTKIGMLSEGQKSRLVFAMMCMKNNNLLLLDEPTNHLDIEAIDSLADAIKRYDGGMVLVSHDFRLIDQVAKEIWVCEDKKVTMWKGDIRDYKALLAKKMGLSGVPGKK

SEQ ID NO: 9891 - protein, 626 aa, Pyrococcus horikoshii OT3
MEFKPYVPPEKSLPEYTVKAFILGVLLSIIMGAANAYLGMYAGMTVSASIPAAVISMAVLMALRDRNILENNMVQTAASAGEALAAGVIFTFPALVVLNYYTEFPYYIVTVIAALGGSLGALFTVVLRRAFIVEEKLPYPEGTACAEVLIAGDKGGTHAKPIFYGGILGSIYKFFGSIGLWSGTLEAAKLVGRRVLYFGSDLSAALISVGYIVGLNIAFLVFLGGAIAWFIAIPIYAAKMGSPGNLSALDLAWTIWSTKIRYMGVGAMVVGGLWSLVKLRGPIARGIKAGLEAARRRQAGEAVLRTEEDLPLNYVLTLIAAFVIPLFLLYAHILHNIGMAIVMAVIMLILGFFGSAIAGYLAGIVGSSNNPVSGITIMSLLFTALILKGLGLSGTEGMVATILVAAVICTAAAIAGDTMQDLATGYLVGATPKRQQVFEVMGTFFAALVMAPVLNLLIKAYGIAGTPTAKGENALPAPQAFLMAKVTEGVFTGTLEWTMVFIGAGIAIALIIIDEILARRGSKFRTPVMPVAVGIYLPLSLGVPILLGGIARYLVSRGRKEGESFTDPGVLGAAGLIAGEALTGIVFAALIVGGIAPSVKTTLAGNILGVLFLLALLGWLTKLGRK

SEQ ID NO: 9892 - protein, 475 aa, Oryza sativa Indica Group
MGALLSSPNSKNQPWEHGEASKADSSKKLRMSAPPLSGGYDHPGLIPGLPDEISLQILARMPRMGYLNAKMVSRSWKAAITGVELYRVRKELGVSEEWLYMLTKSDDGKLVWNAFDPVCGQWQRLPLMPGISHGGECKRGIPGLWLGDLLSAGIRVSDVIRGWLGQRDSLDRLPFCGCAIGTVDGCIYVLGGFSRGSAMKCVWRYDPFVNAWQEVSSMSTGRAFCKASLLNNKLYVVGGVSKGKNGLAPLQSAEVFDPRTGIWVEVPDIPFSKAQALPTAFLAELLKPIATGMTSFGGKLYVPQSLYSWPFFVDVGGEIFDPETNSWAEMPVGMGEGWPARQAGTKLSAVIDGDLYALEPSTSSDRGKIKIYDPQEDAWKVAIGQVPVGDFAESECPYLLAGFLGKLNLIIKDVDSKINIMQTDVLKPVELSAPGNGPTCQNQQLSSEQETNLWKVIVSKNLAAAELVSCQVLNI

SEQ ID NO: 9893 - protein, 351 aa, Escherichia coli CFT073
MIAELETDKVILEIPAPHDGVLSNIIVSEGSTVTSAQLLAHLKPQAVIEETVTPVTETLAMPSARLEAQRSGVELADVAGSGRNGRILKEDVQRVTPAPVIQPERVAEIAPAKPLTPGARQERREPMSRLRQRIAERLLASQQNNAILTTFNEVNMQSVMDLRARWKDRFAEKHGVKLGFMSFFVKAVTRAQERFPVVNASVDGNEIIWRDYCDIGIAVSSNRGLVVPVLRNAQSLSLVEIERQIAEYATQARNGKLPLEALQGGTFSITNGGTFGSMMSTPIINPPQSAILGMHAITPRPVAENGQVVIRPMMYLALSYDHRIIDGQEAVQTLVAIRELLESPEQLLLDL

SEQ ID NO: 9894 - protein, 472 aa, Escherichia coli CFT073
MSTIFDVAVMGGGPGGYVAALRAAQNGLSVVCIDDGVNAQGEPSPGGTCLNVGCIPSKSLLQSSELYAQVQHEASIHGVNVDGVSFNAAAMIQRKDAIVSRLTMGIGLLFKKNKVKYLCGLATLEHARDEIWQLRVNDQQIRARNVVIATGSQPRQLPGVTIDNQQILDNRGALALTAVPPRLGVIGAGVIGLELGSVWNRVGSDVTLLEMAPTFLPALEARLSNEVRKAMIASGMKMQLAVEIEAIEQRDDGVHVRWRQGEKREESRFDKLILAIGRVPRLSGVDLVQLGLEADNRGGIAVDNLCRTGKAGLWAIGDVVRGPMLAHKAMAEGVVVADQIAGLAVEPINFALIPSVIYTQPEVAWVGENEASLKAAGRVFNKGNSLFAGNGRALALGQEGGRCTLYSDKHTDRVLGGAIVGPQASELINEIALAMTFSASGEDIACAIHAHPTLSEVIHEAAMALNNKALHG

SEQ ID NO: 9895 - protein, 389 aa, Escherichia coli CFT073
MNLHEYQAKSLLAGMGMPCPKEIAIQQISQLADAWQHIACPSKGAVLKAQVHAGGRGKAGGVKVLKQLPEAQAFVQQMLGSQLVTYQTGPEGQYVSSILLCENIYPVRQELYFGMVVDRESQRVTFIVSPEGGVEIEKVAHETPEKISSVSIDPLTGVQPCHIREMFAVLQLEHGLFAAFSRLVNQAWKAFNELDFALLEINPLVLRETGEFMCADAKVSLDDNALYRHPELQVLRDETQEDPRESQAAKLDLNYVSLDGNIGCMVNGAGLAMATMDIIKLYGEQPANFLDVGGGATQERVSEAFRLIVSDSKVKAILVNIFGGIVRCDMIARAIIHALNEARITLPVVVRLSGNNAAEGQRLLAESGLTVEAVNSLDDAAKRIIALLN

SEQ ID NO: 9896 - protein, 524 aa, Mesorhizobium loti MAFF303099
MSTPSRPSRCRYSQEARETVPMNAPLNIAMPAEASAAPKNYRLLIDGKHVDARDGRTIARKSPGHGFTVSRYAQAGEAEVEAAVQAAHKAFETGPWPRMKAGERAAILFRAADLIEARLEDIARLDALESGKPIAQARGEIGGAVDIWRYGASLARTLHGESYANLGDAMLGVVLREPIGVVSIITPWNFPFLIVSQKLPFALAAGCTAVVKPSEMTSASTFVLGDILLEAGLPAGVVNILAGLGADVGAPMVSHPLVEMVSFTGSTRVGKMTMASAAQSLKKVSMELGGKNGQIVFPDADLEAAADAAVFGGFFNAGECCNAGSRLIVHEAIADDFLSAVKALTARVTVGDPLDDQTKVGAMISSDHLAKVTDYVTAAAGEGSNVYSGGKQLASNAGQYLDPTIIRGVTEDMAIAREEVFGPVLSVLTFESIEKALHIANNTPYGLSAGVWSASIDTCMSVARGVRSGTVWVNTFMEGYPELPFGGYKQSGLGRELGKRAVEDYTEEKTIQFHRGQRTGWWVG

SEQ ID NO: 9897 - protein, 340 aa, Bacillus thuringiensis serovar konkukian str. 97-27
MTKITVVGAGSWGTALAMVLADNGHDVRIWGNRSELMDEINTKHENSRYLPGITLPSTIVAYSSLEEALVDVNVVLLVVPTKAYREVLQDMKKYVAGPTTWIHASKGIEPGTSKRISEVIEEEIPEDLIKDVVVLSGPSHAEEVGLRQATTVTSAAKRMEAAEEVQDLFMNSYFRVYTNPDIVGVELGGALKNIIALAAGITDGLGLGDNAKAALMTRGLTEIARLGRKMGGNPLTFAGLTGMGDLIVTCTSVHSRNWRAGNMLGKGHSLEEVLESMGMVVEGVRTTKAAHELAEKMEVEMPITAALYDVLFNGNNVKDAVGSLMGRVRKHEVEAIPDLL

SEQ ID NO: 9898 - protein, 299 aa, Dechloromonas aromatica RCB
MYKTLQDFVGNTPLVRLVRIPGADNDKRGNVILAKLEGNNPAGSVKDRPALSMIVHAEARGDIKPGDTLIEATSGNTGIALAMAAAIKGYRMILVMPENQSVERRQSMRAYGAELVLTPKDGGMELARDVADKMRDEGKGIILDQFANPDNPLAHYEGTGPEIWRDTDGKITHFVSSMGTTGTIMGTSRFLKEANPAIEIVGCQPEDGSQIPGIRKWPEAYLPKIFDKTNVDRVEYVSQADAEAMTRRLAMEEGIFAGISSGGALAVALRLSQQLENAVIVSIICDRGDRYLSTGVFPA

SEQ ID NO: 9899 - protein, 572 aa, Zea mays
MASTSVPELTADKKCDKAIADTAAPLTSQGHSEEPTGKVSTLVPALPVVIAAGDGAASSGVIENRNGMDNSADGSLKRDDSEGAEKSSLRGSVKDSSVSAKCSDRASSLSKASGSAKISGQPADMIESGKSSLYRASGGSDLSDESTCSSICSSVSKPHKSNDSKWEAIQVVRTKEGSVGLGHFRLLKRLGCGDIGSVYLSELSGTKCYFAMKIMDKASLATRKKLLRAQTEREILQCLDHPFLPTLYTHFETDKFSCLVMEFCPGGDLHTLRQKQPGKYFPEQAAKFYVAEVLLALEYLHMLGIIYRDLKPENVLVREDGHIMLSDFDLSLRCAVSPTLLRSSNPSGDNQKGNPAYCVQPVCIEPACMQPSCVTTTTCFSPRFFSSKSKEKKDKKAKADLANQVRPLPELVAEPTDARSMSFVGTHEYLAPEIIKGEGHGSAVDWWTFGIFLYELLFGKTPFKGSGNRATLFNVVGQPLRFPESPVVSFAARDLIRGLLIKEPQHRLAYKRGATEIKQHPFFEGVNWALIRCATPPDIPKPVEIPRSVASSSQKATSAAEKGSDYLELEFF

SEQ ID NO: 9900 - protein, 182 aa, Dechloromonas aromatica RCB
MALNNVPSGKSLPDDFNVIIEISAHSEPVKYEVDKESGAIFVDRFMSTSMHYPCNYGYIPHTIAGDGDPVDVLVVAPFSLPPGVVVRCRPLGQLSMTDEGGNDAKLLAVPVDKLTPLYKDAKSIEDMPELLRKQISHFFEHYKDLEPGKWVKVNGWEDIDAARKEVMEGVQRYNDAKDKPNY

SEQ ID NO: 9901 - protein, 324 aa, Brassica napus
MAARYWCHMCSQVVNPIIEAEIKCPYCQSGFLEEMSGENNGGSSSSLREVQDQETGFGTDRALTLWGPVLVGMMSNPRRRRRFRRTEFGVDNDEVNVAVDKHHHRRHHDREHEGEIDLDMEVDSIMRRRRRSSAAILQLLQGIREGLNSDHESPDGNSFGDYLARPELDHLLRSLADNDLIRRQGTLPARKEAVDNLPTVKICEPLQCSVCLDEFDKGCEAKEMPCKHKFHIRCIVPWLELHSSCPVCRYELPHDEELKTDLVRPRTRSVGVNLSNENVEENARNISGSERRFSLRWPFSGLFSSSSSSSGSTSGSSQLNENAS

SEQ ID NO: 9902 - protein, 222 aa, Oryza sativa Indica Group
MAVSLAGLVGACCRVTWLLWVYLLAMFALIVALLGFTAFAFAVTNRGAGEAVSGRGYREYRLGDYSTWLRRHVGSSKNWDKIRSCLAGADVCRSLQDRNETWAQFVADDLSPVQSGCCKPPTSCNFTYGGGTRWGKTARLSSADPDCDEWSNDADEVCYGCRSCKAGVVAALKRDWKRVAIVNVVFLAFIVVVYSVGCCAFKNSRRDSVHRRSGGWKQAGYA

SEQ ID NO: 9903 - protein, 417 aa, Erwinia carotovora subsp. atroseptica SCRI1043
MESKVVVPTEGQKITVDAQGKLVVPNNPVIPFIEGDGIGIDVTPAMINVVDAAVKKAYQGKRAISWMEIYTGEKSTQVYGKDVWLPDETLDLIREYRVAIKGPLTTPVGGGIRSLNVALRQQLDLYVCLRPVRYYEGTPSPVKQPELTDMVIFRENAEDIYAGIEWKAGSVEADKVIKFLREEMGVSKIRFPEQCGIGVKPCSEEGTKRLVRAAIEYAITNDRDSLTLVHKGNIMKFTEGAFKDWGYQLAREEFGGELIDGGPWVKIKNPNTGKEIVVKDVIADAFLQQILLRPAEYDVIACMNLNGDYISDALAAQVGGIGIAPGANIGDECALFEATHGTAPKYAGQDKVNPGSVILSAEMMLRHLQWFEAADLIVKGVEGAIKNKTVTYDFERLMEGAKLRKCSEFAQDIIDNM

SEQ ID NO: 9904 - protein, 175 aa, Oryza sativa Japonica Group
MDSSNNNNNNKRARDAEDEADEAKRLRAEDLLDMLDDDTDAGGAAGDLASVMRSFEEEIVAGDVAGDVAPTTQPELGFLLEASDDELGLPPATASSSEEEAGAGEPEDAIGFGGQIWGFEDEIGGGGYAGFALTSPEAVAAAAAAAEWDDDGFDAGLFGFGDEVSALRHETMPAV

SEQ ID NO: 9905 - protein, 524 aa, Zea mays
MLEIWVQARNDDICGRHYLLGGVLFGSLYLFSYRAGVFSRKLSISISAVALLRSCHRFLVLLQGSSSHENKKDTSNLSARLHSQYEAINPAAHLSQRRLLQDSNLAAPSSANDLVPAAVPVPSTGTGSFSAFSPNNAPAPAVNPPSRPPTAPSTTAGEVQERRSMKWLYFIVLPLVVLLIGIACMLLLCRTKSGTTIGPWKTGLSGQLQKAFVTGVPKLQRSELEGACEDFSNIVSSYPQYTVYKGTLSSGVEIAVVSTMVISSKDWSKHSEGRFRKKIDSLSRINHKNYINLLGYCEEEEPFTRMMVMEYAPNGTLYEHLHVEGFDPIDWNGRMRIIMGVAYCTLHMHELSPPVTHPDIKSSAILLSEDGAAKIVDMSVWHEVYFRGNMPKDGDLVDHQERVAADPAGNVYSFGLLMLEIISGKPPYSEEKGSLSDLALECIRDNRSMSCLLDPSLKDHKEKDLETICDLVQDCIQSDPKKRPAMREVTTRLREVLSISPEAATPRLSPLWWAELEILSVEAS

SEQ ID NO: 9906 - protein, 145 aa, Zea mays
MSSPSKRREMDLMKLMMSDYKVEMVNDGMQEFFVEFKGPAESIYQGGVWKVRVELPDAYPYKSPSIGFINKIYHPNVDEMSGSVCLDVINQTWSPMFDLVNVFEVFLPQLLLYPNPSDPLNGEAAALMMRDRPVYEQKVKGTVLQ

SEQ ID NO: 9907 - protein, 877 aa, Clostridium tetani E88
MESKKYVYLFKEGNAKMKNLLGGKGANLAEMTILGIPVPQGFTITTEACTKYYEDNKKLSDEVISQIYKALEEIEKETKKSFGSIDNPLLVSVRSGARVSMPGMMDTILNLGLNDDTVKAISRLTNNERFAYDSYRRFIQMFSDVVMGLDKRMFEDILEEVKKSINAKFDTDLSAENLKKIVEKYKEIYKKEVGEEFPQDPKIQLLESVNAVFRSWDNPRAIVYRRLNDIPGSWGTAVNIQTMVFGNMGDTSGTGVAFTRDPATGENKIFGEYLINAQGEDVVAGIRTPQAITKLKEDLPSCYEEFVNIAGKLENHYRDMQDMEFTIEQGKLYFLQTRNGKRTAQAALKIAVDMVNEGLITKEEALLKVEPKQLDTLLHPNFHEGELKKATFIAKGLPASPGAACGKVYFTAEEAKEKHELGEKVVLLRVETSPEDIEGMIAAEGILTVRGGMTSHAAVVARGMGKCCVVGCDDIEVFEKENTFQIGRIKFKKGDYISIDGSTGKVYGEAIKTVSPEISGYFGIFMKWADGIRSLKIRTNADTPKDSNQAVEFGAEGIGLCRTEHMFFDEKRIPAVRQMIMADNEDQRREALEKLLPMQREDFVGIYEAMEGRPVTIRFLDPPLHEFLPTEDEDLKELAKDMGVTFERVKYEIESLKEFNPMMGHRGCRLSISYPEIAEMQTRAVIEAAIDVKNRKGYNIKPEIMIPLVGEVKELKFLKDIVINVANKVIEESGVELEYFVGTMIEVPRATIVADEIAKEADFFSFGTNDLTQMTFGFSRDDAGKFLNNYYDNKIYDFDPFQKLDQKGVGQLVQNACELGRKAKENIKLGICGEHGGDPASVEFFHKVGLDYVSCSPYRVPIARLAAAQAEVKYPRK

SEQ ID NO: 9908 - protein, 396 aa, Silicibacter pomeroyi DSS-3
MSFQNPVFIPGPTNIPESLRKACDMPTIDHRSPLFGQILHPARAGVRAVLKSETAEIFIFPSTGTGGWETALTNTLSAGDGVLAARNGMFSHRWIDMCQRHGLAVEVVETPWGEGLPADRYEEILAADTHHRIKAVLATHNETATGVRSDIAAVRRALDKAGHPALLFVDGVSSIGSMDFRFDEWRVDVAVTGSQKGFMLPAGLAIVGFSAKAMEATATGTLPRTFFDVHDMARGYANNAYPYTPAVGLMNGLNQACRMLLDEGLENVFARHHRIAEGVRAAVHAWGLELCAASPDLYSDTVSAIRTPEGFNATDIVTHAASKYGVAFGVGLGEVAGKVFRIGHLGSLTDVMTLSGIATAEMCMADLGLDIGLGSGVAAAQEYFRSHSATSLLAAA

SEQ ID NO: 9909 - protein, 430 aa, Heterocapsa triquetra
MIKSLFAREILDSRGNPTVEVDLVTESGISVRAAVPSGASTGIHEACELRDGDKGRYLGKGVKKAVEAVNTVLASALKGADVSEQKALDAKMCELDGTPNKGKLGANAILGVSLAAAKAAAEAKGVPLYKHFGDLAGNPGPVVLPVPCFNVVNGGSHAGNKLAFQEYFIIPVGAETFTEAMRIGAECYHTLKGIIKKKYGGDATLIGDEGGFAPPCDAREGVELVMEAIEKAGYKDKCKIGMDVAASEFKVEGQDCYDLGTWYPDGEKDAPGLKMTGAELADFYAKLCQDFPIITIEDPFDQDDWASWKLFTEKVGGPCQVVGDDLTVTNVTRVKKAIDDKACNALLLKVNQIGSVTESIDAVKLCKQSGWGVMTSHRSGETEDVTIADLAVGLCTGQIKTGAPCRSERNAKYNQLMRIEEELGDKAVYA

SEQ ID NO: 9910 - protein, 501 aa, Escherichia coli CFT073
MNMSSISHGAPQKRRIIPNPGLWLAIIAGIIITLLPLGDTLPVAGQNMIAILVFAIIVWISEAMDYTASAIVISALIIFMVGFAPDMNHPDTILGTAKALKMTLSGFSNSALALVAAAMFIAAAMTITGLDKRIALFTMSKIGASSRSIIIGAIVVTIVLSLVVPSATARTACVVPIMMGVIAAFKVDKHSRLAASMMIVIAQATSIWNVGIQTSAAQNLLSIGFINKTFGAGHSVSWLDWLLAGAPWSLTMSVILYFLARKLLPPETEAVEGGSEAIKKALAELGPTTGKEKRLIGISLLLLLFWSTGGKLHSIDTTSVTLAGLAIMLLPGIGVMSWKEVEKRVQWGTLLMFGIGISLGSTLLDTQAASWMANYVVKGFGLDGLPSLAIFAILAAFLIIIHLGFASATALTAALLPILISLLSSLPPELGVNPVGMTILLAFSVSFGFILPINAPQNMVCMGTDTFTPRQFTRVGLYLTVIGYLLLLLFAATWWKILGLM

SEQ ID NO: 9911 - protein, 330 aa, Triticum aestivum
  misc_feature (146)..(146): Xaa can be any naturally occurring amino acid
VFLPIIKSLSLSAGSKPNDPSSRKLGSYLVMTQFQAGSNSSALFLTAAAQNLLCLKLAEELGIVVANPWVSWFQAASLPAIVSLLATPYLLYKIFPPEIKDTPEAPALAAEKLERMGPVTKNEWVMIGTMILAVSLWVFGDAIRHXGVSSVVAAMLGLSILLLLGVLDWDDCLSEKSAWDTLSWFAVLVAMAGQLTDLGIVSWMSTSVAKLLASFSLSWPAAFVVLEASYFLVHYLFASQTGHVGALYSAFLAMHLAAGVPGVLSALALAFNTNLFGALTHYSSGQAAVYFGAGYLELPDIFRLGFVTALINALIWGVVGTFWWKFLGLY

SEQ ID NO: 9912 - protein, 355 aa, Physcomitrella patens subsp. patens
GEYLATVRLGTPERVFSVIVDTGSDLTWVQCSPCGTCYSQNDSLFIPNTSTSFTKLACGTELCNGLPYPMCNQTTCVYWYSYGDGSLSTGDFVYDTITMDGINGQKQQVPNFAFGCGHDNEGSFAGADGILGLGQGPLSFPSQLKTVFNGKFSYCLVDWLAPPTQTSPLLFGDAAVPTFPGVKYISLLTNPKVPTYYYVKLNGISVGGKLLNISSTAFDIDSVGRAGTIFDSGTTVTQLAGEVHQEVLAAMNASTMDYPRKSDDSSGLDLCLGGFAEGQLPTVPSMTFHFEGGDMELPPSNYFIFLESSQSYCFSMVSSPDVTIIGSIQQQNFQVYYDTVGRKIGFVPKSCVGRG

SEQ ID NO: 9913 - protein, 279 aa, Physcomitrella patens
MAKDAGTESGVPSKDYSDPPPAPLIDAAEFGRWSFYRAIIAEFVATLLFLYITISTVIGASRNAGCAGVGLLGIAWAFGGMIFVLVYCTAGVSGGHINPAVTFGLLMARKISLPRALTYMIAQCLGAICGAGLAKGFQTAFYMRYGGGANSVALGYSTGTGLAAEIIGTFVLVYTVFSATDPKRNARDSHVPVLAPLPIGFAVFMVHLATIPITGTGINPARSFGAAVIYNRSKPWDDHWIFWVGPFLGAALAASYHQYILRAAPFKSLGSFRSAPSHV

SEQ ID NO: 9914 - protein, 355 aa, Glycine max
MDFLNFMLNLLVPPGSMLTLAFSWPALCFLNVCEWLYNSIYGEDIDNKVVIITGASSGIGEQIAYEYALRRANLTLVARREHRLRGIAENAKRLGARHVMIMAADVVKEEDCRRFVNETINVFGRVDHLVNTVSLGHTFCFEEVTDTSVFPVLLDINFWGNVYPTFVALPYLHQSNGRIIINASVESWLPMPRMSLYAAAKAALVNFYETLRFELKDEVGITIATHGWIGSEMTRGKFMLEEGAEMQWKEEREVHVMGGPVEEFARLIVSGACRGDAYVKFPSWYDVFLLYRVFAPRVLNWAFRFLISPQGTRRASSYVGTGKHIEAVGMVRPMAMLEGTSPTHTGQLISQHKLD

SEQ ID NO: 9915 - protein, 466 aa, Vibrio campbellii AND4
MAHTNHYDVIVIGSGPGGEGAAMGLAKAGFNVAIVEKESSVGGGCTHWGTIPSKALRHAVSRIIEFNSNPLFCGNNTSLHATFSDILGHATSVIDKQTRLRQGFYDRNACTLLFGTARFLDKYSIAVMQSDGTEEVYTADKFVIATGSRPYQPNDVDFLHERVYDSDSILSLQHDPRHIIIYGAGVIGCEYASIFRGLGVKTDLINTRDRLLSFLDNEVSDALSYHFWNSGVVIRNDETYEKIEGTEDGVIVHLKSGKKMKADCLLYANGRTGNTDKLNLSAIGLESDSRGQLKVDSNYRSKVEHIYAVGDVIGYPSLASAAYDQGRFVAQAITKGQADGYLIDDIPTGIYTIPEISSVGKTEQELTAAKIPYEVGRTSFKHLARAQIAGKDIGSLKILFHRETKEILGIHCFGERAAEIIHIGQAIMEQKGEANTIEYFVNTTFNYPTMAEAYRVAALNGLNRLF

SEQ ID NO: 9916 - protein, 279 aa, Physcomitrella patens
MAKDVGVEPGFPSKDYTDPPPAPLIDASEFGQWSFYRAVIAEFVATLLFLYITIATVIGAVRNAGCDGVGLLGIAWAFGGMIFVLVYCTAGISGGHINPAVTFGLLLARKISLPRALAYMIAQCLGAICGAGLVKGFQTAFYMRYGGGANSVAAGYSIGTGLAAEIIGTFVLVYTVFSATDPKRNARDSHVPVLAPLPIGFAVFMVHLATIPITGTGINPARSFGAAVIYNRSKPWNDHWIYWVGPFLGAALAAAYHQYVLRAGPFKSLGSFRSAPSHI

SEQ ID NO: 9917 - protein, 197 aa, Candidatus Fritschea bemisiae
MKGIKFKSASFLTSALKGEELPRLNLPEIAIVGRSNVGKSSLINHLLNAKGLAKVSSTPGKTQRINYFIVDEALLLVDLPGYGYAAASKQIQKNWGLWIDTYLKNRELKGLLFLLDSRRELTREDAQFLRWASYENLSLLLVLTKADKLSQKEKHGALKRIQEEKTLSEFPMVLYSIKRGACRNFLIDAINKMLWGY

SEQ ID NO: 9918 - protein, 183 aa, Zea mays
MSSPSKRREMDLMKLMMSDYKVDMVNDGMQEFFVEFRGPNESIYQGGIWRVRVELPDAYPYKSPSIGFINKIYHPNVDEMSGSVCLDVINQTWSPMFDLVNVFEVFLPQLLLYPNPSDPLNGDAAALMMRDRPAYEQKVKEYCEKYAKPGDAGVTPEEQSSDEELSEDENDSGDEEIMGKPDP

SEQ ID NO: 9919 - protein, 460 aa, Xanthomonas campestris pv. campestris str. ATCC 33913
MTATRYDAIVVGAGQAGPSLAVRLAERGQRVAVIERHLVGGTCVNTGCMPTKTLVASARVAHLARRAGDYGVRIAGPVEVDLPQVMARAHAISDAARTGVEQWLAQTPGVQLIRGHARFVAPDRLRVGAQELGAPRIFLNVGGRARTPELPGLDQISPLNNTSILQLRTLPQHLVVIGGSYIGLEFAQIFRRLGAQVTVVEQHAHLIGREDADISEAIAQMLQDEGIAVRTDARCIAFAAHADGAAVQLECAQGAPQIVASHVLLALGRQPNTDDLGLEAAGIATDAQGYVQVDMQLATNVPGVWAMGDCNGRGAFTHTAYNDYEILAANLLDGAERRLSQRVPAYALFTDPPLGRVGMSETQARASGRPLLVAQRPMQQVGRARENGETIGMMKLVADAQTRRVLGAAILGLHGDEAIHGIIDLINADQPIDTLEWAVPIHPTVSELWPTLARALAPAQ

SEQ ID NO: 9920 - protein, 586 aa, Moritella sp. PE36
MPKDNTSYLTPTYGRVLFNEDIPKNKLPDNSHDPRAVYRFIRDELQLDGNPTLNMASFVTTVMDDEANRLISENLGKNYIDTEVYGRTAEIEKRCVKTLLDLYHAPAPMLDAEELAKDDHQPSSWGTLTVGSSEALMLCALSHKRRWMDSRKAQGLNTERPCIVLGSDVHITWVKFAEYFDVNIIWVPITKENNYAISAIQVEDVINNPTISINTPNDTAVSNKQIICVVAVMGTSYTGQNDPVSDINDVLVKFKNSTTEPLDIPLHVDAASGGFIEPFRQHGDGQKAELKWDFSLEQVKTINVSGHKFGLVYPGIGWALWRDIEDIPKALFVTTNVLGFDESTYSLNFSRGSAMVLGQYYNFLRLGKNGYRSVIQNLMGIAQHLSAGLNRLRVTVIEDGNDEALLSDYKVLEIVNDGAYFPACAAKLSLGQQSDGLSDNDYLYNEHDVVAKLKQNNWIVPAFSMPLDATSPIGPQDPNAPTVNMMRMVVKESFSWDMAEQLIKNVAQAIGSLEVQTRALRYPDKKFSVQVRLDESTTSSAGCDESQRRFTLLTQANEGVLFQQHQKVSVADSSSLKLDIDLDIHA

SEQ ID NO: 9921 - protein, 342 aa, Zea mays
MGDSRRHEPWVILQPDGWLRRPALGLNSLMQIPDKIQSSLKVQFGRFLNKDGAVRRMSAEISSEKAKQSCSAAASAEVRLDRHLQAWWDNPSWTDEPPEIKVNVPEGSLCNLNLRFKAGLPPDAVYNIIIDPENKRVFKNIKEVISRKVLLDEGSRQVVEVEQAAIWKFLWWSGTFSVHVFVDQNRKKHTVKFRQGRAGFMRKFEGCWTIEPLFVDKELCLPLNPHSLEEYESCTGGRGRVGSAITLDQLIEPALLPPPPISWYLRGITSRTTEMLVNDLIAETARLRTISNNANAKQGTEETGDANIGDPVRECGDIKERWRQRRKSGRHGSSLRLTSRFL

SEQ ID NO: 9922 - protein, 324 aa, Bacillus thuringiensis serovar konkukian str. 97-27
MKRILVLHTGGTIAMEEDKETGVVQPGEKNPLLKFIPDLEGDVDLIVEDVFHLPSPHMTPSEMLQLQVIIDERVKQDNIHGVVITHGTDTLEETAYFLDLTVQATIPIVVTGAMRSSNELGADGLYNFLSAVKVASSSEAAEKGVLVVLNDEIHCATNVTKTHTSNVATFQSPQYGPIGMVTKRGVVFHHALVHHETYSVNKISKNVVVLKAYAGMDDTLLAAIENLPVDGIVIEALGQGNLPPRTLPSLERLINKGIPVVLVSRCFNGIVQDVYSYEGGGKQLKDMGIVFTYGLNAQKARIKLLVALENTTSHETIQNMFMHD

SEQ ID NO: 9923 - protein, 473 aa, Methylobacillus sp. 12S
MKIVPVILSGGSGTRLWPLSRQALPKQLLPLTSGHSMLQETLLRLSGVESIESPIVVCGNDHRFLVAEQLLEIGSKPKAIVLEPVGRNTAPAIAVAASRLLQENAEDVLMLVLPADHVIQNRAAFSAAIAVAAQAAKSGRLVTFGIKPTVPETGYGYINGGAALASCPGSFELSRFVEKPNLETAKQYLASGDYYWNSGMFLFSPKQYMEELTQFAPEIASKASEALEQSYTDLDFVRLHEASFKECPSQSVDYAVMEHTRNAAVVPVDIGWSDVGSWTALADVLDKDDAGNVTVGDVYLNGVKNSMVRSEGRMVAALGVENLIIVETSDAVLVAHKDAAQDVKKIVDYLKEQGRKEHEYHSRVYRPWGWYEGIDAAERFQVKRIMVKPGEKLSLQMHHHRAEHWVVVSGTAIVTKNGEAEMLCENQSTYIPIGATHRLENPGKLPLHLIEVQSGGYLGEDDIVRFEDTYGRS

SEQ ID NO: 9924 - protein, 884 aa, Anaplasma marginale str. St. Maries
MSELLIYHFSKSKCDGGSHLANLLGNKGAGLAEMCRIGINVPPGFTIPTSVCGHYHKHGKLPEGLFQQLQKALQHLGNEISLEFGNPDRPLLVSVRSGSVRSMPGMMDTILNVGINDEIVEGLKRAYSERFAYDSYRRLIQMYATTVMQLDNHLFEEGYDRKCRELSLLPGGPIADVSALSELVTEFKHLVLKHGGAEFPQNVHEQLYNAIGAVFRSWMNSRAVAYRKVYGISSEIGTAVNVQSMVFGNVSQNSATGVVFTRNPSTGAKEIFGEFLINAQGEDVVSGNKDPAPISLMERVMPRVYGELVEVCHKLEQSYKDMQDVEFTVQDGKLWILQTRAGKRSAQAAVHLAVAMVKEGLISREEAINRIDHTTLSGLLHPVLDGGSDNAVVCRGLPASPGAASGCVAFTSSDAESLKKQGKNVILVRQETSPEDIGGMSSSVGILTLRGGMTSHAAVVARGMGKPCICGTSGLFIDKSGEFFYNGEGLKVAQGENITINGSTGEVMLGTVKTVTPQLPESFSELMSWVDEVRTIGVMANADTPEDMKTAKQFGADGVGLCRTEHMFFSDGRIATVQEMIVAGDKQERDNALAKIEIMQKNDFKEMCACMQGKQITIRLLDPPLHEFLPTSREVLEDIAKRIGKPLEHVRNRVSALSEKNPMLGHRGCRLAISYPEIYEMQVRAIFQAVGELREEGIAEVVPEIMVPFVMDEGEITRVGDLVRRVAEQFNNAPYSIGVMIELPRAALLADRLAKHVQFFSFGTNDLTQTTLGMSRDDSSKFVEHYTSAGILRSDPFELLDEQGVGKLIEITMKLARESGAKIKTGMCGEHGGTLEAMQLCAKLGIDYVSCSPYKVPVAKLLAAKCAIACKQLTLSNGAVTQSS

SEQ ID NO: 9925 - protein, 327 aa, Methylobacillus sp. 12S
MKVLVVGGAGYIGSHMVKMLLGEGHDVITFDNLSSGYRDAVVGGTFVQADLADKAALDEVFVKHTPDAVMHFASYIQVGESVRHPDKYYLNNFTNTMNLLDAMVKHGVNYFIFSSTAAVFGEPEYVPIDEAHAKNPLNPYGRSKLMVEQALGDYERAYGIKSVCLRYFNAAGADPEGQLGERHEPETHLIPLVLQAISGRRDNITVFGRDYDTPDGTCIRDYIHIVDLCSAHSLALRKLMETNISRRYNLGNGAGFSVQEVIAAAQKVTGKPIKVAEGERREGDPARLVADASLARSELGWKPVYADLDTIIQHAWQWESKTVGKPV

SEQ ID NO: 9926 - protein, 316 aa, Haemophilus influenzae R2866
MTIYADNSYSIGNTPLVRLKHFGHNGNVVVKIEGRNPSYSVKCRIGANMVWQAEKDGTLTKGKEIVDATSGNTGIALAYVAAARGYKITLTMPETMSLERKRLLLGLGVNLVLTEGAKGMKGAIAKAEEIVASDPSRYVMLKQFENPANPQIHRETTGPEIWKDTDGKVDVVVAGVGTGGSITGISRAIKLDFGKQITSVAVEPVESPVISQTLAGEEVKPGPHKIQGIGAGFIPKNLDLSIIDRVETVDSDTALATARRLMAEEGILAGISSGAAVAAADRLAKLPEFADKLIVVILPSASERYLSTALFEGIEG

SEQ ID NO: 9927 - protein, 299 aa, Methylobacillus sp. 12S
MRQKNVTKAVFPVAGLGTRFLPATKANPKEMLPVVDKPLIQYAVEEAVAAGITDLIFITGRNKRSISDHFDMAYELENELERNGKKQLLSVVQNIVPKNVNCIYIRQNQALGLGHAVKLAKPVVNDDPFAVILADDLIDAKVPVVKQMVDAYQYYRCSLLGVQEVPRDQTKSYGIVATHPMSNGIEQVAGIVEKPKPEEAPSNLGVVGRYILTPRIFHHLENLQAGSGGELQLTDAIASLLSEEQILAYRFEGTRYDCGSKSGFLEATVRLGLKHPECGKDLRALLEAIAAEGLVGKKK

SEQ ID NO: 9928 - protein, 563 aa, Novosphingobium aromaticivorans DSM 12444
MAARLPQWERREMADGKKASDLFIECLEEEGCEYIFGVPGEENLDFLDSLSRSKKIRLVLTRHEQGAGFMAATYGRHTGKTGVCIATLGPGATNFVTAAAYATLGGMPMLMITGQKPIKKSKQGRFQILDVVSMMGPITKFTHQMASSDNIPSRVREAYRLAEEEKPGATHIELPEDIADEHTTSVPLKRSLVRRPNADAKSVAQAVHALQNAKAPVLVIGAGANRKMTGKMLLEFVEKTGIPFLTTQLGKGVIDERHPKFLGCAALSSGDFVHRAVEDADIIINVGHDVIEKPPFFMREGGTPVIHVSTKTAEVDPVYFPSIEVIGDIANAIWQMKEAITPNPAWNFDHMLAYRAAEVAHTAPLAADMRFPVFPPHLVQQVRDCMPEDGIICLDNGVYKIWFARGYTAYKPNTVLLDNALATMGAGLPSAMMSAMLYPDRKVMAICGDGGFMMNSQEMETAVRLGLNLTVLILNDSAYGMIRWKQANMGFEDFGLTYNNPDFVKYADSYGAKGYRVESAEHLEKLLAHCRDTPGVHLIDCPVDYSENDQILNKDIKELSKAL

SEQ ID NO: 9929 - protein, 291 aa, Lentisphaera araneosa HTCC2155
MFLARADVLLSELRKFRPAMHQNVCDSYELKHVEGSFIAPDTAAFENCSSESIDYAIMEQSKRIKMLALNTAWSDVGTWKELAKISETDEDGNSCIGDVLLQNSQNNYIRSNKKLCATVGVKDLIIVNNDDALLIAHKDESENVKQIVTQLEALKRPEARTHQTVNRPWGSYCNIDQDFGFKVKHITVKPGAKLSLQKHFHRAEHWVIVKGSALVTNGEENILLSENQSTYIPIGTLHRLENPGKIPLELIEVQSGNYLEEDDIVRYDDDYGRSNQSIPLKVNKDQKKGVS

SEQ ID NO: 9930 - protein, 192 aa, Lentisphaera araneosa HTCC2155
MKNLNIVIMSGGCGSRLWPMSRATYPKQFLPLCGDESLLQETVSRVKNINKPGDLIVVGNKDHRYLIAEQLRQINVESPKIILEPSARNTAPAIALAALEVQASDPEALLLVLASDHKIQDDNKFCETVEAARQSAEEGAIITFGITPTHPATGYGYIRCEETDNTIKTVDCFVEKPCLSKAEEYLNRPNYF

SEQ ID NO: 9931 - protein, 162 aa, Oryza sativa
  misc_feature (157)..(157): Xaa can be any naturally occurring amino acid
MAPVAVGDTLPDGQLGWFDGEDKLQQVSVHGLAAGKKVVLFGVPGAFTPTCSNQHVPGFINQAEQLKAKGVDDILLVSVNDPFVMKAWAKSYPENKHVKFLADGLGTYTKALGLELDLSEKGLGIRSRRFALLADNLKVTVANIEEGGQFTISGAEXILKAL

SEQ ID NO: 9932 - protein, 395 aa, Candidatus Fritschea bemisiae
MDKLSLRDLKLNQKRVLMRVDFNVPLNADGSIRDATRIILTLPSIEYILRQKGRLVLISHLGRPKGSFDSKVSLRPCAQKLGELLGKEVGFCFDCIGAEVQKRVQNLNPGEVLLLENLRFHKGEESPEKDPGFAQSLAELGDVYINDAFGAAHRSHASIVPIAQFFPANCGVGFLMEKEIAAFSKIYLNPNRPFYAMVGGAKIGNKIDILQALSKRVDGLFIGGGMAFTFFKAKGLAIGESICDESRLKFARDFLKECERKGIRLHLPIDVVVTNGKKIQTVQIKGGVPDKWEGKDIGPQTVELWSKELNRGATLFWNGPMGVFEERAFASGTERLAHFLSEVPGDVTIGGGDLVAAVQSLNLEKKLSHVSSGGGASLEFLANGTLPGVEALSNK

SEQ ID NO: 9933 - protein, 73 aa, Zea mays
  misc_feature (44)..(44): Xaa can be any naturally occurring amino acid
GYAPGSCSPRPQTNVERDFLKKYWARWKADHVGRCRAMPHIKTXTRYSGQNMAWLLLTSAHLSKAAWRALQNI

SEQ ID NO: 9934 - protein, 272 aa, Neisseria gonorrhoeae FA 1090
MKKNHLNTTGFDLWHTIREETAAAAAAEPMLASFLHQTVLRHESLGSVLAYHLSSKLGSPIMDVRALFEIYQQALGSDTQISKCVEADLKAIYERDPACDEYSLPLLYFKGFHAIQAHRINHRLYLDGRKTLAYFLQNRMSEVFGVDIHPAARLGYGLMLDHATGFVAGETAVLGNNISILHGVTLGGSGKEGGDRHPKIGDGVMIGANASILGNIRIGSNAKIGAGSVVVSDVPPSITVVGVPAKPVARSLKTPSADMDQNIQFAEIDFMI

SEQ ID NO: 9935 - protein, 339 aa, Silicibacter pomeroyi DSS-3
MHLARYPRRFIAHLPTPLERLDRLTAELGGPEIWIKRDDCTGLSTGGNKTRKLEFLMAEAELQGADMVMTQGATQSNHARQTAAFAAKLGMDCHILLEDRTGSNNANYNNNGNVLLDHLHGATTEKRPGSGLDMNAEMEKVAEKFRADGRKVYTIPGGGSNPTGALGYVNCAFEMLNQFNERGLKVDHIVHATGSAGTQAGLITGLQAMNAQIPLLGIGVRAPKPKQEENVYNLACATAEKLGCPGVVAREDVVANTDYVGEGYGIPTESGLEAIRMFAELEAILLDPVYSAKGAAGFIDLIRKGHFKKGERVVFLHTGGAVALFGYDNAFDYSGRWVA

SEQ ID NO: 9936 - protein, 621 aa, Vitis vinifera
MAHIWNITFNSLYQIPYDAYALKKYHTHVSLYLCWGMVLGVNVLDVAAGVNFNVQLGWECEHHPWGSEEPLCETFPSLFALFDSKETWVADFLEQRGEGDCVIIVSWIFTYRRILFGYILGSNAHEKNISYQNTVYDFMDTVKTPFELQSSDSTLGNQRIMSNPRRKTKIVCTIGPSTSSREMIWKLAETGMNVARLNMSHGDHASHKKTIDLVKEYNAQFEDKVIAIMLDTKGPEVRSGDVPKPIMLKEGQEFNFTIKRGVSSENTVSVNYDDFVNDVEVGDILLVDGGMMSLAVKSKSKDLVKCQVIDGGELKSRRHLNVRGKSATLPSITDKDWEDIKFGVDNQVDFYAVSFVKDAEVVHELKDYLRSCGADIHVIVKIESADSIPNLHSIISASDGAMVARGDLGAELPIEEVPLLQEDIIRRCHSMQKPVIVATNMLESMINHPTPTRAEVSDIAIAVREGADAVMLSGETAHGNTHEIPNKEKTICHKILALSHMGTMFAFHATTMANTLNTPIIVFTRTGSMAITLSHYRPFSTIFAFTNEERVKQRLVLYHGVMPIFMQFSDDAEETFSRALSILVNKGLMKEGEHVTLVQSGAQPIWRVESTHHIQVRKVQG

SEQ ID NO: 9937 - protein, 517 aa, Mesorhizobium loti MAFF303099
MALFELTLVLLLTAVALTALSRRLEVPYPSLLALAGVGIAFVPGAPMIEIDPELALALFIAPVLLDAAYDTSLRDLKRYRLSLLLLALGAVVFTTVVVAFVGWKMAGLPIAAAIALGAIVAPPDAVAASAVLGQFKVPHRITAILQGESLLNDATALLIYRLAVSAALGSIMLSNAIPVILLSTIGSLIAGYLLGRLSLLTLTRIEDAASSTVVQFAGTFGVWILADKLGLSAIITIVVYAITIARRAPRRMSARRRVSTYSVWESAVFVLNVLAFVLMGLQARSIVGRLSGEGQGEAFLFAATVLVVVIVARLVWVASYVAIIRWFARVGSEDKKRDLPTFGGAVLVGWCGMRGLVTLVVAIALPAGFPGRDPIVLAAFAVVLGTLVLQGMTLKPLLRILDFDPDRTIDNEVAQARVAVMQAALDVLSRKTSAAAAVVREQYEAQRVIAENPEDAQAATEYDRLRLYAINRQRDTLEELRSNGTIGDEAYHRLEEEIDWAELAASPAGRFQPLTTD

SEQ ID NO: 9938 - protein, 108 aa, Glycine max
MGWTILLKGCRRLVKLELVGCEGSFDGVKAIGQCCVMLEELVIVDHRMDDGWLAGVSFCENLKTLRVQSCKVIDGSPGLEEHLGCCEALERVHLQKFQMRDRNGVGAL

SEQ ID NO: 9939 - protein, 442 aa, Physcomitrella patens subsp. patens
MLYMGTPRDYEFYIAARVMLGTLVRFQVDADLVVIASESVPPQWQKTLTDEGAKVVVVSDIQNPYANYRNFDKRFLLTLNKIYAWSLTEYQRVVMLDADNLFLRAPDELFQCGQFCAAFINPCIFHTGLFVLQPSNETFSNMMHDISIGKESSDGADQGFLASHFTDLLDRPMFHPPADGSRLDGLFRLPLGYQMDASFFYLKLKWRVPCGPNSVITFPSVPMLKPWYWWSWPILPLGLSWHEKRVATIGYETESPVLIAESLFYIFIMLVALIIRQRYACSEKSSMSRITCFGRGPCAEKKLCHPWAIKLIILALVAGSFRLPFYMIPTTVHPLMGWGVFLLGSFCLLTVVNTAFQLPDLPVLTPWLGCIGALFTMGSPFYASGITRGLGIGIYVAMITPFLWWAAKRVSGVVHAKVYWEPLMAWNSVRSEPASETLMKLC

SEQ ID NO: 9940 - protein, 465 aa, Myxococcus xanthus DK 1622
MKRGESAPSPSLRVLDVMALTVGIVLGAGIFKAPSLVAAQSGSGEAMLLTWLLGGVASLVGALCYAELASAWPHPGGDYHYLYRALGKGPAFLFAWARLTVIPTGSIALLAFVFGDYATQLFPLGLYSSPVYAAMLVVGLTAVNIAGLRQGTRTQNLLTALEVLGVGAVVIVGLLFTPALVPAAAPPAPAASSGTAWGLAMVFVLLTYGGWNEVAYLSSEVRGSRRTIAWSLLASIGLVTALYLLVNVAYLRGLGLEGMARSEAVAADLMQRAVGSGGALVLSVIIAISALTSANATVLTGARTHYAFGRDSVLFNGLGQWHAKSNGPSRALLVQGAISLALVGLGTLTRQGFETMVEYTAPVFWLFFLLTGVSLMVLRVREPDAPRPFRVPLYPLTPLLFIGICAYVLYSSLAFTGLGALAGLAVLGTGGVLLAVEAVRTRRGSQGTSPKASSSPRLQRTKEAT

SEQ ID NO: 9941 - protein, 321 aa, Gibberella zeae PH-1
MTGLNYDPEYFKAIGSPPKGPRADPPKTAHEMRSNIENTIGIFVTNSPYPSGVKETVYKVKSLDGTEIEVTRFTCEETLASEKPTPAVVYFHGGGFVACTVPPFAPQIARFANDSKLPYFAVDYRLAPEHPAPAALEDAWAAIQFVSKSAAEFNIDPARIALYGDSAGGGLTAGAALMARDRHLDPPIAKQILIYPMLDDRYNLKDDDPYLEVLAMRPAGAKVAWDAYLSKLREGDDAQALSYAVPARAATLKGLPSTYIDIGSLDLFRDESLRYANRLADEHVEVEFHLWPGLPHGFDGLRELSWYTRATESRVSALKRM

SEQ ID NO: 9942 - protein, 451 aa, Mycobacterium tuberculosis H37Rv
MSAVALPRVSGGHDEHGHLEEFRTDPIGLMQRVRDECGDVGTFQLAGKQVVLLSGSHANEFFFRAGDDDLDQAKAYPFMTPIFGEGVVFDASPERRKEMLHNAALRGEQMKGHAATIEDQVRRMIADWGEAGEIDLLDFFAELTIYTSSACLIGKKFRDQLDGRFAKLYHELERGTDPLAYVDPYLPIESFRRRDEARNGLVALVADIMNGRIANPPTDKSDRDMLDVLIAVKAETGTPRFSADEITGMFISMMFAGHHTSSGTASWTLIELMRHRDAYAAVIDELDELYGDGRSVSFHALRQIPQLENVLKETLRLHPPLIILMRVAKGEFEVQGHRIHEGDLVAASPAISNRIPEDFPDPHDFVPARYEQPRQEDLLNRWTWIPFGAGRHRCVGAAFAIMQIKAIFSVLLREYEFEMAQPPESYRNDHSKMVVQLAQPACVRYRRRTGV

SEQ ID NO: 9943 - protein, 414 aa, Glycine max
  misc_feature (223)..(223): Xaa can be any naturally occurring amino acid
MTKPNTFFHNLIKPFKFSSSKEGQTEENEIQNLAAQEQKIFPYETLVAATNKFHILNKLGEGGFGPVYKGKLNDGREIAVKKLSHRSNQGKTQFVNEAKLLARVQHRNVVSLFGYCTHGFEKLLVYEYVLHESLDKLLFKSHKKEQLDWKRRFDIINGVARGLLYLHEDSHNCIIHRDIKASNILLDENWVPKIADFGLARLFPEDQTHVNTRVAGTNGYLAXPEYLMHGHLTLKADVFSYGVLVLELVSGQRNSSFDMDVSAQNLVDWAYRLYKKGRALEIVDPTLASSVVAEQAEMCIQLGLLCTQGNQDLRPSMGRVMVILSKKPPCHMEEPTRPGIAGSRYRRRVSRGRRPSATTSGEVDDDSSVNSQTFDSSSNYGTNTTTSATTPTTRSSNTTAEVVDRRGKRPMQGG

SEQ ID NO: 9944 - protein, 406 aa, Streptococcus pneumoniae
MKIAVAGTGYVGLSIAVLMAQHHEVVAVDIISEKVNLINNGKSPIKDDYIEEYLATKPLNLVATLDTNLAYQNADFVIIAAPTNYDSEKNFFDTSAVESVIETVLETNPNAVMVIKSTVPVGYTQSVRNKYKTSNILFSPEFLRESKALYDNLYPSRIIVGLDMDDAYLKERAETFAELLQEGAIKEAIEILYMGFTEAEAVKLFANTYLALRVSYFNELDTYAEVKGLDTKAIIEGIGLDPRIGNQYNNPSFGYGGYCLPKDSKQLLANYKDVPQNMITAIVESNRTRKDFIAEQILKFAGVSNNGEIYPKDVIIGLYRLTMKSNSDNFRQSSIQGVMKRLKAEGANVIIYEPTLSDNETFFGSKIVNDLEHFKSISNVIVANRYDDLLKDVSDKVYSRDIFKRD

SEQ ID NO: 9945 - protein, 228 aa, Brassica napus
PRVRPRVRWRQSGGMQRHAAQVVHDTLPSPCVSASIKRHKPNQPIPSQPFASSSPPQADPTHQFASWTAKRGLVPNVKDKKHKPVLPGSSSFKPIHNHPLDQPPRGQVMNNRLPSGPTSSSEPAKGTGPESFVGRRVRTRWPEDNAFYEAAITKYDPVEGRHALVYDIGTRNETWEWVKLAEISPRDIEWIGEDPGVSNRYGLNRTTGPKHVPQRGSGLAKTTIKNDL

SEQ ID NO: 9946 - protein, 139 aa, Glycine max
  misc_feature (91)..(91): Xaa can be any naturally occurring amino acid
  misc_feature (115)..(115): Xaa can be any naturally occurring amino acid
KVVLFQIGEIISRFERKGFYLKGLKLVTVDRPFAEKHYADLSAKPFFSGLVDYIVSGPVVAMIWEGKNVVTTGRKIIGATNPAQSEPGTIXRGDFAIDIGRNVIHGSDAVESANXKEIALWFPEGPANWQSSQHSWIYE

SEQ ID NO: 9947 - protein, 467 aa, Leptospira interrogans serovar Lai str. 56601
MNKGKIKQIIGSVLDIEFENGELPEIYNALEIETNVFGKKETIIAEVQTHIGGKAVRAIALSSTDGLIRGQEVSNTGKPISVPVGDATLGRIFNVLGKTIDEGPAITVKETRPIHRAAPSFDELTSKTEVFETGIKVIDLLAPYIKGGKTGLFGGAGVGKTVLIQELINNIAKQHGGFSVFAGVGERTREGNDLWREMKESGVIDKTVLCYGQMNEPPGARLRVALSALTMAEHFRDSIGTDVLLFVDNIFRFSQAGSEVSALLGRMPSAVGYQPTLSTEMGALQERITSTKKGSITSVQAIYVPADDLTDPAPANAFAHLDATTVLSRAISDKGIYPAVDPLDSTSRVMNAQVLGEEHYLVAREVQRILQRYKDLQDIIAILGMDELSEDDKVLVARARKIEKFLSQPFHVAEVFTGAPGKYVKLADTVRSFKEVISGNYDHLPEQAFYMVGSIDDAIEKAKGYKG

SEQ ID NO: 9948 - protein, 568 aa, Mycoplasma mobile 163K
MILKIKSSNQELALGKIHFLEEEQIEYKKSFQDIKKEKAILENAINKTNESIKLLIKKAKKEFTENEVDILTAHLEIANDITFKDEANKIIEFEKKTAYEAFKIVSDKYIEIFKSMDNEYMKQRSTDILDVASSVLSFIANPEKKVMGEELKESTIIVSKELTSSDILTLNRKYIKGFITTEGGPTSHCAIIAKSLQVPYVFGLSDFPKYFKEGQEVFIDGINETLNTEPNAKDRKVYEDYLDLVKKTSINPKTFTPINKSKDGKKVELAVNIDGVEEIERLKDFKEISTGLFRTEFLFMQMNDWPTEEEQFLVYKNIALNTSRQSEVVIRTLDIGGDKELKYFKQEKEMNPFLGNRSVRFSLNKPNTFITQIRAIYRASAFGNVAILLPFVSNVEELLSLRKIIDQVKKSMIQEKIEFDPEVKIGMMIEIPSSAVLADVFAQYVDFFSVGSNDLIQYTFAVDRVNSAVSNYFQPLNPAIYRLINMAIQGAHRNGKTISVCGEIASNKYALAILVAMGIDKLSMAPESLGMAKYHLNSLDLTRADELSKKVLEAKTQDEVIEIVKTYY

SEQ ID NO: 9949 - protein, 756 aa, Burkholderia vietnamiensis G4
MDEQLKQAALAYHLNPKPGKISVTPTKPLSNQLDLSLAYSPGVAAACEAIHADPLDAQKYTSRGNLVGVVTNGTAVLGLGNIGPLAAKPVMEGKGCLFKKFAGIDVFDIELSESDPDKLVEAIAMLEPTLGGINLEDIKAPECFYIEQKLRERMKIPVFHDDQHGTAIIASAAILNGLKVVGKKLADVKLVCSGAGAAAIACLDLLVKLGLTKTNILVADSKGVIYEGRGNLDPSKQRYAATTDARTLADAIVGADVFLGCSSAGVLKQDMVKTMGDRPLILALANPEPEIRPEDAKAVRPDAIVATGRSDYPNQVNNVLCFPFIFRGALDVGATTITEEMKLACVRAIAELAEETDQSEEVAKAYEGHSLEFGPEYLIPKPFDPRLIIKIAPAVAQAAMDSGVATRPIEDMDAYREQLGTTVYRTGMVMRPVFATAKKKEARIVFAEGEDERVLRAAQFVLLEKIAKPVIIGRPSVVEMRLEKIGSKLKAGVDFEIVNPEDDTRYQRYWQAYHEIGARDGVTPEVAKAALRKFNTLIGAMLVHLGDADGMICGMIDTFHTHLKFIEQVLGRAKGAEHFAAMNLLMLPGRNLFMCDTYVNELPSAEQLADMTIQAAGEIERFGITPKAALLSNSNFGSAPSASSRRMAEARRLINERAPNLEVDGEMHGDAALSEAVRKAAFPGTTLSGEANLLIMPNVEAANIAYNLLKMVGGDGVTVGPFLLGAAKPVHILTPAATVRRIINMTAVAAANANTK

SEQ ID NO: 9950 - protein, 398 aa, Arabidopsis thaliana
MTMMMSDLPNDLVEEILSRVPITSLGAVRSTCKRWNGLSKDRIVCKGDANQQFTGFTRYVNESTVCSMRLDLNEIQNEDVELVELSINKINKFIELELFQVYYSDGLLLLVTDEVDSKIVVWNPYLGQTRLIQCRDTEHFKYRYALGYDNNRNHKILMYNRKNCEIYDFKSDSWKVLDIIPDLHTNIYVRDMSIKGNTYFFYRGEKIGEGLAGCLLSFDFTRERFVSCLPLPFQIAKFDDNVALSSVREEHLVVLFNNWEESEMEIWVTTKIEPNAVSWSNFLTFTHFRIKFLVTSFFIDQEKKLAVVFGRSLSKQMRCNIAYVIGDNGYLRILDFGVTFIPSNLPVSYAPSLVKITQGQELSVIEEKKRSRLLASLVYSTLFVSFIIFFSFISSVFI

SEQ ID NO: 9951 - protein, 454 aa, Pseudomonas putida GB-1
MTSCSAPLSKLKPTLSVADVVAITVSSVTPASSVFVIAPFAIAQAGTGVIWAFMLGGVLALMFALCYAELGRAHSAAGGEYVFAKRVFGGMAGYATFLTVLAMLVFIPPVLATGAATYLNAALGSQLDGQAVALVIVALGYLLGILNIKLNAWVTGICLLLEVAALMVIVVLGFGHAQQPLTSLVSPLVLDNGILHAAPWALVIGAVGTALFSFNGFGGAVLLAEDMKCGGRGIPKAVLWSLVLVVAIEVIPLLALLIGAPSLEAMLGSPDPIGYLLTAHGNETLSRLVSGGIFLSVFNAIIALVIQSGRVIYSSGRDALWMPALNRTFTRIHPKWESPWLATLFLAVPSTALTFSSNLAELTSFTVLLILCVYLVVGLCALFSRVLRRDREHPYRMPLWPLPALAAVTGAGYLLTTLLSAASARDIFIIVGLLLTSMLLYGTYGRLSPAFQKL

SEQ ID NO: 9952 - protein, 172 aa, Bacillus sp. SG-1
MIYEYNGKKPKIAESAYIADYVTITGDVEIGEESSVWFNTVIRGDVAPTIIGSKVNIQDNSVLHQSPNNPLILEDEVTVGHSVILHSCKIRKKALIGMGSTILDNAEIGEGAFIGAGSLVPPGKVIPPNSMAFGRPAKVIRELNEHDISEMKRISREYAEKGQYYKSSEPLK

SEQ ID NO: 9953 - protein, 141 aa, Halomonas sp. #593
MATERTLSIIKPDAVAKNVIGEIESRFEKAGLKIVAAKMLQLSQEQAEGFYAEHKERPFFGDLVGFMTSGPVVVQVLEGENAIAANRDLMGATNPKEAEAGTIRADYAQSIDANAVHGSDSPESAAREIAYFFEESEICSR

SEQ ID NO: 9954 - protein, 470 aa, Anaplasma marginale str. St. Maries
MESCDLIVVGSGPGGYIAAIRAAQLGYRVTVVEKEESLGGVCLNWGCIPTKSLLKSAEIYSKLRKADSFGVEVSGNISVNIAKVVARSREAVSRLGHGVAGLMKKHGVKVHQGFAQVLGGGKVAIQQKGKPLTLAAKHIILATGASARLVPGLDEKMLWTARDAMLPKALPKSLLIIGSGAIGIEFASFYSHMGSKVTVVEMQDRILPLEDKAVSAFMQKVLQAQGIEILTGGSVPSLKKAGPAMQAQIKLGTQKVITLECDKAIAAIGVIPNTHGLGLENTKAALDERGFIVTDDCCRTAEPNLYAIGDVAGPPCLAHKASHEAVMCVEGIAASDGILKDKPHPLGVHNIPSCIYSIPQVASIGLTEEQARAQGLDIKVGVSHANCSGKAIVSGAVDGFVKVIIDSTSGELLGAHMVGEEVTEMINGYVIGKKLEATDLDLLSTIFPHPTLSEMMHEAVLAALGRPLNG

SEQ ID NO: 9955 - protein, 161 aa, Zea mays
MTSSSSPSRKALSKIACNRLQKELAEWQQNPPAGFKHKVSDNLQRWVIEVTGAAGTLYAGEAYQLQVDFPEHYPMEAPQVIFLNPAPMHPHIYSNGHICLDILYDSWSPAMTVSSVCISILSMLSSSPAKQRPVDNDRYVRNCRNGRSPKETRWWFHDDTV

SEQ ID NO: 9956 - protein, 830 aa, Chromobacterium violaceum ATCC 12472
MSHSLTLVCPLPNGIHARPASRIAEFCAGFGAAIRWRNQRNGQLADAKSVLSLIGGDILFNDVVDIEIDGEEAARVAAELGRFLKQTLPLCDEPLAAAPAASRALPRGLAELVPSPCFGQPAGQGVAIGELCVYRGFRLPEPAELPLSTGRDAEIAALEGARRTLAEQLRMQAEREDGEAAAVSRAHLAILRDPDFRDRLDAAVGDGAGAARAVAAAVAHYRAQLARSASAYLREREVDIRDVGRRLLDILAPGMEPAGGDFPPATLLWAEDLAPSELLALDRSRVKGLLLARGGLTSHTIILARAFSLPVLIGVQSAAIAGGVGRTAVLDAGLGALFQNPDERVLDYYRAEEALLAQQRQKLAQACAGGSVSADGQRLELAVNIASAAEAQLGFAQGADGVGLFRTEMLFMEADEPPGEEAQFQCYAEVVRLAAGRPVIIRTFDIGGDKPAPCFPAAQESNPFLGYRAIRMYPDQEAAFRTQLRAILRASALGPVKAMIPMIATLNEARWARRVLEEERAALGLAEAVPMGIMLEVPSVLFQLDAFCREVDFFSVGSNDLTQYLFAADRDNERVGQLYDSLHPAFLAALNQAVATIHRHGRWIGLCGEAAAAPHALPLFLGMGLDELSMSAPSLQPCRRRLRGLDAGRCRELLAQALACADGAEVRALVDSAATRPALPMLTVDCLMPEADWRSKAAVIKGMVDRLWLLERCDDRYGMEEDLWLREQAYSTGLGHGFAIPHAKSGHVLHPTLCLARLERPVDWGASDGQPVDMVLLLAFNAADAGAAHLKFFSRLARLVMHEDFRQALRAERDPERLLALLRDRLEGAA

SEQ ID NO: 9957 - protein, 618 aa, Nostoc punctiforme PCC 73102
MALIVQKYGGTSVGSVERIQAVAQRVYKTVQAGNSLVVVVSAMGKTTDGLVKLANEISPNPNRREMDMLLSTGEQVTIALLSMALQELGQPAISMTGAQVGIVTEAEHSRARILHIDTTRLCRHINAGKVVVVAGFQGTSSTGEMEITTLGRGGSDTSAVAIAAALRANFCEIYTDVPGILTTDPRLVAEAQLMDDITCDEMLELASLGAKVLHPRAVEIARNYGVPLVVRSSWTDQPGTWVTSAKPQGRSLINLEIARPVDAVEFDTDQAKVALLRVPDKPGVAARLFGEISRQKVDVDLIIQSIHEGNSNDIAFTVTTPILKRAEAVAAAIAPALRNPSNPKSDEAEVMLEHNIAKVSIAGAGMIGRPGVAAKMFATLAEAGVNIQMISTSEVKVSCVVDAAECDHAVLALRTAFEIEAGEQGSRGAGESACIDSPPPLCPSAPLPNCPPVRGVALDLNQARLAIRQLPDRPGMAAKLFGLLAQHNISVDMIIQSQRCRVIDGVPRRDIAFTVSRIDAESAKKMLTQVAAELGWGEVVLDSAIAKVSIVGAGMVGQPGVAAKMFEALAQHQINIQMIATSEIKISCVVAQEQGVKALQAIHAAFGLAGSEKVVVPA

SEQ ID NO: 9958 - protein, 275 aa, Anaplasma marginale str. St. Maries
MHLPRALDRTLSHLRNKLGAHPLIGVELEFYVRGVEDKALEELFAAFAEDVRPLNWSIAKETHESQYELQTSYGPDVQDLLANLFSVKKTLQRTAESFGGNLDFAAKPYIERPGSAFHVHVNLVDQNSNNLFSKRNSKMSDALLYSIGGLCTHMRQHMIFFAPHHQSYLRYTHADNNTPTTVSWGGNNRSTAIRLPDTSLAPENTRIEHRVSGADCDYEPAINAILTGLIYGIEGEIEPPQRIFGIASDPQYNLEKLPHSLQEATRLYHSQTSGL

SEQ ID NO: 9959 - protein, 466 aa, Burkholderia xenovorans LB400
MSKTSLIAADRKHLIHPVINYRAHEARGATVLESGQGAYLRDIDGNELLDAFSGLWCVNVGYGQQSIVEAATRQMTKLPYATTYFHFSSEPAIELADKLVALAPASLQHVYFTLGGSDAVDSAIRFITHYFNATGRPSKKQMIALERGYHGSSSVGAGLTALPAFHRNFDLPLPHQHHLPSPYAYRQTHGDDAQALIAASVAALEAKVAALGTDNVAAFFCEPIQGSGGVIVPPVGWLKAMRDACRRLDILFVADEVITGFGRTGPLFACEAEQVEPDLMTVAKGLTSGYAPMGAVLMSDEIYQGIAGDARDTAIVGHGQTYSAHPVSAAIGLEVLRLYQEGGLLANGQAQAPRFAAGLDALLGHPLVGDSRHRGLLGALELVADKDSRARFDPALKLPDRIAAAAYRNRLVFRAFGDSILGFAPALCFGEAEFEQMFGRLKRTLDEVLDETEVRAALRTAGRAAA

SEQ ID NO: 9960 - protein, 560 aa, Cryptococcus neoformans var. neoformans JEC21
MTTAEILHLLSSLQTNNYQGIHQKSMSAKVPITVFNSLQEIYPSASAVLREGQRWNTLLTRFQERFGETPTYIVRAPGRVNVLGEHIDYSLFPVLPAAIEQDILFALRPTRPVAGSNPTVRLENYDKKYSYPGCSFSLVPGENGWDVGLNAGGGWDKYVRAALLECLDELFPVGKGGGKQEAVGMDVLVSGSIPPGSGLSSSAAMVVGSVIMFLVANNLAAGKTKEDVVQLAINSEHRMGLRTGGMDQSVSALALPNNLLHLSFHPGLLPAPLPLPGNVSLVITNSLAPHSLTDSAPEEYNLRVIEILIATRLILHHWKLESQFYRNPRPWLREVLGAWVGEKGHMGWEKEGEVTKKALGDIEWIKRDGGWTREEMIKYSGMDEEEFKKSYLDFLEIRAEKFHLYERLHHTLTESLRVHKFVHLCQSISTSNPLPPSSDTPLPTANDILSQLGKLFDASHASMRDTYDCTHPLVDSLQELCLKSGAIGSRMTGGGWGGSVVSLVESSQVPEFLEKVRKGYEKYGDLEDEEWVEVGFATMPGHGAGVYVVENGIRVENGAA

SEQ ID NO: 9961 - protein, 349 aa, Physcomitrella patens subsp. patens
MGIYLSTPKTEKISEDGENAELRFGLSAMQGWRESMEDAHTAILDVDEKTSTSIFGVFDGHGGKVVSKFCAKYLHREVIKCDAYAKGDLGGSLEHSFLRMDEMMKGARGYRELMLLEEKSGKAGNSHGSANDESDRFNSAIQTEGNDGNWTEVGPNSDYKGPSSGSTAVVALIRGRNLIVANAGDSRCIISRRGQAENLSVDHKPELELEKERINKAGGFIHAGRVNGSLNLTRAIGDMEFKYQTDLPPDKQIVTCCPDIRQVDIGPGDEFIVLACDGIWDVMSSQAVVDFVIQKLPTAKTLSSICEDILDHCLSPSTRQQEGCDNMSIIIVQLKQSGGVASGSADPSL

SEQ ID NO: 9962 - protein, 243 aa, Oryza sativa Indica Group
MALGASSAAFVFGVAPTRARRRRWLEEEEWISDLCRVDAILSRDIHGCFGRAYLFNHECSVDWPWCSGMEIAVGARNFGGLDCLEFGERRVNISLGPNEGCKGEEVTLMDWGNAIIKEIKMENGVITELIGELHLEGSVKTTKLKVTWLPDIDDLVPLSLVEFDYLISKKKLEEDENFLDNLNPCTRKETLALGDANMRNLLRGEVIQLERKGYYRCDAPFVRSSKPVVLFAIPDGRQQASLN

SEQ ID NO: 9963 - protein, 560 aa, Bacillus thuringiensis serovar konkukian str. 97-27
MKFSSKQRKDVLNGVNKQELDVIVIGGGITGSGIALDGATRGLSTIVFEMQDFAAGTSSRSTKLVHGGLRYLKQLEVKMVAEVGKERAIVYENGPHVTTPEWMLLPFHTGGTFGSFSTSIGLRVYDFLAGVKRSERRKMFNREETLKKEPLVKQEGLKGGGYYVEYRTDDARLTIEVMKEAIEHGAKAVNYAKVDGFLYKDGKVCGVRVIDLLDGEVYEVYGKKIVNAAGPWVDTLREKDNSKKGKVLQLSKGVHLVIDQKRFPLGQAIYFDTPDKRMVFAIPRGGKTYVGTTDTFYDKDAAVPQMTTEDRTYIINAINYMFPSVKITEKDIESSWAGVRPLIYEEGKSASEISRKDEIWTSESGLITIAGGKLTGYRKMAEMVVDYVTNLLQKEGHSAYPKSSTKHMPISGGHVDGSKGLPAFIAKKAGEGTKYGLTTAQAEEFAKFYGSNVDVLFDLAKKHKDEAKEYNMPLDVLIPLVYAMDYEMTAKPVDFFVRRRGAVFFNIHWVYEWKEAVINYMAAKLGWSKEEQMKYTAELEKALRDAVIPVDQQEQAAALA

SEQ ID NO: 9964 - protein, 268 aa, Myxococcus xanthus DK 1622
MSHLPPARNAATRHPGVKPLGWGRGRRVRCRADMPPASLRKTLALVTCLLAGSVLAADSGKWTRKAAAGKDLYATLQTSEGTIVVRLFAKDAPKTVANFVGLAAGEKAWRDPKTGKMSKEPLYDGTVFHRVIPGFMIQGGDPTGTGFGDPGYRFADEFQSGRTFDKVGLLAMANAGPNTNGSQFFITTSTPGHLAGKHTIFGEVLSGYDVVEKISNRPRDNRDRPRTAVVLTRVVLGDKAPAGVTAPAASKGAAPKKDAGAKTVSPRP

SEQ ID NO: 9965 - protein, 284 aa, Oryza sativa Japonica Group
MAAAAAAATIGMMDSAYFVGRGEILSWINATLQLSLAKVEEAASGGGAVPVDGYGSPWGGANAQGALGGSDALLSWGLQVNFDAKTEYDMIQNYKILQDVFNKLRLSKNIEVNKLVKGRPLDNLEFLQWLKRYCDSVNGGIMNENYNPVERRSKGCKERSLKGSNKSSKSLQANRLSSANSADGGPCVGKVNVISEEHYIEQIQQLSEKIAGLKISMDSAEKERDFYFSKLRDIEILCQRPELEHLPMTKAVQKILYAADARDSPLPEANEIITRSPSMFPDEA

SEQ ID NO: 9966 - protein, 1806 aa, marine gamma proteobacterium HTCC2080
MTVGVAWEQIGSQAGEDALRRLINESPQDFFGDVARRNIHWFDAQAKQWVNFDLAAQCWAGFAANTGEFVTSGALAQDESPWSSVLDESQAPYLRWFVGAQTNASFNEIDRHVLQGRGANKALIFEGDRWDPSKNGGRGGPVTEQQFSYRGLLLEVVVRARVLTNLGLKTGDRIALNMPNIPEQIFYILAAQRLGIIYTPVFGGFSAKTLSDRLHDAGAKVVITADGGYRNAEAVPFKSQYTDPALDNYVPREAALKALSDTLNDYPDMADSQGLLDAVTHALAGEITLERADIMRELGGILAEMPNITPEVSAKLRTEVAIALSQVGHDISKVVVARYTGQEVIEYDRDAYSDDLVATAKQEFLAELKAKDMAYFDTLSDTDFQATLYRLEAVVPVEANWPLFIIYTSGSTGKPKGVVHTHGAWLAGVTHSMHAVFEGTPDDVMYVVGDPGWITGQSYLIAAPLSMGMTTVVCEGSPLFPHAGRFAATIERYGITLFKAGSTFLKAVMTDPASTRDMAAFDMSSLRAGTFCAEPVSPAVQQFAMENICSHYINSYWATEHGGIVFSCHSGGYKDLQPDAKTWALPWIQAQVRVAESTGADGVSQWREAEVGEKGELVITSPYPYLAHTLWGDKEHFGSENWCGDVERFKAVYFDRWSEGYSYTQGDYARRHEDGGFTLHGRSDDVINVSGHRIGTEEIEGAILRDKTLREDSPLGNVVVVGAPHDEKGETPVAFLVAAPGRKLNDDDFSRLQGLVRSEKGATAVPSDFLVVPAFPETRSGKYMRRTLRGLLLDAPLGDISTLKNPEVVDVIRDAISQWRDHGALAQARQIVQTWRYIRLEIHRLTDSHTVALLAITNPPVNALNERALDELHTVIHQIKHQSDIDALVVTGARGTFVAGADVKELLKIGEVGDTASALTPPHAAQAAFAAIESLDMPVIAAINGPALGGGNELLLSCAYVIAADQATFGQPEVNLNLLPGYGGTQRLTRKLQDRQGDEGVANALGIMLRGRPIDSEWAQRIGLVDEVVPVGSESALNRAMSRLREHFAGNSQISGVLDRHKALLAQREDALLPSNNIKEHPEVTAALEQLAAGGREHVAQRILEATFTGLEQGVTAGLDAEARLFAESVCDPASGPTGITAFLEKRSSPLPCQPKTVPPYPGEEQLDELESSGNLLPVGASFFPGVTPIPSHQYGWGVARSSLDGAPEHGDPKVAERKLVFPTPEPKAAEALIYILASEVNFNDIWAITGIPVSPFDARESDVQVTGSGGVGIVVSLGAELVSEGRLSVGDLVTVYSGQSELMSPDQGLDPMAADFRIQGYERNDGCHGQFLAVQGPQLHPKLSSLTFEEAGSYGLTMGTIQRALFTTLNIETGRRLFVEGASTGTGYDCLRSATASGLSCLGMVSSDQRATRVTAAGGSPINRKDSRWQDIFTAVPDDPKEWQAWHEAGLPFVAAAEDAVGGNIDYAVSHAGENAFPRTFQLLGNNGVLAFYGASSGYRFTFLGKPGASSPATMFRRAGLRPGQTILIVYGPGADDGIVDNVAIEAIEVACQNGGQVAVLVDTIAQREFVSSLGFGPRVRGVVSIEEIAKRLGNDFMPPGPFPGMPDPFTESLAFREAVREFSDKTLKPIGSAIAPALRNTLDKRGLPDIVFERRGRDGLALASALVKPNTGRVVYAEDLEGQCFSFYAPQVWTRQRRILMPTAEIRGTHLNTSREFAEMQEQIASGLLAVLPPTPVTMDELPEAHQAMWENRHQGANYVAVHALPREGLKTKDELYRAWALRDAAERGEQITQVETGSAGALR

SEQ ID NO: 9967 - protein, 713 aa, Oryza sativa Indica Group
MEAKLSFSQDSPPISIISAAKVAGVSLSIDPSLAAGSAPVLCFSSGESLRGINPILEYIAQSSPSLHGRDAVESGHVVEWLEYAPTFLLGSEFEVACSFVDGYLMSRTFLVGHVLTIADITVWSNLAGIGQRWESLRKSKKYQNLVRWFNGIDSDYKDTLNEVIAAYVGKRGIGKSPAPNLKEKVNDSKDPSAPEVDLPGAKFGEVCVRFAPEPSGYLHIGHAKAALLNKYFAERYQGRLIVRFDDTNPSKESNEFVENLLKDIETLGIKYDAVTYTSDYFPKLMEMAEKLIKQGKAYVDDTPKEQMRSERMDGVESKCRNNTVEENLSLWKEMINGSERGMQCCVRGKLDMQDPNKSLRDPVYYRCNTDPHHRIGSKYKVYPTYDFACPFVDALEGVTHALRSSEYHDRNAQYYRILQDMGMRRVEIYEFSRLNMVYTLLSKRKLLWFVQNKKVEDWTDPRFPTVQGIVRRGLKVEALIQFILQQGASKNLNLMEWDKLWTINKKIIDPVCARHTAVLKDQRVIFRLTNGPEKSFVRILPRHKKFDGAGKKATTFTNRIWLDYADASAISKGEEVTLMDWGNAIIKEIKMENGVITELIGELHLEGSVKTTKLKVTWLPDIDDLVPLSLVEFDYLISKKKLEEDENFLDNLNPCTRKETLALGDANMRNLLRGEVIQLERKGYYRCDAPFVRSSKPVVLFAIPDGRQQASLN

SEQ ID NO: 9968 - protein, 597 aa, Pseudomonas putida KT2440
MLNALPRPFPAVSEYLPLDASTINSLFLIGALLVGASILVSSLSSRLGIPILVIILAVGMLAGVDGGGIIFNNYPTAYLVGNLALAVILLDGGLRTRVASFRVALWPALSLATVGVMITTALTGLIAAWLFNLSLIQGLLIGAIVGSTDAAAVFSLLGGKGLNERVSATLEIESGSNDPMAVFLTVTLIDMIASGETGLHWSLLGHLLREFGIGTLLGLGGGWLMLQLVNRINLAGGLYPILVVAGGLVMFSLTNALHGSGFLAVYLCGLVLGNKPIRSRHGILHMLDGMAWLAQIGMFLVLGLLVTPHDLLPIALPALGLALWMILVARPLSVVAALLPFKAFHGREKGFISWVGLRGAVPIILAVFPLMAGLPDAQLFFNLAFFIVLVSLLVQGTSLPWVAKLLKVTVPPDPAPISRSALEVHITSEWEMFVYRLGAEKWCIGAALRELKMPEGTRIAALFRGEQLLHPSGSTVLEVGDMLCVIGHEHNLPALGKLFSQAPQRGLDLRFFGDFVLEGDAELGAVAALYGLKLDGLDAKMPLAQFIRQKVGGAPVVGDQVEWHGTIWTVATMDGNKIQKVGVRFPEGTRPGPGLFL

SEQ ID NO: 9969 - protein, 512 aa, Mycobacterium tuberculosis H37Rv
MPILATNVVCTSQPLAAQAGLRMLADGGNAVDAAVATAITLTVVEPVSNGIGSDAFSIVWDGQKLHGLNASGRSPSAWTPEYFGGNAVPVLGWNSVTVPGAVSAWVELHARFGRLPFETLFEPAISYGRNGFLVSPTVAAQWAAQVPLFASQPGFADAFMPGGRAPKPGELFTFPDHAATLEKIAATNGEEFYRGELAAKLEAHSAANGGVMRADDLAAHRVDWVDTITGTYRGYTIHQIPPNGQGIVALIALGILEHFDMSSWSVDSAESVHVQIEALKLAFADAQACVADIDYMPVHPKRLLDKEYLRQRATLIDPKRAMPAATGIPRGGTVYLAAADAAGMMVSMIQSNYLGFGSGVVVPGTGISLHNRGSDFTVVPRHPNRVGPRKRPYHTIIPGFVTRDGAPVMSFGVMGGMMQPQGHVQVLVRIADYGQNPQAACDGPRFRWVNGMRVSFENGFPDSTLDELRQRGHDLVAVADYSQFGSCQAIWRLDDGYLAASDPRRDGQAAAC

SEQ ID NO: 9970 - protein, 642 aa, Nicotiana tabacum
MFSLNGSSFTNNSLSGVSRCLTQSSRRGVSGPMVVVAAVNSNGKPGDRNVSVLVENSMKESAAAPVEKEIKSTVTGGVGDVYGEDSATEDQSITPWTLSVASGYSLLRNPHYNKGLAFSEKERDSHYLRGLLPPVVVNHDLQVKKMMNNLRQYEVPLQRYITMMDIQEMNERPYYKLLMDNVEELLPIVYTPTVGEACRKYGSILRRPQGLFISLKEKGKINEVLKNWPERKIQVIVVTDGERILGLGDLGCQGMGIPVGKLSLYTALGGIRPSACLPITIDVGTNNEDLLNDEFYIGLRQRRARGQEYAELFDEFMYAVKQNYGEKVLIQFEDFANHNAFDLLAKYGTSHLVFNDDIQGTASVVLAGLMAALQLVGGTLSEHTFLFLGAGEAGTGIAELIALEMSKQTGIPLEETRKKIWMLDSKGLIVNSRMESLQHFKRPWAHDHEPVKDLVNAVKSIKPTVLIGSSGAGRTFTKEVVQAMATFNEKPIIFALSNPTSQSECTAEEAYSWSEGRAIFASGSPFAPVEYNGKIYASGQANNAYIFPGFGLGLIISGAIRVHDDMLLAASEALAEQVSQENFEKGLIYPPFTNIRKISANIAAKVAAKAYELGLATRLPEPANLVAYAESCMYRPAYRSYR

SEQ ID NO: 9971 - protein, 440 aa, Pseudomonas putida GB-1
MATLKRTLSLGSVVLFGIAYMTPIIVLGTFGILADTTAGMVPAAYLAAAIAMLFTALSYGNMARAFPVAGSAYTYVRKSISPQLGFITGWAVLLDYLFLPMAIWLIGAAYLHSAFPSVPQAIWVLAFIAVTTTINVIGLRLAKTVNGLLMLIQLLVLAAFVALAVHYVWGDPTVPLWTLEPFYKEGAQLPLIMSGAAIACYSFLGFDAVSTLTEETKEPRKNIPRAILLITLIGGGLFIACSYFVQLAHPSTDFINADAAAYEIAQNIGGDLFVSVFLLGLIVGQFTSGLSAQASASRLLYAMGRDGVLPKSFFGKLSERFSTPVPSIILCGVVALLALRMDVTTSTSFINFGAFLAFSLVNLAVIFHYWLAMGQRGGTAVLLYLAFPLVGLVSNVWLMASLDHLAIYLGLGWLCLGMLYLTAITRGFSKQPPEMHFEEA

SEQ ID NO: 9972 - protein, 362 aa, Burkholderia vietnamiensis G4
MATPQFHPLRIRDVRPETADAVTVSFDVPPELRDAYRFTQGQFVTLKTHIDGEETRRSYSICVGTTDYDRDGELRIGIKRVRGGRFSNFAFDTLKPGHTIDVMTPDGRFFTHLNADHGKQYVAFSGGSGITPVLAIVKTTLELEPRSTFTLIYGNRSVDAIMFAEELEDLKNRFMNRFVLYHVLSDDQQDVELFNGVLDQAKCAQFLATLMPADAIDEAFICGPAPMMDAAEAALKAAGVSPEKVHVERFGTPLPQAGAPVVEITEQTPAADLEIVLDGKKRKLRLPYEGVSLLDVGLRAGLALPYACKGGVCCTCRAKVVEGEVRMDKNYTLDEREVKDGFVLTCQCHPVSDKVVVSFDER

SEQ ID NO: 9973 - protein, 297 aa, Nicotiana tabacum
MVEKPKSGGVWPTVKPFVNGGASGMLATCVIQPIDMIKVRIQLGQGSAVDVTKTMLKNEGFGAFYKGLSAGLLRQATYTTARLGSFRILTNKAIEANEGKPLPLYQKALCGLTAGAIGACFGSPADLALIRMQADATLPLAQRRHYTNAFHALSRIVADEGVLALWKGAGPTVVRAMALNMGMLASYDQSVEFCRDNLGMSEAATVVGASSVSGFFAAACSLPFDYVKTQIQKMQPDAEGKLPYSGSFDCAMKTLKAGGPFKFYTGFPVYCVRIAPHVMMTWIFLNQIQKAEKKLGL

SEQ ID NO: 9974 - protein, 281 aa, Euglena gracilis
MDLDYEGQAPTTSLLLLFPPHLVPEYIGTISNNLRSAEVNHRPSKTFLEEVQVDITRLMRAILVDWMNEVTEEFRLKMETLCLAVNYVDRYLSRVPVPRHQLQLVGVASLLIASKMEEIMHPQIDEFVYITDSTYNREQVLRMELSILNALRYDMTVVTPRDFVGIYLKVAQASPEVCMLADYLLELILQEYAFLHWEPSMIAASAVVLALFGFRLPCWSDDLRRITQYQPNELNACLKEMHRVFQNAPHNNLQAVREKYSHGRFMHISMVAQLPPSPPVF

SEQ ID NO: 9975 - protein, 388 aa, Anaplasma marginale str. St. Maries
MNVHEFQAKGVLSSFGVTVPRGVVVESVEEVDRLLGDLAPGLVAVKAQIHAGGRGKAGGVKIGKTKDEVKSLVKQMLHSVLITHQTSPEGQKVNKVYLEEGVDIGKEYYISAVVDRSVGRVSIIFSSEGGVDIETVAKERPNMVSVVHVDPLYGFRSFHGQELCRRFGLGPKQVSGVVSMARKIYKVLVETDASQVEINPMAETSSGEFLALDAKIAFDDNGLYRNPEIAKLQDPDEYAAEELEAAKHGLSYIKMDGNIGCMVNGAGLAMATMDIIKYYGGEPANFLDVGGGANQEAVREAFKIILQSGVKGILVNIFGGIMRCDVIAKGIIESTKEIGVDVPLVVRLSGTNFEIGRKLLDDSGLGITAAADLDEAASFIVKMVNERR

SEQ ID NO: 9976 - protein, 522 aa, Ostreococcus tauri
MLLAQFSTQRCGFLKTHGQVALRLATNTKKAFSTRSVNTNAMVRKTYQLNFSKLTAVSGGGSGGVRASRLASTAGAKVGLCEMPYDPVSSEQTGGLGGTCVIRGCVPKKLFVFGSEFSAQFEDATGFGWDIASSKFDWQRLLNAKMQEIQRLNGIYKKLLHGSGVTTFEGAGKLIDEHTVEISGKKSTERITARDILIATGGRAHVPDIPGAHLGITSDEALSLLELPEKILIIGSGYIAVEFAGIFAGLDVTVDLVYRQPLPLRGFDDDLRRTVKTNLQSRGITQHADCQVFSLSKDDTGRLAVETTTGVLKTDVVLFATGRVPNTSRPSLGLDTVGVDISVTGAIKVDEYSRTNVSNIWAVGDVTNRVNLTPVALMEGMAFVDTVVKGVPTKPEYDNIPCAVFSQPPVASVGLSEQDAIARGHKCDIYTSAFTPMKYSLSGRNEKALMKLVVETYSQRVLGVHMVGPDAAEIMQGFATALKCGATKQQFDQTVGIHPSSAEEFVTMRTMTRQVGGDAQRD

SEQ ID NO: 9977 - protein, 589 aa, Clostridium tetani E88
MNFKKTIAILIIRIAMVFKICKKRGVYMIKEIKLEKLFPGSKEGKVGKIHKSIGDGIKSGEVLVEVEGKKGNIPIKAKEEGKIHSIEIEEGTTVKIGDVLLKIEIEEVTLDEFVIDKDEFAKKSELKSLECDVAILGAGPGGYVAAIQAAKLGAKVVIVEKDKVGGTCLNRGCIPTKAFVRSSEVYSNVKNSEKYGISLENPSIDIKKVVARKDNIVDKLVGGIQYLIQKHNIELISGNGKLIDRNTIETKDALIKAKNIVIASGSKASVLPIKGSNLKQVITSEEALDLKEVPEKIAIIGGGVIGMEFAFIYANMGVEVSVIEYFDNILSMLDEDVIKEITDIGKEKGIKFYTSSKVEEILEDENEGCIVKFTNKGEEKFIFCDKVLMSVGRQPYMENMGVEELGIELNQNKRGIKVNTKMETSVSNIYAIGDVTNVIQLAHVASHQGIVAVKNIMGKDIQIDYSAVPSVIFTEPEIAVVGVCEKIAKENNLDVEVGKFPFSANGKALTLGEDRGFIKVIKEKATGKVVGASIIGAHASDLIAELTLAVKNGLTSEQIAETIHAHPTTAEVVHEASLAVEGGALHFAE

SEQ ID NO: 9978 - protein, 386 aa, Myxococcus xanthus DK 1622
MKIHEYQGKEIFRKYGVPTPKGILAVSANDAEAAAKELGTSVVVVKAQIHAGGRGKGGGVKLAKSPAEAKELAKQMLGMKLKTIQTGPEGQTVHKVYIEEGLAIGQELYLGVTLDRATSRITFMASREGGVEIEEVAEKHPEKILRESVDPAVGFQDFQGRKLAFGLGLTGPTVNKFTQFCSALYRMFMDTDASLVEINPLVILKDGGVVALDAKVTFDENALYRHKDLLEYRDLAEEEPREIQAKEWDLAYIALDGNIGCMVNGAGLAMATMDTIKLVGGSPANFLDVGGGANKEKVTAAFKLILADPAVKAVLVNIFGGIMKCDVIAEGIIAAAKEVQLKVPLVVRLEGTNVEKGKELLSNSGLAITPADNLRQAAEKAVAAVK

SEQ ID NO: 9979 - protein, 533 aa, Pleurotus ostreatus
MFPGARILATLTLALHLLHGTHAAIGPTGNMYIVNEDVSPDGFARSAVVARSVPATDPTPATVSIPGVLVQGNKGDNFQLNVVNQLSDTTMLKTTSIHWHGFFQAGSSWADGPAFVTQCPVASGDSFLYNFNVPDQAGTFWYHSHLSTQYCDGLRGPFVVYDSSDPHLSLYDIDNADTVITLEDWYHIVAPQNAAIPTPDSTLINGKGRYAGGPTSPLSVINVESNKRYRFRLVSMSCDPNFTFSIDGHSLLVIEADAVNIVPITVDSIQIFAGQRYSFVLTADQTVGNYWIRANPNLGSTGFDGGINSAILRYAGATEDDPTTTSSTSTPLLETNLVPLENPGAPGPTVPGGADININLAMAFDFTTFELTINGVPFIPPTAPVLLQILSGASSAASLLPSGSIYALEPNKVVEISMPALAVGGPHPFHLHGHTFDVIRSAGSTTYNFDTPARRDVVNTGTGANDNVTIRFVTDNPGPWFLHCHIDWHLEIGLAVVFAEDVTSISAPPAAWDDLCPIYDALSDNDKGGIVPS

SEQ ID NO: 9980 - protein, 275 aa, Ostreococcus tauri
MRMNASNLRTRDVWAHNLDEECTLIREIVSAYPFVAMDTEFPGIVARPVGSFKHQSEFQYQTLRCNVDMLKLIQLGLTFTDADGNLPLIDGYHCIWQFNFREFSLKDELYAQDSIELLKHSGIDFNTLEERGIDVVQFGESLMVSGVVLNEDIRWLTFHSGYDFGYLLKLLVNAPLPENETEFFELLRCYFPYIIDIKHLVQCVGNMHGGLSKLAEHLSVARIGPQHQAGSDSLLTAHTFFKLQKTHFMNVDLNQFVGTLYGLGQDRELMSSSQV

SEQ ID NO: 9981 - protein, 362 aa, Burkholderia xenovorans LB400
MTRKYRIAVIPGDGIGNEVMPEGLRVLDAACRRFDIGIEYRQIGWASCDYYAQHGQMMPDNWKEQLQDCDAILFGAVGWPEKVPDHISLWGSLLKFRREFDQYVNLRPARLFEGVPCPLANRKPGDIDFMIVRENTEGEYSSVGGTMFEGTEREVVMQQSIFTRHGTERVMKFAFDLAQRRAKKITVATKSNGIAISMPWWDARADEMAARYPDVKMDRQHIDILCARVVLNPDRFDVVVASNLFGDILSDLGPACTGTIGIAPSGNLNPDRRFPSLFEPVHGSAPDIAGKGIANPVATIWSTAMMLEFLGNGARVERDAHDAIVAAITEVLKDGPHTGDLGGRASTTEVGAAIAARVAQAG

SEQ ID NO: 9982 - protein, 362 aa, Arabidopsis thaliana
MANNGPNWDGLLKWSLSHSDGASSSSRISEEDRQWFVEAMQAHTIDSISRMKVISQIMKMPEQVLEAQGVTPDDLEGMLAELQEHVESIDLANDLHSIGGLVPLLSYLKNSNAKIRAKSADVLTTVVQNNPRSQLVMEANGFEPLLTNFIADPDIRVRTKALGAISSLIRNNQPGITAFRLANGYAGLRDALVSDTVRFQRKALNLLHYLLQESNSDCKIVRDLGFPRIMIHLASNQDFEVREFALRGLLELAREESVRNLDRGDVNLRQLLEERTRRIIVMSDEDLCAAREERQLVDSLWTVCYDEPSLLRERGLVYLPSDDELAPDVVRDRFEPPLRAWAARRHDETSESPVPLLLGPAP

SEQ ID NO: 9983 - protein, 492 aa, Burkholderia xenovorans LB400
MSTNLEQLARALIRTDNFINGQWIAAASGRRFAVTDPATGNLIADVADSGPADARAATDAAAKALPAWRALLASERAAILHRWHALIVANRDALGALISLEQGKPLTEGRGEVGYGASYVAWFADEATRIYGDLIPQQQRGKRMSAVKEPIGVVAAITPWNFPLAMIARKIAPALAAGCTVVAKPAEDTPLTAIALVMLAHEAGVPDGVLNLISASRAAAAETVGDWLADSRVRKITFTGSTPVGKHLARESAGTLKKLSLELGGNAPFIVFDDADLDAAVNGLLAAKFRNGGQTCVCPNRVYVQHGVYEHFAALLRARVAELRVGPASDPTSQIGPMINVRAVDKIARHVDDAVEHGAVVLTGGRRLTELGPHYYAPTVLGNASASMALCGEETFGPVVPLFPFDTEQDAVQAANDTPFGLASYFYSENMRRIERVSRALEAGIVGINEGALASEAAPFGGVKESGYGREGSKYGLDDYLSIKYLCQGGLQ

SEQ ID NO: 9984 - protein, 239 aa, Ustilago hordei
MAFGGVALPGPGNSANNATSIKGNANAGALTKANGASEDDKKPAALGKDASLEQGLSSVHGIVPTLQNIVATVNLEVRLDLKTIALHARNAEYNPKRFAAVIMRIREPKTTALIFASGKMVVTGAKSEDDSRLASRKYARIIQKLGFEAKFSEFKIQNIVGSCDVRFPIRLEGLAYSHGVYSSYEPELFPGLIYRMVKPKVVLLIFVSGKIVLTGAKVREEIYQAFNLILPVLAEFRKP

SEQ ID NO: 9985 - protein, 255 aa, Escherichia coli
MRHPLVMGNWKLNGSRHMVHELVSNLRKELAGVAGCAVAIAPPEMYIDMAKREAEGSHIMLGAQNVNLNLSGAFTGETSAAMLKDIGAQYIIIGHSERRTYHKESDELIAKKFAVLKEQGLTPVLCIGETEAENEAGKTEEVCARQIDAVLKTQGAAAFEGAVIAYEPVWAIGTGKSATPAQAQAVHKFIRDHIAKVDANIAEQVIIQYGGSVNASNAAELFAQPDIDGALVGGASLKADAFAVIVKAAEAAKQA

SEQ ID NO: 9986 - protein, 580 aa, Cryptococcus neoformans var. neoformans JEC21
MTSPYIPLPAAPLPLSEDPSSMELSSSADDDEGHGRPRLGRSATINSLGDFEFEHALLPLTLSGDADVDSHKEERHVELWHGVALVVGAQVGSGIFSSPGVVVQEVGSVGASLMVWVISGVLAWTGASSYAELGCAIPLSGGSQAYLAYAFGPITSYLFTWTAVSALKPGSAAMIALIFGEYVNRLISHSLGDSEVPAWSIEVTAVFAIFLCSILNAISPTMGTNSTVVLTVIKIGALVFVAVLGAIVLLRDGPGEGLMPSGLFKGTLADAGNYAIAIYSGLWAFDGWDACCYVAGEMRDTNRDLPRALHSSMAIVVVLFLGANLSYFIVLSPSVVASSNTVALDFGKVTIGKFGAVVFSTLVAISCFGALNGGLYTTARLIYAASKEHFLPSIFSRLHPQRRTPDNAILLQGGLAIFFVIFGGGFRALLNFFSVASWTFYLLTVLGLLVLRVKEPHLDRPYRAWLVTPIVFCAVSMFLLLMPIFAAPWEAFAAFVFIASGMPVYYLTVRSRTRNAELDGASSSGWGVRVTLSDAWIKFREDIDRLLPREWQQPYRPQPHYNSDRRRGMLGEQVEMSERR

SEQ ID NO: 9987 - protein, 267 aa, Zea mays
MSQHNILEALNVRVVGTGDRILVLAHGFGTDQSAWHLILPYFTQTYRVVLYDLVCAGSVNPDYFDFNRYTTLDPYVDDLLSIIDSLGIQTCAYVGHSVSAMIGIIASIRRPELFTKLILIGASPRFLNDEDYHGGFEEGEIEKVFSAIEANYEAWVQGYAPLAVGADVPEAVREFSRTLFNMRPDISLFVSRTVFNSDLRGVLGLVRVPSCVIQTAKDVSVPASVAEYLRAHLGGDTTVETLKTEGHLPHLSAPAQLAQFLRRALPR

SEQ ID NO: 9988 - protein, 77 aa, Brassica napus
  misc_feature (28)..(28): Xaa can be any naturally occurring amino acid
  misc_feature (33)..(35): Xaa can be any naturally occurring amino acid
  misc_feature (41)..(42): Xaa can be any naturally occurring amino acid
  misc_feature (47)..(47): Xaa can be any naturally occurring amino acid
  misc_feature (49)..(49): Xaa can be any naturally occurring amino acid
  misc_feature (56)..(57): Xaa can be any naturally occurring amino acid
  misc_feature (59)..(59): Xaa can be any naturally occurring amino acid
  misc_feature (61)..(61): Xaa can be any naturally occurring amino acid
  misc_feature (66)..(66): Xaa can be any naturally occurring amino acid
  misc_feature (69)..(69): Xaa can be any naturally occurring amino acid
MAENGSLDQFLAAAVDAAQKAGQVIRKXFYETXXXEQKGQXXLLTEXTXKGCEELXXNXLXQLFPXNKXIGITNCQW

SEQ ID NO: 9989 - protein, 473 aa, Burkholderia thailandensis E264
MDLEEGIKRLYPYATEFGAMHGFPEHGLSRERLLDELRSMAVREDRKWESGRCSGTMYCGDHEHYAFLNEAYGLFSHVNALQRDLCPSMSRMESEIVGMTVAMLHGEAVAGHGGAHRACGVLSLGGTESILNATLAYREKARAERGIDRPRMIWPASAHPAFRKAAHLFGFDVTVAPVDPDTMQVDADFVRDAIDANTVMLVGSACNYPYGTVDPIEALSEIAVEKEVWLHVDGCLGGWMLPWGEELGYPNIPAFDFRLPGVTSISADTHKFGYGPKGGSVLAWRDASFRRYQYFLMTDWVGGVYGSPGLAGSRSGGLIAATWAALRGLGREGYRARARAIFDTAFDMQAAVRAIPELRVLGKPTFCFAFASDAFDIYHVNDFMRRQGWRFNGLQHPDALHMCVTGPQTQPGVAKRFRQDLGAAVDYARRHTHARAQSSGVYGGDSAGLDLRDDAQARAFFTQVLDLFTDCPL

SEQ ID NO: 9990 - protein, 308 aa, Ustilago hordei
MPGYTLAVIGCGTMGVAILSGVLDSQRSQQAQAAASMASSVSSLHDSSAGDDLTELPNRYIATVNRVESVRRLNKTFAQYPDIEIHAGKNVQAARDADVILLGCKPQMVQDIIAEEGMKEALDGKLVISICAGLRISQITEWVTPKTKVVRAMPNTPCKIREGMTILTPLSPNLPNAELDRSILLSIFSAVGKSRFLDEKHFDACTALAGSGPAFACVFLEAMADGGVMMGLPRTEALELAAQTMQGAARMVMQSGMHPAAIKDSVTTPGGCTIAGLLNLEDGKVRSTVARTIQAAAEHASGLGQTKK

SEQ ID NO: 9991 - protein, 330 aa, Arabidopsis thaliana
MDAFRRQASKLRDQVAKQQLAVIKQFSGTGYESSDVMVIDELEMQRHHQLDKLYRSTRSAKEFQRDIVKAAEAFTTIGLRHIEAGTKLSEDCCRYGNENSQNIDENILAKAAAIYGDARKHVDKEQEDFNKLLASQVLDPLRAMVAGSPLEDARHLAQRYSRMRQEAETHATEVSRRQARVREAPIPENVAKLQLAEAKMQELKANMAVLGKEATAALAAVESQQHRLTFQRLVAMMVTEKQHKESAPPAIPTENGSEKTSYFLAEVIHPFSAASEKELDLDKGDYIVVRKVSQTGWAEGECKGKAGWFPMAYIEKRQRLPTTNFAAEVY

SEQ ID NO: 9992 - protein, 967 aa, Magnaporthe grisea 70-15
MAWEHLSITKPHLVYIILGGFTSLFMLCSSVIKERMYIGEATVATLCGLIFGPHAANLINPQSWGNVDIVTIEFSRIVLVVQCFAVGVELPKFYMERHWKSVIFLLVPVMTAGWLITSLVIWWMINPLSWLESLVIAACVTATDPVLASSVVGKGKFAKRVPKHLRDLLSAESGCNDGMAFPFVYLALYLIQDHMDAKEVTFHWFVFTILYECVFGAVYGFMIGYLARHGIKYAEKHDLIDRESFLVFYFVLALFCAGSGSILGIDDLLVGFAAGVGFSNDGWFGQKTEEAHVSNVIDLLLNLTYFVYFGTIIPWEMFNNAELGLDAWRLVVIAIFILLFRRIPIMMALKPLIPDIKTWREALFAGHFGPIGVGAIFVAILARAELESETPVPLSELPPADSPHFTLITLVWPIVAFLVVTSIIVHGSSVAVFTLGKHINTLTLTMSYTTAPEDGPSWMNRLPRITSQSRSQARTMSDTESDEPKMPEYPPGTLPPIGFPGNFLRRVRDDEKDDSVRQSRRASSTGRKRRSSRKRWDDGIGPGGPISESAIFPRRTESDTANAPETHGNSKALPSDNNSSDQTQVGGQSGGQSENDSQKTETRPGSGHGGQENDRSRQESALRLYSEGDHLIIENRDGDVIALDPQTEESGPQSPAGGDGQEGASGWSYDAIKKRLGDWRDEEIQKRSRGQEKTKKHAPARAYQFGNTIIVEDEDGEVLKKYELPSGKPEREGGDLVSQSLKKMGIVSKQKGGNVEKTNDNAPSQAAGAPASSNPRPIQRSRKKSSAAEEADEEDDRNIRFKIGGVGQRMTKEDFIREMRKLDKSTRSEVVDQSSASVAVKALANQERRPEDSPKADGNPGDFGRNRAVSQPSKPAQAEAASRSGDQDGETAAERRRRLSVLKNMESDDLINENTETPAERRRREAALGIGPSDQIAEADSDDEDGLPREPSPRRGIRFAEPTRGNK

SEQ ID NO: 9993 - protein, 401 aa, Pseudomonas putida GB-1
MFVSNPKAGRQPYPQALRTVMSIAKAEESRQWLTGWSCLNAGATPLYGLPDLAAELGIAQLSVKDESVRSVLGSFKALGAPIALVRLILRTFPEQPFAPHGLLEGHYADLLAGFTVVSATDGNHGKGLAAAAHSIGCRCVIVLHANVSIEREQAIAAYGAQIVRVAGNYDKSVEHAAVLAASNGWTVVSDTSYEGYEEIPRDVMQGYATIAAEIIEATVGQPPFTHVFLQGGVGGLAAGIVSYLWEHFGEQRPLFVMVEPEQADCLYQSAMLGKPARAVGSVDSVMAGLACGETSPLAWRFLEPSIDCFMTISDDEAVAAMRRLSAGSVRDIPLIAGESGVAGLAGLARLVKDSGAAASLGVGRNARILFINTEGATAPGVYAELLGETAASVLARQQCWA

SEQ ID NO: 9994 - protein, 231 aa, Physcomitrella patens subsp. patens
MPKRTTHTYSSEDAAPDGPESELFVYYCKHCGAHVLITDTQLQKMPKRTDKAYVLDRTKHLTRLNVVEAGKHLLKRGEGKVEKQYRMKCGGCGLFVCYRCEEDMDAGPYLYVADGALSSVAAETNPQDAPVPPCISQIDGGLVQVAIEVEDRAQRSQITRVNADDVRVTVAAPAARGEANNELLEYMGKVLGLRLTQMTLQRGWNNKSKLLAVEDLSVREVYEKLLAAVQI

SEQ ID NO: 9995 - protein, 596 aa, Bacillus anthracis str. Sterne
MVESLLLSIVIIITLGIASQWTAWRFQLPAIVVMAVAGLLIGPVFGIINPKEVLGDVFSPLVSLSVAIILFEGSLSLDIRELRGLSKPVFRIVTFGAFIAWIAGSLAAHYVAGLDWAVAFIIGGLFIVTGPTVIIPLLRQARLKPRTAAILKWEGIIVDPFGALLAVFAFQIVNFLTKENVQLHTLLYFFAGSLFAMVLGYIFSIFMSYMILKGKVPEYLKAPILLVTVLLCFGIADEVMHETGMLAVTVMGITLARMKKYISSIGDIRHFNEIISVLLTSTVFIILTASLPRTTIMEIFSWPIISFVLMMLFVVRPLSIWISTIGTELTKAERALVGWIAPRGIVALTVSSYFATELLQEGYKDASILTALTFALVITTVCAHGFSIGFLAKRLGLANTEPPGILISGASTFSSAFALHCKEMGVPSLIVDVSEEHLQCAKVKGLNTYNGQVLSEQLQFEVDMNQYEYLIAVTDTDSYNVLVANTYVPQFGHHNTFLLPIHDVEKIEQERISLSKKAHLLFGQNEIYEELNRKIEDGYTFKTIQVAEEQKINKEEINSEDLILFIRHRDGSLTFSTLYKYIAVMPGDELVVLAKQ

SEQ ID NO: 9996 - protein, 450 aa, Enterococcus faecalis V583
MNVVKFGGSSLASAPQLQKVLQIVKEEPRRTFVVVSAPGKRTPQDIKVTDLLIQYYQRYLNNEEIESTISAIIRRYEDLFDELHLDKAVLADIAISIRQLATLPKENNAFLFDYFLASGEDNNAKVVASFFKQNGLDARYISPKELGLLVTPEPGNARILPKALEKISVYRETQQILVIPGFFGYTEAGEICTFSRGGSDITGSIVAAGVQADLYENFTDVDGIYVAHPGIIEQPQTIQELTYREMRELAYAGFAVLHDEALMPAYRANIPVVIKNTNNPHHPGTLITTSRKVKHAPVVGIASDQGFASIYISKYLMNRELGFGRRLLEVLEKLALSYEHMPSGIDDITIVLREDQLTTEIENRLMAQLQEVLAPDELRITHHLSMIMIVGEGMRQRIGVTAESTMALAKEKINLEMINQGSSEVSIMFGIKKEQEEKAIKALYRTFFHD

SEQ ID NO: 9997 - protein, 337 aa, Campylobacter fetus
MKKILFVVATIFMALFLNAKENDMRNLKDIYLAGGCFWGTQAYFDKIRGVIKTDVGYANGKSDKTDYHSLHYSGHAETVHITFDENIVSLAEILAHYFRIIDPFSVNKQGNDVGSQYRTGIYYNDSSLKNSISEFIKHEQTKYDKKIAVEVEPLKNYVLAEDYHQKYLDKNPGGYCHVDLSLADKPLYNESKFKAPSKDELKAKLSDLQYSVTQEKATERPYSSEYDKFDKKGIYVDIVSKKPLFSSSDKFDAGCGWPSFTKPITTDALGYNRDLSHGMERVEVTSNLANSHLGHVFTDGPKDKGGLRYCINGASLKFIPLEDMEKEGYKDYIIYVK

SEQ ID NO: 9998 - protein, 378 aa, Zea mays
MKITPVQKQTRAGQRTRFKAFVVVGDGDGHVGLGVKCAKEVATAIRGAIILAKLSVVPVRRGYWGNKIGQPHTVPCKVTGTSLPARQIGGNLGPFTHPAMAERGGERGGERGGERGGFGRGFGRGGRGDRGGRRGGRRGGRQQEEEKWVPVTKLGRLVKENRINKIEEIYLHSLPVKEHQIVETLVPGLKDEVMKITPVQKQTRAGQRTRFKAFVVVGDGDGHVGLGVKCAKEVATAIRGAIILAKLSVVPVRRGYWGNKIGQPHTVPCKVTGKCGSVTVRMVPAPRGSGIVAARVPKKVLQFAGIEDVFTSSRGSTKTLGNFVKATFDCLMKTYGFLTPEFWAETKYAKTPFQEFTDLLAKPTKGLLIEAPTETVEA

SEQ ID NO: 9999 - protein, 263 aa, Chromobacterium violaceum ATCC 12472
MSRVVIKSPAEVAKAREAGKLVAELLAMIGEHVKPGVSTEELDARCNEYIVKVQKAKPANVGYYGYPKTICSSVNQVVCHGIPSAKQILRDGDIVNIDVAVIKNGWHGDSSRMFYVGRPSAEAKRLVETCYDATCAGIRAVRPGATLGDIGHAIQAITESAGFSVVREYCGHGIGKVYHEEPEVLHYGRPGIGMKLKRGMVFTIEPMINAGKAGTRQLGDGWTVVTQDGSWSAQWEHMVAVTDHGFEVLTPWPDGLGDYPAIA

SEQ ID NO: 10000 - protein, 417 aa, Arabidopsis thaliana
MAATAATTTSSHLLLSSSRHVASSSQPSILSPRSLFSNNGKRAPTGVRNHQYASGVRCMAVAADAAETKTAARKKSGYELQTLTGWLLRQEMKGEIDAELTIVMSSISLACKQIASLVQRAGISNLTGVQGAVNIQGEDQKKLDVISNEVFSNCLRSSGRTGIIASEEEDVPVAVEESYSGNYVVVFDPLDGSSNIDAAVSTGSIFGIYSPNDECIVDDSDDISALGSEEQRCIVNVCQPGNNLLAAGYCMYSSSVIFVLTLGKGVFSFTLDPMYGEFVLTQENIEIPKAGRIYSFNEGNYQMWDDKLKKYIDDLKDPGPTGKPYSARYIGSLVGDFHRTLLYGGIYGYPRDAKSKNGKLRLLYECAPMSFIVEQAGGKGSDGHSRVLDIQPTEIHQRVPLYIGSTEEVEKLEKYLA

SEQ ID NO: 10001 - protein, 605 aa, Magnaporthe grisea 70-15
MSLTRPSREFLHLPRQLARTTSRTRPSSTGSNTGITTNQTRRISTLPQTRPSRQTAAPTQTPIRQTRSVATFTPPFQAGAVSRIETNVDPTSPEFRENEASMAELMTRLDTLTRKAQQGGNAKAKEKHIARGKMLPRDRIAALIDPGSSFMELSALAAHEVYPEADVPAAGIITGVGVVEGVTCMIVANDSTVKGGTYYPMTVKKHLRAQAVAQENRLPCIYLVDSGGANLPHQADVFPDQNHFGRIFYNQARMSSQGIPQIAVVMGPCTAGGAYVPAMSDESIIVGNQGHIFLAGPPLVKAATGEVVTPEELGGGEMHSSVSGVTDYLAVDDAHALVLARRSVSNLNWPTNESKSSQELSYEEPLYPAEELLGIASPNLRKPLPIREVIARIVDGSAFSEFKRDYGTTLVTGFASIYGQKVGIVANDGVLLGTSAVKGAHFIELCAQRGVPLVFLQNISGFMVGKEAERDGIAKHGAKLVTAVACADVPKFTVVVGGSYGAGNYGMCGRAYSPRFMWLWPNARVGVMGAEQLAAVMETVGKPDPELKDRIEKETDAVFSSARLWDDGVIPPQHTRRYLGLGLRAAMSGRNEVKPGNTKFGVFRM

SEQ ID NO: 10002 - protein, 659 aa, Streptococcus pneumoniae TIGR4
MIQIGKIFAGRYRIVKQIGRGGMADVYLAKDLILDGEEVAVKVLRTNYQTDPIAVARFQREARAMADLDHPHIVRITDIGEEDGQQYLAMEYVAGLDLKRYIKEHYPLSNEEAVRIMGQILLAMRLAHTRGIVHRDLKPQNILLTPDGTAKVTDFGIAVAFAETSLTQTNSMLGSVHYLSPEQARGSKATVQSDIYAMGIIFYEMLTGHIPYDGDSAVTIALQHFQKPLPSVIAENPSVPQALENVIIKATAKKLTNRYRSVSEMYVDLSSSLSYNRRNESKLIFDETSKADTKTLPKVSQSTLTSIPKVQAQTEHKSIKNPSQAVTEETYQPQAPKKHRFKMRYLILLASLVLVAASLIWILSRTPATIAIPDVAGQTVAEAKATLKKANFEIGEEKTEASEKVEEGRIIRTDPGAGTGRKEGTKINLVVSSGKQSFQISNYVGRKSSDVIAELKEKKVPDNLIKIEEEESNESEAGTVLKQSLPEGTTYDLSKATQIVLTVAKKATTIQLGNYIGRNSTEVISELKQKKVPENLIKIEEEESSESEPGTIMKQSPGAGTTYDVSKPTQIVLTVAKKVTSVAMPSYIGSSLEFTKNNLIQIVGIKEANIEVVEVTTAPAGSAEGMVVEQSPRAGEKVDLNKTRVKISIYKPKTTSATP

SEQ ID NO: 10003 - protein, 274 aa, Zea mays
MATPSSSLCSSFASLRTASIGHPRGIASSTPRKAFHVRASARVDKFSKSDIIVSPSILSANFAKLGDQVKAVEVAGCDWIHVDVMDGRFVPNITIGPLVVDALRPVTDLPLDVHLMIVEPEQRVPDFIKAGADIVSVHCEQTSTIHLHRTVNQIKSLGAKAGVVLNPATPLTAIDYVLDVVDLVLIMSVNPGFGGQSFIESQVKKIAELRRLCAEKGVNPWIEVDGGVGPKNAYKVIEAGANAIVAGSAVFGAPDYAEAIKGIKTSQRPLAVAA

SEQ ID NO: 10004 - protein, 396 aa, Neisseria gonorrhoeae FA 1090
MFFKHIEAAPADPILGLGEAFKAETRPEKVNLGIGVYKDASGATPIVKAVKEAEKRLLESETTKNYLTIDGVADYNEQTQILLFGKDHEIIASRRAKTAQSLGGTGALRIAAEFAKRQLNAQTIWISNPTWPNHNAIAKAVGIQDKPYRYYDAAKHCLDWDGMIEDLNQAQKGDIVLLHGCCHNPTGIDPTPEQWETLAKLSAEKGWLPLFDFAYQGFGNGLEEDAYGLRVFLKHNTELLIASSYSKNFGMYNERVGAFTLVAEDEETAARAHSQIKTIIRTLYSNPASHGANTIALVLKNDDLKAQWIAELDEMRGRIKAMRQKFVELLKAKGSTQDFDFIIEQNGMFSFSGLTPEQVDRLKNEFAIYAVRSGRINVAGITDDNIDYLCESIVKV

SEQ ID NO: 10005 - protein, 530 aa, Ostreococcus tauri
MRRNLREIAWRVARETNFRRRVGVKVPVTGANAGALVGPTTGSKTSTIARNYSATNPIATGKVTQVIGAVVDVQFDDHLPSILSALEVEGHDVRLVLEVAQHLGENTVRTIAMDTTEGLVRGQPVQNMGSPIQIPVGRATLGRIMNVIGEPIDECGPISTTTSLAIHREAPPFVDQSTEMQMLVTGIKVVDLLAPYQKGGKIGLFGGAGVGKTVFIMELINNIAKGHGGFSVFAGVGERTREGNDLYHEMIEGGVIKLGDQASDSKCTLVYGQMNEPPGARARVGLTGLTVAEYFRDFEGQDVLFFVDNIFRFTQANSEVSALLGRIPSAVGYQPTLATDLGGLQERITTTTKGSITSVQAIYVPADDLTDPAPATTFAHLDATTVLSRSIAEIGIYPAVDPLDSTSRMLSPLALGDEHYNTARGVQKILQDYKNLQDIIAILGMDELSEDDKLTVSRARKVQRFLSQPFHVAEVFTGSPGKYVDLKDTISGFKGLINGNYDDLPEMAFYMVGDMNEAVAKANDLAKQVK

SEQ ID NO: 10006 - protein, 551 aa, Oryza sativa Indica Group
MEASDEDRPLIHHLPPQEQCSKYTCDGTVNIDSVEFTECICFYGVSKNLVTYLTSVLHESNVNAAQSVSIWIGSCFFTPLIGAFLADTYWGRYWTVVMSILVIILGMIVLTVSASPLFLNASFYNGGISRLTVYLGLYLFALGTGGIKPNIPAFGADQFDGADPVERVTKGSFFNWYYFSINVGSLLSSTVVVWVQDNIGWSVSFAGPMLLLGFGLAMFIAGRRAYRYKKLGGSPLTRVFQVLVAAVRNHRLNLPDDSSLLHELPGVTEGDYRTQHTYQFRFLDKAAILSDKNCAPAAPSSPWRLCTVSQVEELKMLLRTFPVWASLVGFFMVTAQMTSTLIEQGVAMDGRVGRFTVPPASLATFDVVAVLALIPVYDAALVPLARRVTGRDRGVSHMQRIGVGLALSAVAMAYSALVEARRLAMAAAAAGTRMSIAWQVPSFFVLGAGEVFAVIGMLEFCYEQSPASMKSLGTALVQLAVAVANYLNSGMLRVVAAATARGGGAGWIPDKLDEGHLDYFFWMMAALSVLNLLQFLHCSIRFRGNNTLSSS

SEQ ID NO: 10007 - protein, 583 aa, Auricularia auricula-judae
MRLPVLLGALCAAGMASAALVEYDLVISQGNIKNDGQTKRSWLINGQSPGPAIVATKGDTVNVRVLNLGSENITIHWHGFFQPGPTVFPDSRSTLVCPLAPITFHLRVTQTGAYWYHSHHHMQMVDGLQGPVFLKPDAQTVSSLTTLGLPEADQKKALHAELHPRFLSVFDNQHKSGAGRLPGPRRDCVDIPPAVGKVTKRGCALPDNANLQPYGGKPSEVDPDLWFNCVPTSTPLEVFQVSASEKFVAFNIVNSGTTWELRVSIDSHSFWVFTADGAYISPVKVNVISIPVGERFQILVPLDQSPGDYTIRVAAKAMPQLLSGYAVLSYKKSLLNIKLGGVTSAPPAKHPFIDYGGNVISGSGGVLFNAMAIQPFPAQAPPSGPADVTIRISLQRSHALTWTMNGVPLPTLPEQFTPLLIDPKGISNLDPALYTSFKNGSIVDIILETTVLGKGSHPAHPIHKHNTKAFFLGTGTGRFPAATVWEAFQRNTTGLNLVNPPLRDDFNTPPTKENTNWAALRFQSVNPMVTIMHCHIDPHLAGGMSFIMWRASRRYSPFRLTTRTFTEPTHTHSLFLSNRTSSD

SEQ ID NO: 10008 - protein, 230 aa, Pseudomonas aeruginosa UCBPP-PA14
MSTIAENIAKVAARIREAAQAAGRDPATVGLLAVSKTKPAAAVREAHAAGLRDFGENYLQEALGKQAELADLPLNWHFIGPIQSNKTRPIAEHFQWVHSVDRLKIAQRLSEQRPAGLPLLNVCLQVNVSGEASKSGCAPEDLPALAEAVKQLPNLRLRGLMAIPEPTAERAAQHAAFARLRELLLDLNLGLDTLSMGMSDDLEAAIGEGATWVRIGTALFGARDYGAPAS

SEQ ID NO: 10009 - protein, 397 aa, marine gamma proteobacterium HTCC2080
MTLYDSRAGLADWEMNVSNTAILALEDGTIFRGASVGAEGQTTGEVVFNTAMTGYQEILTDPSYARQIVTLTYPHIGNTGVTSEDAESSGVHAAGLVIRDLPLVASSWRSEQSLSSYLSGEGVVAIADIDTRKLTRILRDKGALSGCIVAGEDPDVDAALAQARGFSGLVGMDLAKEVTTQAPYTWEEGSWQWGGDQRPAPSSNFSVVALDFGVKRNILRMLVDRGCSLTVLPAESDIETVCAYAPDGIFLSNGPGDPEPCDYAIELARAAMARGIPLFGICLGHQIMALASGANTEKMKFGHHGANHPVQKLADGAVMVTSQNHGFTVSEQGLPETLSVTHRSLFDGSIQGIARNDVPAYSFQGHPEASPGPRDAGQLFAPFIRAMKDRRAEQEGG

SEQ ID NO: 10010 - protein, 223 aa, Magnaporthe grisea 70-15
MSDAWIIEWAFGKRMTPAERLRKNQRLLDKAIRELDQQRVKLEKQEKTLVTQIKQSAQKNQMGACKIQAKDLVRTRRYIEKFYGMRSQLQQISLRLQTHRTNEQMMQAMKGATMALGSMNRTMNLPSLQRIAAEFERENDIMEQRQELMDDAVDDAMDVGVEEEGDELVEQVLEEIGVDLKNSLGETPQGLQSETVAETRIAQAVGGGSDDDLQARLDSLRPK

SEQ ID NO: 10011 - protein, 477 aa, Burkholderia thailandensis E264
MRVARIAAVADCAYGADGASARPFPSHVGRGQADVGFWTLAPLARGLPSEGSLQVRPMRVRAGRATRGAPPTRHGDEAMSSNRGVVYQGPGKVEVQKIDYPKMVDPSGRAIGHGVILKVVSTNICGSDQHMVRGRTTAPVGLVLGHEITGEVVEVGRDVETLRIGDLVSVPFNVACGRCAMCKEQHTGVCLNVNPSRAGGAYGYVDMGGWIGGQAEYVLVPYADFNLLKFPDRDRAMTKIRDLTCLSDILPTGYHGAVTAGVKPGSTVYVAGAGPVGMAAAASARLLGAACTIVGDMNAERLAHAKAMGFEVVDLSKDATLGEQIEQILGKPEIDCAVDCVGFEAHGHGSSGHAEEAPATVLNSLMEITRPAGAIGIPGLYVTDDPGAADAAAKHGSLSIRFGLGWAKSHSFHTGQTPVLKYSRNLMQAILFDRLPIAQIVNVTVISLDDAPEGYRKFDGGAPRKFVIDPHGMLKAA

SEQ ID NO: 10012 - protein, 221 aa, Vitis vinifera
MGQKSLIYAFVARGTVILAEYTEFSGNFNSIAFQCLQKLPATSNKFTYNCDAHTFTYLLDNGYTYCVVADESVGRQVPMAFLERIRDDFVARYGGEKAATAPANSLNKDFSSKLKEHMQYCVDHPEEISKLAKVKDQVSEVKGVMMENIEKVLDRGEKIELLVDKTHNLHEQAQDFRSAGTKIRRKMWLQNMKIKLIVLGILVALILIIVLSVCHGFNCGK

SEQ ID NO: 10013 - protein, 992 aa, Vitis vinifera
  misc_feature (163)..(163): Xaa can be any naturally occurring amino acid
  misc_feature (165)..(165): Xaa can be any naturally occurring amino acid
  misc_feature (183)..(183): Xaa can be any naturally occurring amino acid
  misc_feature (318)..(318): Xaa can be any naturally occurring amino acid
  misc_feature (327)..(327): Xaa can be any naturally occurring amino acid
  misc_feature (542)..(542): Xaa can be any naturally occurring amino acid
  misc_feature (564)..(564): Xaa can be any naturally occurring amino acid
  misc_feature (568)..(568): Xaa can be any naturally occurring amino acid
  misc_feature (668)..(668): Xaa can be any naturally occurring amino acid
  misc_feature (779)..(779): Xaa can be any naturally occurring amino acid
  misc_feature (852)..(852): Xaa can be any naturally occurring amino acid
MVLSTSETSPMKTHKKRPFENHAHHQYRSFPPNFNRPRVDAVRDWPRGYGKFIPLTDSKVIGDNIAVGTAGNFQAPVEHSIQSSFSSTIDAEVRMHEVPRSYPPKEVLKSYSIVRDFPEGLKSASSSANNISPSEKFSAEPRPVEVMATSRRSYEGSNEVWNXFXGEVGETSGFVGKWAGDAXEVCILLGQEIQDGDSFGSALKTSACKETGNEVWNDCSRDFETYGVEGKWGVDAKEICTSLGQEIQGGEACNRTLERSPWEATVNEVQNSSRDGETSGFMVRRDDDTKEIRIHPQSERKLSELDPWCQTVGNKDDXGKNVLRNTXKEIEICSKDQIAKDHQAIGNNSRVQGALNLFQELLEKLRREAILTGKKNVLRKLPVTAAMTLKRQQKWVNTTKRLGHVSDYMEKDGKVLAISVVDSGRYANDKESSDVLIYLGQGGNPMVGYNKQPEDQKLERGNLALKNSMDAKTPVRVTRGFQAMKVTSNGYTYDGLYFVDKYWQERGQFGKLVFKFQLKRITGEPKFDQRELNQSKDSEERXIHVVNTIDYEKPQPFTYIARMXYLEXSKWSIPSGCDCTDGCSDSVKCACVLKNGGEIPFNCHGAIIETKPWVYECGPLCKCPPSCNNRVSQNGIRFSLEVFKTKSTGWGVRSRNYISSGSFICEYXGELIQDKEAKRRTANDEYLFDLDNGAFAIDAAKFGNVGRYINHSCSPNLYAQKVLYDHDDKRLPHIMLFATKNIPPMRELTYHYNYMVGQDYMKSASWFFHLLFLESGYFXTITLAWWIFHKQNSRIGGGGGGGGRPDQSPPEANHPPTGGSGSAHGPNWDYNWGWGSGPGSGWGYGSGSGRSXNGFGRGSGSGYGSGTGSGSGSGSGYGSGGASGSGSGSGSGSGGGGAGYGNGNGNGGGGYGHGNGNGNGGGGGGGYGNSNGNGGGGGYGNDDDGGGGYDGYGGGGGGGGGGGGGGGYGNGDGGGGWGGYYNRFVKEKKKHG

SEQ ID NO: 10014 - protein, 438 aa, Bacillus thuringiensis serovar konkukian str. 97-27
MHHDEKNKIGLTVALSIVVGTIIGSGVFMKPGSVLDYSGSSNMAILAWVIGGLLTLASGLTVAEIGAQIPKNGGLYTYLEEIYGSFWGYLSGWMQTIVYGPAIIGTLGLYFSSLMINFFYLDKVWNLPIAIGTVVFLGVVNSMGTKYGGIVQTITTIGKMIPIVLIVVLGFWKGNSDIFNVVVPISENQSIGMAILATLFAYDGWILLASIGGEMKNPTKLLPKAMTVGILIVTAAYVLINLALLNVLPATQIVDLGENATATAAGMLLGEYGGKIISIGIIVSIFGCLNGKILTFPRIPMSMAERGQLPFAKFIAKESPRFKTPANAITVEIILGIILMIISDPNKLSEISVFIIYIFYVMTFIGVFILRKRNKNKERAYSVPLFPIVPIVAIFGSLFVIGSAIINDPLSCFLSIGIVFTGLPVYWYLNKKNKTEVS

SEQ ID NO: 10015 - protein, 974 aa, Medicago truncatula
MKNITCYLLLLCMLFTTCYSLNNDLDALLKLKKSMKGEKAKDDALKDWKFSTSASAHCSFSGVKCDEDQRVIALNVTQVPLFGHLSKEIGELNMLESLTITMDNLTGELPTELSKLTSLRILNISHNLFSGNFPGNITFGMKKLEALDAYDNNFEGPLPEEIVSLMKLKYLSFAGNFFSGTIPESYSEFQKLEILRLNYNSLTGKIPKSLSKLKMLKELQLGYENAYSGGIPPELGSIKSLRYLEISNANLTGEIPPSLGNLENLDSLFLQMNNLTGTIPPELSSMRSLMSLDLSINGLSGEIPETFSKLKNLTLINFFQNKLRGSIPAFIGDLPNLETLQVWENNFSFVLPQNLGSNGKFIYFDVTKNHLTGLIPPELCKSKKLKTFIVTDNFFRGPIPNGIGPCKSLEKIRVANNYLDGPVPPGIFQLPSVQIIELGNNRFNGQLPTEISGNSLGNLALSNNLFTGRIPASMKNLRSLQTLLLDANQFLGEIPAEVFALPVLTRINISGNNLTGGIPKTVTQCSSLTAVDFSRNMLTGEVPKGMKNLKVLSIFNVSHNSISGKIPDEIRFMTSLTTLDLSYNNFTGIVPTGGQFLVFNDRSFAGNPSLCFPHQTTCSSLLYRSRKSHAKEKAVVIAIVFATAVLMVIVTLHMMRKRKRHMAKAWKLTAFQKLEFRAEEVVECLKEENIIGKGGAGIVYRGSMANGTDVAIKRLVGQGSGRNDYGFKAEIETLGRIRHRNIMRLLGYVSNKDTNLLLYEYMPNGSLGEWLHGAKGCHLSWEMRYKIAVEAAKGLCYLHHDCSPLIIHRDVKSNNILLDADFEAHVADFGLAKFLYDPGASQSMSSIAGSYGYIAPEYAYTLKVDEKSDVYSFGVVLLELIIGRKPVGEFGDGVDIVGWINKTELELYQPSDKALVSAVVDPRLNGYPLTSVIYMFNIAMMCVKEMGPARPTMREVVHMLTNPPHSTSHNLINL

SEQ ID NO: 10016 - protein, 316 aa, Pseudomonas putida GB-1
MHEHDVLCFGETMAMFVAEQTGDLASVEQFGKRIAGADSNVAIGLARLGFNVRWLSRVGDDSLGRFVLDSLRREGLDCSGVEVDASYPTGFQLKARCDDGSDPSVEYFRRGSAARRLSPALIHSDVLQARHLHATGIPPALSDSCRALSHALLDAMRAAGRSISFDPNLRPSLWPDQSSMVREINALATKADWVLPGLEEGRLLTGQQTPADIAAFYLDQGVELVVIKLGEAGAYFRSAKGEGQVAAVPVSHVVDTVGAGDAFAVGVLSALLEGRAVVEAVARGNWCGSRAVQSRGDMEGLPLRHELEAHNLRRSA

SEQ ID NO: 10017 - protein, 267 aa, Thermobifida fusca YX
MNRFHVVDAFTDQPFHGNPAAVLVLDSPYDDAWAQRVAAEFNLSETAFVRPLAGADADYELRWFTPTTEVDLCGHATLAAAHVLAAGGAEGPFRFASRSGVLTVTARDGLLWLDFPANPPYAKDVPDGLVAALGGEPVWAGFSDVNDYFVVYPDEATVRALAPDLAEVARCTVRGVTVTAPADPGQPYDFVSRLFAPAIGIPEDPVTGSAHTALGPYWAQRLGRTRLDAVQCSARGGRLVVELPADAPDRVLIGGTAVTVSEGTLRY

SEQ ID NO: 10018 - protein, 625 aa, Oryza sativa Japonica Group
MAGVSCFYHPEHLVTEHHYGEGSGSGSGNPCAACERVVTGDGYRCEHGECDFHVHRSCLALPASFALHERHEHELTLTRLTGSRWCNVCDVISHAGCRMYACAPCNFSAHPRCTPVLDGAHQQPQPPQQQEGEEKRSVGVRAAKVALKIGVAVGLTAVDVGTTGGLATVGSLLLNPHHVPREVRPGGQVRRGRRLHAGEARAPLRKHHRQRGGGRGRGGCNRRRGGAGRAGWAVPPSPHSTLRGLKSEILWALNALTVLSFKEKDDLRRDTTPLAKVPGLLDALLQVIDDWRDIAMPKDHTKPPRVRTLGVNTTLSGFGHENVEKVYSDTTTPSDDQTKTADSTVTKKRSAGFLFDEEGLFNVDDEGRTEKQQCAVAASNIIRNFSFMPENETVMVQHRHCLETVFQCLEDQNTEDDELITNMLETLVNLAPVLDLRIFSSSKPSFIKITEKRAVQAIMGMLASSIRVWHCAAAELIGRLIINPDNEPFLLPAIPQIYKRLVDLLSVPAVDAQAAAISALYNVAEVNMDFRLKLASERWAVDRLLKVVKTPHPVPEVCRKASMIVESLVSEPQNRMHLLVHENTFAEILTSEGKYSDTFARILYELTARPSNKVTAGQAIWGNIN

SEQ ID NO: 10019 - protein, 352 aa, Nocardioides sp. JS614
MKALRFYAPEDVRLEEVPEPTCGPDEVKLRVRNCSTCGTDVKILHNGHQNLTPPRTIGHEIAGEVVEVGADVNVTYGSSWAAGDRVQVIAAVPCGECYECQKGWMAVCQNQTSMGYQYDGGFAEYMIVPRQVLKVDGLNRIPDNVGYDEASAAEPFACAINAQELLGIEPGDTVVVFGAGPIGCMHIRIARGVHQAGPVYLVDVNADRLKMSADAVQPDETINAAEVDVVARVMELTGGRGADVVITATAANITQEQAISMAARNGRISFFGGLPKTNPTITCDSNLVHYRQLHIHGANGSAPEHNKRALEYISTGQVPVKDLITRHIPLSDVLDAFTIVQNGEAIKVTVEP

SEQ ID NO: 10020 - protein, 781 aa, Oryza sativa Indica Group
MASSASRTLLLLVVVVVVAAAVGGVLGGGGEERTFIVRVMRTRSPRRSRRTRTGEWREGGPLIHTYSAAFHGFSARMSPAAAAALAEAPGVAAVVPERVRQLATTRSPRFLGLLSSPPSALLADSDFGSDLVIAIIDTGISPTHRSFHDRGLGPVPSKWRGVCSSGPGFPPNSCNRKLVGARFFSAGYEATSGRMNETAEVRSPLDTDGHGTHTASIAAGRYVFPASTLGYARGVAAGMAPKARLAAYKVCWVGGCFDSDILAAFDAAVADGVDVVSLSVGGVVVPYYLDAIAIGAFGATEAGIVVSASAGNGGPGGLTVTNVAPWMATVGAGSMDRAFPANVQLGNGQVLDGVSVYGGPALQSGKMYELVYAGASSGAASSAADGYSASMCLDGSLDPAAVRGKIVVCDRGVNSRAAKGDVVHRAGGIGMVLANGVFDGEGLVADCHVLPATAVGAAAGDKLRKYIGSSTRQAPATGTILFEGTHLGVHPAPVVAAFSARGPNPQSPEILKPDLIAPGLNILAAWPSGVGPAGIPSDGRRTEFNILSGTSMACPHISGLAALLKAAHPTWSPAAIKSALMTTAYIKDNSNGTMVDESTGVVADVFDFGAGHVDPMRAMDPGLVYDITPVDYVNFLCNLNYTEQNIRAITRRPADCRGARRAGHAGNLNYPSMSATFAADGTRATMKTHFIRTVTNVGGGRAVYRATVRSPEGCAVTVQPRQLAFRRDGQKLSFTVRVEAAAPAKKMEPGSSQVRSGAVTWSDGRHAVNTPVVVTVQAPLQ

SEQ ID NO: 10021 - protein, 675 aa, Oryza sativa Indica Group
MAQIPNLDNAPLNLAALREQSQKDLLNILKSIRGKKCVVIDPKLAGTLSLILQTSLLKEYGAELRLLSAEPLQTECAKILYLIRSELKFMKLIASQIKNDEPKGLQREFFLYFVPRRTVACEKILEEEKVHQKLTLGEYPLYLVPLDEDVICFELDHSLQECLIEGDTSSVWHVAKAIHKLEFAFGVIPNVRAKGVASTKAAELLNSMQQEDPVNMDDMGTPEINTVILLDREVDLVTPMCSQLTYEGLLDEMLQINNGSVEVDATIMGAQQDGFSFSHLWEVFCLPLLGRYLFRKGGAKTDPTSGGSDKLYKEIRDLNFEVVVQVLRQKATSIQQDYAEVKSTNTQSVSELKDFVKRLHSLPEIARHVHLAQHLQSFTGKPSFHARLDIEQTILEVQNFEICFEYIEEMIHKQEPIENVLRLLVLLSLTNAGLPKKNFDYLRREILHSYGFEHMPLLYNLEKAGLFKRQESRSNWIGITRALQLIVDVNDTANPSDISYIFSGYAPLSIRLVQHAVRSGWRSIEELLKLLPGPHLDLKRGSSAINSSLDVHQGLGLQQSIDRLFALSGDEGFMRDLIQTYESKPETGVGHRSLVLVVFIGGVTFAEIAALRFLSAQEGMGYDFLVATTKVVNGNTILRPIITNSKELDLYQKSLKGVLDHDLTINRRFRWKRRA

SEQ ID NO: 10022 - protein, 355 aa, Verticillium dahliae
MSRSNAPNPSGSRKISFNVSEQYDIQDVVGEGAYGPPSSAIHKPSGQKVAIKKITPFDHSMFCLRTLREMKLLRYFNHENIISILDIQKPRGYDTFNEVYLIQELMETDMHRVIRTQDLSDDHCQYFIYQTLRALKAMHSANVLHRDLKPSNLLLNANCDLKVCDFGLARSAASQEDNSGFMTEYVATRWYRAPEIMLTFKEYTKAIDVWSVGCILAEMLSGKPLFPGKDYHHQLTLILDVLGTPTMEDYYGIKSRRAREYIRSLPFKKKVPFRTLFPKTSDLALDLLEKLLAFNPVKRITVEEALKHPYLEPYHDPDDEPTAPPIPEEFFDFDKHKDTLSKEQLKQLIYQEIMR

SEQ ID NO: 10023 - protein, 437 aa, Nostoc punctiforme PCC 73102
MKTNQIPPGSFGLPVLGETLSFVFDRDFAKKRYHQYGPIFKTHLLGRPTVVMAGPEALEFVLSSHIENFSWREGWPDNFKTLLGESLFLQDGEEHRRNRRLMMPALHGPALASYFSTMEDITRSYLQKWEKKQEFTWFQEFKQLTFDIASQLFLGTRPGPECVRLSQLFTTLTNGLLAINPLPLPFTTFGKAIAARNEILEHLTQVVRERQQNPTQDTISLLIKAKDEDGNSLSEKEIIAQAVLLLFAGHETTTSMLTWLCTELACHPEVLEKARVEQLQLASQGDLDLEQLGKMPYLEQVLWEVERLHQPVGGGFRGVIKDFELNGYHVPTGWQLYYSIGVTHQIEEIYSEPELFDPDRFSPQRQEHKKYPFSLVGFGGGPRICIGIAFAKMEMKIVAAHLLRSYHWEILPNQSLEVVAVPTNRPKDGLRVRFQPR

SEQ ID NO: 10024 - protein, 373 aa, Rhodococcus sp. RHA1
MSGSIQRVARAVADLVDGNAIVLVGCGSTDPDGYLVVAAENASTSALDFMVRHTSGFICAAVTDDACARIDLPPMAGTRPTPGDDYTVAVDAAGVGTGISAKDRAWTLRQIADPFSTPGGFTRPGHHPIRAHSDGVLGRRRSAEAVIDLMRAAGLREVGALAALVSVVDPTGIADSTESLAFADAHQLNSISVQDIVNYRRSTEVHVRQTFRTLRNTSCGTVEALGYHSDVTNADYIAYSSGDPSTLSRARVHARFETDFAPHAPSVDQAEPDITDALDDRDGLVVIARRANDADDAHDMEQSDRPDCFFHNRYGERIADIAQILRAREVLEPRLVNPPPGLFEAWSTLSNSASTAVGQTAPQCVSPASPTRG

SEQ ID NO: 10025 - protein, 850 aa, Ralstonia solanacearum GMI1000
MSSRQLQLRVLAPLSGRVVPIEDVPDPAFAQKMVGDGLSIDPATDVVLAPIDGRVIDFHDARHAIVIADASGVEIMVHVGLDTVMLAGQGFEALVGKGDTVRAGQPLLRFDAALVAAKASALTEIVVVNGERVRQMDKAAGSVEAGRSVLLTLHLEAADVADVAGDAPGHAQEEALLQSPPIVLPNPAGLHARPAARLASEARGFAARLTLWYGQQQADAKSAVAIMALATRCGDEVRLSGSGSDAAQALAALADLLRSGCGESAGTAALPQAKAAAFALHERSPVFEPAPAAGSLRGVGASPGVAVGQIVRWSGIAPEFDETGGPFEQEHARLHAALQIAASQIKSLVTADTLPDTPQAQIMDAHLAFLEDPMLIEAAEAGLRSGASAAGAWHLACQSVEQHLRLHANPQVRERAADVRDVGVRVLTVLTGAAERPRSLPERSIIVADDLTPSDTITMDRSKVAGLCTVSGGPTSHVAILARSMGIPAVCGVPAQALSLRDGTPAVLDGTAGVLQADPDPALRAEVERRLAAARQQLQADRQTAHRPGRTRDGHRVEVVANVRDAAEAREAVAAGGEGVGLLRSEFLFEDRTAPPDEDEQAAAYQAVAAALGPERPLIVRTLDIGGDKPLRYLPLPKEDNPFLGLRGIRVSLAYPELFRSQLRAMLRAAPGGNLHIMFPMVSDLDEVLVAKRILREEQARYPIPVKIGVMIEVPAAVAIVEALAQEVDFFSIGTNDLTQYTLAIDRGHAGLAARVDALHPAVLRMIALTVEGAHAHGKWVGVCGALASDLAAVPVLVGLGVDELSVSVPAIASVKAALSRLDFEDCRALARRVLPLGSAARVREALAQG

SEQ ID NO: 10026 - protein, 433 aa, Oryza sativa
MLISEYNWNATYKFDMFSTHEHEALQKREPIKAHLLSQPTRYVILVAHAMSAISRPSIILGAHTVTTNGSSARTHEAERNSTVERSTHVLKAASSPKSPKSPIRISPPRRRCGRSSPPLSLLFPHGDRHRVALRGGEVMWLGFVCSIRHVEGFMASPHSQEVKRWVLSDFDIGKPLGRGKFGHVYLAREKRSNHIVALKVLFKSQLKQSQVEHQLRREVEIQSHLRHPNILRLYGYFYDQTRVYLILEYALKGELYKELQRCKHFSERRSATYIASLAHALIYLHGKHVIHRDIKPENLLIGSQGELKIADFGWSVHTFNRRRTMCGTLDYLPPEMVEKTEHDYHVDIWSLGILCYEFLYGVPPFEAKEHSETYRRIVKVDLKFPLKPFVSPAAKDLISQMLVKNSAHRLPLHKLLEHPWIVQNADPSGVYRG

SEQ ID NO: 10027 - protein, 299 aa, Mesostigma viride
MAQTFAQQCAFTIAAPSSLFAGSVAVDSSSLRPAAVRSERSSIAQFAFRKNVFHTLVQQSTQNGKRASSFSVRAMAETFQDQATSTAASTKLYVGNLAWSCDDEMLNQAFSQFGEVKAAEVVLDRESGRSRGFAFVTMASPDAAEKARRGLDGTELAGRAIRVNFPQPKGERAPRAERGERSERSERSERTYTPRGDGEAGDANRLYVGNLPWSMDDGMLEDLFMEFGTVNYARVVMDRDSGRSRGFAFVALSTPEEANEAMANLDGEEIGGRTIRVNLATKSSGNREGRERRAPREQW

SEQ ID NO: 10028 - protein, 419 aa, Thermococcus waiotapuensis
MVELDPFEMAVQQLERAAQFMDISEEALEWLKRPMRIVEVSVPVEMDDGSVKVFTGFRVQHNWARGPTKGGIRWHPAETLSTVKALATWMTWKVAVVDLPYGGGKGGIIVDPKKLSEREQERLARSYIRAVYDVIGPWSDIPAPDVYTNPKIMGWMMDEYETIMRRTGPAFGVITGKPLSIGGSLGRGTATAQGAIFTIREAAKALGIDLKGKTIAVQGYGNAGYYTAKLAKEQLGMKVVAVSDSQGGIYNPNGLDPDEVLKWKNETGSVKDFPGATNISNEELLELEVEVLAPAAIEGVITEKNADGVKAKIVAEVANGPVTPEADEILREKGILQIPDFLCNAGGATVSYFEWVQNINGYYWTEEEVREKLDKKMTKAFWDVYNTAKEKNIHMRDGAYVVAVSKVYQAMKDRGWVKH

SEQ ID NO: 10029 - protein, 238 aa, Zea mays
LASYSCYSRRARSSDSDCNEEGEEMVGSGADGGGGGDDARSKEAAGMMALHEALRNVCLDSDWTYSVFWTIRPRPRCRGGNGCMVGDDNGSLMLMWEDGFCRPRVAECLADMSGGEDPVRKAFIKMSIQLYNYGEGLMGKVASDKCHKWVFKEPSECEPNISNYWQSSFDALPPEWTDQFASGIQTIAVIQAGHGLLQLGSCKIIPEDLHFVLRMRHTFESLGYQSGFFLSQLFSSAR

SEQ ID NO: 10030 - protein, 435 aa, Burkholderia xenovorans LB400
MDNVSRETDPNAADPVVGPSKPRLLGVLGPGLITGASDDDPSGIATYSQVGAAFGYGLSWTLLFSYPLMVAIQMISARIGRTTGHGIAGVLRRHYPNWLLQWVVVLLLIANVINLGADLGAMADAMALLLPGPKWLYVLFFSVICVCMQLLLQYTRYVAVLKWFTLSLFAYFAVLAVAHVDWIHLASHFFIPHLSWTSTYLTAVVAVFGTTISPYLFFWQSEEEVEDMRAHPRRQDLFDAPEQGTAALHRIEIDTMTGMGLSNLVALAILATTAATLNAHGITDIQTSSQAAQALRPIAGSFASLFFTTGIVGTGLLSVPVLAGSAAYAIGEARDWPVGFTRKVQEAKAFYATIAIATLIGMIVNFTSINPIKALYWSAVINGIVAVPVMFVMMLIVARVDIMGRFVARGWLRMLGWLATIVMLVIALAMLATSF

SEQ ID NO: 10031 - protein, 252 aa, Triticum aestivum
AVSALLDLISALSAFVASTPPFPHSSRYGNPAFRLWHEKLGGSVNELIAPITAAAASPSDLAGAEVELAPYLLDSFGNGTRIDYGTGHETNFAAFLYCLARLGLITDPDYPAVVLRVFASYLDLMRTLQDTYLLEPAGSHGVWGLDDYHFLPFVFGAAQLIDHKYMKPKSIHNPDILENFSKEYMYLACVMYVKKVKKGPFAEHSPMLDDISAVPNWKKVNSGLLKMYKAEVLEKVPIMQHFLFGSLIKWED

SEQ ID NO: 10032 - protein, 333 aa, Burkholderia xenovorans LB400
MFNVHNRSYLTLIEYTPRQIRYLLDLSRDLKRAKYAGTETPRLNGKNIALIFEKTSTRTRCAFEVAAHDQGAHVTYIDPNGSQIGHKESMKDTARVLGRMYDAIEYRGFGQEIVEELAKYAGVPVYNGLTDEFHPTQMLADVLTMHEFSDRPIHDIAYCYIGDAHNNTGNSLMIVGAKLGMDVRLCAPRCLWPHDELIEQCRAIAATTGARLTLTEKPEEAVKGVDFIYTDVWVSMGEPFEKWGARIEELLPYRVNAALLAASGNPRVKFMHCLPAFHDSNTHVGKQIADQYGLPNGVEVTDDVFESDASIVFEQAENRLHTIKAILVATLTG

SEQ ID NO: 10033 - protein, 295 aa, Pyrococcus abyssi GE5
MDVDKLIEAGKIAKKVREEAVKLAKPGVSLLELAEKIEGRIIELGAKPAFPVNLSLNEIAAHYTPYKGDETTLKEGDYLKIDIGVHIDGYIADTAVTVRVGMEEDDLMEAAREALESAISVARAGVEIKELGRAIEDEIRKRGFNPIVNLSGHKIERYKLHAGISIPNIYRPHDNYKLREGDVFAIEPFATTGAGQVIEVPPTLIYMYVRDAPVRMVQARFLLAKIKREYKTLPFAYRWLQGEMPEGQLKLALRTLEKSGALYGYPVLREIRNGLVTQFEHTIIVEKDSVIVTTE

SEQ ID NO: 10034 - protein, 372 aa, Arabidopsis thaliana
MSNDKDSFNVSDLTAALKDEDRAGLVNALKNKLQNLAGQRSDVLENLTPNVRKRVDALRDIQSQHDELEAKFREERAILEAKYQTLYQPLYVKRYEIVNGTTEVELAPEDDTKVDQGEEKTAEEKGVPSFWLTALKNNDVISEEVTERDEGALKYLKDIKWCKIEEPKGFKLEFFFDTNPYFKNTVLTKSYHMIDEDEPLLEKAMGTEIDWYPGKCLTQKILKKKPKKGSKNTKPITKLEDCESFFNFFSPPEVPDEDEDIDEERAEDLQNLMEQDYDIGSTIREKIIPRAVSWFTGEAMEAEDFEIDDDEEDDIDEDEDEEDEEDEEDDDDEDEEESKTKKKPSIGNKKGGRSQIVGEGKQDERPPECKQQ

SEQ ID NO: 10035 - protein, 296 aa, Glycine max
VHRLDPQESLGLMALSPALTIVLGFVIYENRTSGSHIEKKQAVESVGMKIRSMYQTMLYPHVWKPSLYMFLALALNVTTHEGHFYWYTDPKAGPAFSQEFVGVIYAIGAVASLIGVLIYHKALKDYPFRDLVFYAQLLYGISGVLDLIFILRWNLVIGIPDYFFVVIEESATRITSKIRWMPMMVLSTQLCPLGIEGTFFALLMCIDSIGALLSRWGGGVLLRVLHITRTDFTNLWLAVLIRDMLRFATLALVFLVPKTDQYEELLPFEVSGKNTSDKVDEEETLELVPINGKTEV

SEQ ID NO: 10036 - protein, 457 aa, Pseudomonas aeruginosa UCBPP-PA14
MTSDSRPAVLDLIGNTPLVRVTRFDTGPCTLFLKLESQNPGGSIKDRIGVAMIEAAERDGRLRPGGTIVEATAGNTGLGLALVGRAKGYRVVLVVPDKMSTEKVLHLRAMGAEVHITRSDVGKGHPEYYQDVAARLAQDIPGAFFADQFNNPANPLAHECGTGPELWAQTGHDLDAIVVGVGSSGTLTGLTRFFQKVQPELEMVLADPEGSIMAEYSRSGTLGTPGSWAVEGIGEDFVPAIADLSSVRHAYSISDEESFAMARELLRVEGIPGGSSTGTLLAAALRFCREQKEPKRVVSFVCDTGTRYLSKIYNDQWMTDQGLLQRKHYGDLRDIIARRFEEGRVISVGPDDTLLTAFQRMRLADVSQLPVLDDGKLVGVIDESDILLGVHADAPRFRDAVSSAMNAAPETLAPGASLAQLQAVLDRGLVAIVADASGFHGLITRFDLLNHLRRKLT

SEQ ID NO: 10037 - protein, 468 aa, Triticum aestivum
MSMSSSMDHAGPSVSVLRWLLSVAAGGLFALFLLVASPVPFPSASLFLAPTSPASSSTRASKNLFVDQALSVQARAPPASPPRFAYLISGSAGDAGMLRRCLLALYHPRNHYILHLDAEAPDSDRAALAAFVASHPVLAAARNVRVVEKANLVTYRGPTMVTTTLHAAAAFLWGEGRGKGADWDWFINLSASDYPLVTQDDMMEVFSELPRDLNFLDHTSDIGWKAFARAMPVIIDPALYMKKKGDLFWIPQKRELPTAFKLFTGSAWMVLSRPFVEYLIWGWDNLPRTVLMYYANFISSPEGYFHTVACNADEFRNTTVNHDLHYIAWDNPPMQHPHLLTLADWDGMLASAAPFARKFRRDDPVLDRIDADLLSRAPGMLAPGGWCVGEVPAAGANRTGGDDPCAVVGNAAYVRPGPGAARLKRLVTSLLSEENFRPKQCKVAVVEQHIPAKKVEEHIPSEKVEEHH

SEQ ID NO: 10038 - protein, 403 aa, Ustilago hordei
MSNAPLNGVKLNPLDDPNKVIKVLASDSKTAEQREIAYTNCKVIGNGSFGVVFQAKLVAPAGSESAEGSSKESDEVAIKKVLQDKRFKNRELQIMRIVKHPNVVDLKAFFYSNGDKKDEVFLNLVLEYVPETVYRASRHYAKLKQTMPILLIKLYMYQLLRSLAYIHSIGICHRDIKPQNLLLDPSTGILKLCDFGSAKILIAGEPNVSYICSRYYRAPELIFGATNYTTNIDIWSTGCVMAELMQGQPLFPGESGIDQLVEIIKVLGTPSREQIKTMNPNYMEHKFPQIRPHPFSKVFRPRTPPDAIDLISRLLEYTPSARLTAVEALCHPFFDELRAGEVRMPNGREVPPLFDWTKEELSVRPDLISRLVPQHAEAELLSRGIDVHNFQPIPLESMKVTLD

SEQ ID NO: 10039 - protein, 433 aa, Mycobacterium tuberculosis H37Rv
MAATAHGLCEFIDASPSPFHVCATVAGRLLGAGYRELREADRWPDKPGRYFTVRAGSLVAWNAEQSGHTQVPFRIVGAHTDSPNLRVKQHPDRLVAGWHVVALQPYGGVWLHSWLDRDLGISGRLSVRDGTGVSHRLVLIDDPILRVPQLAIHLAEDRKSLTLDPQRHINAVWGVGERVESFVGYVAQRAGVAAADVLAADLMTHDLTPSALIGASVNGTASLLSAPRLDNQASCYAGMEALLAVDVDSASSGFVPVLAIFDHEEVGSASGHGAQSDLLSSVLERIVLAAGGTREDFLRRLTTSMLASADMAHATHPNYPDRHEPSHPIEVNAGPVLKVHPNLRYATDGRTAAAFALACQRAGVPMQRYEHRADLPCGSTIGPLAAARTGIPTVDVGAAQLAMHSARELMGAHDVAAYSAALQAFLSAELSEA

SEQ ID NO: 10040 - protein, 378 aa, Myxococcus xanthus DK 1622
MTRSLESYRDLFPVLKEQLYLNHAGVAPTSLRAAEAVRGWMEDIVHHGIKHERGWEAHCERVRGLAARLINAEPGEIAFVRNTSHGLGLVAEGLDWTPGDEVVVASSLEYPSNVYPWLHLKDRGVTVREIQTPEGGVTPEAVAAALTPSTRLVAVSSVQFATGYRTDLDAVGALCERAGVLFCVDGIQSVGCIPVDVKKSRIHFLSADSHKWMLGIAGIGFLYVAKDVLPRLRPVLVGWRSTTDAWNFNRSHFELRPDAGKLEEGSAAYTGIYALGAALELLHEVGVDAISARIRELLGQLETGLRGLGCDVGPAPEHRAGILTFLPPEGEARALGAWLAGREVALSVRRGRVRLSPHFYNLPEEMDRLVELVRTHRG

SEQ ID NO: 10041 - protein, 275 aa, marine gamma proteobacterium HTCC2080
MVFELEALAVARGFSYPRAPDLAGAGLMAGLVIANWKMHGSLALIEEFSQQWRGLPQLSEVDAVLCPPTPYLVAVGEAFEGLLLLGAQNCAEQVEGAFTGEVASQMLAEMGCKYVIIGHSERRSLHRESDAQVAIKARTANAAGLNPVVCVGEALEQREAGQQDAVVSEQLLGSLAQVPCDNLVVAYEPIWAIGTGRTASPVQADDMHGVIRQRLQEHFGAAGSEIPIIYGGSVKPENAGVLFGCDNIDGALVGGASLEAKSFWQIASAASAGRA

SEQ ID NO: 10042 - protein, 412 aa, Salmonella enterica subsp. enterica serovar Paratyphi B str.
MKALTYHGPHHVKVENVPDPGIEQPDDIILRVTATAICGSDLHLYRGKIPQVKHGDIFGHEFMGEVVETGHDVKNIRKGDRVVIPFVIACGDCFFCRLQQYSACENTNDGHGAAMNKKQIPPPAALFGYSHLYGGVPGGQAEYVRVPKGNVGPFKVPPLLSDDKALFLSDILPTAWQAAKNAQIQQGSSVAVFGAGPVGLLTIACARLLGAEQIFVVDHHVWRLRFAEERYGAIPINFDDENDPAEKIIEQTAGHRGVDAVIDAVGFEAKGSLTETVLTNLKLEGSSGKALRQCIAAVRRGGVVSVPGVYAGFIHGFLFGDAFDKGLTFKMGQTHVHAWLGELLPLIEKGLLKPEEIVTHYMPFEEAARGYEIFEKREEECRKVILVPGATSAQAAQKQATGVINPMPGGVV

SEQ ID NO: 10043 - protein, 335 aa, Xanthomonas campestris pv. campestris str. ATCC 33913
MTLPPPAAYADSLRLSVAPMMDWTDRHCRVFHRLLAPSARLYTEMVHANAVIHGDRQRLIGFDAVEHPLALQLGGSDPALLAQAAQIAQAWGYDEINLNCGCPSDRVQAGRFGACLMREPALVADCVAAMCAATALPVTVKCRLGVDDDDDYAVFAGFIDQVVGAGAAMVVVHARNAWLKGLSPKENREVPPLRYDWAYRLKQERPALPVVLNGGIASVEASLAHLQHTDGVMLGRAAYHDPYVLHQLEAALSGRPERARADLLQAYQPYVQAQLDQGLALKHMTRHILGLFHGQPGGRVFRQVLSEGAHRPGAGWELVEQASQRTDDQARRIAA

SEQ ID NO: 10044 - protein, 279 aa, Bacillus thuringiensis serovar konkukian str. 97-27
MKNLQSKAVLNNGVEMPWFGLGVFKVEEGPELVEAIKTAIKAGYRSIDTAAIYGNEKAVGEGIRAGIEATGISREDLFITSKVWNADQGYETTIAAYEESLKKLGLDYLDLYLVHWPSEGKYKDTWRALETLYKEKRVRAIGVSNFQIHHLQDVMKDAEIKPMINQVEYHPRLTQKELQAFCKEQGIQMEAWSPLMQGQLLDNETLQEIAEKHGKTTAQVILRWDLQNGVITIPKSTKEHRIIANADVFNFELTKEDMEKIDALNQNHRVGPDPDNFDF

SEQ ID NO: 10045 - protein, 456 aa, Gloeobacter violaceus PCC 7421
MASTSGGVLRRSLGLIDGAALIVGITIGSGIFASPGRVVEQVGSVGMALAVWVVGGLLSLAGALCYAELGAALPVAGGEYAYLSRTLGRPLGFMFTWTQFFVMKTGSQAIISIVFASYLGSVLFGLDPRGAGVDGDWRIKAIAVATILLLTAVNCLGVRQGAVVQVVFTALKLLALAGIIAMGFAAFFQGGSSHFVDPFAGSIAAPSAFGLAMITCLWAYDGWNNLNYVSEELREPERNLPRAIVFGTLGVMAVYVLANVAYLSALTPAQMAGSRAVATNLAVQVIGPIGGVLVPIAVAISTFGSTNGSLITGARVFYAAARDGQFPRFFGYVSPRAVPAAALVAQGAWASMLVLPGDFGTLVDYFGFAAWLFYALAVVGLMILRAQAPDLPRPYKVRPYPLVPLVFLAASGFLIVNSLLTTPQSWFALGFMGLGLGVYFLFFRVPRVAVPTTSQP

SEQ ID NO: 10046 - protein, 332 aa, Streptomyces carzinostaticus subsp. neocarzinostaticus
MGKRAAHIGLRALADLATPMAVRVAATLRVADHIAAGHRTAAEIASAAGAHADSLDRLLRHLVAVGLFTRDGQGVYGLTEFGEQLRDDHAAGKRKWLDMNSAVGRGDLGFVELAHSIRTGQPAYPVRYGTSFWEDLGSDPVLSASFDTLMSHHLELDYTGIAAKYDWAALGHVVDVGGGSGGLLSALLTAHEDLSGTVLDLQGPASAAHRRFLDTGLSGRAQVVVGSFFDPLPAGAGGYVLSAVLHDWDDLSAVAILRRCAEAAGSGGVVLVIEAVAGDEHAGTGMDLRMLTYFGGKERSLAELGELAAQAGLAVRAAHPISYVSIVEMTAL

SEQ ID NO: 10047 - protein, 678 aa, Azoarcus sp. EbN1
MMGAHYEHLRLVRDEGDGEGAGDGVAWLHLDCRDAATNTLSRAVLDELAAVFAALEAQPPKGLVIASAKPAGFIAGADIEEFTRLDSPQAARDLVGRGWELFNRLVRLRFPTLALIRGHCLGGGLELALACRYRVVVDEPATKLALPEVMLGIVPAWGGMKRLPETIGAPAALDLMLTGKSVDARRAKQLGLADECVPPRVMENAARMLVLSRQRRRKPPLALRLMNGPLKSVVADRARKQVASKAPREHYPAPYAIVDIWQRFGGNALAVPAGHPASLEAILRSPTAKNLIRVFFLQERLKGFGKSDDNSGDLAPRRVHVVGAGVMGGDIAAVCALAGMTVTLQDQAVERIAPAVGRAAKLFERKLRGDTATKARQVRFALDRLIPDPHGHGARRADVVIEAIFENLDAKRALFAQLERRARPDAVLATNTSSLRIEDIGAELANPARLVGIHFFNPVAQMPLVEVVAGEASDADALYRAAAFVRRLDKLPLPVRSAPGFLVNAVLGPYMLEALRCVEEGVAPEAVDAALVAFGMPMGPVELVDTVGLDIALAAGRALGGGAVAVPKRLAELVAAGHLGRKSGQGYYRWSDGKAQKTPVDTVPAGLAARIVAPLLAATRRCVDEGVVADADLADAGVIFGTGFAPFTGGPLHYLASVGEKPLDAASARRDDAIVSAR

SEQ ID NO: 10048 - protein, 309 aa, Streptococcus pyogenes serotype M1
MIYLAGGCFWGVEEYFSQVDGVLDAVSGYANGRGDTTNYQLIHQTGHAETVEVAYDANRISLKELLLHFFRIIDPTSLNKQGNDRGSQYRTGIYYTDKADLAIIDEVFKEKAKDYKKKIVVEKAPLKHFIKAEDYHQDYLKKNPNGYCHIDINQATYPVIDESKYPKPSATEIKEKLSADEYRVTQKNETEKAFSNRYWDSFDAGIYVDVVTGEPLFSSKDKFESGCGWPSFSRPISPDVVRYKEDKSFNMTRTEVRSRSGNSHLGHVFTDGPKDQGGLRYCINSLSITFIPKADMEAKGYGYLLSSVE

SEQ ID NO: 10049 - protein, 688 aa, Ehrlichia canis
MDIDNNNVTTSSTQDKSGNLMEVIMRILNFGNNSDEKVSNEDTKVLVESLQPAVNDNVGNPSSEVGKEENAPEVKAEDLQPAVDGSVEHSSSEVGKKVSETSKEESTPEVKAEDLQPAVDGSIEHSSSEVGEKVSKTSKEESTPEVKAEDLQPAVDDSVEHSSSEVGEKVSETSKEENTPEVKAEDLQPAVDGSIEHSSSEVGEKVSKTSKEESTPEVKAEDLQPAVDDSVEHSSSEVGEKVSETSKEENTPEVKAEDLQPAVDGSVEHSSSEVGKKVSETSKEESTPEVKAEDLQPAVDDSVEHSSSEVGEKVSETSKEENTPEVRAEDLQPAVDGSVEHSSSEVGEKVSETSKEESTPEVKAEDLQPAVDSSIEHSSSEVGKKVSETSKEESTPEVKAEDLQPAVDGSVEHSSSEVGEKVSETSKEENTPEVKAEDLQPAVDGSVEHSSSEVGEKVSETSKEENTPEVKAEDLQPAVDGSVEHSSSEVGEKVSETSKEESTPEVKAEDLQPAVDDSVEHSSSEVGEKVSETSKEESTPEVKAEDLQPAVDGSVEHSSSEVGEKVSETSKEESTPEVKAEVQPVADGNPVPLNPMPSIDNIDTNIIFHYHKDCKKGSAVGTDEMCCPVSELMAGEHVHMYGIYVYRVQSVKDLSGVFNIDHSTCDCNLDVYFVGYNSFTNKETVDLI

SEQ ID NO: 10050 - protein, 234 aa, Streptomyces carzinostaticus subsp. neocarzinostaticus
MILAGGKGTRLRPYTSRLPKPLVPIGDEFSILEIVLSQLSQRGFDTVTLAIGYLGHLIRSFVGDGSRWNMHITYASEDTPRGTIGPVLGILDQLPEHFLVMNGDILTDLDYADVLAHHTRGEAPLTVATCTREVRIDFGVLTTTSNRVVHFVEKPTVDYRVSMGVYGLSRTTLETYPSHMPFGFDDLVLDLLARGVQPAEYPFDGYWLDIGRPDDYDRANAEFDSIKGTLLKGA

SEQ ID NO: 10051 - protein, 258 aa, Klebsiella pneumoniae subsp. pneumoniae MGH 78578
MMNPLIIKLGGVLLDSEEALERLFTALVNYREAHQRPLIIVHGGGCVVDELMKQLNLPVQKKNGLRVTPAEQIDIITGALAGTANKTLLAWAKKHGISSVGLFLGDGDSVKVTQLDAELGHVGLAQPGSPTLINTLLAGGYLPVVSSIGVTDEGQLMNVNADQAATALAATLGADLILLSDVSGILDGKGQRIAEMTAEKAEQLIEQGIITDGMIVKVNAALDAARALGRPVDIASWRHAEQLPALFNGTPIGTRILA

SEQ ID NO: 10052 - protein, 386 aa, Shigella flexneri 2a str. 301
MTNNPLIPQSKLPQLGTTIFTQMSALAQQHQAINLSQGFPDFDGPRYLQERLAYHVAQGANQYAPMTGVQALREAIAQKTERLYGYQPDADSDITVTAGATEALYAAITALVRNGDEVICFDPSYDSYAPAIALSGGIVKRMALQPPHFRVDWQEFAALLSERTRLVILNTPHNPSATVWQQADFAALWQAIAGHEIFVISDEVYEHINFSQQGHASVLAHPQLRERAVAVSSFGKTYHMTGWKVGYCVAPAPISAEIRKVHQYLTFSVNTPAQLALADMLRAEPEHYLALPDFYRQKRDILVNALNESRLEILPCEGTYFLLVDYSAVSTLDDVEFCQWLTQEHGVAAIPLSVFCADPFPHKLIRLCFAKKESTLLAAAERLRQL

SEQ ID NO: 10053 - protein, 356 aa, Aggregatibacter actinomycetemcomitans
MKKSKLVVALAAILSCAAIPTTVMAESNVQQTMEKSNMSEAKKDLHEIYLAGGCFWGIEAYMERIYGVEDAISGYANGKSDKTNYQKIGITDHAETVKVTYDRNKVSLDKLLKYYFQVIDPTSVNKQGNDRGRQYRTGIYYQDTADKSIIEKEITALQGKYKNKIQIEVEPLHNYIVAEEYHQDYLKKNPNGYCHIDLEQANYVIIDEKDYPKPSDAELKAKLTPLQYSVTQNKNTEHSFSNEYWDNFKPGIYVDVTTGEPLFSSKDKFESGCGWPSFTKPITKEVVTYQDDHSFNMLRTEVISRSGKAHLGHVFDDGPKDKGGLRYCINSAAVKFIPLEDMVKENYGYLTNAVKE

SEQ ID NO: 10054 - protein, 445 aa, Oryza sativa Japonica Group
MEVSASAAAEAGMMVGHGEWRDDDGRARRMGTVWTASAHIITAVIGSGVLSLAWAIAQLGWVAGPAVMLLFAFVIYYTSTLLAECYRSGDPCTGKRNYTYMDAVRANLGGSKVRLCGVIQYANLFGVAIGYTIAASISMLAIKRADCFHEKGHKNPCRSSSNPYMILFGVVQIVFSQIPDFDQIWWLSIVAAIMSFTYSTIGLSLGIAQTVANGGFMGSLTGISVGTGVTSMQKDTIKAPPPSEAKVMKRATMVSVATTTVFYMLCGCMGYAAFGDKSPDNLLTGFGFYEPFWLLDVANAAIVVHLVGAYQVFVQPIFAFVERWAAARWPDGGFISRELRVGPFSLSVFRLTWRTAFVCATTVVSMLLPFFGDVVGLLGAVSFWPLTVYFPVEMYIAQRGVRRGSARWLCLKVLSAACLVVSVAAAAGSIADVVDALKVYRPFSG

SEQ ID NO: 10055 - protein, 521 aa, Flammulina velutipes
MVRFQSFLPYLALFFAASAYAAIGPVADLVISNADVTPDGFTRAAVVVNEAFPSPLITGYKGDHFRLNVINRMTNHTMLKTTSIHWHGLFQRGTNWADGPAFVTQCPIASGDSFLYDFRVPGQAGTFWYHSHLSTQYCDGLRGPSVVYDPLDPLGWLYDVDDDSTVITLADWYHFAARLGPRFPAGLANSTLINGLGRSPDAPGADLAVVNVTHGKRYRFRLVSLSCDPSYTFSIDGHELTVIEADGVDTYPVTVNAIEIFAAQRYSFVLTANQTIDNYWIRANPNLGNLGFADGINSAILRYDGANAVEPVTSQQSTQILLKETDLHPFIPRWTPGRPEPGGVDLALNMAFDFNGTNFFVNNATFDPPPVPVLLQILSGKHAAQDLLPSGSVYALPSHSSIEITFPATARAPGGPHPFHMHGHVFAVVRSAGSSTYNYRNPVWRDTVSTGTSAANDNVTIRFRTDNPGPWFLHCHIDFHLQAGFAIALAEEIPRIPLANPVTYEWSRLCPVYDALAPEDQ

SEQ ID NO: 10056 - protein, 125 aa, Pyrococcus abyssi GE5
MATFKLVISDPKTGIAKQIEITGPEAEKLIGKRIGDQIPVKELGINLNELFGKEFPEDVKMEIRGGTDKDGFPMRPDIHGPRRVRILLSKGPGFRPKEKGERRKKTVRGNTISPEIVQVNVKLVY

SEQ ID NO: 10057 - protein, 386 aa, Rickettsia typhi str. Wilmington
MNIHEYQAKEILRKYGVPTSTGLVVTKTEKINEAIDKLNTKVYVVKAQIHAGGRGKAGGVKVVKSKEEAKKVAHDMFGINLVTHQTGPQGQKVNHLYIESGCDILKEYYFSIVFDRSASCITFIASTEGGVDIEAVAEKMPEKIIKFAVDPATGLQDFHMRGIAYGLGFKDSQAKQMKEIVKSVYNAFIETDATQIEINPLIINSYKNLLALDAKITFDDNGLFKHPNITAMRDHDEEDPLETRAANAGLSYVKMDGNIGCMVNGAGLAMATMDIIKLYGASPANFLDVGGGADRERVKEALKIILSDKEVKGILVNIFGGIMRCDIIAEGIIAAARDIGITVPLVVRLAGTNVEKGKEILSNSNLKIIPAHDLADAANKIVEAIR

SEQ ID NO: 10058 - protein, 366 aa, Glycine max
MFSFLLLFSAMEDEPFLTTTSQPIADCLLPSSKSFNDVTTTRARDVAAAAAEEIQSEQQQPPKKKKLSRCKTAPAMVTMRDLKPKTPQLPKPQSSSIIRQGMWLLAVYLSIGVVIYSFNRDRFSGIETHPVVDALYFCIVTMCTIGYGDIAPLTPFTKIFACAFVLVGFGFIDILLSGLVNFVLDLQENMILTGLQMGASEREGFSARNYIVDVAKGRMRIRLKVGLALGVVVMCIGIGSLVLYFVEGLDWVDSIYLSVMSVTTVGYGDRAFKTLPGRLFAAIWLLFSTLMVARAFLYLAEARIDRRHRRMAKKVLHREITVQDLLAADINNTGFIRYQYHHHFSSNLFLLLLLCFKLRLRFHRHV

SEQ ID NO: 10059 - protein, 277 aa, Pyrococcus abyssi GE5
MKSLLTFKTLLNFKYLIRPRSEEILGVRAMIVVFVGTAGSGKTTLTGEFGRYLEDNYKVAYVNLDTGVKELPYEPSIDVREFVTVEEIMREGYGPNGAIVESYDRLMEKFNEYLNKILRLEKENDYVLIDTPGQMETFLFHEFGVRLMENLPYPLVVYISDPEILKKPNDYCFVRFFALLIDLRLGATTIPALNKVDLLSEEEKERHRKYFEDIDYLTARLKLDPSMQGLMAYKMCSMMTEVLPPVRVLYLSAKTREGFEDLETLAYEHYCTCGDLT

SEQ ID NO: 10060 - protein, 316 aa, Haemophilus influenzae
  misc_feature (42)..(42): Xaa can be any naturally occurring amino acid
MAIYADNSYSIGNTPLVRLKHFGHNGNVVVKIEGRNPSYSVXCRIGANMVWQAEKDGTLTKGKEIVDATSGNTGIALAYVAAARGYKITLTMPETMSLERKRLLCGLGVNLVLTEGAKGMKGAIAKAEEIVASDPSRYVMLKQFENPANPQIHRETTGPEIWKDTDGKVDVVVAGVGTGGSITGISRAIKLDFGKQITSVAVEPVESPVISQTLAGEEVKPGPHKIQGIGAGFIPKNLDLSIIDRVETVDSDTALATARRLMAEEGILAGISSGAAVAAADRLAKLPEFADKLIVVILPSASERYLSTALFEGIEG

SEQ ID NO: 10061 - protein, 143 aa, Bacteroides thetaiotaomicron
MKFGIVVSEWNFNITGALLNGAVNTLKKHGVKDENILVKTVPGSFELTFGANQMMENCDVDAIIAIGCVIKGDTPHFDYVCMGATQGITELNATGDIPVIYGLITTNTMEQAEDRAGGKLGNKGDECAISAIKMIDFVWSLNK

SEQ ID NO: 10062 - protein, 492 aa, Burkholderia thailandensis E264
MSAMSVYGLQRLYIAGAYADATSGKTFDTFDPATGELLASVQQASADDVERAVASAREGQREWAAMTSMQRSRILRRAVELLRERNDALAELEMRDTGKPIAETRAVDIVTGADVIEYYAGLATAIEGLQVPLRPESFVYTRREPLGVCAGIGAWNYPIQIACWKSAPALAAGNAMIFKPSEVTPLSALKLAEIYTEAGVPAGVFNVVQGDGSVGALLTAHPGIAKVSFTGGVETGKKVMSLAGASSLKEVTMELGGKSPLIVFDDADLDRAADIAVTANFFSAGQVCTNGTRVFVQQAVKDAFVERVLERVARIRVGKPSDPDTNFGPLASAAQLDKVLGYIESGKAEGAKLLAGGARLVNDHFASGQYVAPTVFGDCRDDMKIVREEIFGPVMSILSFETEDEAIARANATEYGLAAGVVTENLSRAHRAIHRLEAGICWINTWGESPAEMPVGGYKQSGVGRENGITTLEHYTRIKSVQVELGRYQPVF

SEQ ID NO: 10063 - protein, 426 aa, Vitis vinifera
MAMGTSEAVLQVFSGAVPCLFGSDPCFSKSDSMSPFKSHIKSVKKRGSRYMLKCSYMIRSHIMTHRLHGVGGGLYGNTSIHRSQLQSCKCQRADSVSGIASEAGNGTWFVDNAKKRNPINGVMDTPNVLEFQDVQELKPEMEGSISNGAVETARDTFVKVRVDSIEDEAWDLLRESMVYYCGSPIGTIAAKDPTSSNVLNYDQVFIRDFIPSGIAFLLKGEYDIVRNFILHTLQLQSWEKTMDCHSPGQGLMPASFKVRTVPLDGDDSATEEVLDPDFGEAAIGRVAPVDSGLWWIILLRAYGKCSGDLSVQERIDVQTGIKMILRLCLADGFDMFPTLLVTDGSCMIDRRMGIHGHPLEIQVCKGEKLFLHEILMEFPKIFCTALYFLGSLFTSVEDLVRVLGCRVGNLPTNYLGLPLGAPFKSS

SEQ ID NO: 10064 - protein, 393 aa, Ralstonia eutropha JMP134
MDPQRLATASRLANIDAFHVMELAKQANELERVGRHIIHMGIGEPDFTAAEPVVRAAEAAMRRGVTQYTGALGIHALREAIAGYYKTMYGLEIPARRVIVTAGASGALLLACAVLVEIGAEVLMPDPSYPCNRHFVAAFDGAARMIPSGPAERFQLTAAQVEAHWNERTRGVLLASPSNPTGTSILPDELGRILQAVRARQGFAILDEIYQGLSYDAPPVSALSLDDNVVTVNSFSKYFNMTGWRLGWLVVPDALVADFEKVAQNLFICASAVAQHAALACFSPEAMAIYDERKAEFRRRRDLIVPALESLGLHVPVMPDGAFYVYADCRQVNHPAAGDADKLTQAMLHDAGVVMVPGQDFGPHTAQDYIRISYATSRQNIEEAMARLQKLFR

SEQ ID NO: 10065 - protein, 410 aa, Zea mays
GSTRRRPAGFAPLRPVLANLQEVFLGTKLAVLFPAVPLAIAAQCAHFGQVWVFTLSLLGLIPLAERVSFLTEQIAIYTGPTVGGLLNATCGNATELIIALFALMGGQIEVVKCSLLGSVLSNLLLVLGTSLFCGGVVNLGSDQPYDRTQADVSTGLLILGVLCQSLPLLLRYAVGAGEHSVAAPTTVLDLSRACSVVMLLAYVAYLFFQLKTHAQLFEPQEVDDGCEAEEDEQAVIGFASGLFWLAFNTVLIAILSEYVVGTIEPTSKSWGLSVSFISIILLPIVGNAAEHAGAIIFALKNKLDITLGVALGSATQISMFVVPLSVIVAWIAGIQMDLDFKLIETGSLFVSVIVTAFTLQDGSSHYLKGILLLLCYIVIGACFFVTRQPASNNNGAGLSLPTGTLSAQAA

SEQ ID NO: 10066 - protein, 167 aa, Ralstonia eutropha JMP134
MDHGFYPSNLDGEGLRIGIVQARFNEPVCAELLEACVAELEKLGVEGEDTLVVTVPGALEVPLALQKMAESGQFDALVALGAVVRGETYHFELVSNESGAGITRVGLDFNMPVANGILTVDTDEQAHARTREKGRDCARAAVEMANLVVALDSLRDQEDEEDEDDDE

SEQ ID NO: 10067 - protein, 509 aa, Gloeobacter violaceus PCC 7421
MGTRTTLSTTCGVIAAGHAETAAAGVKILRLGGNAFDAAVAGMLASFVAEATLTSAGGSGFLLAHTATGEDILFDFFSQTPLRRRAAREVNFYPVSVNFGDAAQEFHIGPGSMAVPGNVAGLFHVHRRLGRLPMAVVAAPAVALAKNGLLVSDFQSFCQSVLEPILLATPEARQIFAPVGRLLAPGERLSMPEFADTLEWLVAEGPAVFYEGEIARRLVADSERLGGHLTARDLREYRVIERVPLGCGYRGYRVLTNPEPSAGGTLIAFALRLLEQADCIRQSYASPEHLGLLANVMRLTDEARRHDFASGSEALLSAGTLARYVRRLTKPWGSTTHLSVLDEEGNAASVTSTNGEGSAYVIPGTGIMVNNMLGEDDLHPEGFESWAENRRIASMMAPSLVLEDGRPWVVLGSGGSKRIRTALLQVISNLVDFQMPLSEAVASPRLHWENHVLHLEPGLLAPTHSLHDAVIRWREQNFFFGGVHAVACDALGNLTGSGDGRRNGAARFS

SEQ ID NO: 10068 - protein, 391 aa, Ralstonia eutropha JMP134
MFERPPDSWPPLAPICRPAAMTIARTEDIIADIRAGRMVILVDEEDRENEGDLVLAADFVTPDAINFMAKHGRGLICLTLTAERCRQLNLQPMVSRNGTQHGTNFTVSIEAAEGVTTGISAADRSRTVEAAVARDAKPSDLVQPGHIFPLTAQPGGVLIRAGHTEAGCDLGALAGLTPAAVICEIMKDDGTMARLPDLIEFAQEHNLKIGTIADLIHYRSRTESIVERVGERAMETPYGTFHSIAYRDKPTGHAHLALVKGTPSADKETLVRVHEPLSVLDLLEVSRTTHSWSMPAALEAIAKAESGVMVLLNCGDSADQLFTQFTALDEPQNRPRRKPDLRTYGMGAQILKDVGVGKMRVLAAAQRMPSMTGYDLEVTGYQPMNGQAKQN

SEQ ID NO: 10069 - protein, 577 aa, Bacillus thuringiensis serovar konkukian str. 97-27
MNRGRDVMSKFTVASNGSLETTLRGVEVLSTPLLNKGVAFTQEEREELGLKGLLPPAVLTLEEQARRAYEQFCSQPDDLLKNVYLTALHDRNEVLFYRILTDHLREMLPIVYTPTVGVAIQRYSHEYRKPRGVYLSINDPSGIEEAFANIGATAENIDLVVVTDGEGILGIGDWGVGGINIAIGKLAVYTAAVGIDPSRVLPVILDVGTNREELLDNPFYIGNRHPRITGEAYDEFIDTFVQAVNKQFPKALLHWEDFSSRNARKILDKYRHDICTFNDDIQGTGAVSLAAVLSAVKASGVPLSEHRVVVFGAGTAGIGIADQVRDAMVRVGVSEEESYKRFWCIDRNGLVTDNMEDLLDFQMPYARKEAEVSEWKENGVIGLAEVVKQVKPTILIGTSTVAGAFKEEIIKEMASHVERPIILPMSNPTPLAEAKPADLIKWTEGRALVATGSPFEPVTYNGVTYVIGQSNNALIFPGLGLGTIVVRASVMTDGMFAAAAEAVASMVDTSQPGAPILPEVEELRNISEMVAIEVAKVAVAEGVARENLSDNDIKIAVKEAIWEPEYRQIKAVEKVTI

SEQ ID NO: 10070 - protein, 466 aa, Klebsiella pneumoniae subsp. pneumoniae MGH 78578
MSHSWDYDAIVIGSGPGGEGAAMGLVKQGARVAVIERYHNVGGGCTHWGTIPSKALRHAVSRIIEFNQNPLYSDHSRLLRSSFADILNHADSVINQQTHMRQGFYERNHCEILQGNAHFVDEHTLALECHDGTVETVTAEKFVIACGSRPYHPADVDFHHPRIYDSDSILSLQHEPRHVIIYGAGVIGCEYASIFRGMEVKVDLINTRDRLLAFLDQEMSDSLSYHFWNSGVVIRHNEEYEKIEGVDDGVIMHLKSGKKLKADCLLYANGRTGNTDTLALENIGLQTDSRGQLKVNSMYQTALPHIYAVGDVIGYPSLASAAYDQGRIAAQALVKGEASAHLIEDIPTGIYTIPEISSVGKTEQQLTAMKVPYEVGRAQFKHLARAQIVGMSVGTLKILFHRETKEILGIHCFGERAAEIIHIGQAIMEQKGGGNTIEYFVNTTFNYPTMAEAYRVAALNGLNRLF

SEQ ID NO: 10071 - protein, 512 aa, Zea mays
  misc_feature (494)..(494): Xaa can be any naturally occurring amino acid
  misc_feature (504)..(504): Xaa can be any naturally occurring amino acid
MGNSEVGHNALGAGRIFAQGAKLVDQALASGKIYDGDGFNYIKESFENGTLHLIRLLSDGGVHSRLDQLQLSYKRTTRFTFICSIQLLLKGVSERGAKKIRVHILTDGRDVLDGSSVGFVETLENDLLELRGKGIDAQIASGGGRMYVTMDRYENDWDVVKRGWDAQVLGEAPYKFKSALEAVKTLRAQPKANDQYLPPFVIVDDSGKAVGPVLDGDAVVTINFRADRMVMLAKALKYDGEWKLPSHYLVSPPEIDRTSGEYLVKNGIRTFACRQGHLPSGKIMSQAISTILYCIGTRIFDICRNEFFLGETVKFGHVTFFWNGNRSGYFDETKEEYVEVPSDSGITFNVAPKMKALQIAEKARDALLSGKFDQVRVNLPNGDMVGHTGDIEATVVACKAADEAVKIILNAVEQVGGIYLVTADHGNAEDMVKRNKSGKPLLDKNGGIQILTSHTLQPVPVAIGGPGLHPGVKFRNDIQIPGLANVAATVMNLXGFEAPADYEXTLIEVADN

SEQ ID NO: 10072 - protein, 434 aa, Synechococcus elongatus PCC 7942
MDSLAALARDRGIRYFLIAFTDLFGVQRAKLVPASSIDLMATSGAGFAGFAAWLDLSPADADVLAIPDRDSLFQLPWQPEVAWMPADLYLNDQPLEQAPRWVLKRVLSVAESLGYRPKTGVECEFFLLDETGDAIADPRDRQAKPCYDQQSLMRRYDLITQISEAMEELGWGPYQSDHEDANGQFEMNWTYADALVTADRQAFFKYMVKTLAERQGLRATFMPKPFADLTGNGCHMHLSLWNREGTTNTFVDPVATAPLSTLGYQFIGGLLHSAASLCALTNPTINSYKRINAPATTSGATWSPNGISYSGNNRTHLIRIPDAGRFELRLADGAANPYLLPAAAIAAGLDGIQNKRDPGPRYDNDNYAQPLPPGTVPTLPEHLLDALRSLQESTVLTEGLGAAFTSAYLKLKHQEWRSFCAEITPWERATTLDC

SEQ ID NO: 10073 - protein, 119 aa, Zea mays
MAGRLTAAGSRILGGGGARAAASALRHRAGMGLPVGRHIVPDKPLPVNDELVWDNGTPFPEPCIDRLAPHIGKYEALAWLCGGLGFFAALGMAAVVNDKASNIPYTPKVYPYDNFDKAL

SEQ ID NO: 10074 - protein, 412 aa, Shigella flexneri 2a str. 301
MKALTYHGPHHVQVENVPDPGIEQADDIILRITVTAICGSDLHLYRGKIPQVKHGDIFGHEFMGEVVETGKDVKNLQKGDRVVIPFVIACGDCFFCRLQQYAACENTNAGKGAALNKKQIPAPAALFGYSHLYGGVPGGQAEYVRVPKGNVGPFKVPPLLSDDKALFLSDILPTAWQAAKNVQIQQGSSVAVYGAGPVGLLTIACARLLGAEQIFVVDHHPYRLRFAADRYGAIPINFDEDSDPAQSIIEQTAGHRGVDAVIDAVGFEAKGSTTETVLTNLKLEGSSGKALRQCIAAVRRGGIVSVPGVYAGFIHGFLFGDAFDKGLTFKMGQTHVHAWLGELLPLIEKGLLKPEEIVTHYMPFEEAARGYEIFEKREEECRKVILVPGAQSAEAAQKAVSGLVNAMPGGTI

SEQ ID NO: 10075 - protein, 291 aa, Dunaliella salina
MASMTGGQQMGRGSEEPNPNDGYDYMQHGFDWPGLQEGGTTKYPACSGSNQSPIDINTNQLMEPSSRSGTSAVSLNGLNVDGAQADGITLTNAKVDLEQGMKVTFDQPAANLPTIEIGGTTKSFVPIQFHFHHFLSEHTINGIHYPLELHIVMQEQDPADVATAQLAVIGIMYKYSENGDAFLNSLQTQIEGKIGDGTASYGDTGVSIDNINVKTQLLPSSLKYAGYDGSLTTPGCDERVKWHVFTTPREVTREQMKLFVDVTMGAHAGADVVNNRMIQDLGDREVYKYNY

SEQ ID NO: 10076 - protein, 355 aa, Medicago sativa
MNSLRAVAIALCCIVVVLGGLPFSSNAQLDPSFYRNTCPNVSSIVREVIRSVSKKDPRMLASLVRLHFHDCFVQGCDASVLLNKTDTVVSEQDAFPNRNSLRGLDVVNQIKTAVEKACPNTVSCADILALSAELSSTLADGPDWKVPLGRRDGLTANQLLANQNLPAPFNTTDQLKAAFAAQGLDTTDLVALSGAHTFGRAHCSLFVSRLYNFSGTGSPDPTLNTTYLQQLRTICPNGGPGTNLTNFDPTTPDKFDKNYYSNLQVKKGLLQSDQELFSTSGSDTISIVNKFATDQKAFFESFRAAMIKMGNIGVLTGNQGEIRKQCNFVNSKSAELGLINVASADSSEEGMVSSM

SEQ ID NO: 10077 - protein, 287 aa, Cryptococcus neoformans var. neoformans JEC21
MRYAVLVTGPAGAGKSTFCASLITHAQTIGRSVHLVNLDPAADKFEYEPTIDIRDLINLEDVMEELEFGPNGGLIYCFEYLLNNLDWLEDELGAYEDDYLIIDCPGQIELYTHVPLLPRLATFLSTSLNFRTSAVYLIDSQFMQDKSKFFAGVMSAMSCMLSLGISMLCLMSKMDLVKDKKGRTKREVGRYLDPDPNLLLEDINQGTNSKFNQLNRAVVSLIEDQNIVSFLPLDVTSEDSVNTVLSHIDNMMQYGEDEEPKVPKDMDDGEFVAPPRSYNIKLIVRDR

SEQ ID NO: 10078 - protein, 320 aa, Rickettsia typhi str. Wilmington
MNKFKNIAVYGGGSFGTSLASVVARNCNNVTLFLRNETILKEILYKKTNVQYLGDIKLPTNLQATTNLSVIKDFDLIIIAVPSYAFVDAIKLLKTYGISKDNTLLVATKGFAHNPTELLSDRLNTLLPDNPIGFLSGPNLAKELAKNLHTSASIASLDIDIANKIAHNLSSKTFTTNTTIDIVTLQVAGALKNIFAIKSGIDLAREQGANSRAMLIVAALKEITTLSKVLGGMQKNSDILLEAGVVGDLVLTCYSLGSRNTKFGYEFEISMDKKKFLREYKELVEGREALKLVLDLIKKYNLHMPIVSEVASLIHCGIYI

SEQ ID NO: 10079 - protein, 467 aa, Pseudomonas aeruginosa UCBPP-PA14
MGLNADWMQRDLNVLWHPCTQMKDHERLPVIPIRRGEGVWLEDFEGKRYIDAVSSWWVNVFGHANPRINQRIKDQVDQLEHVILAGFSHQPVIELSERLVKITPPGLDRVFYADSGSAGIEVALKMSYHFWLNSGRPRKKRFVTLTNSYHGETIAAMSVGDVALFTETYKSLLLDTIKVPSPDCFLRPDGMCWEEHSRNMFAHMERTLAEGHDEIAAVIIEPLIQGAGGMRMYHPVYLKLLREACDRYGVHLIHDEIAVGFGRTGTMFACEQAGIAPDFLCLSKALTGGYLPMSAVLTSETIYRGFYDDYQTLRAFLHSHTYTGNPLACAAALATLDIFEEDKVIEANRALSTHMARATAHLADHPHVAEVRQTGMVLAIEMVQDKASRTPYPWQERRGLKVFQHGLERGALLRPLGSVVYFLPPYVITPEQIDFLAEVASEGIDIATRDAVSVAVSDFHPDHRDPG

SEQ ID NO: 10080 - protein, 358 aa, Medicago sativa
MNSLATSMWCVVLLVVLGGLPFSSDAQLSPTFYSKTCPTVSSIVSNVLTNVSKTDPRMLASLVRLHFHDCFVLGCDASVLLNNTATIVSEQQAFPNNNSLRGLDVVNQIKLAVEVPCPNTVSCADILALAAQASSVLAQGPSWTVPLGRRDGLTANRTLANQNLPAPFNSLDQLKAAFTAQGLNTTDLVALSGAHTFGRAHCAQFVSRLYNFSSTGSPDPTLNTTYLQQLRTICPNGGPGTNLTNFDPTTPDKFDKNYYSNLQVKKGLLQSDQELFSTSGADTISIVNKFSTDQNAFFESFKAAMIKMGNIGVLTGTKGEIRKQCNFVNFVNSNSAELDLATIASIVESLEDGIASVI

SEQ ID NO: 10081 - protein, 456 aa, Cryptococcus neoformans var. neoformans JEC21
MAARNWSRVWVGGTVILISFIAFSSQIFVIWPWYGREISLDLLKLLVPLNLAAFMIFWNYRLCVITSPGSVPEGWRPNIGAMDGMEVKKGTHTPRYCKNCEHYKPPRAHHCRQCKTCWVNHCPWIGNCVGFYNQGHFIRFLLWVDIGTTFHLIIMVRRVLYIAEYYHQEPTLADVLFLVFNFATCVPVWLCVGMFSIYHVYLACGNSTTIEGWEKDKVATLIRRGKIKEVKYPYNIGIYKNIKSVLGPNPFLWLWPQKMQGDGLSFPVNPSAGDHTTQYFWPPQDPSRLPNPPPIPAHASPFVYGNNGFNPNLQPTNSLRARRSSTPHIDEDEHSHERDQYRHYSSGEERDNDSISTSSSPKPYLSDYDHYDEGPMYPGERMTALIPRVRRGSEGWEVAPGGGWNAYSGMMDEEVGWDDEVGYDEAPGEGPYVERPWEMRGRYNVYDTEEESGYAH

SEQ ID NO: 10082 - protein, 389 aa, Salmonella enterica subsp. enterica serovar Paratyphi B str.
MKIMRNNPLIPKSKLPNLGTTIFTQMSALAQKHQAINLSQGFPDFDGPRYLHERLAYHVAQGANQYAPMTGAQALREAIADKTAEIYGYRPDDVSDITVTAGATEALYAAITALVRAGDEVICFDPSYDSYAPAVALSGGVLKRIALTPPHFRVDWQAFSALLSERTRLVILNTPHNPTATVWRQADIEALWQAIGEREIYVLSDEVYEHICFAAEGHASVLAHPQLRERAVAVSSFGKTFHMTGWKIGYCVAPAAISAEIRKVHQYLTFCVNTPAQLALADMLRAAPEHYRALPDFYRKKRDVLVNALAQSRLKVLPCEGTYFLLIDYSAVSTLNDVEFCQWLTEEVGVAAIPLSVFCAAPFPHQLIRLCFAKQESTLLAAAERLCKL

SEQ ID NO: 10083 - protein, 272 aa, Bacillus cereus E33L
MNKQIGFIGCGNMGIAMIGGMIKKNIVSPDQIICSDLNVINLKNASNEYGITITTNNNEVANSADILILSIKPDLYSSVINQIKDQIKNDVIVVTIAAGKSIKSTENEFGRKLKVVRVMPNTPALVGEGMSALCFNEMVTEKDIKEVLNIFNIFGQTEVVNEKLMDVVTSISGSSPAYVYMFIEAMADAAVLGGMPRKQAYKFAAQAVLGSAKMVLETGIHPGELKDMVCSPGGTTIEAVVTLEEKGLRTAIISAMKRCMQKSMEMSSLTSK

SEQ ID NO: 10084 - protein, 169 aa, Oryza sativa Japonica Group
MATGGPSSMSAGLLFLNLVLYVVVAVIAGWAINYSIDESFNSLQGVSPPVRLFPIYFPIGNLATGFFVIFALLAGVVGVSTSLTGLHDVSQGYPASMMSAAAASIVTWTLTLLAMGLACKEISIGWRPPSLRALETFTIILAGTQLLCAGSLHAGAHVAIIQNPMVSRV

SEQ ID NO: 10085 - protein, 333 aa, Rickettsia typhi str. Wilmington
MNLLLQSPQNVAIAHNRIKQYINLTPIIHSESLNEMLGHEIFFKVESLQKTGAFKVRGVLNNLLELKEQEKLPNKIVCYSSGNHGIGLAYSSKLFGIKTRIYLPLNTSKVKLQAALYYGCEVIYTNTRQEAESRAKEDEEQGFYYMHPSDSDSIIAGAGTLCYEALQQLDFIPDAIFASCGGGGLISGSYLAKELISPTSLLIGSEPAAANDAYLSIKNNNIYRFNDTPITIADGLKTLSVSARTFEYLKKLDHFYLAEEYEIYYWTAWLIHLLKVICEPSSSINMVSVISWLKTQTRTQKLLVLISGGNIDPTLYNELWQDDYLTVPPSISN

SEQ ID NO: 10086 - protein, 820 aa, Magnaporthe grisea 70-15
MSADPSQDPPKKKVNLADVSGADVKEESDVATAILKKKKKPNQLMVADATNDDNSIIALSNSTMEALQLFRGDTVLVRGKKRKDTVLIVLADDELDDGSARLNRVVRHNLRVKHGDVVTIHPCPDIKYAKRIAVLPIADTVEGLTGSLFDVFLAPYFREAYRPVRQGDIFLVRGGMRQVEFKVVEVDPPEYGIVAQDTVIHCEGEPIQRDEEENNLNEVGYDDIGGCRKQMAQIREMVELPLRHPQLFKSIGIKPPRGVLLYGPPGTGKTLMARAVANETGAFFFLINGPEIMSKMAGESESNLRKAFEEAEKNSPAIIFIDEIDSIAPKREKTNGEVERRVVSQLLTLMDGMKARSNVVVMAATNRPNSIDPALRRFGRFDREVDIGIPDPTGRLEILQIHTKNMKLGDDVDLEQIAAETHGYVGSDVAALCSEAAMQQIREKMDLIDLDEDTIDAEVLDSLGVTMENFRFALGVSNPSALREVAVVEVPNVRWEDIGGLDEVKQDLREQVQYPVDHPEKFLKFGLSPSRGVLFYGPPGTGKTMLAKAVANECAANFISVKGPELLSMWFGESESNIRDIFDKARAAAPCIVFLDELDSIAKARGGSVGDAGGASDRVVNQLLTEMDGMTSKKNVFVIGATNRPEQLDPALCRPGRLDSLIYVPLPDELGRLSILKAQLRKTPVSDDVDLQYIANKTHGFSGADLGFITQRAVKIAIKESITADINRTKALEAAGEDVPMDEDAEDPVPELTKRHFEEAMQQARKSVSDVEIRRYEAFAQQMKNAGPGAFFKFPEGEGAPAASGGETFNDGGNDDGLYD

SEQ ID NO: 10087 - protein, 395 aa, Gloeobacter violaceus PCC 7421
MFAFISHLICPRCDSRFDPRKVHNLCTACASPLLVEYDLEQVRASVDKETLARRGESMWRYRELLPVMDPAHIVSFGEGFTPLLPIDALTRTWGLETVWIKDDGLNPTGSFKARGASCGISKAKELGIREVALPTAGNAGGAWACYGAAAGLRVHVAMPRDAPAVNQLECRLYGADLTLVDGLISDAGKLIAQGVREHGWFDVSTLKEPYRIEGKKTLGLELAEQMNWQLPDAILYPAGGGVGIIGIWRGLQQLKAMGWVTGSLPRLIVVQAEGCAPLVKAFEEGRTESEFWPDARTFASGLRVPKALGDFLVLQAVRETGGTAIAVSDEQCGEMMKLLAGRTGIFAAPEGAATLAAAKILRERGDLASRDRVVLINTGSALKYPEAMSEALAMR

SEQ ID NO: 10088 - protein, 639 aa, Pseudomonas aeruginosa UCBPP-PA14
MSFSSLGLSEALARAVEAAGYSQPTPVQQRAIPAVLQGRDLMVAAQTGTGKTGGFALPVLERLFPAGHPDREHRHGPRQARVLVLTPTRELAAQVHDSFKVYARDLPLNSTCIFGGVGMNPQIQALAKGVDVLVACPGRLLDLAGQNKVDLSHVEILVLDEADRMLDMGFIHDVKKVLAKLPPKRQNLLFSATFSKDIVDLANKLLHNPERIEVTPPNTTVERIEQRVFRLPAPQKRALLAHLVTVGAWEQVLVFTRTKHGANRLAEYLTKHGLPAAAIHGNKSQNARTKALADFKANDVRILVATDIAARGLDIDQLPHVVNYELPNVEEDYVHRIGRTGRAGRSGEAISLVAPDEEKLLKAIEKMTRQRIPDGDAQGFDPEAVLPEVAQPEPREAPQKQPRRDKERRSSRERKPKDAQASNPDSNVAAAQDGTEKPAGKRRRRGGKNKENREAGQAQQPRQSREARPAKPNRPPEVDGNRDPEEFLDDDFDNFGNRADYVSPYQGQENKGRGRRGGQQKPQGGTGQQGRGQGQGQARGKSQGAAQGGARGQGAGQGKAKKPRASKPRGQGRENASRMSDAPLREPSEYGTGKQPSRQPVVINKRDLVRMDRFPTAEQLDELEPRRKGERPALLTRNR

SEQ ID NO: 10089 - protein, 154 aa, Aquifex pyrophilus
MKTYEGELIAEGLRFGIVASRFNHALVDRLVEGAIDCILRHGGREEDITLVRVPGSWEIPVAVGELARREEIDAVIAIGVLIRGATPHFDYIASEVSEGLANLSLELRKPITFGVITADTLEQAIERAGTKHGNKGWEAALSAIEMANLFKKLR

SEQ ID NO: 10090 - protein, 147 aa, Oryza sativa Japonica Group
MNIERLKQLVDLVGKHRLVLDLSCRKKDGRYAIVTDRWQKFSDVFVDEPTLKHLAAYADEFLVHGVDVEGKRLGIDEELVELLGRYSPIPVTYAGGVSTMDDLERIKRAGNSRVDVTVGSALDIFGGDLPYKDVVLWHKEQNMVSQP

SEQ ID NO: 10091 - protein, 208 aa, Triticum aestivum
  misc_feature (205)..(205): Xaa can be any naturally occurring amino acid
MLGTNTMESRMDQYEIMEQIGRGAFGAAILVNHKTEKKKYVLKKIRLARQTERCRKSAHQEMALIARLQHPYTVEFKEAWVEKGCYVCIVTGYCEGGDMAELMKKANGTYFPEEKLLRWFAQLALAVDYLHSNYVLHRDLKCSNIFLTKDHDIRLGDFGLAKTLKADDLTSSVVGTPNYMCPELLTDIPYGFKSDIWSLGCCMYXMAA

SEQ ID NO: 10092 - protein, 160 aa, Candida tropicalis
MSDLCPVYAPFFGSIGCAAAIVFTCFGASYGTAKSGVGICATSVTRPDLLVKNVVPVVMAGIIAIYGLVVSVLVSDSLSQKQALYTGFIQLGAGLSVGLSGLAAGFAIGIVGDAGVRGTAQQPRLFVGMILILIFAEVLGLYGLIVALLLNSRASQDVTC

SEQ ID NO: 10093 - protein, 445 aa, Arabidopsis thaliana
MEVGFKALLDDLDVLEKSLSDPALINKLRSHVENLATLSKCNPHRRSKVKELSSEVVDSNPYSRLMALQRMGIVDNYERIREFSVAIVGIGGVGSVAAEMLTRCGIGRLLLYDYDTVELANMNRLFFRPDQVGMTKTDAAVQTLAEINPDVVLESFTMNITTVQGFETFTSSLTNKSFCPSKEGGSGVDLVLSCVDNYEARMAVNQACNELRQTWMESGVSEDAVSGHIQLLVPGETACFACAPPLWNMGGFKDSVIQGIVVASGIDERTLKREGVCAASLPTTMGVVAGLLVQNSLKFLLNFGEVSPYLGYNSLKDFFPTMKMRPNPQCSNVACLERQKEYMLAKPERDAAAKAKMEADASTTIDEGPLHDDNEWNISVVDDENEKDTTKAASSSDTLPEGLTRELPVADEYEKAIAIASGSGETEEEDDLEDLKKQLEALNAA

SEQ ID NO: 10094 - protein, 219 aa, Burkholderia vietnamiensis G4
MAFLLHQARFYTTVNHLRDLPPTVQPEIAFAGRSNAGKSTAINVLCNQKRLAFASKTPGRTQHINYFSVGPAAEPVANLVDLPGYGYAEVPGAAKAHWEMLLSSYLATRSQLCGLILMMDSRRPLTDLDRRMIEWFAPTGKPIHTLLTKCDKLTRQESINALRNTQKGLDAYRDQGVKGKLTVQLFSALKRTGLDEAHELIESWLRPSVADAEGAPVAQ

SEQ ID NO: 10095 - protein, 514 aa, Klebsiella pneumoniae subsp. pneumoniae MGH 78578
MADSQPLSGAPEGAEYLRAVLRAPVYEAVQKTPLQKMDKLSSRLDNVILVKREDRQPVHSFKLRGAYAMMSSLTAEQKSHGVITASAGNHAQGVAFSASRLGVKALIVMPVATADIKVDAVRGFGGEVLLHGANFDEAKARAIELAQQQGFTWVPPFDHPMVIAGQGTLALELLQQDAHIDRVFVPVGGGGLAAGVAVLIKQLMPQIKVIAVEAEDSACLKAALDAGHPVDLPRVGLFAEGVAVKRIGDETFRLCQEYLDDIITVDSDAICAAMKDLFEDVRAVAEPSGALALAGMKKYIAQHNIRGERLAHILSGANVNFHGLRYVSERCELGEQREALLAVTIPEEKGSFLKFCQLLGGRSVTEFNYRFADAKDACIFVGVRLSRGLEERKEILQLLNDGGYSVVDLSDDEMAKLHVRYMVGGRPSKALQERLFSFEFPESPGALLKFLHTLGTHWNISLFHYRSHGTDYGRVLAAFELGEHEPDFETRLNELGYECHDETHNPAFRFFLAG

SEQ ID NO: 10096 - protein, 1073 aa, Rhodococcus sp. RHA1
MTLLVANRGEIALRIIRTAEEMSVDTVAVYAEDDADSPHVRAATEAVALRGSGPSAYLDPRAILGAAAEFGATAVHPGYGFLSENAAFARACAEAGLTFVGPSPDVLDIFGDKSSAREAAVAAKVPVLTATTGPTDLDGVRAFFAEHPGGIMIKALAGGGGRGIRAVRSADRVEEEYRLCASEAQLGFGNPALFAEALLDGARHIEVQVVAAPQAGVTRALAVGDRDCSVQRRHQKLVEIAPAQGLDPGLRSELHEAAARLCASVGYRGLATVEFLVFRDGFVFLEVNPRIQVEHTVTEEVTGVDLVAVQIDVARGADYGDLSLPDGVSAVGLDTSGTPAAARGIAVQARVNMETMRPDGQAVPAAGTLSVFSPPTGPGVRVDTYGRPGLSPSPRYDSLLAKVIVHSRGPSFSAAVRKADAALAEFVVEGVPTNIGFLRAILADPGFADGVVGTDHLAERMSALVDAAHVHQPAEVASETLELRAGEDVLRAHMAGTVVEAAGEGATVESGAQLVVLEAMKMQHVIAAPAGAVVQRNLVSPGQNVNAGDPLVVIRRTGSEAGDVADSATDLDRERADLAEIRQRHEVTLDAARPAAIAKRTKLGRRSARANIDDLVDPGSFVEYGPLVLAAQRSRRSEQDLIENTPADGLVAGLATVNGDVFGSRDAQAVVLSYDYTVLAGTQGMRNHAKTDRVIELAGRKQVPVVLFAEGGGGRPGDTDAGPAAGLDLNTFRSLAALNGKVPLVSVVSGRCFAGNAALAGVCDVLIATPDANIGMGGPAMVEGGGLGVYRPEDIGPVDVQRRNGVIDLLARDEAHAVELAKKYLSYFQGALPEWEAPDERLARHVVPENRLRAYDVRSAVEAIADVGSVLELRRDHGVGIVTALIRVEGAPYGLVANSSHHLGGAIDAVAADKMARFLELCESFGLPVVSLCDTPGFMVGPDSEKEATVRRFGKLFVAGARMTVPYGTIILRKGYGLGAMAMAGGSFHASEFTVAWPTGEIGAMGLEGAVRLGFRKELEAIDDPAERNTAFAQLVDAAYQHGKALNAATIFELDDVIDPADSRAWIVRLRRP

SEQ ID NO: 10097 - protein, 312 aa, Rhodococcus sp. RHA1
MTVLTFGETMALTRAVDTGPLAHTSTLHVGIGGAESNFAIALRRLGVDVTWIGRVGQDSLGDLIERELRAEGITADVIRDPDAPTGLMVKERRTATATRVWYYRTGSAGSRLTMSDIADDRLESASLLHVTGITPALSDTARKTTLHCAERARALGIPVSFDLNYRRALWSPDDAAPVFRELIALSDIVFAGEDEAAIAVGDGTPAELVARVRDLGPRESILKLGAQGCLAMIDGETYSLPAVPVSVVDSVGAGDGFVAGYLAERLAGVAPADRLRTAVTVGAFACTVSGDWEGMPRRDELGLLTTAEPVTR

SEQ ID NO: 10098 - protein, 812 aa, Thermobifida fusca YX
MLEGDPSGKPWTAERAPGRGPARLEEDGLTGLNLAADSGAELALLGMDLTLVIVVLAVALLALAVAGTLVREVLAASQGTERMQNIARAVQEGAAAYLKRQFRTLAVFVIIIPLLLLLLPADTEAVRWGRSIFFAIGALFSAMTGFLGMWLAVRGNLRVAAAARAGEARAAMRIAFRTGGVAGMFTVGLGLLGAALVVLIYRADAPIVLEGFGFGAALLAMFMRVGGGIFTKAADVGADLVGKVEHHIPEDDPRNAATIADNVGDNVGDCAGMAADLFESYAVVLVASLVLGRVAFGTEGLVFPLLVPMIGVITAIIGIFVVSPRARDANAMAAINRGFFISAVISAVLVVGAALLYLPDTFAELEGVPADIAALDGNPQLIAIGAVLIGLLLAAAIQLLTGYFTETNRPPVREIGESSRSGPATVVLAGVSVGLESAVYSALLIAGAVYAAFLLGGGNITVSLFAVALAGTGLLTTVGVIVAMDTFGPVADNAQGIAEMSGDVEGSGAEVLNSLDAVGNTTKAITKGIAIATAVLAATALFGAFRTAVEAELGATEFSLSVDQPDVLVGVIIGAAVVFLFSGLAIMAVGRAAGRVVHEVREQFRTRPGIMDGTEKPEYGRVVDICTRDSLRELITPGLLAVLTPIALGFALGYAPLGAFLGGGIAAGALMAVFLANSGGAWDNAKKLVEDGHYGGKGSEAHEATVIGDTIGDPFKDTAGPAINPLLKVMNLVALLIAPSVVIYADNLALRLGITVASVALLVGVIVWSKRRSTDGSFAAEATKTQPEAPAADQGAAKEEPVSQGGGASSQE

SEQ ID NO: 10099 - protein, 450 aa, Streptomyces carzinostaticus subsp. neocarzinostaticus
MNGRRPVSPPLRALPGLLRKLAVDRLGMMRDAAALDDAVLVSMGPKKLFVFNRPDYAKHVLADNAANYRKGIGLIESRKMLGDGLLTSEGELWREQRRTVQPAFRPARVAAQADAVAEETMNLRDLLMRRGADGPVDVLQEVTGFTLGVLGRTVLNTDLGGYGGIAHAFEAVQDQAMFDMVTQNMVPTWAPLATQRRFRRARRELIRTVDELVADRSARMTDGEEADDAFSLMIAAARRQTDPRTGQGRLRDELVTLLLAGHETTASTLAWTLLLLARHPHMRDLVREEARGVLADGRAPDAGDLRKLTYTTQVVQEAMRLYPPVWILPRVARQSDEVGPYSVSAGADVLICPYTLHRHPDLWERPEQFDPGRFDPARVADRPRYAYIPFGAGPRFCVGSNLGMMEAVFVTALLTRDLVLEVVPGDERTPEPMMSLRMRGGLPMTVRPVR

SEQ ID NO: 10100 - protein, 198 aa, Synechococcus elongatus PCC 7942
MTEGALRVGQLAPDFEATAVVDQEFQTIKLSNYRGKYVVLFFYPLDFTFVCPTEITAFSDRYADFSALNTEILGVSVDSQFSHLAWIQTSRKEGGLGDLAYPLVADLKKEISTAYNVLDPAEGIALRGLFIIDKEGVIQHATINNLAFGRSVDETLRVLQAIQYVQSHPDEVCPANWQPGAATMNPDPVKSKEFFAAV

SEQ ID NO: 10101 - protein, 185 aa, Zea mays
  misc_feature (174)..(174): Xaa can be any naturally occurring amino acid
  misc_feature (176)..(176): Xaa can be any naturally occurring amino acid
MSILRIHAREIFDSRGNPTVEVDLYTAKGLFRAAVPSGASTGIYEALELRDNDKTRFMGKGVSQAVEHINKTIAPALVSKKVNVVEQEKIDKLMIEMDGTENKSKFGANAILGVSLAVCKAGAVEKGVPLYRHIADLAGNPEVILPVPAFNVINGGSHAGNKLAMQEFMILPVXAXSFREAMRIG

SEQ ID NO: 10102 - protein, 495 aa, Sphingomonas sp. KA1
MVDMSKSLDLNFNQLGLRGLFYGGGWHKPVAVGYAPTLSPGSGRSICDVAQATAPDVDAAVAAARSAFPAWQAVLPLERARILRSIADVIRRHSRELVEIDAENCGNPVSELMGDAATAIAMLEFFAGLVTEMKGQSIPSGPNAVNFSLRQPMGVVARILAFNHPFMFCAAKIAAPLAAGNTVIVKPPEQAPLSALRLAELLEDVLPPGVFNVLPGGSEAGSALAEHPHVAKVSVIGSVAAGRNVMRAASETIKPVLLELGGKNALIAFPDADPEAVADAMVQGMNFGWCGQSCGSTSRAYVQEAIYETVLGLLPDRIGRYKPGVPTDPGTTMGALISENHLDRVLDYIASAKAEGARLLTGGGRPSDPVLSGGYYLEPTVFCDVTSSMRIAREEIFGPVLSVLKWTDEQEMLAQVNALDFGLTCSIWSRDIDAACRTALAVEAGFVWINEVSKHYLGAPYGGVKQSGIGREECLDELISFTQEKNIHIRISPAS

SEQ ID NO: 10103 - protein, 210 aa, Zea mays
  misc_feature (44)..(44): Xaa can be any naturally occurring amino acid
  misc_feature (55)..(55): Xaa can be any naturally occurring amino acid
  misc_feature (84)..(84): Xaa can be any naturally occurring amino acid
  misc_feature (158)..(158): Xaa can be any naturally occurring amino acid
  misc_feature (167)..(167): Xaa can be any naturally occurring amino acid
ATSSNAAYIGTPGRGNPCCVEITGHHCGSALHQASYWRETYEEXTRRALRELLYXCPGALQYSKGGILFQETLYHEYQGWLALXEGLKEGERLPGIKGDKGTIEDGGSDHETTTQGHDDPGRRCAKYYDAGARFAKWRAVLKIVPRGPSQFVVDLNAXGRARYAIFXHEKGLVPSREPEILDDGPDDIDRCAYVTETVLAACYKALNEHH

SEQ ID NO: 10104 - protein, 404 aa, Streptococcus pyogenes str. Manfredo
MKIIEKSSKLEHVAYDIRGPVLDEANRMIASGEKILRLNTGNPAAFGFEAPDEVIRDLIVNARLSEGYSDSKGIFSARKAIMQYCQLKGFPDVDIEDIYLGNGVSELISMSLQALLDNGDEVLVPMPDYPLWTACVSLGGGKAVHYLCDEEAGWYPDIADIKSKITSRTKAIVVINPNNPTGALYPKEILEDIVALAREHQLIIFADEIYDRLVMDGKEHIAIASLAPDVFCVSMNGLSKSHRIAGFRVGWMVLSGPKDHVKGYIEGLNMLANMRLCSNVLAQQVVQTSLGGHQSVDALLLPGGRIFEQRNFIYEAINAIPGLSAVKPEAGLYLFPKIDRQMYRIDDDEEFVLQLLKQEKVMLVHGRGFNWKDPDHFRIVYLPSVEELEDVQEKITRVLYQYRR

SEQ ID NO: 10105 - protein, 548 aa, Yersinia pestis CO92
MKNINPSQTAAWKALQQHFEQMKDVTISSLFAKDDQRFNRFSATFDDQMLVDFSKNRITSETLEKLQDLAKETDLAGAIKSMFSGEKINRTEDRAVLHIALRNRSNTPIVVDGKDVMPEVNAVLAKMKQFCDRVISGDWKGYTGKAITDVVNIGIGGSDLGPYMVTEALRPYKNHLNMHFVSNVDGTHIAEALKPLNPETTLFLVASKTFTTQETMTNAHSARDWFLSAAGDPAHVAKHFAALSTNAKAVGEFGIDTNNMFEFWDWVGGRYSLWSAIGLSIALSVGFEHFEQLLSGAHAMDKHFAETPAEKNLPVLLALIGIWYNNFFGAETEAILPYDQYMHRFPAYFQQGNMESNGKYVDRNGHPVDYQTGPIIWGEPGTNGQHAFYQLIHQGTKLIPCDFIAPAISHNPLSDHHAKLLSNFFAQTEALAFGKSLEDVEAEFAAAGKTPEQVAHVAPFKVFEGNRPTNSILLREITPFSLGALIALYEHKIFTQGVILNIYTFDQWGVELGKQLANRILPELADDQEVTSHDSSTNALINRFKNWR

SEQ ID NO: 10106 - protein, 461 aa, Yersinia pestis CO92
MIQVAPQQTRDAPSATVVAKFGGTSVASFDAMSRSADVVLSNPDVRLVILSASAGITNLLVALADGSEPEKRADHLEDIRHIQYDIIARLTDSTVIREEIDRMLENIAMLSEAASLATSPALTDELVSHGELMSTLLFVELLRQRQVAVEWFDVRKVMRTNDRFGRAEPDTSALAELAQTLLAPRIEDAIVVTQGFIGSEGKGRTTTLGRGGSDYTAALLGEALNVSRIDIWTDVPGIYTTDPRVVPAAKRIDKIAFEEAAEMATFGAKILHPATLLPAVRSDIPMFVGSSKDPAAGGTLVCNETYNPPLFRALALRRKQTLLTLHSLNMLHARGFLAEVFNILARHSISVDLITTSEVSVALTLDTTGSTSTGDSLLTTSLLTELSSLCRVEVEEDLALVAIIGNNLSQACGVGKEVFGVLDPFNIRMICYGASSHNLCFLVPGNDADKVVQTLHYNLFE

SEQ ID NO: 10107 - protein, 153 aa, Fusobacterium nucleatum subsp. nucleatum
MKVFEGKFNGKGTKIAIVAARFNEFITSKLIGGAEDILKRHEVQDDDINLFWVPGAFEIPLIAKKLAQSKKYDAVITLGAVIKGSTPHFDYVCAEVSKGVAHVSLESEVPVIFGVLTTNSIEEAIERAGTKAGNKGADAAMTAIEMINLIKGI

SEQ ID NO: 10108 - protein, 459 aa, Rickettsia typhi str. Wilmington
MQEFDLVVIGSGPAGYTGSIRAAQLGLKVACIEKNDTLGGTCLNIGCIPSKALLNTSKKYEETLRYFENIGIIADTKLDLQKMLSNKDKIVLDLTKGIESLFVKNKVTKIKGEAKIISNNIVEVNKEHIKASNILIATGSSVIGIPTVIIDEEFIVSSTGALKLSKVPEHLIVVGGGYIGLELGSVWRRLGSKVTVIEYASSIVPMLDKEIAKQFMTIQQKQGIKFKLNTKVVASEVRSGKVNLTIEEADKRSIITSDVVLIAVGRKAYTKNLGFESIGITTDNQGRIEINEYFQTAVSNIYAVGDVVKGAMLAHKAEEEAIAAVEIIAGQAGHVNYNLIPSVIYTYPEVASVGATEQQLQEQGIHYKVGKFPFLANSRARAIGSTEGMVKILADSKTDRVLGAHIIGSDAGTLIAELIAYMEFGASTEDIARTCHAHPTLSEAIKEAALSVDKRTINI

SEQ ID NO: 10109 - protein, 252 aa, Zea mays
MNQFAPQQSSLAMDSGESSAASNAAHAAMAVDYAPEVAGCVSSMVDLGGAAGVESQRLFLARRTALEMLRDRGYSVPEDELARTLPEFRAWWSETPEIERLSFSTTLASDESNEVRIVFCPPEPVKIAAIREVYVRIKEENLSCLILILQSKITSRARESIKEMFKFKVDVFQITELLVNITKHVLKPKHEVLTAEGKAKLLKEYNVVDSQLPRMLENDAVARYYGLGKGTVVKVIYDSELTGNHVTYRCIT

SEQ ID NO: 10110 - protein, 355 aa, Burkholderia thailandensis E264
MKIAVLPGDGIGPEIVNEAVKVLNALDEKFELEHAPVGGAGYEASGHPLPDATLALAKEADAILFGAVGDWKYDSLERALRPEQAILGLRKHLELFANFRPAICYPQLVDASPLKPELVAGLDILIVRELNGDIYFGQPRGVRAAPDGPFAGEREGFDTMRYSEPEVRRIAHVAFQAAQKRAKKLLSVDKSNVLETSQFWRDVMIDVSKEYADVELSHMYVDNAAMQLAKAPKQFDVIVTGNMFGDILSDEASMLTGSIGMLPSASLDKNNKGLYEPSHGSAPDIAGKGIANPLATILSAAMLLRYSLNRAEQADRIERAVKTVLEQGYRTGDIATPGCRQVGTAAMGDAVVAAL

SEQ ID NO: 10111 - protein, 641 aa, Oryza sativa
HHTVPVPPPKPLLRTIGGNLMETFFPDDPFRAVARESGGRRALAALRYVFPFLEWLPSYSLAALWSDVVAGVTIASLAVPQGISYAKLGDLPPIMGLYSSFVPPLVYAVMGSSRELAVGTTAVASLLFAATLGKEAPPGEKPELYAALAFTATFFAGVLQAGLGVLRLGFLVDLLSHAAIVGFMAGAATIVCLQQLKGMLGLAHFTTSTDVVAVVRSVVTQSHQWRWQSIVVGCCFLIFLLFARYISKRKPKWFLLSAMAPLASVIAGSVLVYLIHGDRHGIPVIGYLKKGINPPSARDLLLSSPHTMVALRTGIITGIIGLAEGIAIGRSFAMLKSYNVDGNKEMIAFGAMNIVGSCTSCYLTAGPFSRAAVNHNAGCKTPMSNAVMAVAVMLTLQFLTPLFHYTPLVVLSAIIISAMIGIIDYKAAVRLWKVDKIDFCVCVGTYLGVVFGDIQIGLAIAVGISILRILLFIARPKTTVLGKMPNSTNFRRMDQYTVAKAVPGLLVLRIDSPIYFANSGYLRERIMRWIDHEEDRIKAEGLESLKCVVLDMGAVASIDTSGTKMLEDLKKNLDRSSIQIALANPGSEIMRKLDKSNVLGLIGEEWIFLTVSEACYYAQQNCKIGVGMGVVQCVVDPEHMV

SEQ ID NO: 10112 - protein, 211 aa, marine gamma proteobacterium HTCC2080
MYTDDPFSAYRRHPWHGLEPIPEGVEPGIVRAYIEMLPSDTVKYELDKNTGFLMVDRPQRTTATPPALYGFIPRTYCAEEVAARCAHADVADGDPLDICIFSERLITRADILLNARVVGGIQMIDEGEADDKIIAVLEGDNIWGEVNDIKDLPPIKTERLQHYFSTYKMIPGKNVEIRVDGVYGRDEALKVIAASQKDYQNHYGHLLQKNE

SEQ ID NO: 10113 - protein, 385 aa, Isochrysis galbana
IFMKCAFVLAMAAPASALNLFGGAKKPGRGTLYSDITQTIGNTPVVKISKKLNPTQCDVYAKCEFFNPLSSVKDRLALAIIQDAEERGALKPGDTVVEATSGNTGIAVAMLCAQRGHKCVICMAEPFSVERRRLMRMLGAKVIVTPKAGKGTGMVRKAEELCEKHGWFLCHQFENEANWKYHEATTGPEILTDFSGKRLDYWVTGYGTGGTFHGAGRAIKKERPEVKIILAEPEDAGLLASGIPTERKADGAPVGSHPAFKPHPIQGWTPDFIPRCWRTPLDNLSDELVPIPGAHAIATAKALAAKEGILTGISGGGTMWAALEIAKKAPAGSIILAMLPDTGERYLSTPLYADIEADMNDEELDIARSTPSFQLIPGKEPVLAA

SEQ ID NO: 10114 - protein, 289 aa, Magnetospirillum magnetotacticum MS-1
MNLFVFGLGFSARHFAESERARFGAVRGTVTEPARADALAAETGFTIRAFGPEADDPGIAGDLADTDMLLVSAPPAKDGDTVLARYRDVIAGSRIRWIGYLSTIGVYGDHGGAWIDETTPAVPKSARSQGRLAVEEAWLALGAETGKAVQVFRLSGIYGPGRNPIVKLREGRTQRIVKPGQVFNRIHVADIATTLAASIDRPRAGAIYNVTDDEPAPPQVVIEHAAALTGLPLPPEVDFGTAELSPMARSFYGENKRVRNRLIREELGVRLRYPTYREGLADLVADALG

SEQ ID NO: 10115 - protein, 217 aa, Oryza sativa
DLCNNVKRPGHFARDCPNVALCHACGLPGHIAAECSSKDLCWNCKEPGHMANSCPNEGICRNCGKSGHIARECSAPPMLPGEMRLCSNCYKPGHLAAECTNEKACNNCRKSGHLARNCPNEPVCNLCNVSGHLARECPKSDAINERGGPPPFRGGAPPPFRGGYSDVVCRACNQVGHMSRDCMAGAFMICHNCGGRGHMAYECPSGRLMDRFPPRRF

SEQ ID NO: 10116 - protein, 392 aa, Oryza sativa Japonica Group
MSDNLMDKVSAFGERLKITGSEVSKKMTAGMSSMSFKMKEIFQGQTPADKIVEEATSENLDGPDWSANLEICDLINTEKVNSVELIRGIKKRIMLKDARVQYLSLVLLETIVKNCEKAFSEVAAERVLDEMVRLIDDPQTVVNNRNKALMLIEAWGESGDELRYLPVYEETYKSLKSRGVRFPGRDNESLAPIFTPARSVAEAEVDANFSQQTFEDVQVHTYTAEETKEAFDVARNSIELLSTVLSSSPQQDALQDDLTSTLVQQCYQSQHTIQRMIETAGDNEAMLFEALSVNDEIQKVLSKYEQMKKPAASENAEQRPVVIPIATEHEDSATVGNEDALVRKPAGSRARSGGDDDILDDLDEMIFGKKGGSSSQEGPKKQDPKKDDLISF

SEQ ID NO: 10117 - protein, 215 aa, Anaplasma marginale str. St. Maries
MLGAVGPGALWGFEREIMNLVPMVVEQTSRGERAYDIYSRLLKERIIFITGTVEDNMASLIVAQLVFLEAENPEKDISLYINSPGGVVTAGLSIYDTMQYIKPKVSTLCLGQAASMGALLLAGGEPGMRYALPNSRIMVHQPSGGFRGQATDIEIHAREILEIKRRLNEIYVKHTGKSLEEIESSMERDNFMVAEKAKDFGIVDKVIDKRGGEQI

SEQ ID NO: 10118 - protein, 382 aa, Shigella flexneri 2a str. 301
MSLKEKTQSLFANAFGYPATHTIQAPGRVNLIGEHTDYNDGFVLPCAIDYQTVISCAPRDDRKVRVMAADYENQLDEFSLNAPIVAHENYQWANYVRGVVKHLQLRNNSFGGVDMVISGNVPQGAGLSSSASLEVAVGTVLQQLYHLPLDGAQIALNGQEAENQFVGCNCGIMDQLISALGKKDHALLIDCRSLGTKAVSMPKGVAVVIINSNFKRTLVGSEYNTRREQCETGARFFQQPALRDVTIEEFNAVAHELDPIVAKRVRHILTENARTVEAASALEQGDLKRMGELMAESHASMRDDFEITVPQIDTLVEIVKAVIGDKGGVRMTGGGFGGCIVALIPEELVPAVQQAVAEQYEAKTGIKETFYVCKPSQGAGQC

SEQ ID NO: 10119 - protein, 335 aa, Enterococcus faecalis V583
MGKVVTLGEIMLRLSTPVGIRVAQTENFAVHYGGGEANVAISLANYGHQVTFASKVPDNSLGEAAKKHLSRYGVSTEFVRTGGTRLGTYYLETGTGERAASVVYDRAYSSFAQIEEMEWDLHELFSGVEIFHISGITAALSKNWQSMTVALVKAAKQAGCQVSFDINYRGKLWSQKEASVALKAILPFVDICSAGVLDARYLLEIPEPEEELEDALTWYYRKMQERYPNIQVFYSTKRQVHSATDNELIGTLWYKGAYYTSKCHRLQPIVDRVGAGDAFAGGVLHGILAAYDPQTCIDFATAASALKHTVHGDCNQFSQKEVLAFLATGSGKINR

SEQ ID NO: 10120 - protein, 249 aa, Lentisphaera araneosa HTCC2155
MKPLNQEEKDTYAWQTTVPGFGEEGQVKLKNSTVFISRCGGLGSVVAYELAAAGIGKMILAHGGNVKHSDLNRQLLMTHDWLGKPRIESVERRLKELNPRLEIEAVNSNVNEENAQELMKEADLIIDCAPLFEERYLMNREAIRNNIPLVECAMFEMQAQITTIIPGKTACLTCIYPEKPAAWKRRFPVFGAVSGTVGCMAAMEAVKVLSNLGDTLENKLLSFDLRDMTFMKSPLIKRDDCPACSGHSS

SEQ ID NO: 10121 - protein, 262 aa, Enterococcus faecalis V583
MEFKMNDFQLDGKVALITGAVYGIGFEIAKSLAEAGATIVFNNLSPESVEQGLENYRAAGIEARGYVCDVTDEEQVQAMVAQIKEEVGSIDILVNNAGIIKRIPMVDMSAEEFRQVIDVDLNAPFIMAKAVIPDMIEKGHGKIINICSMMSELGRETVSAYAAAKGGLKMLTKNIASEYGQYNIQCNGIGPGYIETPQTAPLREPGHPFNEFILGRTPANRWGTPADLAGPAVFLASNASDFVNGHILYVDGGILAYIGKQP

SEQ ID NO: 10122 - protein, 485 aa, Rhodococcus sp. RHA1
MSLLDIDWEKKVFTGSWTATEGAFSDVVEPATGSTLGHVGTTTAADVAAACIKAAEVQRRWEKMPFEDRAAILRRAGQLFEEHAAEIETWIVREAGSIRAKASLETHVAAQECYEASALPSHPKGEVLPSADGRLSFSRRIAAGVVGVIAPFNFPLILSIRAVAPALALGNSVILKPDTRTAVCGGVVLAAVFAAAGVPDGVFQMLPGGADAGAALVTDRHTRVIAFTGSTSAGRKVGQAAAAHLTRAHLELGGNNALIVLPDADVTKAASAGAWGAYLHQGQICMAAGRHLVHDSVADEYVAVLAEKARALPVGDPYTSEVALGPIIDAVQRDSIHRLVTESVSAGVTLVEGGTHDGLFYRPTVLDHVQRDTPAFCQEVFGPVAPVLRYSTIDEAVEIARDTEFGLSLSVLGSDAMAAWEVAQQIPTGLVHINDQTVGDHAHIPFGGMGSSGNGGRVGGAAANLEAFTELQWATIQGPIQQYPF

SEQ ID NO: 10123 - protein, 314 aa, Zea mays
MAASNIGMMDGAYFVGRNEILAWINTTLQLGLSKVEEAASGAVACQLMDAAHPGAVPMHKVNFDAKTEYDMIQNYKVLQDVFNKLKITKHIEVNKLIKGRPLDNLEFMQWMKRYCDSVNGGFMSSYNASERRESSKGGKETNRRASVPSHTPAKSASTGHKAQASHGAKRASGQTAGAPQRSAKPSPAASSGGPAYDEQITELKLLVDSLEKERDFYFSKLRDIEILCQNPEVEHVPVHAIQNILYTSEEDPQQQAPALSPIMEASEERPKQEAAHKRKSISDLDEFGMSSSSRQRLSDISDVQLCGSPLTSFS

SEQ ID NO: 10124 - protein, 455 aa, Pseudomonas aeruginosa UCBPP-PA14
MIDSLNHLPRPDAGADTLAERFADLAPPLNARQAALESARCLYCYDAPCVNACPTEIDIPGFIRSIAQENVQGAAQKILSANILGGSCARVCPTEILCQRACVRNNAQECAPVLIGQLQRYALDHAGFGEHPFKRSPATGKRIAVVGAGPAGLSCAHRLAMHGHDVVLFEARAKVGGLNEYGIARYKLVDDFARREVEFLLQIGGIELRHGQRLGDNLALGALHDEYDAVFLGIGLAASKRLGLEDEDAPGLLAATDYIRELRQSDDLLDLPVADRCIVIGAGNTAIDMAVQMSRLGARDVNLVYRRGFEEMGATGHEQEIAKASQVRLLTWARPERVLLDEQGRVRGMRFARTRLENGRLGDTGEHFELAADAIFKAIGQAFEGASLGDPLAAQLRRDGERIQVDGQMRTSIPGIYAGGDCVALGEDLTVQAVQHGKLAAEAIHAQLMLNVEAA

SEQ ID NO: 10125 - protein, 263 aa, Rickettsia typhi str. Wilmington
MSDLVANLKKNGLEPQHFDDVLYIQKEINKDSDFIEVFFFPFGCVTIWGGDEIQEKIILSNTDLVAVNKLKEHLSDYIYFEYNTDVEKTFIDEEKNKIILADKSIFVKLSISHALAQSVKLSVLEQSVSNLIVQTTPIQQELARTGSVSLSKKEILQQIGILFNERYSISLHSDIFDTPEFFWRRPNYEPLYLMTAEFQDIEIRQNIMNHRLNMIQELLDILSNDLNYKHSTKLEWIIIILIGLEVILSLSHTNLFLKIIGAL

SEQ ID NO: 10126 - protein, 201 aa, Isochrysis galbana
GGAVRKAEQIVAALGSKGKLLQQFENSDNPKIHRETTGPEIWADTDGSLDIFVAGVGTGGTLTGCAQYIKPLKPEVKFVGLEPVSSPVLSGGKHQGPHKIQGIGAGFIPGNVDLSMIDEVMQISDDDAIATARELAAHEGLMCGISSGASVFAAKQLAKRPENKGKTIVCIIPSFGERYLSTILYANLWEEAAAQTAEPLD

SEQ ID NO: 10127 - protein, 497 aa, Spinacia oleracea
MAFPIPARQLFIDGEWREPIKKNRIPVINPSTEEIIGDIPAATAEDVEVAVVAARRAFRRNNWSATSGAHRATYLRAIAAKITEKKDHFVKLETIDSGKPFDEAVLDIDDVASCFEYFAGQAEALDGKQKAPVTLPMERFKSHVLRQPLGVVGLISPWNYPLLMATWKIAPALAAGCTAVLKPSELASVTCLEFGEVCNEVGLPPGVLNILTGLGPDAGAPLVSHPDVDKIAFTGSSATGSKVMASAAQLVKPVTLELGGKSPIVVFEDVDIDKVVEWTIFGCFWTNGQICSATSRLLVHESIAAEFVDKLVKWTKNIKISDPFEEGCRLGPVISKGQYDKIMKFISTAKSEGATILYGGSRPEHLKKGYYIEPTIVTDISTSMQIWKEEVFGPVLCVKTFSSEDEAIALANDTEYGLAAAVFFNDLERCERITKALEVGAVWVNCSQPCFVQAPWGGIKRSGFGRELGEWGIQNYLNIKQVTQDISDEPWGWYKSP

SEQ ID NO: 10128 - protein, 337 aa, Synechocystis sp. PCC 6803
MTRVAINGFGRIGRNFLRCWLGRTDSQLEVVGINDTSDPRTNAHLLRYDSMLGKLDGDISADENSITVNGKTIKCVSDRNPLNLPWAEWNVDLVIEATGVFVTHEGATKHVQAGAKKVLITAPGKGPNIGTYVVGVNAHEYKHEEYEVISNASCTTNCLAPFGKVINDNFGIIKGTMTTTHSYTGDQRILDASHRDLRRARAAAVNIVPTSTGAAKAVALVIPELQGKLNGIALRVPTPNVSVVDLVVQVEKNTIAEQVNGVLKEAANTSLKGVLEYTDLELVSSDFRGTDCSSTVDGSLTMVMGGDMVKVIAWYDNEWGYSQRVVDLAEIVAKNWK

SEQ ID NO: 10129 - protein, 504 aa, Mycobacterium tuberculosis H37Rv
MPELATSGNAFDKRRFSRRGFLGAGIASGFALAACASKPTASGAAGMTAAIDAAEAARPHSGRTVTATLTPQPARIDLGGPIVSTLTYGNTIPGPLIRATVGDEIVVSVTNRLGDPTSVHWHGIALRNDMDGTEPATANIGPGGDFTYRFSVPDPGTYWAHPHVGLQGDHGLYLPVVVDDPTEPGHYDAEWIIILDDWTDGIGKSPQQLYGELTDPNKPTMQNTTGMPEGEGVDSNLLGGDGGDIAYPYYLINGRIPVAATSFKAKPGQRIRIRIINSAADTAFRIALAGHSMTVTHTDGYPVIPTEVDALLIGMAERYDVMVTAAGGVFPLVALAEGKNALARALLSTGAGSPPDPQFRPDELNWRVGTVEMFTAATTANLGRPEPTHDLPVTLGGTMAKYDWTINGEPYSTTNPLHVRLGQRPTLMFDNTTMMYHPIHLHGHTFQMIKADGSPGARKDTVIVLPKQKMRAVLVADNPGVWVMHCHNNYHQVAGMATRLDYIL

SEQ ID NO: 10130 - protein, 166 aa, Magnetospirillum magnetotacticum MS-1
MVRAKRALRTVKDPESNTEQAVDLGLVGEPEHVERGVLDAVLKAELIPVLAPVAYGEDGKTYNVNADTFAGAIAGALRAKRLLLLTDVPGVLDKDKKLIPELSVDDCRRLIADGTITAGMIPKVETCIYALEQGVEAVVILNGKVAHAALLELFTDFGAGTLIRRT

SEQ ID NO: 10131 - protein, 239 aa, Synechococcus sp. WH 8102
MADLQTQMKQAVADAAVEQIKDGMVLGLGSGSTAALMIKALGAKLASGELKDIVGVTTSFQGEVLAAELNIPLLSLNAVDRIDLAIDGADEVDPGFQLIKGGGACHVQEKLVAARADRFVVVVDSTKLVERLNLGFLLPVEVLPGAWRQVQQQLAALGGKAELRMAQRKAGPVVTDQGNLVLDVTMNGGISDPAALESTVNNIPGVLENGLFVDLVDEVLVGEITDGSAGVRSLEKRLS

SEQ ID NO: 10132 - protein, 420 aa, Klebsiella pneumoniae subsp. pneumoniae MGH 78578
MSFSTISVIGLGYIGLPTAAAFASRQKRVVGVDVNQHAVETINRGEIHIVEPDLASVVKTAVEQGYLSATTTPVEADAYLIAVPTPFKDRHEPDMVFVESAAKSIAPTLKKGSLVILESTSPVGSTEQMAEWLAEMRPDLSFPQQVGEAADVNIAYCPERVLPGQVMVELIKNDRVIGGMSPVCSARASELYKIFLEGECVMTNSRTAEMCKLTENSFRDVNIAFANELSLICADQGINVWELIRLANRHPRVNILQPGPGVGGHCIAVDPWFIVAQNPQQARLIRTAREVNDHKPEWVIEQVKAQVADCLNATNKRASELTIACFGLAFKPNIDDLRESPAMEIAAQIARWHSGTTQVVEPNIHALPKKLDGLCTLATLEAALASADVLVMLVDHNQFKAVSGDSVTQAFIVDTKGVWR

SEQ ID NO: 10133 - protein, 507 aa, Symbiobacterium thermophilum IAM 14863
MLSAFSPPLPCDPARSHPTPEFPSSLQDYCEIRGIQSQPPARRDPTMDWLASLRSQIKPYRDRFPSHARLPRAGLPRAEILAEIAAMGAAESPAWRDGYASGAVYHGDEHHIAFLNEVYALQSQSNPLHPDLWPSTAKFEAEVVAMTAHMLGGDAAGGTVCGTVTSGGTESLLLAMKTYRDWARATKGITAPEAVVPVSAHAAFDKAAQYFGIKLVRTPLDADYRADVAAMREAITPNTVVVAGSAPGYPHGVVDPIPEIAALAAEHGIGCHVDACLGGFILPWAERLGYPVPPFDFRLEGVTSVSADTHKYGYGAKGTSVILYRRPDLLHYQYFIAADWPGGLYFSPTFAGSRPGALSATAWAAMLSLGEEGYLDATRRILQAADRLKAGVRAIPSLKILGDPLWVIAVASDELNIYQVMEEMAGRGWRLNGLHRPPAFHVALTLRHTEPGVVDRFLADLQDAVAQVRAHPEKATGMAPVYGMAAAAPPELVRQVLTGFIDLLYEV

SEQ ID NO: 10134 - protein, 113 aa, Zea mays
MAPQLPSIDSAPSTIPEIIANLIVDREFAREMVQRQNAWRWVVARAVEAGISTPGMTASLSYFDTYRSSRLPANLIQAQRDLFGAHTYERIDCPGSFHTEWTKLARRSNGAAI

SEQ ID NO: 10135 - protein, 395 aa, Bradyrhizobium sp. ORS278
MTVRAGREFLAIPGPTTMPDEVLQAMHRPALDIYSRQMVELTDGILSDLGRLFATKGKTYIYIANGHGAWEAVLSNVLSRGDKVLVLESGRFAVGWGHAAKAMGAEVEVLRGDWRRAVRPAEVEARLRADKEHTIKAIVVAQIDTASGVVNDVEAIGRAIRASGHPALYMVDTVASLGCMPFEMDAWHIDVAMSGSQKGLMTPPGLGFVAANARALEVHKRANMRTPYWDWSEREGTEHYRKYGGTAPVHLLFALRQAMDMLFAEGLPHAFRRHQLLGEAVRRAVAKWSEGQVIGFNIEDATERSNTVTTVLVGEGYDPAVLQAYCKEQCGVVLGTGIGDLSGKAFRIAHMGHVNAPMVLGTLGVIEMALVALKIPHGRGGLDAAIQWLGESVTA

SEQ ID NO: 10136 - protein, 70 aa, Glycine max
  misc_feature (25)..(25): Xaa can be any naturally occurring amino acid
  misc_feature (48)..(48): Xaa can be any naturally occurring amino acid
MARQTFIMINPNGLQRGLIVEIINXCERKGSYLTGSKLVTVDRTYAEXHYADQFAKPSFSCMADYIVHGP

SEQ ID NO: 10137 - protein, 392 aa, Anaplasma marginale str. St. Maries
MGNSCIVPFYAPFDVSFARGEGVYLYDTQGKRYIDFVSGIATVSLGHCHPALVNALETQGKTLWHVSNMYRIAEAERLAEKLVGCSFADLAFFCNSGAEAVECGFKIIRSYQNGKGRPERYKILTMRRSFHGRTYAACSANEPQHFMRLLHPYVDWFVSVNPDIDSVRSEVSKGNIGGILVEPVQGQSGVHILGGEFLKGLRDICDEHDMLLFFDCVQCGAGRTGKFFAYEHFGVHPDVCSIAKGMGGGFPIGGCLITKNAGQFAAVGMHGSTFGCNPLATTVAYAAVSEILREGFLENVSNNGKYLVDELTKLSGKFSGIIEEVRGLGLMVGLQMNTKVNVRAFAGKVLEQGLLLSTADSRNVLRMLPPLVVSKGEIEEALHIFARCLEEI

SEQ ID NO: 10138 - protein, 517 aa, Arabidopsis thaliana
MAAMNMIDFQNCFIFILLCLFSRLCYSHFFKKPKDPRLHFDLPPSPPSLPIIGHLHLLLSVLLHRSLQKLSTKYGSILYLRVFRFPVVLISSASIAYEIFRAHDLNISYRGFTPTDDSLFAGSFSFISAPYGDYWEFMKKVLVTNVFGPQAHEQSRGVRADVLERFYGNLFDKAIKKQSVEICAEALKLSNSSICKMIMGRSCSEERFRALATELDVLTKKLFFANMLRAWFKKLVVSLFKKETTVISYRFDELLESILVEHEKKLDVHHQRTDLMDALLAAYRDENAEYKITRNHIKSIIADLLFAGTENQVQTIQWAMAEIINNPNVLERLRGEIDSVVGKSRLIQETDLPKLPYLQAVVKETIRLHPPGPFFLRFTKEGCRIRGFYVPENTSVVVNVYAVMRDPDAWEDPLVFKPERFLASSRAEQEEERREKEIKYLPFGSGRRSCPGENLAYVIMGTAIGVMVQGFEWRTTEEKINMDEAVVGLSLTMAHPLKIIPVARTSNSLTSSLQKCL

SEQ ID NO: 10139 - protein, 488 aa, Burkholderia vietnamiensis G4
MGKATGFLEFERRHEAYEAPLTRVKHYKEFVAALTDADAKVQGARCMDCGIPFCNNGCPVNNVIPDFNDLVYRQDWQQAIEVLHSTNNFPEFTGRICPAPCEAACTLGINNDPVGIKSIEHAIIDKAWAEGWVKPQPAEHKTGKKVAVVGSGPAGLAAAQQLARAGHDVTVFEKNDRVGGLLRYGIPDFKLEKWLIDRRMRQMEAEGVTFRTSVFIGKEPLPESIGNLAKETISPDTLKEEFDAVVIAGGSETPRDLPVPGRELAGVHFAMDFLPQQNRVNAGDKLTDQLLAKGKHVIVIGGGDTGSDCVGTSNRHGAKQVTQFELLPQPPEEENKPLVWPYWPIKLRTSSSHEEGCERDWAVATKRLEGKNGKVEKLIAVRVEWKDGKMQEVPGSEFEMKADLVLLAMGFTQPAAPVLDAFGVAKDARGNARAATEGERSYYTSVDKVFAAGDMRRGQSLVVWAIREGRQCARSVDAYLMGHSELPR

SEQ ID NO: 10140 - protein, 389 aa, Haemophilus influenzae R2866
MNLHEYQAKQLFEHYGLPVKNGAVCQSVEDVDLVLAQLSGDKWAAKCQVHAGGRGKAGGVKLVQDVEEARAFAEKWLGQRLVTFQTDKLGQPVNQIYFEETCDIDKEFYLSAVVDRASQKVMFIASPAGGMNIEEVAQNSPHLLHKVEIDPLFGGLPYQGRELAFKLGLSGTQNKQFTDIFMGLSRLFLEKDLSLLEVNPLVLTKQGNLVCLDAKISVDDNALFRHKDLLALQDLTQNDAREAEAEKFQLNYVALEGDIGCMVNGAGLAMGTMDIVKLYGGKPANFLDVGGGATKERVAEAFKIILTDPSVKVILVNIFGGIVRCDLIAEGVIAAVNEVGVRVPVVVRLEGTNAEMGRQILVESDVNILTAQSLQQAAELAVNAAKGEH

SEQ ID NO: 10141 - protein, 454 aa, Klebsiella pneumoniae subsp. pneumoniae MGH 78578
MTEKKAELQRGLEARHIELIALGGTIGVGLFMGAASTLKWAGPSVLLAYIIAGLFVFFIMRSMGEMLFLEPVTGSFAVYAHRYMSPFFGYLTAWSYWFMWMAVGISEITAIGVYVQFWFPEMAQWIPALIAVGLVALANLAAVRLYGEIEFWFAMIKVTTIIVMIVVGLGVIFFGFGNGGHSIGFGNLTEHGGFFAGGWKGFLTALCIVVASYQGVELIGITAGEAKNPQVTLRSAVGKVLWRILIFYVGAIFVIVTIFPWDQIGSNGSPFVLTFAKIGITAAAGIINFVVLTAALSGCNSGMYSCGRMLYALAKNRQLPAAIGKVSRNGVPSVGVALSILILLVGSCLNYIIPNPQRVFVYVYSASVLPGMVPWFVILISQLRFRRVHQAAIASHPFRSLLFPWANYFTMAFLICVLVGMGLNDETRMSLFVGIIFLAAVTLIYKVFGLGRQG

SEQ ID NO: 10142 - protein, 283 aa, Lentisphaera araneosa HTCC2155
MKTLCIGEILWDVFPDKKVWGGAPANFIFHTVQMGAEAAAYSAVGDDELGREITRAIKDCGINLKAPTTDHPTGVVDITLNKDGSANYQFNADCAWDHIALSSELINLSSNADLIAFGSLAQRSEQSRQTIYEALRHRKSCCKVLFDINLRQNFYSEEVILKSLNECDFLKLNEEELPIICDLLNIEEAELSDSFNLELIILTLGEEGSTIISQNETSIMSASPCELVDTVGAGDSFTACFIINYLQGMPIKDAQKQASDMAAYVCSHSGATVELPAKLKLTP

SEQ ID NO: 10143 - protein, 331 aa, Glycine max
MAPKGLIFLAVLCFSALSLSRCLAEDNGLVMNFYKESCPQAEDIIKEQVKLLYKRHKNTAFSWLRNIFHDCAVQSCDASLLLDSTRRSLSEKETDRSFGLRNFRYIETIKEALERECPGVVSCADILVLSARDGIVSLGGPHIPLKTGRRDGRRSRADVVEQFLPDHNESISAVLDKFGAMGIDTPGVVALLGAHSVGRTHCVKLVHRLYPEIDPALNPDHVPHILKKCPDAIPDPKAVQYVRNDRGTPMILDNNYYRNILDNKGLLIVDHQLANDKRTKPYVKKMAKSQDYFFKEFSRAITLLSENNPLTGTKGEIRKQCNAANKHHEEP

SEQ ID NO: 10144 - protein, 409 aa, Zea mays
  misc_feature (42)..(42): Xaa can be any naturally occurring amino acid
  misc_feature (67)..(67): Xaa can be any naturally occurring amino acid
  misc_feature (84)..(84): Xaa can be any naturally occurring amino acid
  misc_feature (362)..(362): Xaa can be any naturally occurring amino acid
RLAPLSDPPQLAETEPSPAMPPPPQANGGKVTPNLAMDARGXTACSTLTVLQRLDPAVEDILITAAXVTLYDFNIDLNQWSRKXDVEGSLFVVKRNSQPRFQFIVMNRRNTDNLVEDLLSDFEYELQPPYLLYRNASQEVNGIWFYNQHDCEAVASLFGRILNAYAKVPPKPKVPTTKSEFEELEAVPTSAAIDGPLEPPLSSTAVVSNAPDESLVNYFNGAASIGSVPSAQMAGRAHPSNDTVTPSHVPLIVPSATPTHQMPDSNGDSNARPLPIHDTNAHTSRSTNLVTPDFFAPPPSSSTPLAPPGASVIPTAPPLHPTSASVQRSQYGAPLLQPFPPPTFTPSLTPAHPESSALTSGXTQDPLLSPSQSDELIDLRDRDMQNLQKLAANYPFVYSVSRELQRSFL

SEQ ID NO: 10145 - protein, 501 aa, Rickettsia typhi str. Wilmington
MLPPKIFFEKFKEIIWPIERKELKLFIPMALMMLCILFNFGALRSIKDSLVVPSMGAEIISFLKLWLVLPSCVIFTVLYVKLSNKLNFEYIFYSIVGTFLLFFLLFAYIIYPNQDIYHPNDAMINNLIASYPNLKWFIKIGSKWSYALMYIFSELWSAVVINLMFWQFANHIFDTAKAKRFYPVLGMIGNIGLIIAGSVLVFFSSGQYIIDSELLTDSFNSSSCNSIILQPIISIIVTAGIIAMFLFRIINRFILTNAINVLDVKKAAARTKTKLALIESIKLIIHSKYIGRIALLIICYGLLINIVEGPWKAKIKELHPNTIDYVNFMGMFNIWMGISCVTFMIIGSNILRRLGWLISALLTPIMLSITGFIFFIFIIFIEEIGTCFGDFNLLYVAIIVGAIQNILSKSSKYSLFDSTKEMAYIPLSLELRTKGKAAVEVIGTKFGKSLGAFIQSLIFIIIPTATFDSIIIYLLVIFIVMMNLWIWNIIKLNKEYIKLCK

SEQ ID NO: 10146 - protein, 251 aa, Bacillus megaterium
MRKPIIAGNWKMNKVLSEATSFVEEVKGAVPSPESVDSVVCAPALFLDRLVEATKGTDLKIGAQNMHFEENGAFTGEVSPVALADLGVNYVILGHSERREMFAETDETVNQKTIAAFKHGLTPIVCCGETNEEYEQDQTKTVVANQVQKALAGLTDEQVKQTVIAYEPIWAIGTGKSSTAEGANEVCAYIRSVVAEQFSQDVADAVRIQYGGSVKPANIKEYMSQSDIDGALVGGASLEADSFLQLLEAGK

SEQ ID NO: 10147 - protein, 560 aa, Mycobacterium tuberculosis H37Rv
MTPQKSDACSDPVYTVGDYLLDRLAELGVSEIFGVPGDYNLQFLDHIVAHPTIRWVGSANELNAGYAADGYGRLRGMSAVVTTFGVGELSVTNAIAGSYAEHVPVVHIVGGPTKDAQGTRRALHHSLGDGDFEHFLRISREITCAQANLMPATAGREIDRVLSEVREQKRPGYILLSSDVARFPTEPPAAPLPRYPGGTSPRALSLFTKAAIELIADHQLTVLADLLVHRLQAVKELEALLAADVVPHATLMWGKSLLDESSPNFLGIYAGAASAERVRAAIEGAPVLVTAGVVFTDMVSGFFSQRIDPARTIDIGQYQSSVADQVFAPLEMSAALQALATILTGRGISSPPVVPPPAEPPPAMPARDEPLTQQMVWDRVCSALTPGNVVLADQGTSFYGMADHRLPQGVTFIGQPLWGSIGYTLPAAVGAAVAHPDRRTVLLIGDGAAQLTVQELGTFSREGLSPVIVVVNNDGYTVERAIHGETAPYNDIVSWNWTELPSALGVTNHLAFRAQTYGQLDDALTVAAARRDRMVLVEVVLPRLEIPRLLGQLVGSMAPQ

SEQ ID NO: 10148 - protein, 429 aa, Rickettsia typhi str. Wilmington
MSQKLSFWSVFALVTGSQIGTSVFILPLSLAPFGVYSIWGWVLSLFGAMSIALVFSCLCTKFPKTGGPHVYVRASFGETIAFFTGWTYWIISFVSTSIVVISAIGYLTPFFKSQKILDLILQLILLAAIAILNLKGPKIAGKIEFYLTLLKFVPLLVVGLAALSHFNIDNIVIAQEIENLTIPTIMGRVALLTFWGFIGIECATTTAGTVKDPAKTIPRAIIIGTCCVAFLYIINSIGIIGLIPASELINSKAPYADAATLLFGGTWSKVITVIASVICIGTLNAWVLTSGQIALGLAEDGLLPQFFAKKNSNNAPTYGIIVSCLGITPLLFFTSNNNFAQQITQIIDFSVIAFLFVYLICSLAFLKLIFSSKENFSYYYLFVDIISIIFCIWVIYKTPFETLIIACSFTILGIPVYYGWYRLMNRIKL

SEQ ID NO: 10149 - protein, 397 aa, Mycobacterium tuberculosis H37Rv
MTVSRLRPYATTVFAEMSALATRIGAVNLGQGFPDEDGPPKMLQAAQDAIAGGVNQYPPGPGSAPLRRAIAAQRRRHFGVDYDPETEVLVTVGATEAIAAAVLGLVEPGSEVLLIEPFYDSYSPVVAMAGAHRVTVPLVPDGRGFALDADALRRAVTPRTRALIINSPHNPTGAVLSATELAAIAEIAVAANLVVITDEVYEHLVFDHARHLPLAGFDGMAERTITISSAAKMFNCTGWKIGWACGPAELIAGVRAAKQYLSYVGGAPFQPAVALALDTEDAWVAALRNSLRARRDRLAAGLTEIGFAVHDSYGTYFLCADPRPLGYDDSTEFCAALPEKVGVAAIPMSAFCDPAAGQASQQADVWNHLVRFTFCKRDDTLDEAIRRLSVLAERPAT

SEQ ID NO: 10150 - protein, 426 aa, Vibrio fischeri ES114
MSINVDLDFDHQHIWHPYTSTLNPLACYPVTHAKGVNIYLENGTELVDGMSSWWSTIHGYSHPHLNQALKDQTDKMAHVMFGGITHQPAVELCKKLVELSPSRLEQVFLADSGSVAVEVSLKMALQYWHAKGQPRSKFLTVRHGYHGDTFAAMSVTDPDNSMHGLYKGFLPEHLFVESPSSKFGGVWNPDDILPLEAMLAERHNDIAAMILEPIVQGAGGMRLYHPQYLKEVRRLCDKYGLLLILDEIATGFGRTGKLFACEHAEIEPDIMCIGKALTGGYMTLSATLTSKVVADTVCSGDAGCFMHGPTFMGNPLACAVANASLELIQQNHWQTQTKQIETCFSELLPQLKKHNVVADVRWLGAIGVVELTTPVDMEKIQAHFVEQGVWIRPFGKLIYMMPPFISQPEHITKLVNAIDSALETLF

SEQ ID NO: 10151 - protein, 86 aa, Staphylococcus haemolyticus
MNMSDIIFLNGMRFYGYHGALHAENELGQIFIVDVTLKVDLTEAGKTDNVKDTVHYGEVFEDVKNIVEGPSCQLIEHLAERIAKRI

SEQ ID NO: 10152 - protein, 253 aa, Cryptococcus neoformans var. neoformans B-3501A
MAFLPRLLISSTSLATVVGLYLLFTGQGEAFNVGNFLAESSPYAWALVGVGLCIGLSVSGAAWGIFVTGASILGGGVRAPRIRTKNLISIIFCEVVAIYGVIMAIVFSSKINGDVPNIYTANNYYTGFALFWGGLAVGVCNLLCGVSVGITGSTAAVADAADPQLFVKILIVEIFGSVLGLFGLIVGLLIVSRPPTLSRHPLTQRAVRQGRRVCVNLDNVITMHYYFDMSTSAAWRCSSPWLRTPGFLSACWW

SEQ ID NO: 10153 - protein, 344 aa, Synechococcus elongatus PCC 7942
MAQSTTSETHTRDLDRDCTTLSRHVLEQLQSFSPEAQDLAALMQRIGLAAKLIARRLSHAGLVDDALGFTGEINVQGEAVKRMDVYANQVFISVFRQSGLVCRLASEEMEKPYYIPENCPIGRYTLLYDPLDGSANVDVDLNVGSIFAVRRQEFYDESHEAKDLLQPGDRQIAAGYVLYGASTLLVYSMGQGVHVFVLDPSLGEFVLAQSDIQLPNSGQIYSVNEGNFWQWPEGYRQYIREMHRREGYSGRYSGALVADFHRILMQGGVFLYPETVKNPTGKLRLLYEAAPMAFLAEQAGGKASDGQKPILLRQPQALHERCPLIIGSAADVDFVEACLAESVP

SEQ ID NO: 10154 - protein, 225 aa, Zea mays
MAEVEAPAAAVAAATPEVATVTEGGAATEAKGPHKLHRQWTFWYDIQSKPKPGAAWGTSLKKAYTFDTVEEFWGLYDHVFRPSKLPGTADFHLFKAGVEPKWEDPECANGGKWTVPCNRKPTFETMWLETLMALVGEQFDETDDICGIVASVRPRGDKLALWTRTASNEAVQVNIGKKWKDVIDYNDKIIYTFHDDSRRDKPSRGGRYTGVSRTRRWSLFGLDRG

SEQ ID NO: 10155 - protein, 405 aa, Shigella flexneri 2a str. 301
MSSVDILVPDLPESVADATVATWHKKPGDAVVRDEVLVEIETDKVVLEVPASADGILDAVLEDEGTTVTSRQILGRLREGNSAGKETSAKSEEKASTPAQRQQASLEEQNNDALSPAIRRLLAEHNLDASAIKGTGVGGRLTREDVEKHLAKAPAKESAPAAAAPAAQPALAARSEKRVPMTRLRKRVAERLLEAKNSTAMLTTFNEVNMKPIMDLRKQYGEAFEKRHGIRLGFMSFYVKAVVEALKRYPEVNASIDGDDVVYHNYFDVSMAVSTPRGLVTPVLRDVDTLGMADIEKKIKELAVKGRDGKLTVEDLTGGNFTITNGGVFGSLMSTPIINPPQSAILGMHAIKDRPMAVNGQVEILPMMYLALSYDHRLIDGRESVGFLVTIKELLEEPTRLLLDV

SEQ ID NO: 10156 - protein, 348 aa, Candida albicans SC5314
MSVPTTQKAVIFETNGGKLEYKDIPVPKPKANELLINVKYSGVCHTDLHAWKGDWPLATKLPLVGGHEGAGVVVALGENVKGWKVGDYAGVKWLNGSCLNCEYCQSGAEPNCAEADLSGYTHDGSFQQYATADAVQAARIPAGTDLANVAPILCAGVTVYKALKTAELEAGQWVAISGAAGGLGSLAVQYAKAMGYRVLAIDGGEDKGEFVKSLGAETFIDFTKEKDVVEAVKKATNGGPHGVINVSVSERAIGQSTEYVRTLGKVVLVGLPAGAKISTPVFDAVIKTIQIKGSYVGNRKDTAEAVDFFTRGLIKCPIKIVGLSELPEVYKLMEEGKILGRYVLDNDK

SEQ ID NO: 10157 - protein, 131 aa, Rickettsia typhi str. Wilmington
MAYNKKVIDHYENPRNVGSLDKNKKNVGTGLVGAPACGDVMKLQIEVDDDEIITDAKFKTFGCGSAIASSSLVTELVKGRSVEDAQEIKNTEIAKELSLPPVKLHCSLLAEDAIKAAIADYKQKKGNKKDS

SEQ ID NO: 10158 - protein, 410 aa, Rickettsia typhi str. Wilmington
MNQQLKNLTLPIYMDYQSTTPIDPRVMEAMLPYFTTKFGNPHSRSHSFGWEAENAVENARSMIAKLIGADSKEIIFTSGATESNNLVIKGIAKFYGNKKNHIITLVSEHKCVLNACRYLEQEGIKITYLPIKPNGIIDLEILKNAITDQTLLVSVMAVNNEIGVIQPLREIGKICRERSVFFHSDIAQGFGKIPINVNEYNIDLASISGHKIYGPKGIGALYIRKKPRVRVTPLINGGGQERGMRSGTLPTPLIVGFGIAAEISYNEMEKDAQHVNYLFDRFLNNIYSRIPEVYLNGDKDQRYKGNLNLSFAGVEGESIILAIKDLAVSSGSACTSASLEPSYVLRSIGISEELAHTSIRFGIGRFTTEQEIDYAVNLICSKIDKLRKLSPLWEMMQEGIDLKKIKWTAH

SEQ ID NO: 10159 - protein, 134 aa, Glycine max
  misc_feature (104)..(104): Xaa can be any naturally occurring amino acid
MESPFRPEILKGKVALITGGASGIGFEISTQFGKHGASVALMGRRKQVLQSAVSVLQSLVIPAVGFEGDVRKQEDAARVVESTFKHFGRIDILVNAAAGNFLAXAEDLSSNGFRTGSASITSFFSFFKAKSLFG

SEQ ID NO: 10160 - protein, 880 aa, Rickettsia typhi str. Wilmington
MNKLIYYFGNNGSDGNASMKNILGNKGAGLAEMSNLKLPIPNGFTITTELCNYFYKHNNNLPKNFQNELQQAITKLEITTGKIFGSTTSNPLLLSVRSGSTVSMPGMMDTILNLGMNNEVCNALADSCGNKLFALDSYRRFLEMYGSTVLSIPSDLFEQIYEKHKVQADIYKDSDITVELLEKIIDDFKRLHIKYTKQLIKDPYEQLESAIKAVLYSWKNNRAIVYRKLNNISEDFGTAINIQEMVFGNLGKTSATGVVFTRSPSTGEKKLFGEFLINAQGEDIVSGTRTPMPIIANDSNSMQAMMPEVFTKLSQIAKKLEEHYLDMQDIEFTIENNKLYILQTRTAKRTAIAAINIAVQMVEEKLISKEQALMRIDPESLNQLLHTRIDYSKKLTAIAEGLPASPGAATGIVVFSPYDAEKLSHHHKVILVRHDTSPEDINGMHVASGILTIRGGMTSHAAVVARGMGKPCVCGTNNLSIDEQKQILIAGDIVIKQGDIITIDGGSGKIFLGEMPLIQPTFSEESTLILDWADEISSLKVRANAETVNDALVSIKFGAQGIGLCRSEHMFFDKNKIPLVREMIIAPDIERRQCALQKLLPLQTEDFKALFRVMKNKPVNIRLLDPPLHEFLPTTDEDKKNLAHSLNLPLSMIHQRLHAMHEVNPMLGHRGCRLGICLPEIYQMQIEAILTAIFELHKKEHIESNLELMIPLISNVAEIKKLKMDIYAVVKKLEQRYSYKFSFTLGTMIELPRAALGSKKIAKEVDYFSFGTNDLTQTTYGISRDDIASFLPYYLEEKIFESDPFTTLDEEGVGELIKIAIKRGKSSNANLKLGACGEHAGNPTSIAFFHKMNLNYVSCSPYRIPIARIAAAQAKIKQGS

SEQ ID NO: 10161 - protein, 453 aa, Debaryomyces hansenii CBS767
MMLVRYTRIAIIGGGPAGLAAAKSFGLLPTNFEVDLFERNDNLGGVWLYTGKKPNGLKEIKDINNPSVGRNELFSPMYKYLETNITGKLMQYANSTFPPDAFVYPTRQEVFQYLQEYSNTIPQSTKIHLNSNVLSLTKKNSIWEVQVENLKDKKTSIKQYDAIVLANGHFEVPFIPRVNGLNSWHIKLPLSITHAKYFTDPNDFANKNVLVVGSSSSGTDIAIQLTVRCNKVYVSNRSNSLGPEFKNLRAKVIGLITKYDFDNNRSVTTAEGETVSDIDAVIFCTGYRYDFPFLKSYMDDGSIIDAEGTMVHNIYKQMFYIPDPSLAFFALPKQIVPMPLAESQAAVLSRVFSGKMELPDKETMISEYSKELEMKGKEFHNLKFPADADYCKSLQEWIDLNNLTNYGLHAPTWDKEKYEDRSISGSMKSDRISEVIEHANTLRDKGEGFRLLR

SEQ ID NO: 10162 - protein, 276 aa, Rickettsia typhi str. Wilmington
MKIPYINYNNFINTLSNNLQKNKQLEKIIEQFYQDYQLIPIIGVEIEFYLSNNIDIANFEILSREYLSKFKISKIKKEKGNNQFEIALPPSINLIQYIKNILEVKKILKKSAKQLNGYIDFSPKPFLDDYGNSMHFHINFNSELHDYYILAAQGICHYMLDTLLVFMPTTLDYLRINKKFMSPTHVSYGGNNRSVAVRTPNSLPKRLEHRLSSPETDPYIAMFTILKSILLALTFPNSIKKIEKIYGNAFDPQYNLTPLPTSFQESSMLFKPEFFT

SEQ ID NO: 10163 - protein, 368 aa, Parvularcula bermudensis HTCC2503
MKTRAAVAFEPKKPLEIVDLDLEGPKAGEVLIELKATGICHTDAYTLDGLDSEGLFPSILGHEGCGIVREVGPGVTTLKPDDHVIPLYTPECRECKSCLNPKTNLCTAIRSTQGQGLMPDGTSRFSYKGERIYHYMGCSTFSNYTVMPEIAVAKIRKDAPFETTCYVGCGVTTGVGAVTNTAKVEPGSTVVVFGLGGIGLNVIQGAKMVGASQIVGVDLNPEKAEWGRKFGMTDFVNPKDVDNLVAHLVALTDGGADYSFDCTGNTEVMRQALECCHRGWGESIVIGVAEAGKEISTRPFQLVTGRVWKGTAFGGARGRTDVPTIVDWYMSGQIQIDPMITHRFALDEINKAFDLMHQGQSIRSVVVY

SEQ ID NO: 10164 - protein, 133 aa, Triticum aestivum
ISLTPSHRHSYTAADTSLLLLVHFPRISAEMSTVTRAYLDQKLAAARRCSREAAVAGAKAAAVATIAAAVPTLASVRMLPWARAHLNPTGQALIISTVAGMAYFIVADKTILSMARKHSFDDAPDHLKNTSFH

SEQ ID NO: 10165 - protein, 498 aa, Lobelia polyphylla
MRLNPTPSGSGVSTLEKNKPGRIGQIIGPVLDVAFPPGKMPNIYNALVVKGRDTLGEPINVTCEVQQLLGNNRVRAVAMSATDGLMRGMEVIDTGAPLSVPVGGATLGRIFNVLGEPIDNLGPVDTRTTSPIHRSAPAFIELDTKLSIFETGIKVVDLLAPYRRGGKIGLFGGAGVGKTVLIMELINNIAKAHGGVSVFGGVGERTREGNDLYKEMRESGVINEQNFAESKVALVYGQMNEPPGARMRVGLTALTMAEYFRDVNKQDVLLFIDNIFRFVQAGSEVSALLGRMPSAVGYQPTLSTEMGSLQERITSTKKGSITSIQAVYVPADDLTDPAPATTFAHLDATTVLSRGLAAKGIYPAVDPLDSTSTMLQPRIVGDEHYETAQSVKQTLQRYKELQDIITILGLDELSEEDRLIVARARKIERFLSQPFFVAEVFTGSMGKYVGLAETIKGFQLILSGELDGLPEQAFYMVGNIDEATAKAMNLEMESNLKK

SEQ ID NO: 10166 - protein, 622 aa, Bradyrhizobium sp. BTAi1
MLSINDISIRLAGRLLIDHSTVQIPPGARVGLVGRNGTGKSTLFKAIRGELSLENGAITVPPRWRIGSLAQEAPSGPESLIEVVLRADLERDALLREAETAVEPDRIAEIQTRLVDIDAHSAPARAAAILSGLGFSAADQARACAEFSGGWRMRVALAATLFAAPDLLLLDEPTNYLDLEGTLWLEDHLAHYPRTVIVISHDRDLLETSVDQILHLDRGKLTLYRGGYSSFEEQRATREMLDAKAVKRQEAERARLQSFVDRFKAKASKARQAQSRVKMLERMKPITALVTQDVHEISFPAPEKLLSPPIIAVDNASVGYDPAQPVLNRVTLRIDNDDRVALLGANGNGKSTLVKLLAGRLAPFSGKVTRADKLSIAYFAQHQLDELDEQGSPYTHVRQLMGDAPESKVRARAGAIGFSGKAADTLVKSLSGGEKARLLLGLATFYGPNMIILDEPTNHLDIDSRAALAEAINEFPGAVIMVSHDRYLIEACADRLWVVAERTVKTYDGDLDDYRRMILSSRSGASARDAERPQTSERAERPRGDNKRGGLKQKIAAAEAEMARITEIIAKIDGALALPDIFTRDPKQAAQLSKARANAAEALARAEEQWLEASTLYDETTG

SEQ ID NO: 10167 - protein, 393 aa, Synechococcus sp. WH 8102
MEGFGSGVDHRRMTAETEVIIAGQIQQGLLLGLGPLQSPGKISAAPGVQRAAACWILRCHGISLGGHRRSGWVFRWPVMSLERFTTLFPLWTLLGSLLALLHPPLFVWFRGPLITIGLGVIMLGMGLGLTPRDFLRVSRQPRAVILGVAAQFLVMPSLAAAIAVLLQLPAPLAVGLILVGCCPGGTASNVVTLIAKGDVALSVVMTSISTMAAVVLTPRLTELLASQYVPVDGWLLLLRVLQVVLVPVACGVLLKQGVPRLANRVEPVMPPIAVVAIVLIVASVVGSQRQLLLEQGALLLLACLLLHGGGFLLGFLMARLVGASSQAQCTISIEVGMQNSGLAVVLARTGGFSSPLTALPGAISAVVHCLLGSALAAVWRRSDHAEVLNSSHP

SEQ ID NO: 10168 - protein, 428 aa, Nostoc sp. PCC 7120
MNIAVVGLSHKTAPVEIREKLSIPEPQTESAIGQLTSYPHIDEVAILGTCNRLEIYIVAGETDHGIREVTQFLSEHSKLPVHSLRQHLFVLLHEDAVMHIMRVAAGLDSLVLGEGQILAQVKNTHKLGQQYNGIKTILNRLFKQALTAGKRVRTETSIGTGAVSISSAAVELAEIKAENLAACRVTILGAGKMSRLLVQHLVSKGATQISIVNRSRERAQELAKQFSEHPIRTHLLPEMMTVIAESHLVFTSTSATEPILDRAKLEMVLAPNQPLMLFDVSVPRNVHTDVNELVNVQAFNVDDLKAVVAQNYESRRKMAQEAERLLEEEIEAFDIWWRSLETVSTISSLRSKIETIREQELEKALSRLGSEFGEQTSRGVEALTRGIVNKILHDPMVQLRAQQDVEARRRCMQTLQMLFNLDVGEQFS

SEQ ID NO: 10169 - protein, 140 aa, Bradyrhizobium sp. BTAi1
MAIERTFSIIKPDATERNLTGAINALIEKAGLRIVAQKRIRMTREQAETFYAVHKARPFFGELVDFMISGPVVVQVLEGEGAILKYRDVMGATDPSKAADGTIRKLHAKSIGENSVHGSDAAETAAIEIAQFFSGNEIVG

SEQ ID NO: 10170 - protein, 508 aa, Bradyrhizobium sp. BTAi1
MLLRWHTTSGGNMMSIAYEYERSSALSSDLTKPLQLLIGGRHVPSVSGRTFTTLNPATEQPLATIAEGNAEDVDLAVAAARRAFEGPWRTMRAAERGAILLKWAQLVRDRSAEIVELESLDAGKPVSAILRQDLPAAIDTLTYYAGWADKISGEVVSTRDDALTYTVREPVGVVAAIVPWNFPLMIGMWKLAPALACGCTVVMKPAELTSLSALRIAELALEAGLPPGVLNIVTGPGRIVGEALVNHPDVDKVTFTGSPGVGRGIMKAAAGNFKRVSLELGGKSANIIFDDANIEAAAKAAASGIFFNAGQVCSAGSRVLVQERAYDEVVERLTARARALRIGDPLDRATSLGPVISERQMKTILDYVDIGRREGATLVTGGERAAARGYFISPAVFAGVTHEMRISQEEIFGPVVSVIKFKDEADALRMANGTAYSLAAGVWSRDLGRVQRFAKRLRAGTVWINTYGYTDVRLPWGGDRDSGLGREHGTAALDNFTEPKAVWMNLAV

SEQ ID NO: 10171 - protein, 325 aa, Opitutaceae bacterium TAV2
MARIYNDITETIGNTPLVRLNRTAAAHGAQAEILLKLEFFNPLSSVKDRIGFAMIDEALKSGRINKDTILIEPTSGNTGIALAFVAAAKGLKLILTMPETMSLERRKLLKVLGAKLVLTEGSKGMKGAIAKAEELNKQIANSVVLQQFANPDNPEIHRKTTAEEIWRDTDGAVDFVVSGVGTGGTITGVGEVLKSRKPGVKLVAVEPAGSPVLSGGNPGPHKLQGIGAGFIPSVLNTKIIDEIIQVKEDDSGPISKQVNTLDGIPIGISSGAAVWAAIQLAKRPENKGKKIVAIIPSAAERYLSSWLFADVNVESDNIDALLAAK

SEQ ID NO: 10172 - protein, 561 aa, Oryza sativa Japonica Group
MAALRDVLLSIAQTPHRLRRRALVTWTPAQETSEVRDRSGARMKRRLEWYDLVGLGVGGMLGAGVFVTTGRVARDTAGPAVFASYVIAGVSALLSSFCYAEFSVRVPAAGGAFSYLRVTFGELVGFFGGANILMEYVLSNAAVARSFTDYLASTCGITEPDAWRIQVDGIAKGYNALDFPAVALILVLTLCLCYSTKESAMLNMVITVFHLLFFVFIILAGLWNGSARNLVSPHGLAPYGVRGVLDGAAIVYFSYIGYDSASTMAEEIRDPARALPVGIAGSVLVVSALYCLMSLALCAMLPYTEIAESAPFSAVFREKAGWEWAGSVVGAGASLGIVASLLVAMLGQARYLCVIARARLVPAWLAKVHPSTGTPMNATIFLGLCTASIALFTELQVVFEMISIGTLLVFYLVANALIYHRYAKLGANRSLHVLLFLLILTLSSLGFSLSRRIHGQCRWGMALFGATSVTITAMFHCAVRRDMPEPPSEWMVPLMPWPAAASVFLNVFLMTTLKVMSFQRFGLWSFVIIVFYVCYGVHSTYSAEENEAVNAMIHHANMDIS

SEQ ID NO: 10173 - protein, 492 aa, Sulfolobus solfataricus P2
MGKVLGEVKKDYGKLKLYINGEFIDSKTDTIGKAYNPAKDEIIAEVPFSAKDEVEEAIQSAQEAFEKWREVPITTRIQYLFALKNRLEEYSETIARIIVQNHGKTIQEARGDMRRTIENVEAAISAAYTLYKGEHLDQVSQEVDETVVREPLGVFGIITPFNFPTMVPFWFLPYAIVLGNTVVVKPSEITPVPMDFIIRIFDEIKLPRGVVNVVHGAKDVVDEFLTNKLVQGVTFVGSTRVGKYIYENAGKNGKKAIVQAGAKNFVVVMPDADLNKAIPSIVSAFFGNAGQRCLAAANLVAVGNIYDEVKRKFIEASKQLKIGYGLDESVDMGPVVTKDAKKRIIGYIEKGIEEGAKLLLDGRDVKVPEYPNGYFLGPTVFDEVTPEMVIAKEEIFGPVASIIHVKNLDEAINIINRSNYGNASSIFTTSGYYARKFRREVNTGNIGINIGVAAPMAFFPFGGRKESFFGILHGQIDSVDFFTDKKVVITRW

SEQ ID NO: 10174 - protein, 559 aa, Glycine max
  misc_feature (150)..(150): Xaa can be any naturally occurring amino acid
MFGLIGRKASLLGGSGRRRRWLSFAAAAAATTTTNGGAMEELLSQLQSNVQKALAGGGPEAVKRNKSRNKFLPRQRIDRLLDPGSSFLELSQLAGHDLYEEPLPSGGVVTGIGPVHGRLCMFVANDPTVKGGTYYPITVKKHLRAQGDCXAQCKLPCIYLVDSGGAFLPKQAEVFPDRENFGRIFYNQAVMSAQGIPQIALVLGSCTAGGAYIPAMADESVMVKGNGTIFLAGPPLVKAATGEEVSAEDLGGATVHCKTSGVSDYFAQDELHALALGRNIIKNLHMAGKDVLANGLQNINYEYKEPLYDINELRSIAPTDLRQQFDIRSVIDRIVDGSEFDEFKKLYGTTLVTGFARIFGQPVGIIGNNGILFNESALKGAHFIELCTQRNIPLVFLQNITGFMVGSRSEANGIAKSGAKMVMAVSCAKVPKVTIMVGGSFGAGNYAMCGRAYSPNFLFLWPNARISVMGGAQAAGVLAQIEKGNKKRQGIQWSKEEEDKFKGKVVEAYEREASPYYSTARLWDDGIIDPADTRKVIGLCISASLNRAIENTKYGVFRM

SEQ ID NO: 10175 - protein, 362 aa, Sulfolobus solfataricus P2
MMKAARLVEFQKPLKIEDLDVPKVGKGDVLLKVISCGICRSDWHLWRGDPALVAYMQWSGGKLPITQGHEVYGEIVEVGESVTRLNKGDKVVMPASSTGDNRTCKYCMEGDSNVCEHLVIAGYGINGCFAEYMLIPERSVIDLVKVPDGIKSEWAALSSCGFGTSWNAFTMKTNLKPSDIVVIIGAGGMGLSGIAIANALGAKVIAIDVNERSLEKAKMLGSVETYRHSGKSEELNKIVEDIMKKYGSVDVIYDTTGIPEAVIPFLPLLKVHGTLLLAGLMMKGKEIFPLPADLVVAREIRIQGVLMLPAQKFDTIFKLMKEGKINLDPVIYKTISIYDVNDAYKEMSEYKNAGRIIINKFS

SEQ ID NO: 10176 - protein, 153 aa, Brassica napus
MPSNTASSSSAPAGSADSSASRTKSKRPKYSKFTQQELPACKPILTPGWVILTFLVISVIFIPLGVVSLFASQDVVEIVDRYDNDCVPTPARANKVAYIQGVSDKSCNRTLVVPKKMKQPIYVYYQLENFYQNHRRYVKSRSDSQLRSVKDEN

SEQ ID NO: 10177 - protein, 512 aa, Rickettsia typhi str. Wilmington
MTINASNIENSFSKINSHFSKLTDYIWPIKRNEISKFLFITLLMFCILFIQNLIRALKDSIVTTMIGAETISFLKFWGVMPSAFLITVMYVKLVNRMKAENIFYLIISIFLIFFALFAYVIFPNHEILHLRPVTVHNLTTSLPNLKWFILLLSKWSFSLFYIIAELWPNVVFALLFWQFVNNITTVEESKRFYPLFGLLSQTGIYLAGHFLENLSKINYYITDKFALQSSFHTLSIQIILTIVLILGIVSIKTFWLLNHKVLDKKHMSLLRFKTKNKSITIAKSFQMILSSRHIRLIATLLICYGIAINLVEGPWKAAATKIYKTPTEYAAFIGSYLSYTGVFTIFFVLLGSNIVRRIGWFTSAVITPSIVFITGILFFAFNNFEGFAGLIIANFILTDPALVAITIGAIQNVLSKSSKYTLFDSTKEMAYVPLEPEIKISGKAAADVIGTKLGKSGSAFLQSLIFIILPSSSYQSISICLMIIFILTCLTWIWATKELNKEYKNSIKFSQK

SEQ ID NO: 10178 - protein, 573 aa, Borrelia garinii PBi
MTLSGKRISKGIGIGEVLCIRKNFDKIVSREKIEFSQVDSEISKFNKAKLKAIEALKDLDRKAVLQFGDDKKGIFEGQVLIVEDDELSELVIELITKENYGAAYSIYLAFENLVKSVEDYKDPYLKERASDYKDIRNRLISIILGQVTDFSEINKDIILVTEELTPSDTMQFDLNYVKGFLTAVGGETSHAAILARTMGLPALVMTLLDIDALKDGDKIVIDAISSIVIKNPSSDELDLYKGKILRQVEMEKELFSLKDKDAETKDGVKVFLKANIGTPVDIAYVNKYGVEGIGLFRTEFLYMKSLQPPTEDEQFETYKRVLDTMEKKGIVTIRTLDVGGDKEIPYLNFEKEENPFLGFRALRMYKKYEELIQAQFNAIFRASHYGKIRVMVPMLTRYEEIETIEYFVNNAKISLKSRGLPFDENLEVGCMIEVPSAALISSKLANKLKFFSIGTNDLTQYVLAVDRGNQKISNLYDKYNPAVLKLIKKVLDDGISSGIDVSVCGELGGDDAGALLLVGLGFRSLSMIPSATLRIKYLLRKYTIMELEELANKVLNSNSEQETLSYFDKFIGD

SEQ ID NO: 10179 - protein, 249 aa, Brassica rapa
MKFNVANPTTGCQKKLEIDDDQKLRAFYDKRLSQEVSGDALGEEFKGYVFKIMGGCDKQGFPMKQGVLTPGRVRLLLHRGTPCFRGHGRRTGERRRKSVRGCIVSQDLSVLNLVIVKKGEKDLPGLTDTEKPRMRGPKRASKIRKLFNLGKDDDVRKYVNTYRRKFTNKKGKEVSKAPKIQRLVTPLTLQRKRARIADKKKRIAKANADAADYQKLLASRLKEQRDRRSESLAKKRSRLSSAAAKPVAA

SEQ ID NO: 10180 - protein, 404 aa, Dichelobacter nodosus VCS1703A
MNADIRAEFPILQEKNGGKRLAYLDNAASVHKPLAVMAAMDQCLKKEYSNIHRGVHWLSQRLTQRYETVREKVASFLHAERVDEIIFTKGTTDSLNLLASSLSELLLKSGDKVLITAMEHHANIVPWQIACRKAGAQLVVLPMDERGVLEAQHLPDLLSGVKIFSITQVSNALGTINPVKALIQKVKAFNPDIVCIVDGAQAVAHLPVDVQDLGCDFYAFSAHKLYGPTAVGVLYGRYDLLEAMPPYQSGGDMILSVSFEKTSYAPPPHKFEAGTPPIVEVIGLGAAIDWVQSVGLSSIQNWEQQLHAQAEKALMDFSGVRIYGTAPEKAAVISFTLNGIHPHDAGTIFDAQGVAVRVGHHCAEPVMRFFHIPATIRASFAVYNDEADVAQLLAAVRATQEMFA

SEQ ID NO: 10181 - protein, 607 aa, Parvularcula bermudensis HTCC2503
MTDDLSPPPTSPGYRVLARKYRPQSFDDLLGHEAMVRTLRNAFAADRIAHAFILTGVRGVGKTTTARIIARALNYETETIDRPTVDMPVEGRHCRAIAESRHPDVYEMDAASRTGVGDIRELIEGVRYAPIEGRYKVYIIDEVHMLSTNAFNALLKTLEEPPAHVKFIFATTEIRKVPVTVLSRCQRFDLRRFDITSLSAHLAGIAEKEEAAISKEALDMIAQAAEGSVRDALSLLDQALVQKAGEAIGAADIRDMLGLVDRTQTWDLLGAAMAGDAKTALRLFREQYDGGADAGQVMRDLLSLTHLLTRTLVAGDEAAAHGQAGEADTERAQAMAHGVPLPALTRSWSLLMKALEEVQNAPDAAAAAEIGLIRVAYAAGQPTPEEALKALGQAAPQAAAQAAPQAAPQAAPQAAPQAAPSAERAPTGAATGPQGSWSPTGGQVAVAVNAAPDAGPHTAPDPAQPSPERPARPMLTAPSPAPSPTIETLDDIAALAGVKRDARLREEIETCLIPVHLETGRLDVAVTEAAPKDLTGRLGQALKAWTGRPWIVSIVADPGEVPTIRGRRNQAIKANPVVNAALSAFPKARIAAVRPLSSPTAPGEDSA

SEQ ID NO: 10182 - protein, 257 aa, Gloeobacter violaceus PCC 7421
MELKIPKPVEIKSAKELEKMRTAGRLAAQLLQYIEPFVQPGISTQELDDLCAEWTKARGAVSAPLGYHGYPKHTCTSINQVVCHGIPNKKQLLKEGDIINIDVTPILDGWYGDSSKTFCVGNVSAEAQRLVDVTYECLMVGIAEVKPNARVGDIGAAIQAHAEAAGFSVVRDFVGHGIGRTFHTEPWVPHFGVRGKGTRLRPGMVFTIEPMINAGSWEAVVLPDKWTAVTKDGSLSAQFEHTVAVTEDGVEILTLLH

SEQ ID NO: 10183 - protein, 220 aa, Microcystis aeruginosa PCC 7806
MLNFKSSFKYFYYRRIFRMSNWFGHIVNHAGQHLAKHLGQELFKKTPEIARKVEEGVEKVGEKIQEFQRHRQEEEQRKIREATIASPQYQEYLAGITKLEEGIEELKRRRQESDLRTPNNSYGIGYYNVTLRTPNGQYTIEVPADEYILDVAEEEGLDLPSNCRAGACSTCAAKLISGNVDQSDQSFLDDDQIEDGYVLLCVAYATSNCVIETDKEEELY

SEQ ID NO: 10184 - protein, 88 aa, Oryza sativa
ALAGSGSIFETLRHGKPLIVVVNEDLMDNHQSELAEELATRKHLFCASPQTLGETIQEMDIETLNPYVPGDAKPVVSLINKFFGFPDD

SEQ ID NO: 10185 - protein, 482 aa, Frankia sp. EAN1pec
MSVSVTMPRLGESVSEGTVTRWLKKEGERVEADEPLLEVSTDKVDTEIPAPASGVLGSIKVAEDETVEVGVELAVIEDGAAGAGAAAAPAEAPAAAPEPPPAPAAAAPPPPPAPPAPSAPAPAPAAAPPPPPAPATPVPAQAPVAAPDAAADGLGRYVTPLVRKMAAELGVDLGSVTGSGPGGRITKQDIQDAAKSRGSAPAAAPSAPAAPAVPAAPAPAQAPAAPAAARPAPAAAPTASTAPRGRTEKLTRLRSLVARRMVESLQVSAQLTTVVEADVTRIAKLRERAKANFQAREGVKLSFLPFFAVAACEALREHPGINSSIDLEAGTVTYHDSENLGIAVDTDRGLVVPVIHNASDLNLSGMARKIDELAARTRANQVSPDDLGGGTFTLTNTGSRGALFDTPIINQPQVAILGTGSVVKRPAVVTDPELGEVIAIRSKVYLALTYDHRIVDGADAARFLTAIASRLEEGAFEAELGL

SEQ ID NO: 10186 - protein, 460 aa, Frankia sp. EAN1pec
MADTAAGPVDLVVLGGGSGGYAAALRAAELGLRVVLVEKDKLGGTCLHRGCIPTKALLHAAEVVDTVAASESFGIRATLDGIDMAGVRAYRDSVVDGLYKGLSGLVRARGIEVVTGTGRLVSPTAVAVGDRVVEARHVLLATGSAARTLPGLDLDHRTVIDSGDALALEHVPGSVVVLGGGAIGCEFASVWRSFGAEVTIVEALGHLVPAEDEASSKLLERAFRARGIALRLGVPLAGAKTTDRGVTVVLEDGSTVDAELLLVAVGRGPVSAGLGLDEVGVSTDRGHVLVDTHLRTNIPTVSALGDVRPGPQLAHVAFAEGILSAELLAGLDPVPVDYDNVPRVTYSHPEVASVGLTAAAARERHGEINTATYHLAGNGKARILRSAGAVTVVSAADGPVVGVHMVGDRVGELIAEAQLITNWEAYPADVAQLLHPHPTLSEALGEAHLALAGKPLHVHS

SEQ ID NO: 10187 - protein, 152 aa, Physcomitrella patens subsp. patens
MANSEVTFIMIKPDGVQRGLIGDIICRFEKKGFFLKAMKMVQVERSFAEKHYSDLSTKSFFGSLVEYIVSGPVVAMVWQGKGVVATGRKIIGATNPAASEPGTIRGDYCIEVSRNIIHGSDAVESAQKEIALWFPDGIIDWRSANHSWIYEN

SEQ ID NO: 10188 - protein, 481 aa, Neisseria meningitidis Z2491
MSTQTNFDLVLFGATGDLAMRKLLPCLYQAHVAGLLHPEGRILGVSRSELDTEGFLAKVETSSKIHVKENFSDEAWASFVERLAYLKVDVTQPDDFAALGDLVKARKNTENVVIYLSTAPKFFAQACENLAAIGLNADNVRVVLEKPLGTDLASSQQINTDVARYFKEGQIYRIDHYLGKESLQNLLALRFANVMFEPLWNNKYIESVQLTIAEQLGVEERGEFYDITGALRDMVQNHLMQMLCMTAMEAPASLDADAVRDEKVKVIKSLKPLTVESVNENVVRGQYTAAKGMNGYLEEINVLQDSFTETYVAIKAEIENERWKGVPFYLRTGKRMAGKVAEIVLNFKDLNSHIFEGSRTAPNRLVIELQPYESVRLYTQMKTPGAGNKVETVPLATDLGKALESRRAEAYERLLLDVINGKLALFNRRDELEAAWEYVMPILENWTNNTTPPHGYGAHSWGPEAARELLARDGHKWHEEQ

SEQ ID NO: 10189 - protein, 470 aa, Bradyrhizobium sp. BTAi1
MSDYHLLIGGALVPGETTMPVINPATEEVLTDCPRASKDQLDAAVAAAKAAFPAWAATPITERRRLIGKMADIIEAHANDLARILTSEQGKPLADATGEVLGMAGFFRYLASLDLPMRVLERSGDRQVEAYRRPLGVVGAIIPWNFPLLILGFKLPPALLAGNTLVVKPAPTTPLSTLRFAELVKDVLPAGVLNVIADANDLGDPMTKHPDIRKISFTGSTATGQKVMASAAQTLKRITLELGGNDAGIVLDDVDPKTVAPGIFDGAFQNSGQVCLAIKRLYVHESVYDEICDELVAIAKSTVVDDGSKQGTKLGPLQNKMQYEKVKAFLDDAHKNGKVIAGGAAMDRPGYFIAPTIVRDIAEGSKLVDEEQFGPVLPVIKYSDSDDVIRRANASSYGLGASVWSSDPKRAHEIATRIEAGTVWINKHLDMAPHIPFGGAKQSGIGTEFAEEGLAEFTQLQIINGPGVAA

SEQ ID NO: 10190 - protein, 250 aa, Neisseria meningitidis Z2491
MGYMIDGTQAEYVRTQAEYVRTQAEYVRTPYADNSLVPLPDNVNEEVALLLSDALPTAHEIGVQYGDVKPGDTVFIAGAAPVGMSALPTAQLYSPAAIIVCDMDENRLKLAKELGATHTINPASGDVSKQVAAIVGEDGVDCAIEAVGIPATWNMCQDIVKPGGHIAVVGVHGQSVDFKLEKLWIKKLAITTGLVNANTTEMLMKAISSSSVDYTKMLTHRFKFSELEKAYDVFKHAAENQAMKVVLEAD

SEQ ID NO: 10191 - protein, 652 aa, Debaryomyces hansenii CBS767
MSKIFQTKLAKTALAAAAGVGGTIVYLDFIRPPVVSDLNNSYKPLRKELATPPSRESLLNKLETTPKFDVIVVGGGATGTGTAVDAATRGLNVCLLEKSDFASGTSSKSTKMAHGGVRYLEKAIFQLSKAQLDLVIEALNERGNMLRTAPHLCSVLPIMIPVYKWWQVPYFFVGCKMYDWFAGHQNLRSSTVFSREMTSAIAPMMDDSNLKATCVYHDGTFNDARMNATLAITAIDQGATVLNYMEVKQLVKKDDKITGVLAVDRETGKEYNINATATVNATGPFADKLLEMDKDPQGLPPKIDQPPRMVVPSSGVHVVLPEYYCPRDMGLLDPSTSDGRVMFFLPWQGKVLAGTTDTPLKSVPENPIPTEEDIQDILQELQKYIVFPVNRTDVLSAWSGIRPLVRDPSTIPEDEQPGSGSTQGLVRSHFISQSPSGLLTISGGKWTTYREMAQETVDTLVKNYDFDGKNNALLPCQTNKIILAGGEDYSKNYSARLIHEYRIPLKLAKHLSHNYGSRASLILELYHQSDYNKLPITLAANKSFEPSEDKESEENILSYQSFDEPFTIAELKYSLKYEYARTPVDFLARRTRLAFLNAREALTAVDGVCAIMEHELKWDEETTKKMKFEANDYIGKMGISPKRFDVEDFIVQ

SEQ ID NO: 10192 - protein, 406 aa, Escherichia coli
MIFSVDAVRADFPVLSREVNGLPLAYLDSAASAQKPSQVIDAEAEFYRHGYAAVHAGAHTLSAQATEKMENVRKRASLFINARSAEELVFVRGTTEGINLVANSWGNSNVRAGDNIIISQMEHHANIVPWQMLCARVGAELRVIPLNPDGTLQLETLPTLFDAATRLLAITHVSNVLGTENPLAEMITLAHQHGAKVLVDGAQAVMHHPVDVQALDCDFYVFSGHKLYGPTGIGILYVKEALLQEMPPWEGGGSMIATVSLSEGTTWTKAPWRFEAGTPNTGGIIGLGAALEYVSALGLNNIAEYEQNLMHYALSQLESVPDLTLYGPQARLGVIAFNLGAHHAYDVGSFLDNYGIAVRTGHHCAMPLMAYYNVPAMCRASLAMYNTHEEVDRLVTGLQRIHRLLG

SEQ ID NO: 10193 - protein, 410 aa, Vibrio fischeri ES114
MNFTPNNVRTQFLSLTQEVDNKPVIFFDGPGGSQVPQSVIDSMSRYLGFSNSNLGGHFFSSKNTNNVLNQARLSCAALLNAKSEENIIFGPNMTSLTFQLSRAISRDWKRGDEIIVTALDHYSNVSSWQQAAEDKGVIVHQVRVKEDDCTLDMEHLYSLLTEKTKLVATTYASNTTGSIVDVKSIVEAAHNVNAMVYVDAVHYAPHHLIDVQALGCDFLACSAYKFFGPHVGIAYVSPKWMYALFPYKVEPATNVGPGRFETGTQSFEALAGLTSAVEYLAQWGRKSLSLRDRLKKSFEQYQIHEDELTQHFLNKLAVRPWIHLYGINDKNKLTERTPTFALRIDGIKPEEIAKVLAEYNVCVWSGHFYAIGLIKQLGFYERGGVVRIGFMHYNTIEEIDYLFLLLDAFA

SEQ ID NO: 10194 - protein, 498 aa, Lysipomia pumila
MRINPTPSGSGVSTLEKNKPGRIGQIIGPVLDVAFPPGKMPNIYNALVVKGRDTLGEPINVTCEVQQLLGNNRVRAVAMSATDGLMRGMEVIDTGAPLSVPVGGATLGRIFNVLGEPIDNLGPVDTRTTSPIHRSAPAFIELDTKLSIFETGIKVVDLLAPYRRGGKIGLFGGAGVGKTVLIMELINNIAKAHGGVSVFGGVGERTREGNDLYKEMRESGVINEKNFAESKVALVYGQMNEPPGARMRVGLTALTMAEYFRDVNKQDVLLFIDNIFRFVQAGSEVSALLGRMPSAVGYQPTLSTEMGSLQERITSTKKGSITSIQAVYVPADDLTDPAPATTFAHLDATTVLSRGLAAKGIYPAVDPLDSTSTMLQPRIVGDEHYETAQSVKQTLQRYKELQDIITILGLDELSEEDRLIVARARKIERFLSQPFFVAEVFTGSMGKYVGLAETIKGFQSILSGELDGLPEQAFYMVGNIDEATAKAMNLEMESNLKK

SEQ ID NO: 10195 - protein, 224 aa, Fulvimarina pelagi HTCC2506
MAVADQYHAVKNAIAKAMADAGRKPDSVALVAISKTHGEDKILPLLEAGHRVFGENKVQESQAKWPTLRERFPDIELRLVGPLQSNKTGDAVALFDVIESVDREKIARAIAKEVEKQGRNPRLYVQVNTGEEEQKAGILPKEAVAFVERCRSEHGLTIEGLMCIPPVDENPGPHFALLAKLAGEAGVEKLSMGMSGDYETAIQFGATSVRVGSAIFGERDYSGN

SEQ ID NO: 10196 - protein, 228 aa, Leuconostoc mesenteroides subsp. mesenteroides ATCC 8293
MSSSQDLQKIIAGRRAADFVQDGMVVGIGSGSTIAQVITALGERVANENLKIVGVPTSEKTRRNAAKLGIPMYNVDDVDKIDLTIDGADQISDDFSAIKGGGAALLWEKIVAFNSRENIWVVDSSKRVSKLNQYLPVEIIPYGSDQLFKRFTADGFHPTWRLDQNGNPVRTDSANYLIDLHVPVIEDPRDLGQELINMVGVVEHGLFTDVVNRVVIGSDDGVEIIEAP

SEQ ID NO: 10197 - protein, 498 aa, Lysipomia sphagnophila
MRLNTTPSGSMVSTLEKNKPGRIGQIIGPVLDVAFPPGKMPSIYNALVVKGRDTLGKPINVTCEVQQLLGNNRVRAVAMSATDGLMRGMEVIDTGAPLSVPVGGATLGRIFNVLGEPIDNLGPVDTGTTSPIHRSAPAFIELDTKLSIFETGIKVVDLLAPYRRGGKIGLFGGAGVGKTVLIMELINNIAKAHGGVSVFGGVGERTREGNDLYKEMRESGVINEKKFAESKVALVYGQMNEPPGARMRVGLTALTMAEYFRDVNKQDVLLFIDNIFRFVQAGSEVSALLGRMPSAVGYQPTLSTEMGSLQERITSTKKGSITSIQAVYVPADDLTDPAPATTFAHLDATTVLSRGLAAKGIYPAVDPLDSTSTMLQPRIVGEEHYEAAQNVKQTLQRYKELQDIITILGLDELSEEDRLIVARARKIERFLSQPFFVAEVFTGSMGKYVGLAETIKGFQLILSGELDSLPEQAFYMVGNIDEATAKAMNLEMENNLKK

SEQ ID NO: 10198 - protein, 724 aa, Arabidopsis thaliana
MGGKSEPAKSESMATKPDLLNTSFFSFKSLKLKTKQQELLLRISILGLVYILAFIARLFSVLRYESMIHEFDPYFNYRTTLFLTEKGFYEFWNWFDSESWYPLGRIIGGTLYPGLMVTAALIYWTLRFLRFFVHIREVCVLTAPFFASNTTLVAYFFGKELWDTGAGLVAAVLIAICPGYISRSVAGSYDNEAVAIFALLLTFYLFVKAVNTGSLAWALASAFGYFYMVSAWGGYVFIINLVPLYVLVLLITGRYSMRLYIAYNCMYILGMLLAMQIRFVGFQHVQSGEHMGAMGVFLLMQVFYFLDWVKYQLNDTKLFQTFLRITVTSAILVGGVAVGVGTASGYISPWTGRFYSLLDPTYAKDHIPIIASVSEHQPTAWSSFMFDYHILLFLFPAGLYFCFKRLTDATIFIVMYGLTSLYFAGVMVRLILVATPAVCLISAIAVSATIKNLTSLLRTKQKVSQTGSTKGAGSSKASSKVTLDQSQPFQKNGAIALLVGVFYLLSRYAIHCTWVTAEAYSSPSIVLAARGAHGNRIIFDDYREAYYWLRQNTATDAKIMSWWDYGYQITAMGNRTVIVDNNTWNNTHIATVGRAMSSYEDDAYDIMRSLDVNYVLVVFGGVTGYSSDDINKFLWMVRIGGGVFPVIKEPDYLVNGEFRTKVYKLCYYRFGELTTEYGKPPGYDRARGVEIGNKDIKLEHLEEAYTTSNWIVRIYRVKPPTNRL

SEQ ID NO: 10199 - protein, 545 aa, Bradyrhizobium sp. ORS278
MPALAHALLVALKDHGAREIFGIPGDFVLPLFRVIEESNILPSVTLSHEPAVGFAADAAARYHGGLGVAVVTYGAGAFNVVNAVAGAYAERSPVVVIAGAPGARERLSGFLLHHQARTVDTQLAVFKEITCDQAVLSDPATAPAQIARVLRSAREMSLPVYLEFPRDMVDAEVEAVVPLPPRTANREALDECVDEILARIAQAQRPVIVVDVEIRRYGVEDQIAALARKLGLPLVTTFMGRGLLDNADDVVAGTYLGAAGNPAITQLVEEADLVLMLGVILSDTNFALSNRAPDPRRMILASSREVQIGHHAYRDMPLRDLIDALAQRAAPRAAQPGTPRQRSSYPRRLSSDDQPIAPSDIATAINDMFDRHGRMPMTSDIGDCLFTAMEIDNTALAAPGYYAGMGFGVPAGIGVAATGLRPLILVGDGAFQMTGWELGNCRRYGLDPIVVLFNNCSWEMLRVFQPESRFNDLDDWHYADVANAIGGAGERVATRAALVAALERAVQRRGQFSLVEVMLPRGKTSDTLARFVAGFKSARERMAKA

SEQ ID NO: 10200 - protein, 465 aa, Streptococcus pyogenes
MNKTKQNKTKQNKTKQNKTKHSPLCRYGLTSAAALLLTFGGASAVKADGNANGKEELMNSLSQKLEKINDLRTLNGDRESIKSLVEYLTERGKLEEEWMEDLFSGIQRKLLAGEKGDPGEKGDPGERGATGQVGPRGEKGDPGEKGATGQVGPRGEKGDPGEKGATGPAGPRGEKGDPGEKGATGQVGPRGEKGDPGEKGATGPAGPRGEKGDPGEKGATGPAGPRGEKGDPGEKGDPGEKGATGPAGPRGEKGDPGERGATGPAGPQGPAGQAGKDGERGPVGPAGKQGERGEKGEQGPAGKDGERGPVGPAGKDGQNGKDGLPGKDGKDGQDGKDGLPGKDGQDGKDGLPGKDGQDGKDGLPGKDGKDGKDGLPGKDGQDGKDGLPGKDGQDGKDGLPGKTAPKTPEVPQKPDTAPHTPKTPQIPGQSKDVTPAPQNPSNRGLNKPQTQGGNQLAKTPAAHDT

SEQ ID NO: 10201 - protein, 446 aa, Thermobifida fusca YX
MTHQGIQQFVLPDVGEGLTEAEILTWHVQPGDQVDVNQVICEIETAKAVVELPSPFAGRVEALLVEAGETVPVGTPIIAVDTGGAAGEPRPEPAPAAAPAEPPAEEKREPVLVGYGVKSGATKRRARRRTPSAVPAQTVGQRTVVLAKPPVRKLAKDLGVDLRTVVPSGPNGVITRDDVRRHAEQNQPQPSAPRVPEPAAPAPAASPAPERDVREERIPVKGVLKHMAAAMVDSAFTAPHVTEFLQVDVTKTVKVVQKLRQRPEFADVKVSPLLLVARALLIAVRRHPRINASWDEANQEVVVKHYVNLGIAAATDRGLVVPNIKEADRLPLPDLARALTDLTEKARAGQTAPADLTGGTITITNIGVFGIDGGTPILNRGEAAILALGQIRDMPWVHKGKIKIRKVTTLSLSFDHRLVDGELGSKVLRDVATILEDPEEMVLAWG

SEQ ID NO: 10202 - protein, 470 aa, Photobacterium profundum SS9
MSQNVYQFIDVARVDPAKKPLNIRKIEFVEIYEPFTQQQAGAQADRCLDCGNPYCEWKCPVHNYIPQWLKLANEGRILEAVELAHQTNTLPEVCGRVCPQDRLCEGSCTLNEDFGAVAIGNVEKYITDKAFEMGWKPDMSHVEWTDKKVAIIGAGPAGLSCADILVRNGVKPVVFDRYPEIGGLLTFGIPSFKLEKEVMINRRKVFTEMGVEFQLNTEIGKDIQMNDLLKGYDAVFLGVGTYKNMRAGLENENAAGVYDALPFLVSNTYKVMNLNTEIDFTDMKGKRVVVLGGGDTAMDCVRTSIRQNAKNVICAYRRNAANMPGSRREVKNAREEGVKFMFNLQPLSIKINDQGQATGVNVVKTKLGEPDEAGRRHPELVEGSEHLLEADAVIMAFGFQPHAMPWLEKYAVDIDQRGRIKAPETATFPFQTSNEKIFAGGDAVRGSDLVVTAINEGRLAAQGILDYLEV

SEQ ID NO: 10203 - protein, 295 aa, Pseudomonas fluorescens Pf-5
MITAYQASSQARVDAAMHTLFTAPSPELARLYEAMRYSVMNGGKRVRPLLAYAACEALGGKPEQANGAACAVELIHAYSLVHDDLPAMDDDDLRRGQPTTHKAFDEACAILAGDGLQSLAFSALLDPALSDASAEIRLRMVTTLAQAAGPAGMVGGQAIDLGSVGLKLDQQALEYMHRHKTGALIEASVILGALASGRAEKGELKALQTYAQAIGLAFQVQDDILDVESDTATLGKRQGADIARDKPTYPALLGLAAAKEYALELRDQALHALRPFDAAAEPLRELARYIVERRS

SEQ ID NO: 10204 - protein, 460 aa, Synechococcus elongatus PCC 7942
MLQFLSSALGWPPILAETIEIIESPEASTLILVSVLLGLVVVYLASKLGGELCVRVNLPPVLGELLGGVLVGTSVLRLLVFPSSGAGAEDVVLLNFLQQISGAPDNWMPTIFATQSEVISVLSEIGVIILLFEIGLESNLDELLKVGTKAAIVAVVGVAAPFAAGTLGLIYLFHIATIPAVFAGAALTATSIGITAKVLSELGRLNSPEGQIIIGAAIIDDILGIIVLAVVSSLAKTGEIRPSNIVILIVSSTAFLVGAIFIGRWLNPFFVNLVSSMQTRGEVLVVALVAAILAGLIAQFVRLEAILGAFAVGLILAETEKGEELKEQVKPLADVLVPIFFVVVGAKTDLSVLNPADPVNRAGLIIAGFLLVVAVLGKVITGFSLVGSSTPLNRLAIGVGMIPRGEVGLVFAGVGASSGILSESLNAGVIVMVIMTTFLAPPLLRLAFRGEPTTAVEPGS

SEQ ID NO: 10205 - protein, 633 aa, Pseudomonas fluorescens Pf-5
MPTTFHEIPRKRPTTPLLDRAQTPDGLRRLGEAELETLADELRLELLYTVGQTGGHFGAGLGVIELTIALHYVFDTPDDRLVWDVGHQAYPHKILTGRREQMASLRQKDGLAAFPRRSESEYDTFGVGHSSTSISAALGMAIAARLQNSERKAIAVIGDGALTAGMAFEALNHAPEVDANMLVILNDNDMSISRNVGGLSNYLAKILSSRTYASMREGSKKVLSRLPGAWEIARRTEEYAKGMLVPGTLFEELGWNYIGPIDGHDLPTLIATLRNMRDLKGPQFLHVVTKKGKGFAPAEVDPIGYHAITKLEPLDAPAAAPKKAGGPKYSGVFGEWLCDMAAADPRLVGITPAMKEGSDLVAFSERFPLRYFDVAIAEQHAVTLAAGMACEGAKPVVAIYSTFLQRGYDQLIHDVAVQNLDVLFAIDRAGLVGEDGPTHAGSFDLSYLRCIPGMLVMTPSDENELRMMLSTGHLYNGPAAVRYPRGTGPNAPIDKSLEPIEIGKGVIRRQGRQVALLVFGVQLAEALQVAEKLDATVVDMRFVKPLDEALVREIASSHELLVTIEENAIMGGAGGAVSEYLARENILKPILHLGLPDAYVEHAKPAQMLAECGLDEAGIEASVRQRLALLGLA

SEQ ID NO: 10206 - protein, 490 aa, Photobacterium profundum SS9
MGKPTGFLEFGRELPQKVDPSVRIQDNKEFVLNDDFGDKINTQASRCMDCGVPFCHNACPIGNIIPEFNDAVFRDSWEEAWNILSSTNNFPEFTGRVCPAPCESGCVLGINQDPITICNIEKTIVETAYREGYAKPKTPRTRTGKTIAIIGSGPAGLSAAEQLNSAGHCVTVFERDEKVGGLLRFGIPDFKLGMDIIDRKIDLMSDAGVKFEVNAHIGVTVNAQQLRHEFDVVLLTGGSTVPRNLPIPGRELTGVHFAMEFLAQNNRRANDMDLKTEEIHAKGKHIVVVGGGDTGSDCVGTSNRHGAASITQVEIMPIPPGQRPTNQPWPSYPMIMKTSTSHEEGCDRHWNILTKEFIGDEAGNVKALRIADIQWQEAKPGERPGFDEIAGSERIIPCDMAFLAMGFLHPEPTGVIAQLDIKLDERGNIATTGFATSQKGVFAAGDMRTGQSLVVRCINEGRECAREIDDFLMGNSNLEAKDDSLMLSQA

SEQ ID NO: 10207 - protein, 464 aa, Borrelia garinii PBi
MDVGIYGLGVMGGNLALNIADNGFNVSVYNRDSEKTEIFVKQNSHKKINGFKDVESFVKSLKPPRKIILMVTSLAVEKVVEQILPLLNKSDIIIDGGNSHYKNTMRIEKELFAKDIYFVGLGISGGERGARFGPALMYGGSKSAYEILEPILNKIAAKTKNNDVCSTYIGENGSGHYVKMIHNGVEYADMQLISEVYFFMKKAFNLDNSKISEVFEKWNEGDLSGYLLEITSKILRYKENNEYLVDKILDVANQKGTGVWTSIDALESSMPVNLILESVFSRFMSGLKHERIIASDLLKMDTASFEFELSDWILDLYYALLVSKIVAYAQGFMMLKTASVNYSWDLNLGKISLVWREGCIIRSSFLDKIKLAYDKNPHLINLLFDDYFLDLLKNNHKSLRRIVSKASEIGIPLPAFYASLSFLDSYSTNYLPSNLIQAQRDFFGAHSFERLDSKRGEFFHSIWQ

SEQ ID NO: 10208 - protein, 108 aa, Vitis vinifera
MDKSGAFVAVDPMPGTLLVNLGDIATVWSNGRLCNVKHRVQCKEAAVRLSIASFLLGPKDAAVEAPPELVDSEHPRLFVPVTYEDYRKLRLSTKLQAGEALALVRVDS

SEQ ID NO: 10209 - protein, 205 aa, Pseudomonas fluorescens Pf-5
MPVVFVAACKLPTPFAQFTMHGFLDEATGREHVVLSLGDIADGAPVLGRLHSECLTGDALFSQRCDCGSQLEAALQAIAREGRGVLLYLRQEGRGIGLLNKIRAYELQDGGADTVEANERLGFAADQRDYAMCLPMLEHLGVKSLRLMTNNPRKVKALTEMGIQVAERVPLHTGHNPHNKLYLATKASKLDHMMGNEHQGEVDRA

SEQ ID NO: 10210 - protein, 291 aa, Parvularcula bermudensis HTCC2503
MSKVLLLGAGYSARVFADQALAEGWLVSGTTRDTHKAKALSQAGIEPYLWEAGTPLPRAAISTADLIVVSISPQGDGCPAAAALAEACPSPSTRVIYLSSSGVYGDHGGAWIDETTPPSPSGERGRRRLAAEAAWQDLAAAFGLDLVLCRLAGIYGPGRNALNSLMTDSQGAKSGLSQRVIKEGQVFNRIHVEDIARLLLALAEAETWPAIVNGADDLPSPPQDVILYAAALLGKEPPPAVAFEAAALSPMARSFYVDNKRLKNQRLHTLLPTGLRYPSYREGLRALLSKP

SEQ ID NO: 10211 - protein, 543 aa, Brassica rapa
MASMSMSSREKRRKRKREASPESTTPVSKPTPASTPRWSSPIPSLPYDLVLLCVARVSRLYYPTLSLVSKSFRSLVSSPELYKTRSLFGFTESCLYVCLQDLRGSSTWYTLCRKPDKTLKTGSSGYALSKVPVPSSPIWRCSNVVAVGSNIYNIAFPRSLNVLPRVSILDCKSHTWIEAPSLPVELHSFSASVVHQKIYVAGFDHRLKKNSFEVFDTETQIWDSVSTGNTSVEREGIEREGMFIKKTISIDGKFHVVTDEEVFAYDPKLAKWDMVGRGMRGLMYSEAYCVIGNVLYSAKEGVFKWYDTERRTWKDLQGLVGLPKITRHREFIRLGYYGGKMVVFWVHVIWPYYKKICFFEEAQLVLADLWFWSCNEKIREYTAQVLYFAVKTLKETGHEHVYDAVEKPLQLAQTAAVLEVQSHFLVASLVISWSITEIIRYSFFGLKEALGFAPSWHLWLRYSSFLVLYPTGITSEVGLIYLALPHIKTSEMYSVRMPNTLNFSFDFFYATILVLAIYVPGSPHMYRYMLGQRKRALSKSKRE

SEQ ID NO: 10212 - protein, 345 aa, Dichelobacter nodosus VCS1703A
MTSLLSTVQQFIDPEINCPVFADAQITGDHNHLFIETGFPCTLEHKRWQTMLAAQFNVAAVTFTQNIATHSVQTNLKPLANVKNILAVASGKGGVGKSTVAINLAIALQQQGAAVGILDADIYGPSVAKMLGGAQRPQTPDGKMITPIMRHQIQSLSMGDLLDEDSAVIWRGPMLTQTLVQLLRECQWQDLDYLIIDLPPGTGDAQLTLAQQIPVSGALIVTTPQDIALLDVKKAKTMFDRVRIPVLGLVENMSVFHCPHCHGTSYIFGQDGGKNLAKHYDLPLLAALPLAEEFCQLGDLGTPLTAAKPQSPLAKPYQTMAYHVGYRLAQQKKNDAAVFPKIVLE

SEQ ID NO: 10213 - protein, 668 aa, Parvularcula bermudensis HTCC2503
MDIGIVILGISALSVGAILAGAAGQKIDAPILLIFLLVGMLAGREGPGGVSLDASQTVLVWGSAALASILFEGGLRTEARTFSIGVWPGLTLALLGTILTAVVLAPIAHIAFGLGWTEALLLGAIVSSTDAAAVFALAATGLRMPIKVRAVLEVESGLNDPIAIFLVIGLASSLALDPMSATDWAGSFIAKLSLGTIVGIGMGHLVPRLLTDMTLPQGLLTILVAGFGFMAFGLAETVGGSGFLAIYLTGLTMARTAPDFTQRAAGVMDGLAWLAQTGLFLVLGLLVTPSLLADVALPAFLLSLALILLARPIGVVASLLPFRFRSRDMAFVSWAGLRGATPVFLGLIPAAIGVENGSFFVSAATVVVLLSLVIQGWTAPLVGRALKVTMAEDGTSLDRGAMWARLGAVGASIVVGAWFASVLAPPPGDDPDLMAPETMAELRDGLEDAALIPTRFPTGFSSLPLDERRPLFIATLAQVVEATNQRIETDRVRLKELAAERRRRGRLSLEEEAEAAQIARRYGLRLTTPRALLDRIDVIPPRLAIAQAALATGWGSAGAAVEANAVYGRRRDEGFSSLITATQDLASLYAAHEDFGRLRAARVAARRAERVPTAEELAPLIGAYAREADIYLAQIAELLRTDSLAQPLPQPGPPADEGETPTEDSNGE

SEQ ID NO: 10214 - protein, 185 aa, Rickettsia typhi str. Wilmington
MLIIPYKGIIPKIAKSAYIAKNSSLIGDVVIGNNSSIWFNTVLRGDVESIKIGNNTNVQDGSVIHTSRFNGPVEIGNNITIGHLSLIHACTIHNNAFIGMSTTIMDNAVIEEYAFIAAGSLVPSKKIIKSNELWMGSPAKFIRYLTDQDLQYMEDNIRNYVELANLYKTQSQCTLHSINNCKKLS

SEQ ID NO: 10215 - protein, 105 aa, Arabidopsis thaliana
  misc_feature (22)..(22): Xaa can be any naturally occurring amino acid
FVESPVTRKTNKDMTNILSNGXRVSSMKVWPPLGKKMLETVCYLPDLSDVDAAKEVDYLIRNKSAPCVRIVLEHRFVYRDHRNTPGYYNGRYCTMWKSSLFRCTD

SEQ ID NO: 10216 - protein, 285 aa, Parvularcula bermudensis HTCC2503
MKEKIAFQGEPGAFSEEAARKFLSQYDPLPCSSFAEVFRAVEEGAALEALVPVENAIAGRVDDVYRLLPDMPFVIYAEHFLPVHMQLMTIPGRDENDLRIVRSHPMALGQCAQMIARRGLKAEVAMDTAGAAKALAATREEGVAVIAPEAAAALYDLEIIERNVQDADKNVTRFLRIGAETDAVWPDLLSGPVLTSIVFRVRNIPAALYKALGGFATNGVNLFKLESYQEDASFTATRFQAEFEGHPDEPPVRRALEELGWFSSDLRLLGVFPADPYRSAQSRRS

SEQ ID NO: 10217 - protein, 193 aa, Glycine max
MASTDKPGGDPEYRTSSTPAPAGVDYFKFDVILRFLLFAASLVAVVVIVTANQTEVIRVPQPVPWPAKFRYSPAFVYFVAALSVTGLYSIITTLASLFASNKPALKTKLLLYFILWDALILGIIASATGTAGGVAYLGLKGNRHVVGWNKICHVYDKFCRHVGASIAVALFGSVVTVLLIWLSAYSIHSRVPK

SEQ ID NO: 10218 - protein, 390 aa, Triticum aestivum
MLACALQTMGSSCSRPHSVNEADAADNTRSADIDRRILQETKADQHIHKLLLLGAGESGKSTIFKQIKLLFRTGFDEAELKGYTPVIHANVFQTIKILYDGAKELAQLETESSKNVISPDNQEIGEKLSEIGGRLDYPLLNKELVQDVRKLWEDPAIQETYSCGSVLQVPDCAHYFMENLDRLAEPDYIPTKEDVLHARVRTNGVVEIQFSPLGESKRGGEVYRLYDVGGQRNERRKWIHLFEGVDAAIFCAAISEYDQLLFEDGTQNRMMETKELFDWVLKQRCFEKTSFMLFLNKFDIFEREIQKVPLTVCEWFKDYEPIAPGKQDVEHAYEFVKKKFEEVYFQSSKPDRVDRVFKIYRTTALDQKLVKKTFKLIDESMRRSREGTGT

SEQ ID NO: 10219 - protein, 519 aa, Fulvimarina pelagi HTCC2506
MATSDQAAGADQDVSSETAGEGATGSLKLLPMLIGLGVFVVLLILPPPEGLAIEAWRVVAVASLMIVWWITEAIPVPATALVPLVLFPLTGATSMDDAAAPYADPTIFLFMGGFMLAGAMERWNLHRRIALNIVSRTGSRQHHIVGGFMLATAFLSMWVSNTATTVMMLPIALSVVGLVGDETGNAADAKKFALALLLGVAYSASIGGVATLIGTPPNALLAGTLSQNYGYDLGFGRWMLIGLPVAILMLGISWFLLTQFAIGLKKDEIEGAQEVIKRELIGLGSMSRAETIVGAVFAGAAVLWILRSWLQNFVPELDDAAIAIGAALLLFVIPTSEKDGDGTRIGLLDWKTAAKLPWGVLILFGGGLSLAAAVTETGLDEWIGSAIGSFAGTLTLIVLVLVVASIMLMLTEFTSNTATAATFLPLLAALSQNIGENPLMLAVPAALSASMAFMMPVATPPNALVFSSGHVTIPQMVRYGAWHNLAALIVVSTIGYLVLTTLFGVTVGEMPDWASGTGN

SEQ ID NO: 10220 - protein, 647 aa, Brassica napus
  misc_feature (324)..(324): Xaa can be any naturally occurring amino acid
MAFPIDHSLADLTKLNLLPKPHGHASDMFPFRLSVFPRVHLSLRTSTSRVLSSLGSKVDPNGSVLIETTTPPEPSPDVTGGVQDVYGEDAATEDMPITPWSLSVASGYTLLRDPHHNKGLAFSQRERDAHYLRGLLPPTVISQDLQVKKMMHTLRHYQVPLQRYMAMMDLQETNERLFYKLLIEHVEELLPVVYTPTRGEACQKYGSIFLRPQGLFISLKEKGKILEVLRIAPEKNIQVIVVTDGERILGLGDLGCQGMGIPVGKLSLYTALGGVRPSACLPVTIDVGTNNEKLLNDEFYIGLRQRRATGEEYSELMHEFMTAXVKQNYGEKVVIQFEDFANHNAFDLLAKYGTTHLVFNDDIQGTASVVLAGLIGALRFVGGSLANHRFLFLGAGEAGTGIAELIALEISKKCQIPLEEARKNIWLVDSKGLIVSSRKESIQHFKKPWAHDHKPIKELVDAVKAIKPTVLIGTSGVGQTFTQEVVETMAELNEKPIILSLSNPTSQSECTAEQAYTWSKGRAIFASGSPFAPVEYEGKTFVPGQANNAYIFPGFGLGLIMSGTIRVHDDMLLAASEALAEQLKEEHYEKGMIFPPFRNIRKISARIAAKVAAKAYELGLATRLPQPKELEKCAESSMYSPSYHSYR

SEQ ID NO: 10221 - protein, 339 aa, Thermobifida fusca YX
MTETDSYDVICIGETMGQLSPASAVPLVEQPPLLPRIGGAESNVACGLAGLGHRVAWMSRVGDDPFGAIITRTLARYGVDTSLVEVDQERPTGLYLKDPAPKGTRVYYYRRESAASAIGPRLAERPELRTARLLHLSGITPALSTSCAAFVQRLFVSRPAHGPLLSFDVNYRPALWPADDAAPVLLDLARAADLVFVGRDEAEQLWQASTADQVRALLPDVPLLVVKDADVGATSYTGARRVFVPAPRVDVVEAVGAGDAFAAGFLSGLLDDRTPEECLRLGHIMAAATLLSVADLAPFPPREARERLLALSPAAWAALCIPDPDLFPLDPSDPLFSGA

SEQ ID NO: 10222 - protein, 340 aa, Brassica rapa subsp. pekinensis
MDHEADAYRTDLMTITRFVLNEQSKYPESRGDFTILLSNIVLGCKFVCSAVNKAGLAKLIGLAGDTNIQGEEQKKLDVLSNDVFIKALVSSGRTSVLVSEEDEEATFVESSKRGKYCVVFDPLDGSSNIDCGVSIGTIFGIYTMEHSDEPTTKDVLKPGNEMVAAGYCMYGSSCMLVLSTGTGVHGFTLDPSLGEFILTHPDIKIPKKGNIYSVNEGNAQNWDGPTTKYVERCKYPKDGSPAKSLRYVGSMVADVHRTLLYGGIFLYPADKKSPNGKLRVLYEVFPMAFLMEQAGGQAFTGKKRALDLVPKKIHERSPIFLGSYDDVEEIKALYAAEENN

SEQ ID NO: 10223 - protein, 476 aa, Symbiobacterium thermophilum IAM 14863
MAQRLASMRIIVRLEIENTGSIFSYIATAIGASGGDIVAVDLIQSRRDVVVRDITIAVENRAHGDRIVQALAALPGVKVVNVSDRIFLAHLGGKIEVKPRVQVKTRDDLSVVYTPGVADVCRAIAEDPAKAFTLTIKRNTVAVVTDGTAVLGLGNIGPAAALPVMEGKAMLFKQFAGVDAFPICLDTTDPDEIVRIVKAIAPAFGGINLEDISSPRCFEIEERLKEELDIPVFHDDQHGTAVVVLAGLMNAARVVGKELADLRVVVCGIGAAGVAISKMLMAAGITNIVGVDRVGIIERGKTYENPMWQWYAEHTNPENRHGTLDDAIEGADAFIGVSAPNVLKVEHVKKMAKDPIVFAMANPVPEIDPDEAAPYVAVMATGRSDYPNQVNNLLCFPGIFRGALNCRARQINEAMKLAAARAIASVVSDEELHAEYIIPSVFNKRVVEAVAAAVEQAAYETGVARRERQPRTGGDD

SEQ ID NO: 10224 - protein, 205 aa, Thermobifida fusca YX
MGDCARAWTVSVIFAVRTCLWVGGDAMSGSGERPHIGSAEFGEPTIHPDAWIAPGAVVVGRVRIGAHSSVWYGSVLRADTEDIIVGERCNIQDLCCLHADPGEPAILGNGVSLGHKAMVHGAVVEDGALIGINAVVLGGATVEAGALVAAGALVPPGRRVPAGTLWAGVPGKVIRELTDAERENLVGTAERYVGYAAQHRGVTWR

SEQ ID NO: 10225 - protein, 158 aa, Pseudomonas fluorescens Pf-5
MTLKTIEGTFIAPKGRYALVVGRFNSFVVESLVSGAVDALVRHGVSESDITIIRAPGAFEIPLVAQKVAQKGEFAAIVALGAVIRGGTPHFEYVAGECTKGLAQVSMEFGVPVAFGVLTVDSIEQAIERSGTKAGNKGAEAALSALEMVSLLAQLEAK

SEQ ID NO: 10226 - protein, 363 aa, Pseudomonas fluorescens Pf-5
MALNSIEELVEDIRQGKMVILMDDEDRENEGDLIMAAECCKAEHINFMAKHARGLICMPMSRERCELLKLPLMAPRNGSGFGTKFTVSIEATEGVTTGISAADRARTVQAAAAKDAKAEDIVSPGHIFPLMAQPGGTLARAGHTEAACDLARMAGFEPSGVICEVMNDDGTMSRRTELEAFAAEHNIKIGTIADLIHYRMIHERTVQRIAEQPLDSELGQFNLVTYRDSVEGDVHMALTLGEICAEEPTLVRVHNMDPLRDLLMVKQPGRWSLRAAMATVAEAGSGVVLLLGHPLDGDVLLAHIRETAEHQPAKKPTTYSIVGAGSQILRDLGVRKMRLMSAPMKFNAISGFDLEVVEYVPSE

SEQ ID NO: 10227 - protein, 460 aa, Triticum aestivum
  misc_feature (132)..(132): Xaa can be any naturally occurring amino acid
  misc_feature (164)..(164): Xaa can be any naturally occurring amino acid
  misc_feature (167)..(167): Xaa can be any naturally occurring amino acid
  misc_feature (227)..(227): Xaa can be any naturally occurring amino acid
  misc_feature (253)..(253): Xaa can be any naturally occurring amino acid
YNKFVQKSRLVPVRNSRDIVDPRVRKSVPSISVVGLNGAMLWNHEGYISPEDLKESIDKAWAALQLQETAATLLAASLASRMSEPANTASTTMPGEDGSSTSENHSNSSGQSSESSAVRGFANSTDLVPTPXRQHADSREYSKSISLHNREKVITCSSVRNHNXHVXALLPDFQQAQMWTGPQIPIKRGVTSSPKRKNMVDGNSTKVPSKPASSLPTRISHAGQIEXYKLMQITNRAIEVTTDFCKKDDIQLXIRMPDGPSLQIKLTKEDVLRKVKTFVDENQGSGIGSYNLAMLYPRKVFTEQDLETTLYELGIETRQALVVVPNRQSVKVARHQSSLPSSDLDRTGDTDRSGGWGFLGAALSYVNPLSYLRGNPTPSNPDQLGNEGSQQYRPSSQSQPLRGDGSQQTATHSSGNTLRRRPQQFGGNIHTLSSEEQDPSDNRNVFWNGNSTEFGGDEKK

SEQ ID NO: 10228 - protein, 459 aa, Ralstonia solanacearum GMI1000
MTQRFDAIIIGTGQSGPPLAARLSGAGMKVAIIERGRFGGTCVNTGCIPTKTLIASAYAARLAQRAGEYGVVIGGPVTVDMKRVKARKDEISGHSSQGVEQWLRGLEHGTVYQGHARFESAHAVRVGDARLEAERIFINVGGRALVPPMPGLDQVPYLTNASMMDVDFLPAHLIVVGGSYVGLEFGQMYRRFGARVTIVEKGPRLIQREDEDVSQAVREILENEGIDVQLGADCLSARRDADSVIVGLDCATGAREVAGSHLLLAVGRVPNTDDLGLDRAGVETDARGYIRVDEQLRTTVPGIWALGDCNGRGAFTHTSYNDYEIVAANLLDHDARKVSDRIPAYAMFIDPPLGRAGMTQAEAVQSGRRLLVGTRPMTRVGRAVEKGESQGFMKVIVDADSGAILGASILGVTGDEVIHALLDTMYANAPYTTISRAMHIHPTVSELLPTLLQALRPLG

SEQ ID NO: 10229 - protein, 303 aa, Erwinia chrysanthemi
MSTVNKKVKKAVIPVAGLGTRMLPATKAIPKEMLPLVDKPLIQYVVNECIAAGINEIILVTHSSKNSIENHFDTSFELEAMLEKRVQRQLLKEVQSICPEHVTIMQVRQGLAKGLGHAVLCAHPLVGDEPVAVILPDVIIDEYESDLKKDNLSEMLQRFYSTGHSQIMVEPVENVSSYGVVDCKGVELKPGDSAPMVGVVEKPKASEAPSNLAVVGRYVLSEHIWDLLKKTEPGAGNEIQLTDAIAMLMEKETVEAYHLKGVSHDCGNKLGYMTAFVEYGLRHDALGEDFTQWLKEAIEEDAN

SEQ ID NO: 10230 - protein, 630 aa, Brassica rapa
MANSIFLFSFVSFLPFVCSVHFNIPRFGSDIPEVVYQGDARANGAVELTNIDYTCRSGWATYGKKIPLWDPEIGKPSDFTTSFSFRIDTRGVAFGNYGHGFAFFLAPAGIQMPPNSAGGFLGLFNETNVLSSSYPLVHVEFDTFTNTNWDPLDMTSHVGINNNSLVSSNVTSWNASTHSRDIGRVVIVYDSARRNLSVSWRYDTTSDPKENSSLSYIIDLSKVLPSEVTVGFSATSGGSTEGNRLLSWEYSSSLELIRDDDVEKTEKDRKGLIIGKRAEEIANLTSINEDLERGAGPRKFTYRELASAANNFSEDRKLGEGGFGAVYKGYLNGLDMMVAVKKFAGGSKQGKREFITEVKIISSLRHRNLVQLIGWCHEKDEFLMVYEFMPNGSLDAHLFGKKPHLAWPVRCKVTLGIASALLYLHEEWEQCVVHRDIKASNVMLDSNFNAKLGDFGLARLMDHELGPQTTGLAGTFGYMAPEYISTGRASKESDVYSFGVVTLEIVTGRKSVDPRQGRVEPETSLVERVWDLYGRGEVVTAVDDKLGVDSFDEKQAECLMVVGLWCAHPDRNSRPSIKQAIQVLSFEAPLPHLPSKMPVASYHVSSSSTGTSVSSGGAATATFSSAQLGR

SEQ ID NO: 10231 - protein, 438 aa, Paracoccidioides brasiliensis
MAITKIHARSVYDSRGNPTVEVDVVTETGLHRAIVPSGASTGQHEACELRDGDQSKWLGKGVLNAVKNVNSVIGPAIIKENIDVKDQSKVDEFLNKLDGTPNKSKLGANAILGVSLAIAKAGAAEKGVPLYAHVSDLAGTKKPYVLPVPFQNVLNGGSHAGGRLAFQEFMIVPTAAPSFSEALRQGSEVYHKLKALAKKKYGQSAGNVGDEGGVAPDIQTPEEALDLITEAIEQAGYTGQVKIALDIASSEFYKADEKKYDLDFKNPDSDKSKWLTYEQLADLYKKLASKYAIVSIEDPFAEDDWEAWSYYFKTCDLQVVADDLTVTNPIRIKKAIELKSCNALLLKVNQIGTLTESIQAAKDSYAAGWGVMVSHRSGETEDVTIADIVVGLRAGQIKTGAPARSERLAKLNQILRIEEELGSNAVYAGDKFRAAINM

SEQ ID NO: 10232 - protein, 400 aa, Thermoplasma volcanium GSS1
MYEFKLPDIGEGVTEGEIVKWDVAEGDEVKKDQDLVEVMTDKVTVKIPSPVNGKISKILYKEGQVVPVGSTLVQIDTGEETSQQTMAEEHAELKPQTTAAQQIAIETVPAGKVLASPAVRRIARENGIDLAKVKGTGDNGRVTLDDLDAYMRGETKAKAPEKPIEAAKPAEVPPVQRSPGREEILEMHGLRRIIFDKMTKAKQIMPHFTVVEKVDVTGMISIIESAKSSGKKVTITGYIARIVPIVLKQYPYLNAIYDEANRRYLIKKYYNIGIAVDTPDGLNVFVVKDADRKSMYEITAEITDKAERARNNQLKIDEVQDSTFTITNVGTIGGVLSTPIINYPEVAILGVHRVMDENGKKIMYLSLSCDHRLIDGAVATRFIMDLKKIIEDPNSLIYEM

SEQ ID NO: 10233 - protein, 321 aa, Triticum aestivum
MLIKLNVEPEQRLEVMGLVDIFRAKVVDLSDHTLTVEVTGDPGKIAAVQRNLSKFGIKEVARTGKIALRREKMGQTAPFWRFSVASYPDLEVKMPSKSTLSTAKTTSGDSEESSQGDVYPVESYESFSMNQILDAHWGAMTDSDPTGFCSHTLSILVNDSPGVLNVVTGVFARRGYNIQSLAVGPAEKTGTSRITTVVPGNDESIAKLVQQLYKLIDVYEVQDLTHLPFAARELMIIKVAGNTSARREILDIAEDVFRAKTVDVSGHTITLQLTGDLDKMVALQRLLEPYGICEIARTGRVALCRESGVDSKYLRGYSLPG

SEQ ID NO: 10234 - protein, 288 aa, Solanum tuberosum
MAENKEEDVNLGANKYRETQPLKTAAQTDKDYKEPPPAPLFEPGELSSWSFYRAGIAEFMATFLFLYITILTVMGLKRSDSLCSSVGIQGVAWAFGGMIFALVYCTAGISGGHINPAVTIWSVLGKKLSLTRAVFYIVMQCLGAICGAGVVKGFMVGPYERLNGGANVVNPGYTKGDGLGAEIIGTFVLVYTVFSATDAKRSARDSHVPILAPLPIGFAVFLVHLATIPTTGTGTNPARSLGAATIYNQDQAWDDHWIFWVGPFIGQALAAVYHQIIIRAIPFKSSRS

SEQ ID NO: 10235 - protein, 399 aa, Schizosaccharomyces pombe
MTVDIKIGNKYRIGRKIGSGSFGQIYLGLNTVNGEQVAVKLEPLKARHHQLEYEFRVYNILKGNIGIPTIRWFGVTNSYNAMVMDLLGPSLEDLFCYCGRKFTLKTVLLLADQLISRIEYVHSKSFLHRDIKPDNFLMKKHSNVVTMIDFGLAKKYRDFKTHVHIPYRDNKNLTGTARYASINTHIGIEQSRRDDLESLGYVLLYFCRGSLPWQGLQADTKEQKYQRIRDTKIGTPLEVLCKGLPEEFITYMCYTRQLSFTEKPNYAYLRKLFRDLLIRKGYQYDYVFDWMILKYQKRAAAAAAASATAPPQVTSPMVSQTQPVNPITPNYSSIPLPAERNPKTPQSFSTNIVQCASPSPLPLSFRSPVPNKDYEYIPSSLQPQYSAQLRRVLDEEPAP

SEQ ID NO: 10236 - protein, 85 aa, Glycine max
  misc_feature (79)..(79): Xaa can be any naturally occurring amino acid
VCISMKEEDLERLDLHLMVNSQYNDEKLRTAFTVTVDAKHGTTTGVSAHDRATTVGILASKDSQPSDFNRPGHIFPLKXQEGGVL

SEQ ID NO: 10237 - protein, 286 aa, Solanum tuberosum
MTKEVEAVHEQAAEYSRKDYTDPPPAPLIDFEELTKWSLYRAVIADFIATLLFLYITVLIVIGYNIKPMLKPASVCGGVGLLGIAWAFGGMIFVLVYCTAGISGGHINPAVTFGLFLARKVSLIRAVLYMVAQCLGAICGVGFVKAFQSAYYNRYGGGVNVMAPGHTKGVGLAAEIIGTFVLVYVVFSATDPKRSARDSHVPVLAPLPIGFAVFMVHLATIPITGTGINPARSFGAAVIFNGDKAWDEHWIFWVGPFIGAFIAAVYHQYILRAGAIKALGSFRSNA

SEQ ID NO: 10238 - protein, 423 aa, Physcomitrella patens subsp. patens
MSKRALLVGCNYPGTKCELHGCANDVRRMKELLMNRFGFDEIDILVMLDTDPSLPQPTGANIRKSLAQLIQSTEAGDCLVFHYSGHGTQVPAESGEQDDTGADEAIVPTDMNLLTDDDFRELVNQIPVGVTFTFLSDSCHSGGLIDSAKEQIGNTGISAFSGKRDVEEGEEEEGGFRGLLSNMRSRFGSGNRDNDEERPDLQNFDFESQYLEETSQQVKNRNLDINTLSEMLSEQAGHPVEVGNIRTTLFDMFGDDASPKVKVFVNILLSRIQSGGEEGGFMGMLSSAAGHYLKSKLDSESPDEAANYMAAAGSVHPSTARAAYGGVRPSASHRAREDAGILLSGCQHNETSADATPAGDHSQSYGAFSNALIGVLAETEGPISNRELVLKIRESLASSGFKQHPCLYCTDENADAHFICVTD

SEQ ID NO: 10239 - protein, 477 aa, Chlamydomonas reinhardtii
MKIACIGAGYVGGPTMAMVALKCPEIEVVVVDINEERIKAWNSEKLPIYEPGLFEVVKECRGRNLFFSTDTKKHVGEADIVFVSVNTPTKTHGIGAGRAADLTYWEGAARLIASVSTSSKIVVEKSTVPVKTAEAIGKVLKRNCQDPNVNFEILSNPEFLAEGTAMEDLKHPDRVLIGGADTESGQKAIRTLAEVYAHWIPRERILTANLWSAELAKLTANAFLAQRISSVNAISALCEATGADVSQVAHAIGTDSRIGPKFLNASVGFGGSCFQKDILNLCYVCESVGLKEVADYWLQVVSMNDYQKQRFVERVIGAMFNTVSGKKIAVYGFAFKKDTGDTRETPAIDVCKGLIRDGAKCCIFDPEVKAEQIFRDLSAPKFEWDRPNYSRSQSHMLENVQVQSDPIAAADGAHAICVLTEWDEFKHYDYAALYEKMVKPAFIFDGRNILDHAKLREIGFIVYALGKPLDPFLVKGY

SEQ ID NO: 10240 - protein, 287 aa, Fulvimarina pelagi HTCC2506
MRPKEKLTLKLGAIHIHPVKGGRSLGLESAELHREGLARDRRWMLIDADGRFQSQRDLPALARLDAEPTEDGLILTFGEEAERFVPFPDGSERVDARLWQNELDVALAGEETNNALSRWFGEDVRLIYQDRIDRQADMDFAPAESPVSLADGYPLLIATTDSLRDLNSRLVYDGEEPVPMGRFRPNLVIDDSGPWREDTWRTIRIGGVTLDLVKPCARCKVTTIDQLDGVVTGEQPLQILRETRFSADRRVPGVLFGWNAVPRGEGRLDVGDRVEVLEHRDGEVVRG

SEQ ID NO: 10241 - protein, 220 aa, Synechococcus sp. WH 8102
MSGPLSDRWTALQAALPATAQLLAVSKGHPAAVIRELAGSGQRAFGESRLQEALPKQEQLADLALQWHFIGRLQSNKVRSVVRAFPVIHSVDSLPLAQRVSRIAGEEEQWPEVLLQVKLRPDTNKGGFLRDELLSAWTELAALPSMTVIGLMTMAPMGCDADDRRALFQECRELADQLELRECSMGMSGDWQDAAAAGSTWLRLGSVLFGPRPSAPPQAG

SEQ ID NO: 10242 - protein, 491 aa, Bradyrhizobium sp. BTAi1
MTVHFPFQNSYAALPDNFFARVAPTPVAAPRLIKLNRPLAAELGLNPAELETAEGAEILAGKTVPEGAEPIAMAYAGHQFGHFVPQLGDGRAVLLGEVVDKNGVRRDIQLKGSGPTPFSRRGDGRAALGPVLREYIVSEAMAALGIPTTRSLAAVVTGEQVYRGIALPGAVLTRVATSHIRVGTFQYFAARQDVEAVRRLADHVISRHYPDLAGTERPYHALLDAVIARQAKLIADWLLVGFIHGVMNTDNTSVSGETIDYGPCAFMDGYDPKQVFSSIDEFGRYAFANQPRIALWNLTRLAECLLPLFGDDKDQAIKEAEAALDGFAAQFTDAHQAGLRRKLGLFTQVEGDQPLAQALFDAMAAVKADFTLTFRRLSDAAGSGDDAPVRALFEDPTGLDEWLPRWRQRLADEPQTAAERAAAMRQVNPAFIPRNHRIEAVITAAVENDDYAPFEELHAVLARPYDDQPAFSAYAEPPQPDERVLQTFCGT

SEQ ID NO: 10243 - protein, 264 aa, Synechococcus sp. WH 8102
MIGLGRMAQALVEPLLSSKAFSAEQVLAVVGTVATAQRLRQGAFAGVSIQSSRSAEAARVWTAPIQLLAVKQQQIDGIAAAAPVAENQPLLVSVLAGVSLDRLQRLFPGHRVVRAVPNTPALVGEGLTALAWGEAISSEQRLKVREMFAGVSEVLELPEDKLDAFLALTSSGPAFVALMAEAMADGAVAAGLPRDLSHRLAHRTLAGTAALLDQRQLHPATLKDMVTSPGGTTIAGVRALERAGARSALMEAVIAAAERSRELA

SEQ ID NO: 10244 - protein, 456 aa, Triticum aestivum
  misc_feature (187)..(187): Xaa can be any naturally occurring amino acid
MHTAYLKLLHSLCAAASPLLSPLTTLRGYSTRRRGGSGGGISSGRMNALAATSRNFKQAAKLLGLDSKLEKSLLIPFREIKVECTIPKDDGTLASYVGFRVQHDNARGPMKGGIRYHHEVDPDEVNALAQLMTWKTAVANIPYGGAKGGIGCSPGDLSISELERLTRVFTQKIHDLIGIHTDVPAPXLGTNAQTMAWILDEYSKFHGYSPAVVTGKPVDLGGSLGRDAATGRGVLFATEALLAEHGKGIAGQRFVIQGFGNVGSWAAQLITEAGGKVIAISDVTGAVKNSNGIDIAKLMKHSAENRGIKGFDGGDAVDPTSLLTEECDVLIPAALGGVINKDNADAIKAKYIIEAANHPTDPEADEILAKKGVLILPDILANSGGVTVSYFEWVQNIQGFMWDEEKVNRELKTYMTRAFRDTKEMCRSHHCDLRMGAFTLGVNRVARATVLRGWEA

SEQ ID NO: 10245 - protein, 457 aa, Neisseria meningitidis Z2491
MSNPFSSLGLGTELVSALTAQGYENPTPIQAAAIPKALAGHDLLAAAQTGTGKTAAFMLPSLERLKRYATASTSPAMHPVRMLVLTPTRELADQIDQNVQGYIKNLPLRHTVLFGGMNMDKQTADLRAGCEIVVATVGRLLDHVKQKNIHLNKVEIVVLDEADRMLDMGFIDDIRKIMQMLPRQRQTLLFSATFSAPIRKLAQDFMNAPETVEVAAQDTTNANVEQHIIAVDTIQKRNLLERLIVDLHMNQVIVFCKTKQSVDRVTRELVRRNLSAQAIHGDRSQQSRLETLNAFKDGNLRVLVATDIAARGLDIAELPFVINYEMPAQPEDYVHRIGRTGRAGADGVAISLMDESEQKMFESIKELTGNKLLIERIEGFEPQWWEQGGAKPEKPEMREPRQRNRYESAKAQREKNTRPENAANDAGAACGKIAGRSRRSRREHRTCALLQPRYGVK

SEQ ID NO: 10246 - protein, 594 aa, Zea mays
MDDEDYSWVRRTRFSQSVVRSSSGRERYGAFIDPFGRGAKLRQDGLGTGPGVSSSARLPIPKARPAVARSERRLKHASSEGQLNRVRNGDRSSQGSPAKQSREGVGLSLDIPQLHDLAVRPSKDKEESPDAALDFSFHSDEHSQRLQRVCSSPAPFFLQDAAATADGGSRVRSASTKVSKPPPKPKRRAKSPIPKRVISDVFKEAKAATKRFSSPQRQRKPMSPRSPDDSPPLGFASLRAPSKLKINTRASSWPRTNLDSGPARVAAPEILERWTVDRSELLIGHRFASGAYSRLFHGIYKDQPVAVKFIRQPDDGEDDELSAKLDKQFTSEVTILARLQHRNVIKLVGACNCPTVFCVITEFLSGGSLRAFLRKLERETLPLEKVISIALDIARGLEYIHLQGIVHRDIKPENILFDGEFCAKVVDFGVACEEKYCNLLGDDPGTYRWMAPEMYKHKPYGRKVDVYSFGLVLWELVTGSLPYQDMTPLQAAFAVVNKNLRPAIPLSCPAALKLLIEQCWSWQPERRPEFQQIVSVLENLKTVLERDGTLDKIPGSICQALEPNDQNKKKAGNWIQRLSYAQPAFSGPPPPKLL

SEQ ID NO: 10247 - protein, 178 aa, Physcomitrella patens
MGEEFRCFVGGLAWATTDGSLEEAFRPFGEVVQCKVITDRETGRSRGFGFVTFADENSMNEAIKDMNGKELDGRNITVNQAQSRGGGSGGGGGGGYNNRQGGGGGYGGGGYGGGGGGGYGAGGGGAYGSRSSYDREGGGGGGYGGSRGGGGYGSGGGGGGGRGGSGSGNWRGGRENAY

SEQ ID NO: 10248 - protein, 504 aa, Desulfotalea psychrophila LSv54
MAKKERVVLEKSIKPAGVLALAIGSIIGWGCFILPGSMMDKAGPVGAIIGLILGAVIMLVIAKSYGYMIQKVPVSGGEFAYAYNGFGRNHAYVCGWFLTLGYLSIVPLNATALSLLAKFTAPELLTWGYLYTIAGSKIYFGEVALASSAMLIFGFLNYRGSKGVAGVQVYMVALLVAAAILIAGGAISSESASFSNLVPYFNPDVPTIAGIVSIVAIAPWLFVGFDTIPQAAEEYDFPPAKANKLIILSILVGVGIYLLVLVATGVVFPWQELSAGNHVWPTGFAMEAAVGKAGLWFLVIAISMGICTGINGFYMATSRLLFSMGRAQVLPEWFTGVDKKSGVPKNAVIFTAAVALIAPWFGRNVIVWVVEMAALGTAFGYMYTCFGAYREAKKADGRNVEIPIKSGTALAGGLLSFGILLLLCVPGSPGFMAHESWYALGVWVALGAVFYAMQAKRYNALSHAELDYLILDKKDSSDKSVGECDENIMVQPIINTGSTISAID

SEQ ID NO: 10249 - protein, 168 aa, Zea mays
  misc_feature (38)..(38): Xaa can be any naturally occurring amino acid
  misc_feature (45)..(45): Xaa can be any naturally occurring amino acid
  misc_feature (95)..(95): Xaa can be any naturally occurring amino acid
  misc_feature (147)..(147): Xaa can be any naturally occurring amino acid
MLKICCIGAGYDGGPTMTMIALKSPDIEAGTIDISKSXRIEAWNXDTLTIYEAGLYYFFTQRRDRNLFLNTDVDENVAQADIIFVSVNTPTKTRXIEDGKAADLTYWESAARMIADVSKYDYIDVEKYTGPDKTAEAIEKISTHNSXGINHQIFSNPESLAEATAIED

SEQ ID NO: 10250 - protein, 282 aa, Zea mays
  misc_feature (218)..(218): Xaa can be any naturally occurring amino acid
  misc_feature (240)..(240): Xaa can be any naturally occurring amino acid
MSAYCGKYKDELIKNAAYIGTPGKGILAADESTGTIGKRFASINVENVEDNRRALRELLFCTPGALQYLSGVILFEETLYQSTKGGKPFVDILKEGNVLPGIKVDKGTVELAGTNGETTTQGFDDLGKRCAKYYEAGARFAKWRAVLKIGPTEPSQLSINQNAQGLARYAIICQENGLVPIVEPEILVDGPHDIDRCAYVTEMVLAACYKALNDQHVXLLEGTLLKPNMVTPGSDAKKVXPEVIAEYTVRTLQRTVPAAVPAIVFLSGGQSEEEATLNLNAM

SEQ ID NO: 10251 - protein, 165 aa, Geobacillus stearothermophilus
MAFENKIVEAFIEIPTGSQNKYEFDKERGIFKLDRVLYSPMFYPAEYGYLQNTLALDGDPLDILVITTNPTFPGCVIDTRVIGYLNMVDSGEEDAKLIGVPVEDPRFDEVRSIEDLPQHKLKEIAHFFERYKDLQGKRTEIGTWEGPEAAAKLIDECIARYNEQK

SEQ ID NO: 10252 - protein, 169 aa, Arabidopsis thaliana
  misc_feature (130)..(130): Xaa can be any naturally occurring amino acid
GGPGPEYRGGPHPSGRPRASFMLFSVPMVAFPVKAIMVVLLNGLKSSVAFQATRRVNTAITSITGNGGGVNCLQGWPPMGKKKLGTFFYLPDLTDSEWVKEVDYLIRTRGIPGVEFKWEHGFGSRGPGTXPGSYDGRSWPMGKLPLFGCTDSVQGLKEGERCKRESPNA

SEQ ID NO: 10253 - protein, 493 aa, Klebsiella pneumoniae
MSEIKTLEMPKWGLSMEEGLLARWAIQEGDDFTRGQEICEIETSKIVNVLEAPFAGTLRRILAREGETLQVGAVLALAADASVSDAELDEFVARLATAKPAAPGPEAAAPDVAAQAGAKPASVVSPPSNSPEPPVGQTVIPVSLQGVTDVTQVNATPHALRLSARWGVDLKKVAAAGAGIVSLFLIWKARSLPRGRLASPTPPVRRSKAPRSHADDSQVSATPLARRLAGKLGINLHDCRSSGSRGRVSRDDVLAAALLLDEHPQTSPVQESAPAPFESIPMSGMRRAIASRLQTSKQQSPHFRLSVDLDLERLLALRQDINREVPGVKISVNDLLVKACALALVAVPDVNIQFDEAAQSIRRFTDADISVAVALPAGLITPIVRSAERKSISDISNEIHSLVTRAKAGTLKPEEFQGGTFSLSNLGMLGVRQFDAIINPPQSAILAIGAGEVRAVVRDGQIVARQQMTVSLSCDHRVIDGAAGAAFLRNSSD

SEQ ID NO: 10254 - protein, 508 aa, Oryza sativa Japonica Group
MAATPPSSQHRRPLSSSASAASLAGKPRGGGLLLGRYELGRLLGHGTFAKVYQARSADSGEPVAIKVLDKEKAMRHGLVPHIKREIAILRRVRHPNIVRLFEVMATKSKIYFVMELVRGGELFGRVAKGRLKEDTARRYFQQLVSAVGFCHARGVFHRDLKPENLLVDEHGDLKVSDFGLSAVADQFHPDGLLHTFCGTPSYVAPEVLARRGYDGAKADIWSCGIILFVLMAGYLPFHDQNLMAMYRKIYRGEFRCPRWFSKDLSSLLNRILDTNPETRITVKEVMESRWFQKGFRPVRFYVEDDQVHSLADGDNDMPELEPSEPPPPPPFPPPPPQQDDDGEESGWESDSSVASCPATLSSEERRQRPLGSLTRPASLNAFDIISFSKGFDLSGLFEERGSEVRFISAEPMQTIITKLEEIAKVKSFFVRRKDWRVSIEGTREGLKGPLTIGAEIFELTPSLVVVEVKKKAGDKEEYDDFCNRELKPGMQHLVHHMGSVPNIPSDTE

SEQ ID NO: 10255 - protein, 96 aa, Synechocystis
ASYTVKLITPDGESSIECSDDTYILDAAEEAGLDLPYSCRAGACSTCAGKITAGSVDQSDQSFLDDDQIEAGYVLTCVAYPTSDCTIETHKEEDLY

SEQ ID NO: 10256 - protein, 487 aa, Tropheryma whipplei str. Twist
MPKVNCATQQIALPGALAIFGATGDLSSKKLLPAVYDLFHNSLLSNGFVLIALNRDFSAQDFICHFRHCVKSFSRTGWSESVFLDLQKRVHHVSGDFSDPETYIELSEKLETTKEETGGNCVFYLSVPPNVFTPIMKNLSASGLSRGCLHKIAVEKPFGNDLKSAIQLNSVLRSAFPERAIFRVDHYLGKETIQNILTFRFGNQIFDPIWNRKHVDHVQITMSEDIGVEGRSKYYDGIGAARDVLQNHLLQLMALITMERPSNLNNASDIRHEKQRVLECVSLPKNIAQNAVRGQYSSGYLRDERVVSFLQEDGVNPSSRTETFAAIKLNADNERWYGVPFYVRTGKRMAKRSAYISLVFKPTDMSILQNVIVIRLQPDEGVSIWFASKVPGYRSDIRQVNFDFSYKSSFTESSPEAYERLILDAMRGEASLFPQQREVELCWGIIDPLEEVWENDNTLIPQYTPGSWGPDTSNDLLLRTSRHWRNY

SEQ ID NO: 10257 - protein, 404 aa, Vibrio sp. Ex25
MQNIGMSSKLDNVCYDIRGPVLKHAKRMEEEGHKILKLNIGNPAPFGFDAPDEILVDVIRNLPTSQGYCDSKGIYSARKAVVQHYQRKGIRSLDVEDVYVGNGVSELIVMAMQALLNNGDEMLIPAPDYPLWTASVALSGGKPVHYLCDEGADWYPDLEDIKKKITPKTRGIVLINPNNPTGAVYSRDFLLEVIEIARQHKLIIFADEIYDKVLYDGATHTSVATLTEDVLVMTFNGLSKAYRVCGFRGGWMFLTGPKHLAQGYVNGLELLSSMRLCANVPMQHAIQTALGGYQSINELILPGGRLLEQRNRAYELINQIPGVSCVKPKGAMYLFPKIDTKMYNIKNDQQMVLDFLKQEKVLLVQGSGFNWPKPDHFRIVTLPHVEDLEIAIGRFERFLSTYSQ

SEQ ID NO: 10258 - protein, 216 aa, Lachancea kluyveri
MSSEPFKNVYLLPQTNQLLGLYTIIRDKKTKRPDFVFYSDRIIRLLVEEGLNHLPVTPNTVETDTNQSFDGVSFLGKICGVSIVRAGESMEQGLRDCCRSVRIGKILIQRDEETALPKLFYEKLPDDIADRFVFLLDPMLATGGSAIMATEVLIKRGVKPERIFFLNLICSKEGIENYHAKFPTIKIVTGALDKGLDANRYLIPGLGDFGDRYYCI

SEQ ID NO: 10259 - protein, 326 aa, Zea mays
  misc_feature (64)..(64): Xaa can be any naturally occurring amino acid
  misc_feature (77)..(77): Xaa can be any naturally occurring amino acid
PVPVPYMDAPTASSPSSSFPGTSFVVLSVSIVGILATSLLLLAYYLVLTRCGLLFFWRPGMHDXRRRRRRRAGPPPXVVVTVHDEPPRRSGMEEAAIRRIPTFRYRHGSTRLVLAAEAKQAACAVCLADFRDGERLRVLPPCLHAFHIDCIDAWLQSAASCPLCRAAVSDPAALALRCHHHLDVPLPRAATDDVAVDVVSSSPTPASADAAGEQEAVPSHETAHRNSSCRSCSMGGGGGGGGDGCLLPMRRSLSMDSSTDKRFYLALQTILRQSSGASQAVTAGGDGKAESSNAAADIGPPSSRRLRRSFFSFSQSRGSRNAVLPL

SEQ ID NO: 10260 - protein, 422 aa, Tropheryma whipplei str. Twist
MAVGLLLLAAGVGSRLSSSLPKAFVSVGGLDLIQWCLKNLGQLRTALEVVVTVPKGFVELCERNVLQSLGTLEKIKIVTGGATRQDSVGLGIRYFSARITKLLVHDVARAFTPPEIYLSVIKQLETSKAVIPVIAIVDSIKKVNMQDAYREVARGPGEPFHTKSVLHLDRREFFSAQTPQGFDRALLEAAHERSVASNEQFADDSVMVAQIEKDITLINGHEASFKVTNPCDLQRAEFAASSLLSKSNVSPVNISQPPISALSMPLPLIGVGIDFHKFILDESPLFLACLEWKNYRRLQGHSDGDVVAHACTTALLSAANMGDIGSVFGVDLAATKDASGAYFLESTNRLLATNGFCVLNIAVQVISNTPRLADRRVEAEHAISDCLSGARISLSSVTTDGMGFLGRGEGIGAIAVAQIYHR

SEQ ID NO: 10261 - protein, 401 aa, Thiomicrospira crunogena XCL-2
MAKILGIGNTVLDIILKTPHYPKEDEELRANARHFEVGGNVSNSLYVLSQLGHQSSIMTTIGGDDAAKQLLNGLKSRQINTDHIQRFIQGQTPTSYIIQNTETGSRTITHYRDLSELSFDYFAKVEIENYDWLHFEGRNIENLTGMLNIAKTFLTHQPISLEVEKAREGIEALFPQANVLFFSHHYARQKGFEDGKALLEEMKTLAPESHLICTWGKEGAWFCQAGQEIQHQPIHTIPQTIDTLGAGDTFNAAVIDALSQNKPLFEAVEAGSKLAARKCQQQGLDNLLTEIKEKQPLANIKQLSNAKTMVVPCADLNHSVILIKHDTGIKAYENNCPHQDVPLNEAYKIDVNPFEKTMKCSVHDAFFSIEDGMCVEGPCMNDELVSVPIEIDDRGDIYLAS

SEQ ID NO: 10262 - protein, 365 aa, Daucus carota subsp. sativus
MASVMNLSITHFCSSHLKQKSPSNKLVFHGLNSNPFLKSKPPQNVIPYSSMSISSFHTTKIAMDSSPKPPTFDFKSYMLEKAISVNKALDASVSLQEPVKIHESMRYSLLAGGKRVRPILSIAACELFGGHEAVAMPSACAVEMIHTMSLMHDDLPFMDNDDLRRGKPTNHKVYGESVAVLAGDAMLALAFHLVATETSGVSSSQVVRVIVELAKAIGAEGLVAGQIVDVCSEGDPNLGLKDLEFIHRSKTAALLEGSVVMGAILGGANDEEVEKVRKYARCIGLLFQVVDDILDVTKSSKELGKTAGKDLVADKTTYPKLIGIEKSREFSDELKREAVDQLAGFNSDKAAPLIAMANYIANRDN

SEQ ID NO: 10263 - protein, 769 aa, Bradyrhizobium sp. BTAi1
MSSYSEDLRSAALAYHRLPRPGKLEIQASKPLANQRDLALAYSPGVAAACTEIANNPAEAASLTARANLVAVVSNGTAVLGLGNIGPLASKPVMEGKAVLFKKFAGIDVFDIEIAADTIDRVVETVAALEPTFGGINLEDIKGPECFEIEARLKERMKIPVFHDDQHGTAIIVGAAIKNALSLAGKQLSEVKIVTSGAGAAAIACLNLLVSMGAQRKNIWVCDIDGVVHEGRNTLMDPWKAVYAQKTDKRTLAEVIGGADIFLGLSAGGVLKPELLKQMAEKPLIMALANPNPEIMPEEARAARPDAMICTGRSDFPNQVNNVLCFPFIFRGALDVGATAINEAMKQAAVDAIAQLAQDPPSDAVSRGFDTGETQGFGPGSLIPSPFDPRLILRIAPAVAKAAMDSGVATRPIKNFDEYTALLERFAFRSGLIMKPVFAKAKTQPVRVIYAEGEDERVLRATQVVLEEKLARPILVGRPSVVEARIKRFGLSIKAGQDFDLINPEDDPRYRSYVQSYIEVAGRRGVTPDAARTVVRTNATVIAALAVVRGEADAMICGVEGRYMSHLRHVREIIGFMPGVSDFAALALTITSKGAYFIGDTQVRPNPTAEELAEMASLAANHVTRFNIKPKIAFVSHSDFGGYDTESSRKMRQATALLKQHRPDLEADGEMQGDTALSATARKAILPHSDLEGSANVLIMPNLDAANVAYQMIKVLADAVPVGPILIGPARPAHILTPSVTARGILNMTAVAAVEAQERAGRAQPTLFA

SEQ ID NO: 10264 - protein, 286 aa, Glycine max
MAKDVEVQEQGGEYSAKDYHDPPPAPLFDPEELTQWSFYRALIAEFIATLLFLYVTVLTIIGYKRQTDTTVGGTDCDGVGILGIAWAFGGMIFILVYCTAGISGGHINPAVTFGLFLGRKVSLIRALLYMVAQCAGAICGTGLAKGFQKAYYNRYGGGANSVADGYNNGTALGAEIIGTFVLVYTVFSATDPKRNARDSHVPVLAPLPIGFAVFMVHLATIPITGTGINPARSFGAAVIYNEDKIWDDQWIFWVGPIVGAAVAAFYHQYILRAAAIKALGSFRSNA

SEQ ID NO: 10265 - protein, 521 aa, Rhodococcus sp. YK2
MTLSSLGDEYLATVPTGRSVTPHWESGAEFRDEIFVGGLWRRGTGSLIESVDPSSGKIFATLHGAVEADVDDAVDTGLCAVRQSGWADRLPHERAAVLHRIGALIDAEVEQIATLQTIDTGKTLSETRALARSAAATFRYVAAAVETMEGAVTPSRGSYLTMSTHEPMGVIGSITPWNSPIASDAQKIAPALGAGNAVVAKPPVWAPWVTLLLARICERAGLPAGVLSVLPGPGRTVGDAIVRHPGIAKVTFTGGTDTGRALAHVAAEKLMPITLELGGKSPTIVFEDADLDQAVAGIMFGVFSSSGQSCIAGSRVFVQRSIFDEFVNRLVTATNALELGPGTDPRTQVAPMVAFSHRDNVSAMVDEAVLQGAKVLCGGMIPDEPRLADGAYYLPTILSVTDNSAPICQQEIFGPVAIVLPFDNESDLVDQANDTVFGLACGLWTTDFPRAWRIAKAISAGTVWVNTYKQFSISTPFSGLKDSGLGTEKGRDGIRSYMNQKSIYIDTAGQPLPWARTADNR

SEQ ID NO: 10266 - protein, 436 aa, Bradyrhizobium sp. ORS278
MNISIFGLGYVGTVCAACLAELGHHIIGVDKAGAKVELIQAGQSPVIEPGISEKVAAAVAAGRLTASTDATAAIAATDISMICVGTPSAASGDLDLTAIRQVAAEIGHGLREKPTSHLVVIRSTVLPGTSQRIVVPLIEEASGKKAGTDFEISFNPEFLREGCAIADFNSPSKTVVGADRSETAARILSLYEQLPGAKIAASIETAELAKYIDNTWHALKVAFANEVGVIAKTLDIDSREVIDIFLQDTRLNISAAYLRPGFAFGGSCLPKDIKALKHLAGRHGLSVPVIENVLPSNDMVMSRGVDWILAQPGRKVAFLGISFKAGTDDVRESPFVLLVNGLLSRDREVRVYDPNVRLSQLIGANRDFLMRNRQIADILVDDVAETIDWADIIVLTTNDPRFIDALRSTRADQTVLELTEARLPADVQATVKGFHW

SEQ ID NO: 10267 - protein, 313 aa, Arabidopsis thaliana
MDEGVIAVSAMDAFEKLEKVGEGTYGKVYRAREKATGKIVALKKTRLHEDEEGVPSTTLREISILRMLARDPHVVRLMDVKQGLSKEGKTVLYLVFEYMDTDVKKFIRSFRSTGKNIPTQTIKSLMYQLCKGMAFCHGHGILHRDLKPHNLLMDPKTMRLKIADLGLARAFTLPMKKYTHEILTLWYRAPEVLLGATHYSTAVDMWSVGCIFAELVTNQAIFQGDSELQQLLHIFKLFGTPNEEMWPGVGTLKNWHEYPQWKPSTLFSAVPNLDEAGVDLLSKMLQYEPAKRISAKMAMEHPYFDDLPEKSSL

SEQ ID NO: 10268 - protein, 296 aa, Zea mays
RIPEQYRSGSHGALARELRMPERSIPREAAQQIISDELMLDGNPRLNLASFVTTWMEPECDKLIMDSINKNYVDMDEYPVTTELQNRCVNMIAHLFNAPIKEDETAIGVGTVGSSEAIMLAGLAFKRKWQNKRKEQGKPCDRPNIVTGANVQVCWEKFARYFEVELKEVKLSEGYYVMDPVKAVEMVDENTICVAAILGSTLTGEFEDVKQLNDLLTEKNKETGWDVPIHVDVASGGFIAPFLYPELEWDFRLPLVKSINVSGHKYGLVYPGVGWVIWRSKDDLPEELIFHINYLG

SEQ ID NO: 10269 - protein, 405 aa, Vibrio fischeri ES114
MAGVLGMILAGGEGSRLRPLTESRTKPAVPFGGSYRLIDFALNNFVNADLMRIYVLTQFKSQSLFQHMKKGWNVNGITDRFIDPVPAQMRTGKRWYEGTADAIYQNISFIESTDPEHVCIFGSDHIYKMDIRQMLDFHKKKKAALTVSALRMPAKDASGFGVIEVDEHGKMIGFEEKPSNPKCIPGQPGIALVSMGNYIFEAESLCKELIHDAALEDSSHDFGKDIIPKMFPEGNVYVYDFSTNHIKGEKKEVYWRDVGTIESYWEAHMDLLKKDAPFSLYNRKWPLHTYYPPLPPATFSDSDNGRVQIIDSLVCGGSYIRGSRIEKSVLGFRSNIASACDISESILLGNVKVGKGCVLRRVIVDKGADIAPGTEIGVNLQEDKKRYHVSDEGIVVIPKGERVGY

SEQ ID NO: 10270 - protein, 81 aa, Tomato big bud phytoplasma
GEAVGLPAQQMGNSEVGHLNLGAGRVVHQSLTYINRKIKDGSFFKNKCFLKVIQHVKTNKSKLHLLGLVSDGGVHSHLDHF

SEQ ID NO: 10271 - protein, 345 aa, Borrelia garinii PBi
MFCLKDYVFNKARIFVKENKFKASVVFPESSDSRVLKAAVIVLQKNLANSVILVGKKDPVINSLKKFSNCNNILERIEVIDPNSFPDIEMYLDEYWSLLKLKGATKQSLKTQVLDEITFAMLMVRFGHVKSCVCGAISTSAKVLSNVLRIIPKLDGVKTVSSFMIMDTLNIARNLDFCFGHNGILFFADCSLVVNPNSLELAEIALQSAKSFKDILNAKPKVALLSFSTKGSSNARETEKVKNALNIVKNKESDLLIDGELQLDSAIIKDVAEKKCSESLLAGSANVLIFPNLDAGNIGYKLVERFAFAKAYGPFLQGLSKPISDLSRGCSVDEIVFASALMIGI

SEQ ID NO: 10272 - protein, 612 aa, Streptococcus pyogenes str. Manfredo
MEFSRETRRLALQKMQERDLDLLIIGGGITGAGVALQAAASGLDTGLIEMQDFAQGTSSRSTKLVHGGLRYLKQFDVEVVSDTVSERAVVQQIAPHIPKPDPMLLPVYDEPGSTFSMFRLKIAMDLYDLLAGVSNTPAANKVLTKEEVLKREPDLKQEGLLGGGVYLDFRNNDARLVIENIKRANRDGALIASHVKSEDFLLDDNGKIIGVKARDLLSDQEIIIKAKLVINTTGPWSDEIRQFSHKGQPIHQMRPTKGVHLVVDRQKLPVSQPVYVDTGLNDGRMVFVLPREEKTYFGTTDTDYTGDLEHPQVTQEDVDYLLGVVNNRFPNANVTIDDIESSWAGLRPLLSGNSASDYNGGNSGKVSDDSFDHLVDTVKAYINHEDSREAVEKAIKQVETSTSEKELDPSAVSRGSSFDRDENGLFTLAGGKITDYRKMAEGALTGIIQTLKEEFGKSFKLINSKTYPVSGGEINPANVDSEIEAYAQLGTLSGLSMDDARYLANLYGSNAPKVFALTRQLTAAEGLSLAETLSLHYAMDYEMALKPTDYFLRRTNHLLFMRDSLDALIDPVINEMAKHFEWSDQERVAQEDDLRRVIADNDLSALKGQQEG

SEQ ID NO: 10273 - protein, 200 aa, Bradyrhizobium japonicum USDA 110
MRDMLQLVPMVVEQSARGERSFDIYSRLLRERIIFLNGEVNDAMSGLVCAQLLFLEAENPNRPINLYINSYGGVVTSGLAMYDTMQFIKAPVHTLCMGTARSMGSFLLMAGERGHRAALPNASLHVHQPLGGFQGQASDILIHANEMQETKRRITRLYAQHCGRTEAEVERTLDRDHFMTAQQGVEWGLIDRVFAERDAT

SEQ ID NO: 10274 - protein, 337 aa, Thiomicrospira crunogena XCL-2
MLTPILFSTQERLSMKRLDQVLAADGVNAELELVIKDVMVACKDIAYKLGQGELAGILGATEDENVQGETQKMLDVISNDLLKDILVANPYVRGVGSEEEDYTIAGNADGKYLVTFDPLDGSSNIDVNLSVGTIFSVLEAQDDQSGDNQEVFLQNGRKQVAAGYVLYGPSSLLVMTTGNGVNLFTLDTNIGEFVLTKEALQIPEDTAEFAINMSNQRFWEPEMKQYIDDCLLGEEGPLAKRYNMRWVASMVAEVHRILIRGGIFMYPYDNRDPSKAGKLRLMYEGNPMSMIVEQAGGASSTGRMDIMDVAPQGIHDRVPVVLGSKNEVAKVVAYHTK

SEQ ID NO: 10275 - protein, 364 aa, Tropheryma whipplei str. Twist
MDCSELYSVIPAGGIGSRLWPLSRAASPKFLHKLTGTETSLLRDTWDRLVPISGVDRIMVVIGSDHFDAVTSQLPELKGHNVILEPEPKDSTAAICLAAAILNTREPDVIIGSFPADHVIKTSPLFQQSVAQAVVAANEGYVVTIAITPTEPATQFGYILCGDSAGIKGAPQVLSVKRFVEKPSQKDADRYLSSGKYLWNAGMFIAKACVLLEQLEKARPDIHSLIIDIANSPDLDSALKKNWPKMPRIAIEYSVAEPCAAEGRMVTVPAKFEWNDAGDFSSIARLNSRGGSDLVILGETSRVLSDSATGIVVSQTDRIISVIGTKDIVVVDTPDSLLVTTKDDAKKVKQIVEALRLSGRDDVL

SEQ ID NO: 10276 - protein, 177 aa, Thiomicrospira crunogena XCL-2
MGYSAVPAGKDVPNDINVIIEIPAFAPPIKYEVDKDTDLVWVDRLQGATMQYPANYGYVNNTLSNDGDPVDVLVVTPHPLMIGSVIRCRPIGIFHMTDDGGEDAKVIAVPIDKLTPIYKAVQKVEDIPLLKEQVELFFSHYKDIEPGKWVKVDGWGDVEAARKEILDGIAQYEAAEK

SEQ ID NO: 10277 - protein, 219 aa, Tropheryma whipplei str. Twist
MEIRISPSILSADFCNLERDLQLISSADMVHVDVMDGHFVPNITFGLPVVKRICEVSPVPLDVHLMVENPDYWALQYADLGVYSVTFHFEAAKDPIATARNIRSNKSKVGLAVSPDTDIGECVHVLPEVDMLQVMTVYPGFGGQKLIRRVLDKFSRITRSEFENLSFSVDGGVTLGNISEIASVGVDTFVAGSSVFLSQLPADSVESLRKLAKVAYKRF

SEQ ID NO: 10278 - protein, 269 aa, Triticum aestivum
  misc_feature (240)..(240): Xaa can be any naturally occurring amino acid
  misc_feature (249)..(249): Xaa can be any naturally occurring amino acid
MHSTNLLLEEPIRMVSILEPSKPNFFPAMTKIVGTLGPKSRSVEAISACLKAGMSVARFDFSWGDAAYHQETLENLKLAIKATKKLCAVMLDTVGPELQVVNKSEVTISLEENESVVLTPHQGQEASSKLLPINFAGLAKAVKPGATIFVGQYLFTGSETTSVWLEVSEVQGDDVVCVIKNSATLAGSLFTLHCSQIHIDMPTLSDEDKDVMKKWGAPNKIDFLSLSYTRHAEDVRQARXFLSKLGDLXQTLIFAKIDELLEGFEPIFG

SEQ ID NO: 10279 - protein, 98 aa, Brassica napus
MANKKFVTFFFFLVLLIVPFVFIPAATAAPGRIRGMEVYCRSRCRGRCAKAGFQDRCLKYCGICCRQCKCVPSGTFGNKHQCPCYRDKLSSKGKPKCP

SEQ ID NO: 10280 - protein, 312 aa, Dichelobacter nodosus VCS1703A
MTVFTGNANPQLARQIVQHLGLPLGNATVSKFSDGEIQVEIRENVRGKDVFIIQPTCFPTNDCLMELLLLSDALRRSSANRITAVMPYYGYSRQDRRPRSARVAISAKVVANMIARVGIDRVMTLDLHADQIQGFFDFPVDNIYSTPIVLNDILSKDIKSPVIVSPDIGGVVRARAVAKRVGAKLAIIDKRRPRPNESEVMNIIGDDVSECSCILVDDIVDTAGTLSNAASALKERGAKNVTAYCTHAVLSGNALANIANSGLDELVVADSIPLREEAKSCEKIRVLSIAGLVAESIRRIHVEESISSLFVD

SEQ ID NO: 10281 - protein, 579 aa, Triticum aestivum
  misc_feature (357)..(357): Xaa can be any naturally occurring amino acid
  misc_feature (377)..(377): Xaa can be any naturally occurring amino acid
MTSKTMPQTIPTIPNTEEKKQCSQNDSSLDLTSSSKPSTALPRKLPESAIPSSPNKEVQSSDQKPSHKLHESVDVTSSKVPADDEKDTVENGNTDGTVKSDSTVDKDHGAASASGSARLTGRSETGERGISSRCRPSTGSDVSEESACSSFSSTSKPHKANDSRWEAIQMIRSRDGILGLSHFKLLKKLGCGDIGSVYLSELTGTKSYFAMKVMDKASLTGRKKLLRAQTEKEILQCLDHPFLPTLYTHFETDKFSCLVMEFCPEGDLHTLRQKQRGKYFPEQAVKFYVAEILLAMEYLHMLGIIYRDLKPENILVRDDGHIMLSDFDLSLRCTVSPTLIRSSNPETEALRKSSQAXYCAQPACAEPSCMIQPSCTXPTTCFGPRFFSKSKKDRKPKPEVVNQVRPWPELMAEPSDARSMSFVGTHQYLAPEIIKGEGHGSAVDWWTFGIFLYELLFGKTPFKGSGNRATLFNVIGQPLRFPEYPVVSFSARDLIRGLLVKEPQQRLGCKRGATEIKQHPFFEGVNWALIRCASPPEVPKPVEIERQTTKLPVSTSEASAAPTGASQKGSDNYLEFDFF

SEQ ID NO: 10282 - protein, 122 aa, Vitis vinifera
MASKLVQLQSKASQASQFVAKHGCAYYKQLMEQNKQYIQEPPTVEKCNLLSKQLFYTRLASIPGRYEAFWKELDCVKQLWKNRQEMKVEDAGIAALFGLECFAWFCAGEIVGRGFTFTGYYV

SEQ ID NO: 10283 - protein, 627 aa, Lotus japonicus
MPAWWNRKPWKNKQEHDDDEDGEYEAEEVEEAPRSGLQFNFMKSPISSARSSDKKKKKKIKDKKKPKSFDEVLYRNSPRTSKDCDGGAAAMEKKGLPLPRPTTPCDQASISGSSLSSSASASFDDHSISPHFNANRGQEEVKFNVRPKSPCSRGPTSPTSPLHQRLHALSLDSPTGGKQDEGTSQCHPLPLPPGSPTSPSAPCNTRANGVLENNTCNLSKWKKGKLLGRGTFGHVYLGFNSENGQMCAIKEVKVFSDDKTSKECLKQLNQEINLLNQFSHPNIVQYYGSELGEESLSVYLEYVSGGSIHKLLQEYGAFKEPVIQNYTRQIVSGLAYLHSRNTVHRDIKGANILVDPNGEIKLADFGMSKHINSAASMLSFKGSPYWMAPEVVMNTNGYGLPVDISSLGCTILEMATSKPPWSQFEGVAAIFKIGNSKDMPEIPEHLSDDAKNFIKQCLQRDPLARPTAQSLLNHPFIRDQSATKVANASITRDAFPYMSDGSRTPPVLEPHSNRSSITTLDVDYATKPALAAVRTLRNPRDSTRTITSLPVSPSSSPLRQHRPTHNSPFFSPPHPSYAMMGQSSYTSNNMHKNPARSNATLTLDPWLETSRYKAHTPPGGSPRMRFI

SEQ ID NO: 10284 - protein, 337 aa, Lotus japonicus
MENYLLIATLVSASLVFGCYYILVQIAETCSRDINDCDLGLQCLECHSQNRCTRIRTISPTSKVMELPFNEYSWLTTHNSFAAKGVNWSTGSPVLAFTNQEDSITDQLKNGVRGLMLDMWDYEDTIWLCRGPCTKYTTFQPALNVLKEVRVFLVTHPTEIITIFIDDHVTSGNGVNKVFDKARLRKFWFPVSKMPKNGSDWPTVKTMIRKNYRLIVFTSNASREASEGIAYEWNYVVESQFGNVGIKGGSCQNRPESLPMNNATKSLVLMNYFRNVRNHDDEACRDNSSPLIAMMHVCFRAAGNRWPNFIAVDFYKRGDGGGAPEALDLANRNLIRL

SEQ ID NO: 10285 - protein, 147 aa, Triticum aestivum
MAAAAIRAQINILIATMFNTGLVDDAFLQLQRMREQGRVTPAHVVEVMNHFLNEAERIINDITGLMNGPEVDFDKVDDLVQQLKVACSSVGAKRLNLCCVQHFSPEAKTKEGYLAALGRVRFQFCDLRSMFKIIMELEQHFAACGPK

SEQ ID NO: 10286 - protein, 302 aa, Emericella nidulans
MAANYWASTQRKHWLFTRERLAEIRESFKEKDKASHTHFPLPDQRLLNIYFNQQLIKLGKRMSTRQQALATAQVYIKRYYTKNEIRNTNPYLVLTTAFYLACKMEECPQHIRFVVSEARALWPEFIVPDVSKVGECEFSLISEMQAQLIVHHPYRTLSELQPELSLTSDEVALAWSVINDHYLTDLSLLYPPHIIAVMAIIVAVVFKPSSQTAFHGSAAPIAGAMRDGGMNILAALSDKGGAGPPPRIQKLIAWLAESEVDIKAVIESTQELVSLYEVWEQYSEKNCKELLGRMIRSKSLDK

SEQ ID NO: 10287 - protein, 392 aa, Bacillus subtilis
MEHLLNPKAREIEISGIRKFSNLVAQHEDVISLTIGQPDFFTPHHVKAAAKKAIDENVTSYTPNAGYLELRQAVQLYMKKKADFNYDAESEIIITTGAQAIDAAFRTILSPGDEVIMPGPIYPGYEPIINLCGAKPVIVDTTSHGFKLTARLIEDALTPNTKCVVLPYPSNPTGVTLSEEELKSIAALLKGRNVFVLSDEIYSELTYDRPHYSIATYLRDQTIVINGLSKSHSMTGWRIGFLFAPKDIAKHILKVHQYNVSCASSISQKAALEAVTNGLDDALIMREQYKKRLDYVYDRLVSMGLDVVKPSGAFYIFPSIKSFGMTSFDFSMALLEDAGVALVPGSSFSTYGEGYVRLSFACSMDTLREGLDRLELFVLKKREAMQTINNGV

SEQ ID NO: 10288 - protein, 399 aa, marine gamma proteobacterium HTCC2143
MTTDIKAPTFPESVADGTIATWHKQPGEAVSRDELIVDIETDKVVLEIVAPSDGTISEIVRGEGETVLSDELIGRFEAGAIAATAVADASPAIVEAVTAISDIKTSPAARKLIDENKLIADNIKASGKGGLITKEDVVSHISNVPVEVPSAPAPEAAAIVEVDAGERIEKRVPMTRLRKRIAERLLEATQSTAMLTTFNEVDMGPVMELRKQYKDLFEKTHNGVRLGFMGFFVKAACEALKRYPAVNASLDGSDVVYHGYQDIGVAVSSDKGLVVPVLRDADTMGLATVEDTIRDYGTRARAGKLTLEEMQGGTFTITNGGVFGSLLSTPILNPPQTAILGMHKIQERPMAVNGEVKILPMMYLALSYDHRLIDGKEAVQFLVTIKDLLEDPARILLEI

SEQ ID NO: 10289 - protein, 479 aa, marine gamma proteobacterium HTCC2143
MSKFDVVVIGSGPAGYVAAIRATQLGLTVACLEKETNKMGKPNYGGTCLNVGCIPSKALLDSSHKYVEAIENFGLHGITAKELSIDIPQMIARKDSIVDQLTGGVGQLFKANGVTAIEGSGRVLAGKQVEVTKRDGSVEILDAGNIIIAAGSVPIAIPPTPIDDDVIVDSTGALEFLEVPKRVGVIGAGVIGLELGSVWGRLGAKVVVLEALEDFLPAIDQQIAKEAKKLFVKKQGLDIRLGARVTASEVKDGQVTVTYIDKDGEKQEVFDKLIVAVGRRPQSQNLLAGDCNVTMDERGFISVNDYCETEAPGIYAVGDIVRGPMLAHKGSEEGVMVAERIAGQKAAMNYDCIPNVIYTHPEIAAVGQTEEQLKADGIEYKVGVFPFAASGRALAANDTAGMVKMIAHAETDRILGCHIIGPSAADLVQQMVIAMEFGSSAEDIALTVFSHPALSEAVHEAALAVDGHAIHIANKRKRK

SEQ ID NO: 10290 - protein, 388 aa, marine gamma proteobacterium HTCC2143
MNLHEYQGKQLFAEYGLPVSKGYACDTPEEAAQAADKIGGNKWVVKAQVHAGGRGKAGGVKLVDSKEEIKSFAENWLGKNLVTYQTDENGQPVSKILVEACTDIDQELYLGAVVDRSSRRIVFMASTEGGVEIEKVADETPEKILRAEIDPLVGAQPYQGRELAFKLGLKGVQIKQFVNIFLGLAKLFQDKDLALIEVNPLVITDEGNLHCLDAKLGVDSNAMYRQPTLKEMHDPSQEDAREAQAAQWELNYVALDGNIGCMVNGAGLAMGTMDIVKLHGGSPANFLDVGGGATKERVSEAFKIILSDDTVKAVLVNIFGGIVRCDLIAEGIIGAVEEVGVEVPVVVRLEGNNAELGSKLLAESGLNIIAANSLKEAADAVVKAAEGK

SEQ ID NO: 10291 - protein, 364 aa, Chaetomium globosum
MAANYWESTQRKHWQFTKQDLAAIRQRLDDEDPGLVQMFPLPQLRHLNIYFNQQINRLSKRIGLRQQVMATAQVYLKRFYTRIAIRQTNPYLVLTTVLYLACKMEECPQHIRMMTQEARSLWPSDLHGHDPARVGECEFSLISEMHSNLIVHQPYRSLLGVQDEFGLTQDEMSLAWTVINDHYMTDLPLLHPPHVVALTAVLLALVLRPSANTPAAGGAGGNAGAAAAAAAAGAGGVAMAATALAQAQAQVQARAAAIAAAGAGGGTPGFGSQGSQQQAGFSQGNSQGSLQGDSAAAEPKKVTDPRLAKVQRFAAWLADSNIDIEAMVDCTQELISFYECHEQYNDKHTKEQISRFIKARNLDK

SEQ ID NO: 10292 - protein, 301 aa, Aspergillus oryzae
MAANYWASTQRRHWLFTKERLADIRESFRERDKAAHSQFPLPDQRLLNIYFSQQLIKLGKRMSTRQQALATAQVYIKRFYTKNEIRHTNPYLVVTTAFYLACKMEECPQHIRFVVAEARNFWPEFIAPDVSKLGECEFALISEMNSQLIVHHPYRTLSELQPELSLTSDEVALAWSVINDHYLTDLPLLYPPHVIAVMAIIVAVVFKPSQTSFHGTAAPLAGAMRDGGMNILAALGDKNGAGPPPRIQKLVGWLAESEVDIRAVIECTQELVSLYEIWENYSEKHCKELLGRMVKSKNLDK

SEQ ID NO: 10293 - protein, 884 aa, Aspergillus oryzae
MSVNDRRASYMSAPRPRVSSNRVGDARSGASPLQSDQINHRGSMSSQKGKVSREQRDMMSDKRAERMAPHSKDKAQVRARNPAKESSSAGNRGEWERSRSRRATLTDGASPNMRKKDKEPAESPWNPYASLIPHSTAPLATRVSVPSLASALPKSLHPTPLRELSADEQETALLEDLLFVFMGFEGQYIHYHSGYDSSMEKDRLTGPVFQLPSGLDPTLRDLTLSMLKMATHYNALEAFVEVQSRAEYGAVSHALCAAIRKLLKDYLILVAQLETQLVNNPSFTLHLLHLHTMPTSQCLAQLYSLGQELLRRNGLLDQDLDESIDDFDDVDNILEQLKEGGDLVPGAMSSKKICKGGNVLRLLTERLATFSGDPTTKTLLEKLLREASRPYMTMLNEWLHHGGIKDPHAEFLVKEQKWIKREKLEEDYTDEYWEKRYTIRENEVPPQLDSVRDKVLLAGKYLNVVRECGGVDISKAVKDVPKTLDDPRFLENVNAAYTYANASLLNLLLTKNSLTTRFRSLKHYFFLDRSDFFSYFLELGASELRKPAKSVNENKLQSLLDLVLRQPGSIAVQDPFKEDVKVRMNKIGLTKWLMQVVSVSGIDQDNPEAAIEKYQAPQTQGGDDEKDIAGFDALELDYSVPFPLSLVISRKTVLRYQLIFRHLLSLRHLEHLLVTAWLDQNKVLGWRHKSTDRRLELWKRRAWNLRAKMLVFVQQLLYFCTAEVIEPNWQNLMDRVNGTDADGSEVTVNGTKQVNRTVDELMQDHVDFLDTCLKECMLTQAKLLKIHSKLMTCCTMFASWTASSLARALATADPELARNKASNPDGRGYDPTRISKLEDTLKRYEDHFNRHLRILMDSLNYFAATESVVLLKLAHALSSISKDD

SEQ ID NO: 10294 - protein, 125 aa, Oryza sativa
RNWLFELRCGFGLLMYGFGSKKMLLEDFASTTLSDFTVIVVNGYLPSINLKQVIVTIAEIFWEQTKLKRKRQTATRSQLQPFASQSIDDIISFLNNQTSDNGDDNVCLLIHNIDGPALRDAESQQ

SEQ ID NO: 10295 - protein, 152 aa, Medicago sativa
MSTPARKRLMRDFKRLQHDPPAGISGAPQDNNIMLWNAVIFGPDDTPWDGGTFKLSLQFSEDYPNKPPTVRFVSRMFHPNIYADGSICLDILQNQWSPIYDVAAILTSIQSLLCDPNPNSPANSEAARMFSENKREYNRRVREVVEQSWTAD

SEQ ID NO: 10296 - protein, 229 aa, Bradyrhizobium japonicum USDA 110
MTEANAAPVTGHSPNALAAVEAEIARACKDARRDRASVTLIAVSKTFDADAITPVIAAGQRVFGENRVQEAKGKWPALTSVYPDIALHLIGPLQSNKAKEAVALFDAIHSVDRPSICQALAKEIESQKKHPQLFVQINTGEEPQKAGVAPGEADAFLASCRDTYGLTISGLMCIPPVDEPPAAHFALTAKIAARNGLTNLSMGMSADFATAIMLGATHVRVGSAIFGHR

SEQ ID NO: 10297 - protein, 709 aa, Neisseria meningitidis Z2491
MAYQVLARKWRPKTFADLVGQEHVVKALQNALDEGRLHHAYLLTGTRGVGKTTIARILAKSLNCENAQHGEPCGVCQSCTQIDAGRYVDLLEIDAASNTGIDNIREVLENAQYAPTAGKYKVYIIDEVHMLSKSAFNAMLKTLEEPPEHVKFILATTDPHKVPVTVLSRCLQFVLRNMTAQQVARHLAYVLDSEKIAYDPPALQLLGRAAAGSMRDALSLLDQAIALGSGKVAENDVRQMIGAVDKQYLYELLTGIINQNGAALLAKAQEMAACAVGFDNALGELAILLQQLALIQAVPNALSHDDPDSDILHRLAQTISGEQIQLYYQIAVHGKRDLSLAPDEYAGFMMTLLRMLAFAPLAAASCDANAVIENTELQSPSAQTAEKETAVKKPQPRPEAETAQTSVQTASAAAMPSESKTAGPVSNQENNDVPPWEDAPDEAQAAAGTAQTSAKSIQTASEAETPPENQVSKNKAADNVTDAPLSEVPSENPIQATPNDEAVETEAFAHEAPAKPFYGYGFPDNDCPPEDGAEIPPPDWEHAAPADTVGGGADEEAEAGGIGGNNTPSAPPPEFSTENWAAIVRHFARKLGAAQMPAQHSAWTEYHPDTGLMVLAMTAEARATADKKRLDKIRDTLAQAYGLQLTLQTQDWRDESGRETPAMQDKRVQAEDRQKAQALLEADPAAQKILQAFGAQWQPESLELAANRP

SEQ ID NO: 10298 - protein, 435 aa, Pseudomonas aeruginosa PAO1
MESANAISASAQPRTTSQRIKSIFSGSVGNLVEWYDWYVYAAFSLYFAKAFFPQGDMTAQLLNTAAIFAVGFLMRPIGGWLMGIYADRKGRKAALLASVLLMCFGSLIIALTPSYETIGVAAPILLVVARLLQGLSVGGEYGTSATYLSEMANKEQRGFFSSFQYVTLISGQLIALAVLIVLQQTLTVEQLESWGWRVPFFIGALCAVVAMFLRRGMEETESFSKKKEEPKESLLRTLLRHPKEVLTVVGLTMGGTLAFYTYTTYMQKYLVNTVGMSKTDSTMISAATLFLFMLLQPIVGALSDKIGRRPILIAFGVLGTVFTYPILSTLHSVDSWWGAFFLIMAALVIVSGYTSINAVVKAELFPTEIRALGVGLPYALTVSIFGGTAEYVALWFKSVGLESGFYWYVTACIACSLLVYVFMKDTQKHSKITTD

SEQ ID NO: 10299 - protein, 381 aa, Tropheryma whipplei str. Twist
MLSFRSAVFVMEDGSCFEGVPFGAVGTAFGEAVFSTCMTGYQEVFTDPSYTAQILVMTAVHVGNTGINDFDNESDRMWPSGVVIRDPSPIASSFLAKMDLAKALASEGVIGISEVDTRAIVRKLRTSGAMRAGIFSQPDRPLPDLVDQIRGTQSMHMRSLTSEVSTTSRRFISSESHFATLLVLDLGVKKSTINLLLEQGFDIWLMPHNISFDEAMQIKPDAIFYSNGPGDPAASGTQVDLLRSLLRAGLPYFGICFGNQLLARALGFETKKLLFGHRGINQPVFNRATKQVEITSQNHGFSVDMPIDRISVSPLNFGRVEVSHYCLNDYEVEGIRCLDIPAMSVQYHPESCAGPHDSRYLFREFRRMVEGHLERRYNAEP

SEQ ID NO: 10300 - protein, 516 aa, Dichelobacter nodosus VCS1703A
MEAQKPSYLTEFKTNFSAGLVVFLVALPLCLGIALASGTPPLSGIVAGIIGGIVIGFLSTSHISVSGPAAGLVSVILAAMAQLGAFDLFLCAVIIAGAIQLILGFLRAGSIAEYMPTAVIEGMLAGIGILIMLKQLPYAFGGNSGDNWQTLLTQPHLGASFITIISLFIILFWKNIAGVFKNIPAALIAVIVSTIISIIFQKMGNHWTLDAHQLVLLPNPRGIEDIKNMITLPNIAGFKNSYVWITGATMAIVASIETLLSIEAADHLDKQRRITDTNHELRAQGIGNIIAGLLGGLPVTSVIVRSSANADAGATRKTATIVHGFLLLVCVLTMAPLLNRIPLASLAAVLILVGYKLARPSVIKHFWQKGWYQFVPFFSTMIAVVQFDLLKGVGIGLIISIIFILQNHMKRAYYLSREQLADAKVIELSLAEEVSFLNKAAIKKTLKNIRRNSTLIINASNSLYISSDVMDLIEDFSNITAKEKNIRVILRGFKANHDYENEPLNHHVHIHHHSVI

SEQ ID NO: 10301 - protein, 406 aa, Tropheryma whipplei TW08/27
MTAHNTPKVHCVIRQALRGQRIGPRQLAEQIGVDIKQLWSWLEPTWSQTLDIPQSILHDLEDAIDDTSAFYNTQHLLSIDQINRRSLERLFYVTDMFQPLARRQVRCNILNGAVLACLFYEASTRTRFSFSTAFSRMGGAVVTEADMLQSSSVAKGESTSDTSRVISGYADIVVVRHSELGFAERYASDSLVPVINAGDGSGEHPTQAILDVYTIESEFLYREKTIDGSCIAIIGDLKHGRTVHSLIKLLSLYERLTFKIFSITDLELPNDFHDLLSGRGHTLEVCDSLRNAVNAADVIYATRVQTERIAQDLTAVTGCRLTREVLDDCKKDVIVLHPLPRDSRPDALDIGTDLDSYSGFMPFGQANNGVPVRMAIFSEILGITDKIEFADSIPWARRIPYPQALP

SEQ ID NO: 10302 - protein, 593 aa, Fulvimarina pelagi HTCC2506
MRLRRSIHLTVFALFVAGASPSIAQDQASDAVQPERGGSTAKVVEEVRGAVRAARHMVASAHPLAAEAGLAMLRAGGNAIDAMVATQFVLGLVEPQSSGVGGGAFLVYFDGEAERLTTFDGRETAPALATPRLFLDDDGKPLEFFDAVVGGRSVGTPGTVMLMAETHERYGKLPWRTVLQPAIAVALEGFPVSPRLADAIAEDKERLSRYPGTRGYFFHADGRPLAAGETLTNVPYAATLQVIAEEGPSAFYRGPLADKIVEAVRDAEGNPGVLSRVDLENYRVVEREPVCVTYRAHDVCGMGPPSSGALTIGQILKMVEPFDLAGLGFMNVESWRLIGEASRLAFADRGRYMADTDHVAVPVDGLIDEDYLADRSALIAEERVLAAGEVQPGTPPWDHAKILGDDKSIELPSTSHVSIADETGNVVSLTTTIENGFGSRLMVGGFLLNNELTDFSFETHENGLPIANAVAPGKRPRSSMAPTIVLKDGEPLYVLGSPGGSRIIGYVAQALISLIDWELDPQEAASLPHLVNRFGEYDVEEETAAADLAASLVGIGYQVNVRDLNSGLHILEMTLDGLLGGADPRREGVAVGD

SEQ ID NO: 10303 - protein, 174 aa, Triticum aestivum
MAPAVMASTATTVAPFQGLKSTVSLAVSRRSSGSLGRVSNGGRIRCVQVWPIEGIKNFETLSYLPPLSTEALLEQVDYLIRSRWVPCLKFSKVGFVFREHNSSPGYYNGRYWTMWKLPMSGCTDTTQVLNKVEEVKKDYPDAYVRVIGFNKLPQVQCVSFIAFRPTGCEESGKA

SEQ ID NO: 10304 - protein, 220 aa, Symbiobacterium thermophilum IAM 14863
MKVAPSLLSADFAALGAELAAIEAAGADWAHLDVMDGHFVPNITFGPPVIAKLRPRSKLFFDAHLMIRHPERYIGDFVKAGADLITVHAEACDHLHRVLGQIREAGVKAGVALNPHTPVSVLAHVLDMVDLVLIMTVNPGFGGQRFIDACLPKVRQARAMLAEAGLADRVEIQVDGGVDPHTAPRCVEAGATVLVAGTAVFGKDDYAAAIAALRGQPSAD

SEQ ID NO: 10305 - protein, 273 aa, Oryza sativa
RYHSSQSDSRRKKKKQQQQSSQPVRRARSNRGSKRRRREDSTVRLYRLMGEEDISNDSKSSCGCEDGTVEAPAAAAPKENGRAADPRLQAISDAIRVVPHFPKPGIMFNDITALLLRPAAFKDAVDMFVERYRGMRIAAVAGIEARGFIFGPAIALAIGAKFIPLRKPKKLPGEVISETYILEYGTDCLEMHVGATEPGERVVVVDDLVATGGTLCAAIKLLERAGADVVECACLIGLPKYKNFYKLNGKPKDSQLHSFARARWRNWIGIGEQ

SEQ ID NO: 10306 - protein, 511 aa, Schizosaccharomyces pombe 972h-
MLNSVIKRSALCRFKFTCLQVSECRPAQIEISKRLYSAKASGNGEYDLCVIGGGPGGYVAAIRGAQLGLKTICVEKRGTLGGTCLNVGCIPSKALLNNSHIYHTVKHDTKRRGIDVSGVSVNLSQMMKAKDDSVKSLTSGIEYLFKKNKVEYAKGTGSFIDPQTLSVKGIDGAADQTIKAKNFIIATGSEVKPFPGVTIDEKKIVSSTGALSLSEVPKKMTVLGGGIIGLEMGSVWSRLGAEVTVVEFLPAVGGPMDADISKALSRIISKQGIKFKTSTKLLSAKVNGDSVEVEIENMKNNKRETYQTDVLLVAIGRVPYTEGLGLDKLGISMDKSNRVIMDSEYRTNIPHIRVIGDATLGPMLAHKAEDEGIAAVEYIAKGQGHVNYNCIPAVMYTHPEVAWVGITEQKAKESGIKYRIGTFPFSANSRAKTNMDADGLVKVIVDAETDRLLGVHMIGPMAGELIGEATLALEYGASAEDVARVCHAHPTLSEATKEAMMAAWCGKSIHF

SEQ ID NO: 10307 - protein, 332 aa, Eremothecium gossypii
MSASYWDSSQRNKWQYSRESLARTRQKLWMLECQLYPQGTNILMEGGGKDAQPVTKNIPITHRDLHYDRDYNLRIYCYFLIMKLGRRLNVRQYALATAHVYLARFCLKASIREVNLYLLVTTCIYLACKVEECPQHIRTLVNEARSLWPEFVPPDPTKVTEFEFYLIEELQSYMIVHYPYRAMEQIAAALRRPPYNLVLSPDDLQNSWSLINDSYITDVHLLYPPHVIAMACLFITVCLRSAAGARDLQETFNRFMADSQVDLHEVMDTIQDFITLYDHWDKYNEPWIKFLLHNLYLRPHAGGTTVSGAAAGSAGPAGSVLTPNGTITGSTS

SEQ ID NO: 10308 - protein, 445 aa, Pseudomonas aeruginosa
MTQSVDAFLERLKRRDPDQPEFHQAVEEVLRSLWPFLEANPHYLEAGIIERIVEPERAILFRVPWVDDQGRVRVNRGYRVQMSSAIGPYKGGLRFHPSVNLGVLKFLAFEQVFKNSLTTLPMGGGKGGSDFDPKGKSDAEVMRFCQSFMSELYRHVGADLDVPAGDIGVGAREIGYLFGQYKRLSNQFTSVLTGKGLSYGGSLIRPEATGFGCVYFAQEMLKDRGRGFDGQRVAISGSGNVAQYAARKVMEMGGKVISLSDSEGTLYAEAGLSDEQWEYLMELKNARAGHPRDGVEQFSLQFLEGVPPWGLACDIALPCATQNELDAEDARRLLANGCVCVAEGANMPSTLEAVDLFLEAGILYAPGKASNAGGVAVSGLEMSQNAMRLRWSEGEVDTKLHGIMQSIHHACLLYGEEQGRVNYVKGANIAGFVKVADAMLAQGVV

SEQ ID NO: 10309 - protein, 338 aa, marine gamma proteobacterium HTCC2143
MTQYHQITVLGGGSFGTTIANIMADNGHRVCLWLRNQARADEINCDHVNSAYLPDYHLNHALKASTDLKAAVTGCDIIFMAVPSKSSRAVAAEVSAYLADNVIVVSTTKGIEHDSFKMMSEVLAEEIPGARIGVLSGPNLASEIAAKQLTATVIASCDEDLNTTIQALLHSGTFRVYASADVLGVELGGALKNVYAIMAGMAAAMGIGQNTISMLMTRSLAEMSRFAVQKGADPMTFLGLSGVGDLIATCMSPLSRNYQVGFELGNGKELEDIIADLGQVAEGVNTLQILKRQADELGVYMPLVNGLYDIIYTPKSITEVIGSLMFAEQSRDVEFTIK

SEQ ID NO: 10310 - protein, 302 aa, Aspergillus clavatus
MAANYWASTQRRHWLFTRERLAEIREAFRERHKLAHSQFPLPDQRLLNIYFSQQLIKLGKRMSTRQQALATAQVYIKRFYTKNEIRHTNPYLVLTTAFYLACKMEECPQHIRFVVGEARSLWPEFITPDVSKLGECEFSLISEMNSQLIVHHPYRTLSGLQSELSLTSDEVALAWSVINDHYLTDLPLLYSPHVIAVMAVMVAVVFKPGPGNFHGSAAPVLAGAMRDGGMNMLAALGDKSGNEPPPKVQKLINWLAESEVDIKAVIECTQELVSLYEVWEQYSEKNCKELLGRMVKTKHLDK

SEQ ID NO: 10311 - protein, 499 aa, Magnaporthe grisea
MSHSNPPTGASGGPGSASASAAPARGYYSLKRSIQTAFNDPLDRGLGPPAYQSKVRVMDKYQVIGFISSGTYGRVYKARGRQGQPGEFAIKKFKPDKEGEQITYTGISQSAIREMALCSELRHPNVIRLVETILEDKAIFMVFEYAEHDLLQIIHHHTQQPKHPIPPQTIKSIMFQLLNGCQYLHTNWVLHRDLKPANIMVTSSGEVKVGDLGLARIFWKPVRTLMQGDKVVVTIWYRAPELLMGSHHYTPAVDMWAVGCIFAELLSLRPIFKGEEAKMDNTKKGGSRDMPFQRHQMQKIVDIMGMPTKERWPLLTSMPDYDKLPLLQPPLSASGYSQQPAHSHHHHQHYNQGPQYGGRAGGPTSSSSANSSSAAAAASQSHLDKWYYHTVSQGQTAGPMPHAPPGSLASLGVEGYKLLAGLLEYDPEKRLTAAAALQHNFFSTGDRVSANCFEGCKAEYPHRRVSQEDNDIRTGSVPGTKRSGMPDDSMGRPGKRVKE

SEQ ID NO: 10312 - protein, 488 aa, Coccidioides immitis
MHSFRGLLHDSVSASSVSRQGHGDPLGFPGLPECSEPCEPFSSRPPPRKFITPLQFAIRIQQSRQYRAATANSNRLLESLDNKKPLPFSYASKVKLREKYLIVGFISSGTYGRVYKAKGRDGVGGDFAIKKFKPDKEGEKVEYTGLSQSAIREISLCTELNHPNVVRLVETILEDKCVYMVFEYTEHDLLQIIHHHTQPQRHAIPAPMVKSILFQLLNGLLYLHSQWVMHRDLKPANILVTSKGAVRIGDLGLARVFKKPLNSLFSGDKVVVTIWYRAPELLLGARHYTTAVDLWAVGCIFAELLSLRPIFKGEEAKMDSKKTVPFQRNQMLKIIEILGLPKKEKWPGLSSMPEFPQLQAMAMAPGSGHLHKPSNLEHWYHVCLKSGGYSGSSPAGSPGKEGFDLLSRLLEYDPEKRISAKEALNHPYFTTGTPVAKNCFEGFEGKYPNRRVSQDDNDIRSGSLPGTKRSGLPDDTLTSRAAKRAREM

SEQ ID NO: 10313 - protein, 426 aa, Aspergillus clavatus
MFGRNFPFFNSIGGFYPRDSLDPRKPSGTGYTSKVRVRDKYHIVGFISSGTYGRVYKAIGKDGRKGEFAIKKFKPDKEGEIIQYTGLSQSAIREMSLCSELDHSNVVQLAEIILEDKCIFMVFEYTEHDLLQIIHHHTQPQRHAIPAPMIKSILFQLLNGLLYLHTNWVLHRDLKPANILVTSSGAVRIGDLGLARLFYKPLNSLYSGDKVVVTIWYRAPELLMGSRHYTPAVDLWAVGCIFAELLSLRPIFKGEEAKMDSKKTVPFQRNQMMKIVEIMGLPRKETWPGLVAMPEFSQLQSLAMARGHLNRQSNLEGWYQSCLKNNGYSPTSSAGTPGPEGFDLLSRLLEYDPLKRISAQEALEHPYFTTGTPITANCFAGYEGKYPHRRVTQDDNDIRSGSLPGTKRSGLPDDSLMGRAAKRLKE

SEQ ID NO: 10314 - protein, 426 aa, Aspergillus fumigatus
MFGRNFPFFNSIGGFYPRESLDSKRPSGSGYTSKVRVRDKYHIVGFISSGTYGRVYKAIGKDGRKGEYAIKKFKPDKEGEIIQYTGLSQSAIREMALCSELDHPNVVQLAEIILEDKCIFMVFEYTEHDLLQIIHHHTQPQRHAIPAPMIKSILFQLLNGLLYLHTNWVLHRDLKPANILVTSSGAVRIGDLGLARLFYKPLNSLYSGDKVVVTIWYRAPELLMGSRHYTPAVDLWAVGCIFAELLSLRPIFKGEEAKMDSKKTVPFQRNQMMKIIDIMGLPRKETWPGLVSMPEFSQLQSLAMSRGYINRQCNLEGWYQSCLKNNGYSPGSAAGTPGAEGFDLLSRLLEYDPTKRISAREALEHPYFTTGTPVTANCFAGYEGKYPHRRVTQDDNDIRSGSLPGTKRSGLPDDSLMGRAAKRLKE

SEQ ID NO: 10315 - protein, 194 aa, Borrelia garinii PBi
MHNLIPTVIEHTGNYERVFDIYSRLLRERIIFLSGEINDLKADTVIAQLLFLESEDSNKDIYLYLNSPGGSITAGLAIYDTMQYIKPDVRTICIGQAASMGAFLLAGGAKGKRESLAYSRIMIHQPWGGISGQASDINIQANEILRLKKLIIDIMSNQIGIDKEKLALDMERDYFMTSNDALKYGLIDSILVRE

SEQ ID NO: 10316 - protein, 427 aa, Aspergillus niger
MFGRSFPFYNSLGGFYPQSLDARKPPGSGYTSKVRVRDRYHIVGFISSGTYGRVYKAIGKNGQKGEFAIKKFKPDKEGEIIQYTGLSQSAIREMALCSELDHPNVVQLAEIILEDKCIFMVFEYTEHDLLQIIHHHTQPQRHAIPALMVRSILFQLLNGLLYLHTNWVLHRDLKPANILVTSSGAIRIGDLGLARLFYKPLNSLFSGDKVVVTIWYRAPELLMGSRHYTPAVDLWAVGCIFAELLSLRPIFKGEEAKMDSKKTVPFQRNQMMKIIEIMGLPTKEIWPGIVSMPEYSQLQSLAMSRAPGHFNRSSNLEGWYQSCLKNNGYSANSSAGTPGADGFDLLSRLLEYDPTKRITAQEALEHPYFKNGGPISANCFEGFEGKYPHRRVTQDDNDIRSGSLPGTKRSGLPDDSLLGRATKRLKE

SEQ ID NO: 10317 - protein, 166 aa, Pseudomonas fluorescens Pf-5
MSNNDQKRDEGYIEKLVQVNRVAKTVKGGRIFTFTALTVVGDGKGRVGFGRGKSREVPAAIQKAMEAARRNMIQVDLNGTTLQYAMKSAHGASKVYMQPASEGTGIIAGGAMRAVLEVAGVQNVLAKCYGSTNPVNVVHATFKGLKAMQSPESIAAKRGKSVQEII

SEQ ID NO: 10318 - protein, 221 aa, Streptomyces coelicolor A3(2)
MTEKIGVLGKKTTQRTDVERIVVTPLPTVYGKFRAFGYFDHERGDEQVALVHGDLGAEDVLTRLHSECLTGDAFGSQHCECGAQLASALRQVADAGSGIVVYLRGHEGRGIGLLAKLRAMALQAEGLDTVEANLALGLPVDARDYGVAARILDDLGVRSVRLMSNNPRKREALVRHGIRVAEQVPLLIPPCESNITYLRTKRERLDHHLPHLDAAMAHVSS

SEQ ID NO: 10319 - protein, 193 aa, Methanothermobacter marburgensis str. Marburg
MLDKLKESLRNSPVIKKGEYDYFVNPVTDGIPLTEPELLEEIADEIVRRFNPDPASVDKIVCIEAMGIHHATVLSLKTRIPFVVVRKRRYGLPGEVAVHQMTGYSEGELYINGVDGDDRVMVIDDVVSTGGTLLAVLEALREMEVEVVDVVTVIDKGEGSRVVKERTGFTVRSLVKADVVDGRVTVEDIPDGG

SEQ ID NO: 10320 - protein, 336 aa, Glycine max
IRLELAADESTGTIGKRLASISVENIESNRRALRELLFTAPGVLQYLSGVILFEETLYQSTAAGKPFVNVLKEAGVLPGIKVDKGTVELAGTNGETTTQGLDGLGQRCAKYYEAGARFAKWRAVLKIGPNEPSELSIHENAYGLARYAVICQENGLVPIVEPEILVDGPHDIHKCAAVTERVLAACYKALNDHHVLLEGTLLKPNMVTPGSQSAKVSPQVVAEHTVRALQRTVPAAVPAVVFLSGGQSEEEASVNLNAINQVNGKKPWSLSFSFGRALQQSTLKAWGGKEENVKKAQEALLVRAKANSEATLGTYKGNSQLADGASESLHVSNYSY

SEQ ID NO: 10321 - protein, 336 aa, Thiomicrospira crunogena XCL-2
MKILVTGSAGFIGFYVTQALLKKNHDVIGIDNLNDYYDVDLKKARLSTLNQVCKESGLEKNYQFIEMDIANRAQVHDFFKEHRFDRVIHLAAQAGVRYSIENPHAYVDSNLVAFVNILEGCRQQKTAHLIYASSSSVYGMNTKIPFSTEDRVDFPISLYAATKKSNELMAHTYSHLYGIPTTGLRFFTVYGPWGRPDMAYFSFTKKILKGEKIDVFNHGNMERDFTYIDDIVEGVVRVMDHVPEITHSEITAAEAPYKIYNIGNNQPIKLERFIKAIEMATGKQAVKNNLPMQAGDVPRTYADVGDLMNDVGFKPETTIEDGVNAFVDWYRDFYKV

SEQ ID NO: 10322 - protein, 550 aa, Streptomyces coelicolor A3(2)
MSDTPKLNQRPEWTALADHAKGTLPHPDLRELFAQDPGRAERYVVRVGDLRIDYSKHLVTDETLALLQELAAATGVSGLRDAMFRGERINITEDRAVLHTALRAPRDAVIEVDGENVVPQVHAVLDKMAGFADRVRSGEWTGHTGRRIRNVVNIGIGGSDLGPAMAYEALRAFTDRSLTLRFVSNVDGADLHEAVRDLDPAETLFIIASKTFTTIETITNATSARSWLLDGLGGDEKAVAKHFVALSTNAEKVADFGIDTANMFEFWDWVGGRYSFDSAIGLSLMIAIGPDRFREMLDGFRIVDEHFRNAEAPANAPLLLGLLGVWYGDFLGAQSHAVLPYSHYLSKFTAYLQQLDMESNGKSVDREGNPVQWQTGPVVWGTPGTNGQHAYYQLIHQGTKLIPADFIGFARPVDELSEELKAQHDLLMANFFAQTQALAFGKTPDEVRAEGVPEELVPHKTFRGNHPTTTVLAAELTPSVLGQLIALYEHKVFVQGAIWNIDSFDQWGVELGKVLAKRVEPALTEGADVPGLDPSTAALVAAYRELKEVH

SEQ ID NO: 10323 - protein, 390 aa, Thiomicrospira crunogena XCL-2
MKISIVGSGYVGLSLAVLLAQKNEVVALDIVEEKVTLLNDKQSPIVDPEIEEFLQYKALNLTATLDKQKAYQDAEFVIIATPTDYDTQTNTFDTRSVEAVIQDVMTVNPRAVMVIKSTVPVGYTEQVKKQFNSENILFSPEFLREGKALYDNLYPSRIIVGEKSERAKIFADLLIEGASKPRDEIDVLFTKSTEAEAVKLFSNTYLAMRVAYFNELDTYCETHNLDSRQVIEGVGLDPRIGNHYNNPSFGYGGYCLPKDTKQLLANYDQVPNNLIKAIVDANTTRKDFVADSVIKRNPKVVGIYRLVMKSGSDNFRASAIQGVMKRIKAKGIEVVVYEPVLEEESFFNSRVINNLEDFKKISDVVIANRMTDDIFDIEDKVYTRDLFGQD

SEQ ID NO: 10324 - protein, 1392 aa, Aspergillus oryzae
MVFELTGILGKWLKPIQGHTSEDDARREGVGGHPGVLRCNKLSKLGDTELTDKVTAQSRRRQGDRAHEVHHGGLKIRGLIRNQAQVCRRHQLANPATWFSRKPPPCRAILQRLTGTIRQGEMLMVVGRPGSGCTTVLKALANIREEYLAMEGDVWYGSMDAGTAKQARANQVAFVGEDDIHFPTLSVSTTLKFALNTRRSTSDPDRAQHLQQDLQTVLELMGLAQAAHVRIGSDHIRGVSGGQRRRVSLAEALCTRASLFCFDNPTRGLDSSTAIRFLTTMRKYTTRSQCMTAMSLYQASDLAVAMFDKVLVLNDGHVAYYGPATSAKAYFESLGFYRSPKISVSDFLASMSGTPECRTPREALDRPVPIHPADFETRFRESSLYQQTVSDAATPPQSKTVGKPKASGYALPLYRQVYECTVRHYQIFLTDRAAWIAEAAGTIVQALLLGTLFRNQRDVTQGLYTRGSALFFCVLIMGLQASAEFGNTFVQRPILLKQKALRFYRPGAYALGQILADIPWKFIFIMYSLPIYWMINFQRTAGHFFTWLVCLYMGLMALSVMFRAIAVFTNSITRAILPVGLLLNVFIIYTGFYITPPGMKVWLFWIRYLDPMYYIFESVALNEIGTSSYQCSSGDIVPRGSAYNETSYQACAVSGSVAGELSLSGRLYLMAEYGFKNTHLWRNVGINAGFFVFFSVVVMIGMERFRNAAEHMSTIFYRRLPSWVSASASRSADIEEPPIVAETKDSKPSSNHDVKAIGRLETTQSVFAWQELSLQLGDDKRLLHEVSGWLQPGKMTALMGMSGAGKTTLLDTLAQRIQIGRLSGGLYLNGQTLPASMGRRTGFVHQNDIHLASSTVREALQLSACLRRPATVSWDEKMDHVEMLIQLLEMEDIAEAIIGVPGAGLNLEQRKRVSIGVELAAKPDIVLFLDEPTSGLDGNSALSIVQLMRRLSDAGQTILCTIHQPSAQMIEQFDNLLLLVPGGKTVYFGPLGSRCQKILDYFARYTRRCEETENPADYLLAVSAEPDKDWFQTWRQSPEYGSTQEQLQKMLQVQEVKDSSSSESDRTYAASYLNQLRVVTQRAFTNYWRDSDYVLGKIQLNIWMGLMNGLTFLQLSNDLTGARGRMFSIFVGVITGPVLSLQIEPRFILLRDQFLARENESRVYHWSIFTISALLVEIPFTLLGGLIYWLLWYYMVGYLTISTRAGYAFLMYELYSLFVASLAQLTASLFPTVLAAQVATGFIWLVVNTFNGPLSPPPLTPRGWRWFYNISPLFYFIEGIGTNAMHALQITCRDSELTTFQTPAGETCASYTAEFFGLANSTGYLVDPNATGLCEYCAYADGDEYVKQYDMSYSQRGNNVGIFIGFILFNYTMAVLATYLIFIFKWRKRRSN

SEQ ID NO: 10325 - protein, 592 aa, Streptomyces coelicolor A3(2)
MSEELPAGAPQETKATKEAKETRTAQEAAGPLHAEEAEEARAAEAAKASGRAKAPRGAKKSATNRAAKEAKGKGAAGEGVEPVAPLDWSNPLRDPQDRRLPRIAGPSGLVIFGVTGDLSRKKLMPAVYDLANRGLLPPGFSLVGFARRDWEDQDFAEVVHDAVREHARTPFREEVWQQLSEGMRFIPGDFDDDNAFEQLRKAVEELDASRGTSGNYAFYLSVPPKFFPKVVQQLKKHGLTDAPAGSWRRAVIEKPFGHDLDSARDLNALVHEVFDPEQVFRIDHYLGKETVQNILALRFANQMYEPIWNRSYVDHVQITMAEDIGIGGRAGYYDGIGAARDVIQNHLLQLMALTAMEEPAAFDARSLLTEKLKVLRAVRLPDDLGEHTVRGQYAGGWQGGAQVPGYLEEEGIDPASTTDTYAAIKLGIDNRRWAGVPFYLRTGKRLGRRVTEIAVVFQRAPHSPFDSTATEELGENAIVIRVQPDEGMTVRFGSKVPGTSMEIRDVSMDFAYGESFTESSPEAYERLILDVLLGDANLFPRHQEVEESWRILDPIEEYWASHDKPAQYASGGWGPREADEMLARDGRSWRRP

SEQ ID NO: 10326 - protein, 354 aa, Vibrio sp. Ex25
MLGYTIPDLFFERTAALDLGNIKTGIYIMTHSCRLSVAPMLDWTDRHCRYFHRLMTKETLLYTEMVTTGAIIHGKGDFLAYNEEEHPLALQLGGSNPEDLAKCAKLAQERGYDEVNLNVGCPSDRVQNGRFGACLMAEPQLVADCVAAMKGVVDIPVTVKTRIGIDDQDSYEFLTDFVSIVSEKGGCEQFTIHARKAWLSGLSPKENREIPPLDYPRAYQLKQDFSHLTIAINGGVKSLEEAKAHLQHLDGVMIGREAYQSPYLLASVDQELFGSNAPVKKRSEIVEEMYPYIEAQLAKGAYLGHITRHMLGLFQSMPGARQWRRHISENAHKPGSGLEVLQDALAKIPKELNV

SEQ ID NO: 10327 - protein, 378 aa, Magnetococcus sp. MC-1
MSKDLYEILGVSKGANDAEIKAAYRKLAMKLHPDRNPGNDAAEAQFKEVNAAYEVLKDPQKRTIYDQYGHAGLGQGGPGGPGGFGGQGGAGFGDIFEEFFGDIFGGGRQTRGGGRSGARQGEDYRYDLRVTLEEVARGVEKRVRIPSMSTCDTCHGSGARSGSKPTTCTTCGGAGQIRTQQGFFQVQRACHVCHGKGQIISDPCPDCGGAGRQKKEKTLTVKIPPGVDTGTRIRLSGEGGAGIQGGPAGDLYIITEVEPHSMFERYGVDLLCVVPITFPQAALGAKLEVPTLNGKARITLPAGSQTGKRLVLRSKGLPHLNRPGMLGDLVVEVRVETPVKLTTKQKELLEEFDRCGDPDSQPDSVGFFDKVKEFLGGN

SEQ ID NO: 10328 - protein, 242 aa, Candidatus Protochlamydia amoebophila UWE25
MGIQMNIYRLITLFIFTFALPGLSAEATNPQYTLAEDNQHKNQDDEDDEDWYDDDEDDDNQYQAHSPTPKEESQINTPKTSQVYPKITETTHPTLTQQKPTFASEQTLSIIKPDAVQNNYIGEIISRFEQAGLKIAAIKMTTLTKDQASKFYAIHKDRPFYNDLVNFMSSGPVVVMVLEGNQAIAKNRELMGATDPKKAEKGTLRADFAESMSRNAVHGSDSSETAEEEVLFFFKPDEITHR

SEQ ID NO: 10329 - protein, 122 aa, Arabidopsis thaliana
MQMLRSLSTRTRSRRGGYERVSDDSTFSLLGAKLRRSTSVPYYAPSIKLGAGGVPTILEELPRQKSKKVKPTGKFSHPIFSLFYGKKKKSTTTKPEFSRYLEYLKEGGMWDARANAPVIYYK

SEQ ID NO: 10330 - protein, 212 aa, Glycine max
MASFNLSYSSSPALSRPRASKHFKFFNDVPFVRMNSKFPSSDNAFGRIKAMLISGGGELLSHPNGNDIVIGTNLVGDESVQIEVQPNGTLADDTGLTSNVFSMDNNEFDSDSPSAGFASIPEAIEDIRQGKMVVVVDDEDRENEGDLIMAAQLATPDAMAFIVKHGTGIVCVSMKEEDLDRLELPLMVNSKDNDEKLCTAFTVTVVCTTFLP

SEQ ID NO: 10331 - protein, 479 aa, Silicibacter pomeroyi DSS-3
MIEKRDFYINGAWVAPAVSNDFQVINPSTEEPCAVISLGSEADTNAAVAAAKAALPGWMATPVAERIALVEKLIEIYHTRGEDLAQAMSLEMGAPIDMSRSQQVGAGTWHLKNFIRAAKAFQFERPLGDHAPNDRIIYEAVGVAALITPWNWPMNQVTLKVGAAAIAGCTMVLKPSEQSPLNAMIFAEMMDEAGFPPGVFNLVNGDGAGVGSQLSTHPDIDMVSFTGSTRAGTAISKAAADTLKKVHLELGGKGANVIFADADDKAVKRGVLHMMNNTGQSCNAPSRMLVQRPIYDQAVETAAEVASKVTVGNALDEGRHIGPVVNELQWSKIQDLIQKGIDEGARLVAGGTGRPEGLNKGYYVRPTVFADANNQMTIAREEIFGPVLTMIPFDTEEEAIEIANDTPYGLTNYVQTQDATRANRMARALRSGMVEMNGQSRSAGSPFGGMKQSGNGREGGVWGLEDFLEVKAVGGWAAE

SEQ ID NO: 10332 - protein, 143 aa, Candidatus Protochlamydia amoebophila UWE25
MTLERTLSIIKPDAVGNNHIGEIIARFEKAGLRIVAAKMKQLDRKDAEGFYAVHKGRPFFEDLVGFMTTGPVMIMVLEGENAINKNREIMGATDPKKAAPGTIRADFAQTIDENAVHGSDAAETAKTEIEYFFKSQDVCARKR

SEQ ID NO: 10333 - protein, 498 aa, Schizosaccharomyces pombe 972h-
MSTSSKLSTNIKDLSLFDLEEFPARSYIGGKWVTAASGKTFDVENPGLNETLAPVTDMSVEETRKAIKVAHEAFLSYRNSDIKERYAILRRWYDLIMENADDLATMMTLENGKALGDAKGEVVYAAKFIDWFAGEALRISGDSSMSSNPQNRIITIKQPVGVVGIITPWNFPAAMITRKVGAALAAGCTVVIRPAAETPFTALALAKLAERAGVPAGVLNMVTANSPSEHGIELTTNPLIRKVSFTGSTNVGKILAKQSSSTLKKLSLELGGNAPFIVFEDADLEKAADALMACKFRGSGQTCVCANRIYVHSSVYDAFVDLVTERVSKFKLGYGLDAGVTHGPLISEKAISKVKQHVEDAVQKGGVVVTGGKVASNLGPMYFEPTVIINAKQGMLISEEETFGPVGALFKFDTEDEVVAWANDSPVGLAGYLFSKDISRVFRVGEALQVGMVGCNTGLVSDVLSPFGGVKESGFGREGSKYGISEYLDIKSLTISTL

SEQ ID NO: 10334 - protein, 319 aa, Xylella fastidiosa Temecula1
MTIYNTILDTIGHTPVVKLNRIAPAHVDLYIKVESFNPSGSVKDRLALAIILDAEQQGLLKPGDTIVEATSGNTGVALAMIAAARGYTFVATMVETFSIERRKLMRAYGAKVILTPAAERGSGMVRKAKELAQQHGWFLASQFSNPANPAYHRNTTAAEILRDFAGRRLDHFVSGWGTGGTLTGVGEVLKIARPDIKITASEPASAALLQGKEWQPHKIQGWTPDFVPEVLNRSVPHHILSVTDDDAITVARRLAAEEGVFSGISGGASVATALQIAQQAEPGAVILAMLPDTGERYFSTPLFADINEHSDDAWLASLG

SEQ ID NO: 10335 - protein, 335 aa, Haemophilus influenzae 86-028NP
MITSQTPITVLGAGSYGTALAITFSRNGSPTHLWGHNPVHIAQMQTERQNYRFLPDVIFPEDLHLESNLAQAMEYSQDILIVVPSHAFGEILIKIKPHLKAHHRLIWATKGLERNTGRLLQTVVEEQLGTQYPLAVLSGPTFAKELAQGLPSAITLAANNEQFAREFQSRIHCSKGFRVYINSDMTGVQLGGAIKNVIAIGAGISDGMGFGANARTALITRGIAEITRLGISLGANTNTFMGMSGLGDLVLTCTDNQSRNRRFGLMLGKGLDAQMAMENIGQVVEGFYNTKEAYLLAQRQGVEMPITEQIYQMLFCGKNAQDVAISLLGRACKGE

SEQ ID NO: 10336 - protein, 382 aa, Lolium perenne
MVQPVFDAALLSGQSDIPSQFIWPADESPSPDATEELHVPLIDIGGLLSGDREAAAEVTRLVGDACERHGFFQVVNHGIDAELLADAHRCVDAFFTMSLQDKQRALRRPGESCGYASSFTGRFASKLPWKETLSFRSCPSEPDLVVDYIVATLGEDHRRLGEVYARYCSEMSRLSLEIMEVLGESLGVGRAHYRRFFEGNESIMRLNYYPPCQRPNGTLGTGPHCDPTSLTILHQDDVGGLQVHADGRWLSIRPRADAFVVNIGDTFMALSNGRYKSCLHRAVVNSRVPRKSLAFFLCPEMDKVVAPPGTSVDEANPRAYPDFTWRALLDFTQKHYRADMKTLEVFSDWIQQGHQPAATTTTTQDQRTYTASASLHLLACCT

SEQ ID NO: 10337 - protein, 234 aa, Triticum aestivum
  misc_feature (182)..(184): Xaa can be any naturally occurring amino acid
  misc_feature (192)..(192): Xaa can be any naturally occurring amino acid
  misc_feature (214)..(216): Xaa can be any naturally occurring amino acid
  misc_feature (224)..(224): Xaa can be any naturally occurring amino acid
  misc_feature (231)..(232): Xaa can be any naturally occurring amino acid
MASAAPKRCYYEVLGLSRDCSPTDIKLAFRRLALTLHPDKQAPGSDVAAATAAFQELQHAHSVLSDPQERAYYDSHRSQILFADPVSSRSGTASASPVPDLFSFFSTSAFSGFSDSGRGFYKVYGDVFDKVYAQEVAYARRMGIPTDSISTPPVIGNLDSPYTQVTAFYSYWLGFGSVMDFXXXAAEWDASXVGENRRVSECSWRRVNKKAMRXXXWEYNDAVXGLGCFCXXER

SEQ ID NO: 10338 - protein, 334 aa, Xylella fastidiosa Temecula1
MSIEQLAETAQAMVASGKGIIAIDESAGTIAKRFSSVGIENIEENRRAYRELLLTTPKLSDYISGAILFDETIRQSTKAGVPFPKYMAEHGIIPGIKVDKGAYPLAGCPGELVTEGLDGLRARLEEYYKLGARFAKWRAVINIGDDIPSGMCIDANVHALARYAALCQEQGLVPMVEPEVIMDGNHDISAAYEVTEATLRSLFNALYEQNVVLEGTILKASMVIPGTDCEEQASIDEVAESTVMCLKSTVPAILPGIVFLSGGQTDAQSTAHLNAMNQFDPLPWPLSFSYGRAMQQAALKLWSQDMKGNFAKAQQVVYERAKENGLAALGKWKG

SEQ ID NO: 10339 - protein, 488 aa, Xylella fastidiosa Temecula1
MSERQRRTRILATLGPATDPPGVLDALFKAGVNVVRLNFSHGDVSDQARRVAEVRAAAAHVGVEIGILADLPGPKIRIGRFTGGKVRLVAGARFDLLADSNASLGDTTQVGVSYLGLPQDVAAGDVLLLDDGLMQLQVVQVQGARIVTTVLNDGVLSDRKGLNKQGGGLSLGALTDRDRELIGIVARMGIDFIAVSFCRHAEEMHEARRIARECGCDAALVSKIERAEAIVNLAEIVAASDVVMVARGDLGVEIGDAQLPGLQKKIIKEALLQNKVVITATQMLQSMVESPIPTRAEVLDVANAVIDGTDAVMLSAETATGDYPVKAVEAMARICLGAEHQFEFDTDYEMAQRNLQRADHAIAMATMFLSEHICLGGVVALTESGTTPRFLSRFRSHVPIYAFTRHEDVRRRMVLMRGVFPMRFDSRGLTPREAARATIRLLVECGCMSPGDRVVFTSGEHMETLGATNTLRLLEVGADGCVSGLWEL

SEQ ID NO: 10340 - protein, 391 aa, Xylella fastidiosa Temecula1
MSIVRMTDLALSGKRVLIRQDLNVPIDQGRITSEQRIIASLPTIRVALERGAAVMVTSHLGRPKEGVWSEEDSLAPVAKRLSQLLGIEVPLRRDWVDGVQVAPGQLVLLENCRMNVGEAENDEALARKYAALCDVFVMDAFGTAHRAQASTHGVICCAAIAAGGPLLMAELDALSRGLKHPVKPLLAIVGGSKVSTKLELLSNLVNNVEQLITGGGIANTFLAAAGYPIGKSLYEADLIETAREIITVAKARGAEIPLPTDVVVAKQFLPGVTATVKTVDAIVADDLILDIGPQTARHYAALIETAATVVWNGPVGVFEFDAFSKGTEVLARAVAASSAFSIAGGGDTLAAIDKYGVADQISYISTGGGAFLEFLEGKTLPAVAALQARSG

SEQ ID NO: 10341 - protein, 269 aa, Leuconostoc mesenteroides subsp. mesenteroides ATCC 8293
MSQHNASRIPFVVANWKINKLHADVAEFLDKVNGKVPAENVVETGIAAQDLFLSDMVRATAQSPIHIVAENVHWEDSGAYTGETSPKALKDIGAKYVLIGHFERRKFFNETDSTVNLKVTAALRNGLRPIIDVDEDMSTYAQFMDAEPSVAQVAAALAGVSVDQIRNVTLAYEPTWAIGSGEAASAVQAQKAAHLIRQTLAKLYSPVIAEQVRVLYGGSVTPDNAREIMLQKDIDGVLVGTSALDPEKFLQLVAIAQDPEVPEFNIENT

SEQ ID NO: 10342 - protein, 146 aa, Brassica napus
TTRPPRVRKHSGKSENDMLQCFIESKYKDGRQTTESEVTGLLIAALFAGQQTSSITSTWTGAYLMKYKEYSSTALDEQKKLIEKHGDKIDHDILSSEMNGLYRGIKEALRLHPPLIMLMRASHSDFNVTTRDGKTYDIPKGHIVAT

SEQ ID NO: 10343 - protein, 90 aa, Opitutaceae bacterium TAV2
MAKTPARKPNAAFMKPVQPDDVLAAVVGAKPLPRTELTKKLWEYIKKNNLQDKKVKTNINADDKLKAVFNGKKTVSMFEMTKLVSGHLKA

SEQ ID NO: 10344 - protein, 579 aa, Oryza sativa Japonica Group
MGEVATTTLLLTSHEAKPAKAPSIHDAIEVYIGATGARQLLKAMLLAFAWAFDAQQVFMSVFTDAEPPWHCTGVVDAVEAAAGDSGSSCSSPATSASPCALPLGTWEWDRLAKTSVVSDWALNCSGGGPALVSLPASSFFTGNLVVVLPYSLISATTTPLLTSHEAEPSIDDVIEAYIGATGARQLLKAMLLAFAWAFDAQQVFMSVFTDAEPPWHCTGVVDAAAAAAADSGSSCSPPAASASPKMLLLSLVTMSVAAALTAFSPNVWVYSALRFVSGFGRSMVGTSAMVLSTELDGKRWRNTVSAAGFVFFSVGFVSLPALAYTFREASWRNMYVWTSLPSLCYAVLLYLLVQESPRWLLVRGRKQEAIEAVRQIASLNGGGGGITTSSFSMLDALSPSNLYLSVAYNAVAELPSSILAWLLMGRWFNRRGSVVALTTASGLCSLAACVPAVVLPDGARMAAEVASFFASCTAYDMMLMYTIELFPTSVRNSAVGLVRQAVALGGVVAPVLVALGRETTSYWSSSFGVFGLAVGCLGLLVTCLPETRGRRLSDTMEEEEAAVLSSSGASDMDNNGELV

SEQ ID NO: 10345 - protein, 460 aa, Oryza sativa Japonica Group
MGLAAAAAAAVRPCRRRLLSSATAAAAAATVATATPLFPRCPNPHHHLHGRRLPFLASAASQQQQQSGQTAASPATPPIPSDPRAAVSGNLPFFDRVLFPDTFPVETPPPSSAAASAAAAADEEVASALKAREETEAEREAWRLLRRAVVSYCGEPVGTVAAEDPECTETLNYDQVFIRDFVPSALAFLMRGETEIVRNFLLHTLQLQSWEKTVDCYSPGQGLMPASFKIRAVPLDDNNEAFEEVLDPDFGESAIGRVAPVDSGLWWIILLRAYCKITGDNALQERVDVQTGIKLILSLCLSDGFDMFPTLLVTDGSCMIDRRMGIHGHPLEIQGYYWVDMKKINEIYRYKTEEYSHDATNKFNIYPEQIPSWLVDWIPEKGGYLIGNLQPAHMDFRFFSLGNLWAITSSLTTPKQAEGILSLIDEKWDDLIANMPLKICYPAMEDDEWRIITGSDPKNT

SEQ ID NO: 10346 - protein, 371 aa, Yarrowia lipolytica CLIB122
MPSPPHDRLNDSIGSIDPWLAPKTKFHTVTVRSEHSIITCLQVTQDYIIAACETPEITVYSKTGVVIRRLDGHSDGVWAMHFAHNLLATGGSGKDSDVRVWKVETGRCVAVLKGNKKTVRCVRVARDGRGKLIVVSGARDNTVRVWDLSTADSSGSSNLEPKLPSATFRGHKDTVRCLDSYENTIVSGSYDGTVRVWSLDTRSCLHVLDGHSDRVFAAIIDPQRKRCISASRDTTARIWSLETGQCLHILKGHTSIVYMVELTPDYSHIVTGSSDGTLRVWDPSGALVHTLSGHKSPVSAMQVDNDKIVSSATNMTVKLWDLQKGEFIRNLVSFPTFSSSESVWHVDFNGNVIVVAYSREGAFLDVIERVP

SEQ ID NO: 10347 - protein, 501 aa, Arabidopsis thaliana
MSIFLCFLLLLLLLLVTIIFTRKSQSSKLKLPPGPPKLPIIGNLHYLNGLPHKCLLNLWKIHGPVMQLQLGYVPLVVISSNQAAEEVLKTHDLDCCSRPETIASKTISYNFKDIGFAPYGEEWRALRKLAVIELFSLKKFNSFRYIREEENDLLVKKLSEASEKQSPVNLKKALFTLSASIVCRLAFGQNLHESEFIDEDSMEDLASRSEKIQAKFAFSNFFPGGWILDKITGQSKSLNEIFADLDGFFNQVLDDHLKPGRKVLETPDVVDVMIDMMNKQSQDGSFKLTTDHIKGIISDIFLAGVNTSATTILWAMTELIRNPRVMKKVQDEVRTVLGEKRDRITEQDLNQLNYFKLVIKETFRLHPAAPLLLPREAMAKIKIQGYDIPEKTQIMVNVYAIGRDPDLWENPEEFKPERFVDSSVDYRGLNFELLPFGSGRRICPGMTMGIATVELGLLNLLYFFDWGLPEGRTVKDIDLEEEGAIIIGKKVSLELVPTRRQ

SEQ ID NO: 10348 - protein, 328 aa, Microcystis aeruginosa PCC 7806
MKAILMTAVDVLQLQEVPTPEISQPHQVLVALKAAGVNPIDTKIRKRGTFYPEQMPAILGCDGAGIVEAVGATVQDFRPGDEVYFCSGGLGKAGTGNYAEYALIEADYLAHKPKSLSFAEAAAVPLVLITAWEALYDRVHLQSGQSVLIHGGAGGVGHVAIQLAKLKGAKVYTTVGNSDKERLVRQLGADYPILYKQTDFVAAILQETAGKGVDIAFDTVGGETFRQTCRAVRVYGDMVTILEPTGSWKEARDRNLRISLELMLTPALMGLPEAQKYQTEILRQGARLIDEKKLTIHLSQTFPLAAAISAHQLLETGAVTGKIALIID

SEQ ID NO: 10349 - protein, 601 aa, Prochlorococcus marinus str. NATL2A
MNFDEKESTNIEEIEQTVPSPCIANNSPRAKFEQFKADSNYLSEPLHSELLNDSDHFTNDAVQLLKFHGSYQQDDREHRKRGGTGKDWQMMLRLRNPAGYVPGPLFVALDELSDRLGNQTLRATTRQCFQMHGIKKGNIKEVIGTIVKSMGSTLAACGDVNRNVMAPAAPYEQGSYPAARKLANDIADVLSPQKAEKTYIDLWVDGEMKYAIKPSSEVKKNKKLQLKPGVFSGDKKEPLYGATYLPRKFKCATTVPGDNSVDILTHDIGLVTFTNKKGVLEGCNVYVGGGMGRTHNLDTTFARIADPIGYVEGEHILELVQSILALQRDYGDRKTRRHSRLKYVLHDMGVDWFKKQLTTKYFTRQIENLKHEGDTILEDYLGWHQQSEKLWFVGLPLLSGRLTGRVKKELRNIVEKFALDVRLTPNQDLLLCNIGNYQKASVKRALINIGFINPGAPDSLARNAMACPALPLCGLAMTEAERFLPELLERINNQLKILEINKPILIRVTGCPNGCARPYMAELALVGSGLNQYQLWLGGSTNLKRLATPYLQKMPIDDLEKTLEPLFLSWKDTGASSSLGDHVTKLGSESVMSLLTSSAAP

SEQ ID NO: 10350 - protein, 458 aa, Pseudomonas aeruginosa PAO1
MSSGRIVQIIGAVIDVEFPRDAVPSIYEALKVQGVETTLEVQQQLGDGVVRSIAMGSTEGLKRGLNVDSTGAAISVPVGKATLGRIMDVLGNPIDEAGPIGEEERWGIHREAPSYADQAGGNELLETGIKVIDLVCPFAKGGKVGLFGGAGVGKTVNMMELIRNIAIEHSGYSVFAGVGERTREGNDFYHEMKDSNVLDKVALVYGQMNEPPGNRLRVALTGLTMAEKFRDEGRDVLLFIDNIYRYTLAGTEVSALLGRMPSAVGYQPTLAEEMGVLQERITSTKKGSITSIQAVYVPADDLTDPSPATTFAHLDATVVLSRDIASLGIYPAVDPLDSTSRQLDPLVIGQDHYDTARGVQYVLQRYKELKDIIAILGMDELSEADKLLVARARKIQRFLSQPFFVAEVFTGSPGKYVSLKDTIAGFKGILNGDYDHLPEQAFYMVGGIEEAVEKAKKL

SEQ ID NO: 10351 - protein, 363 aa, Lolium perenne
MVQPVFDAALLSGQSDIPSQFIWPADESPSPDATEELHVPLIDIGGLLSGDRVAAAEVTRLVGDACERHGFFQVVNHGIDAELLADAHRCVDAFFTMSLQGKQRALRRPGESCGYASSFTGRFASKLPWKETLSFRSCPSEPDLVVEYIVATLGEDHRRLGEVYARYCSEMSRLSLEIMEVLGESLGVGRAHYRRFFEGNESIMRLNYYPPCQRPNETLGTGPHCDPTSLTILHQDDVGGLQVHADGRWLSIRPRADAFVVNIGDTFMALSNGRYKSCLHRAVVNSRVPRKSLAFFLCPEMDKVVAPPGTLVDEANPRAYPDFTWRALLDFTQKHYRADMKTLEVFSDWIQQGHQPAATTTTT

SEQ ID NO: 10352 - protein, 441 aa, Leuconostoc mesenteroides subsp. mesenteroides ATCC 8293 [sequence omitted]

SEQ ID NO: 10353 - protein, 220 aa, Schizosaccharomyces pombe 972h-
MSIPLEQPENVVVLRQTMYLLSLMTILRDQQTGHSEFVRTANLIINMLMQEALSALPYKKCLIKTSSGGTYTGVQPARDICGVSILRAGESMEYGLAAACNYSVPVGKLLVQRDETTFEAKLMFCKLPKDAQDRLVLLLDPLLATGNSVILAIQTLINKGIPEENIVFVNLIACNEGITNVFAKFPKLRMVTASIDPELNANKYVVPGCGDFGDRYFGTC

SEQ ID NO: 10354 - protein, 559 aa, Candidatus Protochlamydia amoebophila UWE25
MVNSMDSHNLKIVLILAFGFSLAGILGYITHRLKLSPILGYLLAGYIIGPYSPGFVADVNVSEQLAEIGVVLMLFGVGLHLKWEDLVNVKNIAIPGAIGQTLVAAACGAWIVYAIGWPIEVGIIVGLAIGVASTVVLVRVLSDNHLLDTLEGHVSIGWLIVEDILTVIVLILLPVISTFAKEGNLPLIELLETLGWTVFKFLLLALVMFTFGKKIVTFILMHIARLRSHELFTLALLALTFMIAVASALVFGTSIALGAFIAGMVIGQTHVKHQAAANALPMKDAFAVIFFLTVGMIFNPMAIMENFTLFIGILAIVVVIKPLAAFLIVVVMRYPVKVALTVALALAQIGEFSFILGEEAIKFHLLPDEGYDIIVACALISISINPLLFKGINFLQNSIESVQNTYNPLVPNDIPPVFHSLHAIVIGFGPLGRAIAQTLEQQNFDVTVIDQNVDTIAFLSDSHQRAVFGDATLPTILEDAHIKDADLLLITVPNLNITLKIIQVAQPLNSEMKILARANYLTDQQKLQNLNIQSVCSEEETKQAFIKMVDRIVKEELEA

SEQ ID NO: 10355 - protein, 498 aa, Cicer arietinum
MGIFSFFAYSLFYLSIFFIFRLLFQSRKFKNLPPGPPSLPIIGNFHHLKRPLHRTFKGLSKTYGDIISLWFGSRLVVVVSSLSEFQQCFTKNDVVLANRPRFLSGKYIFYNYTTLGSTSYSEHWRNLRRITSLDVLSNHRINNFSGVRRDETQRLITKLAEDSSTSFAEVELSFRFYDMTFNNIMRMISGKRYYGEDCDMSDLQEASQFRDMVTELLQLSGANNKTDFMPLLKFFDFENLEKRVKNIADKTDAFLRGLLQEQRNKKERTNTMIDHLLNLQESQPEYYTDQIIKGLALAMLLAGTDSSAVTLEWSMSNLLNHPEVLKKVRDELDTHVGQDRLVDESDLPKLTYLKNVIYETLRLCTPAPLLLPHSTSDDCIIGGYKVPRDTIVLINAWAIHRDPKSWSEATTFKPERFDKKGEIEKVIAFGMGRRVCPGEALALRTISMTLALLIQCFDWKRTSDDMIDMAERDGFVLTKLVPLKAMCKTRPVVNKIFK

SEQ ID NO: 10356 - protein, 363 aa, Lolium perenne
MVQPVFDAALLSGQSDIPSQFIWPADESPSPDATEELHVPLIDIGGLLSGDRAAAAEVTRLVGDACERHGFFQVVNHGIDAELLADAHRCVDAFFTMSLQGKQRALRRPGESCGYASSFTGRFASKLPWKETLSFRSCPSEPDLVVEYIVATLGEDHRRLGEAYARYCSEMSRLSLEIMEVLGESLGVGRAHYRRFFEGNESIMRLNYYPPCQRPNETLGTGPHCDPTSLTILHQDDVGGLQVHADGRWLSIRPRADAFVVNIGDTFMALSNGRYKSCLHRAVVNSRVPRKSLAFFLCPEMDKVVAPPETLVDEANPRAYPDFTWRALLDFTQKHYRADMKTLEVFSDWIQQGHQPAATTTTT

SEQ ID NO: 10357 - protein, 202 aa, Oryza sativa Indica Group
MASHLDFRYLDEGLGGERGKRKRREAEEAAAADSMDLDADADAPRPSKLRAVPSLSDPSKPASFGQPTYDGVIAGRVSGRRWKEARTRRASALAASRKPTPLEQRARDKSLKRAYQARVAELKEEIRQSKAAKRKQREEREKRKKENVLRSGTKLQRVTNPKTILKIAKSKKRKQLKVVPDEFLGGKKSDANRRMQVPGLDN

SEQ ID NO: 10358 - protein, 308 aa, Oryza sativa Indica Group
MEAMHAPVYFESYEVRGDMPTVPPEVIDSIRRNKVCLKGGLATPVGGGVSSLNVQLRKELDLYASLVNCFNLPGLPTRHDNVDIVVIRENTEGEYSGLEHEVVPGVVESLKVITKFCSERIAKYAFEYAYLNNRKKVTAVHKANIMKLADGLFLESCREVATKYPGIQYNEIIVDNCCMQLVAKPEQFDVMVTPNLYGNLVANTAAGIAGGTGVMPGGNVGQDHAVFEQGASAGNVGNVKVVEQKKANPVALLLSSAMMLRHLQFPSFADRLETAVKRVIAEGKYRTKDLGGSSTTQEVTDAVIAHLD

SEQ ID NO: 10359 - protein, 404 aa, Neisseria meningitidis Z2491
MDKFPKSAKLDHVCYDIRGPVHKKALQLEEEGNKILKLNIGNPAPFGFEAPDEILVDVIRNLPTSQGYCDSKGLYSARKAIVHYYQTKGLRDITVDDVYIGNGVSELITMSMQALLDDGDEILIPAPDYPLWTAAATLAGGTVRHYLCDEENGWFPNLADMEAKITPKTKAIVVINPNNPTGAVYSREILLEIAELARKHGLIIFADEIYDKILYDGAVHHHIAALAPDLLTVTFNGLSKSYRVAGFRQGWMVLNGPKHHAKGYIEGLDMLSSMRLCANTPMQHAIQTALGGYQSINEFILPGGRLLEQRNRAWELVSQIPGVSCVKPMGAMYMFPKIDTEMYRIRDDMKFVYDLLVREKVLLVQGTGFNWIKPDHFRIVTLPYVHQIEEAMGRLARFLQTYRQ

SEQ ID NO: 10360 - protein, 283 aa, Mycobacterium sp. MCS
MTSTRGEAAGIPSVSLNDGHSIPVLGLGVGELSEAEAERSVAAALEAGYRLIDTAAVYGNEAAVGRAVNASGIPREEIYVTTKLAVADQGFGTSQDAARASLERLGLDYVDLYLIHWPAGDHGKYIDSWGGLMKAKQDGVARSIGVCNFNAEHLSNIIDLSFFTPAINQIELHPLLNQAELREVNAGYGIVTEAYGPLGVGRLLDHAAVTGVAQAHGKTPAQVLLRWSIQLGNVVIARSANPDRITSNLEVFDFELTDDEMATLNGLDEGTRFRPDPETYTGP

SEQ ID NO: 10361 - protein, 272 aa, Triticum aestivum
AYLGDSLEQVCTKKQAGTGPEFPGYRRPTRPGNLGAPVMVDRMLRLLASNNVVSCEVEEGKDGLLARRYGPAPVCKWLTPNEDGASMAGLLLMTHDKVTMESWYYLKDVALEGGQPFHRAHGMTAYEYNSTDPRANCLFNEAMLNHSTIITKKLLEFYRGFDNVETLVDVAGGVGATAHAITSKYPHIKGVNFDLPHVISEAPPYPGVQHIAGDMFKKVPSGDAILLKWILPHWTDDYCMTLLRNCYDALPHDGKVVIVEGILPVKQMHAQH

SEQ ID NO: 10362 - protein, 362 aa, Lolium perenne
MVQPVFDAALLSAQSDIPSQFIWPADESPTPDATEELHVPLIDIGGLLSGDREAAAEVTRLVGDACERHGFFQVVNHGIDAELLGHARCVDAFFTMSLQDKQRALRRPGESCGYASSFTGRFASKLPWKETLSFRSCPSEPDLVVDYIVATLGEDHRRLGEVYARYCSEMSRLSLEIMEVLGESLGVGRAHYRRFFEGNESIMRLNYYPPCQRPNETLGTGPHCDPTSLTILHQDDVGGLQVHADGRWLSIRPRADAFVVNIGDTFMALSNGRYKSCLHRAVVNSRVPRKSLAFFLCPEMDKVVAPPGTLVDEANPRAYPDFTWRALLDFTQKHYRADMKTLEVFSDWIQQGHQPAATTTTT

SEQ ID NO: 10363 - protein, 207 aa, Mycobacterium sp. MCS
MYLVTKLWNSEQGYDATLAAFEASVDRLGVDYLDLYLIHWPVPEKNLFVDTFKAFARLREDGRIRSIGVSNFEPEHLRVLIDSTGIVPAVNQIELHPLLPQRELRELHAQLGIATEAWSPLGQGSLLAHPTVTGVAESHGKTAAQALIRWHMQLGNIVIPKSVNPQRIESNFDVFDFELSEQDMASISSLEDGSRLGPDPKTFNFTG

SEQ ID NO: 10364 - protein, 614 aa, Xylella fastidiosa Temecula1
MSFSKHFGKLMLATCLSLSAAPAFSYSISHGKVVDDKGNQIQLRGVNWFGFETGDHVVNGLWARNWKEFITQLQGMGFNAIRLPFCPANLNSNTSPSSIDYSRNPDLQGLSSLQILDKVVKELSDRRMYVLLDHHRPDCSAISELWYTDSYSEKQWIDDLRFVAHRYANVHGVIGLEVKNEPHGRTTWGTGDPKTDWNTAVEHAAAAILEAAPKWLIGVEGIGENPICSSTIGHFWGENLEPMDCTPLKVPADHLLLMPHVYGPDVYVQPYFNSPDFPNNMAAIWDKHFGHFAKAGYAMAIGEFGGKYGEGDPRDIAWQNAFVDYLISIGVTDAFYWAANQNSVDTGGMVGNDWTTPRDDKVKLLNKLWNAGGGASGGSGGGAGASSGSGAGGGSSGGAGTGSGSGAGGGSSGGAGTGSGSGAGGGSSGGAGASSGSGAGGGSSGGAGTGSGSGAGGGSSGGAGASSGSGAGGGSSGGAGASSGSGAGGGSSGGAGAGSGSGARGGSSGGAGAGSGSGAGGGSGSGSDPTKSKIAVNTIVDSDWHTGYCERIQVTNTSDSPNTWTVTIPIKGKIQTLWSARWSVKDNALTAFGMDWNKTLDPKGRTEFGFCSNY

SEQ ID NO: 10365 - protein, 375 aa, Mycobacterium sp. MCS
MPPSLPASAPPVRGKDPAPRGKNRTRDAVVNAATRMTLRTLPVLPDRVKRALLGFRSVTVDGNTLDTTLQLLLAAQRAAGINGLVASDDVVVARRQLRLTAAMFPADIVADMTELSIPGPAGAIPARLYRPTSPDPDGPLLVFYHGGGFVIGDLDTHDDLCRVICRDGGITVLSPDYRLAPEHKAPAAADDAYAAFRWASEHAAELGVAADRIAVGGDSAGGNLAAVVCQRARNAAAPLPALQLLIYPVVDVGSETRSKTLFADGYFLTARDIAWFMDLYLEGASVDRTDPDVSPLLADDLSGLPPALVLTGGFDPLRDEGNRYAEALRAAGVPVDLREERSLIHAFANFFPLGGDSATATAAMISALRAHLSRG

SEQ ID NO: 10366 - protein, 206 aa, Oryza sativa Indica Group
MARLAGVAALSLVLVLLGAGVPRPPAAAAAKTQVFLSKLPKALVVGVSPKHGEVVHAGENTVTVTWSLNTSEPAGADAAFKSVKVKLCYAPASRTDRGWRKASDDLHKDKACQFKVTVQPYAAGAGRFDYVVARDIPTASYFVRAYAVDASGTEVAYGQSSPDAAFDVAGITGIHASLKVAAGVFSTFSIAALAFFFVVEKRKKDK

SEQ ID NO: 10367 - protein, 300 aa, Zea mays
MAEIPVIDLRLAGSSPDESARLRDACERLGCFRVTGHGAPAGLLADMKAAVRALFDLPDDAKRRNADVIPGSGYVAPCPANPLYEAFGLLDAAAPADVDAFCARLDAPPKVRETVKTYAEKMHDVIVGVAGELATSLGLGLEEHSFQDWPCQFRINRYNYTQETVGSSGVQTHTDSGFLTVLQEDECVGGLEVLDPAAGEFVPVDPVAGSFLVNIGDVGTAWSNGRLHNVKHRVRCVAPVPRISIAMFLLAPKDDRVSAPEALVDAGHPRRYKPFNYDDYRRLRLSTGERAGEALARMAA

SEQ ID NO: 10368 - protein, 502 aa, Agrobacterium tumefaciens str. C58
MSLFWRPERQYILTSFNELGLSEKIVASVTQLGYTTPTPIQAKAIPLLLEGRDLIGLAQTGTGKTAAFGLPIIEMLMKQADRPANRTTRTLILAPTRELVNQIGDNLRSFVKKTPLRINQVVGGASINKQQLQLEKGTDILVATPGRLLDLIARNAISLSKVTYLVLDEADQMLDLGFIHDLRKISRMVPPKRQTLLFSATMPKAISELASNFLTDPIKVEVTPPGKAADKVEQYVHFVAGKNDKTDLLKKSLNENPDGRSIVFLRTKHGAEKLYKHLEHIGFKVASIHGNKSQGQRERALKGFKDGEIKVLVATDVAARGIDIPAVTHVFNYDLPEVPDAYVHRIGRTARAGRDGIAIAFCAPDETRLLHDIEKLMKIDIPVASGERPAGLASPTRPNNNRGGRNNNGGQPRGPREGGRHNGESRPSRNHAPRDADNDLEVTSDFKRVKQAEGDAGRPAGPRKQRRPARKPGGSGANRHAPAGGNGQEKRASGNGNRGRNR

SEQ ID NO: 10369 - protein, 293 aa, Rhodobacter sphaeroides 2.4.1
MAKERNLDYLETTPRPEGSVPVDESRGRITKNGIRIYEPEDYAGMRRAGRAAAEILDLVGPLVVPGATTAEIDRFITDEIERRGVTSATIGYKGYQHASCISVNHVVCHGIPGTKVLKDGDILNIDVTVIVDGWFGDTSRMYVAGTLGRKAERLLEVTHDALMKGIEVVKPGATFGDIGAAIQTYVENNRMSVVRDFCGHGLGRVFHAPPNVLHYGRPGTGPVLEEGMIFTIEPMVNLGRPETKVLADDWTAVTRDKSLSAQFEHSVGVTADGCEIFTLSPAGLFYPTWPTAD

SEQ ID NO: 10370 - protein, 127 aa, Oryza sativa
ALVDAFLFDMEEQIDDIDATDFDALDLASNPFLEKSLENLYERSEELNKEHNKIRYYLLKVAQQKYNMSKKKEKPEETEAALKQISQPDRRDSLILSQQINNYCQIVNQYASAGLEKLYLAEAVLKK

SEQ ID NO: 10371 - protein, 423 aa, Borrelia garinii PBi
MVQDKTLEPKFFQNLLDNNPTPYHLVNYIEEKLINYFNAQQLKLDEKWKIETGSYYIKKEGTSLIAFNIDVKKKYEPFLIATAHTDSPGLKLKIDATEKTGDVFYNHIEVYGSPIISTWLDRDLSLAGILYFKKNENINSKLINIENIGIIPNLAIHLNRQINEGFKYNTHDNLTVINSTKKTIKDNILEQLGIEYENFLSCDLIFTESQPSKIIGTEGEFLASKNLDNKSGCHAIMNSYIHTSNNKNKIAVFFDNEEVGSLTSRGADSNLLSEVLERIDLALNLTREEHLIKTNKSFNISIDSVHGIHPGYAFKHDPNYQATLNKGVVVKNSANFRYATTSTGFAKLKNLAINNNIKIQEIIMKANVPSGTTIGPISNARTGIETIDIGTPMWAMHSLRETVSIADHIEAIKLLRAFFEKGI

SEQ ID NO: 10372 - protein, 182 aa, Streptomyces galbus
MTELANIPELLASRIRDVADYPEPGVMFKDITPLLADPVAFTALTDTLAAGRRRHPRTKVVGLEARGFILGAPVAVRAGLGFIPVRKAGKLPGATLSQAYDLEYGSAEIEVHAEDLAAGDRVLIVDDVLATGGTAEAAIQLIRRAGAEVCGLAVLMELGFLGGRARLEPILDGAPLEALLQV

SEQ ID NO: 10373 - protein, 419 aa, Brassica souliei subsp. amplexicaulis
HHRSYNLFFFVVLVLFHHVFSTNTLSPNETLTISSNKTLVSPGDVFELGFFTTTTHTDRWYLGLWYKTTSHKTYVWVANRDNPLHSSTGTLKISHSNLFLLDQFNTPVWSTNITETVTSPLTAELLSNGNFVLRDSKTKDTNQFLWQSFDFPVDTLLPEMKLGRNLKTGHDRVLTSWKSPTDPSSGDYSFKLETHQGSLLHEFYLLKNELKVYRTGPWFNAIPKMQNWSYIVNSFIDNKEEVSYAFKVNNHKMIHTRFRMSSTGLLQVITWTKTTPQRNMFWSFPEDQCDYYTSCGSYAYCDTNTTPTCNCIKGFMPKNDQAWALRDASSGCVRSSRLSCGEGDGFYRMSHMKLPETSGAVVDKGIGLKECKERCSRDCKCTGFANMDIRNGGSGCVMWTGELMDMRSYVAGGQDLYLK

SEQ ID NO: 10374 - protein, 868 aa, marine gamma proteobacterium HTCC2143
MAKRVYLFNEGGKDDRELLGGKGANLCEMTTLGLPVPFGFIITTPTCREFFEAGNQLPSLLEQEYRVALDLVEKKMGARFGDPENPLLFSVRSGASVSMPGMMNTILNLGLNDEIAEGLAKKTDNARFAYDSYRRFIQMFADVVLGVDGKLFEHEIEKYKAAHNKVLDVDMTAEDWQSIIVIYKTLANFPQDPFVQLKLAVEAVFLSWYTPRANVYREMNNIPDTLGTAVSVQAMVFGNFGDDSGSGVAFTRNPSTGEHAFFGEYLFNAAGEDVVAGTRTPLPVEALNERMPEVYKELYATQALLEKHYRDMQDMEFTVQQGKFYMLQTRSGKRTGRASIKIAVDMVNEGLITESEALMRVSPEHVEAFLHPMVDPAAKTSIVANGLPASPGGATGSVVFSAEEAVEVARDGTAVVLVRRETTPEDIHGMKVAEGILTELGGMTSHAAVVARGMGVCAITGCGSLTINYQQGTAVTAEGVVIKRGDIITLDGTAGEVMLGDIPKTEASSSDDFQILLSWADKHRKLKVRANAETPEDAAKARELGAEGIGLCRTEHMFFAADRIDKMRGMILSETKEERLKYLDMLFEFQRDDILELFKVMDGLPVTVRLLDPPLHEFLPHTPEEMSALAKRIGKPVETIKAMTENLHEVNPMLGFRGCRLSVVYPEITEMQVRAIISAAVDATEQGYRPFPEIMIPLVVNVREIRMLNEIIDKGIQEVLKEKAISIPYKVGTMMETPRACLGADRLAGEVEFMSFGTNDLTQMTYGFSRDDVGKFLPQYLDKKLVESDPFVSLDQRAVGKLMEMAVTESRGRKKGIKYGICGEHGGDPRSIQFCHDLGLDYVSCSPFRVPVARIAAAQANVGGALSD

SEQ ID NO: 10375 - protein, 410 aa, marine gamma proteobacterium HTCC2143
MKMPDKGSSWDNLAAEMINRGSGDAKWREGKTAVYVFNAGEDVARVQKEAYALYMSENGLGPTAFPSLRKMEAEVIDMGLGLLHGSELSDGSITSGGTDSITMAVKAARDYARNALGKTGLFNIVAPYSAHPAFDKAAIMMDLELRRIPVGDDLLADCAAMSTAIDDQTIMLVGSAPNFPYGLIDPITELGEIAEAKNVWLHVDACVGGYIAPFVRMNGVDIPDFDFSVPGVSSMSADLHKYGFCAKGASTVLFKTAELKKHMIFDCRDWPGGRMLTPTLAGTRPGGAISAAWAVMNYLGIEGYKNKHQQVTDARKAIELGVRELGFTILGTPLLGIIAFQHPDVDVFAIYKQMYDRGWVTSLTTQPKALHLMLSPFHKTVTNLYLSDLTESIEQVKSGDKRAVKEAKYN

SEQ ID NO: 10376 - protein, 399 aa, Chlamydomonas reinhardtii
MALSASAPALAGLRPVLNALPALTRALVQPASAATTTLFGNVEQAPKDPILGITEKFLADTNPIKMNLGVGAYRDDNGQPVVLDAVREAERRVAGSHFMEYLPIGGLRDFISESVKLAYGDNAAVLAEGQVAAVQSLSGTGSCRLFADFQKRFMPGTKVFIPEPTWSNHFNIWRDAGVEFAKYRYYKAETRGLDMDGFLEDIKHFPLFDMAYQGFASGDCDRDAASIRIFLADGHRLAVSQSYAKNMGLYGQRVGCLSVVCDNKRDASAVESQLKAIARPMYSNPPLHGALLVTKILQDNDLKQLWFKEVKGMADRIISMRSLLRKRLEEAGSPLPWGHITDQIGMFAYSGMSPEMVDALAAQHHIYMTRNGRISMAGVNTKNVGRLAEAMHAVTSGKL

SEQ ID NO: 10377 - protein, 285 aa, Aspergillus oryzae
MASAEQTYPVLPSTLLIISLKMYFTPTRTLDYLRALLDPKNDIVRPENRSKLLLALIPDFLTIYPSNEIIKNYESSLAPQEAKALPPPFLLGAQDCFWEPLGAYTGEVSPLALRSMGVSIVELGHAERRSIFGETDDQTGRKAAAASAHGMVPLVCIGEVTAPGPVASQAVGLAVRECEVQVRAVLKAIPAHAPVIFAYEPVWAIGKPKPAGVDHISAVVDGIKAVIGERPGDVRILYGGSAGPGLWGAGGLGKAVDGMFLGRFAHEIEGVRKVIREVEETLNVA

SEQ ID NO: 10378 - protein, 358 aa, Wolinella succinogenes
MKKYEIAIIKGDGIGPEIVDEAKKVLDAISYSHGFELSYHDYLMGGIAVDRAGVPLPDETIEGCLRADAVLFGAIGGEKWDSLPRELRPESGLLKLRKSLEIFANLRPTVVYDELIEASTLKESVIKGVDILVVRELIGGIYFGEPKGREGDKAFNTMVYSVPEIERIAHVAFKAAMRRQKRVCSVDKANVLDVSQLWRETVTRIAKEYPEVELSHMYIDNAAMQLIRNPKQFDVILTGNLFGDILSDEASMLSGSIGLLPSASIGGKAALYEPIHGSAPDIAGQGIANPIATIASASMMLRHSLGEVEAADAIDKAIVKTLKEGYRTKDIAAFGAKEICTTDEMGSIIANYAAKKGE

SEQ ID NO: 10379 - protein, 559 aa, Chlorobium tepidum TLS
MYLSRSAEWSALESHYQDISHQAMIDLFSTDPNRHERFSLSFNAIHLDYSKNRISARTMELLMDLVRRSGIEKKRRQMFEGEQINFTEHRSVLHTALRRPPGYTMTIDGNDVASEVSDVLDQMKAFCKKVISGEWKGYTGKRITDVVNIGIGGSDLGPFMVTEALKPFAHGKLKVHFVSNVDGSHLVETLRGLNPETTLFIIASKTFTTQETLANAVSARAWFLVKAGNRDHVAKHFVAVSTNREKVEEFGIDPDNMFRFWDWVGGRYSLWSAIGLSIALYLGFDRFRELLAGAHAMDEHFLNAPLEENMPMILAMLGIWYNNFFGAHSQAIIPYDQYLHRFPAYLQQLDMESNGKRVDRAGHEVDYATGPVIWGEPGTNAQHAFFQLLHQGTEIVPVDFIVSLKSQNPVGEHHDMLVANCFAQSEALMKGKSEAEARAELEAAGLSGGDLEKLLPHKLFPGNRPTNTIVLDELNPFNLGSLIALYEHKVFVQGVVWNINSFDQWGVELGKQLAKAILPEFDAVDPVETHDASTNALINRYRQFRNGLKFPKSNQLKMF

SEQ ID NO: 10380 - protein, 160 aa, Oryza sativa
  misc_feature (104)..(104): Xaa can be any naturally occurring amino acid
MAMLTAKLTSPAAATTWLPGGGRRSAPPRRATVIRAAAVSYADELVSTAKSVASPGRGILAIDESNATCGKRLASIGLDNTEVNRQAYRQLLLTTAGLGEYISXAILFEETLYQSTTDGKKFVDCLKDQNIMPGIKVDKGLGPLPGSNNECGCQGLNGVA

SEQ ID NO: 10381 - protein, 250 aa, Prochlorococcus marinus str. NATL2A
MIQSISSAIFTEHRPVQIIPSVLPADWANMGQCVKDLELAGVDRIQFDVMDGNFVPNLTFGPEMISACRKYCSVPFETQLMVSQYNCETMLEGYVEASKGANGEPGVVIAHAEANVHLHRILGKIRQLGGSPSVALNPHTPMDMVKDVLDMVDHVLVMTVNPGFGGQAYIPTMLNKITQLRKTILDNGYDVDIEVDGGIKADWSLSQCCAAGANCFIAGSGMFAYPTLKEGCDALRKVANDAQNGIIVEK

SEQ ID NO: 10382 - protein, 235 aa, Chlamydomonas reinhardtii
MAALQSASRSSAVAFSRQARVAPRVAASVARRSLVVRASHAEKPLVGSVAPDFKAQAVFDQEFQEITLSKYRGKYVVLFFYPLDFTFVCPTEITAFSDRYKEFKDINTEVLGVSVDSQFTHLAWIQTDRKEGGLGDLAYPLVADLKKEISKAYGVLTEDGISLRGLFIIDKEGVVQHATINNLAFGRSVDETKRVLQAIQYVQSNPDEVCPAGWKPGDKTMKPDPKGSKEYFSAV

SEQ ID NO: 10383 - protein, 525 aa, Thiomicrospira crunogena XCL-2
MNQASPRAFDWRKYKADTLSGITVSLALVPEAVAFAFVAGVHPLVGLYAAIIVGLITAIFGGRPGMISAAAGSLAVVMMHLVMEHGTSYLFAAVIMMGVFQVFIGWMKWGRFIRMVPSPVMLGFVNGLALVILMAQFTQFTDSTGAWLSGDALMIMVGIIIATMAIIYLLPHLTKAVPSALAAIVLVTLAVIFFDMNAVTVGDRASVSGTLESLVFGDGNEGGFQGLSWISALPEGFFSLETLWVILPYALILTVIGSVESLLTMTLIDDITETRGQGNRECIALGAANCTAGAFGTMGGCALIGQSMINVNSGGTGRLSGISAALGLLVIVLIASSWIEMVPIGALVGLMFFVVIATFNWSSWNIMRGMSKMDAFVMVLVTVLTVIFDLAIAVIAGVVVSALVFAWQHAQKVMVETEELEIDGKQGKIYRVNGPLFFASSQNFIEMFSPKHDPECVQIDFQRSRVYDHTGVEAINNLTQKYKAEGKKVVLKHLSPECQALLKDAKDLVEVNVSEDPHYHVSLGK

SEQ ID NO: 10384 - protein, 441 aa, Prochlorococcus marinus str. NATL2A
MHIAVVGLSHRTAPVEVREKLSIPEELVEKSFNNLKKIDQILEVSILSTCNRLEIYSLVKDPQLGIEAIKSFLLQFSGLDDEILSPHLFNYVQEKAVSHVMRVSAGLDSLVLGEGQILSQVKKMVRLGQDHHSLGPILNRLLTQAVSTGKRVRSETNLGTGAVSISSAAVELAQLKLGQAHGRDQLMTLETEKVAVVGAGRMSRLLLQHLQSKGCCSLTLLNRTKKRAEDLSAAFPDIQIDCQLIDELDSCLSLSTLVFTSTAANEPIIDAEKLIKIDRKPLLRLIDIGVPRNISSDAKSVSGIESHDVDDLQEVVSRNQEARQKLALEAEGLIEEECRVFLEWWDSLAAVPTINCLRSGLESIRKEELQKALSRMGPDFSARERKVVEALSKGIINKILHTPVTKLRAPQSRNDRRDSLDVIEKLFNLDVSSSLNKPKNN

SEQ ID NO: 10385 - protein, 431 aa, Prochlorococcus marinus str. NATL2A
MKRVLAIILGGGKGSRLYPLTKMRAKPAVPLAGKYRLIDIPISNCINSDISKMYVLTQFNSASLNRHIAQTYNLSGPFGQGFVEVLAAQQTPETPSWFEGTADAVRKYQWLFQEWDVDEYLILSGDQLYRMDYSLFVEQHRNTGADLTVAALPVDPAQAEAFGLMRTDEIGNIKEFREKPTGDSLKAMAVDTSRFGLEANEAKEKPYLASMGIYVFSRSTLFDLLNKFPSYTDFGKEIIPEALGRGDKLKSYVFNDYWEDIGTIGAFFESNLALTQQPTPPFSFYDEKFPIYTRPRYLPPSKIVDTQITDSIVSEGSILKSCSIHHCVLGVRSRIESDVVLNETLVMGSDFYESYEERIALRNGGGIPLGVGQGTTVKRAILDKNARIGDNVTIVNKDNVEEADRADQGFYIRNGIVVIVKNATIPDGTII

SEQ ID NO: 10386 - protein, 472 aa, Prochlorococcus marinus str. NATL2A
MTKAHFGLVGLGVMGENLVLNAERNGFSSVVYNRTYQKTEDFLLGRGVNKSIQGAKDLQEFVSKLERPRRVLMMVKAGAATDAVINQISPFLEEGDLLIDGGNAQFMDTERRVKELESKSFGYIGMGVSGGAKGALEGPSMMPGGTKTSYDAIESLLNKMAAQVEDGPCVTYIGPGGSGHFVKTVHNGIEYGIEQILAEAYDLMKRVCGMSGDEMASVMGYWNKTEELSSYLVEITEACLRVKDPDDSSDLVEKIMDKAGQKGTGLWTVVSALELGASVPTIYASLNGRVMSSMKDQRNYAETILNGNKPSFVDFGKPSDGMPLLMDAVVLATIASYAQGMDILRLASEEYDYDLDMPSIAQIWKGGCIIRSTLLSRIQDAFKKDPSLTNLIIDKWFTDQVNNRLSGLTQVVSAAANAGIPVPCLSSTLDYLNSFRTSRLPQNLVQAMRDCFGSHTYERVDKAGSFHTEWID

SEQ ID NO: 10387 - protein, 421 aa, Neisseria meningitidis Z2491
MSEALAKETLNPFEIARKQVKTACDRLKTDPAVYEILESPTRVLEVNFPVKLDDDTVKTFTGYRSQHNNAVGPYKGGVRFHPGVNLDEVKALSIWMTIKCCVAGIPYGGGKGGITLDPRDYSEAELERIARAYSEAISPLIGEKIDIPAPDVNTNGKIMSWMVDAYENVVKHSAPGVFTGKPVEFGGSLARTEATGYGVNLAAVQALEKLGKDVKGATYAIQGFGNVGYHTGYYAHQSGAKVVAVSTVDVAIYNENGLDMEALFKEFQEKGFITNEAGYGKEITNAELLALDVDVLAPCALENQLTSENAGKVRAKIVVEGANGPTTPEADVILRQNGVLVVPDILANCGGVVVSYFEWVQNLQGYYWEFDEVQEKETVVLRRAFRDIWNLAQEYDVDLRTASYMMSIRRVEKAMKLRGWY

SEQ ID NO: 10388 - protein, 508 aa, delta proteobacterium MLMS-1
MINLILCGGSGTRLWPLSRTLLPKQFVRLFAGQSLFQQTVRRNQALGSDFFIVSNSEQYFLAVDQFGEVATAAPRFLLEPEGRNTAPAIALACLLLDPEEVVLVTPSDHLIKDEAAYAQAVAQAQTLAIEGALVTFGIKPTCAETGFGYLEVEGNNVLSFREKPDQATANAYLESGNYYWNSGMFCFKAGVLLAELETHAPEIHAACLAAAQTVADPAASKINISPEAMAAIPAESIDYAVMEKSTRVKAVPAAMGWSDLGSFDALYQENHDPAQTNTVVSHGESEHSPAPLCLDAENNLIVGGKRQIALVEVSDLLVVDTADALLISRKGSSQQIKEVVARLKKETPALTEIHQKAHRPWGTYEVLLDSAQYKIKRIVVKPGSKLSLQKHFHRNEHWIVVSGTATVTVGEETFLVRPNESTYIQMGQLHRLENLGQIDLVMIEVQVGEYTGEDDIVRLDDIYERQHSCSARATLSTASNAGPAFSTPTELTNREDLVAAQGELSGGV

SEQ ID NO: 10389 - protein, 326 aa, Zea mays
  misc_feature (247)..(247): Xaa can be any naturally occurring amino acid
  misc_feature (260)..(260): Xaa can be any naturally occurring amino acid
MADPPSPRLDEDDTFGRDFNASPSRNAAPARSGEKRQFGDLDDDEDDVFASKKGKTKVEESAPGAATGMILSLRESLQTCKENLESNQVELEAAKSEIQKWHSAFQNIPAVPAGTNPEPVSVVTYLNNLKSSEESLKEQLEKAKKREAAFIVTFAKREQEIAELKSAVRDLKTQLRPPSMQTRRLLLDPAIHEEFTRLKNLAEEKEKKIKELQENVAAVNFTPSSKHGKMLMAKCRTLQEENEEIGXAMASEGKIHELGXKIAVLKTQNNELRNSSPMGLYKNMDGLTNERRAGEGQNENGFPILGKREVKKGLKKGGGRAKGKKG

SEQ ID NO: 10390 - protein, 852 aa, Kluyveromyces lactis NRRL Y-1140
MSNIATSHRPPGLNEKNGTNMINNGGENVDLFGTENIRDVYPGVETGGWVQGESADKIDWLELVGNEDFKRHLKTGEHMKVYRKKKGFKQFRRLILAQELRPFGNEFQDSSSSNEKGTATEPMKNGGAVWCIRFSHDGKFMATAGKDEILRIWKVISSPAERLELNQHSISFLKSTANAISQLNGQLAQYGGDTDSASLNSGSSNTHVDSLGSSNANRDGFSTKAVPQEQQGQTQGHRHPYGLGDSYCGVFHPNPLVTFHEHTDDILDIDWSKNSFILTGSMDKSCKLWHCARPTSLKTFVHSDFVTAVRFHPEDDRFFLSACLDQKCRLWSILEKQVIFEYDCGDLITAMDISYDGNYTILGTFNGYIHVLITKSLELLFSFNVLDKDSELKKCHRTSRRLKKQSSDKAKNGPKITGLEFIQKDARNYKISSKDVSDWFLVSSNDSRIRIYTLNQEFVSVMKGHSNEHSQITAHSTVTRSGKAYVVSGSEDHWIYCWKLSDEVVKSTETSSKDSKSTRSRSGSLRSFCRRRNNDSVASETLDAVLSRGYTKNHQVSSNSNYIGFHAHHHPITCATAVPMQVTKVLSLSNDLICELTMQFWETTDDFTMESASKNARAKKNGNAISSNDGQKTDCRRKISIDKTIPNVKGKSGVSGAQSNNVPNIQISDGDNRTTNAVNGTTAANPPSLIEFIGGIVVSADTTGVIRVFRSDISSNVRKKVLNRLNAIEKQLKENGEGSVKPRTSGVSSVAAATNGSLSTATTFVGNGSNGHNVHSIERPTPFPMQDSLPLVDESSSSLTTLQQQQPHSQSRVCNVCGGTRFATDQTLSFNQAPQNVKYYCLDCGALYTSLR

SEQ ID NO: 10391 - protein, 223 aa, Leuconostoc mesenteroides subsp. mesenteroides ATCC 8293
MTVNIYMVRHGETYFNLLHRFQGWSDAPLTEKGIQDGYAAGTRLANVHFDGAYSSGLTRTIHTSQYILANNKSDSPNQAIQLPDFREENFGYFEGVHTGLALTTLGAYKNDTFSDFSDVIAKYGMPAAMDLIREGDPFKIAEDYQQFINRIQHGFDDILSRHQDGDNVLIVSHGTAIRAIVDYFGYHDFAKISVKNGAVTQLELAADHAKITNFNDDSTIFNS

SEQ ID NO: 10392 - protein, 250 aa, Triticum aestivum
PFSPREPVLPIWPFLGDQYRTRLYQKPRLVPFRNSRDIVDPRFRDWSTRTLTWTEGVEKARVPPPSKLYTYIVQPWPPTVMASSATSVAPFQGLKSTAGLPVSRRSNGASLGSVSNGGRIRCMQVWPIEGIKKFETLSYLPPLSTEALLKQVDYLIRSKWVPCLEFSKVGFIFREHNASPGYYDGRYWTMWKLPMFGCTDATQVINEVEEVKKEYPDAYVRIIGFDNMRQVQCVSFIAFKPPGCEESGKA

SEQ ID NO: 10393 - protein, 319 aa, Kluyveromyces lactis NRRL Y-1140
MSQPQEEKHNQKTAAHKVSKFGSFVAGGLAACIAVTVTNPFDCVKTRMQLQGELHANAAKVYTNPIQAFGVIFKNEGIAGLQKGLASAYLYQIALNGSRLGFYEPIRGILNNVFYPNVESHKVQHIGINVAAGATSGVVGAFIGSPLFLVKTRMQSYSNAIHIGQQTHYTSAFNGLATIFRSEGIKGLFRGVDAAMLRTGIGSAVQLPIYNICKNFLLKHDLMNDGTGLHLLSSTIAGFGVGVAMNPWDVVLTRVYNQKGNLYSGPIDCFIKTVRNEGLSALYKGFGAQILRIGPHTVLCLTFMEQTLKLVYSVESRFL

SEQ ID NO: 10394 - protein, 477 aa, Neisseria meningitidis Z2491
MNEYSQLIKHPDISLSPISDGIGVGNPATGEILAYVRNTGSDKLKNLIQKAAAAQKLWAAKTALERADILWRWYFLVKENKEALARLMTMEQGKSLTESRGEIDYAASFVRWFAEEARRIDGDVLTSVKASQKLIVLKQPVGVTAAITPWNFPSAMIARKAAPALAVGCAMIVKPASLTPLSAYALVVLAYEAGVPQDLLPVVSGRASEIGREFATNPIIRKISFTGSTEVGAKIFADSAADIKKLSLELGGNAPFIVFDDADLDKAVEGALASKFRNSGQTCVCTNRVYAQSGIYDAFCRKLSEKAAALKLGNGLEDGVNQGPLIEEKAVEKVEQHIADALSKGAVCLTGGKRSALGGTFFEPTVLSGVTAQMAVAREETFGPLCPVFRFETEAEVIEAANNTEYGLAAYLFTADTARQWRVGEALEYGMVGINTGLISNEAAPFGGVKRSGLGREGSKYGADEYLELKYLCMDVG

SEQ ID NO: 10395 - protein, 419 aa, Brassica barrelieri
FYHSCIIFFAVLLQFHHVFSTNTLSSNEALTISSNRTLVSPGDVFELGFFKTTTRNSQDGGDRWYLGIWYKTTSDLRTYVWVANRDNPLHNSIGTLKISHSDLVLLDQSDTPVWSTNCMGVVQSSVTAELLANGNFVLRDSKTKDLNRFMWQSFDFPVDTLLPEMKLGRKRNSSENEKILTSWKSPTDPSSGDYSFILETEGFIHEFYLLKNEFKVYRTGPWNGVRFNGIPKIQNWSYIINNFIDNKKEVAYTFQVSNNHNIHSRFRMSSTGYLQVITWTKTVPQRNMFWSFPEDTCDLYKVCGTYAYCDMHTTPTCNCIKGFVPKNAAAWELRDMSGGCVRSKRLSCGEGDGFLRLGQMKMPETSEAFVDESIGLKECKEKCIRDCNCTGFANMDIMNGGSGCVTWTGELVDMRKYDA

SEQ ID NO: 10396 - protein, 425 aa, Brassica deflexa
YHHSYTLFFFVVLVLFPHVFSTTNTLSSNETLTISSNKTLVSPGDVFELGFFKTTTRKSQDGTDHCWYLGIWYKTTTSNQRTYVWVANRDNPLHNSTGTLKISHASLVLLDQSNTPVWSTNHTGVAHLPVTAELLANGNFVLRDSKTNDLDRFMWQSFDFPVDTLLPEMKLGRKINSSEKEKILTSWKSPTDPSSGDYSLILETEGFLHEFYLFNNDFKMYRTGPWNGVRFNGIPKIQNWSYIDNNFIDNKEEVAYTFKVNNNNNHNIHTRFRMSSTGYLQVITWTKTIPQRNMFWSFPEDACDLYQVCGHYAYCDMHTTPTCNCIKGFVPKNASAWGLRDMSGGCVRSSKLTCGEGDGFLRLGQMKLPEPNEAFVDKRIGLKECKEKCVRACHCTGFAGMDIMNGGSGCVTWTGELVDMRKYDA

SEQ ID NO: 10397 - protein, 435 aa, Arabidopsis thaliana
MPEIEIAAGSGDNNDALFGKYELGKLLGCGAFAKVFHARDRRTGQSVAVKILNKKKLLTNPALANNIKREISIMRRLSHPNIVKLHEVMATKSKIFFAMEFVKGGELFNKISKHGRLSEDLSRRYFQQLISAVGYCHARGVYHRDLKPENLLIDENGNLKVSDFGLSALTDQIRPDGLLHTLCGTPAYVAPEILSKKGYEGAKVDVWSCGIVLFVLVAGYLPFNDPNVMNMYKKIYKGEYRFPRWMSPDLKRFVSRLLDINPETRITIDEILKDPWFVRGGFKQIKFHDDEIEDQKVESSLEAVKSLNAFDLISYSSGLDLSGLFAGCSNSSGESERFLSEKSPEMLAEEVEGFAREENLRMKKKKEEEYGFEMEGQNGKFGIGICISRLNDLLVVVEARRRGGDGDCYKEMWNGKLRVQLIRVCDQTSSTNAAI

SEQ ID NO: 10398 - protein, 420 aa, Raphanus raphanistrum
YHHHSYTFFFVILVLFPHAFSTNTLSSNEALTISSNRTLVSPGDVFELGFFKTTTRNSRDGTDRWYLGIWYKTTSDQRTYVWIANRDNPLLNSMGTLKISHANLVLFDQSATPVWSTNLTGAAHLPVTAELLANGNFVLRDSKTKDLDRFMWQSFDFPVDTLLPEMKLGWKHKILEREKILTSWKSPTDPSSGDYSFILETEGFLHEFYLYKNEFKVYRTGPWNGVRFNGIPKIQNWSYIDNSFIDNHEELAYSFQVNNNHNIHSRFRMSSTGYLQVITWTKTVPQRNMFWSFPEDTCDVYLVCGPYAYCDMHTTPRCNCIEGFVPKNAAQWELRDMSSGCVRSSKLTCGEGDGFLRLGKMKLPETTEAVVEKRIGLKECKEKCLRDCQCTGFANIDNMKGGSGCVTWTGELDDMRKYDA

SEQ ID NO: 10399 - protein, 516 aa, Opitutaceae bacterium TAV2
MPDTPATLASLIDSLQHGAGALRALADAAERPVYGTTIYLATCALDTRYGAFRAYVFQDITDKHYILALTHGDICGATTLHTRLHSSCVTSETLRGCDCDCTQQLEGAFKVIAQKGSGILFYLMQEGRGVGYFAKARDRMLVQASQDQLSTFDAYAAMGLAKDHRNYENISHICHLLGIRASFILLTNNPDKIEALRAQGLPIAGSEPLEFEPGPFNLAYLTSKAANGHQLQRPTASRVHRASPPQPVVPFRPHALGDARRFVYAASYFLPMTPVGDDILLSGEQFKELFSHHSIERWMNDPLPLVREYRRIRGNRYFVRIHAANLAAFQKREPAHPLAALLTTPYWFRVHAYYDIVTNQDWVVLTHGTPTPDDAPVVRLHSDSIFNRFPLRTTDNRAKLKQAVKHIVTYGSGVMLLLHNDGRGAGFGAHATDRMMTEAGAVSTSDDAYRLLAVGYDSRDYDAAIMLLRHHLPSERIQMVMNSPESLVKKPEYAEALNRHHIDVEKWIFLEDAPPA

SEQ ID NO: 10400 - protein, 506 aa, Rhodobacter sphaeroides 2.4.1
MTAPKPVVLCILDGWGLRAEREANAVALAETPTFDRLMATCPNATLVTHGPDVGLPRGQMGNSEVGHTNIGAGRVVAMDLGAIDLAIEEGSFPQNPALRDFIGKVKAKSGTAHLMGVVSDGGVHGHIQHLISAVEVLAGEGIPVVIHAITDGRDVAPTSAGEFVGQLVRVLPEGARIGTVIGRYWAMDRDKRWDRVKRASDAMLHATGEHAPDAEAAVAAALARGETDEFIAPTVVGDYAGARDGDGFFCLNFRADRAREILAGLAQPGFDAYDTGARPDWSAFLGMVDYSKEHDRFMTTAYPKPVIRNTLGEWVASHGLRQFRIAETEKYPHVTFFLNGGREAPETGEDRYMANSPKVATYDLQPEMSAPDVSDHLVEAIGAGYDLIVVNYANPDMVGHTGDLKAAMAAVEEVDRGLGRAVEAVTKAGGAMIVTADHGNCETMVDPETGGPHTAHTTNPVPVILVNGPAGARLHAGRLADLAPTLLQLMQLPQPEEMTGRSLIDA

SEQ ID NO: 10401 - protein, 610 aa, Magnaporthe grisea 70-15
MAIKFWSRSATAADATAAADQSDSEPSVVHDGELAYTRVKAGNGSSAAYQEAVGAPVESKSPLGYHVGWMTIIFLNVNQMIGTGIFSTPATVLNRTGSVGLALIYWLIGVIMAIAGVCIYLELASYFPNRSGGEVVYLEQAYPRPKHFFPIAFAVQSVILSFSSSNAIVLSRYVWRIAGTTPTEWEMRGVAIAAYTLAVVCVVAHNKYSLWATNVIGALKIATLVFISITGFVILGGNVGRIPDPHRNFRNAFEGTTTDGNSLSVALVNIVFSYTGYSNAFNMVNEIRNPIPKLKKYATASVLIVSVLYMLCNVAYFAAVSKSEFAASKEIAAAVFFTTVFGRGGAETALNVLVLLSAFGNLLAVLIGSSRMIREIGRQGVLPYTEFWVSTRPFGTPLGPYLLKWAVTFIMIVAPPAGDAFQFVVSLKTYPDGVFHLAMAIGVYLIRRRRKRAGMGKTEFQAWDVVVVFFILLQVYIIAMPWWPPKGGIYAGEVSFFYATYCLVGIAILITCGIYYYFWMTLLPKWRGYRIRTEIQNVDEGSGANTHRLVRVPLANLDEWDATHDEAGFLRRRPAAAAAAQRTASDTSSRNEGIDGVDGKDVVVPGKQAY

SEQ ID NO: 10402 - protein, 570 aa, Aspergillus oryzae
MADDNPPKRIKLSSNTTENTTNNKSPKESPPIQDLTSLHRSITPPSPPSRSQRRSQSQSQSQSQSAPPQPVKSTEEEVNEKPRLIPSPFQLTHIRDLAASSDNNVDTVRLREILGDPMIRECWQFNYLHDVDFIMGQFDEDVRRLVKVKIVHGSWKRDAPNRVRIDEACSRYPNVEAVVAYMPEAFGTHHSKMMVLLRHDDLVQVVIHTANMIPGDWTNMCQAVWRSPLLPLQKTDDRVEDLTLGSGARFKRDLLAYLTEYGPKKTGPLVEQLRKYDFGAIRAALVASVPSKQKVDDLDSQKKTLWGWPALKDIMRQIPPAQKTTKATTPHIVTQISSVATLGQTDKWLKDVMFASLSPASTSTRQPKYSIIFPTADEIRRSLNGYGSGGSIHMKLQSAAQQKQLQYMRPYLRHWAGDHDTAEPSHTSKQDAGRRRAAPHIKTYIRFSDAEKMDTIDWAMVTSANLSTQAWGAAVNASGEVRICSWEIGIVVWPQLYVQDTESATMVPTFKRDTPEPLENKDSETTPDTVIGLRMPYDLPLTPYAAHDTPWCATAQHLEPDWLGQTWTLD

SEQ ID NO: 10403 - protein, 422 aa, Brassica maurorum
YDHFYTFSFVILVLFPHAFSTNTLSSNESLTISSNKTLVSPGDVFELGFFKTTTRSSRGGSTDRWYLGIWYKTTSQRRTYVWVANRDNPLHNSIGTLKISHASLVLLDHSDTPVWSTSLTGVAHLPVTAELLANGNFVLRDSKTKDLDRFMWQSFDFPVDTLLPEMKLGRKVNSSEKEKILTSWKSPTDPSSGDYSLILETEGFLHEFYLFKNEFKVYRTGPWNGVRFNGIPKKMQNWSYIVNSFIDNKSEVAYSFQVDNNRNIIHSRFRMSSTGYLQVITWTKTVPQRNMFWSFPEDACDPYQVCGPYAYCDMHTSPMCNCIKGFVPKNASRWDLRDASGGCVRSSKLSCGEGDWFLRMSQMKMPETTEAFVDKTIGLEECKEKCMRDCHCTAFANMDIMNGGSGCVTWTGELVDMRKYDA

SEQ ID NO: 10404 - protein, 478 aa, Borrelia garinii PBi
MKEKSVSNFDIVIFGVTGNLSRKKLIPSLFNLFKNKCISNFRVIGFSRKIFTDKEFRLYIKDSLWQEETDSLIEIFLNFFIYVFGDFNENEPYIKLFKFLDKSRETIYYLSTSPTFYGPIINNLKKHFVSERLTLSKIVLEKPFGSSLETAKKLNSLLYSAFREDQIYRIDHYLGKETVQNIFTFRFGNSIFENIWNNRYVDFVQITVAEELGLDGRAEYYDSVGALKDMVQNHILQLLSLVAMESPIKFDSEFIHDEKVKVLKSLRKINREDIKNCIVKGQYIGSQVQGVFKKGYKDETESLGNSNTETYLAMKVFINNWRWSGVPFYLRTGKGLARKFSEIYIQFKKPSFTLFNNSSVDFSNALIFRIQPRDGIEIKFNTKKPGYNYEIQTANMEFSYYGTFKRLFDEAYERLLLDAFLGDGTLYATSDEIESSWEFVSDIANKWEDIEICNYFYGSEGPKEIDSILEKDHFWRKI

SEQ ID NO: 10405 - protein, 156 aa, Opitutaceae bacterium TAV2
MRHTISVLVENKFGVLARVAGMFSGRGFNIDSLNVAPTHDSGLSRITAVLKGDDAALDLATKQLRKLVNVVDVVDFTEGEAVVRELVLAKVAATRQNRSEIMQICDIFRTKIVNVSQDSLIIEITGDEGKVSAFLKILEPFGILEIARTGVLAQKR

SEQ ID NO: 10406 - protein, 795 aa, Oryza sativa Japonica Group
MDPTCHSPPLSSSSPSLQSSSRAPTGASGIGGGDAAEVVAKALSHPAATPSLPRRTRKATTAALGGQIEDDGVDGQIKEEEPLRGKGGEGRAVAVVSTAVGGVQGACAHTFIEYEQTRSCSRNTSTWPPSRRSSPWSSSSSWGPYTGSAPKASPASTPECKACKPALANAVFSTIAFLLGAATSVASGFLGMRIATAANARTTVEARRGIGPAFAAAFRSGAVMGFLLASLGLLVLYVAIKVFGLYYGDDWEGLYESITGYGLGGSSMALFGRVGGGIYTKAADVGADLVGKVERNIPEDDPRNPAVIADNVGDNVGDIAGMGSDLFGSYAESTCAALFVGSISSFGADHNFAAVSYPLLISSAGLIVCLITTLFATDLYRVKTVDGVAPALKLQLLISTVLMTVGVLVVTFTALPHEFTMFDFGEVKRVKNWHLFFCVTIGLWAGLAIGFTTEYFTSNAYSPVRDVADSCRTGAATNVIFGLALGYKSVIVPVFAIAVSIYVSFTLASIYGIAVAALGMLSTVATGLAIDAYGPISDNAGGIAEMAGMSHRIRQRTDALDAAGNTTAAIGKGFAIGSAALVSLALFGAFVSRAGMAVINVLSPKVFVGLVVGAMLPYWFSAMTMKSVGSAALKMVEEVRRQFAAIPGLMEGRATPDYASCVRISTDASLREMMPPGALVLLAPLVAGTFFGVQTLAGLLAGALVSGVQVAISASNSGGAWDNAKKYIEAGASDHAKALGPKGSDAHKAAVIGDTIGDPLKDTSGPSLNILIKLMAVESLVFAPFFAAHGGLIFK

SEQ ID NO: 10407 - protein, 178 aa, Streptomyces clavuligerus
MTGGAQELLLSRIRDVPDYPQPGVVFKDITPLLADPEAFSVLTEALAEVCVRHGATKVVGLEARGFILGAPVAVRAGLGFIPIRKAGKLPGATLSQAYALEYGTAEIEVHAEDLTPDDRVMVIDDVLATGGTAAAAMELIRRGGADVAGLAVLMELGFLGGRARLEPTLAALEALLAL

SEQ ID NO: 10408 - protein, 419 aa, Brassica nigra
NHHSCTIFFVVLLQFHHVFSINTLSPNEALTISSNKTLVSPGDVFELGFFKTTTRNSQDSADRWYLGIWYKTTSERTYVWIANRDNPLHNSIGTLKISHANLVLLDQSDTPVWSTNLTGVVQSSVTAELLANGNFVLRGSYSTEDEFMWQSFDFPVDTLLPEMKLGWNLKPGPERILTSWKSPTDPSSGDFSFMLETHTIRLHEFYLLKNEFIVYRTGPWNGVRFNGIPKMQNWSYIVNSFTDNNGEVAYAFHVDNHNIHSRFRMSSTGYLQVITWTKTVPQRNMFWSFPEDSCDAYKVCGPYAYCDMNTTPTCNCIKGFVPKNASRWELRDMSGGCVRSSRLSCGEGDGFLRMSQMKLPETSEAVAVLVDKRIGFKECKERCIRDCNCTGFANMDIMNGESRCVIWSGELVDMRNYVA

SEQ ID NO: 10409 - protein, 258 aa, Vitis vinifera
MDRYQRVEKPRPETPINENEIRITAQGRMRNYITYATTLLQDKGSDEIALKAMGRAINKTVMIAELIKRRIAGLHQNTSIGSTDITDMWEPLEEGLLPLETTRHVSVIAITLSKKELDISSTGYQPPIPADQVRPWTEYDYEGEGSPAMRGRGRSGRGRGRGRGNNNNGMVEYNGDGGWDGVRGGYGGRARGRGRGRGYRGRGRGYGGGDMQQEMGGYNDYGSGAVPAQGRRGRWRGRGRGRGPGRDIKSDGPVQAAA

SEQ ID NO: 10410 - protein, 467 aa, Oryza sativa Japonica Group
MQGLKTAIIEGDVVGGTCVNRGCVPSKALLAVSGRMRELQDEHHMKSLGLQVSTAGYDRQAVADHANNLASKIRSNLTNSMKALGVDILTGFGTIVGKQKVRYGKVGFPDNEITARNIIIATGSVPFVPNGIEIDGKTVFTSDHALKLESVPDWIAIVGSGYIGLEFSDVYTALGSEVTFVEALDQLMPGFDPEIAKLAQRILINPRKIDYHTGVFASKITPAKDGKPVLIELIDAKTKEHKETLEVDAALIATGRAPFTKGLGLENVNVVTQRGFVPVDERMQVMDADGNAVPNLYCIGDANGKLMLAHAASAQGISVVERISGKDNILNHLSIPAACFTHPEISMVGLTEPQAREKADKEGFEISVVKTSFKANTKALAENEGDGLAKMIYRPDTGEILGVHILGLHAADLIHEASNAIALGTRVQDIKFAVHAHPTLSEVLDELFKAAKVNAGVPHSVNEPVAA

SEQ ID NO: 10411 - protein, 343 aa, Saccharomyces cerevisiae
MSSSVASTENIVENMLHPKTTEIYFSLNNGVRIPALGLGTANPHEKLAETKQAVKLQSKLDNRHIDTAWASREPFVGEAIKELLEDGSIKREDLFITTKVWPVLWDEVDRSLNESLKALGLEYVDLLLQHWPLCFEKIKDPKGISGLVKTPVDDSGKTMYAADGDYLETYKQLEKIYLDPNDHRVRAIGVSNFSIEYLERLIKECRVKPTVNQVETHPHLPQMELRKFCFMHDILLTAYSPLGSHGAPNLKIPLVKKLAEKYNVTGNDLLISYHIRQGTIVIPRSLNPVRISSSIEFASLTKDELQELNDFGEKYPVRFIDEPFAAILPEFTGNGPNLDNLKY

SEQ ID NO: 10412 - protein, 173 aa, Microcystis aeruginosa PCC 7806
MAKRRKGNREKEKETTWQERVIQIRRVSKVVKGGKKLSFRAIVVVGNENGQVGVGVGKAGDVIGAVRKGVADGKKQLIEVSLTKASSITHLTRGASGGAQVIMRPAAPGTGVIAGGAVRTVLELAGVKNILAKQLGSDNPLNNARAAVNALETLRTFSEVAKDRGVSVEHLYT

SEQ ID NO: 10413 - protein, 490 aa, Oryza sativa Indica Group
MGSRPVDEVLDAAAAGVHYSTLRLDELNINGSMTGEEQPTTSGVENGHQEPFVIGVAGGASSGKSTVCKMIIDQLRDQRVVVVTQESFYYGLSDEELVHVHDYNFDHPDAFDTELLLSCMENLKHGKAVDIPNYNFKTYKSVASARKVNPSDVIILEGILVFHDSRVRDLMNMKIFVDTDADVRLTRRIRRDTIEKGRDIKTVLDQYSKFVKPAFEDFILPTKKYADIIIPRGGDNDVAIDLIVQHIRTKLGQHDLCKVHPNLYVIQTTYQIRGMHTIIRDAATTTHDFIFYADRLIRLVVEHGLGHLPFKEKQVITPTGSVYTGVEFSKRLCGISVIRSGESMENALRACCKGIKIGKILIHREGDNGKQLIYHNLPKDIANRHVLLLDPILGTGNSAVQAISLLLKKGVQETNIIFLNLISAPQGVHVVSKRFPRVKIVTSEIEFGLNDDFRVIPGMGEFGDRYFGTDDYQSSTPFFCDEKNRVRCPY

SEQ ID NO: 10414 - protein, 269 aa, Aspergillus oryzae
MARLLNKVALITGSSSGMGRAIALRYAKEGAHIVCADLSLTARSLVPEEAEITTHDAIIQAGGRAIYVQTDVSEAQQFERAVQTAVSEFGRLDILVNNAGIATDTRNPTRVHETDEHAWDTMLRVNTTSVFLGCKYGIAQMLKQEPHSSGDRGWVINLASIWGLVGGLGSPAYCASKGAVVNLTRQMALDYGPDRIHVNAICPGFIWTAMTRDLEEASPHAIESLHQKHPLKGFGYPDDVARMAVVLASDDASLVTGVALPVDGGYTAQ

SEQ ID NO: 10415 - protein, 665 aa, Oryza sativa Indica Group
MAGAIRVTMEVGADGVAVVTICNPPVNALHPIIIQGLKEKYAEAMDRDDVKAIVLTGAGGKFCGGFDINVFTEVHKTGNVSLMPDVSVELVSNLMEAGKKPSVAAIQGLALGGGLELTMGCHARISTPEAQLGLPELTLGIIPGFGGTQRLPRLVGLPKAIEMMLQSKFITAKEGKERGLVDALCSPDELIKMSRLWALEIANYRKPWIRSLARTDRLGSLSEARSVINSARQQAKKVAANLPQHQACLDVMEEGVLCGGHAGVLKEAKVFKELVLSPTSKALVHAFFAQRLTTKVPGVTDVQLKPRKIRKVAVIGGGLMGSGIATALLVSNTSVVLKEVNPQFLQRGQKMIAANLEGLVKRGSLTKDKMNKAMSLLKGALDYSDFKDVDMVIEAVIEKIPLKQSIFSDLEKVCPPHCILATNTSTIDLNVVGEKTNSQDRIIGAHFFSPAHIMPLLEIVRTEKTSPQAILDLITVGKMIKKVPVVVGNCTGFAVNRTFFPYTQGSHLLVSIGIDVFRIDRVISSFGMPMGPFQLQDLAGYGVALAVKDIYAAAFGTRNLDSNLVDLMVQNGRQGKSNGKGYYLYEKGGKPKPDPSVQVVIDEYRRCAKTMPGGKPVTLSDQDILEMIFFPVVNEACRVMDENVVIRASDLDIASILGMGFPKFR

SEQ ID NO: 10416 - protein, 343 aa, Arabidopsis thaliana
MMEVEGSMNRAPDQSSFLRSRRSKALYQFKQQKLPACKPVLTPISVITVFMLMGFVFIPIGLITLRASRDAIEIIDRYDVECIPEEYRTNKLLYITDSSIPKNCTRYLKVQKYMKAPIFIYYQLDNYYQNHRRYVKSRSDQQLLHGLEYSHTSSCEPEESSNGLPIVPCGLIAWSMFNDTFTFSRERTKLNVSRNNIAWKSDREHKFGKNVYPINFQNGTLIGGAKLDPKIPLSDQEDFIVWMRAAALLSFRKLYGRIEEDLEPGKVVEVNLMNNYNTYSFSGQKKLILSTSNWLGGRNDFLGITYLVVGSSSIVISIIFMLLHLKNPRPYGDNSWNKKSLSS

SEQ ID NO: 10417 - protein, 525 aa, Silicibacter pomeroyi DSS-3
MRDFHLPGRSPTYATEGMCATSHPLAAQVALDLLKRGGNAMDAALAAGLVLGICEPQMTGIGGDCFVLYSRAGEDQIRALNGSGRAAAGASAAALREQGLDRVPLGSPHAVTIPGAIDAFCHLAETEGRLGLDTLLQPAIHYAERGVPVAPRVAFDWAREAGTLQGAARHHYLLDGRAPVTGQVFAAPGQAEVLRRIARLGRDGFYTGEVAEDMLAALNALGGPHRAEDFGATACTPTEPISGTYKSTELVEHPPNGQGATAILLLNILSQFDIAAMDPLGAARIHIEAEAAKLAYDARNRFLADPDHTDRLDHMLAPETAARLAALIDPKRAMAAAAPLTEAVHKDTIYITVVDRDRMAVSLIYSIFHGFGSGIASEKFGILLQNRGAGFTLQAGHPNEMAGGKRPMHTIIPGMLREGPGTLTPFGVMGGAYQPVGHARFASNLVDFGMDPQTAIDAPRAFADAGVLKLERGYPDAVRQTLADMGHKVVTPEVPLGGAQAIRIRADGVLEAASDARKDGCALGY

SEQ ID NO: 10418 - protein, 355 aa, Prochlorococcus marinus str. NATL2A
MALSYYAEELKKTASAIAQPGKGILAVDESTKTVGKRLASIGVENSEENRKAYRGMLFTTEGLGNFISGAILFEETLFQNHPDGEPMVKKLEKLGIIPGIKVDKGLRPLAGGHDVETFCSGLDGLVERAADYYEQGARFAKWRAVLQITDDGCPSKLSIRENAWGLARYARSVQESGLVPIIEPEILMDGSHSIEKTAAVQEEVIKEVYLACQVNGVLLEGTLLKPSMTVQGADSSTKADPQQVAEMTIRTMERCVPASVPGITFLSGGLSEEAASVYLNLMNKIDRKAKWNVSFSYGRALQHSCLKAWKGSNTADGQKALIARAQANSEASKGLYVAGSQPSSDEQLFVAGYKY

SEQ ID NO: 10419 - protein, 123 aa, Pyrococcus furiosus
MAKPSYVKFEVPKELAEKALQAVEIARDTGKIRKGTNETTKAVERGQAKLVIIAEDVDPEEIVAHLPPLCEEKEIPYIYVPSKKELGAAAGIEVAAASVAIIEPGKARDLVEEIAMKVKELMK

SEQ ID NO: 10420 - protein, 405 aa, Neisseria meningitidis Z2491
MALIVHKYGGTSVGSPERIKNVAKRVAKARAEGHDIVVVVSAMSGETNRLVALAHEMQEHPDPRELDVVLSTGEQVTIGLLAMALKDIGVDAKSYTGWQVALKTDTAHTKARIESIDDEKMRADLTAGKVVIVAGFQGISSEGDISTLGRGGSDTSAVALAAALKADECQIYTDVDGVYTTDPRVVPEARRMDTVTFEEMIELASLGSKVLQIRSVEFAGKYKVRLRVLSSLQDGGNGTLITFEEDDNMERAAVTGIAFDKNQARINVRGVPDKPGVAYQILGAVADANIEVDMIIQNVGSEGTTDFSFTVPRGDYKQTLEILSERQDSIGAASIDGDDTVCKVSAVGLGMRSHVGVAAKIFRTLAEEGINIQMISTSEIKVSVLIDEKYMELATRVLHKAFNLG

SEQ ID NO: 10421 - protein, 500 aa, Schizosaccharomyces pombe 972h-
MAKKDKTSVKKSVKETASKKGAIEKPSKSKKITKEAAKEIAKQSSKTDVSPKKSKKEAKRASSPEPSKKSVKKQKKSKKKEESSSESESESSSSESESSSSESESSSSESESSSSESSSSESEEEVIVKTEEKKESSSESSSSSESEEEEEAVVKIEEKKESSSDSSSESSSSESESESSSSESEEEEEVVEKTEEKKEGSSESSSDSESSSDSSSESGDSDSSSDSESESSSEDEKKRKAEPASEERPAKITKPSQDSNETCTVFVGRLSWNVDDQWLGQEFEEYGTIVGARVIMDGQSGRSKGYGYVDFETPEAAKAAVAANGTKEIDGRMVNLDLSNPRPANPQPYAQQRAGNFGDQLSEPSDTVFVGNLSFNATEDDLSTAFGGCGDIQSIRLPTDPQSGRLKGFGYVTFSDIDSAKKCVEMNGHFIAGRPCRLDFSTPRTGGGSRGGRGGFGGRGGFGGRGGFGGGRGRGRGGARSGNPNRGSVAPFSGNKVTFD

SEQ ID NO: 10422 - protein, 458 aa, Clostridium perfringens ATCC 13124
METLREKINKQREYFSTGETKDINFRIEKLKKLRDVLKSEEEKVFEALKKDLMKSSFESYVTEVAMVYDEINMHIKNIKKWSKKRRVKTPLVQFPAKSFIQLEPYGVVLIIGPFNYPFMLTMDPLIGAIAAGNTAVIKPSESAPETSKILKEILEKVFDEKYVLHVNPERGKEVVEELLKEKFDYIFFTGSATVGKIVMKAASQYLTPVTLELGGKSPCIIDKDCKLELAARRIVWGKLLSSGQTCVAPDYLYVHKDIEEEFIKKLEEEIKNQFGDNPLESEDYSKMVNEREFNRVLSYIDKEKLVFGGNYNRKTFQIEPTILKNVTWNDPVMEREIFGPIFPILPFEDLDEVIRLVNSKDKPLAIYYFSEDKNKIEKVLNSTSSGGVTINDTLVHVSSSYLPFGGVGNSGMGEYHGKYSFDLFSNKKGVMNRKTFLDLKIRYAPFQNKLTIVKKIMK

SEQ ID NO: 10423 - protein, 258 aa, Neisseria meningitidis Z2491
MSDNALTSSRRFGGIARLYGDSALAHFSQAHVCVVGVGGVGSWAVEALARTGIGRLTLIDLDNVAESNVNRQLHALTGDFGKAKVTALRERVAQINPECQVFEIEDFVTEDNLPEYFGKGFDFVIDAIDQVRVKAAMAAYFVERKQPFVLSGGAGGQKNPALIQTADLSRVTHDPLLANLRYTLRKRYGFSRDTKANMRVPCVYSTENIVPPQSREACSADAAPQGLSCAGYGASMLVTASFGLYCAQAAVEHIADKK

SEQ ID NO: 10424 - protein, 278 aa, Bacillus halodurans C-125
MIQSIQDRVKLANGVEMPWFGLGVYKAAEGEEVIGAVRAALKAGYRSIDTASLYQNEVGVGQAIRESGIPRDEIFVTTKVWNTEQGYDETLAAFERSRKRLGLEVIDLYLIHWPVREKFLDTWRALETLYKERKVRAIGVSNFNIHHLETVMNISDINPMVNQVEFHPFLTQKPLLTFCKAHDIQLEAWRPLTKGEIFTHPVVQALAKKYGKTPAQIVLRWNLEHRVVTIPKSVREERIQENANIFDFHLSPEDVEALDGLNEDRRLGQDPDSFSFDF

SEQ ID NO: 10425 - protein, 148 aa, Vitis vinifera
MEQTFIMIKPDGVQRNLVGEIIGRFEKKGFSLKGLKLLSVERGFAEKHYEDLSSKPFFNGLVEYIISGPVVAMIWEGKNVVTTGRKIIGATNPSDSAPGTIRGDFAVDIGRNVIHGSDSVGSARKEIALWFPEGPVAWSSSLNHWIYE

SEQ ID NO: 10426 - protein, 302 aa, Clostridium perfringens ATCC 13124
MKYYNDIRDLIGNTPILKLNNISTKEGVNIYAKIEGTSPGGSCKDRVGIYMVEKAEKEGKLKSGSTIIEATAGNTGIGIALAAINKGYKIIFIVPNKFSIEKQKIMKALGAEIINTPKEEGMEGAINLANSLLSEIPNSLSLNQFKNEANPLAHYETTGRELYDGLDGQIDYFVAGAGSGGTISGVLKFLKENISEVKGILADPVGSIIGGGQCGTYKIEGIGNNFIPETMDMSLVDDVIKVNDEEAFDAVKLLAKKEGLIVGSSSGAAFAAVLKLAEKIEEGNIVTIFPDRGDRYFSTDLF

SEQ ID NO: 10427 - protein, 392 aa, Klebsiella pneumoniae
MRYGGRHSCLSPAMISLRHRGTVMKSRAAVAFGPGLPLEIVEIDVAPPKKGEVLVKISHTGVCHTDAYTLSGDDPEGLFPVVLGHEGAGVVVEVGEGVTSVKPGDHVIPLYTAECGECDFCTSGKTNLCVAVRETQGKGVMPDGTSRFSYNGQPLYHYMGCSTFSEYTVVAEVSLAKINPQANAEQVCLLGCGVTTGIGAVHNTAKVQEGDSVAVFGLGGIGLAVVQGARQAKAGRIFAIDTNPSKFELAKQFGATDCINPNDYDKPVQQVLVEMTKWGVDHTFECIGNVNVMRSALESAHRGWGQSVIIGVAGAGKEISTRPFQLVTGRVWKGTAFGGVKGRTQLPGMVEDAMSGKIELAPFVTHTMELDKINEAFDLMHDGKSIRTVIHY

SEQ ID NO: 10428 - protein, 419 aa, Brassica oxyrrhina
YHHSYTFFFVILVLFPHAFSTNNLSSNETLTISSNRTLVSPGDVFELGFFKTTTRNSQDGGDRWYLGIWYKTTSDQRTYVWVANRDNPLHNSIGTLKISHSNLVLLDQSDTPVWSTNCTGVVQSPVTAELLANGNFVLRDSKTKDLNRFIWQSFDFPDDTLLPEMKLGRKLNSPENKKILTSWKSPTDPSSGDYSFILETEGFLHEFYLLQNEFKVYRTGPWNGVRFNGIPKLQNWSYITNNFIDNKEEVAYTFHVNKNHNIHSRFRMSSTGYLQVITWTKTVPQRNMFWSFPEDSCDPYKVCGPYAYCDMHTTPTCNCIKGFVPKNEAAWALRDMSGGCVRSSGLSCGEGDGFLRLGQMKMPETSEAFVDKRIGLNECKEKCVRDCNCTGFANMDIMNGGSGCVTWTGELVDMRNYDA

SEQ ID NO: 10429 - protein, 422 aa, Brassica tournefortii
FYHSCTIFFVVLLQFHHVFSTNTLSSNEALTISSNRTLVSPGDVFELGFFKTTTRNSQDGADRWYLGIWYKTTSDQIQRTYVWVANRDNPLHNSTGTLKISHANLVLLDQSDTPVWSTNLTGVAHLPVTAELLANGNFVLRDSKTKDLNRFMWQSFDFPVDTLLPEMKLGRKFNSSEKEKILTSWKSPTDPSSGDYSFILETKGFLHEFYLFKNEFKVYRTGLWNGVRFNGIPKKMQNWSYIVNDFIDNKEEVAYSFQVNNKNHNIHSRFRMSSTGYLQVITWTKTVPQRNMFWTFPEDTCDLYQVCGPYAYCDMHTTPRCNCIKGFVPKNAGRWDLRDMSGGCVRSSRLTCGEGDGFLRLGQMKMPETSEAVVDKMIGLKECREKCVRDCNCTGYANMDIMNGGGCVMWTGELVDMRKYDA

SEQ ID NO: 10430 - protein, 513 aa, Haemophilus influenzae 86-028NP
MKNLLTNPQPSQSDYINAIVKLGSRVYEAAQVTPLQKMGKLSERLHNNIWIKREDRQPVNSFKLRGAYAMISSLSEEQKAAGVIAASAGNHAQGVALSAKQLGLKALIVMPQNTPSIKVDAVRGFGGEVLLHGANFDEAKAKAIELSKEKNMTFIPPFDHPLVIAGQGTLAMEMLQQVADLDYVFVQVGGGGLAAGVAILLKQFMPEIKIIGVESKDSACLKAALDKGEPTDLTHVGLFADGVAVKRIGDETFRLCQQYLDDMVLVDSDEVCAAMKDLFENVRAVAEPSGALGLAGLKKYAKQNHIEGKNMAAILSGANLNFHTLRYVSERCEIGENREALLAVTMPEQPGSFLKFAYVLGNRAVTEFSYRYADDKRACVFVGVRTTNEQEKADIIADLTKNGFDVEDMSDDDIAKTHVRYLMGGRASNDNERLYTFEFPEQKGALLKFLETLQNRWNISLFHYRAHGADYGNILAGFQIEEREQAEFEQALAQLNYVFEDVTESKSYRYFLR

SEQ ID NO: 10431 - protein, 420 aa, Brassica villosa
YHHSYTLFFFVILVLFPHVFSTNTLSPNEALTISSNKTLVSPGDVFELGFFKTTTRNSPDGTDRWYLGIWYKTTSGHRTYVWVANRDNALHNSMGTLKISHASLVLLDHSNTPVWSTNFTGVAHLPVTAELLANGNFVLRDSKTNDLDRFMWQSFDYPVDTLLPEMKLGRNLIGSENEKILTSWKSPTDPSSGDYSFILETEGLLHEFYLLKNEFKVYRTGPWNGVRFNGIPKMQNWSYIDNSFIDNNEEVAYSFQVNNNHNIHTRFRMSSTGYLQVITWTKTVPQRNMFWSFPEDTCDLYKVCGPYAYCDMHTSPTCNCIKGFVPKNAGRWDLRDMSGGCVRSSKLSCGEGDGFLRMSQMKLPETSEAVVDKRIGLKECREKCVRDCNCTGYANMDIMNGGSGCVMWTGELDDMRKYDA

SEQ ID NO: 10432 - protein, 178 aa, Triticum aestivum
  misc_feature (114)..(114): Xaa can be any naturally occurring amino acid
  misc_feature (124)..(124): Xaa can be any naturally occurring amino acid
  misc_feature (138)..(138): Xaa can be any naturally occurring amino acid
  misc_feature (163)..(163): Xaa can be any naturally occurring amino acid
MAPTVMASSATSVAPFQGLKSTAGLPVSRRSNGASLGSVSNGGRIRCMQVWPIEGIKKFETLSYLPPLSTEALLKQVDYLIRSKWVPCLEFSKVGFIFREHNASPGYYDGRYWXTMWKLPMFGXATDATQVINEVEEXKKEYPDAYVRIIGFDNMRQVQCVSXFIAFKPPGLPRSPKA

SEQ ID NO: 10433 - protein, 460 aa, Rhodobacter sphaeroides 2.4.1
MMEGLAQANDLSEVIEADRAHMWHHLSQHKQYETVDPRIIVEGKGMRVWDAAGKEHLDAVSGGVWTVNVGYGRESIANAVRDQLIKMNYFAHSAGSIPASRFSKRLIEKMPGLSRVYYSNSGSEANEKVFKMVRQISHRHHGGKKGKILFRERDYHGTTITALATSGQPQRAEQYGPLTPGFVMVPHCLEYRKQWDVENYGERAADAIEEVILREGPDTIGALCLEPVTAGGGVIVPPAGYWERVQEICRKYDILLHIDEVVCGLGRTGTWFGYQNFGVKPDFVTMAKGVASGYAAISCTVTTEAVFDMFKDDPSDPMSYFRDISTFGGCTAGPVAALENMRIIEDEGLLENTLKMGARVVENLSALQEKHAVIGDVRGKGLFCGAELVADRATKEPMDEKRVAAVVADVMAQGVIIGMTNRSLPGFNNTLCLSPALIATPDDIDQITDAIDRALTRVFG

SEQ ID NO: 10434 - protein, 412 aa, Crambe kralikii
YHHSCTLFFILLLQFHHVFSTNTLSSNETLTISSNKTLVSPGDVFELGFFKTTQDGHDRWYLGTWYKTTSERTYVWIANRDNPLHNSMGTLKVSHANLVLLDQSDTPVWSSNLTGTAQLPVTAELLSNGNFVLRDSKTNDLNQSMWQSFDFPVDTLLPEMKLGRNLKTGHDRVLTSWKSPTDPSSGDYSFKLETQGLHEFYLLKNEFKVYRTGPWNGVRFNGIPKMQNWSYIVNNFIDTKEEVAYTFHVNNRNIHTRFRISSSGVLQVITWTSTVPQRNMFWSFPEDDCDMYQMCGPYAYCDMNTTPRCNCIKGFVHKNASAWDLRDMSGGCVRSSKLSCGGEGDGFLRMSQMKLPETSEAVVDERIGLEECKEKCVRDCNCTGFANVDNRNGGSGCVIWTGELVDMRNYVA

SEQ ID NO: 10435 - protein, 267 aa, Leifsonia aquatica
MTATSSPTTRFTDRVVLITGGGSGLGRATAVRLAAEGAKLSLVDVSSEGLEASKAAVLETAPDAEVLTTVADVSDEAQVEAYVTATTERFGRIDGFFNNAGIEGKQNPTESFTAAEFDKVVSINLRGVFLGLEKVLKIMREQGSGMVVNTASVGGIRGIGNQSGYAAAKHGVVGLTRNSAVEYGRYGIRINAIAPGAIWTPMVENSMKQLDPENPRKAAEEFIQVNPSKRYGEAPEIAAVVAFLLSDDASYVNATVVPIDGGQSAAY

SEQ ID NO: 10436 - protein, 432 aa, Vitis vinifera
MKWRPPVTARARAGGLGVAAIAYVAVDYLRYLAPAWHSWLMPALWSVLALVAVARVPFYKHWSMEFRSVLPFVASMIFMLSTCLFEVLSVRSVTAVLGLDWHSDTPPLPDTGQWFLLALNEKLPPTVVEILRAHIIGLHHFLMLFMMLAFSVLFDSVKAPGLGLGARYMFTMAIGRFLRAITFVSTILPSARPWCAFARFRVPAHPHHWAQKYYVPYASDPAAIRQVIERDIAYADVGNYLGDFRPDWGSMSFLIDFLRPTTTDGSWYNLLKKAGGGCNDLIYSGHILVAVLTAMAWTEAYGGFSSAVIWLFVLHSAQREIRERHHYTVDCVVAIYVGILLWKMTGFIWSAKDASRSKRLSRLDKIHGRLTQAAKDSNMDEVRELLKEVEMGSPASHSSGRVRSRAMWVFACATIFSALTVVFLALTLTSDG

SEQ ID NO: 10437 - protein, 171 aa, Mycoplasma fermentans
MDLKKYIRDIENFPKTGIMFKDISPLLANGKALNYTITEMAKLAQDVDVIVGPDARGFLFGTPTAAFLKKPFIMVRKPGKLPGDVISKSYDLEYGNNVLQIQKGFIKKGQTVAIIDDVLATGGTTKAIIKLLEEQGAIVKKVILLLELVDLNGRQLITKDNDIEIVSLVKF

SEQ ID NO: 10438 - protein, 420 aa, Diplotaxis erucoides
YHHHSYTFFFVILVLFPHAFSTNTLSSNEALTISSNRTLVSPGDVFELGFFKTTTRNSRDGTDRWYLGIWYKTTSDQRTYVWIANRDNPLHSSMGTLKISQENLVLFDQSATPVWSTNLTGVAHLPVTAELLANGNFVLRDSKTKDLDRFMWQSFDFPVDTLLPEMKLGRKRNSSEKEKILTSWKSPTDPSSGDFSLILETEGFLHEFYLFNNEFKVYRTGPWNGVRFNGIPKIQNWSYIDNSFIDNHEGLAYSFQVNNNHNIHSRFRMSSTGYLEVITWTKTVPQRNMFWSFPEDSCDLYKVCGPYAYCDMHTTPRCNCIQGFVPKNAAQWELRDMSSGCVRSSKLSCGEGDVFLRLGQMKLPETPEAVVEERIGLKECKEKCLRDCQCSGFANIDNMKGGSGCVTWTGELDDMRKYDA

SEQ ID NO: 10439 - protein, 181 aa, Rhizobium galegae
MTASTKDILATAIRSIPDYPKPGIIFRDITTLLGDAAAFRLAVDELVKPYEGLGVDKIAGMEARGFILGGAMAHQLSAGFVPIRKKGKLPYRTVSMAYALEYGTDEMEIHVDAVKPGEKVILCDDLIATGGTAVGAVKLLRQIGAEVVSACFVIDLPDLGGRKALEALGVEVRTLAEFSGH

SEQ ID NO: 10440 - protein, 193 aa, Oryza sativa
MGGPGASSTMSFEQAFLKNLLLSLQDCSTTKPLDAMSLHERKRAVKSSAGFAMATARGGGARWPKAIVLQQQPASTTARARRCGRIVRRCCGRKTRSGAGGGGEMARRLQVRRRAMALRKVIPGGGDAMDEAALLREAMDYVVHLRAQVDVLRRVSEAVQLQRRYTSSTSLRDYSWSKCALKGEEDSSMNMKR

SEQ ID NO: 10441 - protein, 309 aa, Yarrowia lipolytica CLIB122
MTSIDFTMNNGKTIPAIGLGTWKSTTEEVAGAVECALTEGGYRHIDTAFNYRNEDAVGLGIKRAMEKGVKREDIFVTTKIWVTYHDRVEENLNMSLERLGLDYVDMLLIHWPVPLNPNGNDPVYPLREDGSRDIDESGSQPKTWKQMEAVLKTGKTKSIGVSNFSIPYLEELLKEAEVVPAVNQVELHPLLPQLELMEFCKKNNIIMTAFSPFGSVGGPLLKNELVLKLADKYKTSPGGILTSYHIGNGTVVIPKSVTNSRIIENGKSAVTLSQEDLKALNDLHKTEGIHRTSKPKWGVDLGFPDFDFC

SEQ ID NO: 10442 - protein, 243 aa, Triticum aestivum
  misc_feature (3)..(3): Xaa can be any naturally occurring amino acid
  misc_feature (6)..(6): Xaa can be any naturally occurring amino acid
LGXTSXGHRPGRFTNFQLTGASGIFTGFSTEFVARAWDLDQDSAAKLVSTQPGSGIVKLAEGHRMPAPRPEDRDGMVLNCLEAPLDVDIKGGGRVVVLNTANLPLVKEVGLGADLVRIDAHSMCSPGFSSDSAYQVTYIVRGSGRVQVVGIDGTRVLETRAEGGCLFIVPRFFVVSKIADDTGMEWFSIITTPNPIFSHLAGRTSVWKAISPAVLETAFNTTPEMEKMFRSKRLDSEIFFAPN

SEQ ID NO: 10443 - protein, 419 aa, Chlorobium tepidum TLS
MAVSFSKLIQSRWLPLKKLLGFLGPGFLVTVGFIDPGNWATNIEGGARFGYELLWVITLSTLILIVIQHMAARLGIATGKSLAVNIRDHFPAPVSSLLGFTIVAACVATDVAELVGGGIGFSLLFGMPLWAGALLTVVLEVFLVVSQRYHRIETIIVGFLGIIALCYLAELWIVRPAWHEVLPATVTPVLGRESIYVAIAILGAVVMPHNVYLHSNVIHSRKWGMTDDEKKELLRYEKADTLFAMTLGWVVNSAMIVVAAAVFHQHGVRVESIEQASATLRPLAGPLAGLLFAVALVFAGVGSSITSSMAEANVITGFLGKPEDPESLLWRVSVFLTAIPSFIIILFKVDTYKILIFSQVVLSLQLPFTLLPLLVLCRSEKVMGVFRSRGVEFVAAVLITMVVVALNLYLLSTTVTGDS

SEQ ID NO: 10444 - protein, 300 aa, Prochlorococcus marinus str. NATL2A
MSKLHPVVAVTGSSGAGTSTVKRAFEHIFAREKIVPAVVEGDSYHRFERMPMKKAMSEALSRGENFSHFGPEANLFDKLEDLFSQYGKTGGGQKRYYLHSPEEAEEHNTRLGTKLDPGQFTPWEDIPTGTDLLFYEGLHGGVVGKDYDVASFADLLVGVVPITNLEWIQKIHRDNAERGYSAETIVDTILRRMPDYINHICPQFSLTDINFQRVPTIDTSNPFICRNIPTPDESFVIIHFRKGSREKWGIDFQYLLGMIHDSFMSSPTSIVVNGGKMGFAMELILTPIIHKMIEEKKAAG

SEQ ID NO: 10445 - protein, 393 aa, Silicibacter pomeroyi DSS-3
MNFPERFSNLPAYAFPRLRALLDHHPAGGEVVHMTIGEPKHAFPAWVTDVIVENAHLFQSYPPNEGSPELRGAITDWIARRYGVTLDPEKNVMALNGTREGLYNAAMALCPEQKNGQRPIVLCPNPFYQVYMVAAISVGAEPHFVPATAATGHLPDYASLPVEVLNRTAVAYICSPANPQGAVASREYWAELIGLAEQYDFRIFADECYSEIYREEAPAGALSVAQEMGADPERVVLFNSLSKRSNLAGLRSGLIAGGPETLKHVKQLRNYSGAPLPGPLQAAAARVWADEAHVAENRALYQEKYALADQVFAGVQGYQPPEAGFFLWLPVDDGEAASLKAWRETGVRVLPGAYLAQGKPGQNPGETYIRVAMVAPKQDLQRGLIALRDCIYR

SEQ ID NO: 10446 - protein, 359 aa, Prochlorococcus marinus str. NATL2A
MKSYKITLLPGDGIGPEITNVTHKILDLVSRKFGFEIKFKEMPFGGSAIDSDGIPFPDRTLQECKNSDAVLLAAIGDPKYDELPREKRPETGLLNLRSSLDLFANIRPVKIIPSLTKASSLKEDFVKEVDLVVVRELTSGIYFGEPKGRIKTDKGERAFNTMTYTSEEVNRIAEIAFKLAKQRNQKVCSVDKANVLDVSQLWREETILVSNKYKDIELTHQYVDNAAMQLVRNPSQFDVILTGNLFGDILSDIAAMLTGSIGMLPSASLTTDGPGVFEPVHGSAPDIAGKDIANPIAMLLSAAMMLKIALNETEAATFLENAINEILNDGYRTSDLMSIQTTKQVGCSQMGELLAEKLK

SEQ ID NO: 10447 - protein, 371 aa, Aspergillus oryzae
MVPDVAPQTANPNTGSSETERDNRPMMKALVYTGPNKLEVLDRPMPVIQSPTDAILKMLHSTICGTDLHILKGDVPAIPYDRVLGHEGVGTVVSVGPAIDGLSVGDNVVIAAITACKVCASCRKGLEAHCITGGWQLGNKVDGTQAEYVRIPHATSSLYKIPEGLDLRACAAISDALPTGLECGTISAHVQPGSTVAIIGAGPVGLAVMLTARLYTPSQIVMIDLDDTRLEHAKRLGADHAVNPGKLDAMETLNTFTEGQGFDCVIEAVGIPKTFEMCQKLVAPGGSIANVGVHGHPVNLDLHKLWDRNISIKMQLLNAVSIPTLLRLYQSGHIKPSNLFTHHYPFSEVHKAYHSFQMAAQEGALKVAIDF

SEQ ID NO: 10448 - protein, 135 aa, Zea mays
PLTPTPTTPTPYDPNTPPFTGPCTYWMMHPGVIWGLFGFWCPLVRLFGPSAAVPFGHDLTVPEALANTREDGMGALYREGTASLLNSMVNNRFPFTTQEVKDAFGAALNSGDDGAAAAQARLFKKANEGHVIRQN

SEQ ID NO: 10449 - protein, 178 aa, Prochlorococcus marinus str. NATL2A
MSTTNKNDQVPTLLVKDSQGSDLLCFLEQVVPLEGNEYALLTPVDTPVSLFQLIDDQDPKLIETIEKNEPILEVADVVLQEHDLRLVRSAITLTVSGELDEPEPEEIEEEDIDDESETYELLVNFRVESNEYGLYIPLDPFFIVGKLEDGEVKLVEGEEFDKIQSGIEAELEGRGLSE

SEQ ID NO: 10450 - protein, 146 aa, Zea mays
PTRPGLLPLETTRHVSMITITLSKKELDTSSIGYQSPLPADEVKPLVKYENDEDAHSPGGRGRGRGGRGRGRGRGRGGRGNGFNDYADAGWEEDHTPAYMGNGYARGRGRSFRGRGRRGGYNNQPEYQQVGGYYEEAPVHAPALGG

SEQ ID NO: 10451 - protein, 176 aa, Synechococcus sp. WH 7805
MKHTLSVLVEDESGALSRIAGLFARRGFNIDSLAVGPAEADGRSRLTMVVEGDQQTLQQMTKQLDKLVNVLQVLDLSQRPAVERELMLMKVTAPASQRSAILELVQVFRAKVVDVADDALTLEVVGDPGKLVALERLMGPYGIQEIARTGKVALERASGVNTELLKASISGGRVPA

SEQ ID NO: 10452 - protein, 124 aa, Kluyveromyces lactis NRRL Y-1140
MLKRHRSGKKEKKPKKKKKRKVANDNPNSIHLKKVGLSPELQEFLKVEEMPRTQVVKSVWDYIKEHDLQNPEDRREIICDDAMKPIFGEKMTMFTLNKILSKHLFNLAKSEKDEITEQHSDLEP

SEQ ID NO: 10453 - protein, 360 aa, Candida glabrata CBS 138
MSVYNKTPLIRQIFPSIPQMYLKHECFQPSGSFKSRGIGHLISKQSQRILGNGLGKKPMVFASSGGNAGLAAATAAKFLNLPCTVVIPTATKQRMADKIRATGANVIVSGNFWKEADNYLKDNILSKLEELHKNVEPIYVHPFDNPDIWEGHASMVDEIVEDFKNKMIPLNKIKAIVCSVGGGGLYNGIIQGLEKYNLADKIPIVGVETKGCHVFNTSLRMNKVVSFKKITSIATSLGTADISTEAFKYAKRYGTKSVVLSDQDVVKTCLRYTHDFNMVIEPACGAAVHLAYHTEILEKELGTKLNADDIVLVVACGGSSNTVEDMESILQRLSTEENNINIPNVAENIIVRMPEVSVLA

SEQ ID NO: 10454 - protein, 442 aa, delta proteobacterium MLMS-1
MKIAVVGTGYVGLVSGACLAEFGHQVVCMDLDAGRIEALRQGEIPIYEPGLDDLVAKNVREGRLSFTTELACAMAGARAVFIAVGTPSQRRGNGYADLSYIYAAAKDIAGLLEDNYTVVIDKSTVPVGTGRQVRRIIAEANPAADFDVASNPEFLREGAAINDFMRPDRVVLGVESERAAEVLQEIYNPLYLNATPFVVTSLETAELSKYAANAFLAMKISFINEMANLCEAVGGDVKPLARAVGLDGRIGAKFLHPGPGYGGSCFPKDTLALLRIAQEHGSSSRLVEAAVEVNAAQKGRMIKKIRDAIGGSEAGKTIAVLGLTFKPETDDMREAPALTILPALLEKGARLQVHDPQGMKEAAALMPDCHYRENAYEAAAGAHALVLLTEWNQYRALDLERLRQSMQTPLFIDLRNVYEPEKMQAAGFTYVGVGRRGLSLPQ

SEQ ID NO: 10455 - protein, 711 aa, Gibberella zeae PH-1
MAPRGFEDEELTISLSSSHVRRPQQTQPQSQSQQQDDSHDAPQAASRPADAPLKERIKTEQRIGAYKVLRTLGEGSFGKVKLAIHNGTGQQVALKIIARKKLISRDMAGRVEREIEYLQLLRHPHIIKLFTVIKTPNEIIMVLEYAGGELFDYIVQHGRMKEPEARRFFQQMLCAVEYCHRHKIVHRDLKPENLLLDENLNVKIADFGLSNIMTDGNFLKTSCGSPNYAAPEVIGGKLYAGPEVDVWSCGVILYVLLVGRLPFDDEHIPSLFAKIAKGTYSIPQWMPTGAANLIKKMLVVNPVHRATIEDIRADPWFTTELPVYLQLPVEEFFNTGVDPNKAIKKNDIAPNASEKVQERLHNEVTEKISKTMGYGKSDVEEALQAAEPSAIKDAYMIVRENKMMQVNHNSEALLAEPEGSSPMLSMSSARSTISQATTTPRPYVSKVGILPSSLPAYHKDYMEREKAGSVENSPPKVLINDEPQLNRTDAEKEETARRLRPHSRSQLRIDEANTRPQGMTPINPPKKTKPVRWQFGIRSRNSPWEALLCIHKALYKLGATYIPDEDYESRTAEERAEASGDSSFVDSHDGYRGSTSSIDPKKRYNLPADPWHINVRWDTSAIKKKAGNTPSAPSTPSSPSTPDGHHAKEPFVALHLDIQIYEMEHGVYLVDFKCSGYETAHGRLLEEKDVTSPFPFLDMAAKLIMQLAEAD

SEQ ID NO: 10456 - protein, 501 aa, Catharanthus roseus
MALASIEKVATGLICFILLIFSLKRIGHPRDWALVGILSVWFPSLGHIYEKLAKSLAKNDKTFVLKGSFLSKQDVIFTCDPANMHHVMSTNFSNYPKGPENRNVFDVYGEMLFTADHEKWKSHRKVTNAYFHDQRFNGFSQKVNKEVIEKELFPFLDHAAEEALVFDLQDVFQRLMLDSSSILTTGQNHRSLRVGLPYDETLEAINIANYQIFVRHILPAKIWKFQKWLGIMGEKKIKKAWRILDDISVEYMNRRKKEISSTISSQEDMDVVKFSEEDHVVLKSVDASDNLLRDTVKGILLAGTDTTATVLSWFFWLILKNPRVEQKIREEIELYLKQKNGEHGLYTNPEELNELMYLHAAIYETMRLYPAAPFTSRKSIQADVFPTGHQVNPNTTIVMAYYAVGRMKSIWGEDCLEFKPERWLSDKGKLIPVQTNKFLAFGTGPRICPGKELGLNRVKAVAAAIIPKYSFKIMRNKPVMPAACATLYLKDGLIVRVNKII

SEQ ID NO: 10457 - protein, 468 aa, Neisseria meningitidis
MSIKNVVKLIEESEARFVDLRFTDTKGKQHHFTVPARIVLEDPEEWFENGQAFDGSSIGGWKGIQASDMQLRPDASTAFVDPFYDDVTVVITCDVIDPADGQGYDRDPRSIARRAEAYLKSSGIGDTAYFGPEPEFFVFDGVEFETDMHKTRYEITSESGAWASGLHMDGQNTGHRPAVKGGYAPVAPIDCGQDLRSAMVNILEELGIEVEVHHSEVGTGSQMEIGTRFATLVKRADQTQDMKYVIQNVAHNFGKTATFMPKPIMGDNGSGMHVHQSIWKDGQNLFAGDGYAGLSDTALYYIGGIIKHAKALNAITNPSTNSYKRLVPHFEAPTKLAYSAKNRSASIRIPSVNSSKARRIEARFPDPTANPYLAFAALLMAGLDGIQNKIHPGDPADKNLYDLPPEEDALVPTVCASLEEALAALKADHEFLLRGGVFSKDWIDSYIAFKEEDVRRIRMAPHPLEFEM

SEQ ID NO: 10458 - protein, 135 aa, Taiwanofungus camphoratus
MLSSLASRALRTTFTTQNVLKRGFHSSIRRNEQFLNANAETFSKAISNEDNVVLVDFYADWCGPCKVISPIFQKLFEQFSHADFYKVDVDDQQDISQEVGIRAMPTFVAFKNGSKLKEIVGANPSGLQELIQGLA

SEQ ID NO: 10459 - protein, 204 aa, Kluyveromyces lactis NRRL Y-1140
MSTTKYSERPVTVEKAIPVTYDLGNLAVFDTNVLDRNDFDSSNAARESNIKDLTRDNVQLLINQILSLPIRATTESAGGSSGQSSSMTLVQLPEPTTELPREKPLPKPKAPTKWEQFAAKKGIKPKERSGKMIYDEAAGEWVPKWGYKGSNKELDDQWLVEVDDKVQGTEDELIDPRTLNRAERKRLIKKNQLQQKRNLKNQVK

SEQ ID NO: 10460 - protein, 540 aa, Prochlorococcus marinus str. MIT 9515
MSKISKKNINKIKVTESPVVLAILDGWGHREETSDNAIKQANTPVMDALWHAYPHTLISASGADVGLPNGQMGNSEVGHLTIGSGRIIQQELVRITNVVKNNQLTQVLELNNMANSIKKNNGTLHITGLCSDGGVHSHIEHLLGLIKWASESGLDKVAIHVITDGRDTPAKSAYKYIKQIEDCIKEFKVGEIASICGRYWIMDRNLLWERTEKAFINLTDPNLQVTDLSPEDYLNKSYGENITDEFLEPVRISKKFLKDGDSLICFNFRPDRARQIIKALSEREFDNFKRNIIPDIDILTFTQYEANLPVKVVFPPESLNNFIGQIVSENGLKQYRTAETEKYPHVTYFFNGGVEVPSPGEHRHLIPSPRVATYDMAPEMSAEELTISCSNAIKTGQYSFVVINFANPDMVGHTGDMEAAIKAIETVDKCIGKIVNATGEMGGSILITADHGNAELMKGPDGEPWTAHTINKVPLIFIEGEKRKIPNMGNEIYLRDNAGLADIAPTLLQLLSLPVPKEMTGKSLIKEIELKGFNKVVQHV

SEQ ID NO: 10461 - protein, 468 aa, Neisseria meningitidis
MSIKDAVKLIEESEARFVDLRFTDTKGKQHHFTVPARIVLEDPEEWFENGQAFDGSSIGGWKGIQASDMQLRPDASTAFVDPFYDDATVVLTCDVIDPADGQGYDRDPRSIARRAEAYLKSSGIGDTAYFGPEPEFFVFDGVEFETDMHKTRYEITSESGAWASGLHMDGQNTGHRPAVKGGYAPVAPIDCGQDLRSAMVNILEGLGIEVEVHHSEVGTGSQMEIGTKFSTLVKRADQTQDMKYVIQNVAHNFGKTATFMPKPIMGDNGSGMHVHQSIWKDGQNLFAGDGYAGLSDTALYYIGGIIKHAKALNAITNPSTNSYKRLVPHFEAPTKLAYSAKNRSASIRIPSVNSSKARRIEARFPDPTANPYLAFAALLMAGLDGIQNKIHPGDPADKNLYDLPPEEDALVPTVCASLEEALAALKADHEFLLRGGVFSKDWIDSYIAFKEEDVRRIRMAPHPLEFEM

SEQ ID NO: 10462 - protein, 468 aa, Neisseria meningitidis
MSIKNAVKLIEESEARFVDLRFTDTKGKQHHFTVPARIVLEDPEEWFENGQAFDGSSIGGWKGIQASDMQLRPDASTAFVDPFYDDVTVVITCDVIDPADGQGYDRDPRSIARRAEAYLKSSGIGDTAYFGPEPEFFVFDGVEFETDMHKTRYEITSESGAWASGLHMDGQNTGHRPAVKGGYAPVAPIDAGQDLRSAMVNILEELGIEVEVHHSEVGTGSQMEIGTRFATLVKRADQTQDMKYVIQNVAHNFGKTATFMPKPIMGDNGSGMHVHQSIWKDGQNLFAGDGYAGLSDTALYYIGGIIKHAKALNAITNPSTNSYKRLVPHFEAPTKLAYSAKNRSASIRIPSVNSSKARRIEARFPDPTANPYLAFAALLMAGLDGIQNKIHPGDPADKNLYDLPPEEDALVPTVCASLEEALAALKADHEFLLRGGVFSKDWIDSYIAFKEEDVRRIRMAPHPLEFEM

SEQ ID NO: 10463 - protein, 420 aa, Diplotaxis siifolia
YHYSCTFFFVILVLFPHAFSTNTLSSNESLTISSNKTLVSPGDVFELGFFKTTTRNSRNGTDRWYLGIWYKTTSDQRTYVWVANRDNPLHNSIGTLKISHANLVLLDQSNTSVWSTNLAGVVQSPVTAELLANGNFVLRGSYSTEDEFMWQSFDFPVDTLLPEMKLGWKLNSSEKEKILKSWKSPTDPSSGDYSFRLETEEFLYEFYLMKNEFKVHRTGPWNRVRFNGVPKMQNWSYISNNFIDNEDEVAYSFLVNNNNHNIHTRFRMSSTGYLQVITWTKTVPQRNMFWSFPEDTCDLYKVCGPYAYCDMNTTPMCNCIKGFVPKNAGQWELRDASGGCMRSSQLSCGEGDGFLRMSQMKLPETSEAVAVLVDNGLKECKERCVRDCNCTGFANMDSMNGGPSCVIWSGELEDMRNYVA

SEQ ID NO: 10464 - protein, 468 aa, Neisseria meningitidis
MSIKNAVKLIEESEARFVDLRFTDTKGKQHHFTVPARIVLEDPEEWFENGQAFDGSSIGGWKGIQASDMQLRPDASTAFVDPFYDDATVVLTCDVIDPADGQGYDRDPRSIARRAEAYLKSSGIGETAYFGPEPEFFVFDGIEFETDMHKTRYEITSESGAWASGLHMDGQNTGHRPTVKGGYAPVAPIDCGQDLRSAMVNILEELGIEVEVHHSEVGTGSQMEIGTRFATLVKRADQTQDMKYVIQNVAHNFGKTATFMPKPIMGDNGSGMHVHQSIWKDGQNLFAGDGYAGLSDTALYYIGGIIKHAKALNAITNPSTNSYKRLVPHFEAPTKLAYSAKNRSASIRIPSVNSSKARRIEARFPDPTANPYLAFAALLMAGLDGIQNKIHPGDPADKNLYDLPPEEDALVPTVCASLEEALAALKADHEFLLRGGVFSKDWIDSYIAFKEEDVRRIRMAPHPLEFEM

SEQ ID NO: 10465 - protein, 419 aa, Eruca sativa
YHHSYTLFFLVLLQFHHVFSTNTLSSNETLTISSNKTLVSPGDVFELGFLKTNTKNSQDGTDRWYLGIWYKTTSERTYVWVANRDNPLHNSIGTLKISHANLVLLNQFNTPVWSTNLTESVTSPVTAELLANGNFVLRDSKTKDLNHFMWQSFDFPVDTLLPEMKLSRNIKPGNDRILTSWKSPTDPSSGDFTFVLEPHNHGLHEFYLLKNEIEVYRTGPWNQNRFNGIPKIQNWSYIANNFIDNNNEEVAYTFHVNNSNIHSRFRMSSLGYLQVITWTKTIPQRDMFWSFPEDACDLYQVCGSYAYCDINTTPNKCNCIKGFVPKNPDAWTLRDATGGCVRSSRLSCGEGDGFVRMSKMKLPETSEARVDKGIGLEECKERCVRDCDCTGFANMDIGSGGSGCVMWIDELVGMRNYVA

SEQ ID NO: 10466 - protein, 468 aa, Neisseria meningitidis
MSIKNAVKLIEESEARFVDLRFTDTKGKQHHFTVPARIVLEDPEEWFENGQAFDGSSIGGWKGIQASDMQLRPDASTAFVDPFYDDVTVVITCDVIDPADGQGYDRDPRSIARRAEAYLKSSGIGDTAYFGPEPEFFVFDGVEFETDMHKTRYEITSESGAWASGLHMDGQNTGHRPAVKGGYAPVAPIDCGQDLRSAMVNILEGLGIEVEVHHSEVGTGSQMEIGTRFATLVKRADQTQDMKYVIQNVAHNFGKTATFMPKPIMGDNGSGMHVHQSIWKDGQNLFAGDGYAGLSDTALYYIGGIIKHAKALNAITNPSTNSYKRLVPHFEAPTKLAYSAKNRSASIRIPSVNSSKARRIEARFPDPTANPYLAFAALLMAGLDGIQNKIHPGDPADKNLYDLPPEEDALVPTVCASLEEALAALKADHEFLLRGGVFSKDWIDSYIAFKEEDVRRIRMAPHPLEFEM

SEQ ID NO: 10467 - protein, 159 aa, Triticum aestivum
VRCETNISAGAVSVSSAAVELAMMKLPKSECLSARMLLIGAGKMGKLVVKHLIAKGCKKVVVVNRSVERVDAIREEMKDIEIVYRPLAEMYEAAADADVVFTSTASESLLFTKEHAEALPPVSLAMGGARLFVDISVPRNVGACLSEVEHARVYNVDDL

SEQ ID NO: 10468 - protein, 419 aa, Eruca vesicaria
YHYSYTLFFVILLQFHHVFSTNTLSSNETLTISSNKTLVSRGDVFELGFFKTTTKNSQDGTDRWYLGIWYKTTSERTYVWVANRDNPLHNSIGTLKISHNNLVLLNQFNTPVWSTNLTESVTSPVTAELLANGNFVLRDSKTKDLNRFMWQSFDFPVDTLLPEMKLSRNFKPGNDRILTSWKSPTDPSSGDFSFKLEPQNHGLHEFYLLKNEIEVYRTGPWNQNRFNGIPKIQNWSYIVNNFIDNNNEDVAYTFHVNNSNIHSRFRMSSTGYLQVITWTKTIPQRNMFWSFPEDACDLYQVCGSYAYCDINTTSNKCNCIKGFVPKNPEAWDLRDATGGCVRSSRLSCGEGDGFMRMSKMKLPETSEARVDKGIGLEECKERCVRDCDCTGFANMDILNGGSGCVMWIDELVDMRNYVA

SEQ ID NO: 10469 - protein, 335 aa, marine gamma proteobacterium HTCC2143
MEISFPPRLSLAQTPTPLIAIDRISEVVGGPRIWVKRDDMTGSAVSGNKIRKLEFSLAKALDEGCDTIITCGGVQSNHCRTTAVLCAQLGLKCHLILRGPEDSEIEGNLLLDRLVGAEISFYTNREYQQKSDEIIQHWMQHYHEQGSKVFSIPVGASDGIGLWGYIAACEELKDDFSQLNIQPGHIISATGSGGTQGGLTVGSELFQLGAKVWGMAVCDDANYFINKVKQDIAQWRQWYSPLISPSFDCDSLCVNVIDDYIGPGYAQATPDIFATISMAARLEGLILDPVYTGKGFHGMLDQIRQGRFDDTNDIVFVHTGGIFGLFPQRDQLGLS

SEQ ID NO: 10470 - protein, 80 aa, Zea mays
KQILAPLPIGFAVFLVHLATIPITGTGINPARSLGAAIIYNRDHAWNDHWIFWVGPFIGAALAAIYHQVIIRAIPFKSRS

SEQ ID NO: 10471 - protein, 420 aa, Erucastrum abyssinicum
YHQSCTIFFLVLIQFHHVFSTNTLSPNDALTISSNKTLVSPGDVFELGFFKTTTRNSRDGTDRWYLGIWYKTTSDQRTYVWIANRDNPLHNSMGSLKISHANLVLLDQSDTPVWSTNLTGVAHLPVTAELLANGNFVLRDSKTNDLDRFMWQSFDFPVDTLLPEMKLGRKVNSSEKEKILTSWKSPTDPSSGDYSFILETEGFLHEFYLFKNEFKVYRTAPWNGVRFNGVPKMQNWSYIDNSFIDNKEEVAYTFRVNNNHNIHSRFRMSSTGYLQVITWTKTVPQRNMFWSFPEDTCDPYKVCGPYAYCDMHTTPMCNCIKGFVPKNAAQWDLRDASGGCVRSSKLSCGERDGFLRLGQLKLPETSEALVEKGIGLKECKEKCLRDCHCTGFANMDIMNGGGSGCVTWTGELVDMRDYDA

SEQ ID NO: 10472 - protein, 390 aa, Oryza sativa
MDSIMEPYVADLLTDDITASMVELLSGDGGAAQMDVGVLEAYLRAIGALPAHPAAPGADLAAAAEVESMASNDDTNGNWDTKVDAKVPSAFLPPPPGFPPLPVPALADEPVYAAPVDEGDAIRAFMQQLEWSEQYNGDDDAPAPDDSMASRPQLCAPYDDDIDANLRAMEKDAAERPSPDYLDTVHNGQISAASRASLVAWMGRLTHRYELAAGTLHRAVSYFDRFLSARALPSYTEHQLSLVGATAVYTAAKYEDQGTVFKLDTREIASYGEFASAQEVLAMEREMMAALGYRLGGPNAETFVEHFTRYSKGKEELRVQRLARHIADRSLESYGCLGYLPSVVAAAVISIARWTLNPPGALPWSSELHELTGYSSQDISSCVLTVLNTQ

SEQ ID NO: 10473 - protein, 386 aa, Synechococcus sp. CC9605
MTCGGPSMPDSPSDKAYLVLADGTVLTGVGFGHRGTTIGEVVFNTGMTGYQEVLTDPSYAGQLVSFTYPELGNTGVNADDQEADRPHARGVIARQLVPLPSNWRCEQTLESWMQTHQLVGISGLDTRALVRHLREVGAMNGVISSDGQTPAQLLELLKQAPSMQGLNLADRVTTKQPYQWNQACSVGFDQRLQRRSDAPFRVVAIDFGIKRAILDRLVAHGCDVTVLPADTDLATVRSHRPDGVFLSNGPGDPAAVSQGIALAKSLLDESDLPLFGICLGHQILGLALGGETFKLPYGHRGLNHPCGTTGQVEITSQNHGFALSADSLDQGVVDVTHFNLNDRTVAAIAHRQKPVFGVQYHPEASPGPHDADHHFGRFVTLMADRR

SEQ ID NO: 10474 - protein, 124 aa, Arabidopsis thaliana
  misc_feature (50)..(50): Xaa can be any naturally occurring amino acid
  misc_feature (84)..(84): Xaa can be any naturally occurring amino acid
  misc_feature (103)..(103): Xaa can be any naturally occurring amino acid
MGLVLSWTWPPPPGGGVSQVHHHQFSVGVNTNELWFRPTRRTLISKSSCXFNLPQESSLSEGLREPFAFLGGMFAGLLSLDLNXEPVKDWATQTVEPSGITEXEVHADEVGSHDEDSPQQIDIE

SEQ ID NO: 10475 - protein, 363 aa, Silicibacter pomeroyi DSS-3
MSLIPDITELLARARADLRMGVPVVLRDEGGDSALALAAETLTAARLADLRQLGDPVIAITGRRAETLKARAYDGDLARVILPTGADLRWVQAVADPSDDLNTPMKGPLGTMRQGKAGLHRLAISLTKSARLLPAAVLVALPEGRTFAADHGLTTIDHAQAAPHLSERSPLHVVSAARLPMEVSEAGRLHVFRPEDGGEEHYAVEIGRPDRDKPVLARLHSACFTGDLMGSLKCDCGPQLRGALAQMGAEGAGVLLYLNQEGRGIGLANKMRAYFLQDQGFDTVEANHRLGFEDDERDFRLGSDILKSLGFKSVRLLTNNPAKIAMMERTGIAVTERVPLKVGETAHNRGYLATKAAKSGHML

SEQ ID NO: 10476 - protein, 156 aa, Triticum aestivum
GTTIEPVCTKNQAVPSRIPGISSTHASGWISYDLYSSKLQHIVGADKTVKTSALILFSLLGLPLSITYSVPFSVTAELTAGTGGGQGLATGVLNLAIVAPQIVVSLGAGPWDKLLGGGNVPAFALASVFSLAAGVFAVIKLPKLSNNYQSAGFHMG

SEQ ID NO: 10477 - protein, 232 aa, Silicibacter pomeroyi DSS-3
MVFFCGKPDRGDDMSLQEIKNRIARAEQAANRPDGSVKLIAVSKVQPNERVEAVLEQGHRIFGENRVQEAAGKWPAFMERYDGVELHLIGPLQTNKARQAMELVHAIHSVDRPKLATTLARLAQELGRCPDLFIQVNTGEEDQKAGIMPAEADGFIAECRALDLPVQGLMCIPPVEEEPALHFALLAKIAARNGLSGLSMGMSGDFESAIALGATHVRVGSAIFGDRVKAAG

SEQ ID NO: 10478 - protein, 207 aa, Bradyrhizobium japonicum USDA 110
MSERLLVLVRHGQSEWNLKNLFTGWKDPDLTEQGVAEAREAGRKLKAQGLVFDVAYTSVLTRAQHTLDLILGELGQKGLPTEKNLALNERDYGDLSGLNKDDARKKWGEDQVLIWRRSYDVPPPGGESLKDTLARALPYYVQEILPSVLNGKRTLVAAHGNSLRALIMVLEKLSPEGILKRELATGVPIIYRLNADSTVASKLDLAG

SEQ ID NO: 10479 - protein, 730 aa, Kluyveromyces lactis NRRL Y-1140
MSSDVSSPISEVPFVEKFLGEVECEEYLPTFEKFRLFDEDRLYYLDREILEELGVKKIGDKIKILKQSRQLRRDASGFNPKKELVEITAKINALNSNPLSINEELVTDKHSVIFILNDGSAKKVNVNGCFNAHSIKKKLIKRLPSEFISIDPVTKEATHSSQDYDVFVVDYVKNVLHLLYDVELVTICHSSDRLEKNRLIFVSKDQTPSEKAIFTSKKVYLKTLSVMQQMGSQPGAGRPLLSGPGTNALRIENRSDNIREIFTQRPPTELISTNLPEYFPHTDINRLKKTLRNSMRQSIRASMIRGKNGSLVSLAGSNKIGDILVNQSHAVDRALLESIQNDGSASNSADHAVPMHNTSTNGSDASTASLTPLMKRTSISSNSRNSKSSVRGRSGSESGTSESNDKIELYSTDTDTEGEEDDAEDTISLPTKVEAPKSWLKGARIGSGSFGSVYLGMNAETGELMAVKQVELKPTAVTAGVVSIADESKKAHSPGGGNTAVKNTSQIHRKMIDALQHEMNILKELHHENIVTYYGSSQEGGNLNIFLEYVPGGSVSSMLNNYGPFDEPLVKNFTRQILIGLAYLHKRNIIHRDIKGANILIDIKGGVKITDFGISKKLSPLNKQQNKRASLQGSVYWMAPEVVKQVVTTEKADIWSVGCVIVEMFTGKHPFPDFSQMQAIFKIGTNIIPEIPSWVSEEAKAFLFKSFELDYRKRPSSLGLLQEPWLNTVL

SEQ ID NO: 10480 - protein, 535 aa, Pseudomonas aeruginosa PAO1
MAILHTQINPRSAEFAANAATMLEQVNALRTLLGRIHEGGGSAAQARHSARGKLLVRERINRLLDPGSPFLELSALAAHEVYGEEVAAAGIVAGIGRVEGVECMIVGNDATVKGGTYYPLTVKKHLRAQAIALENRLPCIYLVDSGGANLPRQDEVFPDREHFGRIFFNQANMSARGIPQIAVVMGSCTAGGAYVPAMSDETVMVREQATIFLAGPPLVKAATGEVVSAEELGGADVHCKVSGVADHYAEDDDHALAIARRCVANLNWRKQGQLQCRAPRAPLYPAEELYGVIPADSKQPYDVREVIARLVDGSEFDEFKALFGTTLVCGFAHLHGYPIAILANNGILFAEAAQKGAHFIELACQRGIPLLFLQNITGFMVGQKYEAGGIAKHGAKLVTAVACARVPKFTVLIGGSFGAGNYGMCGRAYDPRFLWMWPNARIGVMGGEQAAGVLAQVKREQAERAGQQLGVEEEAKIKAPILEQYEHQGHPYYSSARLWDDGVIDPAQTREVLALALSAALNAPIEPTAFGVFRM

SEQ ID NO: 10481 - protein, 321 aa, Magnaporthe grisea 70-15
MFGRSAPKFDPAKDIPNQAGRIAFVTGGNGGLGLETVIQLAKAGMERIFIGARNEEKALKAIKEISTNLNCSTTFTFVKMDLTSFDSVCRAADQVISQTDKLHLLINNAGVVGTAPGLTPEGYETQWGTNHMGHALFTRLLLPLLKQTAEGGRVDVRIVNVSSLSERMCALHGCGDLEVFKRAEAKGPLWGAGLFWGYGASKLATILHARMLAKKHPSVKAVAVHPGTVKTTITGSFSKTSPFIGGYVMPFITALFFVDVSEGARNQLWAATSDQANTGEYYAPVGRPNMGSGKSRNMKEAERVWEWTERELDAYLRKTGR

SEQ ID NO: 10482 - protein, 540 aa, Oryza sativa Indica Group
MSGGSGDSSPASGRASFSSLSDLKDLELSSESGCLSIVVLGASGDLAKKKTFPALFHLFQQGFLLSGEVHIFGYARSNISDDGLRERIRGYLKGASDEHISQFLQLIKYVSGSYNSGEGFESLNNAISENETSKNNKPGSSRRLFYLALPPSVYPSVCKMIRSYCMNPSSHSGWTRVIVEKPFGKDLESAEELSAQLGELFNEQQLYRIDHYLGKELVQNLLVLRFANRLFLPLWNRDNIANVQIVFREDFGTEGRGGYFDQYGIIRDIIQNHLLQVFCLVAMEKPVSLKPEHIRDEKVKVLQSVTPIKHDEVVLGQYDGYKDDSTVPDDSNTPTFASLVLRVNNERWEGVPFILKAGKALNNRKAEIRVQFKDAPGDIFKFLSAIVLLLPMVSKTLFLFHPDKGKKQGRNEFVIRLQPSEAMYMKLTVKKPGLEMATEQSELDLSYGLRYQDVKIPEAYERLILDTIRGDQQHFVRRDELKAAWEIFTPLLHDIDDGKVKALPYKPGTRGPPEADELSKRMGYVQTHGYVWIPPTLSKF

SEQ ID NO: 10483 - protein, 468 aa, Neisseria meningitidis
MSIKNAVKLIEESEARFVDLRFTDTKGKQHHFTVPARIVLEDPEEWFENGQAFDGSSIGGWKGIQASDMQLRPDASTAFVDPFYDDVTVVITCDVIDPADGQGYDRDPRSIARRAEAYLKSSGIGDTAYFGPEPEFFVFDGVEFETDMHKTRYEITSESGAWASGLHMDGQNTGHRPAVKGGYAPVAPIDCGQDLRSAMVNILEELGIEVEVHHSEVGTGSQMEIGTRFATLVKRADQTQDMKYVIQNVAHNFGKTATFMPKPIMGDNGSGMHVHQSIWKDGQNLFAGDGYAGLSDTALYYIGGIIKHAKALNAITNPSTNSYKRLVPHFEAPTKLAYSAKNRSASIRIPSVNSSKARRIEARFPDPTANPYLAFAALLMAGLDGIQNKIHPGDPADKNLYDLPPEEDALVPTVCASLEEALSALKADHEFLLRGGVFSKDWIDSYIAFKEEDVRRIRMAPHPLEFEM

SEQ ID NO: 10484 - protein, 518 aa, Gibberella zeae PH-1
MSDPFAPRSMKRKNVKGLALKAAAPRPPPTAETSNHEYSGSQDAGRDEQLEIGIEYKLDLRPEDLEILKELGSGNGGTVSKVKHITTGTVMARKVIHVEAKREIRKRIVRELQIMHGCHSDYIVTFYGAFLTPNNDVIMCMEYMDVGALDRVSRVFGPVRVDVLGKIAEATLGGLTYLYTKHHIMHRDIKPSNILVNSRGGIKLCDFGVSGELVNSIADTFVGTSTYMAPERIQGEKYTVKSDVWSFGLSIMELAIGKFPFAASEQVSDGDFAPAGILDLLQQIVHEPAPKLPKSDAFPSILDDMIQKCLYKEPERRPTPQELFDRDHFVQAAKRTPVDLREWAVGMMERDNRKSHLAPQLSPSTQDLLRSSDSPTQSQQAQAQAQAQPEERSHTPTSGEIPIGGAGITSPRDQYGSNQNRSPPRNGHASSRTPASAHPGLGSRVITTNSIPKVSGYPDNVGPVSANAATFSLPVRPAPPGGPLPPPPPRKETPDELRRENRRQATFGLPPNPSYGIQ

SEQ ID NO: 10485 - protein, 315 aa, Neisseria meningitidis MC58
MNILSKISSFIGKTFSLWAALFAAAAFFAPDTFKWAGPYIPWLLGIIMFGMGLTLKPSDFDILFKHPKVVIIGVIAQFAIMPATAWLLSKLLNLPAEIAVGVILVGCCPGGTASNVMTYLARGNVALSVAVTSVSTLISPLLTPAIFLMLAGEMLEIQAAGMLMSIVKMVLLPIVLGLIVHKVLGSKTEKLTDALPLVSVAAIVLIIGAVVGASKGKIMESGLLIFAVVVLHNGIGYLLGFFAAKWTGLPYDAQKTLTIEVGMQNSGLAAALAAAHFAAAPVVAVPGALFSVWHNISGSLLATYWAAKAGKHKKP

SEQ ID NO: 10486 - protein, 535 aa, Cryptococcus neoformans var. neoformans B-3501A
MSAKVPITVFNSLQEIYPSASAVLREGQRWNTLLTRFQERFGETPTYIVRAPGRVNVLGEHIDYSLFPVLPAAIEQDILFALRPTRPVAGSNPTVRLENYDKKYSYPGCSFSLVPGENGWDVGLNAGGGWDKYVRAALLECLDELFPVGKGGGKQEAVGMDVLVSGSIPPGSGLSSSAAMVVGSVIMFLVANNLAAGKTKEDVVQLAINSEHRMGLRTGGMDQSVSALALPNNLLHLSFHPGLLPAPLPLPGNVSLVITNSLAPHSLTDSAPEEYNLRVIEILIATRLILHHWKLESQFYGNPRPWLREVLGAWVGEKGHMGWEKEGEVTEKALGDIEWIKRDGGWTREEMIKYSGMDEEEFKKSYLDFLEIRAEKFHLYERLHHTLTESLRVHKFVHLCQSISTSDPLPPSSDTPLPTANDILSQLGKLFDASHASMRDTYDCTHPLVDSLQELCLKSGAIGSRMTGGGWGGSVVSLVESSQVPEFLEKVRKGYEKYGDLEDEEWVEVGFATMPGHGAGVYVVENGIRVENGAA

SEQ ID NO: 10487 - protein, 453 aa, Pseudomonas aeruginosa PAO1
MRLCVIGAGYVGLVTAACFAEMGNQVRCVERDRERVARLRRGEMPIYEPGLESILRDQLDAARLTFTASLAEGLADAEVVFIAVGTPCGEDGSADLSHVLAVAEQLGAQLRQACIVVNKSTVPVGTAERVEEIIRLGLARRRKRFRVAVASNPEFLKEGSAVDDFRRPDRVIIGSAETQAGETLRQLYAPFLRNHERVLLMGRREAEFSKYAANAFLATKISFMNEMAGLCALTGVDIEDVRRGMGSDKRIGTHFIYAGCGYGGSCFPKDVRALIRSAEQQGYDSQILRAVEARNARQKELLFETLGELFQGRWQGRTVALWGLAFKPGTDDLREAPSLVLLEALLRHGVRVRAHDPVANAGVAARYPEAVACARLTLHDSPYAAVEGADALVLVTEWKQFRQPDFQKIRGSMRTPLLVDGRNLYAPARMAELGFIYQGIGRPRAGHCKASAA

SEQ ID NO: 10488 - protein, 279 aa, Pseudomonas aeruginosa PAO1
MIKKCLFPAAGYGTRFLPATKAMPKEMLPVVNKPLIQYAVEEALEAGLSEIGIVTGRGKRSLEDHFDISYELEHQIRNTDKEKYLVGIRRLIDECTFAYTRQVEMKGLGHAILTGRPLIGDEPFAVVLADDLCLNLEGDSVLKQMVKLYNQFRCSIVAIQEVPPEETNKYGVIAGEMIRDDIFRVNTMVEKPKPEEAPSNLAIIGRYILTPDIFDLIEQTEPGKGGEIQITDALMKQAQDGCVLAYKFKGKRFDCGSAEGYIEATNFCYENLYKTGKAH

SEQ ID NO: 10489 - protein, 468 aa, Neisseria meningitidis
MSIKNAVKLIEESEARFVDLRFTDTKGKQHHFTVPARIVLEDPEEWFENGQAFDGSSIGGWKGIQASDMQLRPDASTAFVDPFYDDATVVLTCDVIDPADGQGYDRDPRSIARRAEAYLKSSGIGDTAYFGPEPEFFVFDGIEFETDMHKTRYEITSESGAWASGLHMDGQNTGHRPAVKGGYAPVAPIDAGQDLRSAMVNILEELGIEVEVHHSEVGTGSQMEIGTRFATLVKRADQTQDMKYVIQNVAHNFGKTATFMPKPIMGDNGSGMHVHQSIWKDGQNLFAGDGYAGLSDTALYYIGGIIKHAKALNAITNPSTNSYKRLVPHFEAPTKLAYSAKNRSASIRIPSVNSSKARRIEARFPDPTANPYLAFAALLMAGLDGIQNKIHPGDPADKNLYDLPPEEDALVPTVCASLEEALAALKADHEFLLRGGVFSKDWIDSYIAFKEEDVRRIRMAPHPLEFEM

SEQ ID NO: 10490 - protein, 1401 aa, Schizosaccharomyces pombe 972h-
MGLEHTFYPAEDRFEPLLEHSEPVNFVPKENAKSYVRQGFASPHQSLMDNLVDSTESTKRSENFVSHIPLTPSHSGQSEKLMSTRTSHSPYISPTMSYTNHSPANLTRNSSFNHQHYSTTLRSPPSMRGRGIDVNSSHYPHISRPRTSSDSQKMYTRAPVDYYYIQENPYFNNIDQDSISDKSLPSTNQSLHHSEEDTESDNDFSESIHPEFDIDVFYKVSNILYDESDLQDPEKRERLEWHSMLSSVLKGDVMQTEKRRLRLTEPDGHSGTYISEVWLGLQAWLHGRLNADQAEVIRKSREGVEPVLREVIDFQIQDEETTKPPLEQVTEILEKVEQCKQFYISSREMEENVPLSASKEFNYKLNALISWSNVMESIQVETLVLQKWVGNDEFDLTMRTPQFNYDGVENTSSFVERIFRQSGLQRTFEQRTLTTLNRIIHQAKQTISENAQAFEEMKLPTYEDKLLPLVRFPIKLLEEALRLRLAYAKKIKGPNFLIVDSMLDDFKIALSVAVRIKREYIKIASPSPGWSLPTNVDEDYDNVLLDSLKFYFKLLTLKLSSGNKNLYFKEIDFLENEWAFLNEHIYWINGGDIHMAGQFSYLSNSLLLNVHRYVESHLNGPTERTAASLTNWYSTLLKNTQIRFRKILRFSETLNSRFENASDFVISEGHLPDLVNRLSTTGHFLAYTANLERDGVFVIADHTLSENPEALKALLFSKDISNLETIQQNCSYVLILCPVHPIVWKGRIEKVDVPDFSVDLKTNRVRIIASNKREHLQAAKSVFQSISGDLVTLAVECRSSITRVYKEFIRLSKLCMRISSTVVDCVSAVREACSGVNCHDLIYHVFSFAAEFGQRILRFLSFDSYWQTKLKRKITSLAVEWISFICDECDLMDRKTFRWGVGALEFLMLMIRGNNILLIDDAMFLKIREKVGKSMAFLLTHFDVLGAKSKVAAKLQRESTEVSSSPRLTSFGDVEEEALSIQLLQKETMLRIDELEIERNNTLLERLAIGHVLDDSVFRNRDFIKLASSFSNITIRWQQGHFVRSGMFGDVYTGVNMETGDLLAVKEIKLQDSRTFRSTVDQIHNEMTVLERLNHPNVVTYYGVEVHREKVYIFMEFCQGGSLADLLAHGRIEDENVLKVYVVQLLEGLAYIHSQHILHRDIKPANILLDHRGMIKYSDFGSALYVSPPTDPEVRYEDIQPELQHLAGTPMYMAPEIILGTKKGDFGAMDIWSLGCVILEMMTGSTPWSEMDNEWAIMYHVAAMHTPSIPQNEKISSLARDFIEQCFERDPEQRPRAVDLLTHPWITDFRKKTIITMPPATITKKTSLSHTITEEKTAQLLAGRHDDSKAETDSLAASYKEESALPVASNVGLRQPNELRIDSINLPPAIVTPDTINYSVD

SEQ ID NO: 10491 - protein, 543 aa, Bacillus halodurans C-125
MKAVRSVLDYLAKGGVDTVFGIPAGSVNAFFDELYSMPQMTPVIAKHEGAASYMAAAYAKYSGQLAVAIGCSGPGSTNLLTGAANAMREQLPILFLTGAVPTNTEGLNASQELDVQPLYAPVTKYSVTVRKGSDLLSEVEKAVTIALSPVPGPVHVAMPIDVQLETIEPPDLPSYPTQPRTMPSNQSVKQAARELTELKNGIVFIGQGVRRAVREAIEMAERLRWPIVTTPQAKGYIPSGHPLNKGVFGFAGHTTASDLLNGEEGDGLFIIGSSLGETATNNYNKKLTDGRYVIQLDHDKTVFNRKYKIDFPIVGDVKITLTELNLELERLGRDHQPQPIARVENKVNKEYTTQHLLLSIQQALPPTTRYHIDIGEFMSYVIHYMDVYEPDTFNINVHFGAMGTAIGSAIGAAMVDRKRPTVCITGDGCFFMHGMEVLTAKEYGLPILFVIVNNARLGMVYHGHALQYERTHPRFEQAPVNLSKLLESVGIPTARIESLADLKEERISSLLPTDGPAILELAIVDSQIPPMGDRVKFLSSFGK

SEQ ID NO: 10492 - protein, 415 aa, Lunaria annua
YPHSYTFFFFFMFVVLVLFRHVFSINTLSSTETLTISSNRTIVSPGDVFELGFFKTTTTSRDSDRWYLGIWYKSSSERIYVWVANRDNPLSNSIGTFKISYANLILLDQSDTPVWSTNLTKAVNSPVVAELLANGNLVLRDSKTKNKDLNRFLWQSFDFPVDTLLPEMKIGWDLKTGHNRFLSSWKSSDDPSSGDFSFKLETQVLPEFYLWNKESRVYRTGPWNGIWFNGIPKMQEWSYIVNSFIKNKDEVAYTFKVTNPIIHTRFTLSYNGLLQGITTINEPNMFWFLPEDKCDVYKRCGPYSYCDMETTPVCNCIRGFEPKNAKAWALGETFDGCVRKKRLSYGGYGFLLMKMMKLPETSKVIVDERIGLKECEDKCGKDCNCTGFANLDIRNGGSGCVVWTEELVDMRNYIA

SEQ ID NO: 10493 - protein, 416 aa, Moricandia arvensis
YHHSNTLFFVMLVLFPHVLSTNTLSSNEALTISSNKTLVSPGDVFELGFFKTTTRNSTDRWYLGIWYQTTSERTYVWVANRDNPLHNSNGTLKVSHANLVLLDQSDTPVWSTNITRPVTSPVTAELLANGNFVVRGSYTIDQSHFMWQSFDFPVDTLLPEMKLGWNNKTEHGRFLTSWKSPTDPSSGDFSFGLETHEGLHEFYLLKDEYEMYRTGPWNGARFSGIPKMQNWSYIVNSFIDNKEEVSYSFHVNNNHNNIHSRFRMSSTGSLQVITWTSTTPQRNMFWSFPEDACDAYQMCGPYAYCDMNTTPTCNCIKGFVPKDADAWALRDASGGCVRSSRLSCGEGNGFLRMGQMKLPETSTGAVGDKRIGLKECKERCVRDCRCTGFANMDIRNGGSGCVIWTGELMDMRNYGA

SEQ ID NO: 10494 - protein, 419 aa, Neisseria lactamica
FTVPARIVLEDPEEWFENGQAFDGSSIGGWKGIQASDMQLRPDPATAFVDPFYDDVTVVITCDVIDPADGQGYDRDPRSIARRAEAYLKSSGIGDTAYFGPEPEFFVFDGVEFETDMHKTRYEITSESGAWASGLHMDGQNTGHRPAVKGGYAPVAPIDCGQDLRSAMVNILEELGIEVEVHHSEVGTGSQMEIGTRFATLVKRADQTQDMKYVIQNVAHNFGKTATFMPKPIMGDNGSGMHVHQSIWKDGQNLFAGDGYAGLSDTALYYIGGIIKHAKALNAITNPSTNSYKRLVPHFEAPTKLAYSAKNRSASIRIPSVNSSKARRIEARFPDPTANPYLAFAALLMAGLDGIQNKIHPGDPADKNLYDLPPEEDALVPTVCASLEEALAALKADHEFLLRGGVFSKDWIDSYIAFK

SEQ ID NO: 10495 - protein, 577 aa, marine gamma proteobacterium HTCC2143
MTKYAHLNPSLENPFVEAREREFVVPGQINYEPGLYEESLKSGQALIDRPRVAAGVVNIEKQHLKNRMTVWERLDVLADVGTEPTVLFQNWGPNLDGASIVTAIVKINGRDVAVYGHDFTVRAGSMDATNGKKLARLFQLAGKRKIPLVGMNDSAGAFIPAGVGGLEGYAEAFTALRKISGVVPSIMCMFGFNAGGGSYLPRQGSFVIQPNDTFFGLTGPGVVKSVLGEDVTADELGGPSVHSQTGVADFVVPDEVSALLTAKQLLNYLPANNNEQAPFQPTSDPIDRKTWDIDILLRKAFNSPTGYNTPLDISILIQQLCDHGDYFEIQPDRARNTICALGRMGGNVIGFVANNSAVGSGQIDIDAAYKNARFIRFCNLYNIPVIFMEDTTGFRPGKDQESNGIVQAGRAMLDAIVDLRTPRFLLLVRNAYGGAYASYNNYPTGADLVVALPTTRVAVMGPAGVDFVYKKELRQIRSSSIERVAVATEEQINNGLSEKEAKIAAQAAVADWSKREEALLAIRYEKELLNPNEALSLGSISQIVMPSDLRKVLGENMAFHLDHYQAEPLNAVQREFF

SEQ ID NO: 10496 - protein, 420 aa, Sinapis alba
YHHSCTIFFVVLLQFHHHVFSINTLSSNEALTITSNKTLVSPGDVFELGFFKTPTSNSQDGTDRWYLGLWYKTTSDQRTYVWVANRDNPLHSSTGTLKISHANLVLLDQSDTPVWSTNLTGVVQLPVTAELLDNGNFVLRDSKTKDLNQFMWQSFDFPVDTLLPEMKLGRKLNSPENEKILTSWKSPTDPSSGDYSFILETEGFIHEFYLLKNEFTVYRSGPWNGVRFNGIPKMQNWSYIVNSFTDNKEEVAYTFRVNNHNIHTRFRMSSTGYLQVITWTKTVPQRNMFWSFPEDTCDVYKMCGPYAYCDMHTTPMCNCIKGFVPKNAGRWDLRDTSGGCVRSSRLSCGEGDGFLRMSQMKLPETSEAAVDKMIGLKECKEKCVRDCNCTGFANMDIMNGGGSGCVTWTGELVDMRNYVA

SEQ ID NO: 10497 - protein, 462 aa, Rhodobacter sphaeroides 2.4.1
MATFDVIIIGAGPGGYVSAIRCAQLGLKTAVVEGREALGGTCLNVGCIPSKALLHATHNLHEVHENFEKMGLMGAHPTVDWSKMQGYKQEVVDGNTKGIEFLFKKNKITWLKGWGSIPEPGKVKVGEEIHEAKSIVIATGSEPASLPGVEADESVIVTSTGALSLGRIPETMVVIGAGVIGLELGSVYARLGTKVTVVEYMEAILPGMDAEVVKTTQRILAKQGLSFVLGAAVKGATVSDGKATVTWAAKKDGKETSLTVDTVLVATGRKPFTEGLGLEALGVEMLPRGVVKIDDHFRTSVPGIYAIGDCVPGMMLAHKAEDEGVALAEILAGKHGHVNYGVIPGVIYTTPEVASVGRTEESLKEEGRAYKVGKFPFMGNARAKAVFQAEGFVKMIADKETDRILGCHIIGPAAGDLIHEVCVAMEFGASAQDLAMTCHAHPTWSEAVREAALACGDGAIHA

SEQ ID NO: 10498 - protein, 414 aa, Thermus caldophilus
MVKVEVLGMILAGGQGSRLYPLTAKRAKPAVPFGAKYRIIDFVLNNFVNSGIYAIYVLTQYKAQSLTEHIQRYWRFGAFLEDHFILLVPAQMYRYEELGPVWYRGTADAIYQNLHLVHNHAPKAVAVFGGDHIFKMNIRHMVEYHYDTRADITIAAYPVPVAEATRFGVLQVDEEWRITEFQEKPEEPKPIPGRPDMALASMGNYIFRTEALFELLEADARDETSAHDFGKGVIPRAIRVGYRVYAYDFHRNPIPGQEGPNLYWRDVGTLDAYYEASMDLVKVDPVFGLCSPVWPLRTANLFSPPAKFVHETGERVGRALNSLLAGGVIVSGGTVRESVLFRRVRVNSYSLVERSVLFDDVEVGRYCRIRNAIIDKNVKIPPHTEIGYDLELDRARGFTVTPEGVVVVPKGYRF

SEQ ID NO: 10499 - protein, 510 aa, Rhodobacter sphaeroides 2.4.1
MMGTEVRVPTLGESVSEATVATWFKKPGDRVAADEMLCELETDKVTVEVHAPVAGRLVEIVAPEGTTVAVSALLAQIGAAEAGEDPAPEKTHAGAEAKAGAGESKMIDVMVPALGESVSEATVSTWFKKPGDTVAQDEMLCELETDKVSVEVPAPAAGVLAEILVTEGTTVAAGSKLALISSDGQGVAAAPKAETPKKTEAAPAQEPAPKKDVEDAPSARKAMAEAGLSPDAVQGTGRDGRIMKDDVARAVSGASQAAAPTPAPQPALPRQPVPADDAAREERVKMTRLRQTIARRLKEAQNTAAMLTTYNEVDMSGVMGLRNEYKDAFEKKHGTKMGFMSFFVKACCHALKEVPEVNAEIDGTDIVYKNYVHMGVAVGTPSGLVVPVVRDADQMGFAQIEKKIAELGLRARDGKLSMAEMQGGSFTISNGGVYGSLMSSPILNPPQSGILGMHKIQERPVVEKGQIVIRPMMYLALSYDHRIVDGKGAVTFLVRVKEALEDPRRLLLDL

SEQ ID NO: 10500 - protein, 420 aa, Sinapis arvensis
YHHSNTFFFVVLVLFPHVFSTNTLSSNDALTISSNKTLVSPGNVFELGFFRTTTRNSQDGADRWYLGIWYKTTSDQRTYVWVANRDNPLHNSIGTLKISNANLLLLDHSDSPVWSTNLTGVVEPPVTAELLANGNFVLRGSYSTEDEFMWQSFDFPVDTLLPEMKLGWNRKPGPERILTSWKSPTDPSSGDFSFMLETHTIGLHEFYLRKNEFIMYRTGPWNGVRFSGIPKMQNWSYIVNSFVDNHKEVAYTFHVDNHKINSRFRMSSTGYLQVITWTMTVPQRNMFWSFPEDTCDLYQVCGPYAYCDMNTAPTCNCIKGFVPKNAAQWELRDASGGCVRSSRLSCGEGDGFLRMSQMKLPETSEAVAVLVDKRNGFKECKERCIRDCNCTGFANMDSMNGESRCVIWSDELLDMRKYVA

SEQ ID NO: 10501 - protein, 397 aa, Rhodobacter sphaeroides 2.4.1
MNIHEYQAKALLRSYGAPVSDGRVVLKADEAKSAAGELGGPLWVVKAQIHAGGRGKGKFKEPEAGEKGGVRLAKSVGEAAELAKQMLGRTLVTHQTGPAGKQVNRIYIEEGSDIARELYLALLVDRGTSRISFVVSTEGGMDIEEVAASTPEKIVSFSVDPASGLSDFHGRRVAFALGLEGAQVKQCVQLVKNLYRAFVEKDMEMLEINPLIVMTDGNLKVLDAKVGFDNNALYRQSDVMALRDETEEDPKELAASKFDLNYIALDGEIGCMVNGAGLAMATMDIIKLYGAEPANFLDVGGGATKEKVTEAFKIITSDPNVKGILVNIFGGIMRCDIIAEGIIAAVKEVGLQVPLVVRLEGTNVEKGKEIIANSGLNVIAGDNLSDAAQKIVKAVKG

SEQ ID NO: 10502 - protein, 420 aa, Sinapis arvensis
YHHSYTFFFVVLVLFPHVFSTNTLSSNDALTISSNKTLVSPGDVFELGFFRTTTRNSRDGTDRWYLGIWYKTTSDQRTYVWVANRDNPLHNSIGTLKISNANLVLLDHSDTPVWSTNLTGVVEPPVTAELLANGNFVLRGSYSTDDEFMWQSFDFPVDTLLPEMKLGRNRKPGPERILTSWKSPTDPSSGDFSFMLETHTIGLHEFYLRKNDFIMYRTGPWNGVRFSGIPKMQNWSYIVNSFVDNHKEVAYTFHVDNHKINSRFRMSSTGYLQVITWTMTVPQRNMFWSFPEDTCDLYQVCGPYAYCDMNTAPTCNCIKGFVPKNAAQWELRDASGGCVRSSRLSCGEGDGFLRMSQMKLPETSEAVAVLVDKRNGFKECKERCTRDCNCTGFANMDSMNGESRCVIWSDELVDMRNYVA

SEQ ID NO: 10503 - protein, 338 aa, Vitis vinifera
MDHEADSHRTDLMTITRYVLNEQSRHPESRGDFTILLSHIVLGCKFVCTAVNKAGLAKLIGLAGETNVQAKQKKLDVLSNEVFIKALVSSGRTCILVSEEDEEATIVEPSKRGRYCVVFDPLDGSSNIDCGVSIGTIFGIYMVKDGGEPTLDNVLQPGKNMLAAGYCMYGSSCTLVLSTGTGVNGFTLDPSLGEFILTHPNIKIPKKGKIYSVNEGNTKNWDAPTAKYVEKCKFPKDGSSPKSLRYIGSMVADVHRTLLYGGIFLYPADKKSPNGKLRVLYEVFPMSFLMEQAGGQAFTGKQRALDLVPKNIHERSPIFLGSYDDVEEIKALYAAEEK

SEQ ID NO: 10504 - protein, 263 aa, uncultured marine bacterium 560
MINFDYKNKVAVVTGGTSGIGLATVRILLKSGAKVAFCARSRERLLEVESKLKLEFSNDQVFAKALSVLDQNDVNKFSKDVESQFGKCDLLVNNAGQGMISTFNTTDDDDWKSEYELKIFSQIYPIRAFQSMLKKENGSVVVVNSLLAIQPEQHMICTSSARAAVQNLIKSLSVEFAPQIRFNSILLGLIKTNQWESRFEDREDKSINRNDWYQNLALNKGIPLGRLGNPEEVASAIAFLGSSDSSYITGAQLEISGGLSKHI

SEQ ID NO: 10505 - protein, 780 aa, Sulfolobus acidocaldarius
MRINILRVEYHSKTAHSILLQLDLFKKVKVICHMSQSIKFRVTEARQRDVGKKVARISETSMRKLNVEAGDYIEIIGQDGNSALAQVMPAYDISDDEIRIDGYIRKSIKVGIGDDVTVRKTNVSPASKVVLAPTQPIRFDNSFVEYVKDTLMDKPLAKGETLPIPIYTGTLELTVVNTQPSNYVYVTGSTNIEIREEPVKESSLAYPKVSWEDIGDLEEAKQKIREIVEWPMRHPELFQRLGIDPPKGILLYGPPGTGKTLLARALANEIGAYFITVNGPEIMSKFYGESEQRIREIFKEAEENAPSIIFIDEIDAIAPKREDVTGEVEKRVVAQLLTLMDGIKGRGRVIVIGATNRPDAIDPALRRPGRFDREIEIRPPDTKGRKDILQVHTRNMPITDDVDLDKLAEMTYGYTGADLAALAKEAAIYALRRFVDEKKLNLDQPTIPAEIIKELKVSMNDFLNALKSIQPSLLREVYVEVPKVNWNDIGGLDNVKQQLREAVEWPLRFPELFTKSGVTPPKGILLFGPPGTGKTMLAKAVATESGANFIAVRGPEILSKWVGESEKAIREIFRKARQAAPTVIFFDEIDSIAPIRGLSTDSGVTERIVNQLLAEMDGIVPLNKVVIIAATNRPDILDPALLRPGRFDRLIYVPPPDKTARFEILKVHTKNVPLAEDVSLEDIAEKAEGYTGADLEALVREATINAMRSIYSMCDKQSRDECKGNMECYQKHIKECMNKTSFKVSKEDFEKALNVVKASLTQADIQRYERFSKELKRAIA

SEQ ID NO: 10506 - protein, 582 aa, Zea mays
ARDHYLEHPNRKIKPPPSPPTPAPPSFHTHLDPPNPNPSGRTAAMAESGESSPNSAAATDDTHHEMPEAGAAAAAVHAQPRPPPPPSKVRLMVSYGGRIQPRPNDNQLAYVNGETKILSLERPLCFPDFAARLAALVGNAADVRVKYQLPGEDLDALVSVTNDEDLEHLVHEYDRLHVHRHATASSAGSSRGGSAPRLRVFLFPVQSPPPPPQPAGILEPKVEQRQWFVDALNTVLLPSSKQDPPPVPPQQQKQEQESVFAQQSPPPQAKHEAVFVQQSPPQPQTVVQMQMPPPQHVVLAAASPDYLFGLDNGFVHPPAVKVKDPAGDPPAVRESVPVELPAKNEDRHPIPNPAGDNVAVSPAEYQRQIPGLEKLQVADNAAHQPPPPAPAPAPAPSLAPTPVPAALPRNGSDDSLTRGYPLATPTPNSSAEYYLPKFPEKPPVPPPPQSSAPPPPTYLQVQGRYTSVAPGSGADRGPVFFIPAPHGYFAATASPGATSYPAVYAVAPPSTAANGSAASPAASNATAYSPAPTQVAYDSNGRAIYYTSMLPQYPSAVNGMSSAGAVLGTEPVNPVAVKPTVS

SEQ ID NO: 10507 - protein, 664 aa, Yarrowia lipolytica CLIB122
EITALFHGCLLTHGSSTHALPQHTLSPSATSTHTTMGLLNSADKEKIKRVVPKNTNKVIDCTIARLYIAYPDPDNWQYTGLSGALALVDDLVGHTLFLKLIDIHGSRGVLWDQELYVGVNYFQDRTFFHSVELEDCFAGFLFEDESEAAHLFKRIQNREKYASKDTVKNKNAIALKKAAPAEKAAVGPRGEPRTRLGYSGPVYYDDEPPEEWRALYRELEEQGITPEMIADNTEFIKEHIRQTGGPLVGLEPPIPRNRGRGRSTSNATSSSADTNARKPPPPPPPAAAAESTQNNDRRAAPPPPPASAPPSYSSTPEPDLPATPAAPSDPPAAVAPPRRFNVPPPPSFMGKNAGAPPPAATPASPTAAAAPPALPGRSLPPSLPSRGSPAPPALPGRSVPPPPELPGRAVPAPPPSLPARGGTPAAGGPPPPPPPRDGATPLSRPPPPPSRSAIPPPAAAPTAYTPPPPPAAASPAAAQSSYTPPPPPPPPASSRPVPGVPGGVPPPPPPPPPGPGPAAAGGPPPPPPPPPGAAPSFGSAAPPPPPGPPPAMSGGPPPPPPPPGDFGVTPGPPPPPTGDAGRDALLSSITAAGGIGSLKKVDKSQLDRPSVMLQEARGESPTIPSAAPGAPGGGNSLADALASALNKRKGQVSKSDDESDGDDW

SEQ ID NO: 10508 - protein, 267 aa, Silicibacter pomeroyi DSS-3
MPETDVDLLIRAAREAGQIATRYSGRDARRWDKPDGAGPVTEADLAVNAMLAQMLPAARPGYGWLSEETEDTAARLDHDRVFIIDPIDGTRSFAEGSRTWAHALAVADRGVVTAAAVYLPQRDLLFSASAGGGAFLNGAPIRVSAPAHLAQAHILAARPNLQPEHWTGGQVPAFHRDYRPSLAYRLALVAQGRFDGMLTLRPSWEWDIAAGELILREAGGLCTDRSGAALRFNNPKPRLDGVIAGGHTVHRGLFGALDPASAGIAAH

SEQ ID NO: 10509 - protein, 167 aa, Candidatus Protochlamydia amoebophila UWE25
MAKNNESPKKEREKAESDLTEKVLHINRCSKVVKGGRKFSFSALILVGDGKGRIGYGFAKANELTDAIRKGGEAARKNMISCPTEGTTIPHEVTVQWDGASVLLKPAPFGTGVIAGSKVRAVLELAGIKDVMAKNLGSSNPINQVKATFQAIQQLLTRDEIKQRRGV

SEQ ID NO: 10510 - protein, 355 aa, Oryza sativa Indica Group
MENGGGGGGDGGKSDVPADANEHCPGTQSEEAGKADACAGCPNQQICATAPKGPDPDLVGIVERMATVKHKILVLSGKGGVGKSTFSAQLSFALAEMDCQVGLLDIDICGPSIPKMLGLEGQDIHQSNLGWSPVYVESNLGVMSIGFMLPNPDDAVIWRGPRKNGLIKQFLKDVDWGEIDYLVVDAPPGTSDEHISIVQYLQATGIDGAIIVTTPQQVSLIDVRKEINFCKKVGVPILGVVENMSGLRQVLSDFRFVKQGEGGETDATEWALNYIKEKAPELLTMVACSEVFDSSKGGAEKMCNEMGVPFLGKVPMDPQLCKAAEEGRSCFVDQKCSASAPALKSIVKKLIENQD

SEQ ID NO: 10511 - protein, 313 aa, Bordetella pertussis Tohama I
MTPPTTQNGPLRHFLQFKDFSPAEIAYVLERTRIIKDKFKRYEPHMPLHDRTLAMVFEKASTRTRVSFEAGMYQMGGSVINLTSNDSQLGRSEPIEDTARVISRMVDIVMIRTFEQTRIERFASHSRVPVINGLTNEYHPCQILADIFTYIEHRGPIAGKTVAWIGDANNMSYTWLQAAEMLGFTLHVSTPAGYELDPARIGAPAAGVLKQFKDPMQACQGAHLVTTDVWTSMGYEAENEERRAAFADWCVDAEMMAAADPQAVFMHCLPAHRGEEVTGEVIDGAQSVVWDEAENRLHVQKALMEFLLLGQLA

SEQ ID NO: 10512 - protein, 451 aa, Pseudomonas aeruginosa PAO1
MSFDFDLFVIGAGSGGVRAARFAAGFGARVAVAESRYLGGTCVNVGCVPKKLLVYGAHFSEDFEQARAYGWSAGEAQFDWATLIGNKNREIQRLNGIYRNLLVNSGVTLLEGHARLLDAHSVEVDGQRFSAKHILVATGGWPQVPDIPGKEHAITSNEAFFLERLPRRVLVVGGGYIAVEFASIFNGLGAETTLLYRRDLFLRGFDRSVREHLRDELGKKGLDLQFNSDIARIDKQADGSLAATLKDGRVLEADCVFYATGRRPMLDDLGLENTAVKLTDKGFIAVDEHYQTSEPSILALGDVIGRVQLTPVALAEGMAVARRLFKPEEYRPVDYKLIPTAVFSLPNIGTVGLTEEEALSAGHKVKIFESRFRPMKLTLTDDQEKTLMKLVVDAHDDRVLGCHMVGAEAGEILQGIAVAMKAGATKQAFDETIGIHPTAAEEFVTLRTPTR

SEQ ID NO: 10513 - protein, 578 aa, Kluyveromyces lactis NRRL Y-1140
MSGSRSFLSQLNVFNKDNYEISTDSKTLDTDANPTGTSDDNRSVETGEHFDVELDKGSKKLGLISCIGLICNRMLGTGIFAVSSTIYTLSGSVGLALIMWAVGAIIALAGLYVYMEFGTAIPRNGGEKNYLERIFPAPKFFVTCMYGAYVFFLGWAAGNSVNTAVMFLTAANADITEWNQRGIGVAVVGFAFLINSVNVKVGLYIQNILGIFKIGVVLFIAVTGWVALGGGLKDGYKTDNFHNAFEGTGNATAYGIVNALYNVIWSFVGYSNVNYALGEVKNPVRTLKIAGPTSLIFLAIVYIFVNIAYFAVVPKEVFRTSKLILVADFFELAFKSDSAKKAASVLVGLSALGNVMSVIFSQGRIIQQLGREGVLPFSNFFATSKPFDSPCVGLFQHFIVCTVTIIAPPAGDAYNFVLNLISYPMNIVNFFISAGLLWIHWERKKGRTMWDPPIKAGIPVIAFFMLANLYLIVAPYIPPSNGESVYQSLPYWIHCVVAWGIFAVGGIYWVVWAVVLPKIGKYELVHEEVLGEDGFWRQKIAKRKINEANAEQISFELEKVSNSTGFEKIPDQHTVTIA

SEQ ID NO: 10514 - protein, 432 aa, Tropheryma whipplei TW08/27
MSKIKLVTAIPGPESERLHRIRQATVARGVSSTFPIYIKESHGSILIDEDGNHLIDMGCGIGVTTLGHSHPAVVDAARAQINSVWHTLFSITPYESYVEVCKLLAKNTPGDFPKKSLLLNSGAEAVENAVKISRAYTGRPTVAVLDRSFHGRTNLTSSMTYRGSLYSSDFGPTASNIVSAPNSYPLHDRLSGKEAAARTISYLETRVAARNIACLFYEPIQGEGGVIVPADGFLPALQDWCRENDIVFVADEIQSGFGRTGCFFASETDGLEPDIVCSAKGIANGLPLSAVTGRSDIVDAARPGTLGGTFTGNHVSCAAALEVFEQYKDNAPLDSASRLGDILKELLLNLQSKHPQIAEVRGRGAMFGAEFSGNHAGEMVSRVITRAAELGVIFLSSGVEGNVVRFLPNVFMDKETIEEAIGVLDSAISSVV

SEQ ID NO: 10515 - protein, 419 aa, Neisseria polysaccharea
FTVPARIVLEDPEEWFENGQAFDGSSIGGWKGIQASDMQLRPDASTAFVDPFYDDVTVVITCDVIDPADGQGYDRDPRSIARRAEAYLKSSGIGDTAYFGPEPEFFVFDGVEFETDMHKTRYEITSESGAWASGLHMDGQNTGHRPAVKGGYAPVAPIDCGQDLRSAMVNILEELGIEVEVHHSEVGTGSQMEIGTRFATLVKRADQTQDMKYVIQNVAHNFGKTATFMPKPIMGDNGSGMHVHQSIWKDGQNLFAGDGYAGLSDTALYYIGGIIKHAKALNAITNPSTNSYKRLVPHFEAPTKVAYSAKNRSASIRIPSVNSSKARRIEARFPDPTANPYLAFAALLMAGLDGIQNKIHPGDPADKNLYDLPPEEDALVPTVCASLEEALAALKADHEFLLRGGVFSKDWIDSYIAFK

SEQ ID NO: 10516 - protein, 356 aa, Oryza sativa Indica Group
MVSVRAYDWIWLFYGFGRIGRLVARVALQSEDVELVAVNDPFITTEYMTYMFKYDTVHGQWKHHEVKVKDSKTLIFGTKEVAVFGCRNPEEIPWAAAGAEYVVESTGVFTDKDKAAAHLKGQAVDLFSIIFHMQGGAKKVVISAPSKDAPMFVVGVNEKEYKSDVNIVSNASCTTNCLAPLAKVINDRFGIVEGLMTTVHAITATQKTVDGPSMKDWRGGRAASFNIIPSSTGAAKAVGKVLPALNGKLTGMAFRVPTVDVSVVDLTVRLEKPASYDQIKAAIKEEAEGKLKGILGYVEEDLVSTDFQGDSRSSIFDAKAGIALSDTFVKLVSWYDNEWGYSTRVIDLIRHMHSTN

SEQ ID NO: 10517 - protein, 215 aa, Haemophilus influenzae 86-028NP
MNQSILSPFGNTAEERVLNAINAFKHGTGVLVLDDEDRENEGDLIFPAETITSEQMAKLIRYGSGIVCLCITDERCQQLDLPPMVEHNNSVNKTAFTVTIEAAKGVSTGVSAADRVTTIQTAIADNAVPTDLHRPGHVFPLRAANGGVLTRRGHTEASVDLARLAGFKEAGVICEITNDDGTMARTPEIVEFAKKFGYSVLTIEDLVEYRLAHNI

SEQ ID NO: 10518 - protein, 419 aa, Neisseria mucosa
FTIPARIVLDDPEEWFENGQAFDGSSIGGWKGIQASDMQLRPDPATAFIDPFYDDTTVVLTCDVIDPADGQGYDRDPRSIARRAEAYLKSTGIGDTAYFGPEPEFFVFDGVEFETDMHKTRYEITSESGAWASGLHMDGQNTGHRPTVKGGYAPVAPIDAGQDLRSAMVNILEELGIEVEVHHAEVGTGSQMEIGTRFATLVKRADQTQDMKYVIQNVAHNFGKTATFMPKPIMGDNGSGMHVHQSIWKDGQNLFAGDGYAGLSDTALYYIGGIIKHAKALNAITNPSTNSYKRLVPHFEAPTKLAYSAKNRSASIRIPSVNSSKARRIEARFPDPTANPYLAFAALLMAGLDGIQNKIHPGDPADKNLYDLPPEEDALVPTVCASLEEALAALKADHEFLLRGGVFSKDWIDSYIAFK

SEQ ID NO: 10519 - protein, 339 aa, Candidatus Protochlamydia amoebophila UWE25
MAVNIAINGFGRIGRLVCRLAIEREDIRIIAINDLVPADNLAYLLKFDSTHGRFKGEIKVEENAIHVNGKKILIFSEKDPQNLPWNDLKIDYVVESTGLFTTSELAGKHLIAGAQRVVISAPAKGDVPTFVMGVNEKNYNPATDRIVSNASCTTNCLAPITKVLLDNFGIDEGLMTTIHAVTASQPTVDGPSKKDWRGGRGASQNIIPASTGAAKAVALCLPQVKGKLTGMAFRVPNADVSAIDLTVRLSKETSYEDICQAMKNASEGAMKGILAFCDEQVVSSDFISSPYSAIFDKDAGITLNSKFYKLIAWYDNEMGYACRVIDLVSYMNCCNNNSL

SEQ ID NO: 10520 - protein, 401 aa, Solanum tuberosum
MAVKKSVGSLKEADLKGKRVFVRVDLNVPLDDIFNITDDTRIRAAVPTIKYLMQNGARVILASHLGRPKGVTPKYSLKPLVPRLSELLAIEVKMANDSIGPEVENLVAELPEGGVVLLENVRFYKEEEKNDPEFAKKLASLADLYVNDAFGTAHRAHASTEGVAKVLKPAVAGFLMQKELDYLVGAVSNPQKPFAAIVGGSKVSSKIGVIESLLEKVDVLLLGGGMIFTFYKAQGYAVGSSLVEEDKLDLATSLMEKAKTKGVSLLLPTDVVIADKFAADANSKIVPASEIPDGWMGLDIGPDAIKSFGSALDTTKNIIWNGPMGVFEFDKFAAGTEAIAKKLAELSGKGVTTIIGGGDSVAAVEKVGLAEKMSHISTGGGASLELLEGKPLPGVLALDDA

SEQ ID NO: 10521 - protein, 419 aa, Neisseria cinerea
FTVPARIVLKDPEEWFENGQAFDGSSIGGWKGIQASDMQLRPDASTAFVDPFYDDVTVVITCDVIDPADGQGYDRDPRSIARRAEAYLKSSGIGDTAYFGPEPEFFVFDGVEFETDMHKTRYEITSESGAWASGLHMDGQNTGHRPAVKGGYAPVAPIDAGQDLRSAMVNILEELGIEVEVHHSEVGTGSQMEIGTRFATLVKRADQTQDMKYVIQNVAHNFGKTATFMPKPIMGDNGSGMHVHQSIWKDGQNLFAGDGYAGLSDTALYYIGGIIKHAKALNAITNPSTNSYKRLVPHFEAPTKLAYSAKNRSASIRIPSVNSSKARRIEARFPDPTANPYLAFAALLMAGLDGIQNKIHPGDPADKNLYDLPPEEDALVPTVCASLEEALAALKADHEFLLRGGVFSKDWIDSYIAFK

SEQ ID NO: 10522 - protein, 419 aa, Neisseria pharyngis subsp. flava
FTIPTRIVLDDPEEWFENGQAFDGSSIGGWKGIQASDMQLRPDPATAFIDPFFDDTTVVLTCDVIDPADGQGYDRDPRSIARRAEAYLKSSGIGDTAYFGPEPEFFVFDGVEFETDMHKTRYEITSESGAWASGLHMDGQNTGHRPTVKGGYAPVAPIDAGQDLRSAMVNILEELGIEVEVHHSEVGTGSQMEIGTRFATLVKRADQTQDMKYVIQNVAHNFGKTATFMPKPIMGDNGSGMHVHQSIWKDGQNLFAGDGYAGLSDTALYYIGGIIKHAKALNAITNPSTNSYKRLVPHFEAPTKLAYSAKNRSASIRIPSVNSSKARRIEARFPDPTANPYLAFAALLMAGLDGIQNKIHPGDPADKNLYDLPPEEDALVPTVCASLEEALAALKADHEFLLRGGVFSKDWIDSYIAFK

SEQ ID NO: 10523 - protein, 419 aa, Neisseria flavescens
FTIPTRIVLDDPEEWFENGQAFDGSSIGGWKGIQASDMQLRPDASTAFVDPFYDDTTVVFTCDVIDPADGQGYDRDPRSIARRAEAYLKSSGIGDTAYFGPEPEFFVFDGVEFETDMHKTRYEITSESGAWASGLHMDGQNTGHRPTVKGGYAPVAPIDCGQDLRSAMVNILEELGIEVEVHHSEVGTGSQMEIGTRFATLVKRADQTQDMKYVIQNVAHNFGKTATFMPKPIMGDNGSGMHVHQSIWKDGQNLFAGDGYAGLSDTALYYIGGIIKHAKALNAITNPSTNSYKRLVPHFEAPTKLAYSAKNRSASIRIPSVNSSKARRIEARFPDPTANPYLAFAALLMAGLDGIQNKIHPGDPADKNLYDLPPEEDALVPTVCASLEEALAALKADHEFLLRGGVFSKDWIDSYIAFK

SEQ ID NO: 10524 - protein, 511 aa, Geobacillus stearothermophilus
MSKKPVALIILDGFALRDETYGNAVAQANKPNFDRYWNEYPHTTLKACGEAVGLPEGQMGNSEVGHLNIGAGRIVYQSLTRINIAIREGEFDRNETFLAAMNHVKQHGTSLHLFGLLSDGGVHSHIHHLYALLRLAAKEGVKRVYIHGFLDGRDVGPQTAPQYIKELQEKIKEYGVGEIATLSGRYYSMDRDKRWDRVEKAYRAMVYGEGPTYRDPLECIEDSYKHGIYDEFVLPSVIVREDGRPVATIQDNDAIIFYNFRPDRAIQISNTFTNEDFREFDRGPKHPKHLFFVCLTHFSETVKGYVAFKPTNLDNTIGEVLSQHGLRQLRIAETEKYPHVTFFMSGGREEKFPGEDRILINSPKVPTYDLKPEMSAYEVTDALLKEIEADKYDAIILNYANPDMVGHSGKLEPTIKAVEAVDECLGKVVDAILAKGGIAIITADHGNADEVLTPDGKPQTAHTTNPVPVIVTKKGIKLRDGGILGDLAPTMLDLLGLPQPKEMTGKSLIVK

SEQ ID NO: 10525 - protein, 194 aa, Triticum aestivum
MAPTVMASSATSVAPFQGLKSTVGLPVSRRSNGASLGSVSNGGRIRCMQVWPIEGIKKFETLSYLPPLSTEALLKQVDYLIRSKWVPCLEFSKVGFIFREHNASPGYYNGRYWTMCKLPMFGCTDATQVINEVEEVKKEYPDAYVRIIGFDNMRQVQCVSFIAFKPPGCQESGKAYTAHSRQAIYKVPLQYGQL

SEQ ID NO: 10526 - protein, 492 aa, uncultured marine bacterium 560
MIKMPDGKLFIGGEWETGTGKEIVSIFPADGSINCSLYGASKNDVLRAVKLAKSAQSQPSWRSLKPHERARYLYAIADGIEANIDRISQIQTRDTGKTLRETAILASSASGTFRYFGALLESSDDLLTAQRNDSLTMSVYEPLGLVSAITPWNSPIASDAQKIAPALAAGNAVLLKPSSWSPLVSLELAKLVESSGLPKGLFSVLPGSGEEVGNLLVEHPDISKVTFTGSTKTGRSLAIKAAKKLMPISLELGGKSPVIVFKDSDIDIAIAGVMFGIFSSTGQSCIAGSRLFVQKDIYNEFVERLVKATKKLKVGSPYNLDTQVSTMIHPQHRDSVAAYVDLARNEGAKILCGGKSPSGAEYKKGAYYLPTIITQVDNSAQICREEVFGPVLVVMPFDDEADVIEQANENEYGLACGIWTSDFPKAWRVGRAINAGTVWVNTYKQFSISTPFGGEKNSGMGREKGRNGIRAFMSQKSLYFDLTGNSHPWAET

SEQ ID NO: 10527 - protein, 414 aa, Chlorobium tepidum TLS
MPFSALGIIDHLRKALAEEGYNSPTPIQKEAIPVILEGNDLLACAQTGTGKTAAFALPVLQRLHQSRMHGEKRKIRCLVLTPTRELAIQIGESFTAYGRHTGLINTVIFGGVNQNPQTARLVRGVDILVATPGRLLDLIGQGHLHLRDIEYFVLDEADRMLDMGFIHDIRRVLAVLPKKRQSLFFSATMPPEIIKLSAAILHNPKEVMVTPVSSTVEIINQQILFVDRENKNSLLAHLLKERNIESALVFTRTKHGADKVARFLAHHDITAEAIHGNKSQNARQRALGNFKTRQTRVLVATDIAARGIDIDELEYVINIDLPNIPETYVHRIGRTGRAGNRGAAYSFCNAEEKAYLRDIEKLIARKIPVIEDHPFPMVNTIPENAAASKQPARKVPHQKKPSGTHPGNSHWKRK

SEQ ID NO: 10528 - protein, 397 aa, Aspergillus oryzae
MTTMDLRVGNKYRIGRKIGSGSFGDIYLGAYYISLEWQQSGWSILTDRNLGTNIISGEEIAIKLESVKAKHPQLEYEARVYKSLAGGVGIPFVRWFGTECDYNAMVIDLLGPSLEDLFNFCNRKFSLKTVLLLADQLISRIEYIHAKSFIHRDIKPDNFLMGIGKRGNQVNVIDFGLAKKYRDPKTHFHIPYRENKNLTGTARYASINTHLGVEQSRRDDMESLGYVMLYFCRGTLPWQGLKAATKKQKYDRIMEKKMTTPTEVLCRGFPNEFSIYLNYTRSLRFDDKPDYSYLRKIFRDLFVRESFQYDYVFDWTVYKYQKNAAMIVDASNKKDKEAEEQQRRQGVAAAAPMGTPGAAAKPGAISSQRRKVIERGTLENTPDTNRAVGGSDRILRR

SEQ ID NO: 10529 - protein, 489 aa, Debaryomyces hansenii CBS767
MFKRFVSFKAAGKLKLADLNKLTINAKYAVRGKIPIRADELKEQLNDTNNELPFKEIIYANIGNPQQLDQAPLTWYRQVLSVLQNPKLLNSQIDYPKDVIDRAKILLENVGSVGAYSHSQGTPHVRKSVADFITRRDGFPSNSSDIFLTSGASAAVSYLLQVLSSSDRSGFLIPIPQYPLYTATIALNDAVPIGYYLNEENNWSTNPTQIRELIKENNEKGIQIKALVVINPGNPTGSILSYDNIVEIINIAAEHGIAIIADEVYQENVFEGEFVSVKKVLSKLNRLDPQAYNNVQLASLHSTSKGVSGECGQRGGYMELVGFSKEVRDIIFKLASINLCSVVSGQTLMELMINPPTPESPSYELYKSETSKIHKSLQSRADLLYKSFIEMEGITCNKPMGAMYLFPKLNFTPNSYSKLFEASENIGATIDEVYCIELLENTGICCIPGSGFGQVPDTYHLRTTFLPPGSKWIDRWVEFHNDFIAKYKN

SEQ ID NO: 10530 - protein, 247 aa, Griffithsia japonica
MKINIADPQSGAQKMFEIDDEKKLQYLYDMRLAQEVTGVHLGDEFKGYIFRVMGGQDKQGFAMKQGVLTADRVRLLMSKNTQGCRGYGMRKGERKRKSVRGCIISHHISVLHLLVVKNGEQPIDGLTNRQIPRRLGPKRASNIRKLFNLTKEDDVPKYVIRREIPVKDDAQRGAKLGSKARRFSDLLPRSGLHRKRRRIALKKASVAASRKAMAEYEKMIAKRNLEARQSRKTSLSKRRSAKAAAEK

SEQ ID NO: 10531 - protein, 186 aa, Streptococcus mutans UA159
MSLVGKEMVEFSAQAYHQGEFVTVNNEDVKGKWAVFCFYPADFSFVCPTELGDLQEQYATLQSLGVEVYSVSTDTHFVHKAWHDDSDVVGTITYTMIGDPSHVLSQGFEVLGEDGLAQRGTFIVDPDGIIQMMEVNADGIGRDASTLIDKVRAAQYIRQHPGEVCPAKWKEGAETLKPSLDLVGKI

SEQ ID NO: 10532 - protein, 347 aa, Prochlorococcus marinus str. NATL2A
MRVLLTGGSGFIGSHVALLLIERGLDVLILDSFANSSSNVINRINTYLDDKLLKYRLEIINGDIRDKKLLESIFSDSINSHKPIDIVIHLAGLKSVAESLTNPIHYWDVNVHGTLNLLLTMKEYECYSFVFSSSATIYGLSDSVPMAEDHRISPINPYGKTKVAIENMFYDLYNSNNLWKICSLRYFNPVGAHPSGLIGEDPIGIPNNLFPFLTQVAIGKRKFLNVFGDNWDTYDGSGIRDYIHIMDLAEGHLASLDYISSSDSCLEFINLGSGNGYSVFQIIRQFELTTGCQIPFSIQNRRDGDVAISYADISKAKKLLGWTPKRTLEQICLDGWNWQIRNPNGYN

SEQ ID NO: 10533 - protein, 466 aa, Lactobacillus brevis
MENTRMKQMRRSNQSSGPALNCHDLPKYKLAKHALEPRPREADRLVRDQLLDEGNSRLNLATFCQTYMEPEAVELMKDTLEKNAIDKSEYPRTAEIENRCVNIIANLWHAPEAESFTGTSTIGSSEACMLAGLAMKFAWRKRAKANGLDLTAHQPNIVISAGYQVCWEKFCVYWDIDMHVVPMDDDHMSLNVDHVLDYVDDYTIGIVGIMGITYTGQYDDLARLDAVVERYNRTTKFPVYIHVDAASGGFYTPFIEPELKWDFRLNNVISINASGHKYGLVYPGVGWVIWRDQQYLPKELVFKVSYLGGELPTMAINFSHSASQLIGQYYNFIRFGFDGYREIQEKTHDVARYLAKSLTKLGGFSLINDGHELPLICYELTADSDREWTLYDLSDRLLMKGWQVPTYPLPKNMTDRVIQRIVVRADFGMSMAHDFIDDLTQAIHDLDQAHIVFHSDPQPKKYGFTH

SEQ ID NO: 10534 - protein, 393 aa, Bordetella pertussis Tohama I
MSSALANIYARLPVSFTHGRGVWLWDTGERRYLDALAGIGVSCLGHGHPGLVAAISEQAARLIHTSNIYEVPQQAALARRLAELSGMSEVLFNNSGSEANEAAIKLARYYGYKQGNTHAHIITMDSSWHGRTLATLAATGSDKARQGFGPMPSGFIQVPYNDLPAIRAAGEAEPRVTAVLLEVLQGEGGIRPSDMAFLQGVRQLCTERGWLLMIDEVQSGIGRTGKWFAHQWADIRPDVMTLAKGLAGGVPIGAMLAAGPAAGVFAPGSHGTTFGGGPLACAAGLAVIDAIEQEGLLGNAHEVGAHLHAALASELAGAPGVIEVRGRGLMLGIELDRPCGILATRAMEAGLLINVTRERVVRLLPPLILSGEEADQIVRILVPLIKQFLAQQQ

SEQ ID NO: 10535 - protein, 821 aa, Aspergillus oryzae
MSAEPDHTHDKKRVHLQDASGAEKKEELDTATAILKKKKKPNSLIVTDAVNDDNSVIALSNNTMETLQLFRGDTVLVKGKKRKDTVLIVLADDDLDDGSARINRVVRHNLRVKHGDVITVHPCPDIKYAKRIAVLPIADTVEGLTGSLFDVFLAPYFREAYRPVRQGDLFTVRGGMRQVEFKVVEVDPPEYGIVAQDTVIHCEGEPIQREDEEGNLNEVGYDDIGGCRKQMAQIRELVELPLRHPQLFKSIGIKPPRGILMYGPPGTGKTLMARAVANETGAFFFLINGPEIMSKMAGESESNLRKAFEEAEKNSPAIIFIDEIDSIAPKREKTNGEVERRVVSQLLTLMDGMKARSNVVVMAATNRPNSIDPALRRFGRFDREVDIGIPDPTGRLEIMQIHTKNMKLGEDVDLETIAAETHGYVGSDLASLCSEAAMQQIREKMDLIDLDEDTIDAEVLDSLGVTMENFRYALGVSNPSALREVAVVEVPNVRWEDIGGLEEVKRELIESVQYPVDHPEKYQKFGLSPSRGVLFYGPPGTGKTMLAKAVANECAANFISVKGPELLSMWFGESESNIRDIFDKARAAAPCVVFLDELDSIAKSRGGSVGDAGGASDRVVNQLLTEMDGMTSKKNVFVIGATNRPEQLDAALVRPGRLDTLVYVPLPDQASREGILKAQLRKTPVAPDVDLPFIASKTHGFSGADLGFVTQRAVKLAIKQSITADIERQKQREANGEDIKMDEDEEVDEEDPVPELTRAHFEEAMKTARRSVSDVEIRRYEAFAQSLKNSGGSSFFRFPSAGEVQDNNTFGEAGNDDSLYD

SEQ ID NO: 10536 - protein, 96 aa, Chlamydomonas reinhardtii
MSQQAAAVTKVTFKVTLTSDPKLPFRVFSVPEEAPFTAVLKFAAEEFKVPAQTSAIITNDGVGINPQQIAGNVFLKHGSELRLIPRDRVGGISRAR

SEQ ID NO: 10537 - protein, 260 aa, Mesorhizobium loti MAFF303099
MEVIMTKTPFKTLEDKVALITGASSGIGRATAVELARRGAKVIASARRAFEIETLVADIKNEGFEATAVVADVNVEHSVIDLVAKTISTYGRIDIAFNNAGTEGMFSPFVDQTNETYDTIFNANVRGVFWSMKHEAKAMLAQGGGAIINNASMGGVIGFANAGLYIASKHAVLGLTKTASIELFKQGVRVNAINPGIIDTPFQDRIWPSAEAKDAFAASTVPGRAGSPEEMAAVVAFLASDDASFVSGHGLLADGGYSIA

SEQ ID NO: 10538 - protein, 79 aa, Guillardia theta
MSEFSIDSILRESKPYVITIECKNGFIYRGKLIHIEENMNCILKEAFVIKKKKVQKLTLVFLRGSNISMFIIPDILIHF

SEQ ID NO: 10539 - protein, 499 aa, Synechococcus sp. RS9916
MAGRFSQQNQRVRPSSKEDQVVEKAKEHFERTLIQIAGSVAGSVAALEHPSHDEALNYGEIFLRDNVPVMVYLLTQRRYDIVRHFLTVCLDLQSTTYQTRGVFPTSFVEEGDALLADYGQRSIGRITSVDASLWWPVLCWLYVKHSGDEEFGSSQKVQRGIQLLLDLVLHPTFEGTPVLFVPDCAFMIDRPMDVWGAPLEVEVLLYGSLRSCIKLMELSRRHHDSRLLDQRLVLTRQWVHDLRQFLLKHYWVTSKTMQVLRRRPTEQYGDNQHQNEFNVQPQVIPDWLQDWLENRGGYLIGNMRTGRPDFRFYSLGNSLGCLFGLLTSPQQRALFRLVLHNRDHLMAQMPMRICHPPMDGLEWQNKTGSDPKNWPWSYHNGGHWPSLLWFFGASILLHERRHPHADVLLMGQMKALLEESYWSQLNQLPRQQWAEYFDGPTGTWVGQQSRTYQTWTIVGFLLLHHFLRTRPEDVEILDLEELFGTGADNDEASASESQP

SEQ ID NO: 10540 - protein, 446 aa, Streptococcus mutans UA159
MKTHPKKQSLSEVNQSVRVPKNASFLTTLRAFLGPGALVAVGYMDPGNWITSVVGGASYKYLLLSVVLLSSLIAMQLQQMAGKLGIVSRQDLAQATASHLPKRLRYLLFIVIELALMATDLAEVIGSGIALHLLFGWPLLFSIFITILDVFLLLSIMKLGFRKIEAIVSTLILTILVIFVYLVVISHPSFSGIIKGYIPQFAIFDSAQAATNSRLTLALGIIGATVMPHNLYLHSSISQTRQVDYKQKSSIAQAVKFMTWDSNLQLSLAFIVNSLLLILGASLFYGHASEISAFSQMYNALANNHIAGAVASSFLSTLFAIALLASGQNSTITGTLTGQIVMEGFLHLKMPQWLIRLVTRLLALLPVLIAAILYGSQEKILDQLIVYSQVFLSVALPFSIFPLVYFTSQKKIMGEFVNAKWNTYLAYGVATVLTILNLQLIINTIF

SEQ ID NO: 10541 - protein, 250 aa, Salmonella typhimurium LT2
MAVTKLVLVRHGESQWNKENRFTGWYDVDLSEKGVSEAKAAGKLLKEEGFSFDFAYTSVLKRAIHTLWNVLDELDQAWLPVEKSWKLNERHYGALQGLNKAETAEKYGDEQVKQWRRGFAVTPPELTKDDERYPGHDPRYAKLSEKELPLTESLALTIDRVIPYWNDTILPRMKSGERVIIAAHGNSLRALVKYLDNMSEDEILELNIPTGVPLVYEFDENFKPLKHYYLGNADEIAAKAAAVANQGKAK

SEQ ID NO: 10542 - protein, 158 aa, Oryza sativa Indica Group
MLKFLSKVVVEYCPLDPRKAAVVELLAQCNGRKAKDSNPASSVELRRLPSPPPSADAGDQNAHPPPRVLVTYFNGVEESFVAAEGATAQGIRDQILDRGRLLDTEQLFRDGGEKWPVLIPEEELTMSFPGIKVRLFVFFSSQHLAWVCISCNFGWPFR

SEQ ID NO: 10543 - protein, 382 aa, Salmonella typhimurium LT2
MNLKEKTRALFAEIFGYPATHTIQAPGRVNLIGEHTDYNDGFVLPCAIDYQTVISCAPRDDRTVRVIAADYDNQVDEFSLDAPIVTHDSQQWSNYVRGVVKHLQQRNNAFGGVDMVISGNVPQGAGLSSSASLEVAVGTVFQQLYHLPLDGAQIALNGQEAENQFVGCNCGIMDQLISALGKKDHALLIDCRTLGAKAVSMPKGVAVVIINSNFKRTLVGSEYNTRREQCETGARFFQQPALRDVSLEAFNAVASELDPVVAKRVRHVLSENARTVEAASALEKGDLQRMGQLMAESHASMRDDFEITVPQIDTLVDIVKATIGDRGGVRMTGGGFGGCVVALIPEDLVPAVRQAVAQQYEAKTGIKETFYVCKPSQGAGQC

SEQ ID NO: 10544 - protein, 236 aa, Kluyveromyces lactis NRRL Y-1140
MSLLSWVFGSSMTPQERMRKNQRALERAQRELEREKKKLEAQEKKLIQEIKKSAKNGQVNAAKIQAKDLVRTRKYTEKFGNMKTQLQAISLRVQAVRSSDQMAVSMREATGLLAGMNRSMNLPQLQRISMEFEKQSDLMEQRQEFMDESIDDVMGDELDEDDEADEIVNRVLDEIGVDLNSKLQTAPQDLVKNEQAAAEPARAVAEAIGSSGDGPGPVTGSTTDDELQARLNSLKR

SEQ ID NO: 10545 - protein, 507 aa, Arabidopsis thaliana
MAMASLARRKAYFLTRNISNSPTDAFRFSFSLTRGFASSGSDDNDVVIIGGGPGGYVAAIKAAQLGLKTTCIEKRGALGGTCLNVGCIPSKALLHSSHMYHEAKHVFANHGVKVSSVEVDLPAMLAQKDNAVKNLTRGIEGLFKKNKVTYVKGYGKFISPNEVSVETIDGGNTIVKGKHIIVATGSDVKSLPGITIDEKKIVSSTGALSLSEVPKKLIVIGAGYIGLEMGSVWGRLGSEVTVVEFAGDIVPSMDGEIRKQFQRSLEKQKMKFMLKTKVVSVDSSSDGVKLTVEPAEGGEQSILEADVVLVSAGRTPFTSGLDLEKIGVETDKAGRILVNERFSTNVSGVYAIGDVIPGPMLAHKAEEDGVACVEFIAGKHGHVDYDKVPGVVYTHPEVASVGKTEEQLKKEGVSYRVGKFPFMANSRAKAIDNAEGLVKILADKETDKILGVHIMAPNAGELIHEAVLAINYDASSEDIARVCHAHPTMSEALKEAAMATYDKPIHI

SEQ ID NO: 10546 - protein, 198 aa, Brassica napus
MAMILQVPSSTPSSLFHTRNTKTRFFFFSSIQTSSESNTNKFRCRAVREKAEEKNTSPPSPEEVTKKYGLEVGLWKILTSKDEESDGEEKKKKKKSKTDEAKELLAKYGGAYLATSITLSLVSFSLCYALVTSGVDVQSLLLKVGISTNETGEKVGAFALAYAAHKAASPIRFPPTVALTPIVANWIGKKVDKEKDDE

SEQ ID NO: 10547 - protein, 341 aa, Ustilago maydis 521
MPEVIVSNATTSLDGTALAAASTSKYKPTTVDQGSTPYQFDVGLLASINPNPVTACSAAHLADRTRDGVQSLVNKIFALPITRDPDHGPLASLPAFTSKLPREKSMPKPKPLTKWEKFAKQKGIQSRKKDKMVFDENTQEWVPRWGFKGANKDLEEQWIHELKNNGNTDMDPAKTAKKERLAKKQKNEKQRLGNLARAAASTAASSAASSSSKGGLGDANPAKLARAAAREKRKAELEADVLRSRASTASMGRFDKTLQGEQKQKGLKRKFDPNEKDVGAERASNLALLNKLGTAAMRKNAKLAQGQGDRELVNTRKAVQFATAGHGVTSMNAKRGKRASK

SEQ ID NO: 10548 - protein, 458 aa, Pseudomonas aeruginosa PAO1
MSVPLRAVQLTEPSLFLQEHPEVQFVDLLISDMNGVVRGKRIERNSLPKVFEKGINLPASLFALDITGSTVESTGLGLDIGDADRICYPIPGTLSMEPWQKRPTAQLLMTMHELEGEPFFADPREVLRQVVARFTEMELTIVAAFELEFYLIDQENVNGRPQPPRSPISGKRPQSVQVYSIDDLDEYVECLQDIIDGARAQGIPADAIVAESAPAQFEVNLHHVADPMKACDYAVLLKRLIKNIAYDHEMDTTFMAKPYPGQAGNGLHVHISLLDKHGNNIFTSEDPEQNAALRHAIGGVLETLPASMAFLCPNVNSYRRFGSQFYVPNAPSWGLDNRTVALRVPTGSPDAVRLEHRVAGADANPYLLLASVLAGVHHGLTNKVEPGAPIEGNSYEQLEPSLPNNLRDALRELDDSEILAKYIDPKYIDIFVACKESELEEFEYSISDLEYNWYLHTV

SEQ ID NO: 10549 - protein, 720 aa, Mycoplasma mobile 163K
MDYKALYRKYRPKNFDEIKGQDHIVTTLKNILNFDKLSHAYLFSGPRGTGKTSVAKIFAAALNCEHEIQKEKICNLCVENLDNNLDIIEIDAASNNGVDEIRELREKVKYSPSQYKYKVYIIDEAHMLTKSAFNALLKTLEEPPKHAIFILATTDPQKIPLTVISRVQRFNFKRITLPILEKQLQEVLTKENIRINKNALTLIAKMAEGGLRDALSIADQISIFSNNNITEKEVDEVFSLVSIEDQIYFLNLIYKKDTTTVLRTINNYIESGINIEKLVINLIDIIRDFIVFNKTHASNLLEYLNEEDLKELEIDIHFAYQTKDALMPLLSDLKHSEIPTRNFEIIILQLLHESKRDEILEQNKKNSLSEFFKNEDTQPIHLADSKVKQKNENAIKFTAPTETFETEFSSNDKKNSNKSFLKNEMNSITNTDKLLEETTQSINLENENLNEYKQINEHILSTDILDLENIIIDTGEIDLNDKILNQSKIDFFENQDEEFFSFDNSKNETFENEEYSNEQISENSTIKKILNQKENKEIASNDPSNLQELDITDLVKEKNSFQNQFFNDLNEVKIVNLLMQTDPLFLKECKDIWKNLFSYKTDQKFNKEILYLENTKLIAASEKFIMVSADDDNLITKLIEKSKENNFNMFIEKITKGPKHFFAITKKEFKESRKMWNEINEQKRSFKIEKLSKPKSFDNSKEKTEEFARNIFGDTLEIKK

SEQ ID NO: 10550 - protein, 278 aa, Corynebacterium sp.
MTVPSIVLNDGNSIPQLGYGVYKVPPADTQRAVEEALEVGYRHIDTAAIYGNEEGVGAAIAASGIARDDLFITTKLWNDRHDGDEPAAAIAESLAKLALDQVDLYLVHWPTPAADNYVHAWEKMIELRAAGLTRSIGVSNHLVPHLERIVAATGVVPAVNQIELHPAYQQREITDWAAAHDVKIESWGPLGQGKYDLFGAEPVTAAAAAHGKTPAQAVLRWHLQKGFVVFPGSVRREHLEENLDVFDFDLTDTEIAAIDAMDPGDGSGRVSGHPDEVD

SEQ ID NO: 10551 - protein, 456 aa, Pseudomonas aeruginosa PAO1
MSNPPPTAERTQLRKSLKLWQIVMIGLAYLTPMTVFDTFGIVSGISQGHVPTAYLLALAGVLFTAISYGKLVRQFPTAGSAYTYAQRAINPHVGFMVGWSSLLDYLFLPMINALLAKIYLTALFPEVAPWIWVVMFVLIMTLINIKSVNLVANFNTVFVLVQLAIIVVFIGLVIHGLNNGEGTATVLSTQPFFSEHAHLSAMVAGATILCFSFLGFDAVTTLSEETRDAGRVIPRAIFLTALYGGVIFITVSYFLQSYFPTNVRFKEPDAALPEIALYVGGKLFQSIFLCATFINTLASGLASQASVSRLLYVMGRDNVLPERIFGFVHPKWRTPSINVLIVGMVALSAISFDLVTATALINFGALVAFTFVNLSVIVHFYVRGGRNRSLKEHFHYLVLPLLGAAIVAVLWLNLESTSLVMGLIWAGLGFGYLFYLTRSFSRPPPRFQESELSPTQ

SEQ ID NO: 10552 - protein, 416 aa, Thermotoga maritima
MPEKSLYEMAVEQFNRAASLMDLESDLAEVLRRPKRVLIVEFPVRMDDGHVEVFTGYRVQHNVARGPAKGGIRYHPDVTLDEVKALAFWMTWKTAVMNLPFGGGKGGVRVDPKKLSRNELERLSRRFFSEIQVIIGPYNDIPAPDVNTNADVIAWYMDTYSMNVGHTVLGIVTGKPVELGGSKGREEATGRGVKVCAGLAMDVLGIDPKKATVAVQGFGNVGQFAALLISQELGSKVVAVSDSRGGIYNPEGFDVEELIRYKKEHGTVVTYPKGERITNEELLELDVDILVPAALEGAIHAGNAERIKAKAVVEGANGPTTPEADEILSRRGILVVPDILANAGGVTVSYFEWVQDLQSFFWDLDQVRNALEKMMKGAFNDVMKVKEKYNVDMRTAAYILAIDRVAYATKKRGIYP

SEQ ID NO: 10553 - protein, 620 aa, Magnaporthe grisea 70-15
MPSEGDIEMHSLAAKEDIMLAQQGSSSNHSMRREPIYDDNTRGPSALRRWADSFRRDPGIRITPKEVPLYLDRDQVHHHHIHHEQYHHPPPPLPPQVPMREHDGERYYDLRSATLATVNTGLSRELKGRHLQMIAIGGSIGTGLFVASGKALATGGPASVLLAYCIIGVMLYCTVHALGELAVVFPVAGSFSAFSTRFLDPSWGFAMGWNSLHDYTILGSQREKSRVCGNILDGHIGLNLFGVKGYGEAEFIFAIVKVTAVIGFILLGIVINVGGTTTEGYIGTKYWHNPGAFNNGFKGLCSVFVQAAFAFAGTELVGLAAAETANPRKSLPTAIKQVFWRITLFYIVALTIVGFLVPYDSKRLLARNIADAAASPFVIAIESAGIEVLPSIMNSVILIAVLSVGNSAVFGSSRTLAALADQGQAPRILAYVDRRGRPLVAILLSMSIGLLAFVADSDIQQELLDWLLAISALSSIFTWGSICLSHIRFRRAWSKKGRSLGDLAFRAQPGLAGSWIGFLLNAIFLVAQFWVGGWPLPPVTGEEMTPLSIAGEFFLQCMAIPIVLIMWLGHKLYYRTSLVRTDDMDIDTGRRDFNLPILMAQEYEEKLNWPRWKRLYRFFC

SEQ ID NO: 10554 - protein, 516 aa, Arabidopsis thaliana
MALITLLEVSISLLFFSFLYGYFLISKKPHRSFLTNWPFLGMLPGLLVEIPRVYDFVTELLEASNLTYPFKGPCFGGLDMLITVDPANIHHIMSSNFANYPKGTEFKKIFDVLGDGIFNADSELWKDLRKSAQSMMTHQDFQRFTLRTIMSKLEKGLVPLLDYVAEKKQVVDLQDVFQRFTFDTSFVLATGVDPGCLSTEMPQIEFARALDEAEEAIFFRHVKPEIVWKMQRFIGFGDELKMKKAHSTFDRVCSKCIASKRDEITNGVINIDSSSKDLLMCYMNVDTICHTTKYKLLNPSDDKFLRDMILSFMLAGRDTTSSALTWFFWLLSKNPKAITKIRQEINTQLSPRTNDFDSFNAQELNKLVYVHGALCEALRLYPPVPFQHKSPTKSDVLPSGHRVDASSKIVFCLYSLGRMKSVWGEDASEFKPERWISESGRLIHVPSFKFLSFNAGPRTCLGKEVAMTQMKTVAVKIIQNYEIKVVEGHKIEPVPSIILHMKHGLKVTVTKRSNLL

SEQ ID NO: 10555 - protein, 173 aa, Crocosphaera watsonii WH 8501
MAKNRKNSREKAKESNWQERVIQIRRVSKVVKGGKKLSFRAIVVVGNEKGQVGVGVGKAGDVIGAVRKGVADGKKQLIDVSLTKSSSITHIAKGVSGGAKVIVRPAAPGTGVIAGGAVRTVLELAGLKNILAKQLGSNNPLNNARAVINALEGLRTFSEVAQERGVPLEHLYT

SEQ ID NO: 10556 - protein, 118 aa, Agrobacterium tumefaciens str. C58
MATAHYHGSCQCGSVSFEVDADLDHTVICNCSRCKRLGSTLAFAPREKFTLLSGEDKLSEYLFNKHKIHHFFCSTCGIESFAYADGPDGTPMVAVNANCLDGVDPRALKSQAFDGAAA

SEQ ID NO: 10557 - protein, 431 aa, Vitis vinifera
MEQRLASTFRMTVNEKKFIEKALLSDLRIDGRRPFDFRRISIKFGRQMGRQTHVMGFVTGQLIQPYRDRPNEGTLSIYTEFSPMADPSFEAGRPGEAAVELGRVIDRGLRESRAVDMESLCVLAGKLVWSIRIDLHIIDNGGNLIDAANIAALAALLTFRRPECSFGGEDGQELIVHPPEVREPLPLIVHHLPIAVTFAIIGNENIMVIDPTHSEEAVMGGRMTATLNTNGDVCAIQKAGGEGIIQSVIMQCLRIASVKAADITSKIKNAVEAFNTERALRKIKRHSSSIAVDVSGPGAKMRENKNQSVDEKVVNELSSHHMERLKMESEESCVTQSSDVEVKTQLSEQGRTNRSDENTRSFIGGPSSWDPYSKGIDSDFLKASLASHGIQFILSFLNSTRNYSMLQFPHFLTLKCMLMTFLVVFVLVEHY

SEQ ID NO: 10558 - protein, 265 aa, Viscum album subsp. album
IAAGVQFGWALQLSLLTPYVQELGIPHKWASIIWLCGPLSGLFVQPLVGVMSDRCTSRFGRRRPFIFAGSLLIAISVLIIGHSADIGWWLGDRGGVRPRAIGAFVFGFWILDVANNMTQGPCRALLADLTGKDHRRTRVANAYFSLFMAIGNILGFATGSYNGWYKVFPFTVTSACNIDCANLKSAFYLDVVFMAITACISISAAQESPLDLPARSMLADEEMLGQSNSVQEAFLWELFGTFRCFPSTVWIILLVTALNWIAWFP

SEQ ID NO: 10559 - protein, 379 aa, Glycine max
MGICFSIEDPNNLSISDSNAKPNKPAGHESGAPLASMNIKDLREGAGYSNVDIFTYEELRLATKHFRPDFILGEGGFGVVYKGVIDHSVRSGYMSTEVAIKELNREGFQGDREWLAEVNYLGQFSHPNLVKLIGYSCEDDHRLLVYEYMASGSLEKHLFRRVGSTLTWSKRMKIALHAARGLAFLHGAERPIIYRDFKTSNILLDADFNAKLSDFGLAKDGPMGDQTHVSTRVMGTYGYAAPEYVMTGHLTARSDVYGFGVVLLEMLIGRRALDKSRPSREHNLVEWARPLLNHNKKLLKILDPKLEGQYSSKTALKVAHLAYQCLSQNPKGRPLMSQVVEILENFQSKGENEEDQMLQTGDTSITLYEVPKGSNGTPT

SEQ ID NO: 10560 - protein, 281 aa, Aspergillus awamori
MKQFSAKHALAVVVTAGHALAASTQGISEDLYTRLVEMATISQAAYADLCNIPSTIIKGEKIYNSQTDINGWILRDDSSKEIITVFRGTGGDTNLQLDTNYTLTPFDTLPQCNGCEVHGGYYIGWVSVQDQVESLVKQQVSQYPDYALTVTGHSLGASLAALTAAQLSATYDNIRLYTFGEPRSGNQAFASYMNDAFQASSPDTTQYFRVTHANDGIPNLPPVEQGYAHGGVEYWSVDPYSAQNTFVCTGDEVQCCEAQGGQGVNNAHTTYFGMTSGACTW

SEQ ID NO: 10561 - protein, 517 aa, Parachlamydia sp. Hall's coccus
MTNESKPEFGPLRSFFWPVHNYELRKLLPMFLMFFCISFNYTILRDTKDTLIVTSSGAEAIPFLKVWGVVPAAIIFMLLYAKLSNILSKEKLFYVTITPFIVFFALFATVLYPNKDFLHPTTSAEYIQSFLPEGLGGLVACYRNWTYSLFYILSELWGSAVLSLMFWGFANDIMKITEAKRFYTLLGLGANVALLVSGPAIMYFSDIRKHLPAGVDAWQVSLNYLMGSVVLAGVCVVAVYWWMQRNVMTDPRYYDPSDVKQPKKAKAKMSIMESFAFLGKSKYILCIAILVICYGISINLVEVTWKNQLKLQYPNPNEYNTFMGAFSTFTGAITIIMMFVGGYIVRKKGWGFAAMTTPTVLLLTGLGFFSFVIFRDSLQGYIAMLGTTPLMLAVVIGMIQNIMSKSTKYSLFDPTKEMAYIPLDQESKVKGKAAIDVVGARLGKSGGSFIQQGLLVFFGTISAITPYVAVATIAVIVVWMIAVRSLNKQFVALTGETIAKPAVPVAAVKAATETTAA

SEQ ID NO: 10562 - protein, 127 aa, Oryza sativa
MAITKIHARSVYDSRGNPTVEVDIVTETGLHRAIVPSGASTGSHEACELRDGDKSKWGGKGVTKAVANVNDTIAPALIKEGIDVKDQSAVDAFLNKLDGTKNKEKLGANAILGVSMAIAKAAAAEKG

SEQ ID NO: 10563 - protein, 181 aa, Populus trichocarpa
MALDVARGMNCLHASIPTIVHRDLKSPNLLVDKNWTVKVCDFGLSRLKHNTFLSSKSTAGTPEWMAPEVLRNEPSNEKCDVYSFGIILWELATIRLPWSGMNPMQVVGAVGFQNRRLEIPKEVDPLVARIIWECWQTDPNLRPSFAQLTVALKPLQRLVIPSHLDQPSPPLQQEIAVNSTP

SEQ ID NO: 10564 - protein, 506 aa, Debaryomyces hansenii CBS767
MPNETTKARRSSRISPYHEDSSSFFNIASVLDKQKDTQQINTDLEKCSYIPPWTEPYIIGIAGNSGSGKTSLSQKIIQEINQPWTVLLSFDNFYNPLSQEERQKAFSNEFDFDTPDSLDLDLLYNVVKSLKSGEKTEIPIYSFTKHDRTDKTTTIYGANVIVIEGIYALYDQRLLDLMDIKIYVDTDLDICLARRLTRDILYRGRDLSGAMKQWETFVKPNAVRYVNPTMDNANLVIPRGLDNSIAINLMIKHIQKQLALKSSLHLQSLKSLGVNEFNIGNYGNLNLLPNNNHTRGINSALFNMSTERSDFIFYFDRIAILIIENAIETFENYRSKIVNTAGNYQYQGLDHVDEIFAINIIRSGDCFMNSIKKTFPEISIGKLLIQSAALTGEPQLHFETLPPNLDKIEHKTILLFDAQIISGAAAIMAIQVLLDHKVRMEDIVFCTYLSTEIGLRRILNVFPRVRIVIGKLSTIDDSTKSYNPENFKDTDWCFRNRFIDSLYFGT

SEQ ID NO: 10565 - protein, 338 aa, Salmonella typhimurium LT2
MRVLVTGGSGYIGSHTCVQLLQNGHDVVILDNLCNSKRSVLPVIERLGGKHPTFVEGDIRNEALITEILHDHAIDTVIHFAGLKAVGESVARPLEYYDNNVNGTLRLVSAMRAANVKNLIFSSSATVYGDQPKIPYVESFPTGTPQSPYGKSKLMVEQILTDLQKAQPEWSIALLRYFNPVGAHPSGDMGEDPQGIPNNLMPYIAQVAVGRRESLAVFGNDYPTEDGTGVRDYIHVMDLADGHVVAMEKLADKSGVHIYNLGAGVGSSVLDVVNAFSKACGKPINYHFAPRRDGDLPAYWADASKADRELNWRVTRTLDEMAQDTWHWQSRHPQGYPD

SEQ ID NO: 10566 - protein, 385 aa, Streptococcus mutans UA159
MIKLMVGSFAEKKLKRGVQLLSSRDYPNLNLDNQVVQLYSDADIFLGTAYLSKQNKGVGWLISPKKVSLNVTYFIKLFQWSKDKRKNFAHSKLTTAYRLFNQDGDSFGGVTIDCYGDFVLFSWYNSFVYQIRDEIVAAFRQVYPNFLGAYEKIRFKGIDNVSAHLYGQEAPEQFLILENGISYNVFLNDGLMTGIFLDQRQVRNELINGSAAGKTVLNLFSYTAAFSVAAAMGGAMATTSVDLAKRSRALSLAHFEANHLDMANHQLVVMDVFDYFKYARRHHLTYDIIIIDPPSFARNKKEVFSVSKDYHKLIRQGLEILSENGLIIASTNAANMTVSQFKKQIEKGFGKQKHTYLDLQQLPSDFAVNVQDESSNYLKVFTIKV

SEQ ID NO: 10567 - protein, 81 aa, Rhodomonas salina
MNEQEIFEKVQTIISEQLGVEKSQVTKDANFANDLGADSLDTVELVMAIEEAFNIEIPDETAEQISNLQQAVDFISQKVAA

SEQ ID NO: 10568 - protein, 207 aa, Physcomitrella patens subsp. patens
MNGSSAVHKATALNSRILSSMERRTVAAHPWHDLEIGPAAPEIFNCVVEINRGSKVKYELDKKSSLMKVDRILYSSVVYPHNYGFIPRTLCEDEDPIDVLVIMQEPVMPGSFVRARAIGLMPMIDQGEKDDKIIAVCADDPEYRHFKDINELPPHRLAEIRRFFEDYKKNENKEVTVDNFLGHEAAIQAISHSMDLYASYIVESLRQ

SEQ ID NO: 10569 - protein, 450 aa, Triticum aestivum
VTLPNKFVQKSRLAPVRNSRDIVDPRVREYNAQTKDNVIALMVDTKGPEVRSGDLPQPIFLETGQEFTFTIKRGVGTETCVSVNYDDFVNDVEAGDMLLVDGGMMSFLVKSKTEDSVKCEVIDGGELKSRRHLNVRGKSATLPSITDKDWDDIKFGVENQVDYYAVSFVKDAQVVHELKDYLRSSNADIHVIVKIESADSIPNLHSIITASDGAMVARGDLGAELPIEEVPLLQEEIIRMCRSMGKAVIVATNMLESMIVHPTPTRAEVSDIAIAVRRKGAELQFCLSGETAHGKFPLKAVKVMHTVALRTEATIIGGETPSNLGQVFKNHMSEMFAYHSTMMSNTLGTSIVVFTRTGFMSILLSHYRPSGTIFAFTDQEIVRQRLALYQGVCPVHMEFSDCAEKTFADALSYLLKHGMVKEGEEVALVQSGRQPIWRSQSTHNIQVRKV

SEQ ID NO: 10570 - protein, 322 aa, Salmonella typhimurium
SKIYEDNSLTIGHTPLVRLNRIGNGRILAKVESRNPSFSVACRIGANMIWDAEKRGVLKPGVELVEPTNGNTGIALAYVAAARGYKLTLTMPETMSIERRKLLKALGANLVLTEGAKGMKGAIQKAEEIVASDPQKYLLLQQFSNPANPEIHEKTTGPEIWEDTDGQVDVFISGVGTGGTLTGVTRYIKGTKGKTDLITVAVEPTDSPVIAQALAGEEIKPGPHKIQGIGAGFIPGNLDLKLIDKVVGITNEEAISTARRLMEEEGILAGISSGAAVAAALKLQEDESFTNKNIVVILPSSGERYLSTALFADLFTEKELQQ

SEQ ID NO: 10571 - protein, 182 aa, Bordetella pertussis Tohama I
MKTVGDKLEPFKVTGVKPGFNQHEENGVSAFEDITESSFPGKWKVIYFYPKDFTFVCPTEIVGFNKLAKDFEDRDAVLLGGSTDNEFVKLAWRREHPDLNKLGHYQFGDTTGALIDQLGVREKGAGVALRATFIVDPDNTIQHVSVNNLNVGRNPEEVLRLLDGLQTDELCPCNRSVGGATL

SEQ ID NO: 10572 - protein, 125 aa, Guillardia theta
MITKSKIFPIANENLTVQILDLIEIASSFKLIKKGANEAVKNIKKGKVELLVLASDSDPIEIVLHLPLLCEDRSIPYIFINSKISIGKACGINRGIVACCIMESINLDLNKQIKCLKKRMELEFF

SEQ ID NO: 10573 - protein, 490 aa, Zea mays
MMDLADSQQQRLIAGAALLVATVAFFRFLLRSRSGGKRLPPTIPGAPVVGGLVKFMRGPIPMIREQYARLGSVFTVPIISRKITFLVGPEVSAHFFKGNEAEMSQQEVYRFNVPTFGPGVVFDVDYSIRQEQFRFFTEALRANKLRSYVDQMVVEAEEYFSKWGESGTVDLKYELEHLIILTASRCLLGREVREKLFDDVSALFHDLDNGMQPISVLFPYLPIPAHKRRDRARARLAEIFATIIKSRKASGQSEEDMLQCFIDSKYKNGRPTTEGEVTGLLIAALFAGQHTSSITSTWTGAYMLRFKQYFAEAVEEQKDIMRRHGDKIDHDILAEMDVLYRCIKEALRLHPPLIMLLRQSHSDFTVTTKEGKEYDIPKGHIVATSPSFANRLPHIYKNPDSYDPDRFGPGREEDKAAGAFSYISFGGGRHGCLGEPFAYLQIKAIWTHLLRNFEFELVSPFPENDWNAMVVGIKGEVMVNYKRRKLAVDN

SEQ ID NO: 10574 - protein, 135 aa, Yarrowia lipolytica CLIB122
MTVYALYILNKAGGLIFQRDYGTELAKLSSNDYLVLAGTFHGVHAISAKLSPIEGSSGIQTMETEKYALTCFQTVTGIKFLLITDLRQQFVDSVLKRVYQLFADYVMKSPFYQLDMPIRCTLFDLHLNKYLESVS

SEQ ID NO: 10575 - protein, 155 aa, Anaplasma phagocytophilum
MYCCVLTYLVEYKGGTRVQERTLSILKPDVVERGIIGNVISYIEAAGLKVVAQRMCRLTVSQAEEFYDVHRDRPFFPELVKFMTSGPVVVQVLEGESAIAVYRDVMGATNPKEAAKGTIRADFAESIDANCVHGSDNADNAKREIMFFFGECEIF

SEQ ID NO: 10576 - protein, 375 aa, Cryptococcus neoformans var. neoformans B-3501A
MSIPTEKPAGPSAFTPYLDAVANVFHPVSGPVLNTYAKFHGWKENMGLVQPGTVENLTRDAQQVQLANWMFDGARADVAKVISGNPAFQLTHSFSLGSTTRPAAYNFGVIFANAKTFLQGGLDGSGSLTMRANQTWSARDLSKIQAQVTDKPGHTMVQFEHDHIGDHYTFSWKSINPNLLDFTGIHMASLLHSVSPRLSLGFETVIQYPEPAILQTATSYVAKLTSLPNPVAALTPTAPGLPSPFVPSWIATGHLQPDGNVQATYYQKLSDKVDVALDFQTILRPQSMLGPAKREALTTLAAKYDFRMATFRGQIDSAGKVGMYLEQRFTPAFAFLVAGEIDHAKNASKFGVGIMIESSTMTQEEMIAAGMLTPV

SEQ ID NO: 10577 - protein, 433 aa, Neisseria meningitidis MC58
MPSEHQHISSLLDFDRTHLLHPYTSMTDPLPVYPVKRAEGVFIELADGTRLIDGMSSWWCAIHGYNHPVLNQAVETQMKQMAHVMFGGLTHEPAVELGKLLVGILPQGLNRIFYADSGSISVEVALKMAVQYQQARGLTAKQNIATVRRGYHGDTWNAMSVCDPETGMHHIFGSALPQRYFVDNPKSRFDDEWDGADLQPVRALFEVHHADIAAFILEPVVQGAGGMYFYHPQYLRGLHDLCDEFDIMLIFDEIATGFGRTGKMFACEHAEVVPDIMCIGKGLSGGYMTLAAAITSQKVTETISRGEAGVFMHGPTFMANPLACAVACASVKLLLSQDWQANIRRIESILKGRLKAAWDIRGVKDVRVLGAIGVIELEKGVDMARFQADCVAQGIWVRPFGRLVYLMPPYIISDGVLTKLADKTVQILKEHSK

SEQ ID NO: 10578 - protein, 528 aa, Candidatus Protochlamydia amoebophila UWE25
MITLSKISKNFGSRVLFEDVTITFNAGNRYGLTGPNGAGKTTLLKIIMGFEEATSGTVTLPNRVGILRQNIEAFKNEKVVDTVIMGNKRLWDAIKERDSLYEVEMSDDVGMRLGELEGIIAEEDGYSAEANAEEFLAGMGILNEYFNEKMHAVPTDIQFRVLLCQALFGEPQALLLDEPTNHLDLDSIGWLEKFLHNYKGTLVVISHDRHFLNSVTTHIADIDYETIIIYPGNYDEMVVAKTSVRERADADAKSKEKKISQLREFVARFGAGTRASQVQSRLREIERLQPQDLKKSNIQRPYIRFIPTEKAPGKILLKVEEISKSYDNTPVIKHFSMELDRGDKIGIIGSNGRGKTTLLKMLAQVLRPDNGQVELGHQVLISYFPQEHSDIVEKKGQKTAFDWLKERRPGIYDQEIRSVMGKLLFGGDDAFKPVATLSGGETARLILAGMLLSEHNLIILDEPNNHLDLEAVSALGWGLAEYKGTVVVASHDRDLISTVANKIIAFEPDGIHFFEGNLEEYLLHKSHS

SEQ ID NO: 10579 - protein, 389 aa, Mycoplasma mobile 163K
MNEEFRNQFPILKKIIYLDSAALVQKPLSVIKANEEYYSNFSVNSHSSDSLLGIKALKNIEDTREKVANLINGNSNEIIITSGTTQSLNMVALMLKRLLKENDEIILSTFNHSSNMVPWIEIAKEVNAKIIFSEESENDSIINRITKKTKLIAISQVNNALLKKKNLKSLYEICKDKNIILINDAAQAVISEKIDLKNESDVVVFSSNKMFGPTGIGVLAVKKELLVKLKPAYYGGGSTVSMNGEKWESSKSIKAFEAGTPNLAGIYQFSKAIDFVQKYVLNDESKKYLLNLSIYLHQQLKLLKDIEIISQDSDFIAIFRLKKYPSQDVVSYLGHNNIYVRAGDFCVKNLKFLKENNGYIRVSLTYYNNKNDIDNLIEKIQKEAFYEFL

SEQ ID NO: 10580 - protein, 389 aa, Triticum aestivum
MASGTDEKAKMESLTSPAAFVEGGVQDACDDACSICLEAFCESDPSALTGCKHEFHLQCILEWCQRSSQCPMCWQPVSMKDPTSQELLEAVQRERNIRTNQTRNTTIFHHPALGDFEVQHLPVVGNDAELEERILQHLAAAAAMGRSHQHGRREGQRNRSGSHGSPQFLVFSAHPNTPAGSVSSSSAQGEGADDLRILVPRVGDLPPHANPIEEAGNQSPGVLTYDAEQDAVVSSGNSTPVSSPRFFNRRHSSGQSTPVGNDRAGPSDVQSFSDSLKLRLNAVSSKYKESITKSTRGWKERLFSRNSSVSDLGSEVRREVNNGIASVSRMMERLETRGSGRPSYSPTTSTSEVCLTTEPSNERVTESNSNTTTSTSNTSTPCVTTSGSN

SEQ ID NO: 10581 - protein, 408 aa, Kluyveromyces lactis NRRL Y-1140
MPPKNQSPELRRRRTTSIGRINLGDTSVPSLSTMSVTEESKHASEARLKLLSSSSEKDIDVLRKLWLSYRELSYRHSWLTSLLIISVIYLFYICSGNRTASNPLHMFVAISYQIGDTNMYGKGPKDLCFVFFYMIFFTFLREFIMQVILRPLSIKMGSTRENKIRRMMEQMYSIFYYSISGPFGLYIMYHTDLWLFRTDTMYKTYPDFNNEYLYKIFYLGQAAFWTQQSCVLTLQLEKPRKDFQELIFHHIVTLALIWLSYVFHFTKMGLSVYVTMDVSDFFLSLSKTFNYLDSSLTPPFFLFFIVSWVYLRHYINLKILWSLLTEFTTVGNYTLNFATQQYKCWISQPIIFVLLFALHLLNLFWLFFIARILYRLVVHGIQKDERSDSESESENEPEKESAVDEKKQ

SEQ ID NO: 10582 - protein, 181 aa, Coccidioides immitis RS
MTFSKLFDSIWRKKEMRILMVGLDAAGKTTILYKLKLGEIVTTIPTIGFNVETVEYKNIQFTVWDVGGQDKIRPLWRHYFQNTQGIIFVVDSNDRDRVVEAREELQRMLNEDELRDALLLVFANKQDLPNAMSPAEITQQLGLQSLTRRAWYIQSTCATTGDGLYEGLEWLANALKKSGHD

SEQ ID NO: 10583 - protein, 433 aa, Prochlorococcus marinus str. MIT 9515
MKSQISTNINQDWHPHIWPPFTQITNSKPQIEVTHGKNALIYTKNPQQELIDGISSWWVTLHGHSNDYIANAIFHQAKTLEQIIFADFLHPQAKLLSERLSSLTKLERLFFSDNGSTAVEVALKIAYQSWQNQGEIRNQIIAFDGAYHGDTFGAMALGERNIFNENFDNLMFPVKRVPWPSTWIDDEKVKIKEKQAIQILNNLLKKPTVAVIIEPLVQGAGGMNMVRPEFIKKVSEVVKNNNSLLIADEVLTGFGRCGSLFAFQKANIIPDLISISKGLTGGFLPMGITLAKETIFQAFISDSPKKTFWHGHSFTANPLGCAAANASLDLLENDPVKYISFEAKHSYHLKKIKKLPFVKNIRFTGTIAAFDIEIGNNEGYLNNIGKKIKALAIKKGLFIRPLGNVIYLLPPLCITDKQLEKSYRIIFEILSDL

SEQ ID NO: 10584 - protein, 415 aa, Thermotoga maritima
PEKSLYEMAVEQFNRAASLMDLESDLAEVLRRPKRVLIVEFPVRMDDGHVEVFTGYRVQHNVARGPAKGGIRYHPDVTLDEVKALAFWMTWKTAVMDLPFGGGKGGVRVDPKKLSRNELERLSRRFFSEIQVIIGPYNDIPAPDVNTNADVIAWYMDTYSMNVGHTVLGIVTGKPVELGGSKGREEATGRGVKVCAGLAMDVLGIDPKKATVAVQGFGNVGQFAALLISQELGSKVVAVSDSRGGIYNPEGFDVEELIRYKKEHGTVVTYPKGERITNEELLELDVDILVPAALEGAIHAGNAERIKAKAVVEGANGPTTPEADEILSRRGILVVPDILANAGGVTVSYFEWVQDLQSFFWDLDQVRNALEKMMKKAFNDVMKVKEKYNVDMRTAAYILAIDRVAYATKKRGIYP

SEQ ID NO: 10585 - protein, 491 aa, Erwinia carotovora subsp. atroseptica SCRI1043
MAVTSTAQACDLVIFGAKGDLARRKLLPSLYQLEKAGHIHADTKIIGVGRADWDKAEYTRVVREALDTFMKEAIDDKLWETLSSRLDFCNLDVEDTKAFNKLGKMLDQKNRTTINYFAMPPSTFGAICKGLGTAGLNKEPARVVMEKPLGTDLASSRAINDQVAEFFNECQVYRIDHYLGKETVLNLLALRFANSLFSSNWDNRTIDHVQITVAEEVGIEGRWGYFDKAGQMRDMIQNHLLQILTMIAMSPPSDLTTDRIRDEKVKVLRSLRRINRSNVHETTVRGQYSSGFVQGHKVPGYLEEEGANKSSSTETFVAIRVDIDDWRWSGVPFYLRTGKRLPTKCSEVVVYFKNPALNLFHDSYQQLPQNKLIIRLQPDEGVEIQILNKIPGLEHKHRLQTVKLDLSFSETFNQQHLADAYERLLLETMRGIQALFVRRDEVEEAWKWVDSIMEAWAMDNDAPKPYQAGSWGPVASVAMITRDGRSWNEFE

SEQ ID NO: 10586 - protein, 480 aa, Erwinia carotovora subsp. atroseptica SCRI1043
MSRRLRRTKIVTTLGPATDRDNNLEKIINAGANVVRMNFSHGTAEDHQLRANKVREIAAKLGRHVAILGDLQGPKIRVSTFKEGKIFLNIGDKFLLDANLAKGEGDKEKVGIDYKGLPSDVVPGDILLLDDGRVQLKVLQVEGLKVYTEVTVGGPLSNNKGINKLGGGLSAEALTEKDKADIITAAKIGVDYLAVSFPRTGEDLNYARRLARDAGCNAKIVSKVERAEAVCSDAAMDDIILASDVVMVARGDLGVEIGDPELVGIQKKLIRRARQLNRAVITATQMMESMITNPMPTRAEVMDVANAVLDGTDAVMLSAETAAGQYPAETVAAMAKVCLGAEKIPSINVSKHRLDVQFDNTEESIAMSSMYAANHLKGVTALIAMTESGRTALMMSRISSGLPIFAMSRHEHTLNLTALYRGVTPVHFDSYTDGVAAANDAVILLRDKGFLMSGDLVIVTQGDIMGTVGTTNTIRILRVE

SEQ ID NO: 10587 - protein, 387 aa, Xylella fastidiosa Temecula1
MNFHEYQAKQLFAEYGIPVPAGRIASSADEAVTAAKSLGNGPWMVKAQIHAGGRGKAGGVKFCKTTDEVKQAAATMLGTKMATYQSAGVALPVNLVLVTEAGEITKELYLSVLVDRGTRSITYIASSEGGVDIEHVAAETPEKIQTLNVDFVEGLQPYQGRDIGFHLGLEAKQVNQLSKIMISLYQLFNDKDLSLIELNPLAILSNGDLYALDGKINSDDNATFRHKELAAMRDKTQEDETEVLASENDLNYVTMDGNIGCMVNGAGLAMATMDVIKLNGGEPANFLDVGGGATKERVTTAFKLILSSNKVKAIFVNIFGGIVRCDMIAEGIIAAVKEVGVKVPVIVRLEGTNVDAGKQLLATSGLAIIPADDINDGAKKAVAAVTV

SEQ ID NO: 10588 - protein, 555 aa, Methanococcus maripaludis S2
MKDTVMTYLLENSIKFKGKPNPKAAMGKILGENPDLRSKVKEVNQVISEVLKEIETMSLEEQQAKLDELAPEGLGQKTERKRKEIELKNVKGNVVMRFAPNPSGPLHIGHARASVLNDFFSKKYNGKLVLRLEDTDAKRVLPEAYEMIQEDLKWLGVKVDEVIVQSERLETYYEYGRKLIEMGHAYVCDCDADEFRTLREQGLPCKCRDTTPEENIALWEKMLAGELDNVAVRLKTDIAHKNPSIRDFPIFRIERTPHPKNGTKYHVYPLMNLSVTVDDHLLGMTHVLRGKDHIVNTEKQEYIYNYFGWEIPEYVHYGILKIEGPVLSTSKMHAGILSGEYSGWDDARLGTLRALRKRGIRPEALYKLMVEIGIKQADVRFAWENLYAANKDIIDKDARRFFFVESPKKLVISGAENRKIDLRMHPDRSELGNRELLFDGEIYVSDDLEAGKMYRLMELFNIVVEKVENDIIYAKYDSDDFKVAKTNKASIIHWIPVKDSIPVTVIDENAEKIEGFAEKDFAVVKEDDFVQFERFGFVRIDEKLDNKYTCYLTHK

SEQ ID NO: 10589 - protein, 256 aa, Agrobacterium tumefaciens str. C58
MGILQKFSLENRTAIITGSGRGLGFEIAKGFAEAGAHVWLTGRNAETLQQAVDTLRKAGGKADYAAFDIADTAAGSALVRRIMDEAGHLDILVNNVGARDRRPLAEFTDDDVLELIRTDLTSSISLSRDAAEAMNANGYGRIITITSILGHIVRPGDAIYPVAKQGLTGLMRAIAVEYGARGITSNAIAPGMFATETNAALAENPDMVAFAKLRVPLERWGRPDEIAGAALFLASDAASFVNGHILTVDGGMSVRL

SEQ ID NO: 10590 - protein, 836 aa, Novosphingobium aromaticivorans DSM 12444
MMGSIVLSAPIAGWVSALDEVPDGVFSARLLGDGVAIDPVEGLLCAPCDGEILSVHAARHAVTMAGEGGVELLMHLGIDTVELKGDGFETLVRAGHRVVRGQPLLRFSLDDLAGRAPSLVSPVIVTNGDRFTISSCTVDALVAVGDDLIRLDPVGVAPSPDRAPVGEAVGAIVVVPLPNGLHARPAARLGEAARAFAAETRIVKNGRAVSTRSPVGLLGLSIQLGDEILVEASGPDASQAVAALVDLIRSGLGEGAEHDAAAEPRASSAGMPPFAPVPDGALRGNLASPGFALGTCHRLDRSEPELPVQGKGKEEERIRLLSAMDHLRSRLAISSEVSPKAAICSAHRALLDDPELEAAALSRIAEGEDAAHAWREACRASAVVLRGSGSARFAERADDVLDLGRQLVTILIGELDETLAFPPGTILLADELLPSQIMQLGAEVTGIALANGGPTSHVAILAASMGIPMLVAIGDALAGVRAGDKAILDADGGFLLPAPGAAALAEAEAEVAARQARRADALASASELCHSRDGARIEVFANLGSLDDARRAVSAGAEGCGLLRTEFLFLERESAPTVAQQAELYAGIADALGGRPLIVRLLDIGGDKPATYLPIAPEANPALGLRGIRVGLAHPDVLEDQLRAILSVERGGALRIMVPMVTGVAEVREVRQRVDRISAELGLAQRVEVGIMVETPAAAATAFLLAPHADFMSIGTNDLTQYVLAMDRDNPAVAGGIDGLHPAVLNLIAQTVRGAQSVGRWTGVCGGLAADRLAVPLLLGLGVTELSVPLRQLPEIKALVRGLSISDCKTLALEALQLESAAEIRALSRAFVETLP

SEQ ID NO: 10591 - protein, 666 aa, uncultured marine bacterium 560
MEFDANLIAPALGVLGLLIVFFIYQWIKKQPGGSGSVQKIGEQIHIGSIVFMKREYKMLSIFAFVLLVLLYIFLGPASALCFLVGAVASATAGYIGMNTATIANVRTAQAAHEEGSAAALTVAFFGGSVMGLSVAALGLLGLGGLYYFFGETHSEALHGFAMGASVVALFSRVGGGIFTKSADVGADLVGKLEAGIPEDDPRNPAVIADNVGDNVGDIAGMGSDIFESYCGSMIATIAIASTLSAVALDKLGNQSELMFLPLALASLGFVCSVIGIVFVKMSSNKSPESALRIGTIGSALLFIIASYFLINQLEVSNSIWAAVLMGSVGGIIIGLVTEYYTAGKPIRDIAESGKTGAATVMIKGLAIGMQSVVIPVLMICLIIYVANLFVGLYGVGIAAIGMLATVGMTMAIDAYGPIADNAGGIAEMSGLGEDTRKITDSLDELGNTTAAIGKGFAIGAAALAALAIITAYTETVSANSTDFILKLNSAEVLIGLFIGGTIPFLIAALTMTAVGDAAFEMIEEVRRQFKEIKGLLEGKAEPDTAKCIDIATTAALKKMILPGVIAISAPVLVGFLISPEALGGMLAGALLGCVLMALMMANAGGAWDNAKKHVEKGNFGGKGTDVHTATVVGDTVGDPFKDTSGPSMNILINVMAIVSLVIAPLL

SEQ ID NO: 10592 - protein, 556 aa, Vitis vinifera
MDGSKEFGLKNVSSHCSISEMADYDLSRLLDKPRLNIERQRSFDERSMSELSIGLARHLEHLDSMYSPGGRSGFDTPASSARNSFEPHPMVNEAWEALRRSLVFFRGQPVGTIAAYDHASEEVLNYDQVFVRDFVPSALAFLMNGEPEIVKNFLLKTLHLQGWEKRIDRFKLGEGAMPASFKVLHDPIRKTDTLIADFGESAIGRVAPVDSGFWWIILLRAYTKSTGDLSLAETPECQKGMKLILTLCLSEGFDTFPTLLCADGCSMVDRRMGIYGYPIEIQALFFMALRCALAMLKQDSEGKECIERIVKRLHALSYHMRSYFWLDFQQLNDIYRYKTEEYSHTAVNKFNVIPDSIPEWVFDFMPTRGGYFIGNVSPARMDFRWFALGNCVAILSSLATPEQSMAIMDLIESRWEELVGEMPLKISYPAFENHEWRIITGCDPKNTRWSYHNGGSWPVLLWLLTAACIKTGRPQIARRAIDLAESRLLKDSWPEYYDGKLGRYVGKQARKYQTWSIAGYLVAKMLLEDPSHLGMISLEEDRQMKPLIKRSSSWTC

SEQ ID NO: 10593 - protein, 680 aa, Staphylococcus aureus subsp. aureus Mu50
MKSQNKYSIRKFSVGASSILIATLLFLSGGQAQAAEKQVNMGNSQEDTVTAQSIGDQQTRENANYQRENGVDEQQHTENLTKNLHNDKTISEENHRKTDDLNKDQLKDDKNSSLNNKNIQRDTTKNNNANPSDVNQGLEQAINDGKQSKVASQQQSKEVDNSQDSNANNNLPSQSLTKEAPSLNKSDQTSQREIVNETEIEKVQPQQNNQANDKITNHNFNNEQEVKPQKDEKTLSVSDLKNNQKSPVEPTKDNDKKNGLNLLKSSAVATLPNKGTKELTAKAKDDQTNKVAKQGQYKNQDPIVLVHGFNGFTDDINPSVLAHYWGGNKMNIRQDLEENGYKAYEASISAFGSNYDRAVELYYYIKGGRVDYGAAHAAKYGHERYGKTYEGIYKDWKPGQKVHLVGHSMGGQTIRQLEELLRNGNREEIEYQKKHGGEISPLFKGNNDNMISSITTLGTPHNGTHASDLAGNEALVRQIVFDIGKMFGNKNSRVDFGLAQWGLKQKPNESYIDYVKRVKQSNLWKSKDNGFYDLTREGATDLNRKTSLNPNIVYKTYTGEATHKALNSDRQKADLNMFFPFVITGNLIGKATEKEWRENDGLVSVISSQHPFNQAYTNATDKIQKGIWQVTPTKHDWDHVDFVGQDSSDTVRTREELQDFWHHLADDLVKTEKVTDTKQA

SEQ ID NO: 10594 - protein, 397 aa, Chlamydomonas reinhardtii
MAQPPRPAEEYDDDVQEDEDELKEGELDDDESHEAASEGGEAAAGDEEAEDDEQDEEDGDEDSQPWAGLNRLPERDDMLDILNELRAEGRKQLTVLLLGKSSVGKSSLINSLLGEAVVRVQAFKLQADTDITTTVVRQVAVGNSEVDGFRLKLIDTCGLEDPEAGDTVNLGALSKIAEDVRGVGIDVVLYCDRLDLYRVDPLDKAIIDAISSTFGRGIWRRTVVALTHANLVQTPPGTDYDSFVNGRVRLIRGAVRGPLFFRPSLPVALVENSETCPVSSESGFRVLPDGEPWLVALVSQLVDMAAARRRPYKYHPRLSSKPSHRFRWLLPVAIAAEVLFYRRFLHPRLDDNQRRVEREEERVWALRGQQRRALGLHRPHRPDKDAAWRLEQMYDDD

SEQ ID NO: 10595 - protein, 274 aa, Streptococcus mutans UA159
MKIAYLGPSGSFTHNVALHAFPAADLLPFENITEVIKAYESKQVCFAIVPVENSIEGSVHETFDYLFHQAKIEAVAEIILPIKQQLMSTSADKTIETIFSHPQAIAQGKQYIRSHYPDVKIEMTASTAYAARFVAEHPEENYAAIAPYAAADEYHLSIIAKDIQEIDENYTRFWVLGDETPTIHLKEEDQKISLALTLPDNLPGALYKALSTFAWRGIDLTKIESRPLKTILGEYFFIIDFENHNEKLVSFALEELTSIGIHYKILGKYAVYRL

SEQ ID NO: 10596 - protein, 318 aa, Synechococcus sp. WH 7805
MASATTSVAAVLTGLSGSDFLSSADTTAQQTAALLQLATQLKRGERRIDLGNRVLGLIFTKASTRTRVSFQVAMARLGGQTVDLNPQLTQLGRGEPLEDTARVLSRFCDVLAIRTFAQQELADYAHWASIPVINALTDLEHPCQALADFLTMQEAFGDLQGQTLAYVGDGNNVAHSLMLCGALLGVNVRIGCPEGFEPLPGVVDQARALSVEGAQISVITDPVEAVRGAQALYTDVWASMGQEQEQAERERAFQGFCLNEDLLAEADSRAIVLHCLPAHRGEEISAGVMEGPSSRIFDQAENRLHAQQALLAALLGGL

SEQ ID NO: 10597 - protein, 429 aa, Salmonella typhimurium LT2
MTTDDLAFDKRHIWHPYTSMTSPLPVYPVERAEGCELVLASGKRLIEGMSSWWAAIHGYNHPQLNAAMKAQIDAMSHVMFGGITHQPAVNLCRKLVAITPEPLECVFLADSGSVSVEVAMKMALQYWQARGESRQRFLTFRHGYHGDTFGAMSVCDPDNSMHSLWKGYLPENLFAPAPQSRMDGEWDESDIAPFARLMAAHRHEIAAVILEPIVQGAGGMRIYHPQWLRRIRNMCDREGILLIADEIATGFGRTGKLFACEHAGIAPDILCLGKALTGGTMTLSATLTTRQVAETISNGEAGCFMHGPTFMGNPLACAVACANLTLLESGEWRQQVASIESQLRAELAPAQSSPWVADVRVLGAIGVVETTHPVNMAALQRFFVGQGVWIRPFGKLIYLMPPYIIRPDQLRRLTQAVNDAVHNETFFSH

SEQ ID NO: 10598 - protein, 121 aa, Triticum aestivum
  misc_feature (102)..(102): Xaa can be any naturally occurring amino acid
MSAYCGKYKDELIKNAAYIGTPGKGILAADESTGTIGKRFASINVENVEDNRRALRELLFCTPGALQYLSGVILFEETLYQEHQGWQAFVDILKEGNVLPGXKVDKGTVELAGTTVRHTKV

SEQ ID NO: 10599 - protein, 464 aa, Silicibacter pomeroyi DSS-3
MATITNHMPTAELQALDAAHHLHPFSANNALGEEGTRVITRARGVWLNDSEGEEILDAMAGLWCVNIGYGRDELAEVAARQMRELPYYNTFFKTTHVPAIALAQKLAELAPGDLNHVFFAGGGSEANDTNIRMVRTYWQNKGQPEKTVIISRKNAYHGSTVASSALGGMAGMHAQSGLIPDVHHINQPNWWAEGGDMDPEEFGLARARELEEAILELGENRVAAFIAEPVQGAGGVIVAPDSYWPEIQRICDKYDILLIADEVICGFGRTGNWFGTQTMGIRPHIMTIAKGLSSGYAPIGGSIVCDEVAHVIGKDEFNHGYTYSGHPVAAAVALENLRILEEENILDHVRNVAAPYLKEKWEALTDHPLVGEAKIVGMMASIALTPNKASRAKFASEPGTIGYICRERCFANNLIMRHVGDRMIISPPLVITPAEIDEMFVRIRKSLDEAQAEIEKQGLMKSAA

SEQ ID NO: 10600 - protein, 329 aa, Burkholderia sp. DBT1
MARTIRIRQVGGPEVLQFEELDVGKPGPDELCIRVEAIGLNRAEAIFRAGRYIEPTNLPARLGYEASGVVERVGSGVGGVLPGDAICVIPAFSMNQYGVYAHKAIVPASAVIKRPEGLGAVEAAAVWMAYLTAYGALIDVGKLGKGDAVVIQAASSSVGLAAIQIANSVGAVPIATTRTSTKRSALLDAGAAHVIASLEQDLATEVMRITNGKGARIVFDPVGGPHVEILAQAMSRGGTFFVYGNLSGQPTPFPRWMLKHGQSMRGYLLFEITKDQSRLERACAFISDGLRSGQFKPFIAKTFSFDQMVEAHRYQALNQHIGKIIVTVP

SEQ ID NO: 10601 - protein, 259 aa, Mesorhizobium loti MAFF303099
MQKMLALANKIAIVTGASSGIGRATAKLFAEEGARVVVAARRQAELDTLVAEISDAEGTAVALAGDVRDEAYAKALVDLAVESFGGLDVAFNNAGAVGQMGPISGLSLEGWRETLDTNLTSAFLGAKYQVPAMIERGGGSLIFTSTFVGHTIGMPGMTSYAASKAGLIGLTQVLAAEHGPQGVRVNALLPGGTDTPASITNAPDAGPEVLAFVQALHALKRMAQPEEIARSALYLASDASSFTTGTALFADGGVSINRT

SEQ ID NO: 10602 - protein, 297 aa, Oryza sativa
  misc_feature (274)..(274): Xaa can be any naturally occurring amino acid
MSESNDLEVHQDVPEHCPGVLSEQAGKSSACEGCPNQGICSSGQAKEKDPDIELIREHLSPVKHKVLILSGKGGVGKSTVCGQIAFALAAQLEAENKQIGALDIDICGPSLPQVFGVQGEQIHQSGSGWSPIFVDENLSLMSIGFMLPSLDDAVIWRGPKKNGMIKQFLRDVDWDELEYLLVDTPPGTSDEHLSIVEYLREAGLSGAVIVTTPQEVSLLDVRKEITFCKKVGVPIIGVVENMSGFACPKCKIESQIFPASTGGAEKMCQEKGCXTFLGKISLNPRIGQCLDGRQIRY

SEQ ID NO: 10603 - protein, 485 aa, Ustilago maydis 521
MAKKQLCLPFSPLACTLDTNNAHKQQALYASLGCALEPLRSRRSATATATAKMDASDFVEDEAAIAQQKLSNEEYKIWKKNSPFLYDLVVTHALEWPSLTCQWLPDKESPAGQSYTQHRLLLGTHTSGQDQNYLQFAQVQLPTTGADGASNSAESRLDLKQYDEDKGEIGSYSATTARLSIVQKINHDGEINRARYCPQNCDLIATRSVTGKTYIFDRTKHSNTPSADGVCRPDIILEGQHKEGYGLSWSPLKQGHILAASEDTTVCHWDINNYTKPNNTLQPSATYTGHTAIVEDVAWHNHHESLFGSVGDDRQLLIWDIREPASAPKYRVEAHTGEVNALAFSPENENILVTGSSDKSVGVWDLRNLKVKLHSLESHTDEILSVCWSPHHATVLASASADRRVNLWDLSKIGQEQTPDDAEDGPPELIFVHGGHTSRPTDLAWSPHMEWALTSAAEDNIVMVWRPSKAVIDTGNEELTPDDLE

SEQ ID NO: 10604 - protein, 163 aa, Candida glabrata CBS 138
MFALVGRGARYTYLTTNKTTYNKTIKMLFQSKTDKKEWNPELTSEQLHVLKDKGTEAPGTGKYLYNDRTGVYTCANCDAPLYRSETKFDSGCGWPAFNGEIKGALKYKKDFSHGMMRTEIMCAKCGGHLGHEFKGEGWNKRLNLPNDSRHCVNSLSLNFKKEE

SEQ ID NO: 10605 - protein, 245 aa, Neisseria meningitidis MC58
MGGQKTHFGFSTVNEDEKAGKVAEVFHSVAKNYDIMNDVMSAGLHRVWKHFTINTAHLKKGDKVLDIAGGTGDLSRGWAKRVGKEGEVWLTDINSSMLTVGRDRLLNEGMILPVSLADAEKLPFPDNYFNLVSVAFGLRNMTHKDAALKEMYRVLKPGGTLLVLEFSKIYKPLEGAYDFYSFKLLPVMGRLIAKDAESYQYLAESIRMHPDQETLKQMMLDAGFDSVDYHNMSAGIVALHKGVKF

SEQ ID NO: 10606 - protein, 133 aa, Glycine max
MHQAIPYRTSILTGTCDMAHAGGIKEFNLANPSNVAAMVSESAVVIIGKRGCCMCHVVKRLLQGLGVNPPVYEVDEDHEAAVARHLFPQGAETVQFPAVFLAGKLFGGLERVMATHISGELIPILKDAGALWL

SEQ ID NO: 10607 - protein, 193 aa, Leptospira interrogans serovar Lai str. 56601
MPQVTSLAPDFKAEAVLGKEIKEIKLSDYKGKWVVLFFYPLDFTFVCPTEIIEYDNKLAEFKKLGTEVLGVSVDSAFTHLAWKNTPKKEGGIGEIKYPLIADLTKSISRDYNVLTEGGVALRGTFIIDPAGVIRQATINDLPVGRNIDEAIRLIKAFQFVEKHGEVCPANWDEGKKTMKADPEKSKDYFAAVN

SEQ ID NO: 10608 - protein, 288 aa, Physcomitrella patens subsp. patens
MKSKAQAVNVALDKAVPMQYPEKIREAMRYSLLAGGKRVRPALCIAACELVGGNEEMSMPAACAMEMVHTMSLIHDDLPCMDNDDLRRGKPTNHKVFGEDTAVLAGDALLTYAFEHIARDTTGVPADRVLRVIAHLGKAVGSEGLVAGQIVDIASEGDPTVGLETLEYVHTHKTAVLLESSVVCGAILGGASEDEISRLSKYARNVGLLFQVVDDILDVTKSSAELGKTAGKDLLADKATYPKLLGLEKSKAFAEELTRKAKDQLSVFDQQKAAPLLGLADYIAYRQN

SEQ ID NO: 10609 - protein, 101 aa, Zea mays
PTRASRPSNKCQRALADAERESTFIMIKPDEIQRRLIGEIISRCEKKVLYLKDSNLANVERSFAEKHYSDLECKPFFQGVVDYIISDPVEVMVCEGKSRIT

SEQ ID NO: 10610 - protein, 468 aa, Methanococcus maripaludis S2
MVTVMKFGGTSVGNGDRIRNVAKIVVNKTNEDNDVVVVTSAMTQVTNSLVEISAQALDVRDIAKINNFIEDLRRKHEIAIEQAIENHEIRVEVSKTIESSINELEKVLVGVSYLGELTPKSKDFILSFGERLSAPILSGAIRDMGKHSLYLAGRDAGIITDDNFTCAKVLRLEVSEKIKPLLKDGFIPIVTGFVAGTEEGHITTLGRGGSDYSAALVGLGLTADMVEIWTDVSGVLSADPRMVENVKQIPKMSYIEAMELAYFGAKVLHPRTMEPVMEKKIPLRIKNTFEPENEGTLITDSSETSNGIIKAITTIKDVILINIFGGGMVGVSGTAARIFNVLGKSNANVILITQGSSETNISIVIYDGELEAKKCVRELRDEFGECHLIKDITFDKEVCVVSVVGSGMKGAKGIAGKLFEAVSESGANIKMIAQGSSETNISFVINEDKLEPCLKTLHKTFVEDEINF

SEQ ID NO: 10611 - protein, 472 aa, Crocosphaera watsonii WH 8501
MTLNGDNPFLNLNYEPALENLGEDYYDQVAAAQFPQHILRFRNDDLLTQLGLSSNDVDDRHFIEAFGKFQGIRPFLALRYHGYQFGQYNPSLGDGRGFLYGQVRGVDAELYDFGTKGSGVTPYSRGGDGRLTLKGGVREVLAAETLHRMGVKTSRCLSLVETGESLWRGDEPSPTRSSVMIRMSRSHIRFGTFERLYYIKRPDLIKKLLDFVIDIYYPKIDLKSPDCYSLFYQELVKRHAQLTAQWMAAGFCHGVLNTDNMSITGESFDYGPYAFIPTYDSSFTAAYFDYSKRYCYGNQSFIVRVNLEMLHLPLMTLISPKILETALNKFDDYYQTAYTQEMLKRLGLFGLVEDGKELVEVTVDALKKSQVGYHQFFLDLMTEINLGWWQNETTILENSNLDDIYWKNWRKIYSKTLSKISPEKLEQIRKTINQFNSQIPLLRPQIELVWEAIANEDNWQPFNELVNKIQVK

SEQ ID NO: 10612 - protein, 167 aa, Triticum aestivum
  misc_feature (88)..(88): Xaa can be any naturally occurring amino acid
  misc_feature (108)..(109): Xaa can be any naturally occurring amino acid
  misc_feature (119)..(119): Xaa can be any naturally occurring amino acid
  misc_feature (129)..(129): Xaa can be any naturally occurring amino acid
  misc_feature (140)..(140): Xaa can be any naturally occurring amino acid
  misc_feature (150)..(150): Xaa can be any naturally occurring amino acid
  misc_feature (154)..(154): Xaa can be any naturally occurring amino acid
  misc_feature (160)..(160): Xaa can be any naturally occurring amino acid
  misc_feature (164)..(164): Xaa can be any naturally occurring amino acid
FMLSAFLIEMISVRFVSVLMGLQWHGSAAPLPDTGQWVLLALNEKLPGSVVGLLRAHVITLHHYLMLFMMLGFSVLFDCIKAPGLGIXTRYMFTMAVGRLLRTATFVXXILPSAKPWCXAGRYQIPGHXSSWAQKYYVQXLLINAIVRHXNDMXYAVSSXPDEXRRF

SEQ ID NO: 10613 - protein, 366 aa, Escherichia coli
MLPLHLLPVNRWKSLKLTLHHRKKGEVLIKVTHTGVCHTDAFTLSGDDPEGVFPVVLGHEGAGVVVEVGEGVTSVKPGDHVIPLYTAECGECEFCRSGKTNLCVAVRETQGKGLMPDGTTRFSYNGQPLYHYMGCSTFSEYTVVAEVSLAKINPEANHEHVCLLGCGVTTGIGAVHNTAKVQPGDSVAVFGLGAIGLAVVQGARQAKAGRIIAIDTNPKKFDLARRFGATDCINPNDYDKPIKDVLLDINKWGIDHTFECIGNVNVMRAALESAHRGWGQSVIIGVAVAGQEISTRPFQLVTGRVWKGSAFGGVKGRSQLPGMVEDAMKGDIDLEPFVTHTMSLDEINDAFDLMHEGKSIRTVIRY

SEQ ID NO: 10614 - protein, 172 aa, Populus trichocarpa
MLVNLGIPWVILGHSERRSLLNESNEFVGDKVAYALSLGLKVIACVGETLQQRESGSTMAVVAAQTKAIAANVSYWDNVVMAYEPVWAIGTGKVATPAQAQEVHLELRKWFHDNVGAEVAASTRIIYGGSVNGANCKELAGQPDVDGFLVGGASLKPEFIDIIKSATVKSQL

SEQ ID NO: 10615 - protein, 300 aa, Cyanophora paradoxa
MKPLQTNFNLLTYLYERKEIVEDTLNKSIPRGNPTFIYDSIRYSLSAGGKRIRPILCLASCELAGGTMEMALPTACALEMIHTMSLIHDDLPAMDNDSYRRGKPTNHIIYGEDLAILAGDALLAYAFEFIATQTKNVPADLIVKVIAQVAHSVTTSGLVGGQIIDLSSEGKSDTTLETLNFIHIHKTGALLEAAVLSGALLAGAKEKDMNRFLRYAQNIGLAFQIIDDVLDIISTEEKLGKSIGKDLKTQKATYPSFWGVEESIKQAELLVEEAKEEILYFDNKAIPLIAIADFIVNRNN

SEQ ID NO: 10616 - protein, 369 aa, uncultured marine bacterium 560
MAQRDYYEVLGVKKGSAEAEIKKAYKRLAMKYHPDRNAGDKASAEKKFKEVRKAYDIISDPQKRSAYDQFGHAGVEQQGAGGFGGGNPFGGGAGGFGDIFGDIFGGGNTKPDNRGPDLRYDLEIDLKQAAKGDTVRIRVPKNDTCDTCSGTGAKPGTKVKTCGNCHGSGQIQMQQGFFSIQRPCNQCHGTGEKIDTPCRTCGGQGIVRKQKTLSVKIPAGVDTGNRIRLSSEGEAGLRGGPSGDLYVQIHIKDHQIFQREGNDLYCEVPIDFAKATLGGSIEVPTLDGKLKINIPSGTQTAKLFRLRGKGMPAMRYNGSGDLLCQVKLETPVNLNSKQKQLLKDFSSSCNAKQYPESNSFFGKMKSFFE

SEQ ID NO: 10617 - protein, 419 aa, Zea mays
SCEKFVQVKYVSGSYDRVEGFELLNKAISEYETSKNNDSGSYRRLFYLALPPSVYPSVCKMIRSYCMSPSSHTGWTRVIVEKPFGKDLNTAEELSTELGQLFQEEQLYRIDHYLGKELVQNLLVLRFANRLFLPLCTLAMLSRFQRGKNKEDFGTEGRGGYFDQYGIIRDIIQNHLLQVFCLVAMEKPVSLKPEHIRDEKVKVLQSVEPIKHEEVVIGQYDGYKDDPTVPDDSNTPTFASVVLRVHNERWEGVPFILKAGKALNSRKAEIRVQFKDAPGDIFRCKKQGRNEFVIRLQPSEAMYMKLTVKKPGLEMATEQSELDLSYGMRYNDVKIPEAYERLILDTIRGDQQHFVRRDELRAAWEIFTPLLHDIDGGKLRSVPYKPGTRGPQEADELSRRMGYVQTHGYVWVPPTLSKV

SEQ ID NO: 10618 - protein, 859 aa, Vitis vinifera
  misc_feature (161)..(161): Xaa can be any naturally occurring amino acid
  misc_feature (256)..(256): Xaa can be any naturally occurring amino acid
  misc_feature (303)..(303): Xaa can be any naturally occurring amino acid
  misc_feature (485)..(485): Xaa can be any naturally occurring amino acid
  misc_feature (704)..(704): Xaa can be any naturally occurring amino acid
  misc_feature (764)..(764): Xaa can be any naturally occurring amino acid
  misc_feature (818)..(818): Xaa can be any naturally occurring amino acid
  misc_feature (838)..(838): Xaa can be any naturally occurring amino acid
  misc_feature (844)..(844): Xaa can be any naturally occurring amino acid
MSKAEVTMEVGNDGVAVITMSNPPVNALALASTVYISEFLWNFDFGSLILCVIAGLKEKYAEAMRRNDVKAIVVTGKGGRFSGGFDINVFQKVHKTADISHLPDASIDLLVNTVEDAKKPSVAAVEGLALGGGLEVAMACHARIAAPKTQLGLPELSLGVXPGFGGTQRLPRLVGLSKAIEMMRLPLSDVNKFLQLSKSISSEEGYKLGLVDAIVSSEELLKVSRRWALDIVDKRKPWVRSLHQTEKLGSVSEALXILKISRQQARKTVPHLPQHQACLDVIEEGIVHGGYSGLLKETKVFNXLVLSDTAKGLIHVFFAQRATSKALQKLLMLDPSLRTIYWLCWGQGPGHSCLCVGYLPIELPVGAITALMQNLILGTVPNVTDIGLKPRNVKKVAVIGGGLMGSGIATALITSNIYVVLKEVNSEYLLKGIKTIEANVRGLVTKGKLTQDKARKALSMLKGVLDYSEFKDIDMVIEAVIENIXLKQKIFSEIEKICSPHCILATNTSTIDLNLVGEKTSSQDRIIGAHFFSPAHVMPLLEVVRTEKTSAQVILDLMTVGKAIKKIPVVVGSCTGFAVNRTFFPYAQGAHFLVNLGVDPFRIDWVISNFGLPMGPFQLQDLSGYGVAVAVGKEFATAFQGRTFESPLVNLLLKNGRNGKQNGKGYYIYEKGSKPRPDPSVLPIIEESRRLANIMPGGKPISVXNQEILEMILFPVVNEACRVLDEGVVVRASDLDITSVLGMSFPSYRGGIVFWADEVGPYYXYTCLKKWSAMYGTFFKPSSYLEQRATKGIPLLLQLHQLQIHVSRVLQDPPGRQXYRVSRRIRTLFFFGSIGILXEAKIEXNYLLHDLNVGSNIIS

SEQ ID NO: 10619 - protein, 425 aa, uncultured marine bacterium 560
MTIKQIKAREVLDSRGNPTVEADVILSNGVFGRAMVPSGASTGQREALELRDGDKNRYLGKGVTQSVNNINHEINNALVGMKISNQQAIDQKMIDIDGTETKSRLGANSILAVSLACAHANANNNKQSLFRSFDFSETYQLPVPMMNIINGGEHANNSIDIQEFMIIPAGAPNFREALRYGAEVFHHLKKLLDQEGLNTAVGDEGGFAPDLSSNEEALKIIIKAIKSAGYKAGKDIFIGIDAASSEFYNNGTYNLSSEGLKLSNEEFTSYLASWVEKYPIISIEDGMDENDWSGWEMLTKKLSDKVQLVGDDLFVTNSKILARGIENNIANSILIKVNQIGTLTETFNAMKMALNAGYTCVMSHRSGETEDTTIADLSVATGCGQIKTGSLSRSDRLAKYNRLLRIEEELGDDAFYPGINAFKHL

SEQ ID NO: 10620 - protein, 332 aa, Rhizobium sp. NGR234
MQTGSTLHDDRTSVSALGGLGARARGASGRLLPEIWMQNGAKRVEQALARLLCAEDHGETELMAAMRYATLHGGKRTRALLCLAAGALADTPAHILDDVGAAIEMMHACTLVHDDLPAMDDDVLRRGLPTVHVKFGEATAILVGDALQAHAFLTLASLDAPGDNRIALVRELAQAVSAEGAAGGQAMDLSLVGKHVELDRIVAMHRMKCGALVRASVRMGALCAIAEDAADATLYCALDHYSACFGLALQVVDDILDATADTATLGKTPGKDAAAQKPTCASIMGLQAARQFALDLLCEAGEAIAPLGPRAERLAQMLQRASAYLFKHAPSA

SEQ ID NO: 10621 - protein, 423 aa, Aspergillus oryzae
MADLRGRKIFKVFNQDFIVDERYNVTKELGQGAYGIVCAATNIQTGEGVAIKKVTNVFSKKILAKRALREIKLLQHFRGHRNITCLYDMDIPRPDNFNETYLYEELMECDLAAIIRSGQPLTDAHFQSFIYQILCGLKYIHSANVLHRDLKPGNLLVNADCELKICDFGLARGFSIDPEENAGYMTEYVATRWYRAPEIMLSFQSYTKAIDVWSVGCILAELLGGRPFFKGRDYVDQLNQILHYLGTPNEETLSRIGSPRAQEYVRNLPFMPKIPFQRLFPSANPDALDLLDRMLAFDPSSRISVEEALEHPYLHIWHDASDEPTCPTTFDFHFEVVDDVQEMRRMIYEEVVRFRAAVRQQSQAQAAAAAQQQQIAQQTNVPIPENQQGVWKQEEPKPQEALAAGGGVHNDLESSLQRGMDVQ

SEQ ID NO: 10622 - protein, 168 aa, Rhodomonas salina
MSNRRKSNKLKEKETDWQERVVQIRRVTKVVKGGKKLSFRAILIIGNEKGEVGVGVGKASDVIGAVKKAVSDGKKKIVSVPITKDSSIPHIVKGRSGAAKVIMRPSAPGSGVIAGGSVRTILELAGVKNILAKQLGSNNPLNNARAATDALLKLKTFSQVAQDRGITS

SEQ ID NO: 10623 - protein, 234 aa, Triticum aestivum
  misc_feature (202)..(202): Xaa can be any naturally occurring amino acid
MASTPPQADYGKEAVLDVSENQDVETGEVKNGGLQRDLKNRHMQMIAIGGAIGAGLFVGSGGALQKGGPAALLIGYLIIGIMLLCTCLALAEMAVLYPVNGAFFTYICRFVDPSWGFAMGWQYALAWLTVLPFELIAASITIKFWREDINMAVWVSVFLVTLIGIQFFGVRGYGEVEFVLSIIKICAWCGFIILGIVINCGXGVGDQGYIGVKYWQDPGAFTSFKGFCAVFVVA

SEQ ID NO: 10624 - protein, 164 aa, Zea mays
MASATVLKSSFLPKKSEWGATREGGAARAATGSMGGRASAYADEVVENAKKIASPGGGILGMDESNATWGKRLAAIRLENTEGNRQGDRTLVVTAPGLGQYISGGILFEEKLEQSAVDGRKNVDILAEQGIVAGIKVDKGLVPLGGSNNKSWWQGLDGLASREG

SEQ ID NO: 10625 - protein, 233 aa, Escherichia coli CFT073
MNMKISPSLMCMDLLKFKEQIEFIDSHADYFHIDIMDGHFVPNLTLSPFFVSQVKKLASKPLDCHLMVTRPQDYIAQLARAGADFITLHPETINGQAFRLIDEIRRHGMKVGLILNPETPVEAMKYYIHKADKITVMTVDPGFAGQPFIPEMLDKVAELKAWREREGLEYEIEVDGSCNQATYEKLMAAGADVFIVGTSGLFNHAENIDEAWRIMTAQILAAKSEVQPHAKTA

SEQ ID NO: 10626 - protein, 593 aa, Zea mays
STATTRLLSSQSVWPSMAGQTSKAKEAGKDDREEPGAEAAKEKLVPSHQQQESPASVVDKDSSGVSSVPGDESPVLEGDSVELKVEENLDGNGNKENKTSQKSSTSDGFASAKVSDGTSSLRKTSGSVAMSTRADFTESGKSSMCRASTASDISDESSCSSMSSATTKPHKGNDSRWEAIHVVKSRDKVLGLNHFRLLKKLGSGDIGSVYLSELSGTRSYFAMKVMDKTSLASRKKLLRAQTEREILQSLDHPFLPTLYTHFETDKFSCLVMEFCPGGDLHTLRQRQPGKYFSEQAAKFYVAEVLLALEYLHMLGIIYRDLKPENVLVREDGHIMLSDFDLSLRCSVSLTVIKSANPGLDALQRNNAAYCAQPACIEPSCIQPSCVAPTTCFGPRFFSKSKSKSKSKPKKEKSKPDGPNQENLFPELIAEPTDARSMSFVGTHEYLAPEIIKGEGHGSAVDWWTFGIFLYELLFGKTPFKGSGNRATLFNVVGQPLRFPESPIVSFSARDMIRGLLVKDPQHRLGYKRGATEIKQHPFFEGVNWALIRCASPPDIPKPLELECRPKQVPSANGKVAPVANQKGPDNYLEFEFF

SEQ ID NO: 10627 - protein, 507 aa, Rhodopirellula baltica SH 1
MNALLPHDEHNQQLEANVHPTDWQNPSPKQPYHLVVIGAGTAGLVTAAGAAGLGARVALIERDLMGGDCLNVGCVPSKGVISAARVAATVKNASDFSVHVPNGVEIDFDGVMSRMRELRAKISQNDSAKRFQDLGVDVYFGQASFTDSQTIDVQGTKLQYKRAVIATGARAAAPPIKGLDQVDYLTNETVFSLTKLPKRIGIIGAGPIGCEMAQTFAQLGSEVFLIESQHGILPKEDREAADIVQKAMLADGVQLLCCGHDLEIKNEGGIRLTLNSHGNQYDQPVDQLLVAVGRAPNVEKLNLDAVGVKFDKNGVEVNDNLQTTNPNIFAAGDVSSKYQFTHVADFLARIVIQNSLFAIGPFGKKKASELIIPWATYTSPEIAHVGMYEQDAKDAGIEIDTYVQHFREVDRAILEGEEEGFVRIHTKKGTDKIVGTTIVAKNAGDMISEITVAMNNNVGLGAIANAIHPYPTQAEAIRKLGDQYNRTRLTPFSKTMLHALMRWNVGR

SEQ ID NO: 10628 - protein, 384 aa, Prochlorococcus marinus str. NATL2A
MFFDTDSSAILLLEDGTYFEGLSFGAVGTISGEVVFNTGMTGYQEVITDPSYYGQLITFTYPEIGNTGVNYEDNESSHPSVKGVIARQISKTPSNWRHEISFENWLNDEKVVGIHGIDTRSLVRHIRESGSLNGIISSESKYSIAELFSLLKKSPSMSGLNLVDKVTTKRAFNANSSCPVAFDMRIKNTQTIPYKVVAIDFGIKQSILDRLVAHGCEVTVLPASAEMTDVLALSPEGVFLSNGPGDPSTVHSGINLAKDLIEYKKLPVFGICLGHQILGLALGGKTFKLSYGHRGLNHPCGLNGKVEITSQNHGFALNSESLNSEKIKITRLNLNDQTVAAISVIDRPFFGVQYHPEASPGPHDADHHFNHFVTLIEERRRIVD

SEQ ID NO: 10629 - protein, 227 aa, Kluyveromyces lactis NRRL Y-1140
MGKKVPKSESTAFKFPIELYSLNENSEKHNYEFIPYPEVEQDSKVILINKFFDKKLCDVLIRHISGSNVMESFSQRGTKDFAARANDRFSITDEEIASIIWSRIQKCLLQDPYIADDLQFSTAKGLNPQLRVYRYEKGHHFGRHYDESVNVPRMGTTQWTLLIYLSGDSELIGGDTIFYSAWNNAASNVHPSKGLALLHKHGDDCLLHEAQLVEKGTKWVLRSDVVF

SEQ ID NO: 10630 - protein, 632 aa, Pseudomonas aeruginosa PAO1
MHRTSRRTFVKGLAATGLLGGLGLWRAPAWALAGPGQQNLLAGDSFDLFIGETPVNLSGSPAAAMTINGSLPGPTLRWREGDNVTLRVRNRLAEDTSIHWHGIILPANMDGVPGLSFEGIAPGGLYEYRFKVRQNGTYWYHSHSGLQEQAGVYGALVIDAREPEPFSYDRDYVVLLSDWSDEKPQRILAKLKKQSDYYNFHKRTVGDFIDDVSANGWAATLADRKMWAEMKMSPTDLADVSGYTYTYLLNGQPPDGNWTGLFRPGEKLRLRFVNASAMSYFDVRIPGLKMTVVAADGQHVEPVSVDELRIAVAETYDVIVEPGGERAYTLFAQSMDRSGYARGTLALAEGLSAPVPTPDPRPLIGMDDMGMGGMDHGAMGHGAATRPASEMDHSKMSGMDVNGMDHSKMAGMDMSGMDHSKMAGMDMNGMDHSKMAGMDMNGMDHSRMGMGAMPMQSHPASEDGNPLVDMQTMTPTPKLADPGLGLRDNGRRVLTYADLRSRFADPDGREPGRTIELHLTGHMEKFAWSFDGIKFSDAEPLRLTYGERLRIVLVNDTMMTHPIHLHGMWSDLEDEQGNFLVRKHTIDMPPGTRRSYRVTADALGRWAYHCHLLFHMEMGMFREVRVDEGDNA

SEQ ID NO: 10631 - protein, 99 aa, Triticum aestivum
AIGTGKVASPEQAQEVHAAVRDWLKTNVSADVASTVRIIYGGSVNAANCAELAKKEDIDGFLVGGASLKGRDFATICNSVTSKKVTADVETTTYMVRNK

SEQ ID NO: 10632 - protein, 388 aa, Moritella sp. PE36
MNLHEYQAKQLFAEYGLPVPEGYATNVPHEAAAFADKIGGDKWVAKCQVHAGGRGKAGGVKLVTSKEEITAFAEYWLGKNIVTYQTDAKGQPVSQILVEAAGDIANELYLGAVIDRGSRKVVFMASTEGGVDIETVAEQTPELIHKATIDPLVGAQPFQARELAFKLGLQGAQIKQFTQIFMGLAKMFTDCDMALLEINPLIVTGAGDLVCLDGKITIDSNALYRQPKLRAMQDITQEDAREAHAAKFELNYVALDGSIGCMVNGAGLAMGTMDIVNIHGGKPANFLDVGGGATKERVAEAFKIILSDDNVKAVLVNIFGGIVRCDMIAEGIIGAVQEVGVKVPVVVRLEGNNAELGRAVLAKSDLNIIAASSLTDAAQQVVAAAEGK

SEQ ID NO: 10633 - protein, 427 aa, Coccidioides immitis RS
MAPKSRVIIDTDPGIDDILALLLAFSSKAEEIEVLLVSLTFGNIEVRSCLRNAVSMFHIIEKEMEWRHNRGLAPGFEALMASKPLMAVGAEEPLTGEKMLADYFHGKDGLGNVHTSHPHLTPAQGWESLFSPLPASVEELEAAARRHSSFIASTKPAYEEMLRLLRENDPGTITIIALGPLTNLALAAAEDPETFLRVKEVVVMGGAVDCPGNVTPTAEFNTYADPVAAARIFALTSQMPLSTMPPADLPSALPVYPATLSKQLKVKLVSLDVTRSHNLTRGQFRDRIASTVATRSPLVEWTSAILEHSFAKLDAMHPGHEGDMAALSLHDPVCIWYALLPDSWQWMLSLDSPLDLRVETTGQWTRGMCVVDRRNRKRRDHDDPDVEDNGLWLANRSGNRVDWVVGTPGPDMFAGYVMDRLFVKHQN

SEQ ID NO: 10634 - protein, 829 aa, Arabidopsis halleri
MRGAVPNIHHSYIFFFLFFVIVLFPDFSISANTLSATESLTISSNKTIVSPGGVFELGFFRILGDSWYLGIWYKKISQRTYVWVANRDNPLSNPIGILKISNANLVILDNSDISVWTTNLTGAVRSPVVAELLDNGNFVLRDSKINESDEFLWQSFDFPTDTLLPQMKLGRDHKRGLNRFLTSWKSSFDPSSGSFMFKLETRGLPEFFGFTTFLEVYRSGPWDGLRFSGIPEMQQWDDIIYNFTENRDEVAYTFRVTEHNFYSRLTINTVGRLEGFMWEPTQQEWNMFWFMPKDTCDLYGICGPYAYCDMSTSPACNCIKGFQPLSQQEWASGDVTGRCRRKTQLTCGEDRFFKLMNMKLPATTAAVVDKRIGLKECEKKCKTHCNCTAYANSDVRNGGSGCIIWIGEFRDIRNYAADGQDLYVRLAPAEFGERSNISGKIIGLIIGISLMLVLSFIMYCFWKKKQRRARATAAPIGYRDRIQESIITNGVVMSSGRRLLGEKEDLELPLTEFETVVMATDNFSDSNILGRGGFGIVYKGRLLDGQEIAVKRLSEMSSQGTNEFKNEVRLIARLQHINLVRLLSCCIYADEKILIYEYLENGSLDSHLFETTQSSNKLNWQTRFNIINGIARGLLYLHQDSRFKIIHRDMKASNVLLDKNMTPKISDFGMARIFERDETEANTRKVVGTYGYMSPEYAMEGIFSVKSDVFSFGVLVLEIVSGKRNRGFHNSGQDNNLLGYTWENWKEGKGLEIVDSIIVDSSSSMSLFRPHEVLRCIQIGLLCVQERAEDRPKMSSVVLMLGSEKGEIPQPKRPGYCVGRSSLDTDSSS

SEQ ID NO: 10635 - protein, 303 aa, Glycine max
  misc_feature (80)..(80): Xaa can be any naturally occurring amino acid
  misc_feature (93)..(93): Xaa can be any naturally occurring amino acid
QLRRPPPPHVNISLSRIGGEDCCSTCMGNCVLSTTCACANKTGGKFAYNTEGLLKEEFLEECIAISRNPQQHCYVGLPPXCKNCPLERSKSDXCLEPCKGHLKRKFIKECWSKCGCGKQCGNRVIQRGITCHLQVFFTSEGKGWGLRTLEDLPKGAFVCEFVGEILSMKELHERNLKCTENGKYTCPVLLDANWDSGYVKDEEALCLDAASFGNTARFINHRCSDANLIEIPVEVEDPGHYYYHFAFFTSRKISAQEELTWDYGIDFDDHDHPVKLFQCRCGSKFCRNMKRYSRSLRYASIAG

SEQ ID NO: 10636 - protein, 511 aa, Rhodobacter sphaeroides 2.4.1
MHSARPSGQPQIHCPREDQMLDSVTDLRSLLKDPSLLETRAFVAGEWVDADDGATFEVTNPARGDVICTVPDLGRAETARAIAAAEEAMKEWAARTGKERAQVMRKWFDLMMANQDDLGAILTAEMGKPLAEAKGEIAYGASFIEWFGEEAKRIYGETIPGHMRDKRITVLKQPIGVVGSITPWNFPNAMITRKCGPALAAGCGFVARPAAETPLSALALAVLGERAGLPKGILSVITSSRSSDIGKEMCENPIVRKLTFTGSTEVGRILLRQAADQVMKCSMELGGNAPFIVFDDADLDAAVQGAMASKFRNNGQTCVCANRIYVQSGVYDAFAEKLAAAVKKLKVGDGLVEGTEAGPLINEKAVAKVEEHIRDVLDGGGQVLTGGKRHALGGTFFEPTVVTGVKQEMKVSTEETFGPLAPLFRFETEDEAVGYANDTIFGLASYFYARDVGRITRVQEALEYGIVGVNTGIISTEVAPFGGVKQSGLGREGSRHGIEDYLEMKYICLSI

SEQ ID NO: 10637 - protein, 362 aa, Zea mays
MVVGAGRGPLVRASLQAAEETGRKLKVYAVEKNPNAVITLHSLIKLEGWESLVTVISSDMRCWDAPEKADVLVSELLGSFGDNELSPECLDGAQRFLKPDGISIPSSYTSFIQPITASKLHNDIKAHKDIAHFETAYVVKLHRIATLAPPQQVFTFTHPNFSPNASNQRYTKLQFEMLPDMGSCLVHGFAGYFDSVLYKDVHLGIEPNTATPNMFSWFPIFFPLRKPIYVPEGSPIEVHFWRCCAPTKVWYEWAVTTPTLSPIHNSNGRSYWAFQVIVRNKKRVGYNYELSLRFSGEWLIKEENKKIKGHLDIPEFSFGEIDDLEVQVRLGDDKGLASDDRTRICKDSQVLFGADPGENAHV

SEQ ID NO: 10638 - protein, 133 aa, Populus trichocarpa
MGSVEEHSSLLEDGLIQQDESNGLYTGDGSVDINGNPVLKQKTGNWKACPFILGTECCERLAYYGIATNLVTYLTKKLHEGNVSAARNVTTWSGTCYLTPLIGAVLADTCWGRYWTIAAFSSIYFIVTVNRTH

SEQ ID NO: 10639 - protein, 461 aa, uncultured marine bacterium 560
MTSSLKFAELGEEYFSRVETQRLENTHLIHVNNDLKVKLELNLSKKELLGVCTGETKLDGIEPLSSVYAGHQFGYFVPQLGDGRSCLIGEANGYELSLKGAGTTPYSRGADGRAVLRSSIREYLCSIAMEGLNIPTTKALAIVASDTDVYREHVESGAIVTRVAKSHIRFGHFELFASRGQTAEVKKLADFVIDHYYPQLKGKDSYLQLFKTNILSTAVMIARWQAQGFAHGVMNSDNMSILGLTIDYGPFSFMETYNPSFICNHSDHQGRYSFERQPSVALWNLERLANAIRSLIDETHLKDALAEYEGFLVKEYSALMRQKFGLVEVKEDDSKLVNDYLQLLYLHRKDYPLSMRLLSKEHNNMGFDFDSWFERYHQRLIQEKIKPNQRQQSMDSVNPKYVLRNYLAEVAIRKAEDQQQFEEIETLFNLLKNPFAEHKGFDSYTKEAPEWAKNLELSCSS

SEQ ID NO: 10640 - protein, 304 aa, Ostreococcus tauri
MSNATSAVNSANLMPKASINTFADMAKFKISPARTALLDYIEGVGDSLARASVCSTTANRCNWAIDRVISFLCCIEDRLKLFPRTTPSTRFGDPNFRIWSQHLQICSKGLVGDITPPERQDLKLELEEYLQNSFGNPLRLDYGTGHELNFVAFLCCLEKTGIATTEQRSLVALNIFARYTSLIRIIQRHFRLEPAGSHGVWGLDDYCFIPFLWGAAQLQHETSTPRNILDANFPCGGLFFESCTHVKQTKSGPLTVVSPVLASLSTVRTWSKVFEGLLKMYCGECLDKFQIMQHFHFGVILQLE

SEQ ID NO: 10641 - protein, 184 aa, Rhodopirellula baltica SH 1
MKADKQLVSTSKFLSLVLRHQPGVIGMTLDEQGWLEIDGLIANANTRGKKLTLELIHEVVATNDKKRFVLSDDGLRIRASQGHSVAGVDLNLTEANPPATLYHGTVDAFLPRIREQGLQKRSRNHVHLSADEATATNVGSRRGKPKLLLIAAQRMHQDGHIFYLSENEVWLVDSVPPTYLTFPT

SEQ ID NO: 10642 - protein, 336 aa, Photobacterium sp. SKA34
MEVLVTGGMGYIGSHTCVQMIQAGITPVIIDNLSNAKIEVLARIEVLTGKMPVFHQGNVQDEAFLDSVFAKHDIKAVIHFAGLKAVGESVEKPLEYYDNNVNGSLVLARAMRKAGVKSIVFSSSATVYGDPEIVPITEDSPTGATTNPYGRSKYMVEECFKDLFHAENDWSITLLRYFNPVGAHSSGTMGEDPQGIPNNLMPFIAQVGIGRRDRLSIFGNDYPTPDGTGVRDYIHVMDLADGHIAALNALCDRAGLHIYNLGTGKGSSVLEMVDAFAKACGNQVPYIICPRRAGDIAECWASTDKAERDLNWKATRSIKEMTVDTWNWQSNNPNGY

SEQ ID NO: 10643 - protein, 395 aa, Moritella sp. PE36
MTIEILVPVLPESVADAAIAIWHKRPGDAVERDDIIVEIETDKVILEVPAVEAGVLVEIIEDDGATVLGQQVIGKLKVGAVAGEETKDKPAAASEESVDASPAVRRLIAEKGLDASKITGTGKNGLIIKEDVEKALSAPAVAPVAKAAAPAPVVSAPVELQPGRSEKRVPMTRLRKRIAERLLEAKNSTAMLTTFNEVNMKPIMDLRKQYKDIFEERHGIRLGFMSFYVKAVVEALKRYPEVNASLDGTDIVYHNYFDVSIAISTPRGLVTPVLRDCDSMSLADIEKNIRHLALKGRDGKLSIEDLTGGNFTVTNGGVFGSLMSTPIINPPQSAILGMHKIQDRPMAVDGQVVILPMMYLALSYDHRIVDGKESVGFLVTIKELLEDPTRLLLDV

SEQ ID NO: 10644 - protein, 623 aa, Candida glabrata CBS 138
MSDFKDNSADFNDKVSDKEVEYMSPREVSVTPETSATPNTPAPSQFRRFVDSFKRAEQQNNSEITSAASCDGSSENLDKDGKEVADLEVQENQVLTEKSNQKNKELKQTIKPRHVILISLGTGIGTGLLVGNAKALHNAGPAGLLIGYSIMGTCLYCIIQAAGELAVSYSSLSGGFNVYPSFLVDPAFGFSVAWVYCIQWLCVCPLELVTASMTIKYWTTTVNADIFVGIFYVLIIVINTFGARGYAEAEFFFNCCKILMMIGFFILGIVINTGGAGNDGYIGDRYWHTPGAFAGDRPIDHFKGIMATMVTAAFAFGATEFIALTAAEQSNPRKAIPSAAKKVLYRILFIFLGSITLVGFLVPYDSDQLMGSGGSATKASPYVLAVSTHGVKVVPHFINAVILLSVLSVGNSAFYSSSRLLYSLAQQGNAPKFFDYVDREGRPFRAMVCAGVFAIISFCAASPKEEQVFTWLLAISGLSQVFTWFAICLSHIRFRKAMFVQKRSLGEIGFKAQTGVWGSYYVCFMLVMILIAQFWVAIAPIGEGKLDAQGFFENYLAMPILILFYVGYKIWKKDWSLFIRANNIDLDKHRQIFDEELLKQEDEEYREKLKNGGYLKRIAAFWC

SEQ ID NO: 10645 - protein, 453 aa, Nocardioides sp. JS614
MTPRSAEASPVTRQSSSGGSPSSRGTTRTLQTTTDADGQVTSRVRRTVLPSGLRVISEHQAGVRSAAIGVWVGVGSRDESPSLHGCSHFLEHLLFKGTTERSALDISVALDAVGGEFNAFTAKEYTCFHARVLDEDLPLAVDVLGDMITASTLTAEDVEAERDVILDEIAMHDDDPDDVVHNLFAEQAWGDTPLGRPIAGTVGSIRSLSRDQVRRFYRRHYRPANVVVAAAGNVDHAQLVRQVRTAFARNGWLDGRDTPVVPRHGTRKRVRPGVLATTRPFEQVNVVLGMEGLRRDDDRRFALGVLNTALGGGTSSRLFQEVRERRGLAYSVFSFATHHADSGLVGVSVGCLPNKLDDVLAVVREELAKVAESGITAEELARGKGQLRGGLVLGLEDSASRMSRIGKAELVHDRLMSIDEVIARIDGVTLEEVQSIAAEVFARPEILAVVGPA

SEQ ID NO: 10646 - protein, 260 aa, Zea mays
  misc_feature (218)..(218): Xaa can be any naturally occurring amino acid
VFSEWNKGELLSFLIEITADIFGIKDDKGEGYLVDKVLDKTGMKGTGKWTVQQAAELSVAAPTIEASLDSRFLSGLKDERVEASKIFQGDYSTGLPVDKAQLIEDVRQALYASKICSYAQGMNIIKAKSSEKGWGLNLGELARIWKGGCIIRAIFLDRIKKAYDRNPNLANLLVDPEFAQEIIDRQAAWRRVVCLAINNGVSTPGMSASLAYFDSYRXDRLPANLVQAQRDYFGAHTYERVDMPGSFHTEWFKIARNSKI

SEQ ID NO: 10647 - protein, 455 aa, Pyrococcus horikoshii OT3
MNMDWVESLKKKIKDRSAIIGIVGLGYVGLPLAVAFSKKFNVIGYDINTKKIDSLKKRKSYIEDVRDDEINLNRLQPTNDPEDLKKCDFIIITVPTPLREDKTPDLSYVKDAARTVGRILRRGQFVILESTTYPGTTEEVLIPILEEESGLKVIEDFGVAYSPERIDPGNKRYKIENTPKVVGGLTPEFTELASMLYGSVIEKIVPVKDCKTAEAVKMLENVFRNVNIALVNELALIFEKMGIDIWEVIEAAKTKPYGFMAFYPGPGVGGHCIPVDPYYLSYRAKQFGIIPRFIETAGEINNYMPVHTVNLAETGLRKIGRKIRGAKVAVLGLAYKADISDTRESPAIKIIEELIERGAQVKVYDPYVKSVRTKFGTFRVTETLEDILKWSDCVIFVTDHSLFKEKMEEILKIFGETSTKKVIVDSRNIFEKVSPSTFFNSKLEYIKLGFGLGGE

SEQ ID NO: 10648 - protein, 509 aa, Oryza sativa Japonica Group
MAVAAPGQLNLDESPSWGSRSVDCFEKLEQIGEGTYGQVYMARETETQEIVALKKIRMDNEREGFPITAIREIKILKKLHHQNVIQLKEIVTSPVHGNKYKGSIYMVFEYMDHDLTGLADRPGMRFTVPQIKCYMKQLLTGLHYCHINQVLHRDIKGSNLLIDNEGNLKLADFGLARSFSNDHNGNLTNRVITLWYRPPELLLGSTKYGPAVDMWSVGCIFAELLNGKPILPGKNEPEQLSKIFDVCGTPDESNWPGVTKMPWYNNFKPPRQLKRRVKEYFKHFDRLALDLLEKMLTLDPAQRISAQDALDAEYFWSDPLPCDPKSLPKYESSHEFQTKKKRQQMRQADEAAKRQKTQHPQPHGRLPPIQQTGQPHPQIRPGQPMNNPHAPMAAGPGHHYAKPRGPGGSSRYPQGGNQGGGYPNRGGQGGGGSYGNAPYPQQGRGPPPPYPGSGMAGTGGPRGGVGGGYGGGSNYPQQGGPYGPSGPGRGSNYPQQGGSRNQQQYGNWQ

SEQ ID NO: 10649 - protein, 556 aa, Cryptococcus neoformans var. neoformans B-3501A
MDGKPATQYQAWKKLQSLHASKADKLVLKDLFKADPKRFSNLSKTFSSSSPNVSLLLDYSKNLVDDEVLSTLFDLAREAKVETFRDEMFAGKHINTSEDRSVLHIALRNPPADKGGFKISEAGVDEVHAVLAHMKEFSDSVRSGAWKGYTGKAIDTIVNIGIGGSDLGPVMVCEALKHYSKRDLKTHFVSNIDGTDMAEVLKACNRETTLFIVASKTFTTQETITNAESAKEWFLEQAKEKAHVAKHFVALSTNTKGVTEFGIAESNMFQFWDWVGGRYSLWSAIGLSICLSIGFDNFQELLNGAHEMDKHFKTAKLEDNLPVILALVGIWYNDFYGAQTQALLPYDQYLKKFADYFQQGDMESNGKSVTKDGSRVDYETGPIIWGQSGTNGQHAFYQLIHQGTKLIPCDFLAPVETLNPISGGKHHEILLSNFFAQPEALAFGKTEEEVIKELGPEQSKNSALVKSKIFEGNKPTNSIMFQKLTPGTLGALIALYEHKIHVQGAIWGINSYDQMGVELGKVLAKAILKQLGSENDVQGHDSSTTGLIHFYQKNRK

SEQ ID NO: 10650 - protein, 139 aa, Klebsiella pneumoniae
MKVLVTGGSGYIGSHTCVQLLQRGHEVVILDNLCNSKRRILPVIERLGGKEATFIEGDIRNEARMTEILHDHAIEAVIHFAGLKAVGESVAKPLEYYDNNVTGTLKLVSAMRAAGVKNFIFSSSATVYGDQPKIPYVES

SEQ ID NO: 10651 - protein, 471 aa, Oryza sativa Japonica Group
MRSSSDCKVVAAAARKKEKEAAAWPWSLWGFLLTGCLGGGGGGGKKKSGGKKVRPRGGGGGGLRRLSFTDLTGAADQDLSVSLVGSNLHVFTVAELRDATRGFVSGNFLGEGGFGPVYKGLVGDGVKPGLRPQAIAVKLWDPEGAQGHKEWLAEVIFLGQLRHPNLVKLVGYCCEDENRLLVYEYMEHGSLENHLFKQIPAVLPWSTRLNIAVGAAKGLAFLHDAEKPVIYRDFKASNILLDSDYKAKLSDFGLAKDGPEGDDTHVSTRVMGTHGYAAPEYIMTGHLTAKSDVYSFGVVLLEILTGRRAVDKTRPNREQSLVEYARPCLRDPLRLIRIMDPALEGRYSPAAAREAAAVAYRCLSGSPKNRPDMSAVVDALEPLLVATDDVPLGPVVLFVAPDQEADAAAAADDDEDDKARRRQRRTRKDEQHRRRSRLRTSPKGSPRKPAVAAACRNEEFWVWHVPADHKA

SEQ ID NO: 10652 - protein, 520 aa, Zea mays
MAVAAPGQLNLDEAPSWGSRSVDCFEKLEQIGEGTYGQVYMAKETGTNEIVALKKIRMDNEREGFPITAIREIKILKKLHHQNVIKLKEIVTSPGPERDEQGKPIDGNKYKGSIYMVFEYMDHDLTGLADRPGMRFTVPQIKCYMRQLLTGLHYCHVNQVLHRDIKGSNLLIDNEGNLKLADFGLARSFSSDHNGNLTNRPYSCCCKLLKSSWIGCRPPELLLGSTKYGPAVDMWSVGCIFAELLNGKPILPGKNEPEQLTKIFELCGTPDDTIWPGVTKMPWYNNFKPPRPLKRRVKDFFKHFDRHALDLLEKMLTLDPSQRISAKDALDAEYFWTDPLPCDPKSLPKYEASHEFQTKKKRQQQRQAEEAAKRQKLNHPPPHSRLPPLQQPGQAHPQMRPGQGMHNVPPVAAGPGHHYAKPRGPGGPNRYPQGGNQGGGYNPNRGGQGGGYGSGPYPQQGRGPPYPGAAGPRGSGGSGYGAGGPNYQQGGPYGTSGPGRGPNYSQGSGSRNQQQYGNWQ

SEQ ID NO: 10653 - protein, 310 aa, Neisseria meningitidis MC58
MKIANSITELIGNTPLVKLNRLTEGLKAEVAVKLEFFNPGSSVKDRIAEAMIEGAEKAGKINKNTVIVEATSGNTGVGLAMVCAARGYKLAITMPESMSKERKMLLRAFGAELILTPAAEGMAGAIAKAKSLVDAHPDTYFMPRQFDNEANPEVHRKTTAEEIWRDTDGKVDVFVAGVGTGGTITGVGEVLKKYKPEVKVVAVEPEASPVLSGGEKGPHPIQGIGAGFIPTVLNTKIYDSITKVSNEAAFETARAIAEKEGILVGISSGAAVWSALQLAKQPENEGKLIVVLLPSYGERYLSTPLFADLA

SEQ ID NO: 10654 - protein, 580 aa, Nocardioides sp. JS614
MVLRPNVLTVKGGGRLLVTMVTSPEARSTLRGTPVVPAVAYGPAVLVRSEVSPDAIARFDPSGLDPETALQTYESAAQSVSDGFARKAEKASGAAAEVLTASAGLARDKGLRGAVRKHLSAGDDLLAAVHAGVEQFVTVFTGMGGLMAERVTDLRDIERRIVARLVGEPEPGVVVPETPAVLLAEDLAPSDTAGLHPAVVLGLVTERGGPTSHTAIIARQLGIPCVVGVHGAMAVPAGTPLLLDGVAGTVELGPDPATAQERVAADAALRAALASWSGPGGTADGVPVKILANVADGESARAASSAPVQGVGLFRTELCFLNRQDEPSVEEQASIYGEVLGAFGNERYVVVRTLDAGSDKPVAFATHVGEENPALGVRGLRLSFDNPGLLDRQLEGIAKAAAATGTEAWVMAPMVATVAEAAEFSTKVRAHGLKAGVMIEVPSAALLAHRVLEVVDFLSIGTNDLTQYTMAADRMATDLAHLTDPWQPAVLQLIAITAEAGFHAGKPVGVCGEAAADPLLACVLVGMGVTSLSMAAAAVRPVGARLATVPMDLCEDAAEVALAATDPASARDAVRTLLLG

SEQ ID NO: 10655 - protein, 468 aa, Pseudomonas aeruginosa PAO1
MNDPQGFEAISRREQGLQRRLSAAQMSMIAIGGAIGTGLFMGSAFAIGFAGPSVLLSYAIGALITLLLMGCLAEMTVAHATPGSFGAFAEHYVGPLAGFLVRYAYWAAIVLAVGTEVTAVAMYMKYWFAGIPEWVWIISFSTLLIGLNASSVKAFGNFEYCFSTLKIAAIVAFILLGAYLVFGSANPAYGVHNYSAHGGFFPHGLKGMWIAVVVSIFSYLSVEMIAVAAAEAEHPEQAVRSAFRSTIVRLVVFYLLTLALMLAIVPWDQAGQSQSPFVTVMQAIGLPGATGVMNFVVLVAALSAMNSQLYITTRMMFSLSRAGHAPKGLGELSRQGVPLNALLLSSVGIALATLLNLVYPEQSFTLMMAVSMFGALFTWLMIFFTHLCFRRHRARHGGAPLAFRMRLAPWSTLLGLALMAAILVTTFFTEAFRMTLVFGVPFLALLSALYLVFVRKPGRDCPIERATP

SEQ ID NO: 10656 - protein, 76 aa, Physcomitrella patens subsp. patens
AGAPPKGTGGSGLRRRRTTSTGSGSGSGSYRSGNSNMLRFYTDDAPGLKITPTVVLVMSLCFIGFVTCLHVVGKLY

SEQ ID NO: 10657 - protein, 2065 aa, Ustilago maydis 521
MRVAYSDLDDTSSVGSNDALNAPKVHIKSAISSPRSSVSSSGAVRRGGWRGVGAATSASTSRSFTHAHRGETYASSSSSELGADEPLPLSSSGNAHVQPNSPLWAPSPPPPDTCQHDVQELEQRYSDNPHELSVADHPAWHKLRAQPGLPAPGILSYLPSVSQDLAPSRNACPRQHITLESIDDDYNAPLPSVEPGAYDWANFVYAYARGRWNPGLIPQPPGQSTAFPGTHTRINSTRHPTPDATSSATNVLSKRRPSLEYVMPDSALPTTKAAPISTAPTHQLCSLPLSARGSADSDTAVPLPLDTSADASAVLNGETSLPSHSLQYIHSSESDQHVSSQNASASTTVESERSSNTVGNLIDANVLTALRLPPMSMSSVSRKSTCVARGADLDFDGLSSPHNSPDDAQPPQRAKTAPEGLPTSVAQALLPSQLDHKDTLSLRKSILKDEPNKPVVRTPISELSDPLHRATPHKDKTNLANDAVSLMLNSNAQDAVVTPSARPQSKLAGDMAESVISTAILAPADSAHNDFFESEPLERPGPTPIQSTHGVPKHPVVWQSAPEGLSSFAEAMSRQASGTGAADAKSALFNEIAIDNVTVAGLRRAARRTSMERSVAELDRICSDACRNPKGPLVSHSASFPGSTPRPSKSAAAGGPHEGVQPLPHLFGSSTSVSASTNNGPTVNVAHFVRGKQSGETRIDLRGTITSSPATNAKDVNFAPPSTGQLPYEVSAHDVSLAANASTTKNRPAMTNTSSQRIQSYLAAGKRVELFYRDFGYLPSILPPHEEVRLHALSRYGPPKIAGNPNFERLAHLVKLVFNSKLVLITLVGENEQIFQTQMGGGGEITIASLQAIAGSRNCSFCSHAILQDSDEPIVILDAAKDWRFSGNPLVQGSPDIRFYAGSPLRTSDGLNIGSLCLIDDKPRTDFGPRQRHTLREFSRVVMREMELLRDKIQFGMRDRMQRSVELFTKECLEMDSEDGETEAVASAHATIGTHKVFQLAAQSMREALQASGAVIFDLSHFELIDSYEDDFVPSELGNGTSSKVYFANPSSSHDIDPAASASGSADDRFGSDSEGNSAADVPTTPHGKTAARDRYFDGTSGVETFKSPLHSPKDDQSARAKRVPPMSVLGTSEADGVPPERGEFVPLSHHVQMAEFLRVHRTGKFYSYAPPPFRSLLPHGVTGLLLVPIFGLNKQPFALLCAYITSSERSIALEELQVSGLQYLRALGMIVLSAILKKDIMLADKAKSNFISNISHELRTPLHGILAAAELLAETKLNATQGSYLETVEACGKSLLELVNHVLDFTKLSGNTRSGKRSIQTKTKCDMVKLIQEVCESSWIGQIARQVETASSGIGSVYAPPEASESGASMVQARARAARDHKVETVIDIALRENGWLVNCDTGGIRRVLMNLIGNSLKFTSAGFVHVSLREVQSSKTHIMIELSVTDTGRGISRAFLEEQLFHPFTQENPHGTGTGLGLSIVNSIVQSPSMNGKIDVWSTEGEGTEIRVTCELELCEDDDIEGPTYKPAVNVHQAYTVALLGFDESRGDQDLRLALQGYFLNWWEFKLCELDNVDDQIKKSDVVVINDDMALLERVKGERKGELPPVIFLTASRGESEIAMACEAYHASGGVARILFKPAGPAKLESVVDFCLQCLERKLSGENVSSEETKPSTPLPSPSEAGGAYQQMEQADSYFSPRPSRPDIHSHLGHEIGSFDTNASITPRAEGETRVPVTSMAQDAQSTSGQKGPKLADGEIGEMRRPTLDAGIDRNRSHYMSPDPPGSSSNSLIRRHSTEARMDAGNEDASSSMTAKPSRPLLPARSITYHEPRLHKHVLMSPMGGREVDGDSYFERAPTPNAPHTPNTPGSTVSLEGGDGAVLKSVLASSRGGSSLSTGGGGGGTSRKRMQILSVEDNAINRKVIAAFLAKLEVDFVEATNGEEGIAQFSRYPPNHFDVILMDLSMPVMDGISAIAAIRKIELERYQGGKSDSGSSGNNSSSTHTIGSLGRTGTNKLVARQRSKIFALTGRSTDEDKRQAFQTGADGYIVKPLSFKVLSSLLRMLMR

SEQ ID NO: 10658 - protein, 237 aa, Physcomitrella patens subsp. patens
MAQNLEVKVPRAKIAPSMLSSDFSNLASEAKFIEECGADWLHMDVMDGHFVPNLTIGAPVIKSLRKHTKMYMDCHLMVTNPMDYVDEFVKAGASGFTFHVEVAKDNWQELIHKIKAGGMRAGVALRPGTPVEEVFPLVESQEPVDMVLVMTVEPGFGGQSFMPETMPKVNALRRKFPLLDIEVDGGLAPATIKQAAEAGANCIVAGSAVFGAKDPAEVIATLRQGVDAAQTSSIFFK

SEQ ID NO: 10659 - protein, 357 aa, Chromobacterium violaceum ATCC 12472
MSEERLKQHRNAIDAIDVEVLKLLNQRASHAREIGEIKGGGVIYRPEREAQVLRRLKDLNPGPLPSESVARLFREVMSECLALEKPLSIAYLGPEGTFSQLATIKHFGHAARAVACSSIDEAFRLVESRALDYVVAPVENSTEGAVGRTLDLMVSSPLKICGEVVLRIHHHLLRKVEGVDGIRRVYAHAQALAQCHEWLNKNLPADVERVSVASNAEAARLAAEDDTAAAIAGQAAAERYALVKLAENVEDEPNNTTRFLVLGLQDVGPSGQDKTSIVVSAPNRPGAVHQLLEPVAANGVSMSKFESRPSRAGLWDYVFFIDLEGHRQDERVLKALAGLGERTSFVKVLGSYPTAVL

SEQ ID NO: 10660 - protein, 176 aa, Triticum aestivum
  misc_feature (164)..(164): Xaa can be any naturally occurring amino acid
MAPTVMASSATSVVPYQGLKSTAGLPVSRRSNGASLGSVSNGGRIRCMQVWPIEGIKKLETLSYLPPLSTEALLKQVEYLIRSKWVPCLEFSKVGFIFREHNTSPGYYDGRYWTMWKLPMYGCTDSTQVINEVEEVMKEYPDAYVRIIGFDNMRQVQCVSFIAXFKPPGCEESGKA

SEQ ID NO: 10661 - protein, 502 aa, Novosphingobium aromaticivorans DSM 12444
MDGKDEVGNRRVFDVAVIGGGVNGCGIARDAAGRGASVLLLEANDLASGTSSNSSKLIHGGLRYLEHYEFGLVREALSEREKLWAIAPHIIWPMRFVLPWVRGLRPRWLLRTGLFLYDHIGARKLLPATETIRLDRHPAGRPLKPEFVHGFVYSDGWVDDARLVVLNARDAANRGAEVRTRCPVTALRREDDLWSIETAHGRFLARSVINAAGPSVLAILGCSGEPPRQSIRLVRGSHIVVRKLFDHPHPYFFQLPDGRIFFAIPYEHDFTLIGTTDRDHRPGDPIEASAEEIAYLCEGASRFFRKPVVPADVVWTYAGVRPLVDDGSGKPEAATRGYRFDISDENEGAPILSVFGGKITTYRTLSQEAVDRMATRIPALEGRHWTDNSALPGGDFGVNEVDRLIADLRGRYPFLEPAWADRLVRSYGTLAFLVLGEAHTLNDCGRHFGHGLTEREVRYLLANEWAREAGDVLWRRTKLGLRLDAAEQADLAQFMKANLPND

SEQ ID NO: 10662 - protein, 488 aa, Neisseria gonorrhoeae FA 1090
MMKLGFKPIPLAIAAVLCALVLALPVPDGVKPQAWTLLAMFVGVIAAIIGKVMPLGALSIIAVGLVAVTGVTADKPGAAMSDALSAFANPLIWLIAIAVMISRGLLKTGLGMRIGYLFIAVFGRKTLGIGYSLALSELLLAPVTPSNTARGGGIIHPIMQSIAGSYGSNPAKGTEGKMGKYLALVNYHSNPISSAMFITATAPNPLIVNLIAENLGSSFRLSWGAWAWAMAVPGVIAFFVMPLILYFLYPPEIKETPNAVQFAKDRLSEMGKMSADEIIMAVIFGILLLLWADVPALITGNHAFSINATATAFIGLSLLLLSGVLTWDDVLKEKSAWDTIIWFGALIMMAAFLNKLGLIKWFSGVLAESVGGLGVSGTAAGVILVLAYMYAHYMFASTTAHITAMFGAFLAAAVSLNAPAMPTALMMAAASNIMMTLTHYATGTSPVIFGSGYTTMGEWWKAGFIMSVVNFLIFSVIGSIWWKVLGYW

SEQ ID NO: 10663 - protein, 297 aa, Ostreococcus tauri
MPSLFLLPHLLQHSRIYSSRQALNRRLSATSHTQVWRVSSGRRTTGSHILPERQRKRLCASPIASTSPASANPGTSYNEHKPKTPPPDLPSLLLDSRIVYIGMPLVPAVTELIVSELLYLQYADQKKPCYIYINSTGCTRADGEVVGFETEATAIYDTMKYIGNEIYTVGTGVAVGQACVLLSAGDKGKRFMTPHATAMLHQPRVPSTGERQATELNIKWHETLAQKKTLLNVLSKTTGHSVEKLDKDMRRPLYMTAADAIQYGVADKIVTRDSKAIADVLSASAWDSAAGLVQKSI

SEQ ID NO: 10664 - protein, 482 aa, Physcomitrella patens subsp. patens
KPKLPPSPPQWPVLGNLPHIMRKSAALHTTLRLLGKKLGPIYTLWLGRSFPLVIVTGEETAREAFVDQGHIFSARPTLISWQYISSGYRTTMTTPAGAHWQKLRKIISHHLISPTNLARYIPVRDSEIQKLLERFRDQSRENEGVVHPLQQLRISAVDIIMRIAFGDEFATLDNEGRKGNAVVLDRLFQEIMDAGSIFQIALDSSPLTRTLLFSASRKCYSNIRTIAGQITDLVMPIVMERKRLLKERPLTEVKTFVDSLIMLKGDDALTDMEIVWNVVELMVGATDNTSHILEWIFANMITYPHVQQKAYEEVKRAMGPNLDRGLVQENHIPNLPYIQAIVKESMRRHMMAVLAIPRIASRDCKLRGYDIPKGTMVVLHAGALALNEEIWSDPLEFRPERFLNLDNEATHMHKMAFLPFGVGRRSCPGASMGLLHLHMLLANLIYRFEWGPESPGQPVDFSEKFRMVVTMKSRLRATITER

SEQ ID NO: 10665 - protein, 97 aa, Rhodomonas salina
MASYKVTLKGEGVDTTIDCPDDQYVLDAAEEQGIDLPYSCRAGACSTCAGKVDAGTIDQSDQSFLDDSQIADGFVLTCVAYPTSDCTILTHQEESLY

SEQ ID NO: 10666 - protein, 384 aa, Photobacterium sp. SKA34
MSDLISNVKHAFTTVLGYQPSHLIQAPGRVNLIGEHTDYNDGFVLPCAINYQTVVAASPRTDNIIRVVSVDYGNATDEFDLTQPIEFQQDKMWANYIRGVVKCLLERGFNFKGADIAVTGNVPQGAGLSSSAALEVVIAQTFKVLYNLEISQAEIALNGQQAENQFVGCNCGIMDQMISAEGRENHAMLLDCRSLETQAVSMPADMAVMIINSNKKRGLVDSEYNTRRQQCEEAASIFGVKALRDVTIEQFNAKAHELDEFVAKRARHVITENDRTIEAAKVLRNNDMKRMGELMAQSHASMRDDFEITVFEVDTLVNIVKDVIGEQGGVRMTGGGFGGCIVALVPPTLVDDVKAAVEAKYQAATELKESIYVCQAKDGSGKID

SEQ ID NO: 10667 - protein, 640 aa, Vibrio campbellii AND4
MAIEINVPDIGADEVEVTEILVSVGDKVEEEQSLITVEGDKASMEVPASHTGIVKEIKVAEGDSVATGSLIMIFEAEGAAAAPAAPAVEAAAPVAAAPAVAAPVTKELKEVHVPDIGGDEVEVTEIMVAVGDSIEEEQSLLTVEGDKASMEVPAPFAGTLKEIKVAAGDKVTTGSLIMVFETAGSGAAAAPAAVEAPAAPAAAPAAAPAASAEKEVNVPDIGGDEVEVTEIMVAVGDTVEEEQSLITVEGDKASMEVPAPFAGTVKEIKIAVGDKVSTSSLIMTFVVAGTPVEGAAPAPVAAPAQAAAPAADRPKAEAPAATGDFQENNEYAHASPVVRRLAREFGVNLAKVKGTGRKSRVLKEDVQAYVKDALKRLESGAGAAASGKGDGAALGLLPWPKVDFSKFGETEVKKLSKIKKISGANLHRNWVMIPHVTQWDNADITELEAFRKEQNAIEAKKDTGMKITPLVFIMKAVAKALEAFPAFNSSLSEDGESIILKKYVNVGIAVDTPNGLVVPVFKDVNKKGIYELSEELMAISKKARAGKLTASDMQGGCFTISSLGGIGGTAFTPIVNAPEVGILGVSKSEMKPVWNGKEFEPRLQLPLSLSYDHRVIDGAEGARFITFLNGALSDIRRLVL

SEQ ID NO: 10668 - protein, 329 aa, Streptomyces lividans
MSGKYLVTGGAGYVGSVVAQHLVEAGNEVVVLHNLSTGFRAGVPAGASFYRGDIRDQDFMRKVFRGRLSFDGVLHFAAFSQVGESVVKPEKYWDNNVGGTMALLEAMRGAGVRRLVFSSTAATYGEPEQVPIVESAPTRPTNPYGASKLAVDHMITGEAAAHGLGAVSVPYFNVAGANRGVRLVHDPESHLIPLVLQVAQGRREAISVYGDDYPTPDTCVRDYIHVADLAEAHLLAVRRRPGNEHLICNLGNGNGFSVREVVETVRRVTGHPIPEIMAPRRGRDPAVLVASAGTAREKLGWNPSRADLAIVSDAWEWHSSHPKGYDDRG

SEQ ID NO: 10669 - protein, 454 aa, Salmonella typhimurium LT2
MSFDSLGLNPDILRAIAEQGYREPTPIQQQAIPAVLEGRDLMASAQTGTGKTAGFTLPLLQHLITHQPHAKGRRPVRALILTPTRELAAQIGENVRDYSKYLNIRSLVVFGGVSINPQMMKLRGGVDVLVATPGRLLDLEHQNAVKLDQIEILVLDEADRMLDMGFIHDIRRVLAKLPAKRQNLLFSATFSDDIKALAEKLLRNPLEIEVARRNTASEQVTQHVHFVDKKRKRELLSQMIGQGNWQQVLVFTRTKHGANHLAEQLNKDGIRSAAIHGNKSQGARTRALADFKSGDIRVLVATDIAARGLDIEELPHVVNYELPNVPEDYVHRIGRTGRAAATGEALSLVCVDEHKLLRDIEKLLKKEIPRITTPGYEPDPSIKAEPIQNGRQQRGGGGGRGRGQNQGGAGRSQQPRRQDSGAAKAKPKPRTGEGKTAGDKARPPRRPRRITPAQ

SEQ ID NO: 10670 - protein, 476 aa, Vibrio campbellii AND4
MSKEIKAQVVVLGSGPAGYSAAFRCADLGLETVLVERYSTLGGVCLNVGCIPSKALLHVSKVIEEAKAMAEHGVVFGEPQTDISKIRIWKEKVVNQLTGGLSGMAKMRNVTVVNGYGKFTSPNSILVEGEGESTTVNFDNAIIAAGSRPIKLPFIPHEDPRIWDSTDALELKDVPEKLLIMGGGIIGLEMGTVYHSLGSKVDVVEMFDQVIPAADKDIVKVFTKRIKDKFKLMLETKVTAVEAKEDGIYVSMEGKKAPAEAERYDAVLVAIGRVPNGALIDAEKAGIEVDERGFINVDKQMRTNVPHIHAIGDVVGQPMLAHKGVHEGHVAAEVISGKKHYFDPKVIPSIAYTEPEVAWVGKTEKEAKAEGINYEVATFPWAASGRAIASDCADGMTKLIFDKETHRVIGGAIVGTNGGELLGEIGLAIEMGCDAEDIALTIHAHPTLHESVGLAAEVFEGSITDLPNKKAVKKKK

SEQ ID NO: 10671 - protein, 189 aa, Rhizobium leguminosarum bv. viciae 3841
MAQERRPQRDDRQSREERDSEFVDKLVAINRVAKVVKGGRRFGFAALVVVGDQKGRVGFGHGKAREVPEAIRKATEAAKRELIFVPLRDGRTLHHDVHGRHGAGKVLLRSAKVGTGIIAGGPMRAVFETLGMHDVVAKSTGSSNPYNMVRATFDALKHQVHPKDIAAQRGIKYATLQARRSASGNASEE

SEQ ID NO: 10672 - protein, 608 aa, Photobacterium sp. SKA34
MHEEMIGLTIAGLGVLGLSCQWLAWRMKLPAILLLLMAGLIIGPVTGVFNPNILFGDLLFPLISLSVAVILFEGSLTLNFDEIKNVRRNVKSIVTVGAIITWMITSVATHYLLDFSWPLALLFGSMTVVTGPTVIVPLLRTVRPQAKLANILRWEGILIYPIGAIFVVIVYEFIVSSSTIHSIEVFGLMLLVGLVLGGVAGWLLAHVLRRHLLPEYLQPFAVLALVLGVFSGANALEPEAGLLAVTVMGMWLANAKDVNIQHILHFKENLTILLISGLFLILASRIQMSDFHALGWGAITVFVVIQLVSRPVSIFVSTMFSQLAFKEKLFLAWVAPRGIVAAAISALFALKLSNDGVAGAELLVPLTFMVIIGTVVLQSLTARPMAKLLGVAEPSPKGFIIVGANDVARNIALALKKYDCRVVVTDSNWDYIRAARMAGLETYYGNAVSSHADEYLDVIGIGHLLALTPDKHFNAVAAMHFESDFGGRNVFRLNGRRHNSGLEKHSASQAHNGAALFGEDISYKKLASLINQGGEIKHTKLSDNFTLEDYYAQYKASQLIPMFAIDPKGYIYTYTINDEFAVKAGWTIVSLIKELKVAEEIKEIKTEA

SEQ ID NO: 10673 - protein, 461 aa, Photobacterium sp. SKA34
MSQTAFSTLNLNPDLLSNLTSLGYDAMTPIQAQSLPLILEGKDVIAQGKTGSGKTAAFGLGLLQNLKVKRFRVQTLVLCPTRELADQVAKEIRRLARAIHNIKVLTLCGGTPFGPQIGSLEHGAHIIVGTPGRVEEHVRKGFLCLDELNTLVLDEADRMLEMGFQDSLDAIIDVAPSDRQTLLFSATYPTQIASIAKRIMRNPVEVKVESNHDNSSISQHFYKVESNDDRLRAVRLLLSQHRPESCVIFCNTKREAQEISDDLEDYGFSSIALHGDLEQRERDRTLVLFANKSRSILVATDVAARGLDIDNLDAVINYHLARDTEVHVHRIGRTGRAGSKGIACSLFSDKEHYKVALLEDYLDRPISGEALPAEHLLDQPTFRPEMVTLMIDGGKKQKVRPGDILGALTGENGIAGSDVGKINVFDFCAYVAVKREVVRAALKKLENGRIKGRNFRSRQLR

SEQ ID NO: 10674 - protein, 499 aa, Mycoplasma mobile 163K
MIKKIGFFTALTILVGTMVGIGIFFKNNSISTIVKGNGIAWLISWILGAIIAIFTALSYVEISTAKPKEKSGGLSYWASIFSGKKLAYLTRFNLAFFYYPIFVVVLGIFASQIFFQFLNLIAPNRFENISVWIHVIFGISISMIYFILNKISIWIAGIHQNIVTILKFIPLFVAIIVGLIFANTNNIGGSNAFNQGAFDFSRALFAIPSVLFTLDAFLIVATITHKVKGGEKTVTKVVLIGMVFVSIIYILVTIASILHNSGTVEKLIQNSLAIGFSNGIAIFVNFFIFISALGVINGMFTGFIGETENSTYSFTWFGSKILTKKFGPKKAMSFFYLFSYSFWSLIIFIPAITLNSDSIIETISNFPTLFFFLVYGLVIFFYAIKRHKTTETKKINSVLFYFISIFSMIGIVVAIFSQFIVLIIDASTLPNIEGAFGTIGIKLTNLQLMITTIIFIILFFLLPYINFLLIKYFEENLQKKSTIKTTKMDKSKKTLQENF

SEQ ID NO: 10675 - protein, 340 aa, Glycine max
  misc_feature (234)..(234): Xaa can be any naturally occurring amino acid
MASFNLSYSSSPALSCPSPTRPIQCRASKHFKFFNDVPFVRMNSKFPSSDNAFGRIKAMLISGGGELLSHPNGNDIVIGTNLVGDESVQIEVQPNGTLADDTGLTSNVFSMDNNEFDSDSPSAGFASIPEAIEDIRQGKMVVVVDDEDRENEGDLIMAAQLATPDAMAFIVKHGTGIVCVSMKEEDLDRLELPLMVNSKDNDEKLCTAFTVTVDAKHGTTTGVSAHDRATTVLXLASRDSTPGDFNRPGHIFPLKYREGGVLKRAGHTEASADLAVLAGLDPVAVLCEIVDDDGSMARLPKLRQFAERENLKIVSIADLIRYAVTIHGPCNKIHCMHIYV

SEQ ID NO: 10676 - protein, 292 aa, Mycoplasma mobile 163K
MNKKVRKAIIPAAGWGTRFLPITKVIHKELLPILKKPAIEILIEEAFEAGIEEIILVISSRKQELKRYFEVNHDLELELFKNKKWDLLKSLKTTNINAKIRIVYQEKQLGLGHAIAVGAQWIDDEPFAVILGDDLIKSKEPAIKQLIREFDDKQASILGVQAVEERDLNKYGVVVPFKGYDPKDKSFKIIGAVEKPKIENAPSNKAILGRYIFTPRIIDILTNLKPSKTSNEIDVIDAFSKLLKEEDIYAYQFSGTRYDIGNIEGFVKATIDYALDDDKLREVVLEHIKEKV

SEQ ID NO: 10677 - protein, 409 aa, Bacillus thuringiensis serovar konkukian str. 97-27
METIVQKFGGTSVGSVERIQHVANLIIEEYERGHSIVTIVSAMGKSTDELVALANAITENPSKREMDMLLSTGEQVTISLLTMALQAKGYNAISLTGWQAGITTESVHSSARITDIHTDRIQSYLAEGTIVIVAGFQGVSENHEITTLGRGGSDTTAVALAAALNAKKCDIYTDVTGVYTTDPRVVKDAYKLDEISYDEMLELANLGAGVLHPRAVEFAKNHNVILEVRSSTEQENGTIVKGECNMEQQSIVKGIAFEDNITRITVKGLEQGSLSTVFSTLAAAHINVDIIIQSITNEGTVHLSFSIHSNDLRETLKVLEQNQEALHYESVEYENHLAKVSIVGSGMVSNPGVAANMFTTLKEEDIHIKMVSTSEIKVSVVIDRLHLVTGVEALHQSFMAKIEPLVQLI

SEQ ID NO: 10678 - protein, 420 aa, Mesorhizobium loti MAFF303099
MHANRVLEFACIRCGASAPADVTIDSRGCARCQDTAPANLRPVYAVPHLDPLDGATSSRSLWRFAHMLPCTEAEAVSLGEGLTPLLAAPRIGAFLGVPNLAIKDEGRNPTWSHKDRFSTIAVSVARARGAKIVATASSGNAGASLAAYAARAGLKCVVTTFAGSAGAMLAQIRKYGATVLPLVSKMDRWSLLEQAAARYDWFIASPYHGPVVGSHPLGIEGYKTIAYEIVEQSDGTAPDWCVLPVCYGDALSGVWAGFCELFAQGSITRLPRLVAAEVHGSLADALASGADAVSERQMLFDSLAVSIGTPRSTFQALKALRESGGHAVPVSNHGLIAMQERLARDEGIFAELASVTPLIAISKLRDQGIIATPDRVVAVVTASGLKDLDRSAGSNEHDQIFRTTDDAWRWLDKNGLDLVS

SEQ ID NO: 10679 - protein, 160 aa, Zea mays
  misc_feature (56)..(56): Xaa can be any naturally occurring amino acid
  misc_feature (137)..(137): Xaa can be any naturally occurring amino acid
GPLAVSPGPSVRGDVCSQLPPSPRSIQRMRAPGLELAAAPDVQGRDGGGRWRAGIXCFRFLPPFFTGNKGEKDAPKAMRIKEELLDSIAPVDRDSEVTPEDKERVQQIVHDLEAVNQVKEPIKVDLLNGKWELVYTXSSSVLQAQRPKYLEPFGKIYQLI

SEQ ID NO: 10680 - protein, 622 aa, Cryptococcus neoformans var. neoformans B-3501A
MSSGGHTNAAGPSRQHSLTAESRSLTTARQKEKAPQLEDVVLEEGLFEQEIDLLIGQYLEARGASKAARIWDEQILGRSANGSTRKEHIEDVERAILDGDWGSIENLVARPGLLRIQTQKAFLYLVYRQQFLEHVENRESQKAFNLLQKRLKALEHYQPVPYDFYSLSYLTSASTVHDAPTFRDWAGVGPERDRLVGVWKELMDAERGGGVDERRYIPPDRLKTLLKQAAAWQVGRVGKKRDDIVKIPTLLQDYRPLELPSKLLRLVEGHLANVKCVELIGSTAQHVVSGSSDCTLRVVSTEDGSLSHILSGHSSRVWSCASSPSGEMIASSSGDGTIRLWSASKGDCLGVLVGDGGDVYNVRWRPNREDQVVSASYDRILRSWDIETGKQLRTFSGHSQSTLAIAYDSTGNTIASGSKDKHVRLWDAVGGVCTNTMTDCLGEISSVEFDNEGKYLLVGCKDNSNRLWDLRMQRSVYRYTGHQNTSKNLVRCSFACSTSLVISGSEDGSVYIWDREGNSNDRRSNSLVPSTRDNELLAPERKGSGGDLTDFNIHPSSPAYYPPREGVRNRNSFARRGEITVRPSKVLVGHGEGAVFEVRWKEGKMVSAGEDGSVGVWGVETN

SEQ ID NO: 10681 - protein, 550 aa, Chromobacterium violaceum ATCC 12472
MAAQRHIDINSTQVWAKLHQHQRATRHMHMRELFELDPQRFQRFSLELDGLLLDYSKNRVTERTLELLFDLARKADLRGWMDRMRSGERINVSENRSVLHTALRLPAGARLDLEGHNVAADVHQVLARLKDFSEQVREGRWLGFAGQPIRDVVNLGIGGSDLGPLVAADALAAYAHPDLKVHFVSNVDGQHLARTLERLNPATTLFIVASKSFTTPETLLNAQAARAWFLQAAGEAQIAKHFVAVSTNEPAVRAFGIDPQHMFGFWDWVGGRYSVWSAIGLPVMLSIGYDNFRAFLDGGHAMDRHFFESPFDANMPVLLALIGIWYNTFYRAHTHAIMPYDHGLRRLPAHIQQLDMESNGKRVGRLGEALDFDTGPVIWGEEGANSQHAFFQLLHQGTRLVPCDFILPLNSHYPLGNQHDVLVANCLAQTEALMRGKNEAEVMRELSHLSGEQLDMLLPQKLFPGNQPSNTLALDRVTPYSMGMLMALYEHKVFVQGVIWGINSFDQWGVEYGKQLARRILPELSGDTGALGHDSSTNGLIRHYRERHGK

SEQ ID NO: 10682 - protein, 227 aa, Zea mays
  misc_feature (190)..(190): Xaa can be any naturally occurring amino acid
MASDEVKVIGAWASPFVMRPRIALNLKSVPYEFLQETFGAKSELLLKSNPVHKKIPVLIHADKPVCESNIIVEYVDETWSASGPSMLPSTPYDRAIARFWAAYIDEKWFPSLKSILKAEGEEEKKAVLAQVEEGNALLEKAFNDCSKGKAFFNGEHIGYLDIAFGCFLAWLRVTELAGGHKLIDEVKTPXLSNGLTGLCNDPAVKPVMPETATLAEFAKKIFAKPPA

SEQ ID NO: 10683 - protein, 394 aa, Bordetella bronchiseptica RB50
MKDTDRQAALDYHAYPHPGKISVTATKPLVTQRDLSLAYSPGVAAACEEIVEDPANVFRYTGRGNLVGVITNGTAVLGLGNIGALASKPVMEGKAVLFKKFAGLDVFDIEINETDPDKLVEIIAGLEATFGGINLEDIKAPECFTVERKLRERMKIPVFHDDQHGTAITVCAAVVNGLAVAGKRIEDVKLVTSGAGAAALACLDLLVDLGLPLEHIWVTDIEGVVYEGRKKLMDADKERFARKTKARTLAEVIEGADVFLGLSAGNVLKPEMVATMAANPLILALANPNPEILPEAAHAVRDDIIMATGRSDYPNQVNNVLCFPYIFRGALDVGATTITREMEKAAVLAIANLAREEQNEVVAAAYGTYDISFGRDYLIPKPFDPRLIVRIAPA

SEQ ID NO: 10684 - protein, 337 aa, Cryptococcus neoformans var. neoformans JEC21
MAARNWSRVWVGGTVILISFIAFSSQIFVIWPWYGREISLDLLKLLVPLNLAAFMIFWNYRLCVITSPGSVPEGWRPNIGAMDGMEVKKGTHTPRYCKNCEHYKPPRAHHCRQCKTCWVNHCPWIGNCVGFYNQGHFIRFLLWVDIGTTFHLIIMVRRVLYIAEYYHQEPTLADVLFLVFNFATCVPVWLCVGMFSIYHVYLACGNSTTIEGWEKDKVATLIRRGKIKEVKYPYNIGIYKNIKSVLGPNPFLWLWPQKMQGDGLSFPVNPSAGGESATVEWAGIVAPREGSSAPGEYGAADQCESAGSGSGTNGRPGMGHGEERVRHGRARVEHSMV

SEQ ID NO: 10685 - protein, 185 aa, Odontella sinensis
MSTDLKQVNKSKKALQRNDNLSESKFVERLIKISRVSKVTKGGKKLSFRAIVVVGNENGQVGVGVGKADDVVNAFKKAKADGRKNLIKIPITKSLSIPHNVIGIFGACKIIMRPSIEGSGVIAGGSVRTVLEVAGIKNVIAKQLGSNNVLNNARAAVSGLNNLTTKSQVLKKRDLHSNSSEKINS

SEQ ID NO: 10686 - protein, 345 aa, Rhizobium sp. NGR234
MRRSKYERPAHLIGNAERPRLTTSAMIASIAGADQPTRPAPFGHALSALAEKDDRVVGLSADLAKYTDLHVFRAAHPDRFYQMGMAEQLLMMSAAGMAREGLQPWVTTYAVFASRRAYDFICLAIAEEMLDVKVVCALPGLTTGYGPSHQATEDIAMFRGMPNLTIIDPCDASEIEQAVPAIAAHEGPVYMRLLRGNVPLVLEEYGYRFELGKAKLLRDGRDTLIISSGLMTMRALEAAEELRKNGIDAGVLHVPTIKPLDEATILAECARQGRLVVVAENHTVIGGLGEAVAATLMRSAVRPAAFRQIGLPDAFLEAGALPTLHDMYGISTTKIVAQIKEWLDE

SEQ ID NO: 10687 - protein, 1627 aa, Cryptococcus neoformans var. neoformans
MSRTPISPRPNSNPRVPPSSAAFLQHLHSDPSSHHITLSGHRVSGLSLSPQSLTGEGDLLDINGTSEPSISPSLHSHLSPVSSGTSSGPSPLGSVGRAPSKRARPKTAPSRNDEWPLGRSYETSPDLPPLIPPQADEHLRSSPVGDLCTNAMTMDEGLVDAMEALSTSGEPKSYLIGRSESLAGTAESHTGPSKPSPASMNWSTFAQAYAHGLFDPNRVPNPPTPNETPTEFQSARSSPGQKYSSLPLNHKYSMPTVPHNRSGSSSENYSSKSSKDSVSTNASSAPSTSSASASGKQMSMAASLAARKKAYELENIRSKPSGLALNTDKLSLPSYSLAAATVRMASTSILNDLAPLSMPSPERELTDPLASVVSFDSSSTKKDSARSDPGSSRFPLHHSVSSAANPYTSSLRLPTIQASPVTTPLEGPHRPKGKDRSPPRARHGIVNSRIPSASAPLEKTAEAESSTDYFGAVAVAAVSPQETDSSSTATDPTPTGPSLELRKTTPLRSNSVVPEPSPRQQKDPLPPLVTPSDLNRIYDQYGWLPAPLPPDEAARRRALYRFSILHSAPDINFNRIAHMTKLVFNPKAVLITLIDSDTQWFKSQSGFTVEQGGRISSFCAHTILPRTDEPFVVLDTSSDWRFENNPNVVGPNSIRFYAGAPLRTADGFNVGALCILDDKPRTEFPPRSRLILKEFAAVTMREMELWRDKLQLRVRDKIQTSMEKFTRECLEMDSASPTSDAETVNKMEHVYSRAAQLVCSTIGLDGCFILDISQIEMVQTNTPTGKKSTYRANPYGAAENTSPVLERSESFGPVNPFPVLAAVPTAKSTRALTPYEHEKLSDFMQNHHDGRIFEGAAPQWIRYMFPQSFRYGMAVPIYGVDQQPFAMICAYTANPEKQFLEGYELQFLRAIGVIILSAVLRRRMALADKTKSILISSVSHELRTPLHGILAAAELLSDTQLDSNQLSFLKTVQTCGNSLIETVNHVLDFTKLSGTQSCKGSPSDLGKVNLAALVEQTVEGCWIGQRARFFMGDSDIGSFYAPPAPTSIVPKSKRALVGEELSHVETVVDIDMREKGWMVRCEKGGLRRVLMNLVGNSFKFTKNGYIQVSLREMPHEPGSKTIPVEMTVVDTGKGIGKDFLKDQLFHPFSQENPLQTGTGLGLAIVNTIVRSDSVNGKVDVWSAEGVGTEIKVTFDVEVVDDDDGQPSISSSSSVVSATSTFGHGLSVSFVGFNPKHQGHMLSCEVFTRYVNYWYFSIEDQQRADILIVNELEELVNHPMAAQKPILLLSVQRGFESTALAEKINRGGGFCQVVYKPVGPSALQKALNAAVHWIEERDSSDKSDILGGNVTGINLEGNSYRPSISRGSSGESHESHSTISELSNARFNQQSSINSRLPLQRRRSEENEQAPRRPSMAPRGMTYHSSRKMQRSSNDSAGSTPSQVPPSPTSSIPTIPLADGGVMLKAATVSAEAPRKEKMGRVMVVEDNVINRRVLGAFLKKRGFEYAEAVDGQAGVELFENAPPNYWDVILMDISMPIMNGHQATRAIRRIEATRRNSLSDIPIVPPPGKPVTISSQKAVQARVKIFALTGLATPDDKREAFWSGVDGYLVKPVSLSSLDIIFKKIGF

SEQ ID NO: 10688 - protein, 258 aa, Mesorhizobium loti MAFF303099
MSVERTTAAGGMETSYGFKRVGEGEKQSLVNDVFHKVANRYDLMNDLMSAGLHRLWKDAMVTWLNPPKRPGWKVLDVAGGTGDIAFRIVDASHGNAHATVLDINGSMLGVGRDRAQKKGLSGNTDFVEANAEELPFADATFDAYTIAFGIRNVPRIDVALSEAFRVLKPGGRFLCLEFSEVEMPLLDKAYEAWSFNAIPKIGKMVTGDGEPYSYLVESIAKFPNQQNFAAMISRAGFDRVSFRNYSGGIAALHSGWKL

SEQ ID NO: 10689 - protein, 290 aa, Vitis vinifera
  misc_feature (6)..(6): Xaa can be any naturally occurring amino acid
MPAGEXRHPSILPATESGZDEAWLWTQIKAEARRDAESEPALASYLYSTILSHSSLERSLSFHLGNKLCSSTLLSTLLYDLFLDTFSKDAELRSATVADLRANHMRDPACVSFSHCLLNYKGFLACQAHRVAHRLWTQMRRPLALALQSRIADVFAVDIHPAARIGKGILFDHATGVVVGETAVIGNNVSILHHVTLGGTGKAGGDRHPKIGDGVLIGAGATILGNIKIGEGAKIGAGSVVLIDVPARTTAVGNPARLVGGKEKPARHEDVPGESMDHTSFISEWSDYII

SEQ ID NO: 10690 - protein, 435 aa, Magnaporthe grisea 70-15
MATSEPFPLLSTSADQLHNAADRVSASAVRRRRQSSGLGSELRVGDTGAPGLATSIANMGQNKDATKRAPRRRKAYFRRFKQFATKHTCVLPLVLLFIFLVLYAINPTESNPISRFIFLSYELPPDAPGKPPQYGKGRWDIAFVTFYTVVLSFTREFIMQELLRPLSRYAGVKSRGKQARFMEQAYTAIYFAILGPAGMYVMSRTPVWYFNTHGMYENFPHKTHEACFKFYYLFQAAYWAQQAIVLVLGMEKPRKDFKELIAHHIVSLALIALSYRFHFTYIGLAVYVTHDISDFFLATAKLMNYIDHALTGPYFAFFMGVWIYLRHFINLRIIWSLLTEFQTVGPFELNWETQQYKCRLSQVITLGLLSSLQALNLFWLFFIVRIAYRFVFNDNLRDDRSDVETEAEDSTEPAATTATANGASVANGSAIKKRK

SEQ ID NO: 10691 - protein, 311 aa, Leptospira interrogans serovar Lai str. 56601
MSESNVKHLISWEDWSDSEILDLLDFAIHVKKNRVNYAGHMSGRSLAMLFQKTSTRTRVSFEVAMTEMGGHGIYLDWMASNFQLSDIDLEARYLSRNVSVIMARLKKHEDLLTMRNGSQVPLINGCDNMFHPCQSLADIMTIALDKPEIPLNQIQLTYIGVHNNVVNSLIGITSALGIRLTLVTPIAEKENIHSQTVERAKAKGTLSWEENLKKAIQNADYVYTDTWLDMEFFNDPSYADKKKQRMELMMPYQINSSLLEKTNAKVMHDMPIHAGYEITREVVLGPRSIIFQQAENRLDAQKAVILKLLEA

SEQ ID NO: 10692 - protein, 538 aa, Oryza sativa
MAAIGNMNLFDLFFVLQLLLSGVCVLVICYRYQRLKSMKKCSLGVVQWPIVGVLPAIVANMHRLLDGVTFLLATSQLNFQCRFWLAGFRFFVTCDPDNVRHIFTSNFDNYPKGDVFADMFDVLGGGIFNTDGERWRRQRNKAQMLMTTPRFRAFVARSSLDKVEKGLLPFLAHVADARKTCDLQDVFTRWSLDATCHLVFGVDPGCLDIGLPEVPFARAMDDVLRTIFLRHTMPVSFWKTMRWLGIGHEKRNAAARRTVESFVASAIAKHRADDESKSRQGGGGGGDKQSVADLLSSFLCDDEIAGSADADVYIRDMAMNLLVAGRDTTSSALSWFFYLLSTNPRVEQKLLQELAPIASRKPQLQQGRLFPGNGGMVTFDASEVRNLLYLHAALCEAMRLYPPVPLEHKAAVADDVLPSGHEVMAGDKVLVFYYSMGRMKRVWGKDCREFRPDRWITEDGKLRYVPSNKFVAFNSGPRTCLGKEMALVQMKVTAAAMAWNFAVEVVPGHVVEPRLSVILHMKNGLLVRVKRREPVMNT

SEQ ID NO: 10693 - protein, 377 aa, Bacillus cereus E33L
MKAVTYQGPNQVQVKQVDDAKLEKKDDIIVKITSTAICGSDLHLYQGNMPLPPGYIIGHEPMGIVEEVGPDVTKVKKGDRVVIPFNVACGHCFYCQHEMESQCDNSNPHYDSGGYFGYTEKFGNHPGGQAEYLKVPFGNFTPFVIPESCELEDESLLFLSDVLPTAYWSVINAGVKPGDTVIVLGCGPVGLMTQKFAWMQGAKRVIAVDYLDYRMNYAKKINNVEVFEFTKFPDMGEHLKEITHGGADVVIDCVGMDGKKSPLEFLEQKLKLQGGTLGPIQIATKAVRKYGTVQMTGVYGGNYNAFPLGAFWVRNINLKMGQAPVIHFMPELFEKITNKEFDPKEIITHKIPLEEASYGYQIFNNREDDCIKVILKP

SEQ ID NO: 10694 - protein, 464 aa, Glycine max
APPPGKCVRREMKEKEKVEERYTQWKSLVPVLYDWLANHNLVWPSLSCRWGPQLEQATYKNRHRLYLSEQTDGSVPNTLVIANCEVVKPRVAAAEHISQFNEEARSPFVKKHKTILHPGEVNRIREFQQNNKIVATHTDSPEVLIWDVETQPNRHAVLGATTSRPDLVLTGHKDNAEFALAMCPTEPFVLSGGKDKCVVLWSVHDHISTLAVETASNVKQGSKTGGNNTKATESPCIEPRGIYQGHEDTVEDVQFCPSSALEFCSVGDDSRLILWDARVGSAPVVKVDKAHNGDLHCVDWSPHDINFILTGSADNTIHMFDRRNLTSSGVGSPVYKFEGHDAAVLCVQWSPDKSSVFGSTAEDGILNIWDHDKVGKTTDSADSKASNAPPGLFFRHAGHRDKVVDFHWNASDPWTIVSVSDDCESSGGGGTLQIWRMMDLIYRPEEEVLTELDKFRSHIFGCNS

SEQ ID NO: 10695 - protein, 721 aa, Candida albicans SC5314
MSYKRKSYNPSPLSSPKSNTSLRHDITVTSSEYNNSDEYEVEDNVPTIFLNQLATFPLFKNAPTSFHKQVAANLRLIHYRPQEFIIKKGDLSRSMYWILKGTVSVTSTDGEEVYAELNQGEFFGEIGILYNRPRTATVIAKTRILLGVLTAESLNRVLKNFPLIERRIRDEAQERLAMQDKKNKEPLSIQSFITNLPLFQFLPPDIIHKLALSVEPLVFSPFEYILRKGDTCGDIYFIIEGEVEVLNQEGVIEIPLARLSSGSYFGEMSFLNYLQNKPRIRTATIRSVTYCELMVIKSEYLEKLCDDYPTIIEDMKITAEERKVVKPAQGIFRPNWSINPTRTIPPQKRQRENENENVDYVPFTKRMRMASMKRRRSSALAIVEPLPETILMKIFGYLSLPDLMKLRRVSKRWRKMVTTTAPLEVLDLSQYSTTIDNKALIAITDFAGSRPRVIDISGCFHITDEGFSHMVNEIGIGGRLEVLRMASVWEVTGMAIMDLCFPGEKLEEIDLTNCRKVDDNVVQRLLQKCHLKVLNLSYCKGISDSVVPYFNNLESLDLTRCSGITDAGFAQLPFSPSLRKLSLKQCSYLTDNAIYSIANAARNLEILNLNFCCGLTDGSLSAIAMGFPYLREIDLSFCGSAVSDSSVASLSVLYYLERVLVRGCVRLTRAGLDTLFGGPCPLNFIDISQCRNAHVYPGNFPAPPFQSNLVRVSNKIIYIVV

SEQ ID NO: 10696 - protein, 171 aa, Brassica napus
IAIFSILITSLIGVCLPFFARSVPAFQPEKSHFLIVKSFASGIILSTGFMHVLPDSFDMLSSPCLGDNPWHKFPFTGFVAMISAIFTLMVDSITTSVFTKSGRKDLRPEVTSAETPDQEIGHVQVHAPHHSHGHGLHHDVHGDNDKELGSSLQLLRYRVIAIVSISSIFFF

SEQ ID NO: 10697 - protein, 563 aa, Physcomitrella patens subsp. patens
MMAVALPGQLNLDETPTWGSRSVDVYEKIEQIGEGTYGQVYMAKDKSTGEVVALKKVRMDNEKEGFPITAIREIKILKKLQHANVIKLKEIVTSKGPEKEDNIKPGDASKFKGSIYMVFEYMDHDLTGLADRPGMRFSIPQIKCYMKQLLTGLHYCHVNQVLHRDIKGSNLLIDNNGILKLADFGLARSFSNDQNGQPLTNRVITLWYRPPELLLGSTKYTPAVDMWSVGCIFAELLNGKPILPGRNESEQFQKICELCGSPDETNWPRVSQLPYYNQFKPERLMKRRVKDVFKHFDRHALELLERMLTLDPDHRISAKDALDAEYFWVEPFPCQPSSLPKYEASHEYQTKKKRQQQRQQQEEQAKRMKVLHHPAPHTRLPPIQQQPLRPGPHQPGHNLGPPSHAIGMPNQHSNYNRAQGGNNQGRVPGGGRPPHGGPNQNVGYGGPNRGGPGGVYGGPAQPSAYTAPNLGHQGGRGGPYGGPTGGAYAAGPYGGGRGPPIGGRGQQFGGMAGGPQPPAYGGQHYMQQPTAQYVDIDGAYARASHSGFQPLSPRRPDYRQQQR

SEQ ID NO: 10698 - protein, 447 aa, Bacillus cereus E33L
MTCHDAKNETKEKKDLKWWQLSLIGIGCTIGTGFFLGSSIGIKIGGSSIILILILTGFTTYIVFEALAKMAVEDPQKGSFRIYSRKAFGNWAGFSHGWTYWCSELLIMGSQLSALGIFSRYWFPKIPLWIFATIYGVAAILIIFIGVKIFERLEKWMAIIKIAAIIGFIVIAVLVILGFIKGGLYKAQIPRNFKDWFPNGLKGTWSSLIYAFYAFGGIEIMGLMTIRLKDPKDAQKSGRVMLMILTIIYVVSLGLAIMMVPLNQFNTKESPFVIALQDYNLPYVPFILNVVLILAGFSTLVGSLFAVTSVLMNLAEEGDAPAMFAKKNKKNISFPALILIIIGLGASILSALLLPKNIYEYVTTAAGLMLLYTWSLILLSFWRLMNPKGWMQIKSIIGLIMIALAVSGTLLQKTTRFGFLVSLLFLGIVIIVTIIVHFVSRKRNTAI

SEQ ID NO: 10699 - protein, 255 aa, Oryza sativa Japonica Group
MAARKFFVGGNWKCNGTGEDVKKIVTVLNEAEVPSEDVVEVVVSPPFVFLPQVKGLLRPDFSVAAQNCWVRKGGAFTGEISAEMLVNLQVPWVILGHSERRALMGESSDFVADKIAYALSQGIKVIACIGETLEQREAGTTMEVVAAQTKAIAEKISDWTNVVLAYEPVWAIGTGKVATPAQAQEVHDGLRKWLVTNVSPAVAESTRIIYRGSVNGANCKELAAKPDVDGFLVGGASLKPEFVDIIKSATVKSSA

SEQ ID NO: 10700 - protein, 118 aa, Cicer arietinum
VAPGYTKGDGLGAEIIGTFVLVYTVFSATDAKRSARDSHVPILAPLPIGFAVFLVHLATIPITGTGINPARSLGAAIIFNKDLGWDDQWIFWVGPFIGAALAALYHQVVIRAIPFKSS

SEQ ID NO: 10701 - protein, 420 aa, Bacillus thuringiensis serovar konkukian str. 97-27
MVQKVKERVKIEDILMAHTCMKDIVIKTPLQRDTVLSEKYDCDVYVKREDLQLIRSFKIRGAYNLIQSLPKEQLQNGVVCASAGNHAQGVAYTCNLLKIPSKIFMPTTTPKQKVSQVQFFGGDFAEIVLVGDTFDSSFQEAQRYCEENRMTFVHPFDDPYVVAGQGTVAVEIMHDMEKPVDYIFTAIGGGGLASGVGTYVKGVSPATQVIGVEPMGAASMKEAFLQNDNVALEKIDSFVDGAAVKKVGKLTFETCKDVIDDIVLVPEGKVCTTILELYKKNAIVAEPAGALSIAALDLYRDEIKGKTVVCTLSGGNNDIDRMQEMKERSLIYEGLKHYFIIEFPQRSGALREFLDKGLGPEDDITRFEYIKKHNKENGPALVGVELKHKEDYEQLIIRFKENNIQFMELNKNPVLFDLLI

SEQ ID NO: 10702 - protein, 842 aa, Ustilago maydis 521
MATPTLKLDPQAKVAPLAPIALAKLVTAADASQALTLVFEDGIAPTLILPNAAPVEGYLHIIRELASHYAHLGLSGTDKDQSAQVNLYVSQGDNLALANFQTASAIADSLDQHLALRTFLVSHSVTAADAAIWAAVRASSPVIGLVRKGLHKHLQRWFNHIDSLAPFSDALVQLADAKAEKFKNKKTAAGFDLFLKDAQQGQVVTRFPPEPSGYLHVGHAKAAILNQYFARQYNGKLIIRFDDTNPSKEKEEFEQSIIEDLALLGIKGDATSHTSDYFDKLYQLAIQMIQLGKAYADDTPQEQMRAERMDGIASKRRDASVEENMTRFADMSTGSAEGRKWCLRAKISYSDPNKAMRDPVIYRCNPDVSHHRTGTTWKVYPTYDFACPIVDSIEGVTHALRTNEYRDRNPQYYWMLDALKLRKVDIWDFGRLNFVYTLLSKRKLQWFVDNGVVSGWDDPRFPTVRGIRRRGMTIETIQEFILAQGPSQQIINMEWDNIWTINKRNIDPVVPRYHALDKDGLVKVNVKGAPKRHTKEMPRHKKNADLGTKLTVFDQEVYVEQADARSFGQAEEVTLMDWGNVIIDSKQTDAAGNVVSIDASANLDGDFKKTKKKVTWLAASASTTETLVEVDLLDFDYLITKKKLDEEDNFADFVTPNSEFRSVALADHNVASLEPGAAIQFERKGYYILDQLVGKNGRREFIRIPDGKQASSASKVAPDADVEAKKHAAQKARAEKAAAKAKKQQEKADKTKAKALEKGDGLQYVAGAVSASVAAATAGLATAIATKPSSAANTHNTRASHPPHFPELIDSAHTINMYHAPIITTNIPTPVRTNMYSMNKIL

SEQ ID NO: 10703 - protein, 450 aa, Nocardioides sp. JS614
MTESAVAAVGGPTLPQERRVVTDIPGPRSLERLERKRAHVADGVGTMLPVFVEAAGGGVLVDVDGNSLIDLGSGIAVTTVGNAAPAVARNVHAQVDAFTHTCFMITPYDGYVDVCAALAELTPGDHAKKSALFNSGAEAVENAVKIARVATGRDAVVVFDHAYHGRTNLTMAMTAKNMPYKNGFGPFAGEVYRAPMSYPLRDGLTGEQAAARAIDVIDKQVGAANLACIVIEPIQGEGGFVVPAPGFLPALAHWAQANGVVFVADEIQSGFCRTGDWFACDHEGVVPDLVTTAKGIAGGLPLAAVTGRAELMDAVHVGGLGGTYGGNPIACAAALGSIEEMRAGRLDARAREIGDRMRARLEALAAEHAVIAEVRGRGAMMAIELCKPGTTEPDPVRTAAVSAYCHQHGVVTLTCGTWGNVFRFLPPLSISDALLDEGFDVVGEAFAATA

SEQ ID NO: 10704 - protein, 118 aa, Zea mays
MAEATDTAVATPPPAPAMATLSPPPKSGIPPRYDLDAKWDACLDLSIRRVAYSSLAGALAGLLLFRSPTTRWASVTLGAGVGIGAAYTECSYLFSGGPPNWSPKVSTIPSAHSEGEDK

SEQ ID NO: 10705 - protein, 658 aa, Vitis vinifera
  misc_feature (110)..(110): Xaa can be any naturally occurring amino acid
  misc_feature (117)..(117): Xaa can be any naturally occurring amino acid
  misc_feature (139)..(139): Xaa can be any naturally occurring amino acid
  misc_feature (389)..(389): Xaa can be any naturally occurring amino acid
  misc_feature (529)..(529): Xaa can be any naturally occurring amino acid
  misc_feature (582)..(582): Xaa can be any naturally occurring amino acid
  misc_feature (591)..(591): Xaa can be any naturally occurring amino acid
MELIPHRRQNSSNASTIADADADAEVAVISFSFIPFNSLVNTCYDCEILLVVICLLLLLRFFKGKNIIPWNWPLIGMLPTILFQYDQVLDLGAEILERCGGTFLVKGLWXAHSDMLXTCIPADAHHVMSTNFWNFPKGXEFRMMLDAFGNGLFISDLEDWSFHRRIGRALFNHQRFQQLSVDITLDKVENGLVPVLEHASQQRLAVDFQDLFQRFGLDATCALITGCDPKSLCLELPDVPFASAMEEAGKVIFLRHVYPKCIWKLQRWLGIGSERILIAAKKTLYDFAAEHVSFMRERSNMGTNQTEGLDILSAYINEDEAFQSSASDKVLIDNILSLLLAGKDTTSAALSWFFWLVSKNPSVETKIIEELKAAVPAKEAEKWHLFDAXELSKLVYLHGALCESLRLFPPVPLQIRTPLQPDILPSGHRVDPSTKVIFHAYAMGRMACAWGKDCLEFKPERWLTGKGRTKHEPAYKFLAFSAGPRICLGKEVAFFKMKAVAAAIMHNYHFQMVKGHRVVPTVSIVLHMXHGLRADLVECWVRAAKTNVQGQSSSSKGSSFDDFKKLGHPYFFGTSNPTEAKXWILKMEKFXDVIDCFKEQKTSYATFLLDKQAAHWWRMTKRLLEDQEPITWKQFREAFYKKYFHDNVRQHKVEEFVI

SEQ ID NO: 10706 - protein, 253 aa, Arabidopsis thaliana
MPTRNIAIGGVQEEVYHPNALRAALAEFISTLIFVFAGSGSGIAFNKITDNGATTPSGLVAAALAHAFGLFVAVSVGANISGGHVNPAVTFGVLLGGNITLLRGILYWIAQLLGSVAACFLLSFATGGEPIPAFGLSAGVRSLNALVFEIVMTFGLVYTVYATAVDPKNASLGTIAPIAIGFIVGANILAGGAFSGASMNPAVAFGPAVVSWTWTNHWVYWAGPLIGGGLAGIIYDFVFIDENAHEQLPTTDY

SEQ ID NO: 10707 - protein, 390 aa, Thermus caldophilus
YATLLDLDPKGKRVLVRVDYNVPVQDGKVQDETRILESLPTLRHLLAGGASLVLLSHLGRPKGPDPRYSLAPVGEALRAHLPEARFAPFPPGSEEARREAEALRPGEVLLLENVRFEPGEEKNDPELSARYARLGEAFVLDAFGSAHRAHASVVGVARLLPAYAGFLMEKEVRALSRLLKDPERPYAVVLGGAKVSDKIGVIESLLPRIDRLLIGGAMAFTFLKALGGEVGRSLVEEDRLDLAKDLLGRAEALGVRVYLPEDVVAAERIEAGVETRVFPARAIPVPYMGLDIGPKTREAFARALEGARTVFWNGPMGVFEVPPFDEGTLAVGQAIAALEGAFTVVGGGDSVAAVNRLGLKERFGHVSTGGGASLEFLEKGTLPGLEVLEG

SEQ ID NO: 10708 - protein, 469 aa, Burkholderia xenovorans LB400
MNDFSLLIDGQLVAGDHTIPVLNPATGKVAASAPAASVQQLERAITAANRAFAGWRDTPFAERRAIVLKIIDIIAANQGELSRLLTLEQGKPLAAAAGEVSATIDYFRYFTTLSLAPEVRQDNETRYVEVRRDPLGVVAAIIPWNFPLLLAAFKLPAALLAGNTVVLKPAPTTPLATLHLGRLIAGAVPAGVVNIVSGGDELGPVLTSHPGIRKVSFTGSTETGKKVMASAATHLARVTLELGGNDPAILLDKVDLEHTATAIFASAFGNSGQVCRAIKRVYVPRPIYEPFCAALAERARAAVVGDGLTDGVQFGPVQNAAQFERLKELHADAQQRGTVMPGGGPVKGPGYFFRPTIVKDIASDSRLVVEEQFGPILPVIAYDELEEAVEMANNSQYGLAASVWSTDSQAAFAVADRIVAGTVWINKHTDRMPDLPIAGARQSGMGVELGEEGLHEFTQIKIVNLSKAA

SEQ ID NO: 10709 - protein, 110 aa, Populus trichocarpa
MEANRGQNGIQLLLAAEQEAQHIVNTARNAKMARLRQAKEEADKEIAEFRAHMEAEFQRKLTESSGDSGANVKRLEHETEAKIGHLKTEASRISHDVVQMLLKHVTAVKN

SEQ ID NO: 10710 - protein, 629 aa, Ostreococcus tauri
MRLCTGLIVLWLYAAVVVHAYGSGEERERTSQLLESTPTTEATTTLTIDAAKDRVFNKTIAAQFNTLLEKEFDEEQLEVGGTTPGAGRSFSDSVRNEGATLETVVRLHRPRGSDVPTEIFHDKKVSEETEQISPQVAAEDALSDTASSVDTLDRGREVAGSGVDSKDGPQVNKREGTLFTQLVSVKRDINKVLSNEEIDNDVDRLVDSADNEFVISNPKRGTMELQQDLRLINDLVIMLCSAALGGSTFALLRQPLITGYLVAGSLVGPGGLGMIVELVQVETFAQFGIIFLLFGLGLELNVSNLRQVHIVAVYGGALQMLLSMLVCGVISDFAGASAKEGIFVGAFLSVSSTAVVSKSLLERDDLHTATGQITMGTLILQDCATGLLFALIPVLGSSEGVGSTFLSFVNVLMKMIIFMLVCTVLSGIVTTRLFRFASSYGDESYQLTGVAFCLLVARITERFGLSMELGAFLAGVAVSATPYAEKTLHSLEPFRNIFTALFLTSIGLIMNPHFLWLHLDVLLLSVCSLVIFKTTLIAVVVRAFGYNTYTSFTVGVSLAQVGELSFVLLSRASAVNLVERKLYLLLLGTTALSLVLTPTLFRVTPGILRVATAAHFINQDDQSLPSHKS

SEQ ID NO: 10711 - protein, 499 aa, Arabidopsis thaliana
MDLLLIIAGLVAAAAFFFLRSTTKKSLRLPPGPKGLPIIGNLHQMEKFNPQHFLFRLSKLYGPIFTMKIGGRRLAVISSAELAKELLKTQDLNFTARPLLKGQQTMSYQGRELGFGQYTAYYREMRKMCMVNLFSPNRVASFRPVREEECQRMMDKIYKAADQSGTVDLSELLLSFTNCVVCRQAFGKRYNEYGTEMKRFIDILYETQALLGTLFFSDLFPYFGFLDNLTGLSARLKKAFKELDTYLQELLDETLDPNRPKQETESFIDLLMQIYKDQPFSIKFTHENVKAMILDIVVPGTDTAAAVVVWAMTYLIKYPEAMKKAQDEVRSVIGDKGYVSEEDIPNLPYLKAVIKESLRLEPVIPILLHRETIADAKIGGYDIPAKTIIQVNAWAVSRDTAAWGDNPNEFIPERFMNEHKGVDFKGQDFELLPFGSGRRMCPAMHLGIAMVEIPFANLLYKFDWSLPKGIKPEDIKMDVMTGLAMHKKEHLVLAPTKHI

SEQ ID NO: 10712 - protein, 280 aa, Streptococcus mutans UA159
MEAYTLINGVHIPKIGFGTWKLADGDEAYKSVSYALEVGYRHVDTAQYYGNEVSVGRAIADSPIKREELFITTKIWNDKHSYDEAKQSVEESLAKLKLNYLDLLLIHWPNPKALRENDAWKTRNADVWRAMEDLYQAGKVRAIGVSNFMIHHLEPLLEVATVKPMVNQVLLAPGCSQEELVAFCRQNEMILEAYSPLGTGSIFDNQTAQDLANKYNKTVAQIALRWSLQKGFLPLPKSATPKNILSNLAIFDFDLTEDDILKLDKIENVKSQGNPDETAF

SEQ ID NO: 10713 - protein, 450 aa, Streptococcus mutans UA159
MTKQYDYIVIGGGSGGIASANRAAMHGAKVILFEGKQVGGTCVNVGCVPKKVMWYGAQVAETINNYAADYGFDVTTQAFHFDVLKQNRQAYIDRIHDSYERGFDSNGVERVYGYATFVDAHTVEVAGEHYTAPHILIATGGHALLPDIPGSEYGITSDGFFELDAIPKRTAVVGAGYIAVEISGILHALGSETHLFVRRDRPLRKFDKEIVGTLVDEMKKDGPHLHTFSVPKEVIKNTDNSLTLILENGEEYTVDTLIWAIGRAANTKGFNLEVTGVTLDSRGFIATDAFENTNVEGLYALGDVNGKLELTPVAVKAGRQLSERLFNHKPQAKMDYKDVATVIFSHPVIGSIGLSEEAALDQYGEENVTVYRSTFTSMYTAVTSHRQACKMKLVTVGEDEKIVGLHGIGYGVDEMIQGFAVAIKMGATKADFDNTVAIHPTGSEEFVTMR

SEQ ID NO: 10714 - protein, 233 aa, Vibrio campbellii AND4
MPISTPQEIIDDIRAGKMVILMDDEDRENEGDLIMAAEHITPEAINFMATHGRGLICLTMTKTRCESLGLPPMVQDNNAQYTTNFTVSIEAAEGVTTGISAADRARTVQAAVAPNAKAADLVQPGHIFPLAAQDGGVLTRAGHTEAGCDLARLANLEPASVIVEILNDDGTMARRPDLEVFAEKHGLKLGTIADLIEYRNNTETTIERVAQCALPTEFGEFTLVTYKDTIDNQ

SEQ ID NO: 10715 - protein, 252 aa, Cryptococcus neoformans var. neoformans JEC21
MSVYVGESRGELLAWLNDLLAPTVVTKLEQCGTGSVYCQIIDSIYGDLPMSRVKFNARMEYEYLDNFKILQKAFTRHKIEKPIPVDRLIKCKMQDNLEFLQWIKKYWDMHSRGEGYDAQARAGGHIAGVRASTSRPTAARTRPAPAVTGSRTVSSASQQANSAQVAAMQARVAEIEAHSEGLLKERDFYFDKLRNIELIVQERLAVEGITPEESDVMTKIQDILYATIEGFEVPQEEDFIEEQPVEGEEETF

SEQ ID NO: 10716 - protein, 473 aa, Photobacterium sp. SKA34
MATVITEERSNGTLSLEKSDLNKNVFIACLIAALAGLLFGLDIGVISGALPFIAKEFGLATHTQEWVVSSMMFGAAFGAIGSGPLSNKFGRKYSLVVASILFTIGSLGCALANNTEILIIFRIFLGLAVGVASFTAPLYLSEIAPQKLRGSLISMYQLMITIGIVVAFLSDTAFSYEGQWRWMLGVITVPALILLIGVLMLPRSPRWLALKGRHTEAKEVLELLRGSDETAKHELDAIRESLKVKQSGWSLFKTNRNCRRAVYLGVTLQVMQQFTGMNVIMYYAPKIFKIAGFASTEQQMWGTVIVGLVNVFATFIAIGLVDKLGRKPILKLGFLVMSASMATLGFLLNQGVTTSFEQYFAAFVLLIFIVGFAMSAGPLIWVLCSEIQPLKARDFGITVSTATNWIANMIVGATFLTFLQVLGNSQTFWLYAVLNIIFLFVTLILIPETKGISLEKIEQNLMTGVPLSKLGKK

SEQ ID NO: 10717 - protein, 375 aa, Neisseria gonorrhoeae FA 1090
MLECTANYRSGEIMSQTIDELLIPHRNAIDTIDAEILRLLNERAQHAHAIGELKGTGAVYRPEREVAVLRRIQDLNKGPLPDESVARLFREVMSECLAVERPLTIAYLGPQGTFTQQAAIKHFGHAAHTMACPTIDDCFKQVETRQADYLVAPVENSTEGSVGRTLDLLAVTALQACGEVVLRIHHNLLRKNNGSTEGIAKVFSHAQALAQCNDWLGRRLPNAERIAVSSNAEAARLVAESDDGTVAAIAGRTAAEIYGLDMVAECIEDEPNNTTRFLVMGHHETGASGSDKTSLAVSAPNRAGAVASLLQPLTESGISMTKFESRPSKSVLWEYLFFIDIEGHRRDAQIQTALERLGERASFVKAIGSYPTAVL

SEQ ID NO: 10718 - protein, 173 aa, Helicobacter pylori
MNLDQLEVSHDANALCVVIEISKHSNIKYELDKESGALMVDRVLYGAQNYPANYGFVPNTLGSDGDPVDALVLSDVAFQAGSVVKARLVGVLNMEDESGMDEKLLALPIDKIDPTHSYVKDIDDLSKHTLDKIKHFFETYKDLEPNKWVKVKGFENKESAIKVLEKAIKAYQG

SEQ ID NO: 10719 - protein, 429 aa, Candida albicans
MGCGASVPVDDDEIDPFLQDKRINDAIEQSLQLRQQNSKKGVKLLLLGAGESGKSTVLKQLKLLHKGGFTQQERRQYSHVIWCDVIQSMKVLIIQARKLKIKLDCDQPNNSLIPYKQIILRSDPLKQIDASVAGGTDFLNDFVVKYSEENKNKRRLKSTGTTDIWGKDDDSNINSDAINQALESSLNKDSEQFTRLSIAEAIHKLWKLDSGIKKCFDRSNEFQLEGSADYYFDNVVNFADTNYLSTDLDILKGRIKTTGITETDFLIKSFQFKVLDAGGQRSVRKKWIHCFEDITAVLFVLAISEYDQNLFEDERVNRMHESIVLFDSLCNSKWFANTPFILFLNKIDIFENKIKKNPLKNYFPDYDGKPDDTNEAIKFFETNFLKINQTNKPIYVHRTCATDSKSMKFVLSAVTDMIVQQNLKKSGIM

SEQ ID NO: 10720 - protein, 743 aa, Vitis vinifera
  misc_feature (221)..(221): Xaa can be any naturally occurring amino acid
  misc_feature (306)..(306): Xaa can be any naturally occurring amino acid
  misc_feature (421)..(421): Xaa can be any naturally occurring amino acid
  misc_feature (450)..(450): Xaa can be any naturally occurring amino acid
MWQVLLAAAVAGSGIFAKNLFSNNNADPTVSPPPPQAELQTHDKCDQNHQQRSSSRSASKEVSQSNQSGVVGEAEEIFRFSSSGVSKKPRTRPRGFKKKVEVEGISLSFKKRRTGKAASVKSSTDGSSFVWGLGVGMMYMMSAGKAEISKLNTSMDETAKVVQELKTELYKRKSSRNLQVSSFSSEADTSPKKIRGKHTAQVLAKSSTGNQDPNEINISSXPVIDDGEYASSVLTEEPRPEVLEMDQLEAELESELQKLPCCATDAPDSEEIRPDLGDTREVSAKGFHELEGQNSNSYQFHGVLPXELDQKLCHVLIEQQENQIVDLESELHLAQSKLHEKEAELQALKDCVKRLTEFSLSTVSGNVIKWKDHRMSSNLRVVVRDIKRRDNTKQARHLGTRGREFQSDERQSREAEREGVXLVKMKLSSKTMSSPGRTEKFPPPLMRFLXSNVGSRSRGRSRSSPMFVRKKNTAIETQEPSSPKVTCIGQVRVRRSKQGSGKATKARKKTRGWCRWIRKALCCNHFVGRLKPKPFRPVWRKWVLFFRVRFRRKSEIREDSSRIESKLEDRVEESEQSDDVGNEEEEARVFYSSSFSPPKNALLLTRCRSAPYRSSSLASRFWGSPLATEEEQKTEPENTDQQNPASENEPSSRDSAAESRTDPETDRDSEYLNQSEDSTSERSTKPTKTEAFKTGEEATAHPLILTRCKSEPARTGARLNPDTTLFWKKRRLGFAEPRSPSVL

SEQ ID NO: 10721 - protein, 103 aa, Glycine max
  misc_feature (33)..(33): Xaa can be any naturally occurring amino acid
FFPFADPRLRLKTLVPLSFSSGGGGGGGGGSKXIIPVRCFTCGKVIGNKWDHYLDLLQADYTEGDALDALGLVRYCCRRMLMTHVDLIEKLLNYNTLEKTETS

SEQ ID NO: 10722 - protein, 537 aa, Bacillus sp. SG-1
MENMDFLYHPYASQRNTVFSKKGMVATSQPLAAQAGLEILQRGGNAIDAAIAAAAALTVVEPTSNGIGGDAFALVWVKDKLHGLNASGPSPKSISIEKVKEKGHEKMPVHGVIPVTVPGVPSAWAELSEKFGKLSLKETLEPAIRLAEEGYPLTPILGKYWSLAYKKFKQILTGDEFKAWFETFAPDGKAPQIGEVWSSPGHASTLKSIAETNAESFYRGEIADKIGSFMEEHGGFLSADDLKDYRAQWVDPIKTDYRGYDVWEIPPNGQGLVALMAMNIAKGFEFQEKDAVDTYHKQIESMKLAFTDGKAFITEQEDMPLPVDELLSDRYAAARRELIGDEAITPEAYDIPKGGTVYLAAADDEGNMISYIQSNYMGFGSGVVIPGTGIGLQNRGHDFSLDPEHPNALKPGKKTYHTIIPGFLTKGDKAVGPFGVMGGYMQPQGHFQVISNTIDFHLNPQSALDAPRWQWIEGRKVLVEPNFPTHIAQALARKGHEIQTATDEGMFGRGQIIWRDEGTGVLMGGTESRTDGAIAAW

SEQ ID NO: 10723 - protein, 145 aa, Brassica napus
MAMPPGNVAPGNWILDGRDGFISWIRGEFAAANAIIDSLCQHLIAIGDHNEYEGVVSAIQQRQSSWSQVLYMQHFFPIADVSYALEQAAWKRQQKTMMPQRHYNSDQIGGRRSGNGFNKHHHGGYRGGGTMVRKRASLGFGWLQD

SEQ ID NO: 10724 - protein, 100 aa, Mycoplasma mobile 163K
MVHEVVKKQIDFEKFNKDKKILVFHATWCGPCRMYGPILEEVGSKGYEIFKIDVDKDREFTREFGIKNTPSTLFFKNGELKEKVIGFKSADELIDLINKI

SEQ ID NO: 10725 - protein, 367 aa, Erwinia carotovora subsp. atroseptica SCRI1043
MIGVTRLYIHPVKSMRGLQLSHAMASVSGLANDRAFMITESDGTFITARQYPQMVLFTPALLPDGLFIAAPDGQTATIRFADFIETPQPTEVWGTHFTALVAPDAINRWLSHYFQRSVQLRWVGSEPSRRVKHYPEVPLAFADGYPFLLINDASFQALRQRCSAGIKIEQFRPNLVVTGAEAFAEDSWKTIRIGEVIFDVVKPCSRCILTTVSTERGRKHPSAEPLATLQSFRTAENGDVDFGQNLVARNTGIIRVGDTLEVLATKPPRPYGSGQVVESLVVPEKSEQAVTIHYQGKSLQGNNQQILLEQLEQQGIRVPYSCRAGLCGCCKLTLVSGEVSALKQSAIRANGEILTCSCIPQSDIHLQ

SEQ ID NO: 10726 - protein, 374 aa, Chromobacterium violaceum ATCC 12472
MTISPIQDIIADIQAGKMVVLMDAEDRENEGDLVMAAEFVTPEAINFMAKYGRGLICLTLTEERCKLLNLPMMATNNGTSFGTNFTVSVEAAEGVTTGISAADRAHTIKTAVARLAKASDLVQPGHVFPLKAQNGGVLIRAGHTEAGCDLAMLAGVEPAGVICEIMNDDGTMARLPELLEFAKQHGLKIGTISDLIQHRSRTESLVEKVGERPVETPFGSFDLHVFRDITTSATHLALSKGKIRPDKEILVRVHEPLSVIDVLAPLCSHHSWTLPNALETMEEEGCGVMVLLYRDETGADLAQRALDQEPPRQKWDSKTFGIGAQMLKALGVGKMKLMSSPVSLPSMAGFELEVTGFCQPGHFHVDRDGGPGVA

SEQ ID NO: 10727 - protein, 177 aa, Brassica napus
MSGMVDASSWGAALVRISPYTFSAIGIAISIGVSVLGAAWGIYITGSSLIGAAIEAPRITSKNLISVIFCEAVAIYGVIVAIILQTKLESVPSSKMYDAESLRAGYAIFASGIIVGFANLVCGLCVGIIGSSCALSDAQNSTLFVKILVIEIFGSALGLFGVIVGIIMSAQATWPTK

SEQ ID NO: 10728 - protein, 155 aa, Chromobacterium violaceum ATCC 12472
MLDAIQCIEPNFSGKGLKIGIAMARFNTPVCHGLRDACLAELEKLGVAAGDITLATVPGALEVPLVLQTMAKSGRFDALVALGAVIRGETYHFELVSNESGAGVTRVGLDFDIPVANAILTTENDEQAEVRMLEKGGDAARVAVEMANLHKTLRG

SEQ ID NO: 10729 - protein, 571 aa, Populus tomentosa
MNYFPDEVLEHVFDFVTSQRDRNSVSQVCKPWYKIESSSRQKVFVGNCYAISPERVIERFPGLKSITLKGKPHFADFNMVPHDWGGFVYPWIEAFARNNMGLEELKLKRMIISDECLELISRSFANFKSLVLVSCVGFSTDGLAAIASNCRFLRELDLQENDVEDHRGYWLSFFPDTCTSLVSLNFACLKGDVNLAALERLVARSPNLRSLRLNHAVPLDILQKILMRAPHLVDLGVGSYVHDPDSETYNKLVTALQKCKSVKSLSGFLEAAPQCLPAFHLICPNLTSLNLSYAPGIHGTELIKLIRHCRKLQRLWILDCIGDEGLEVVASTCKDLQEIRVFPSDLHVGDAAVTEVGLVALSSGCPNLHSILYFCQQMTNAALITVAKNCPNFTRFRLCILDPTKPDGDTNQPLDEGFGAIVHLCKGLRRLSMSGLLTDQVFLYIGMYAEQLEMLSIAFAGDTDKGMQYLLSGCKKLRKLEIRDCPFGNAALLMDVGKYETMRSLWMSSCEVTLGGCRSLAKKMPRLNVEIINENDQMDASADDTLKVEKMFLYRTLAGRREDAPEFVWTL

SEQ ID NO: 10730 - protein, 396 aa, Erwinia carotovora subsp. atroseptica SCRI1043
MFENISAAPADPILGLTDLFRADDRADKINLGIGVYKDETGKTPVLTSVKKAEHYLLENETTKNYLGIDGLPAFGQCTQELLFGKQNAIIADKRARTAQTPGGTGALRVAADFIANQTSAKRIWISNPTWPNHNNVFSAAGLEVCQYDYYDAANHALDFDGLLNSLNAVEAGDVVLFHGCCHNPTGIDPTAEQWATLAELSVAKGWLPLFDFAYQGFARGIEEDAEGLRLFAAKHAELIVCSSYSKNFGLYNERVGACTLVAADAATADKAFSQVKAAIRANYSNPPSHGATIVATILGNDALKAIWEQELTAMRERIQRMRQLFVNTLQEKGAQQDFSFIINQNGMFSFSGLTKEQVLRLRDEFGVYAVNSGRVNVAGMTPENMAPLCEAIVAVL

SEQ ID NO: 10731 - protein, 741 aa, Ostreococcus tauri
MGILSLHVQRCRASLPASRSTVARKHAGATRCCQVIKRASSKSLSALHLRSRGVTQVSSREDIEELDGQIEGIEGYGAISTKPATPLLDTINFPSHLKSLTMGQLNQVAKELRADLIYNVSQTGGHLGSSLGVIELTVALNYVFDQPEDKIIWDVGHQAYPHKILTGRRDKMNTMRQTGGLSPFTKRSESPYDCFGAGHSSTSISAGLGMAVARDMQGEDFHVISIIGDGAITGGMAYEAMNNAGFLDTNMIIILNDNQQVSLPTQYNSLNQDPVGALSSTFARLQSSRPLRELRESAKAITKQMPTPVQEVTAKVDEYARGMISGSGSTLFEELGLYYIGTVDGHNLEDLVAILQEVKETRSVGPVLIHIVTEKGRGYSYAEDAQDKYHGVSKFDLASGRQSQLKENAPSYTKVFADALIGEAMMDDKVVAVHAAMGGGTGLNHFEKYFADRTYDVGIAEQHAVTFAAGLACEGLKPMCTIYSTFLQRGWDQVVHDVALQKLPVRFAMDRAGLVGADGPTHAGAYDVTFMACLPDMVVMAPMNEAELCHMVATSLAIDDRPSCFRYPRGAGVGLNMEDESVKLVNPGYKGMVLDIGKGRVLQEGTDVVLLGYGTPTNNCLQAAQMLQKFGVSVTVADARFCKPLDGELIRRLAKSHPIFITVEEGAIGGFASHVMHFLATDGLLDSGLKFRPMILPDRPIDHGSYSFQVNEAGLSASHIASTALSLVGKQHESLEVLARV

SEQ ID NO: 10732 - protein, 369 aa, Arabidopsis thaliana
MGGVTSSVAAKFAFFPPSPSSYKLVYDELTGLLLMNPFPHRENVEILKLPTRRGTEIVAMYVRHPMATSTLLYSHGNAADLGQMYELFIELSIHLKVNLMGYDYSGYGQSTGKPSEHHTYADIEAAYKCLEETYGAKQEDIILYGQSVGSGPTLDLAARLPQLRAAVLHSPILSGLRVMYPVKKTYWFDIFKNIDKIPLVNCPVLVIHGTCDEVVDCSHGKQLWELSKEKYEPLWLEGGNHCDLEHYPEYIKHLKKFITTVERDLSSRASTAQLEKQSSDLEMPRQSVDRREKPRQSVDKREKEKPPKGPSKKSKLRITFEQHLDRTRRSVDFHEKARKSVDHHQHHQNHHQIERGRKSVDRLDRVRSE

SEQ ID NO: 10733 - protein, 294 aa, Populus trichocarpa
MGPYGGFKGDTGDWSRSLYSAPRDELASKEFSLRVVCPTANIGAVIGKGGTIINQIRQESGATIKVDSSVAEGDDCLITISAKEIYDHYSPTIEAAVRLQPRCSEKMERDSGLISFTTRLLVPSSRIGCLLGKGGAIIDEMRKLTKAIIRIPRKENLPKVASDDDEMVQIAGDLDVAKDALIQISRRLRANVFDREGAMSAILPVLPYLPVSAEGSEGLNYDSRDGKRHGRGSSYAGGYSSSDYASGDGYGSYGSSQINASGGPYGAYGSYSSGRTGTSGLSGQAPVSRRKSYY

SEQ ID NO: 10734 - protein, 494 aa, Ostreococcus tauri
MTSDGGNNDANVDWTALLKWSLAQQQGFDADAMPRRELTNDDMKFFYNAVAASNAGGKSDAVMILESVESTRDGGTDEEAAVALEDLIDRCEQTENAGNMLSAGGAEALTAMLRAGRGEIRKLAARALATVTQNHPEAQARAANAGAVEALLDVVRIDNDDGLRGASLWALSCLIRDCVGAAKAFEAAGGVEVCTQFISMPTLNDRIRAKALHLGRHAFVQSEENMSDAVEHGAIKSASECVRSEDVNVREAAATLLLLIAQCVDFTKNPKAVDQFRSAKAHVAKALSNMQFTTGPDAESNEPTRQALEQLIAMLTDAFSKAELACVHDLLENEGWLKKEQAMQFSPLPSWLVVVGQRLYQIAVEVGFVMDDERPLFNFSQCIINQYTPPGGLTPHVDLRAFGDLIASISLCSTVAMDFAPVEPNANMQSNLTLRLDHGDVLIFKGDARWRWTHAIPSRQVDIFGAERVERAHRISITLRTMDPDGHVLEVPAT

SEQ ID NO: 10735 - protein, 306 aa, Mesorhizobium loti MAFF303099
MIVVVGSINLDLIAKVDRLPSPGETVRGSGFSTAPGGKGANQALAAARAGVPVRMVGAVGKDSFAGEALALLREAKVDLSGVAETFASTGTALIMVGDDGENIIAVVSGANASVVTGDLSKAFLKKGDVVLLQHEIPLATVDAALDQARAAGAITVLNTAPFQGDATAFLGKADYVVANETEFDLYGEALALNGRDRAARMRDFAAKTGRSIVVTLGGDGVMAATPSDFLTVAAMKITPVDTVGAGDTFCGYFAAGLSSGLALDQALARAGAAGSLACLKPGAQPAIPLAKDVDQALQEVSRNDAP

SEQ ID NO: 10736 - protein, 475 aa, Bordetella pertussis Tohama I
MYEQLALYIDGEFLTGDGRRTQDVVNPATLEVLGQLPHASEADLDRALAAAQRAFETWKRTSPMERAAILRKVGQLSRDRAQEIGRNMTLDQGKPLAEAVGEVASCSEHADWHAEECRRIYGRVIPPRNPDVRQFVVREPIGVCAAFTPWNFPYNQAIRKIAAALGAGCTVVLKGPEDSPSAVMAIARMFHEAGLPKGCLNIVWGEPAKISDYLIRSPIVRKVSFTGSVPVGKQLAALAGAHMKRVTMELGGHSPVLVFDDADVDRAAEMLARFKVRNAGQVCVSPTRFYVQNGAYEQFLARFTEVLKNIKVGDGLEKGTDMGPLAHERRVPAMSTFVDDALKHGGKVVLGGDAPDRKGYFFSPTVVTELPDNAMLMTEEPFGPLAPVVRFTDTDEVLRRANSLPFGLSSYVFTNSLKTATKVSNALEAGMVNINHFGSALAETPFGGIKDSGIGSEGGLETFDGYLVTKYITHI

SEQ ID NO: 10737 - protein, 463 aa, Physcomitrella patens subsp. patens
KALDESPLEAEAWRLLKKAVVSYCGQPVGTIAANDPTDPYPLNYDQVFIRDFIPSAIAFLLKGEHEIVRNFIHHTLQLQSWEKTVDCYTPGQGLMPASFKVQTVFLDREGVKETEEILQPDFGEAAIGRVAPVDSGLWWIILLRAYGKCTGDLTLQERVDVQTGIKMILKVCLADGFDMFPSLLVTDGSMMIDRRMGTHGHPLEIQALFYHALRCAKEMLHPEAHDLIRSVNSRLAALSFHIQEYYWLDIRKLNEIYRYRTEEYSSDAVNKFNIYPDQISRWLLDWLPEQGGYFIGNLQPAHMDFRWFTLGNIWSICSALATKEQSEEILTLVEKKWEDLIGTMPLKICYPTLEEDEWRIITGADPKNTAWSYHNGGSWPVLLWQFTLACIKMGRSDLAEKAVAIAEKRLSKDWWPEYYDTKSGRFIGKQARLYQTWSIAGYLTSKLLLKNPDAVKWLTCEDD

SEQ ID NO: 10738 - protein, 313 aa, Mesorhizobium loti MAFF303099
MPQPRKIIIDTDPGQDDAVAILLALGSSELEIVGITAVAGNVPLKLTEKNARKICELAGRPEMKVYAGAIRPLARTLVTAEEVHGKTGLNGPQLPEPTMKLQEQYAVDFIVETLMKEESGTITLCPLGPLTNIALALIREPRIAPRIKEIVLMGGGFFEGGNVTPAAEFNIYVDPQAADLVFKSGIPIVMMPLDVTHKALTTTKRTQAFRALGTKVGIATAEMLEFFERYDEGKYGTDGGPLHDPCVIAYLLKPELFKGRNCNVSVETASELTMGMTVIDWWGVTKREKNAMVMREIDHDGFFALLVERLGRL

SEQ ID NO: 10739 - protein, 508 aa, Rhizobium leguminosarum bv. viciae 3841
MVMTVLVNPTALSDHKARDFKMFIDGRWEAGSSDPIERVAPSHGVVVSRFPTGSKKDAERAIAAARKAFDLGPWPRMTASERSAILLKAADLIAARAEELAFLDAIEAGKPITQVRGEIAGSVDIWRYAAALARDLHGESYNTLGDGTLGVVLREAIGVVSIITPWNFPFLIVGQKLPFALAAGCTTVVKPSELTSGSTLVLGEILEEAGIPDGVVNIVTGTGPEVGAVMTSHPDVDMVSFTGSTGVGKLTMSNAAQTLKKVSLELGGKNPQIVFPDADLDAFIDAAVFGAYFNAGECCNAGSRLILHKSIASDVVKRIAELSKAVKVGDPLDPSTQVGAIITPEHLEKISGYVAGARGSGARLAHGGETLDLGMGQFMSPTILEEVTPDMAVAREEVFGPVLSVLTFETSAEAIRIANSIDYGLSAGVWSRDFDTCLTIGRSVRAGTVWMNTFMDGASELPFGGYKQSGLGRELGRHAVEDYTETKTLNMHIGKRTSWWMPQTEKLA

SEQ ID NO: 10740 - protein, 530 aa, Euphorbia esula
METQLATKNPSSQPPPPPPELAAPPSSNLKKIVVVASIAAGVQFGWALQLSLLTPYVQLLGIPHTWAAFIWLCGPISGMLVQPIVGYHSDRCTSRFGRRRPFIAAGAASVAVAVFLIGYAADLGHMSGDSIGKSPKIRAIAIFVVGFWILDVANNMLQGPCRALLADLSGTSQKKTRLANALFSFFMAVGNILGYAAGAYTHLYKIAPFTLTKACDVYCANLKTCFFISIALLLVLTVIALTYVKEKQWSPEIAKTVAGVDGDDEDGPVEAAPLPFFGEIFAALKNLQRPMRILLLVTCLNWIAWFPFLLFDTDWMGREVYGGSSDSSATAGESKLYDRGVRAGALGLMLNSVVLGFTSLGVELMARKLGKVKRLWGIVNFLLAICLALTILITKLAESGRHYPTVNGVVSTTPSPPSSGIKAGALTLFAVMGIPQAITYSVPFALASIFSNDSGAGQGLSLGVLNLSIVIPQMLVSVASGPFDALFGGGNLPAFVVGAVAAAASGVLALTYLPSPPPDLPAKALTVGFH

SEQ ID NO: 10741 - protein, 356 aa, Xanthomonas campestris pv. campestris str. 8004
MWIHGRAVRLGRRQGVGCVRYIVVVALCLAALFFSSRVSAACVQLEAPTSSHNGDWSCADQGEAFAKVSSFPVPADLAKCAMKAVRAVASGPGFSQRMTYPGNTCGIGYELDIGTGSAQFPEASTCAKRPAQSGWINPTAPTPSDVCNDGCYYTYSVDPGNPKGYSYTPSGATCTTDDAAPPIDDGGDGSDGDGGGDGGGDGGGDGGGDGGGDGGGDGGGDGGGDGGGDGGGDGDGDGDGDGDTPGDGDGTTPGDGEGGEGAPMSELYKKSGKTVESVLSKFNTQVRATPMVGGITDFMTVPSGGSCPVFSLGASKWWNAMTINFHCGGDFLAFLRAAGWVILAIAAYAALRIAVT

SEQ ID NO: 10742 - protein, 174 aa, Bordetella pertussis Tohama I
MATKVQGKHAAEKENDDGLREKMIAVNRVSKVVKGGRTMSFAALSVVGDGDGRIGMGKGKAREVPVSVQKAMEQARRGMFKVALKNGTLHHTVVGKHGASTVLISPAAEGTGVIAGGPMRAIFEVMGVRNVVAKSLGSSNPYNLVRATLNGLRASLTPAEVAAKRGKSVEEILG

SEQ ID NO: 10743 - protein, 275 aa, Xanthomonas campestris pv. campestris str. ATCC 33913
MPSFKSFLLHRVSPVCLCVAAGWGTVAMAQTVLPDATPVHAHETTQHDGHEWGYTGPEGAEHWAELAKENALCGNGQQNSPIDLKDAIDATLGKLQLDYGAVPLVVRNTGHSIQLDLHAGGTMRVGGKQYDALQLHFHHPSEHLLNGRRFPMEAHIVHQGPDGTLGVLAIFFETGKANPAFQRVLDAMPSDKNQTRQVADAVVRASDFLPPANQRSFYRYEGSLTTPPCSETVDWVVLSQPVQVSREQINAFERVYPFNARPLQPLDRRFLLKSH

SEQ ID NO: 10744 - protein, 308 aa, Candida albicans SC5314
MSSISNVYHDYSSFSNATTFSQVYQNFNQLDNLNVFEKLWGSYYYYMANDLFATGLLFFLTHEIFYFGRCLPWAIIDRIPYFRKWKIQDEKIPSDKEQWECLKSVLTSHFLVEAFPIWFFHPLCQKIGISYQVPFPKITDMLIQWAVFFVLEDTWHYWFHRGLHYGVFYKYIHKQHHRYAAPFGLAAEYAHPVEVALLGLGTVGIPIVWCLITGNLHLFTVSIWIILRLFQAVDAHSGYEFPWSLHNFLPFWAGADHHDEHHHYFIGGYSSSFRWWDFILDTEAGPKAKKGREDKVKQNVEKLQKKNL

SEQ ID NO: 10745 - protein, 389 aa, Euphorbia esula
MEDASATTTAPSDSLNNHQLPPTAGIENIPATLSHGGRFIQYNIFGNIFEVTAKYRPPIMPIGKGAYGIVCSALNSETGEHVAIKKIANAFDNKIDAKRTLREIKLLRHMDHENVVAIRDIMPPPQREVFNDVYIAYELMDTDLHQIIRSNQALSEEHCQYFLYQILRGLKYIHSANVLHRDLKPSNLLLNANCDLKICDFGLARVTSETDFMTEYVVTRWYRAPELLLNSSDYTAAIDVWSVGCIFMELMDRKPLFPGRDHVHQLRLLMELIGTPSEEELGFLNENAKRYIRQMSVFRRQSFTEKFPTVHPAAIDLVEKMLTFDPRQRITVEDALAHPYLTSLHDISDEPVCMTPFSFDFEQHALTEEQMKELIYREALAFNPEYQQQ

SEQ ID NO: 10746 - protein, 603 aa, Xanthomonas campestris pv. campestris str. ATCC 33913
MHSGGLELALVLMLAAIVAVPVFKRFGLGAVLAYLVAGVVLGPDGVGVVQDAERISGAAEIGVVMLLFVIGLELSPARLKVMRHSVFGAGTTQVVMTALILGGLLMAGQLGWKTSLIVGVALALSSTAVGLQLLAERKALGSDYGRLAFAILLFQDLIAIPLLAAIPLLGGSKNATLDWQEVAKALVALTLVILCGRFVLRHLFNVVARTRMPEVFTASALLVVLGTAWIMQEAGLSASLGAFIAGVLLADSEFRHELESQIEPFEGLLLGLFFISVGMGIDLDRVVSEPWLIAAGVGILLLVKFALLVGIGTVAKLPLRSSLMLGGVLWLGGEFAFVVFNEADRVGLLDAANHDRLVAIVGVSMALTPLLLLGIQRALNGPLRIKVPKSERPYDTIDTQTPKVLIAGMGRFGQVIARLLTARHVPFVALEHNPDTVEDLRRFGSQLYYGDPTRPELLRAAGAERIKVFVIAVDDPDTNIKTVRLIRRLYPNATVLARARNRQHAWKLMDLGAEPFREVFASSLELGGRVLTSLGLGEADAQEHVTRFRHHDEDLLRRQHLVYDDEAKVIQTSRDAREDLMHLFEADVKAEVDPEPAPVTPER

SEQ ID NO: 10747 - protein, 640 aa, Xanthomonas campestris pv. campestris str. ATCC 33913
MQRRGPARRRVRPAQQTHAWQLPARVFPRGPGQCGIAPAWTHGREGDASMSEQVTTPPCIIVVFGARGDLTRRLVMPALYNLRRAGALGEEFAIVGMDHGDITERAWRTNMGKAMTELLSSRDAEFQADGFDTDTWDWLRERMHYVRGDFTDLRAYQSLDGVLEKLHKRYGTRGNVLFYLATAARFFEPVLLNLGEAGLVKQREGAGWRRVIVEKPFGHDLPSAKHLNATVARVLHEDQVFRIDHFLGKETVQNILAFRFANGLFEPVWNRDRIDHVQITAAETIGVEGRGRFYDPTGCLRDMVPNHLFQLLAMIAMEPPAAFTTEAMHRRRAEVIEAVRPIKPEDVVRGQYASGAVNRSAVPGYREEDTVPDESETETFVAMKLQVDTWRWAGVPFYLRTGKRLRERTTEIAIRFKPAPLAPFRSTEVGGYGPDWLVLHIQPDEGISLQFDVKRPGAQVALAPVRMDFRYRDWFPKEYTVGYERLLQDCMNGEAGLFQDAAMVEGAWRIVQPILDAWKQPPSDFPNYAAGSAGPSAADALLAMNGGHAWRALTPGRKPPPRRPPEARAGAAAPAKKSAKKAVKKAAKKVAKAPAKRSAAVAGKSAAAASPSKAASKAVTKRATKKATKPATKVVKKSAS

SEQ ID NO: 10748 - protein, 104 aa, Triticum aestivum
  misc_feature (26)..(26): Xaa can be any naturally occurring amino acid
  misc_feature (34)..(34): Xaa can be any naturally occurring amino acid
  misc_feature (56)..(56): Xaa can be any naturally occurring amino acid
  misc_feature (73)..(73): Xaa can be any naturally occurring amino acid
  misc_feature (92)..(92): Xaa can be any naturally occurring amino acid
  misc_feature (102)..(102): Xaa can be any naturally occurring amino acid
MARRGGGGRRSKVMPNLGADREGTRXLNLTVLRXLDPAVADILVTAAKRHRLQASXKDTVRWSHKGVEGSLFXVKRNTQPTFQFLIMNRPNXQKNLVEDLLXGF

SEQ ID NO: 10749 - protein, 477 aa, Nocardioides sp. JS614
MADQTFKNVINGQLVDSASGETYDIVDPTTGEVYAQAPRSGAEDVDRAYAAAAAAFESWGSTTPKERSEALLKIADAIEARVEEINAVECKDTGKPIGLTMSEEMPYASDHFRFFAGAARVLEGRSAGEYMTDHTSWIRREPVGVVGQVTPWNYPLLMMIWKIAPALAGGNTIVLKPSDTTPASSTLLAEIAQEFLPPGVLNVVTGDRDTGRALVAHPTPQMVAITGSVRAGMEVAESASHDLKRVHLELGGKAPVIVFDDADIEKAAEGIAGAGLFNAGQDCTAATRVLAGAGVHDDFVAALTEAAKGMPTGDPTNEDTYFGPLNNQNQFDRVSGMVDRLPDHASVETGGARHGSVGYFYEPTVLSGLRQDDEQIQTEIFGPVMTVQRFTDEAEALRWANGVEYGLSSSVWTKDHARAMRMSRGLDFGVVWINTHIPFISEMPHGGFKHSGYGKDLSMYGLEDYTRIKHVMSYIGS

SEQ ID NO: 10750 - protein, 339 aa, Haemophilus influenzae Rd KW20
MAIKIGINGFGRIGRIVFRAAQHRDDIEVVGINDLIDVEYMAYMLKYDSTHGRFDGTVEVKDGNLVVNGKTIRVTAERDPANLNWGAIGVDIAVEATGLFLTDETARKHITAGAKKVVLTGPSKDATPMFVRGVNFNAYAGQDIVSNASCTTNCLAPLARVVHETFGIKDGLMTTVHATTATQKTVDGPSAKDWRGGRGASQNIIPSSTGAAKAVGKVLPALNGKLTGMAFRVPTPNVSVVDLTVNLEKPASYDAIKQAIKDAAEGKTFNGELKGVLGYTEDAVVSTDFNGCALTSVFDADAGIALTDSFVKLVSWYDNETGYSNKVLDLVAHIYNYKG

SEQ ID NO: 10751 - protein, 456 aa, Nocardioides sp. JS614
MHPDYDHLQRAAKDHLWMHFTRHSSYAEADVPIIVRGEGAYIYDAKGKRYLDGLGGLFVSQLGHGRTELAEAAAAQARELAFHPLWSYAHPNAILLAERIAGYAPGELNRVFFTSGGGESVESAWKLAKNYFKLTGKPLKHKVISRAIAYHGTTQGALSITGLPPLKQQFEPLVPSTFRVPNTNIYRAPLHGEDPEAFGRWAADQIAVAIENEGPDTVAAVFLEPVQNSGGCFPPPPGYFQRVREICDEYDVLLVSDEVICAFGRLGHMFGAERYGYQPDIITCAKGITSGYAPLGAMIASDRLMEPFLRDAQMFAHGYTFGGHPVSTAVALKNLEIFEEEKVLEHVRSNEAAFRSTLERLHDLPIVGDVRGDGYFYGIELVKDKTTKESFTDEECERLLYGFVSKQLFAEGLYCRADDRGDPVIQLSPPLICEQSHFDEMEQILRVVLDKAGTLV

SEQ ID NO: 10752 - protein, 307 aa, Rhodococcus sp. RHA1
MSLVIGEALIDIVTASSGATTEYVGGSPLNVAVGLGRLGRPVEFVTRIGDDTRGGAIVRHLEQSGVSLAPGSVTAQRTATAHATLDSAGSATYEFDIEWDLPSPSGSSTPALVHTGSIAAVMEPGCDVVADMLDRRRSSATISYDPNVRPVLITDKARARQRIEHLVSISDIIKVSDEDLRWYDPERDPDDIAREWLSRGPAMVAVTKGAEGAFAVCAAGLVEVAARNVEVVDTVGAGDAFMAGLLDGFWAHGFLGAESRDALHAIDPEEVRNVLDNAALMSGLTVARAGADLPSRETLDRAAGVRQ

SEQ ID NO: 10753 - protein, 265 aa, Chromobacterium violaceum ATCC 12472
MSIQIKDAQDIEKMRIAGRLASEVLDFITPHIKPGITTEAIDKLCHDYMVNVQGTIPAPLNYAPDGHNPYPKSVCTSVNHVICHGIPNDKPLKNGDIMNLDITVIKDGYHGDTSRMFFVGDVSPHAKRLSKITYEAMWKGIEKVKPGATLGDIGYAVQSYAESAGYSVVQEFCGHGIGKKFHEEPQILHYGRPGTGLEIQAGMIFTIEPMINQGKRHLRMLADGWTVVTKDRSLSAQWEHTVLVTETGYEILTQSAGTPDKPSFK

SEQ ID NO: 10754 - protein, 472 aa, Bacillus sp. SG-1
MEKYYMRINGENAGHDLSAVEVTNPADQSVIASVPNGGQKEAKAAVDAAYDAFAEWSRYSAYERSELLFKWHDLIEKNKDELAKTMTREQGKPLKEALGEMNYANGFISWYAEEGKRVYGETIPATQRNKRLFVQKQPVGVVAVITPWNFPAAMITRKVAPALATGCTVVIKPAEQTPLTALKMAQLAEEAGIPKGVINVVTGDAKAIGETWLSDTRVRKLTFTGSTQVGKLLMRGAADTVKKISLELGGHAPVIVMDDCDIDKAVNGVIAAKFRNAGQTCVCSNRIYIHESIQQTFTEKLVEKVKGLKVGNGLDEGVDIGPLIDEAAVQKVKNHVEDALKAGAVLEYGGNSNEGLYFGPVILSNVKDDMLCMTEETFGPLAPISTFSSMEEAIERANNSIYGLAAYVFTENITKGITVCEALQYGIVGLNDGLPSTPQAPFGGFKQSGLGREGGHHGIDEYLEVKYISLGI

SEQ ID NO: 10755 - protein, 407 aa, Vitis vinifera
MADRFFPNEMPETAVEAEETSAQNSGDSLIKLLSFPYETLSQQFERAALDVKDAVVRETWALAGKRVQDYALYTGALGTAFLLFKAYQITNNRDDLNVCSEIVKACDSASATSGRVTFICGQAGVYAIGAVAAKHAGDERLLGRYLTQFKEIKLPKDLPNELLYGRGGFLWACSFLNKHIGKDTISSARMRASVKEIIKSGREMAKRERCPLMYEWHGKKYWGAAHGLAGVMHVLMHMELKPDEVEDVKGTLRYMIKNRFPSGNYPSSEGSESDRLVHWCHGAPGVALTLLKAAEVFGDKEFLQAAVDAGEVVWNRGLLKRVGICHGISGNTYVFLSLYRLTGNVEFLYRAKAFACFLLDRAQRLISEGKMHGGDRPYSLFEGIGGMTYLFLDMIEPSEARFPGYEL

SEQ ID NO: 10756 - protein, 154 aa, Populus trichocarpa
MNMNMEEMKEIERVGGEGMEEVRDEPEDIKRIAPWTKQITVRGRGIVASIAIGIIYSVIVMKLNLTTGLVPNLNVSAALLTFVFLITWSGFGSYLLGLNRKTYEQAGVDTEGNTPGSTGEPGIGWMTGFLFVSSFVGLLALVPLRKYKQDIKWI

SEQ ID NO: 10757 - protein, 439 aa, Rhodotorula mucilaginosa
MAISKIHSRYVYDSRGNPTVEVELTTEKGTFRSIVPSGASTGVHEALELRDGDKSKWLGKGVLKAVANVNDTIAPALIEANIDVADQAKIDEFLLKLDGTPNKAKLGANAILGVSLAAAKAGAAQKDVPLYKHIADISKAKEGKFVLPVPFQNVLNGGSHAGGDLAFQEFMIVPSGAPSFSEGLRIGSEVYHHLKSLTKKKYGQSAGNVGDEGGVAPDIKTAKEALDLIVSAIEAAGYTGQVDIAMDVASSEFYKDGLYDLDFKNPNSDKSKWITGPQLAELYEQLLNEYPIVSIEDPFAEDDWEAWSHFFSKVEGKTQIVGDDLTVTNPIRIKKAIETKAADALLLKVNQIGTLTESIQAANDSYAAGWGVMVSHRSGETEDTFIADLSVGIRSGQTKTGAPARSERLAKLNQILRIEEELGDKAIYAGKDFHKAHSL

SEQ ID NO: 10758 - protein, 167 aa, Rhodomonas salina
MKHTLSVLVEDESGVLTRIAGLFARRSFNIDSLAVGPTEKTGISRITMVVPSDHRTIEQLTNQLYKLVNILKVQDITHLPSVERELMLIKINSDPEHRSEILDIVKIFRAKVVDLSENSFIIEVTGDPGKMCAIEQVLSKFGIIEIARTGKISLIRDSKVNSEYLRA

SEQ ID NO: 10759 - protein, 224 aa, Oryza sativa
GSYDGIAAVGRCCAMLEELTIANHKMDNGWLAALAFCGNLKTLRLQGCCRIDDDPGPAEHLGACLTLESLQLQQCQLRDRRALHALLLVCEGARELLVQNCWGLEDDMFAMAGLCRRVKFLSLEGCSQLTTRGLESVITSWSDLQSLKVVSCDKIKDEEISPALSELFSTFKELKWRPDNKSRLAASLAGTGMGKKGRVLCKRILPGHQRVKGTMLNYSTGVAA

SEQ ID NO: 10760 - protein, 658 aa, Physcomitrella patens subsp. patens
MPLAQRAGDNSEARYCGVEVGFSDDIQNTLAFALGGQFDFIVAPLTDPEYRPSKGKEGPPPFSGSDLVLSPSQWSSHVVGKMSAWIDLDSPDALARQDAELTLKQELSWAQHLSLQACLLPTPRPLECANYSRCVNQLLQGLSNLQIWLRIPLIAPELQAVEGTVEEDTAFLKREPVSGKPLNDSWEWWNMFRSLCEYHCQLSVVLDITGSLPSPASLKRWIGEPLRAVIIHTSAFLTNKKGYPCLSKRHQNFITTLFNHNVQIIVSGESMHHVDSLDPTTASSESGANGSEDGAYPRHHLRPYLEYISHLYRHMDPLTEQERFEIGYRDFLQAPLQPLMDNLESQTYETFEKDATKYNQYQKAVYAALVDRVTDDETTVVLMVVGAGRGPLVRASLQAAEDAGCRLKVYAVEKNPNAVVTLHSLIKIEGWEDLVTVVSCDMREWNAPEKADILVSELLGSFGDNELSPECLDGAQRFLKQDGISIPSSYTSYICPITTSKLYNDVKSYNDLAHFETAYVVKLHSVSMLAPPQEVFTFEHPKFTGDKIDNGRYKKLLFQPPEDTGSALVHGFGGYFDAVLYKDVHLGTEPSTATPNMFSWFAIFFPLRRPVYIPAGSAVELHFWRCVAPSKVWYEWAVSSPDVSPIHNANGRSYWVGL

SEQ ID NO: 10761 - protein, 443 aa, Physcomitrella patens subsp. patens
MQAWQLLSIFASTIAGLVLSPLPVGAWAFLGLTVAVVTKTLTFAAAFGAFTNDVIWLIVISFFFARGFVKTGLGDRVATYFVKWLGKSTLGLSYGLTLSETLLAPAMPSTTARAGGVFLPIIGSLSLSSGSKPKDASSSKLGAYLVMTQFQAAGNSSALFLTAAAQNLLCLKLAQGLGVVIANPWVSWLKAAIVPAFIALVTTPLILYKLYPPEIKDTPEAPTAAEKKLKALGPITQNEWSMVATMLLAVTLWVFGETLGIASVVAAMLGLCILLLTGVLNWDDCLSEKSAWDTLTWFAVLVGMAGNLSNLGLVKWMSDSVAGALASYSLSWPAAFGVLQATYFLSHYLFASQTGHVGALYSAFLAMHIASGVPSSLAALALAFNTNLFGGLTHYSSGQAAVYFGSGFVELKDVFKYGAIMAVWNILVWSVAGSLWWKAIGLY

SEQ ID NO: 10762 - protein, 442 aa, Arabidopsis thaliana
MSSSSDTHAGESRHRRNPIRWLLDFGFFVQGFRGFPWLGANFFLTEQLRVNPSVLQLLQNSANLPMVAKPIYGVVSDSVYFFGQHRIPYIAVGALLQAISWLAIAFLSRSNVSILALSIYLLLSNLGASLVEVANDAIVAESGKQKTSETQSGELPSFVWMVSSLGGILGNLLGGIAIKTFSAQSTFLVFGILALLQFLVTINIREKSLNLPENPSPAGGIRKHLSDLSHVLRKPEISYSIAWIAVSTAVVPVLTGTMFFYQTKFLKVDASLLGISKVFGQIAMLLWGFAYNRWLKAMRPRKLLTAIQVTIAFFVISDLLFVKGVYRDLGVSDSVYVLFFSGFLETLFYFKILPFTVLMARLCPPGCEGSLMAFVMSAIALAFIVSGYLGIVLASFVGVTEDDFSGFTRGLAIEACCVGIPLILTSWIYDEAETKEKSKKIE

SEQ ID NO: 10763 - protein, 402 aa, Myxococcus xanthus DK 1622
MSYLVLARKWRPQKFDDMTGQEHVVRTVANAIKIDRVAHAYLFCGPRGVGKTTAARLLAKALNCEKGPTAQPCGECRACTEIAAGTSVDVAEIDGASNNGVENVREIRENAKYLPQRDRHKIYIIDEVHMLSGAAFNALLKTLEEPPGHVKFIFATTEAHKLPDTILSRCQRHNFRRIPAARMLQRLQEICKAEGAGISDRSLSLVVRQSEGGMRDALSLLDQVLASCGATPSDEEVADALGAIDRTLVQDFADALVHKDAKRVLERVEEVFNRGLDLKRLAEELAFQLRHLFVTKTLGKAPDELAESEQKALMALAQDAEAAQLTRLFDVVHGCIWDVSRAAQPRLALEMALLKAIQLSPGGSIPELLARVDKLAAGMGEGSAKSNAGAPGGRSSPTNFRA

SEQ ID NO: 10764 - protein, 154 aa, Glycine max
MSSSVSETYDSDSVAVSMKKRKDKKKKVTSARKSLSLQQEHKNKHYKTRGKVANEEEVTSFKTTSLGQQPQRMKQSSLAAKRKRLLWTAEEEKVFKEGVSKFSTENQNIPWRKILEFGCRVFDETRTPVDLKDKWKNIISKKSRSTDCSYTFDL

SEQ ID NO: 10765 - protein, 300 aa, Halobacillus halophilus
MMKNVIKKANKKYERERLTQMIKQTIAFLGAGSMAEAMISGMVESGNISADQIIVTNRSNQDRLNEINDKYGVRTVLKDDLDFSQVDQLILAMKPKDIDAVLEDLRYKLNPNQVLVSVLAGISTSYMEDRLNDGQEVIRVMPNTSSTLRESATAMCPGHYTDMENVLVSKALLQSIGEVFIIPEDKMDVFTGIAGSGPAYFYYLMEHIEETGRAEGMDSKTLREIGAQTLLGAAKMMLEGEESPAELRKKVTSPNGTTAAGLDALEESGGGDAISAAIKGAAGRSKELSKEIEGLLVGSK

SEQ ID NO: 10766 - protein, 144 aa, Triticum aestivum
  misc_feature (60)..(60): Xaa can be any naturally occurring amino acid
  misc_feature (91)..(91): Xaa can be any naturally occurring amino acid
  misc_feature (102)..(102): Xaa can be any naturally occurring amino acid
  misc_feature (115)..(115): Xaa can be any naturally occurring amino acid
  misc_feature (143)..(143): Xaa can be any naturally occurring amino acid
MAPAVMASSATTVAPFQGLKSTAGLPVSRRSSGSLGSVSNGGRIRCMQVWPIEGIKKFEXTLSYLPPLSTEALLKQVDYLIRSKWVPCLEXFNKVGFVFREXTAPPGYYDGRYWXTCGKLPMFGVQRRTQVLKQVEGRSKKEXP

SEQ ID NO: 10767 - protein, 151 aa, Glycine max
MSAKCSQIRHIVRLRQMLRRWRNKARMSANRAPPSDVPAGHVAVCVGSNLTRFVVRATYLNHPVFKKLLLQAEEEYGFTNHGPLAIPCDETLFRDVLRFISRSDPAKSNRFLNLELDDFQRHYCHVGISNNLDFWPESRPLLHGPTDKTIW

SEQ ID NO: 10768 - protein, 288 aa, Arabidopsis thaliana
MALRSVSRRLGSRILNQRSFVASLHSHATSFGFQEVKEEEKSKLVGNVFTNVASSYDIMNDVMSGGLHRLWKERLVGKLSPFAGMKHLDVAGGTGDVAFRIYDAVYSVKRRALQKVDEASLEETQIYVCDINPNMLNVGKQRAAERGLRDNKSLVWVEGDAEALSFDDNSMDGYTIAFGIRNVTHIEKALAEAYRVLKRGGRFLCLELSHVEIPVFKNLYDLYSFQVIPNLGELIAGDRESYQYLVESVRRFPPQERFASMIADAGFEKVEYENLVGGVVAIHSAIKL

SEQ ID NO: 10769 - protein, 385 aa, Azospirillum brasilense
MYADAPSDSAPPEAVLPMDEAAMRAVDRATAALRRGEAVAIETADGSVGAAVSVESVAIDAVQRLVQLTGAAPVLAVTRRRATVLKLMGEGTGVVALSLPRCLTADEAHALADPEHRPDGDMPDGLTATAMDPGSRETAAVDLARLARLLPAAIVAPATDHTGSAAEWAAEHDLLLVRARDIADYRVHVVRTLRRVAEARVPLSGAENTSIAAFRPIDGGPEHLAIIVGNPVAGEPVLARLHSECFTGDLLAGLRCDCGQQLRGAIAEIARHGSGVLLYLAQEGRGIGLVNKLRAYRIQDRGFDTVDANEILGFEADERVYLPAAEMLRQLGFTAVRLMTNNPEKLRQLARCGIEVVERVPHIFPANGHNEGYLRTKAERSGHMF

SEQ ID NO: 10770 - protein, 160 aa, Euphorbia esula
GGAPVGRIVMELYADTTPRTAENFRALCTGEKGVGRSRKPLHFKGSSFHRVIPGFMCQGGDFTAGNGTGGESIYGAKFADENFIKKHTGPGILSMANAGPGTNGSQFFICTAKTEWLDGKHVVFGKVVEGMDVVKAIEKVGSSSGRTSKPVVVSDCGQLC

SEQ ID NO: 10771 - protein, 252 aa, Moritella sp. PE36
MTQFRPCIDLHQGKVKQIVGGSLNDQGAATNFISQYDAAYYANIYRQHDLRGGHVIALGPNNEAEVLKALQAWPHGLQFGGGVNLTNADKYIKAGASHVIVTSYLFDGNEFSWDKLAQLKAEVGKEHLILDLSCRKTAQGWNIATNRWQTVTSTVINAETLQQLSEHCAEFLIHAADVEGLQNGIDEELVSLLGQHTKIPVTYAGGARSIEDLALVERLSNGNVDLTIGSALDIFGGSGITLQQCIDWNQEH

SEQ ID NO: 10772 - protein, 295 aa, Ralstonia eutropha JMP134
MNDAASPLPELPPHLADLPEPLTHESPADDDYHRRFGGVARLYGNAGLARLEAASICVVGIGGVGSWTAEALARNAVGRITLIDLDHIALSNTNRQIHALGDAYGRAKVEAMAERIMAINPRCRVTQVDDFVTTDNVAQLLGAGHDYVIDAIDAVRVKTAMLGWARGHGMPIITCGGAGGQFDPTRVRIDDLSRTIQDPLLSKVRASLRKDWGFSRDPKKRFGIAAVYSDEPLQYPEPEQQACEIDEAPPAAAVAPASGPQGLACAGFGSSVAVTAVFGFVAASAVIGAIARGKP

SEQ ID NO: 10773 - protein, 396 aa, Moritella sp. PE36
MHIFKLPDLGEGLPEAEIVEWFIKPGDVVAADQLMVSMETAKAIVEIPCPENAIVVKLYGESGDIIHTGDPLVEFVEEGDAISSENGAATTNGATTREPVKASTSVVGELHTSETKLKETPQSVSGNSIGVKATPAVRALAHRYNIDLSIVTPSGPHSTITAADVERVVKIFADVGELVPLKGVRRSMAKAMAQAHAEVVPVTLHDDADITAWFALGDITVRLIRAMALACEAEPTLNAWYDSHAIGRRIIEPMHLGLAVDTQDGLFVPVIRDAQSYSARTMRDKINTIKELVSQRKIAADDLRGNTITLSNFGSMVGKYANPIVMPPTVAILGTGRLFQQLAYTNLNKTASDDVKRTIVELTLLPLSLTFDHRSITGGEAARFLAVLMADLALDS

SEQ ID NO: 10774 - protein, 514 aa, Oryza sativa Indica Group
MVVSVAATDSDTAQPVQYSTFFASRYVRDPLPRFRMPEQSIPREAAYQIINDELMLDGNPRLNLASFVTTWMEPECDKLIMDSVNKNYVDMDEYPVTTELQNRCVNMIAHLFNAPIKEDETAIGVGTVGSSEAIMLAGLAFKRKWQNKRKEQGKPCDKPNIVTGANVQVCWEKFARYFEVELKEVKLSEGYYVMDPVKAVEMVDENTICVAAILGSTLTGEFEDVKLLNNLLTEKNKETGLSLEVDRYDQENWWDVPIHVDAASGGFIAPFLYPELEWDFRLPLVKSINVSGHKYGLVYPGVGWVIWRSKEDLPEELIFHINYLGTDQPTFTLNFSKGSSQIIAQYYQLIRLGFEGYKNIMQNCMENTAILREGIEATGRFEILSKEAGVPLVAFSLKGSGRYTVFDISEHLRRFGWIVPAYTMPANAEHVAVLRVVIREDFSRSLAERLVSDIVKILHELDAHSAQVLKISSAIAKQQSGDDGVVTKKSVLETEREIFACWRDQVKKKQTGIC

SEQ ID NO: 10775 - protein, 253 aa, Zea mays
MKDLGPLHHFLRVVVERHSRDSSLASVSTPSTFWSGLACQKASPASCLLTLSTKHVKINLYLVRERVVVRVLRVLRVLATSQFVDIFTKGRRSTVGRMNITEFKYRYNSNAKDALVLYSVGIYTDNELGAMMDRMESAKLRTVNLTDNDLAKDHLRYFIGGRSEIKDELVYRFIFPERPGALMKFLDTFSPRWNISLFHYRAQGEAGANVLVGIQVPPAEFDEFKSHANNLGYEYMSEHNNEIYRLLLRDPKV

SEQ ID NO: 10776 - protein, 519 aa, Pseudomonas putida GB-1
MTSFSVLRTTVTPQQLLSEQVRRILAAPVYDLAIETPLQAAPALSASLGNQVLLKREDLQPTFSFKIRGAYTRLSRLTPTQRECGVITASAGNHAQGVALAASHLGMKATIVMPTTTPSLKVEGVRSRGGHVVLHGESFPHALAHALKLADSEGATFVPPFDDPDVIAGQGTVAMEILRQRPGALDAIFVPVGGGGLIAGIAAYVKYLRPEVKVIGVEPEDSNCLQAAMAAGERVILPQVGTFADGVAVAQIGAHCFELCRHFVDEVVTVSSDELCAAIKDIYDDTRSITEPSGALAVAGIKKYVAREGVQGQTLVAIDSGANVNFDRLRHVAERAELGEQREAIIAVTIPEQPGSFRAFCQALGKRQITEFNYRYYPGKEARLFVGMQTHPVHDPREQLLANLREQGYNVLDLTDNELAKLHVRHTVGGHAAPGADERVLRFEFPERPGALLGFLERLGKRWNISLFHYRNHGAAEARVFAALEVPADELAGLPLALDEMGYRYWDETDNPAYTLFLG

SEQ ID NO: 10777 - protein, 87 aa, Glycine max
MDTQKGPSSSAAAVTSCRKKKNEEATFLEDLKDHIDEFINASMDEHKTCFKKTVQKMFGMSKAVAERDTNAAKEVESSLPLQTTLQD

SEQ ID NO: 10778 - protein, 488 aa, Oryza sativa Indica Group
MVGSGAAGGGGGGGGGGDHARSKEAAGMMALHEALRNVCLNSDWTYSVFWTIRPRPRCRGGNGCKVGDDNGSLMLMWEDGFCRPRVAECLEDIDGEDPVRKAFSKMSIQLYNYGEGLMGKVASDKCHKWVFKEPSECEPNIANYWQSSFDASPLAPLLLGGRDLITATTTHLINHLQKQAQHTATATVTIAVIQAGHGLLQLGSCKIIPEDLHFVLRMRHMFESLGYQSGFFLSQLFSSSRGTSPSPSSFPLKQQQPPPPPAARPPPQLFNWPGHAPPQLPPGASPLFPPGPAAFHPSSRPMPPFPGGGKDESHLFHLPPAAAAKQPQHMDEHHHHQQQPMAAPQQHGGEAPEGDLKWPNGLSFFTALTGRTEDAKLLFGGGGGGGADDGSKTAAAAQDAGHGGAENVEEYLSLESHSNKARRMESAQSTKFKRSFTLPARMSSSTTSTSPSVSASTAPAPPQQQQGMEYRGPHEGGVYSDLMETFLE

SEQ ID NO: 10779 - protein, 336 aa, Antirrhinum majus
APIKIGINGFGRIGRLVARVALQRDDVELVAVNDPFISTDYMTYMFKYDSVHGAWKHHELKVKDEKTLLFGEKPVVVFGRRNPEEIPRASTGAEYIVESTGVFTDKDKAAAHLKGGAKKVIISAPSKDAPMFVVGVNEKEYKSDLHIVSNASCTTNCLAPLAKVINDRFGIVEGLMTTVHSITATQKTVDGPSAKDWRGGRAASFNIIPSSTGAAKAVGKVLPQLNGKLTGMSFRVPTVDVSVVDLTVRLEKKATYEQIKAAIKEESEGKLKGILGYTEDDVVSTDFVGDSRSSIFDAKAGIALNDNFVKLVSWYDNEWGYSTRVVDLIVHMASVQ

SEQ ID NO: 10780 - protein, 204 aa, Odontella sinensis
MTNFPKIGKTPPNFLTIGVYKKRLGKIRLSDYRGKKYVILFFYPANFTAISPTELMLLSDRISEFRKLSTQILAISVDSPFSHLQYLLCNREEGGLEDLNYPLVSDLTQTITRDYQVLTDEGLAFPGLFIIDKEGIIQYYTVNNLLCGRNINELLRILESIQYVKENPGYACPVNWNFGDQVFYSHPLKSKIYFKDLYSPKKSS

SEQ ID NO: 10781 - protein, 299 aa, Bacillus thuringiensis serovar konkukian str. 97-27
MKTINVFHYDAFTNKPNMGNPAGIVLDADGLTEEEMQRIAEKVGFNETTFVLSSEVGDIRMRYFTPGFEMDLCGHGTVGTLYALREKGLLEEKSNLTIEAKAGILPIQIGVNENGETFIKMRQAAPQFKEFTGSKEELAHSIGLEVNDLDVSLPIVYGSTGNWTVIVPIKNLDACERMKPNNEMFPSVLKEIPNASIHPICLETYDEKVHMHGRHFSSAYAGTIEDPVTGTASGVMGAYYATYVEKDFDREIELIVEQGQEIHKDGRVTIYVTKDVESEKLQIDIAGTAVYVKEFEVLI

SEQ ID NO: 10782 - protein, 188 aa, Streptococcus pneumoniae TIGR4
MILLIDNYDSFTYNLAQYIGNFAEVQVLRNDDSKLYEEAEKADGLVFSPGPGWPVDAGKMEDMIRDFAGKKPILGICLGHQAIAEVFGGKLGLAPKVMHGKQSNINFEAPSVLYQGIEDGRAVMRYHSILIEEMPEDFEVTARSTDDQAIMGIQHKNLPIYGFQYHPESIGTPDGLSSIRNFIEEVVK

SEQ ID NO: 10783 - protein, 199 aa, Triticum aestivum
  misc_feature (99)..(99): Xaa can be any naturally occurring amino acid
  misc_feature (112)..(112): Xaa can be any naturally occurring amino acid
  misc_feature (125)..(125): Xaa can be any naturally occurring amino acid
  misc_feature (158)..(158): Xaa can be any naturally occurring amino acid
MAPTVMASSATSVAPFQGLKSTAGLPVSRRSNGASLGSVSNGGRIRCMQVWPIEGIKKFETLSYLPPLSTEALLKQVDYLIRSKWVPCLEFSKVGFIFXREHNASPGYYDGXRYWTMWKLPMFGXCTDATQVINEVEEVKKEYPDAYVRIIGFNNMPXGQCFSFIPFNPPGLQGARQGPKQLPHEEAIIKRRLCSFGPI

SEQ ID NO: 10784 - protein, 240 aa, Ostreococcus tauri
MISREDDVDRQRRWIYCDFLKEAGMKLKVPQLTIATAVVFCHRFFHVETAYEFDTMVMATACLFLAGKVEETPKPLNDLAHTSYYLQQKRNDPTHVEGSEQEGHVELRETILRAERILLHRLAFDFNVQHPYKHLLSVIKRLSQTGLIEEDSTKSLAQVSWNFANDSLRTSLCLEYDAKHIAEAVVYLATKFLSSKFELPKKWWESVDIDPNTSELIGNRILDLYEQSGREGVIHVQSSV

SEQ ID NO: 10785 - protein, 248 aa, Bacillus thuringiensis serovar konkukian str. 97-27
MITIKTKNEIDLMHESGKLLASCHREIAKIMKPGITTKEINTFVEAYLEKHGATSEQKGYNGYPYAICASVNDEMCHAFPADVPLTEGDIVTIDMVVNLNGGLSDSAWTYRIGKVSDEAEKLLLVAENALYKGIDQAVIGNRVGDIGYAIESYVANEGFSVARDFTGHGIGKEIHEEPVIFHFGKQGQGPELQEGMVITIEPIVNVGMRYCKVDLNGWTARTMDGKLSAQYEHTIVITKDGPIILTKL

SEQ ID NO: 10786 - protein, 311 aa, Rhodococcus sp. RHA1
MRNLVGVPKIAYFGPSGTFTEMALAQLEAAGAFDGPVERVAATSPPASLAKVRNGVVDGAVVPIESSVEGAVVPTLDSLALGDRLQIVAETELDVAFTILGRAGIERLDQVRTVRAYPVAAGQVRIWLEENCPGADLQTASSNAGAAEDVANGLADAAVSTALAGERLGLRSLADGVADEKSARTRFVLVTAPTQVPARTGGDRTSAVLEPHNTPGSLVGVLSEFATRGIDLIRIESRPVRTTPGLYRFFVDCIGHIDDPLVAEAFRALHRKSHVRFLGSWPAANPSGPPPPSDGDAADWIERIRQGERES

SEQ ID NO: 10787 - protein, 395 aa, marine gamma proteobacterium HTCC2080
MFEELPILPPDSILGLAAECRADPNPDKVDLTIGIYMDESGNCPVFNAVRLAQHQLVDEEQTKSYIPPQGDPNFIKGLVELVVGADALAARAGCVGAVQAPGGCGAVRLGAEVLKASGTQGKVWVSDPTWPVHIPLITSAGLELSQYRYYDPETHGVDFSAMAEDLAAAGSNDIVLLHGCCHNPSGADLTPEQWREIASMAAKQGFTPMVDLAYQGFGEGLETDVYGLRTLIEQVPEVVIAASLSKNMGLYRERTGLAIFVGPDSRTAEATVSQAKAAARRIYSMPPAHGALLAGRVLGDPILRADWEAELTAMCARINGLRSEFQRRLEEATGRDFGFIAKEKGMFSFLGLTEDQARSVRSERGLYMLNSSRINIASLNAQNMDRVVAAVASVL

SEQ ID NO: 10788 - protein, 496 aa, Vitis vinifera
MELNTFLLLCMPLILCFFLLQFLRPSSHATKLPPGPTGLPILGSLLEIGKLPHRSLARLAKIHGPLITLRLGSITTVVASSPQTAKLILQTHGQNFLDRPAPEALDSPQGTIGWIPADHVWRSRRRVCINHLFTSQSLDSLQHLRYKKVEQLLQHIRKHCVSGTPVDIGLLTSAINLNVLSNAIFSVDLVDPGFESAQDFRDQVWGIMEGAGKFNISDYFPMFRRFDLLGVKRDTFSCYKRLYEIVGGIIKSRIKCRASNPMSRNDDFLDVILDQCQEDGSVFNSDNIQVLIVELFYAGSDTSTITTEWAMTELLRNPRLMQKVRQELSEVIGAGQMVRESDMDRLPYFQAVVKETLRLHPAGPLLLPFKAKNDVELCGFTIPSNSHVLVNMWAIARDPGYWEDPSSFLPERFLGSKIDYRGQDYEYIPFGAGRRICPGIPLAIRMVQLVLASIIHSFNWKLPEGTTPLTIDMQEQCGATLKKAIPLSAIPFIEEN

SEQ ID NO: 10789 - protein, 471 aa, Bacillus megaterium
TIKEMPQPKTFGELKNLPLLNTDKPVQALMKIADELGEIFKFEAPGRVTRYLSSQRLIKEACDESRFDKNLSQALKFVRDFAGDGLFTSWTHEKNWKKAHNILLPSFSQQAMKGYHAMMVDIAVQLVQKWERLNADEHIEVPEDMTRLTLDTIGLCGFNYRFNSFYRDQPHPFITSMVRALDEAMNKLQRANPDDPAYDENKRQFQEDIKVMNDLVDKIIADRKASGEQSDDLLTHMLNGKDPETGEPLDDENIRYQIITFLIAGHETTSGLLSFALYFLVKNPHVLQKAAEEAARVLVDPVPSYKQVKQLKYVGMVLNEALRLWPTAPAFSLYAKEDTVLGGEYPLEKGDELMVLIPQLHRDKTIWGDDVEEFRPERFENPSAIPQHAFKPFGNGQRACIGQQFALHEATLVLGMMLKHFDFEDHTNYELDIKETLTLKPEGFVVKAKSKKIPLGGIPSPSTEQSAKKVR

SEQ ID NO: 10790 - protein, 150 aa, Brassica napus
MASLCSARLLPSLSPDVLKKMSSSSSMHHDSRSLVCSSSRALGSSSASWRSSPGNRKGRKSNNQLQVVAMAPEEEKLTRRNPLDFPIEWERPKPGRRPDIFPKFSPMKTPLPPPMPYDPPAEDEEEEVEKKEEEEENPDQEEEEQPEKQQ

SEQ ID NO: 10791 - protein, 374 aa, Physcomitrella patens subsp. patens
MEGTPPTPTSHDTSYGPTSQGECNLEQGKWIPDSTSPQYNSTTCRFIQGHQNCHKNGRPDDGYLYWKWKPEQCDLPKIDAPSFLTAMRNRSMVFAGDSIARNQFQSLLCVLVQVEDPKNTYHTEDDRFNTYLFRSFNFTLSIHWSPYLVRVEDKSITWPDNTTETVKHIYVDELDEVWVKAAVGVDILHISTGQWWYKKAMYFEKGNLLGCHGLPACKNEIGFDPPYNKAIANILKGSLTIPGFSGTTVYRSFTPEHFEDGDWDSGGRCPRTTPGGVPMSFLTKWMYDIQMRQFKNTTEELGVVAKDRLKLLRITHLSQMRPDGHPNSYRTKDDKAKDKRGNIIPNDCLHWCLPGPIDTWNDMLVHSLRDVIFK

SEQ ID NO: 10792 - protein, 462 aa, Bacillus thuringiensis serovar konkukian str. 97-27
MHRENSMYSYIFYGIFLCEKEMKITIIGTGYVGLITGVGLAVLGHSVTCLDINDEKIERIKQGDLPIYEAGLYELIHDGCENNRLTFTTNKEEAFKEAEFIFIAVGTPSLLDGTADLTYIQNACVDIGTYATKDIIVVTKSTVPVGTNGAMRGWIEETLQNRHELHIVSNPEFLREGSGIYDFFQGDRIVIGADNEEAARKVENLYSELHLKTYVTDIKSAEMIKYASNAFLATKISFINEISNICEKIGANVLDVAKGMGMDKRIGASFLNAGIGYGGSCFPKDTKALVQIAGNVAHDFRLLKAVIEVNNKQQLLLIEKAKKVINMNKKRIAVLGAAFKPNTDDIRDAPSLIMIQELINLGADIVLYDPKAIQNMKNIFGETIQYSECIDESIRGASAAFIVTEWEAIRTYPLEKYVQLMREPILFDGRNCYTNEDVKKQGIDYYSVGRESIYKRDFSVIR

SEQ ID NO: 10793 - protein, 490 aa, Leptospira interrogans serovar Lai str. 56601
MRKFDKTLFHEFRRIYKFMPESYDLTVIGAGPGGYVAAIRAAQLGMNVCIIEKDKPGGICLNWGCIPTKALLESAHLLEKLHSAKEYGINLSDPKPDFAAIIRRSRNVADGMASGVEFLLNKNKITRKKGTAVFKDPNTIWLPDSSKEEITSKYFILATGARARELPGLPFDSHTVLSSKTAMIQDKIPESLLIVGAGAIGVEFADFYSTMGTKVTLVEMMDQILPVEDKEISTFLEKSFVKRGIRVLTGVGVSDPKIVNGKVKVLLKGKNLPEAVESFEAEKILVSIGLVPNTDSMHLEEIGIFLQKGFVKTDTKYKTSVPHIYAIGDCNGPPLLAHVASMEGIKAVEAISIHAGNPHHLSYIPIDYNAIPGCTYCHPEVASIGFTEKKATDMGYTISVGKFPFVASGRAKAMGDTGGFTKVIVDKTSGEILGAHLIGPGVTELLPAVSLGITQELTAKEIASTIFAHPTLSETVMESFGAALGEAINL

SEQ ID NO: 10794 - protein, 545 aa, Moritella sp. PE36
MNPTETNAWHALKAHYSDMQKTNISTLFANDVNRFEQFSKQFNNDILCDFSKNIITQCTLKKLTALAHEVDLPTAITAMVSGKKINQTEKRAVLHTALRNRSNTPVMVDGKDVMPAVNAVLAQMKAFCHDIISGNWKGYTGKAITDIVNIGIGGSDLGPYMVTEALRPYKNHLNMHFVSNVDGTHIAETLKGLDPETTLFLIASKTFTTQETMTNAHSARSWFLTSAESEEHVASHFAALSTNATAVKAFGIDTKNMFEFWDWVGGRYSLWSAIGLSIALSIGFDNFEELLSGAHEMDKHFVETPLEDNIPVILALIGVWYNNFFGAESEAILPYDQYMHRFAAYFQQGNMESNGKSVDRDGKAVDYQTGPIIWGEPGTNGQHAFYQLIHQGTKLIPCDFIAPAQSHNKISDHHVKLMSNFFAQTEALAFGKSKQTVIDELADSGMSEADIASLAEFKTFTGNNPTNSILFKQLTPKTLGSLLAMYEHKIFTQGIIWNIFSFDQWGVELGKQLANQILPELNNNESINNHDSSTNGLINTFKAWR

SEQ ID NO: 10795 - protein, 479 aa, Haemophilus influenzae Rd KW20
MALSKNTKLVILMAIPLITFLLPAPDGLSLIAWRLLGVYIATIVGLVLKPYGEPVILLAAIAVSGVIIGNTEGAKELVKVGNMLDGYKSGTTWLIFTAFTLSSAFVITGLGKRIAYHMIGAMGSTTLRLGYVTMFLDLLLSPATPSNTARSGGIIFPIINSVVVALGSDPEKSPKKAGRYLMMNVYMVVKTTSYIFLTAMAPNALALSLMAPILGFETTWIKWFLAASVPGLLCLFLIPLICYWVSPPELKKVDNKAIAKKGLEELGPMSFREKALSVLFVIALFGWIFSNSLHINATIVAIIVMVLCIVLSIVTWDDILKSKGAWNTLVWYGGIIGMSGLLEKSGFFKWLANTLSTILQFEGHGMMALIVILTLSVSVRYLFASGGAYVAAMVPVFATVGHVTGAPTELLALGLVFANSYGGSVTHYGGGPGPIAFGAGYNDIKSWWITGAIIAFGSLIIHLTIGMAWWKLLMSLGWL

SEQ ID NO: 10796 - protein, 456 aa, Erwinia carotovora subsp. atroseptica SCRI1043
MSLDTHLPNAGTKRTQLKRTLTLWPVVMMGLAYMQPMTIFDTFGIVSGLTDGHVATAYAFALVAILFTALSYGKLVKRFPSAGSAYTYAQKAISPHVGFMVGWSSLLDYLFMPMINILLAKIYLEAIFPGVPSWIFVAALVGLMTLFNLRGINLVANLNSIIVVVQVAIMAVFLGLVIHGVYLGEGAGTLTSTRPFWSEDAHVVPMITGATILCFSFLGFDGISSLSEETHDAGRVIPKAIFLTALFGGVIFVAVAYFLQLYFPDISRFKEPDASQPEIMLYVAGKFFQSVILVFSCVTVLASGMAAHAGVSRLMYVMGRDGVFPERFFGYIHPKWRTPSLNVLLVGVIALSAVSFDLVTATALINFGALVAFTFVNLSVISQFYIRERRNRTVKDTINFLVLPVMGALTVGALWVNLEASSMTLGLVWATIGLLYLAFVTRSFRQPVPQCSEEPV

SEQ ID NO: 10797 - protein, 495 aa, Rhodococcus sp. RHA1
MTAVHENVSATGLPDGAATQLFIGGQWRPASDGGTFTDLNPATGKPLVDVSAGTAQDIDDAVRAARTQLNGEWGSLPGAARGRILNKVADLIERDGEILARLEALDVGKPVGQPTMLDIPMAAGTFRHFAGWADKITGQSIPTAGYFGQPTHSYTVREPVGVIGAIVPWNTPLMISAWKIAPALAAGNTLVVKPPEDAPLSILHLATLLEEAGLPAGTVNIVPGLGEVAGDALAGHPGVDKISFTGSPRVGRIIAKRAADTFKRTTLELGGKSPQIILPDADLEAAVGGTAMGLFFNQGEVCAAGTRILVHRSLYSQVVDGLAAAASAQVLGDPFDPATTMGALVNAKQRDTVLGYIEAGRSEGARVVAGGGRPDGDGFFVQPTIFADANNDMKIAREEIFGPVGTVIAFDTTDEAIAIANATDYGLAASIWTRDVSHAHTLAGKVRAGAVAVNGWAPIDPALPWGGMKTSGTGRELGWAGIEANTEEKVVTIIL

SEQ ID NO: 10798 - protein, 470 aa, Bacillus megaterium
TIKEMPQPKTFGELKNLPLLNTDKPVQALMKIADELGEIFKFEAPGRVTRYLSSQRLIKEACDESRFDKNLSQALKFVRDFAGDGLFTSWTHEKNWKKAHNILLPSFSQQAMKGYHAMMVDIAVQLVQKWERLNADEHIEVPEDMTRLTLDTIGLCGFNYRFNSFYRDQPHPFITSMVRALDEAMNKLQRANPDDPAYDENKRQFQEDIKVMNDLVDKIIADRKASGEQSDDLLTHMLNGKDPETGEPLDDENIRYQIITFLIAGHETTSGLLSFALYFLVKNPHVLQKAAEEAARVLVDPVPSYKQVKQLKYVGMVLNEALRLWPTAPAFSLYAKEDTVLGGEYPLEKGDELMVLIPQLHRDKTIWGDDVEEFRPERFENPSAIPQHAFKPFGNGQRACIGQQFALHEATLVLGMMLKHFDFEDHTNYELDIKETLTLKPEGFVVKAKSKKIPLGGIPSPSTEQSAKKV

SEQ ID NO: 10799 - protein, 189 aa, Glycine max
MAGTVEDSGNTAPSSPAGLRGADLALRVLLFAVSLSGLVVLVTAKQTEMVPLVLTPPFRFGPVPAQFKDSPALIYLLVALCMTSLYSLLTAATSVKSMSSSASCAKGIFVLILLDVVYAGIMASATGTAGAVAWVGLKGNSHTRWNKICNIYGKFCRHIGSATCLGLIASIILVLLVVLNAYSLYRRSR

SEQ ID NO: 10800 - protein, 371 aa, Rhodococcus sp. RHA1
MKTQAAVLWEPGQPWQIEELELDPPKHGEVLLQLAASGMCHSDEHVRDGSLPLEYYPFIGGHEGAGVVLEVGPGVTSVEKGDHVALGFIPACGRCRQCATGQSSICDLGAHLLEGWQISDGTARHHVRGKDAAIQCLIGTFSPYTVVNEASCVKITKDIPLDKAALVGCGVTTGWGSSVYAAGVQAGETVVVIGMGGVGCGAVQGAALAGARHVVVVDPAEFKREQAKIFGATHTAASIDEALPLLQDLTWGQLADKVLITVANASGRIIAPAMSLVAKGGTCVHVSVGDVTQNDVDLNLFDLTAMRKTLKGAWFGNANIRFDIPHLLRLYMEGQLKLDEMITRTYTLDQINDGYEAMRKAENVRGVIMYS

SEQ ID NO: 10801 - protein, 470 aa, Bacillus megaterium
TIKEMPQPKTFGELKNLPLLNTDKPVQALMKIADELGEIFKFEAPGRVTRYLSSQRLIKEACDESRFDKNLSQALKFVRDFAGDGLFTSWTHEKNWKKAHNILLPSFSQQAMKGYHAMMVDIAVQLVQKWERLNADEHIEVPEDMTRLTLDTIGLCGFNYRFNSFYRDQPHPFITSMVRALDEAMNKLQRANPDDPAYDENKRQFQEDIKVMNDLVDKIIADRKASGEQSDDLLTHMLNGKDPETGEPLDDENIRYQIITFLIHGHETTSGLLSFALYFLVKNPHVLQKAAEEAARVLVDPVPSYKQVKQLKYVGMVLNEALRLWPTAPAFSLYAKEDTVLGGEYPLEKGDELMVLIPQLHRDKTIWGDDVEEFRPERFENPSAIPQHAFKPFGNGQRACIGQQFALHEATLVLGMMLKHFDFEDHTNYELDIKETLTLKPEGFVVKAKSKKIPLGGIPSPSTEQSAKKV

SEQ ID NO: 10802 - protein, 251 aa, Klebsiella pneumoniae subsp. pneumoniae MGH 78578
MVEDSQETTHFGFQTVAKEQKADMVAHVFHSVAAKYDVMNDLMSFGIHRLWKRFTIDCSGVRRGQTVLDLAGGTGDLTAKFSRLVGETGRVMLADINDSMLKMGREKLRNIGIVGNVEYVQANAEALPFADNTFDCITISFGLRNVTDKEKALRSMYRVLKPGGRLLVLEFSKPIIEPLSKAYDAYSFHILPKVGELVAKDGDSYRYLAESIRMHPDQETLKGMMQDAGFENVDYYNLTAGIVALHRGYKF

SEQ ID NO: 10803 - protein, 470 aa, Bacillus megaterium
TIKEMPQPKTFGELKNLPLLNTDKPVQALMKIADELGEIFKFEAPGRVTRYLSSQRLIKEACDESRFDKNLSQALKFVRDFAGDGLFTSWTHEKNWKKAHNILLPSFSQQAMKGYHAMMVDIAVQLVQKWERLNADEHIEVPEDMTRLTLDTIGLCGFNYRFNSFYRDQPHPFITSMVRALDEAMNKLQRANPDDPAYDENKRQFQEDIKVMNDLVDKIIADRKASGEQSDDLLTHMLNGKDPETGEPLDDENIRYQIITFLIKGHETTSGLLSFALYFLVKNPHVLQKAAEEAARVLVDPVPSYKQVKQLKYVGMVLNEALRLWPTAPAFSLYAKEDTVLGGEYPLEKGDELMVLIPQLHRDKTIWGDDVEEFRPERFENPSAIPQHAFKPFGNGQRACIGQQFALHEATLVLGMMLKHFDFEDHTNYELDIKETLTLKPEGFVVKAKSKKIPLGGIPSPSTEQSAKKV

SEQ ID NO: 10804 - protein, 580 aa, Ostreococcus tauri
MRDVADDDAFTSDLTRSFATSAHSSQSDAHVERDDRVESDEFERSDAHVRTTSSPEMGEREDESANERARTIDELYTERIGDANRAQLTQYALAAVAWFPAAFLTLTPVFAARSPDWKCATENGCVHADTGASLDLCSLDREAWTWVDAKASIVSEWDLVCAHEYKVQLADSIFFLGFLFGAGILGQIADSKGRLFGLYVSTALASAGALFASWAGGYWTYLLHTVLRGFGCGGLGVASYVLCLEFLGLKWRAVLGIATQYFWSGGIALMSGVAYGMPRWRSFTAFCGVFGFVYIGLSVKFLLESPRWFLATGRSDKAMGVLTQLAKGNPKFTGRLPPLKQPRAAKGLNVTAVLPFPALRHRLYAMAYIFCITSMVYYGLSLNVGSLSGSIYMNTFIGAITEFPAHAFAQISADKLGRRKTQLILMGTACSGTFASSLFTGSMQVFVSMFGRFGIAGSFNMIYLYTTELFPTIVRSACLGTCSLAARVGGICAPAIIYSQIIHPVLPYIILSIAAASACAVTLTLPETQGMVIEESLAGAAQQDMGAGRAHWTSAREVGFTRLVDRGDAESGAFDDDANL

SEQ ID NO: 10805 - protein, 401 aa, Onion yellows phytoplasma OY-M
MQNNPFRCLFPIFKTNPKIVYFDNAATSLKPQKVIDELTRFYNTNGLNTKSFGVLSHQNTLLMNETRIKTANFINSKPEEIIFTKGTTDSLNILAQSLGETLQEGDEIITSELEHNSSVIPWFKQAKLKKAKLIFVPLNEQNQITVENFAKVLTNKTKIVVLTHVSNLLGYETPIKEITTLAHKKNALVILDSAQSSSHLPIDVKFLDVDFLAFSSHKLYGPFGIGILFGKNHLLEQLQPPSFGGTSIKEFSLKHFLLNEGPNKFESGTPNISGILAFKKALEFVEEIGFENIQKHEKKIYQNIMKELKQIPKITIYNPQAFSNIITFNFNQIHAHDAEAFLAQENIYVRTGRCCAFLATQKLKQTSIIRVSIGIHNNQEDVDILIKNLKKTQTFFSKFNK

SEQ ID NO: 10806 - protein, 336 aa, Streptococcus pneumoniae TIGR4
MAILVTGGAGYIGSHTVVELLNLGKEVIIVDNLSNSSILVLDRIEAITGIRPVFYELDVCDKQALRKVFEQESIDAAIHFAGYKAVGESVQKPVMYYKNNIMSTLALVEVMSEFNVKKIVFSSSATVYGINNQSPLIETMQTSATNPYGYTKVMLEQILKDVHVADSEWSIALLRYFNPIGAHESGLIGEDPSGIPNNLMPYIAQVAVGKLSELSVFGNDYDTLDGTGVRDYIHVVDLAIGHIKALEKVSEKTDVYIYNLGSGEGTSVLQLVNTFESVNKIPIPYKIVPRRSGDVATCYANADKAYKELNWRTTKSIEDMCRDTWNWQSKNPNGYN

SEQ ID NO: 10807 - protein, 316 aa, Myxococcus xanthus DK 1622
MQPRDFKVFAGNSNPGLAHRICEYLKRPLGKAEVGRFSDGEIHVEIGENVRGHDVFILQSTCPPANDHLMELLIMCDALKRASAGSITAVIPYYGYARQDRKVAPRTPITAKLIADLLESAGAGRVVSMDMHAGQIQGFFNIPSDHLYGSPVFLEDLRKRFPESQELVIVSPDAGGVERARAYSKRLNTGLAIIDKRRPRPNASEVMNLIGDVSGKDAVLVDDMVDTAGTLAQAAAALKAKGARRVVAYAVHPILSGPAIQRIQDSVLEEVVFTDTVPLSPAAQACSKIRLLTTERLFGEAIARIHRADSLSSLFV

SEQ ID NO: 10808 - protein, 729 aa, Yersinia pestis CO92
MLYQSETLQLHWLENGIAELVFDAPGSVNKLDTKTVANLGEALNVLEKQSELKGLLLRSAKTALIVGADITEFLSLFNAPPEKLHQWLVFANTIFNRLEDLPVPTISAINGYALGGGCECILATDFRIASPEARIGLPETKLGIMPGFGGSVRLPRLLGADSALEIIATGKDVTANDALKIGLVDAVVDPEKLVGSALTMLKQAIDGKLDWQAARRPKLEPLKLNPTEAAMCFTIAKGRVMQVAGKHYPAPLTAVKTIEAAAKFGRTEALNLETNSFVPLAGSNEARALVGIFLNDQYVKAQAKKLSKGVAAPKLAAVLGAGIMGGGIAYQSALKSVPVIMKDINENSLDLGMNEAAKLLNKQLERGKVDGLKMASILATIRPTLDYAGIERAQVIVEAVVENPKVKAAVLAEVEALIGEDTVLASNTSTIPIDQLAKSLKRPENFCGMHFFNPVHRMPLVEIIRGAKTSDKTLAAVVAYATQMGKTPIVVNDCPGFFVNRVLFPYLAGFGMLVRDGGDFHQIDKVMEKQFGWPMGPAYLLDVVGIDTAHHAQAVMAAGFPERMNKDYRDAVDVMFDNQRFGQKNGQGFYRYTQDAKGKPRKENDEQVDKLLAEISQPLQEFSDEDIIARTMIPMINEVVRCLEEGIIASAAEGDMALVYGLGFPPFHGGVFRYLDTLGSANYVEMAQRYAHLGALYHVPAGLRAKAEHNESYYPVAAALLDVSTNQPA

SEQ ID NO: 10809 - protein, 316 aa, Oryza sativa Japonica Group
MGYNNPYDSSGTDDDLPPTQNRGLRVRSFSANGRASVMPFSYIRPHGDLESEIHQVEQEAYTGVLRAFKVQSDAISWEKESLITELRKELRVSDDEHRELLNKVNEDVAIRRMREFRQGGGSLSAQHRGSRIFHDTEPGPAAKRQRTPLSIPSHSAGLQSPAMPSPSVPSSTKWGPFSGTKGKKTRTNTPLAVPSADPTSLINRKIYTRWPDDNNFYEATITDYNPATGKHALVYDMGTVAQTWESVRLSDVERVLSNPNMGEIEKAKKLLQDQEQSLLDAIARLDDASDSESEDMAVGAQMVSAGDHMGRNGVAC

SEQ ID NO: 10810 - protein, 286 aa, Ralstonia eutropha JMP134
MTTYAFRLLNVFAESTFGGNPLCVFEDARGMDDATMQALALQFNLSETTFILPSDRAHAQVRIFTPGYEMRFAGHPTLGTAHVVRDLVASGDRLTLEFKAGVVPVEASGDVWTFTAPHAGPPKTVAVNLPDAEMAALLGLDAHDLLTSPMWVDTGADQLLVAVRTTAAVRRAQPDTARLAEWPQSSLGRKTAYVFAFDPTQPGRVLARYFFSKQGGGVAEDPGTGSACANLGGWLLANAHALPAEYEVDQGAAVDRPCTLRLAVTANGAIRVGGRVIEIGRGTVTL

SEQ ID NO: 10811 - protein, 541 aa, Ralstonia eutropha JMP134
MQNFNWTNPYPSVRIPLFARNVVSTSHPLAAQAGLRMLLKGGNAVDAAIAAAATITLVEPVSCGLGSDAFAILWDGKELHGLNSSGVAPAAWNPEYFKNKYGTDANGLANRPVRGWDSVTVPGVVAGWAALHERFGKLPFADLMEPAIEIAERGYAVPPVVAHKWAAAVPELKNQPGFADTFMPNGRAPLVGEKFTLKAAAETLRKIGETGGRAYYEGEIAEKIAAFSKQSGGAMTLDDLRNYRPDWVKPISKSYRGYELHEIPPNGQGIAALIALGILNQFDVGALPVDSVDSQHLQIEAMKLAFADLYRYVADPRSMEVTPEQMLDDAYLKSRAKLIDMQRATHFNFGMPKVGGTIYLTAADENGMMISFIQSNYMGFGSGVVVPDTGISLQNRGVGFSMDPKSANVVAGGKRPFHTIIPAFLTKDGQPVMSFGVMGGDMQPQGHLQTVVRMLDYKQQPQAACCAPRWKVNRDFTLDVEGTMDPATVEGLKARGHQLKSVDDPYMDFGSGQFIWRLSDDPEHGYVAASDSRRDGQAVGF

SEQ ID NO: 10812 - protein, 604 aa, Pseudomonas putida GB-1
MCCKSVAFQPFRQFPGLGQQHGWPIAACHFATGCFRLRQHLTCRLLALRAAVSPPSHTVSLCNSAPLQTEPCVTAKPSQLKALPPSAQVGTAIAPVPATSNDKRHRPMLSELPILPATRAFLERKLKMRIGAEWQDAASGRTLSFRNPATGEVLGEVPAAEAEDVDRAVRAARQAFDDSPWSRLRPRERQNLLWRLADLMERDARQLAELECLNNGKSAAVAQVMDVQLAIDFLRYMAGWATKIEGSTVEASMPLMPNDQFHGFVRREAVGVVGAIVAWNFPLLLACWKLGPALATGCTVVLKPADETPLSVLKLAELVDEAGYPAGVFNVITGTGLNAGAALSRHPGVDKLTFTGSTEVGKLIGKAAMDNMTRVTLELGGKSPTIVMPDANLQEAAAGAATAIFFNQGQVCCAGSRLYVHRKHFDNVVADIAGIANGMKLGNGLDPAVQMGPLISAKQQDRVTGYIELGRELGATIACGGEGFGPGYFVKPTVIVDVDQRHRLVQEEIFGPVLVAMPFDDIDEVIGMANDNPYGLGASIWSNDLAAVHRMIPRIKSGSVWVNCHSALDPALPFGGYKMSGVGREMGAAAIEHYTELKSVLIKL

SEQ ID NO: 10813 - protein, 209 aa, Chromobacterium violaceum ATCC 12472
MGACPRFERASARGMIARNPIKQDPAMRNTQDDHSRFLSLVLRHQPETIGLQLDDQGWADIGELLARLAAKGRNLGRKQLEKIVLDNDKQRFAISEDGLRIRANQGHSIKIDLGLAACEPPDRLYHGTASRFLDAILAEGLRPGQRQHVHLSADGQTARKVGARHGKPVVLEIDARAMRQAGLAFYRSDNGVWLIDGVPPVFIRQTEAR

SEQ ID NO: 10814 - protein, 472 aa, Oryza sativa
MEYRRVKDQESYDVVSQKDIESPGERSLSSTSATSSLSTAGASKGKNSWKLKSIVTLALTLLTSSQAILIVWSKRAGKYEYSVTTANFSVEALKCLLSLIALYRTWNSQGVTEDNRLSTSFDEVSVYPIPAILYMVKNLLQYYIFAYVDAPAYQILKNLNIISTGVLYRIILKKKLSEIQWAAFILLCAGCTTAQLNPSSDHVLQTPIQGWVMAIVMALLSGFAGVYTEAIIKKRPSRNINVQNFWLYIFGMLFNLVAICVQDFDAVMNKGFFHGYSFITVLMILNHALSGIAVSMVMKYADNIVKVYSTSVAMLLTAVVSVFLFGFHLSLAFFLGSTWHSVLQRAENMVNAIKGLFISCDVPMAQFIVNLNASMPASDKFILHILDPTHMFVQPHVAEMIRSSPNYQKLYYYQKSRAYEAGKVQIVSEFRNMELKFSGNGRQCKKKTSAAPSAVASWPIVFNAGPFLAFSP

SEQ ID NO: 10815 - protein, 379 aa, Emericella nidulans
MAEFVRAQIFGTTFEITSRYTDLQPVGMGAFGLVCSARDQLTAQPVAVKKIMKPFSTPVLSKRTYRELKLLKHLRHENIISLSDIFISPLEDIYFVTELLGTDLHRLISSRPLEKQFIQYFLYQIMRGLKYCHSAGVVHRDLKPSNILINENCDLKICDFGLARIQDPQMTGYVSTRYYRAPEIMLTWQKYDAKVDVWSAACIFAEMLLGAPLFPGKDHVNQFSIITELLGTPPDDVIQTICSENTLRFVKSLPKREPQDLAKLPKFLALVHPDKKPEEDEDYKNTINLLKAMLVYNPKDRISAEAALAAPYLAPYHDETDEPVAEEKFDWSFNDADLPVDTWKIMMYSEILDFHNIDQGGDINPALVEGAGLNQQGFQ

SEQ ID NO: 10816 - protein, 588 aa, Ralstonia eutropha JMP134
MESVDHVILIGAVVMSLGIVVGAFSARAGVPFLLVFLAVGMLAGVDGPGGIRFSNTWLSFLVGNLALAVILLDGGLRTSYATFRVALRPSLALATVGVLVTAGLVGLFSASVLGIDWKLGLLLGAIVGSTDAAAVFSLLHSSGIRLKDRVASVLEIESGINDPMAIFLTLTLMEWIAAPDGLTPLALAMRLGVQFGVGAVLGVGLGLCLASVLERIEVAEGLHAILICSGGALIFAITQTLGGSGFLAVYLAGMLVGNRDRAVTSDTMRAMDGMAWLAQSAMFLLLGLLVAPHRIWEVALPAIAVAAFLMFVARPAAVFLALLPFRLSVGEKGFIAWMGLRGAVPIVLSLFPLLRGLPESGLIFRIAFAVVLASLLLQGTTVAPAARLARVLRPGFPEPLARSRLRGTHGPTLEVMQFRVGANAPVENVRADQLELPPKCRLLTVARDDALAPHDQTVLRAGDTVSVLAPATVVPRLAALFQAAGPAPAWEQVTHDFLISGDAFLRDLAALYGERALTAAESPLTLADAMQAAFVSPPVEGDSVVIAGLHLTAARMEGPRIVQVGLLLPRTEGATGTRRWGIWRKRQA

SEQ ID NO: 10817 - protein, 335 aa, Chromobacterium violaceum ATCC 12472
MSRITLSRFLIEQQRKAGTLPPELRLLIETVGRACKAISYSVNKGALADVLGEAGTGNIQGEAQKKLDVIANDFLLDANEWGGSLAAMASEEMELPYHIPGEYPKGEYLLMFDPLDGSSNIDVNISVGTIFSILRCPEGVTQPTETDFLQPGTHQVAAGYTVYGPQTMLVLTFGSGVHGFTLDREHGSFVLTHPDMKVPERTAEFAINMSNMRHWEAPVRRYVEEMLAGKTGPRGRDFNMRWVASMVAEVHRIITRGGIFMYPKDARDPSKAGKLRLMYEGNPMAFIIEQAGGAATNGHQRILDIVPTKLHERVAVFLGSKEEVELVTRYHSEQQ

SEQ ID NO: 10818 - protein, 374 aa, Arabidopsis thaliana
MTMAANLARRLIGNRSTQILGAVNSSSGAASSVARAFCSSTTPITATLFPGDGIGPEIAESVKKVFTTAGVPIEWEEHYVGTEIDPRTQSFLTWESLESVRRNKVGLKGPMATPIGKGHRSLNLTLRKELNLYANVRPCYSLPGYKTRYDDVDLITIRENTEGEYSGLEHQVVRGVVESLKIITRQASLRVAEYAFLYAKTHGRERVSAIHKANIMQKTDGLFLKCCREVAEKYPEITYEEVVIDNCCMMLVKNPALFDVLVMPNLYGDIISDLCAGLVGGLGLTPSCNIGEDGVALAEAVHGSAPDIAGKNLANPTALLLSGVMMLRHLKFNEQAEQIHSAIINTIAEGKYRTADLGGSSTTTEFTKAICDHL

SEQ ID NO: 10819 - protein, 397 aa, Clostridium tetani E88
MAVSLAIILLLGLLVSKLFEKIKLPGLLGMIILGTIIGPYGLNWLHGDMINVSADLRKIALIIILLRAGLGINKKDLKKVGKTAFKMSCVPGIIEGFSIAFVSVKLLEFSFIEGGMLGFIIAAVSPAVVVPSMLNLLESSIGTNKGIPTLILAGASIDDIFAITIFSTFLGLYSGANINIGIQLLNIPVSIILGIIAGGIIGFTMVRVFSKYHIRDTKKVLLILGTSILFTELEKVLKTKIEIASLLGVMTIGFVIIKKIPDVGKGLALKFNKIWIFAEILLFVLVGAEVNVNVAINAGKMGILVILIGLLGRSIGVIISLLGTDLNWKERLFCVIAYVPKATVQAAMGAVPLSLGVESGDIILAMAVLSIIITAPLGAIGINFSAKRLLYVDNKKE

SEQ ID NO: 10820 - protein, 729 aa, Klebsiella pneumoniae subsp. pneumoniae MGH 78578
MLYKGDTLYLDWLEDGIAELVFDAPGSVNKLDTATVASLGHALDVLEKQSDLKGLLLRSEKAAFIVGADITEFLSLFLVPEEQLSQWLHFANSVFNRLEDLPVPTISAVNGYALGGGCECVLATDYRLATPDLRIGLPETKLGIMPGFGGSVRLPRLLGADSALEIIAAGKDVGADQALKIGLVDGVVAAEKLRDGALAILRQAMNGDLDWKAKRQPKLEPLKLSKIEAAMSFTIAKGMVAQTAGKHYPAPITAVKTIEAAARLGREEALVLENKSFVPLAHTNEARALVGIFLNDQYVKAKAKKLTKDVETPKHAAVLGAGIMGGGIAYQSAWKGVPVVMKDISDKSLTLGMTEAAKLLNKQLERGKIDGLKLAGVISTIQPTLEYSGFDRVDVVVEAVVENPKVKKAVLAETESKVRPDTVLASNTSTIPISELASVLQRPENFCGMHFFNPVHRMPLVEVIRGEKTSDNTIAKVVAWASKMGKTPIVVNDCPGFFVNRVLFPYFAGFSQLLRDGADFRKVDKVMEKQFGWPMGPAYLLDVVGIDTAHHAQAVMAAGFPQRMQKDYRDAIDALFDANRFGQKNGLGFWRYKDDSKGKPKKEEDAAVDSLLADVSQPKRDFSDEEIIARMMIPMVNEVVRCLEEGIIASPAEADMALVYGLGFPPFHGGAFRWLDTIGSAKYLDMAQQYQHLGPLYEVPAGLRDKARHNEAYYPQVEPARPVGALKTA

SEQ ID NO: 10821 - protein, 443 aa, Phaeosphaeria nodorum
MERKRGREMNPPSADPPSATPVARANLPGSVAAAFHGRPCSQGTTTLKRVNERYKIVGFISSGTYGRVYKAEGKNGRTGEFAIKKFKPDKEGELQYSGISQSAIREMALCTELAHPNVVHTVEIILEEKCIFIVFEYAEHDLLQIIHHHNQPQRQAIPARTIKSILYQLLQGLVYLHRNWVMHRDLKPANIMVTSAGKVKIGDLGLARLFYKPLQSLFSGDKVVVTIWYRAPELLLGSRHYTPAVDLWAVGCIFAELLSLRPIFKGEEAKMDSKKTVPFQRNQMQKIVEIMGMPSKDRWPLLTAMPEYPQLSSLIAGNAARFARPQGGDGLDRWYNQTLINNQYPAGPGPETPGAEGLALLKQLLEYDPQKRLTAEKALEHRYFTEHGKPSDNCFEDSKIKYPVRRVSQEDNDIRTSSLPGTKRSGLPDDSLMGRPAKRLKEG

SEQ ID NO: 10822 - protein, 1072 aa, Mesotaenium caldariorum
MESTTGLVAGSHNRKELVVISVDEEREPLPSHAAGICQICSDDVGPSHESSQLFIACIECGYPVCRSCYEYERKEGSRACPRCKTVYMRHKGSPRVDTDPEEEEIDDIDNELRDIVQQPQSDNNWNSKTLGFDAESVNSSLMKRHLYLNSGYGHAYFGSPNHSDAVSDLGSNTIQPSVPASETGKKSFSSSIDGSECRMLDSYKDNGYGNVAWKVKCDRDGEANAVSVNMGGMEAMQLRGGGHDYFPEELPSPLDDARQPLSRKVHFAMGLIQPYRLLIVLRLLVLAFFLRYRFLNPADSRPLWLASVVCEVWFAVSWILDQFPKWNPINRETNLGRLQLRYGEALDAVDLFVSTVDPGKEPPLTTANTLLSILAMDYPVEKLNCYLSDDGASKLTFDAVNETSEFAKKWVPFCKKFAVEPRAPEAYFAQKTDFLKGQVQSSFVNERRNMKKEYEEFKVRINHLVSDFQNVPEDGWTMADGSYWPGNNARDHPGMIQVFLGPSGGKDVEGNALPRLVYVSREKRPGFNHHKKAGAMNALIRVSALLTNAPHILNLDCDHYVNASSALRHAMCFLMEPSTGQKTAFVQFPQRFDGVDRSDRYANHNTVFFDINLRGLDGIQGPVYVGTGCCFRRHALYGFSPLKDKKIGGRQPWFGELSRTNSSLKQKVSPSTSPLFTMDAGDVEMNENESLLNLKRFERRFGGSPTLVLSTFQEDSSSPAPYSSSSSSWDASCLPEAIQVISCGYETDTEWGTEIGWIYGSVTEDILTGFKMHCRGWRSVYCHLALPHRPAFKGRAPINLSDRLEQILRWALGSVEILFSRYSPLWYGWMGGNGGGLKLLQRMAYVNTVVYPFTAFPLIVYCTLPALCLLSDQFIIPSISTVSAIWFVLLFISIFASAFLEMRWSGVSMEEWWRNEQFWVIGGVSAHLYAVFQGLLKVVVGIDTNFTVTAKTADEEEEFEELYLFKWTTLLIPPTTLIALNAIGIAAGIANAINNGYAEWSALIGKVFFAFWVLVHLYPFLKGMMGKNTRMPTLVIVWSVLLASILSLIWVKTSPFGLTTTGPSAEDCGVRC

SEQ ID NO: 10823 - protein, 134 aa, Cryptococcus neoformans var. neoformans JEC21
MSQPAKVQKSDDEWRAILSPEQFRVLRQKGTERPGSHPYDHSNDKGVYHCAGCDAPLYTSNTKFQSGCGWPAFYDTIPGAVNRHEDRNFGMTRTEITCANCGGHLGHVFKGEGFPNPVDERHCVNGISLNFKNE

SEQ ID NO: 10824 - protein, 181 aa, Oryza sativa Japonica Group
MGLTFTKLFSRLFAKKEMRILMVGLDAAGKTTILYKLKLGEIVTTIPTIGFNVETVEYKNISFTVWDVGGQDKIRPLWRHYFQNTQGLIFVVDSNDRDRVVEARDELHRMLNEDELRDAVLLVFANKQDLPNAMNAAEITDKLGLHSLRQRHWYIQSTCATTGEGLYEGLDWLSSNIASKA

SEQ ID NO: 10825 - protein, 108 aa, Shewanella oneidensis MR-1
MSDKIIYLSDDSFENDVLKADLPVLVDFWAEWCGPCKMIAPILDDVAEEYAGRVTIAKLNVDQNNVSPAKYGVRGIPTLLLFKNGELAATKVGALSKTQLKEFIDAQI

SEQ ID NO: 10826 - protein, 110 aa, Oryza sativa
MKLNISCPATGCQKAISIDDDKKLSAFYGRRMGQEVEGDTLGDEFKGYIFKITGGNDKDGFSMKQGVLVQGRVRILMGAGQTCYRPRRKGERKRKSVRGCVVGPDLSVMA

SEQ ID NO: 10827 - protein, 201 aa, Rickettsia typhi str. Wilmington
MSYIPVVIEQTSRGERAYDIYSRLLKERIIFVCSTVEDHMANLIVAQLLFLEAENPKKDIYMYINSPGGVVTAGLAIYDTMQFIKPKVATLCIGQACSMGSLLLCGGEHGMRYSLPHSRIMIHQPSGGYKGQATDIEIHARETLKIKKLLNELYSKHTEQALKHIEKSMERDNFMSPGEAKKFGLVDNIISSRDAMALLHK

SEQ ID NO: 10828 - protein, 251 aa, Yersinia pestis CO92
MVDQEKETTHFGFRTVAKEQKEGMVAEVFHSVAAKYDLMNDLMSFGVHRIWKRFTVDCSGVRRGQRVLDLAGGTGDLTAKFSRLVGEQGEVILADINESMLRMGREKLRDKGIVGNVSYVQANAEALPFPDNFFDCITISFGLRNVTEKEKALRSMFRVLKPGGRLLVLEFSKPLLEPLSKAYDAYSFHILPKIGELVAQDAESYRYLAESIRMHPDQETLKGMMADAGFENVTYSNLTGGIVALHRGFKF

SEQ ID NO: 10829 - protein, 762 aa, Myxococcus xanthus DK 1622
MSAAPRLLWFSELSREDVALAGGKGANLGEMTRAGLPVPPGFVITATAFQEAMAPVRARLQALWAQVDPDDPSSLTQVTQQLREHVRSAPVPERLRAAILEAYQQLGADRAVAVRSSATSEDSAATSFAGMHESFTHVLGEDALMDALRACWASAYGERVVAYRKAEGLTEEPAIAVVVQAMVDAARAGVMFTADPSSGDTGRIVIEAAWGLGEVVVGGQVEPDTYSVSKKEPCVREVRVGDKSVRLVRNAEGHTQRETLSPEQAHERVLSDVAVLELARLGLRVEQHYGAPQDIEWAEERGRLFLVQTRPITTLGKSAVPPPEEGHAGKALVQGLGASPGVAAGRVRVLASPAEGRQLQPGEVLVAEMTSPDWVPTMRRAAAIVTDRGGMTCHAAIVSRELRKPCVVGTRTATRTLRDSEAVTVDGSMGEVREGQEAPRPRAVEVPATASTVGTAPVLATRLYVNLALPAQAREAAALPVEGVGLLRAEFMLTEALGGVHPRKLIAEGRRGEFVERMAGALLQTTRAFHPRPVVYRTTDFRTNEFRGLEGGAEFEPEESNPMIGFRGAYRYLREPDVFNLELEVLARVREQTPNLQVMLPFVRTLWELEACLELIARSPLGRQRGLKTWVMAEVPSIVYRLHDYAKCGIDGVSIGSNDLTQLMLGVDRDSESCAELFDEADAAVLAAIGDIIRGCEEAGLTSSLCGQAPSNRPDFAEHLVRAGITSISVDPAAVLATQRVIAAAEQRLLLAASKRATLQGC

SEQ ID NO: 10830 - protein, 502 aa, marine gamma proteobacterium HTCC2080
MAKDPFEEFQQRLLSTQDEARDEAVKKRHGRGGRTARENLHDLVDGASVNEFGQYVVAAQRSRRDVEELQQQTAGDGVITAIGPVNGGLFSDSLAKTALIINDYTVLAGTQGYFHHRKIDRLLGLAGQQELPVIMYTEGGGGRPGDTDVLVSGGGLNVPTFHRWCALTGKVPRIAVNHGFCFAGNAALFGAADLRIATQESYIGMAGPAMIEGGGLGHFKPTEIGPTSVHSKNGVIDIVVRDEAEATMKARQALAFCQGPTADFEFAEQSDLRNALPSNRRMAYDPVKILERLFDKNSFIPLRSHYGRSIVSGLARINGIPFAVLANDCRHLGGAIDSEGASKATDLYRLAERWKLPVVSFVDTPGFMVGPDSEAIGAPRYMSEMFTAGATLTQPIVAIFLRRGYGLGAMAMTGGSFEIPVYAASWPTGEFGPMGLEGAVHLGYKQELSTLPEGPERDAHFEELLGKLYERGKATEAASFLEFDSVIDPVDTRSVISSALPR

SEQ ID NO: 10831 - protein, 303 aa, Bacillus cereus E33L
MKRWQMEWLLVSVALVWGANYTIGKYGVAFMSSIQFNSLRFLVASPVLLLITFLMKRSLRIERKDWLRLVAVGIVGTTMYQTMFMLSVKYTSATNASLLIAMSPIFTGILAVLHKQERFSMKVQIGSIVAFIGAAFVLLTGHTGGATYEYAWLGNIIGLVAAIAWGWYPILAQPLITKYSAMRVTSWSTLIGIVPLVIYCLFNVNTLTWPIDMLSWGSLAYSIIFATIFGLAMWYVGISQIGSTKVMVYMYLVPLFAVIFAAVTIGEQINMMQLVGGLIIFIGLYVVKKGGIKKPALNLKKVS

SEQ ID NO: 10832 - protein, 514 aa, Cryptococcus neoformans var. grubii H99
MSAIIPQVQQLLGQVAQFIPPWFAALPTSVKVVIAVIGIPALVICLNVFQQLCLPRRKDLPPVVFHYIPWFGSAAYYGEDPYKFLFECRDKYGDLFTFILMGRRVTVALGPKGNNLSLGGKISQVSAEEAYTIKSGLTTESLQSYPPMITSECEDFFTKEVGISPQKPSATLDLLKSMSELIILTASRTLQGKEVRESLNGQFAKYYEDLDGGFTPLNFMFPNLPLPSYKRRDEAQKAMSDFYLKIMENRRKGESDHEHDMIENLQSCKYRNGVPLSDRDIAHIMIALLMAGQHTSSATSSWTLLHLADRPDVVSIYRKVLSDIPVPPSLSAPSENGQYIIPKGHYIMAAPGVSQMDPRIWQDAKVWNPARWHDEKGFAAAAMAQYSKAEQVDYGFGSVSKGTESPYQPFGAGRHRCVGEQFAYTQLSTIFTYVVRNFTLKLAVPKFPETNYRVSLRVPIYHWMDVLLISTRVDHDCPTQQPFGYFHPSKCRGQIGGVKCTHISKLDGASFSMN

SEQ ID NO: 10833 - protein, 994 aa, Candida albicans SC5314
MSTIPSQVEINFNKIHQRSNSSSSTSSYRIPSGNSCIPRTVEMPSLPPTSTHHQHQQMPSSSSHAHIAKKIHREVRFGAYILGSTLGEGEFGKVKLGWRKDGKHPSQVAIKLIKRSTITKDSDSEIKIHREINSLKLLNHPNIVNLVEVMKSGKYIGIVLEYASGGELFDYILQHKYLKENVAKKLFAQLVSGVDYMHAKGLIHRDLKLENLLLDKHRNVIISDFGFVNSYNRDKNDLMKTSCGSPCYAAPELVLSQTAYEGRKVDIWSLGVILYAMLAGYLPFDDDPENEDGSDIIKLYHYICKTPLTFPEYVSPLARDLLRKIIVSDPKKRISIDDIRNHPWLSSHANLLSIRQPEWDKVHSEKQQPIAVEPPQPNKRYSMINERTNSSSLMSPAPRVTHTQPLSSHARSYSSTSISLLYSSPSATPSMANAVTNGEGATTTTTNGSINESNDTLQLSGTPSPKKPSTVSPVRGHQKSASISNSYSSASIALKAVVHEENRLHNHQQSQQYIPRSSTISTIVESPTKANTATETETTDGHKILLPPPSKDAQKLPHAAKKPRPTSYHPSSMSSALIHNNQNPTDVLKMPSPINFPMTQFISTSPPKSNGSLNDSGNFTNCSPKATSRRNSVVTHVHVNGVLSKENLIHSSSSPDNKRNSVLSYLEDKIDTLELTESHSPSKNTFEEIVDAAIATPEINQVPVFDSQTSPNGIGLDIKHKEFDETSLVVEKKSKETVSDSKSEESTKETQQQENVVMYEPIVPVEEYIKKPEEVNSVEAKQPEEVKSEDKSLQGQKSQQQQQQPEKHSADIGKTKVDLKKSASQKKKVKEESIKKQKDVDSKPIERRHTIAARRHHNDENKENKDVKKRNRFSLLSFYSSYNSSNSNVSLATSKVPSNSENNTTVLKPTSMNTTRKVLEPSNETNIMRKETKQTNSNGSTTSKSTTSSSSSSAPAASSSSSSSTSKRASTATKETSAARKVMDFFKRRSVRVG

SEQ ID NO: 10834 - protein, 408 aa, Erythrobacter sp. NAP1
MATEITVPQLGESVTEGSIGEWLKQPGDAVAVDEPIASLETDKVAVDVPSPVAGVLSEHRAEVGDTVEVGAVIAVIEEGATGAATKGEEPARAQEKREEGEEKREDQEVTQTLSPAVRRAVLEHGVDPSTIKGTGKDGRLTKEDVIAAAKAKGDSPAPSPTPTPAPAPTATATGEGRNEERVKMTRMRQTIAKRLKGAQDNAALLTTFNDVDMTAVIEARTKYKDLFAKKHDIRLGFMGFFAKAACLALKDVPSVNAYIEGDEIVYHDYVDISVAVSAPNGLVVPVVRDCDKKGFAQIEKDIADYGKRAKDGTLTMADMTGGTFTISNGGVFGSLMSTPIINPPQSAVLGLHRIEDRPVAINGEVKIRPMMYIALSYDHRLIDGREAVTALKIIKEAIEDPTRMLIDL

SEQ ID NO: 10835 - protein, 479 aa, Marinobacter sp. ELB17
MTAPLSDALPDSSPGSLSGSLAERLNRRSRNVQAQQTPELAGRLTRMVGLTLECVGVPMVVGDRCVIQSQGSSVVEAEVVGFEDEKVYLMPLTAIEGLRPGALVVPLSSTSRVPVGNQLLGRVVDGSGEPLDGKGPLHAEARVSLSGDIINPLNRAPVRQPMDVGIRAINALLTVGQGQRLGLFAGSGVGKSVLLGMMTRFTNADVTVVGLIGERGREVKEFIEDILGEEGLARSVVVASPADDSPLMRLRAAMLTTRIAEFYRDQGKRVLLLMDSLTRYAQAQREIALAVGEPPATKGYPPSVFAKLPQLVERTGNGRPGGGSITAFYTVLTEGDDQQDPIADAARAILDGHIVLSRRLAEEGHYPAIDVEASISRVMPQVTEPEHFARAQRFKQVYSRYQQARDLISVGAYVKGSDPETDFAIAHIANMRQFLKQGLSEKTSLNDSVEQLLAVVPERRSPERMQVAAPNPTAAGSNP

SEQ ID NO: 10836 - protein, 472 aa, Erythrobacter sp. NAP1
MADHPYDYDCLVIGAGPGGYVAAIRAAQLGLKTACIESRETLGGTCLNVGCIPSKALLHASELFEEAEGGHFATWGIDAKATFDLSKMMAEKTSAVGDLTKGIEFLFKKNKVTWLKGHGAFEDAHTVKVGDETITAKDIVIATGSSVTPLPGVEVDNEAKRIVDSTGALELEEVPEHLVVIGGGVIGLELGSVWRRLGAKVTVVEFLPQILPGMDEEVRKEANKIFKKQGMEMMLGHKVTGAEVKGKKVTLTIEKAEGGDEQKLEASHVLVSIGRRPNTDGLALEKAGLQVNNRGQIEIDHAFRTGVEGVWAIGDVVPGPMLAHKAEDEGVAVAENIAGQTGIVNHDVIPNVVYTTPEIAGVGLTQEQAIKKAGGDKKAIKVGKFPMMANSRAKANRDTDGFVKVIADAKTDRVLGVWMINTLAGTMIAQAAQAMEFGATSEDIAYTCHAHPTHAEAFKEAAMAVQGKPIHM

SEQ ID NO: 10837 - protein, 200 aa, Glycine max
MAEQALEGSQPVDLTKHPSGIVPTLQNIVSTVNLDCKLELKSIALQARNAEYNPKRFAAVIMRIREPKTTALIFASGKMVCTGAKSEQQSKLAARKYARIIQKLGFPAKFKDFKIQNIVGSCDVKFPIRLEGLAYSHGAFSSYEPELFPGLIYRMKQPKIVLLIFVSGKIVLTGAKVRDETYTAFENIYPVLTEFRKNQQ

SEQ ID NO: 10838 - protein, 255 aa, Oryza sativa Indica Group
MASYTPATDVAAGDEEEAACLQAFELMCAFTVPMTLKAAIELGLLDALVTAADDDDGRALTADELAARLPDALDTAEAASSVDRMLRLLASCNVVKCSTEAGPAGEPLRRRYSPAPVCRWFTAGGNSHHGSLAPSVLFGIDEDYLSTWHQLAAAVGGGGAVAFERAHGAPMFEYMGTNRRLNTLFNQAMAQQSMIVINKLLDRFHGFDGVGVLVDVGGGTGGTLEMIMSRHKHITGVNFDLPHVISQAPSLPGYV

SEQ ID NO: 10839 - protein, 403 aa, Eleusine coracana subsp. coracana
QILFQGFNWESWKQNGGWYNLLMGKVDVIAAAGITHVWLPPPSHSVAEQGYMPGRLYDLDASKYGNEAQLKSLIQAFHAKGVKVIADIVINHRTAEHQDSRGIYCMFEGGTPDTRLDWGPHMICRDDSPYADGTGNPDTGADFGGAPDIDHLNTRVQQELIGWLNWLKTDIGFDAWRLDFAKGYSADVAKIYIDSTEPSFAVAEIWTSLAYGGDGKPNYDQSAHRQELVNWVDRVGRSGPATTFDFTTKGILNVAVDGELWRLRGNDGKAPGMIGWWPAKAVTFIDNHDTGSTQHMWPFPANKVMQGYAYILTHPGNPCIFYDHFFDWGLKDEIVQLVSIRNRHGIHPESELRAIEADADLYLAEIDGKVITKLGTRYDVGHLIPDGFQVVAHGDGYAVWEKV

SEQ ID NO: 10840 - protein, 365 aa, Rhodococcus sp. RHA1
MTTAVSPKPGAALRNRAFHTLTVADVESLCDDAVAVTFDVPAELADEFAFGPGQSLTLRRTIDGVEHRRSYSICAPSGSAPRVGVREVSDGLFSTWLVRDVRPGDRIEVQGPSGTFVADPAAGGRHVLIAAGSGITPMLSIAASMLANPEAEVVLLYGNRRTRSVMFAEEIADLKDTYGSRFDIIHVLSREPREVELFTGRLDADRLRAIFDAVVPVADIDHFWLCGPYGMVTDAETVLGDLQIDKSRVHHELFFVDDVPPPMETHREPGVTGPSSEVTLVLDGRSTTATLPRDESILDAAEKYRSDLPFACKGGVCGTCRAKITCGDVDMRRNYALEDYEVDSGFVLTCQTFPVSDNVTVDFDA

SEQ ID NO: 10841 - protein, 428 aa, Pseudomonas aeruginosa
RAELNQGLIDFLKASPTPFHATASLARRLEAAGYRRLDERDAWHTETGGRYYVTRNDSSLIAIRLGRRSPLESGFRLVGAHTDSPCLRVKPNPEIARNGFLQLGVEVYGGALFAPWFDRDLSLAGRVTFRANGKLESRLVDFRKAIAVIPNLNIHLNRAANEGWPINAQNELPPIIAQLAPGEAADFRLLLDEQLLREHGITADVVLDYELSFYDTQSAAVVGLNDEFIAGARLDNLLSCHAGLEALLNAEGDENCILVCTDHEEVGSCSHCGADGPFLEQVLRRLLPEGDAFSRAIQRSLLVSADNAHGVHPNYADRHDANHGPALNGGPVIKINSNQRYATNSETAGFFRHLCQDSEVPVQSFVTRSDMGCGSTIGPITASQVGVRTVDIGLPTFAMHSIRELAGSHDLAHLVKVLGAFYASSELP

SEQ ID NO: 10842 - protein, 490 aa, Arabidopsis thaliana
  misc_feature (92)..(92): Xaa can be any naturally occurring amino acid
MGCLHSKTANLPSSDDPSAPNKPESVNGDQVDQEIQNFKEFELNELRKATNGFSPSCIVSEGGEKAPNVVYRGKLEGNHLVAIKRFSRQSWXPDAQQFVVEATGVGKLRNKRIVSLIGCCAEGDERLLVAEYMPNDTLSKHLFHWEKQPLPWDMRVRIADYIAEALDYCNIENRKIYHDLNAYRILFDEEGDPRLSTFGLMKNSRDGKSYSTNLAYTPPEFLRTGRVIPESVIFSYGTILLDLLSGKHIPPSHALDIIRGKNALLLMDSSLEGQYANDDATKLVDLASKCLQSEAKDRPDTKFLLSAVAPLQKQEEVASHVLMGLPKNTVILPTMLSPLGKACAKMDLATFHDILLKTGYRDEEGAENELSFQEWTQQVQEMLNTKKFGDIAFRDKDFKNSIEYYSKLVGMMPVPSATVFARRAFSYLMTDQQELALRDAMQAQVCIPEWPTAFYLQALALSKLGMETDAQDMLNDGAAYDAKRQNSWRC

SEQ ID NO: 10843 - protein, 310 aa, Ceratopteris richardii
SEVWFTFSWVLDQLPKMCPVNRATDLPVLKEKFDEAGPDNPEGRSDLPGMDIFVSTADPEKEPPLVTANTILSILAADYPVEKLACYLSDDGGALLTFEAMAEAASFAQVWIPFCRKHAIEPRNPDSYFNMKGDPTKNQMRQDFVRDRRRVKREYDEFKVRINGLPESIRRRSDAYNAHEEIKAKRQQIEAGLEPIEPLNVSKATWMADGTYWPGAWSTPTVDQGRGDHAGIIQVMLAPPSSEPLFGNSGDDNLIDTTEVDIRLPMLVYVSREKRPNYDHNKKAGAMNALVRASAIMSNGPFILNLDCDH

SEQ ID NO: 10844 - protein, 465 aa, Burkholderia xenovorans LB400
MDDHYDVIVIGGGPGGYVAALRAAQLGRRTALCERDQLGGICLNWGCIPTKALLHTADTLRTVRKAAHLGIGIDDPVVDFTRVMARSREVAQKLNRGVSHLLRKAGVTVLAGTAAFAADRSVRVHGADGALRTLQARHTIVATGAAARQLPALPWDGERIWTYREALAATAVPKSLLVVGAGAIGMEFAGFYAAMGTEVTVVEVAPRILPASDADVSEFVARACERDGIRLRTGCSVVHSAAHAEGVRVMFRSENAEEQREFERVLVAVGLDGNTEGLGLEHTRVAFERGLIIADAAGATSDPVVHAVGDVTGAPMLAHKASHQAIACVERIAEVNRGERHASPKIPGCVYSHPQTASVGLTEDEARRTGRALRVGRFPLDANGKAIALGDPSGFVKTIFDAASGELLGAHIVGPEAPELIHGFTLAATLEATESELIETVFPHPTLSEAMHESVLAAFGRPLHI

SEQ ID NO: 10845 - protein, 397 aa, Pyrococcus abyssi GE5
MEIGVVGKPNVGKSTFFSAATLVDVEIANYPFTTIDANVGVTYAIAEHPCKELGCKPNPQNYEYREGLALIPVKMIDVAGLVPGAHEGRGLGNKFLDDLRMASALIHVVDVTGKTDAEGQPTENHDPIEDIEFLEREIDYWIYGILSKGWDKFAKRIKLQRIKLESAIAEHLSGIGVTENDVWEAMHRLGLPSDPTLWSQEDLLAFASEIRRINKPMIIAANKADAASEEQINRLIKEGEKRGYIVVPTSAAAELTLRKAAKAGFIDYIPGSSEFKILKDMNERQKKALLMIKEKVLDRFGSTGVQEVINKAVFELLNLIPVYPVQDENKLTDQFGNVLPHVFLMKKGSNPRDLAFKVHTDLGRGFLYAINAKTKRRIGEDYELQFNDIIKIVAVTK

SEQ ID NO: 10846 - protein, 428 aa, Burkholderia xenovorans LB400
MRRELLVPKLGLTMTEGTLIEWMISPGDRFDADQGLYVIESDKAANEVSAEGSGVLLEVTAELGMPLSVGSVIGYWDDDPQAATNHAVRAEPSAHAAAASASSPDSNAANAAPSAQTSRPPAAMNGQSGQSGQSGARGISTPLARRLARERGIDLTNLAGSGPRGRIRARDVELAPANSPASAPDVPLPATASRAAQVAQAATVRAATSIEKTIARRLVTSKQTIPHFYLSVEAEISAVQRLRSQLNDAQSNRRFTVNHFVVAAVGRALALVPEANRVWDDSGITSFAATDVGVAVHTERGLLVPVLRDVGRQALGEVARHASEAIGRAQAGQLNAAEMAGGAITVSNAGMHDVTLMTSIINPGQSMILGVGSVRQVFRPDAHGQPALKNEVGLVLSVDHRVLDGVTALKFLRQVVAAIERPASLLVT

SEQ ID NO: 10847 - protein, 189 aa, Ustilago maydis 521
MDQQGLSSVHGIVPTLQNIVATVNLEVRLDLKTIALHARNAEYNPKRFAAVIMRIREPKTTALIFASGKMVVTGAKSEDDSRLASRKYARIIQKLGFEAKFSEFKIQNIVGSCDVRFPIRLEGLAYSHGVYSSYEPELFPGLIYRMVKPKVVLLIFVSGKIVLTGAKVREEIYQAFNLILPVLAEFRKP

SEQ ID NO: 10848 - protein, 404 aa, Rickettsia typhi str. Wilmington
MPIKILMPALSPTMKDGNLARWLKKEGDKVNPGEVIAEIETDKATMEVESVDEGILAKIIIPQNSQNVPVNSLIAVLSEEGESTADIDAFIAKNNSVSLSLKTDTTLKKANESITNVEVVKHDLSKIFASPLAKRLAKIRNIRLESVQGSGPHGRIVKQDILSYSPSTAYNRDTEEYRSVPNNNIRQIIAKRLLESKQTVPHFYLSIECNVDKLLDIREDINKSFSEDKLTKISVNDFIILAVAKALQEVPNANASWAEDAIRYYNNVDISVAVAIENGIVTPIIKDANKKNIIELSHEMKILIKKAKDNKLTPVEFQGGGFTISNLGMYGIKNFNAIINTPQSCIMGVGASTKRAIVKNDQIIIATIMDVTLSADHRVIDGAVSAEFLASFKRFIEHPVLMLI

SEQ ID NO: 10849 - protein, 275 aa, Bdellovibrio bacteriovorus HD100
MNPLLKSQKIGFLGAGNMAQAMIKGLIEGGFPAKNIFASNRSEGKLHKLAETFKINPVFSNDELVDTCDIIILAIKPQDLLQALEPVTRSFDEHKIVISVAAGIRMEKLERYVQGARLARVMPNTPSLIGRGVIGYLLNDDDDSGLDSTVEDLFQPLGRVIQVHDEDQFEALMVSCSSGTGFVFEMMMYWQDWIEEHGFSVEEARMMTIETFVGASLLAAQAREGVEDLQARVTSKKGVTAAGLQSMRELEIERALRISFEKAAMRNKEMAREIK

SEQ ID NO: 10850 - protein, 148 aa, Brassica napus
  misc_feature (6)..(6): Xaa can be any naturally occurring amino acid
  misc_feature (12)..(12): Xaa can be any naturally occurring amino acid
  misc_feature (14)..(14): Xaa can be any naturally occurring amino acid
  misc_feature (17)..(20): Xaa can be any naturally occurring amino acid
  misc_feature (32)..(32): Xaa can be any naturally occurring amino acid
  misc_feature (37)..(37): Xaa can be any naturally occurring amino acid
  misc_feature (39)..(39): Xaa can be any naturally occurring amino acid
  misc_feature (42)..(42): Xaa can be any naturally occurring amino acid
  misc_feature (47)..(48): Xaa can be any naturally occurring amino acid
  misc_feature (53)..(56): Xaa can be any naturally occurring amino acid
  misc_feature (59)..(59): Xaa can be any naturally occurring amino acid
  misc_feature (68)..(68): Xaa can be any naturally occurring amino acid
  misc_feature (71)..(71): Xaa can be any naturally occurring amino acid
  misc_feature (73)..(73): Xaa can be any naturally occurring amino acid
  misc_feature (77)..(77): Xaa can be any naturally occurring amino acid
  misc_feature (99)..(99): Xaa can be any naturally occurring amino acid
  misc_feature (102)..(102): Xaa can be any naturally occurring amino acid
  misc_feature (105)..(105): Xaa can be any naturally occurring amino acid
  misc_feature (107)..(107): Xaa can be any naturally occurring amino acid
  misc_feature (109)..(109): Xaa can be any naturally occurring amino acid
  misc_feature (111)..(112): Xaa can be any naturally occurring amino acid
  misc_feature (114)..(114): Xaa can be any naturally occurring amino acid
  misc_feature (116)..(116): Xaa can be any naturally occurring amino acid
  misc_feature (119)..(119): Xaa can be any naturally occurring amino acid
  misc_feature (126)..(126): Xaa can be any naturally occurring amino acid
  misc_feature (128)..(128): Xaa can be any naturally occurring amino acid
  misc_feature (131)..(131): Xaa can be any naturally occurring amino acid
  misc_feature (139)..(139): Xaa can be any naturally occurring amino acid
  misc_feature (144)..(144): Xaa can be any naturally occurring amino acid
KREQVXASSMFXSXAVXXXXAQATMVAPFTGXLKSSXAXPVXRKANXXITSIXXXXGRXSCMKVWPPXGKXKXESLXYLPDLTEVELGKEVDYLLRNKXIPXVEXEXEXGXXYXEXGSXPGYYDGXYXTMXNLPLVGCXDSAQXLEGS

SEQ ID NO: 10851 - protein, 219 aa, Bdellovibrio bacteriovorus HD100
MALKEITEKAKPAKILAVSKLQPAEKVRALHVEGQRLFGENYVQEALEKQSVLSDLSDIQWHLIGHLQKNKAKLVVGKFHLIHSVDSLELAQVISRQCEQKGVSQNILIQVNLAGEASKEGFSAETLENQWAELTKLPHLHIYGLMTMPPLTETGAEVRPYFAELRQLRDRLKTTTDTTVHPLNELSMGTSHDYPVAVEEGATIVRLGTILFGERPAKG

SEQ ID NO: 10852 - protein, 514 aa, Rhodococcus sp. RHA1
MTTTTAEKLAELREKLETAKEPAGEQAIAKRAKKGIPSARERIDMLLDPGSFIEVGGLMRQPGDPGALYSDGVVTGHGTVEGRPVAVFSHDQTVFGGSVGEMFGRKVAAIMEFAAKIGCPCVGINDSGGARVQDAVTSLAWYAELGRRQEPLSGMCPQISMILGKCAGGAVYAPINTDVLVATEESYMFVTGPDVVRKITGEDVSLEELGGARNQAQYGNLHHVAADEKAAFEWVRKYLSFLPSSCMEKPPVVNPGLEPDITDSDRDLDTFIPDADNAGYDMHDILLRIFDDGEFHEIGGQVALNIITGFARVDGRTVGVIANQPLVAAGALDAQASDKAAHFIRICDAFDIPLVFAVDTPGFLPGLEQERIGVIKRGGRFIFAFVTATVPKVTVVIRKAYGGAYAVMGSKQLGADINFAWPTARIAVMGAEGAVDLIGRRQIEAAGENAPAVRRQLINFYNENIATPYIAAERGYIDAVIEPATTRLEIRKALTMLRDKKVQRNPRKHDLMPL

SEQ ID NO: 10853 - protein, 569 aa, Gibberella zeae PH-1
MASEINPKTEAFDAHDGSPRYDEKHGTTEPIQTPKGSWALRNGLTIESFKAHDDYAKGTVELSRDMKPRHLNMIAIGGSIGAGFFVGSGGALQTGGPGSLTIGFLIMGVMIFNVVYALGELAVMYPVSGGFYTYANRFVDPSWGFAMGWNYVMQWAFVLPLELTVFLAVIIIVNIFGTLGYAEEEFWAALLKLSATVIFMIVAVVLVCGGGPSNGIYDEYWGARLWHNPGAFQHGFRGFCGVFVTAAFSFSGTELVGLAAAEAKNPAKALPGAIKQVFWRITLFYVVGLLLVGFLVSSTDERLLNAGNNNPSASPFVIAASNAGLKGYDSFMNVIILVSVLSIGVSCVYGGSRTLVALAQQGYAPKFFSFIDKSGRPLPAVVSIIAIGALGYISVDGEGTTVFIWLQALSGLAALFTWGSICLCHIRFRSAWKYHGHTLDEIPFQHVFGVWGSWLGLAIIVIVLIAQFYTAITNIDGSIGTAEGFFQSYLAMPVVILFYIIGYIWKREGWRKISEIDLDTGRREHDWDAINAYRQQLANGPAWKHGVQTFPVTGGLIIHVLPWTQMGPE

SEQ ID NO: 10854 - protein, 237 aa, Oryza sativa Indica Group
MVMTLKAAIQLGLIDALTAAADGRALTAGELVAQLPAVDDAEAATSVDRMLRLLASFNVVRCSTEAGPGGDPLRRYSPAPVCRWFTAGDNHQGSLAPRLMLDVDEDNLSTWHQMAAAVVSGGPSAFERAHGMPLFEYMGTNHRFNMLFNQAMSQQSMMVMNKLLDRFHGFDGISVLVDVGGGTGVTLKMIISRYKHITGVNFDLPHVISQAPSLPGWVQGRWEEFLVQYAPVAVAKR

SEQ ID NO: 10855 - protein, 325 aa, Zea mays
MGEASPSIAKDVTELIGNTPLVYLNKVTDGCVGRVAAKLESMEPCSSVKDRIGYSMITDAEEKGLITPGVSVLIEPTSGNTGIGLAFMAAAKGYKLTLTMPASMSMERRIILKAFGAELVLTDPLLGMKGAVKKAEEIQAKTPNSYILQQFENPANPKIHYETTGPEIWKATAGKIDGLVSGIGTGGTITGTGRYLREQNPNVKLYGVEPVESAVLNGGKPGPHKIQGIGAGFIPGVLDVDLLDETLQVSSDEAIETAKALALKEGLLVGISSGAAAAAAVRLAKRPENAGKLFVVVFPSFGERYLSSVLFQSIKKEAESMVVEP

SEQ ID NO: 10856 - protein, 441 aa, Synechococcus sp. WH 8102
MATHDIFMPALSSTMTEGKIVEWLKQPGDKVGRGESVLVVESDKADMDVESFQDGYLAAVLMPAGSTAPVGETIGLIVETEAEIADAQAKATSAAPAASAPAPTPAPAAVQAPAPTPAPTQAPAAPAPVAASAAPVANGRVVASPRAKKLASQMGVDLSTVRGSGPHGRIQAEDVEQAGGQPISVPRVAEGTAAAVAASAAPSAAAPSAPAGNSFGRPGDTVAFNTLQGAVNRNMEASLAVPCFRVGYTITTDKLDAFSKLVKPKGVTMTALLAKAVAVTLARHPQVNAATTAAGMTYPAEVNVAIAVAMEDGGLITPVLRNADRTDLYEMSRQWKDLVKRSRSKQLQPEEYSTGTFTLSNLGMFGVDRFDAILPPGTGAILAVAASRPTVVAGKDGSIAVKRQMQVNLTADHRVIYGADGAAFLKDLAELIEHRPESLAL

SEQ ID NO: 10857 - protein, 260 aa, Triticum aestivum
  misc_feature (123)..(123): Xaa can be any naturally occurring amino acid
NNLFSGPFPAATLLIPSLVYLDLRFNGFSGELPDEVFAKNLDALFLNNNQFEGQIPETLWSSPATAITLANNRLTGPVPTAYGYGGRVRELLFLNNKLTGCVPEALGFLPYIEVLDLSNNLLXGHLPSTLSCLSGIEVLNIAHNQFTGELPELVCDLRRITNLSVSFNFFSGISEDCDRLAGRSVFDFAGNCVPGRGMQRPQPECDDAPGDVGLSCLRIPGSRPVACAEAAVSIGIGVTFGGGLPFGMSGGGAGVTVTVP

SEQ ID NO: 10858 - protein, 328 aa, Synechococcus sp. WH 8102
MSRIYDDNSLAIGNTPLVKLNSVTKNCKATVLAKVEGRNPAYSVKCRIGANMIWDAEKSGKLTKDKVIVEPTSGNTGIALAFTAAARGYKLILTMPESMSIERRRMMAVLGAELILTEAAKGMPGAIAKAKEIADSDPGKYFMPGQFDNPANPEIHFKTTGPEIWNDCDGAIDVLVAGVGTGGTITGVSRYIKNEAGKAIESVAVEPSHSPVITQTINGETVKPGPHKIQGIGAGFIPKNLDMSMVDKVEQVTNDESIAMALRLAQEEGLLVGISCGAAAAAAIRLAEQDAYAGKTIVVVLPDLAERYLSSVMFADVPTGIIEQPVAV

SEQ ID NO: 10859 - protein, 263 aa, Agrobacterium rhizogenes
MQSTEEVISPDFLRRLAAVAARETLPRFRLPGAVVNKIAGGFDPVTEADRETEKALRALIRSEYPDHGILGEEFGNEGADAGLVWVIDPIDGTRSFISGIPLWGTLVGLTRDGDAVAGMMAQPFIGELFYATGNGAYYEGQHGQTRLATSATKNLADATLFTTTPAIFEADRRASYDRLEKQVRLARYGTDCYAYCMLAAGQIDCVVEAGLYPYDIVALIPIIEQAGGVVTDWDGGPAENGGGIVAAANSSLHAQIMAFLHGD

SEQ ID NO: 10860 - protein, 175 aa, Oryza sativa Indica Group
MQSPIDLSHERLMRNLGYLDYSYLPAEASMVNRGHDIEVKFMGNAGRVVINGKAYKLKQLHWHTPSEHTVNGRRYDMELHLVHDDGNSNTAVIGNLYQIGNPDPFLLMLEPFIRRIADTKDKSEPIGVVDPQLAKSPDAVYYRYMGSLTTPPCTEGVIWTVFKRVGLTFHKFISR

SEQ ID NO: 10861 - protein, 2738 aa, Debaryomyces hansenii
MASYLPQEEFETNVYKYDETPENKSWASTLPTAKGLYNPEYEKDACGVGFTCHIKGEASHKIVSDCRNLLCNMTHRGGELNPKDGDGAGLLSSLPHKFFLREFKYYCNIDLPKLGQYGTGNIFFKKDDIVFEKSRKTFESIANTLGLKVLGWRKVPHDSSILGPASLSREPLILQPAIVLSELFDGQHKEISEEEFEKNYQMDFEKKLFILRKQSTHTIGLHNWFYICSLSSKTIVYKGQLAPNQVYAYYHDLANAEYEAHFALVHSRFSTNTFPSWDRAQPLRWAAHNGEINTLRGNKNWMRAKEGVMESELFGDELDKLYPIIEEGGSDSAAFDNVLELLVINGVLSLPEAVMMLIPEAWQNDIHIDSKKKAFYEWAACLMEPWDGPALFTFADGRYCGANLDRNGLRPCRYYVTDDDRMICASEVGVIEIEPEKILQKGRLQPGRMLLVDTKEGRIVDDRELKNKVASRFDFKSWVLANMISMDDLFSKLESRNVNLIENPESQDITVQTDPRLVAFGYSHEQISMVLAPMAEAKEALGSMGNDNALACISEQPKLLYDYFRQLFAQVTNPPIDPIREEIVMSLECYVGPQGNLLEMKPDQCNRLLLKSPVLSSLELNAIKNIEKVYPKWSVTNIDITFDKAEGIQGYINKIDNICQASSKAIADDHQIIILSDKLTSFNRIPISALIATGAVHHHLVRQKQRSKVAIIIETAEAREVHHACCLVGYGADGINPYLALETLVRMNIENLLKASLTDDQIIKNYKIAVDSGILKVMSKMGISTLASYKGAQIFEALGVDNSVIDRCFAGTASRIKGITFEYIAQDAFSLHDVGYPSRETIKPVALPETGEYHWRDGGDSHINEPAAIASMQDAVKNKNEIAYEAYSKKEYEAIKKCTLRGLLDFDYENSQSIPIDQVEPWTEIVRRFFTGAMSYGSISMEAHSTLAVAMNRLGGKSNTGEGGEDSARSLVHSNGDTMRSSIKQIASGRFGVTSHHLSDADELQIKMAQGAKPGEGGELPGHKVSEQIGKTRHSTPGVGLISPPPHHDIYSIEDLKQLLYDLKCSNPRARTSVKLVSEVGVGIVAAGVAKAGSENILISGGDGGTGAAKLTSIKYAGLPWELGLAESHQTLVLNDIRGRVILQTDGQLRTGRDIAVAALLGAEEWGFATTPLIALGCIMMRRCLASDTLVRTSEGDKPVAEVAIGDYLLDAEDKPVLCMGANPSQTGRMKEIAYQDFDSKKRVSFKCTPDHHLELTLTDSTPSLSGKSVTWFSRCTGAHLSEEVSEVYLDNMVSIFYNDLVDSTDSAVDKDSIHEAVDLALEDHYHRGNSDQYSIHLNEYISRIADKELQNEPEFIRECIHDAANRFVITSSGNRNIKSESFDDKLLLSRSRSSTADSDSDYVITDASVHSHSNNSSVYLASPDSMIPDGAANRFENIASKLKEPVCNCGGIRKIFRSFGTTEDAELAYSLLLSEHYYRLDPRFVTDGYTFQASVEQYENMCSQEVQNMHLKLYRSPLKFVEREHNSAELPVDPYFLGLWLGDGDSSGTTIMTTDREIVVWLNSYVERLNQNKPEGCFPLKLTEQLIYGAGHTSKSGHTTKVDVRNYKISSGDAFVRSGTYWNPIFDGLKKLGLLNNKSAGIPQEYMNSDEQNRLSVIAGLMDSDGCYVKSHNTYRFTQLTEDHKKIVYDLKELALSCGINTTGVELSVKPLGFNKHKHSTEYVVYLGNGSQKFQELLLLPRKKMEISKKHVSLDARPFTVSDVEDGEFRAIEVSGGVFQLANRLVVANCHLNTCPVGIATQDPELRKKFTGTPEHVINFFYYLANELRGIMANLGFRTVNEMIGRTEKLKVREDLRNTKNANMDLSPILTPAHTIRPGVATHCVKKQDHRLHVRIDNKLIDESEITLAKGLPVTIDCDVVNTDRSLGTTLSYRVSKTFGEQGLPHDTIHVNVNGSAGQSFGAFLAPGITLELEGDANDYVGKGLSGGRIIVYPPKESKFNAEDQIIAGNTAFFGATSGAAFIRGIAAERFAVRNSGANIVVEGTGDHGCEYMSGGRVVVLGSTGRNFAAGMCGGIAYVLDMAQDFGDKVNSQNVELSQITEASEIAFVRGLIEDHRHYTSSAVAENILNNFDRILPRFVKVLPYDYEKVLENEKKKQEEAKKNELNTFIKSIKEDPESDATNGEAAKIRKGHIHRPSLATVSAKDCSHEPNVLDLEDTIFDTEVEKKSVAKLDKLKGFMKYKRRNEKYRDAKKRTNDWNEMTSRLTKDELKYETARCMDCGVPFCTSDTGCPISNVIPKWNELVFQDRWYDALQRLLMTNNFPEFTGRICPAPCNGACVLGINSDPVNIKSVECAIIDHGFEQGWIKPEPPQHRTGKSIAVIGSGPAGLATADQLNKAGHSVKVYERSDRPGGLLMYGIPNMKLDKRIVKRRTDLMTAEGVEFICSTTIGEDISIEEIRSSNDAVVFAVGSTIPRDLRIKGRELNNINFAMQLLHKNTKALLDNDLEEIKKTLEGKHVIVIGGGDTGNDCLGTSTRHGAKSVTNFELLPNPPTSRPKDNPWPQWPRVFRVDYGHTEVTEHYGKDPREYSILSKEFVDDGEGNVKGIKTIRVEWKRSDSGAWQMAEVPGSEEFFSADVVLLSMGFVGPDADNLEVTKTKRGTISTVEPNGYKVSNEDNLFTAGDCRRGQSLVVWGIQEGRQCAREVDNYLMGSSRLPGNGSIEQRNFKLLEELAEKV

SEQ ID NO: 10862 - protein, 431 aa, Thermobifida fusca YX
MSHTTSTALWPYLLPPSAHGDDSICAVSARGHRVRFADGRELLCGASGLWNANLGYGNPAIAQAVAQALHDASYLSAFRYENVYARRAAADLIEVSGPEHYSRVLFSSSGGAANDAAMKVARHYHALLGRTRRSLVVSLRGSYHGLTFGGFALTGEDLGQRLYGVDQRLVRHVRPNDTAELNALVSRAAKQIAAVVVEPVVGTGTIPLTDEYVAELLRLRAEHGFLLIADEVATGFGRTGSFFASQRWPEQPDLLITSKGLTNGTCPASAVIVSQRVADAFTEHDAVLSHAETQGATPLTCAAISATIAEMRRLDAVAAGQALGEKLGAGIAELMAEMPQIIGTTGVGCFRSLRIADASGAPLPQHRVPALVAAIRDAGAIVHPGPSGVQLVPALTYSDAELAELLDCVRRGILLMSSLSAPGGRWLRGCR

SEQ ID NO: 10863 - protein, 275 aa, Oryza sativa Indica Group
MHSSTRARLLLAAAVLLLSAAPAARAQETDDERKFGYVPGTENGPGNWSRLDPRWAKCNTGNMQSPIDLSHERLMRNLGYLDYSYLPAEASMVNRGHDIEVKFMGNAGRVVINGKAYKLKQLHWHTPSEHTVNGRRYDMELHLVHDDGNSNTVVIGNLYQIGNPDPFLLMLEPFIRRIADTKDRSEPIGVVDPQLAKSPDAVYYRYMGSLTTPPCTEGVIWTVFKRVFLLAQTVAQYQLDLLREAVADGYENNARPLQKVNNRNISIFIPDPKKD

SEQ ID NO: 10864 - protein, 298 aa, Ralstonia eutropha JMP134
MENRVTKAVFPVAGLGTRFLPATKASPKEMLPVVDKPLIQYAVEEAMAAGITEMIFVTGRSKRAIEDHFDKAFELEVELEAKNKQALLDVVRSIKPANVECYYVRQPEALGLGHAVLCAAKLVGEAPFAVMLADDLIDGTPPVMKQMVDLYNHYNCSVLGVEEIAPEQSRSYGVVDGREWDEGVIKMSGIVEKPAPEDAPSNLGVVGRYILTPRIFDHLRELKPGAGGEFQLTDAIQSLLSQEQVLAYRYHGTRYDCGSKLGYLKATVEYALKHPEVSAGFRDYLEHRGTYLADGTMA

SEQ ID NO: 10865 - protein, 389 aa, Nocardioides sp. JS614
MRRVKGSRRVRERDTLSNVGRMTPPARIHERHLFGPGPSNAYPEATLALAAPLLGHLDPAFLAVMDETCEMLREVWGTGNARTLPLSATGSAGMEAAFVNTVHPGDVVVVAVNGLFGQRMCDVAARCGAEVVAVEHEWGQPIDVERVLAAHPAPAIIAAVHAETSTGVRSDIAALGAGKGDALLLVDAVTSIGGIELRADDWGVDIGYAGTQKCLGVAPGLAPFTINDRAFGRRVEKPRSWYLDLGLLGGYVGEASGSGGRTYHHTAPVAMVASLHAGLARILDEGLETVWARHEAAGRQLQAGLEELGLELFAAEGHRLPELTTVKVPDGVDSAAVRRYLLDTHDVEIGAGAGAYASTVWRIGLMGHNARPDAVLLVLAALRDALAHA

SEQ ID NO: 10866 - protein, 257 aa, uncultured bacterium
AGTGDRVRQWKTGDEVMGIVSGGAYAERLVVHERQAMSVPKSVGLANAAAIPEVFITAWDALVVQAGLTSGRWALVHAGASGVGTAAIQICKAIGARVIVTCSTGKVSACRALGADAVVDYTTSNFVESVKQETDGGGVDAVLDVIGGEYLNRNVSALALKGHIVQVGVMGGGTAPFNLAALMAKRGKVSGTLLRVRPLEEKIAITQRFIVEMLPLFDTGVLKARVDRRFPLAQISDAHTYMEANANIGKIIIDIDA

SEQ ID NO: 10867 - protein, 728 aa, Lentisphaera araneosa HTCC2155
MKTLIKSKSFSIVEVIVVCAVVAILSSLIMSASSSVREAGRKTTCLNNLKQIQAIYEAYRKDHRKAPAGDILLLNDFTFASEYISESDLETFICPGDESNELLARGIDGLDGYTSYSYVPIDHLSNGLVTSGNELASSEEVQLASMKLVAFDKDDGNHHGNRNIVYFHGSGNSKSGIAQTLKRGTFSDLALLDTPDNASEADDNASSEEEEADDNASNEQEEADDNASNEEEEADDNASNEEEEADDDASNEEEEADDNASNEEEEADDNASNEEEEADDNASNEEEEADDNALEEAQEELEAREDELVEASDEADEALEDAQEAEEAAEAAEAAEEAAREEAEEAANDAKEVAEEAARKEEALEQAKEALENGPQGYDSQNVTLPDDNKGSVVTVNTDVTVTLELIGSGFSSNSIYSDITVGNETYKWEDEGGDAHTRHVVGVEGLAIDLDVETGLTIAVNGRSSYYDSSNLQGKDNLMVYRDGDKATSVGGYNGQDSVKTFLSDYIDKDGYVTIGADQVIFLMELGTTNKSKSYYDMQDLVVLATFEVVATEEDVAELEKQVQEAKEALITATTDANAAAEAAAEAAAKAETAVIAAEAAAEAAAEAAEDVEAAEEAVLEAEETEKMCRNGNTQNQNNGFGNGDQDAPGNSLENNNAENAQGNNGNTNPNSTSSEADNSAEIAELEEKIEEWTTKHQKFVKNGKKNKAKNILKKIEAAQAELEALN

SEQ ID NO: 10868 - protein, 345 aa, Streptococcus pneumoniae TIGR4
MKSAVYTKAGQVGLASIERPQIIEADDVIIRVVRACVCGSDLWRYRNPETKAGHKNSGHEAIGIVEEAGEAITTVKPGDFVIVPFTHGCGECDACLAGFDGSCDNHIGNNLGGDFQAEYIRFHYANWALVKIPGQPSDYTEGMLKSLLTLADVMPTGYHAARVANVQKGDKVVVIGDGAVGQCAVIAAKMRGASQIILMSRHEDRQKMAMESGATAVVAERGQEGITKVREILGGGADAALECVGTEAAIEQALGVLHNGGRMGFVGVPHYNNRALGSTFMQNISVAGGAASATTYDKQFLLKAVLDGDINPGRVFTSSYKLEDIDQAYKDMDERKTIKSMIVIE

SEQ ID NO: 10869 - protein, 567 aa, Arabidopsis thaliana
MGFGTSSSSSSSSALKWLGFVTAVWVQSISGNNYTFSNYSGALKSLMNLTQLELNSLSVAKDVGKAFGILAGLASDRLSTPVILLIGSFEGLLGYGVQWLVVSRTIQPIPYWQMCVFLCMGGNSTTWMNTAVLVTCIRNFRRNRGPVSGILKGYVGLSTAIFTDLCNALFSSDPASFLVLLSVVPFAVCLTAVFFLREIPPSTTFAEDNEESKYFAVFNIVAVVVAVYLQSYDIIGIKTGAFSIAFASILLILLASPVAVPFHAFIRSKVHDEQDVEGRIDEPLLRSGSEIEVEETIVGAAAAADNELPPSLKPLSNEEEENHGTIVTTEKKRPVLGEEHTIMEAMLTVDFWVLFVSFLCGVGTGLAVMNNMGQIGLALGYTDVSIFVSMTSIWGFFGRILSGTISEHFIKKAGTPRPLWNAAAQIIMAVGYLLMALALPGSLYIGSMVVGVCYGVRLAITVPTASELFGLKYYGLIYNILILNMPLGSFLFSGLLAGLLYDAEATPTPGGGNTCVGAHCFRIVFIVMAFASIIGVGLDLLLAYRTKGIYAKIHASKKTKKSGGNLR

SEQ ID NO: 10870 - protein, 677 aa, Shewanella oneidensis MR-1
MAELKEVFVPDIGGDEVQVIEICAAVGDTLAAEESILTVESDKATMDIPAPFAGVLAELKVAVGDKVSEGTLIALIQAAGASAQAAAPVAQAAAPAPAPVQAAPAPVVAAPATGATKLVEAKVVEISVPDIGGDTDVSVIEVLVAAGDKIEVDAGLITLETDKATMDVPSPFAGVVKEVKVAVGDKVSQGSLVIMLEVGGAAPAAAPQANAPAASAPVAQAAPAAAVAPVAAVPVVAVKEIQVPDIGDASNVDVIEVLVSVGDMISADQGLITLETDKATMEVPAPFAGKLLSLTVKVGDKVSQGSVIATIETTSVATVSAGAATAPVAQAAAPAPVAQEAAPAPVAAAPSRPPVPHHPSAGAPVSTGAVHASPAVRRLAREFGVDLTQVTGSGRKGRIMKEDVQAYVKYELSRPKATAATSVATGNGGGLQVIAAPKVDFSKFGEVEEIPLSRIQKISGPNLHRNWVTIPHVTQFDEADITEMEEFRKQQNDAAAKKKADYKITPLVFMMKAVAKTLQQFPVFNSSLSSDGESLIQKKYFHIGVAVDTPNGLVVPVVRDVDKKGIIELSRELADISIRARDGKLKSADMQGSCFTISSLGGIGGTAFTPIVNYPDVAILGVSKSEIKPKWNGKEFEPKLMLPLSLSYDHRVIDGAMAARFSVTLSGILSDIRTLIL

SEQ ID NO: 10871 - protein, 353 aa, Cryptococcus neoformans var. neoformans JEC21
MSHPGMADPAISIKPQSEISPEASSLTALLAHPLLQDPKFVAAAGGLALLLLFLTREWGMLFRCDMRHLSFGIVFRQGKKTHKRNGPATVLLVGPSDGGKTSLFTKLIHDIYPQTHTSIVPSDTTFDFDSPYEDDQKKQIRLIDIPGHPRLRDEVKKYIADSAGVVFVVDIQGIVRNASGVAEQLPPILTALSNISSRLPPSAPPPKLLLLAHKADLLARPTPSPSHCPPEIPSSTLTTSTDRLKSILTREMDRLKSTRAGTGGKIEGIGKVAGTSGGFFSKLFGGGAGDVAGEDEGDDDESLIWGGKGPFKWEDVEGVEVEWGASGLGSTKGKTEAESGNGLDELKAFLWDI

SEQ ID NO: 10872 - protein, 171 aa, Triticum aestivum
  misc_feature (57)..(57): Xaa can be any naturally occurring amino acid
  misc_feature (66)..(66): Xaa can be any naturally occurring amino acid
  misc_feature (77)..(77): Xaa can be any naturally occurring amino acid
  misc_feature (87)..(87): Xaa can be any naturally occurring amino acid
  misc_feature (120)..(120): Xaa can be any naturally occurring amino acid
GKKKKIEGQSPTIFLQGFTNFLDFLRSPKQFQVISGGLSYVTLKPRGGKAFKYPVLXKLSEEVMLXKVGDLMYDSHXGASRNIIHVXALPMEELVKVCRDNGALGARLTGAGWGGCAVAXLVKEGIVPQFILNLKEKYYKSRIDRGVIKQSDLGLYVFASKPSSGAAILRL

SEQ ID NO: 10873 - protein, 152 aa, Oryza sativa Japonica Group
MAKCSKIRYIVWLRQTLRRWRSRAAARAAAEAVPAGHVAVCVGGASRRFVVRAAHLNHPVFRELLRQAEEEYGFPSGAYCGPIALPCDEGLFEHVLRHLSSPSSAARFVTLEDIQSGALSCCCAAAGDALPLLRHCHRQGRVVNAMCDPTPS

SEQ ID NO: 10874 - protein, 475 aa, Shewanella oneidensis MR-1
MSNEIKTQVVVLGAGPAGYSAAFRAADLGLETVIVERFSTLGGVCLNVGCIPSKALLHVAKVIEEAKAVAAHGVVFGEPTIDLDKLRSFKQKVISQLTGGLGGMSKMRKVNVVNGFGKFSGPNSLEVTAEDGTVTVVKFDQAIIAAGSRPIKLPFIPHEDPRIWDSTDALELKEVPGKLLVMGGGIIGLEMGTVYSSLGSEIDVVEMFDQVIPAADKDVVRVFTKQIKKKFNLILETKVTAVEAREDGIYVSMEGKSAPAEPVRYDAVLVAIGRTPNGKLIDAEKAGVKIDERGFINVDKQLRTNVPHIYAIGDIVGQPMLAHKGVHEGHVAAEVIAGMKHYFDPKVIPSIAYTDPEVAWVGLTEKEAKEQGIAYETATFPWAASGRAIASDCSEGMTKLIFDKDTHRVIGGAIVGVNGGELLGEIGLAIEMGCDAEDLALTIHAHPTLHESVGLAAEIYEGSITDLPNPKAKKK

SEQ ID NO: 10875 - protein, 598 aa, Oryza sativa
  misc_feature (151)..(151): Xaa can be any naturally occurring amino acid
  misc_feature (325)..(325): Xaa can be any naturally occurring amino acid
MDTTIGSVPTASDAAAPAPAANSAPREATLGRHLARRLAEVGARDVFTVPGDFNLTLLDELEAEAGAGHGGVRLVGCCNELNAAYAADGYARARGGGVGACAVTFTVGGLSAINAVAGAFSENLPVVCIVGGPNSNDYGSNRILHHTIGLXPDFTQELRCFQTVTCYQAVVNNLEDAHEQIDAAISTAIKESKPVYISISCNLPSIPHPTFSRHPVPFFLSPRLSNQMNLETAVETAAAFLNKAVKPVLVGGPKMRVAKACKSFVELADACGYPVAVMPSAKGLVPEHHPRFIGTYWGAVSTPFCAEIVESADAYLFAGPIFNDXDPPGCRLLLKKEKAIIVQPDRVVIGHGPAFGCVLMKDFLHALSARLKKNTAAYENYRRIYVPPGEPPLSEPGEPLRVNVLFQHIQKMLSANSAVIAETGDSWFNCQKLKLPEGCGYEFQMQYGSIGWSVGATLGYAKAAKDKRVIACIGDGSFQVTAQEVSTMLRWGQKSIIFLINNGGYTIEVEIHDGPYNVIKNWNYTGVVEAFHNGEGKCYTAKVRTEEELKEAIEEAQGPKKDCLCFIEVIVHKDDTSKELLEWGSRVSAANSRPPNPQ

SEQ ID NO: 10876 - protein, 254 aa, Rhodococcus sp. RHA1
MVELKSAAEVQAMRAAGRVVADALAAVREAAAIGVTLQGLDAVAAAVIRDAGAEPVFLNYHPNWAPSPFPGVICASVNDAVVHGIPGEYRLRDGDLVSIDCGARLAGWCGDAAVSFVVGTADPADIALVEATEAALAHGIAAARPGNRLGDIGAAIGLFARGAGYGMLADHGGHGIGRQMHEDPHVPNEGRVGKGMLLRPGMVIAIEPMLIGDGTDDYRHEADGWTLRTATGARAAHSEHTVAIGEDGPEVLTR

SEQ ID NO: 10877 - protein, 489 aa, Gibberella zeae PH-1
MPQHIRRVAVIGAGPAGAIATDALVKEEAFDTIRVFDRRIVVGGTWVYTPHLPPKVPSLDALVSGEADKRVPIPEYLPAVTPFNERVNSHQQRYSDTPIHENLHSNIAPEIMGYTEEPLPNKLSQQTLKEYGPGAPFRHHTVVRQWVEDLFIRGDHDKLLELRTTVELVVKEGDEWVITLRKVVNGSNYWWKERFDAVVVASGHYNIPWFPVVQGFLDYNQRFPGKILHSKHFRGGQHYRGKRIIVVGASVSAIEVMYEILDFIDGPLYASVRDEPLEYYGWVPLEHPKISVKPAIDRMDPRTGRVWFTDGSYLDEIDHIIYGTGYTFSFPFLPAVQERVKKAHRRLPGVYQHTWDIEDPTLTFVGMIGSFTFKAYEWQAVAVARFLAGRSQPLPLIEDQREWERQRVAERRGGKAYYSIGPDYESFFEWFREFAGEPVRGTTGRVLPPFEPRWLAIWGSMFLPKLDRWRWKKKEAEWKQEFKAKLSRI

SEQ ID NO: 10878 - protein, 525 aa, marine gamma proteobacterium HTCC2080
MLPNNPAFAPVLELTMPSNTTYADNKARAAGYLSRFSLKPAGHFINGKWDPSEGQETFSNLDPATNQSLGEIVAGTEADMDRACEAAANAFPEWAAMPGAARKKSLHHFADLIERRADEIALIESSDCGQAIRFMKQAALRGAANFRFFADKAPEARNGQSLFQPDHTNFTLRSPIGPVGIITPWNTPFMLATWKIAPALAAGCTVVHKPAELSPLSAQLLAEISAEAGIPPGVWNTVQGYGETVGRRLCEHPAIKAVALVGETRTGSQILRQGADTIKRVHLELGGKNPVIVFNDADYDRALDAVIFMIYSLNGQRCTSSSRLFIHNDIREQFLQDVRKRVETLVVGPPLDPATEVGPLIHEGHLKKVMHYLNAAVEDGATVAAGGNRREDLGPGNYVSPTLFIDANNKMRVAREEIFGPVLTAIGFDTEEEVIGLANDTDFGLAGYIWTKDTGRAMRLAQRIEAGMLWVNSENNRNLPSPFGGMKMSGMGRDGGDYSFDFYMETKNVCVAHDTHSIPVLGHHN

SEQ ID NO: 10879 - protein, 352 aa, Bacillus thuringiensis serovar konkukian str. 97-27
MYKGLLNQYASYLPVNENTPDVSLMEGNTPLIPLLNISKQLGIQLYGKYEGANPTGSFKDRGMVMAVAKAKEEGSEAIICASTGNTSASAAAYAARLGMKCIIVIPEGKIAHGKLAQAVAYGAEIISIEGNFDDALKAVRNIAAEEPITLVNSVNPYRIEGQKTAAFEICDQLQRAPDVLAIPVGNAGNITAYWKGFCEYEKEKGYKKPRIHGFEAEGAAAIVKGHVIDEPETIATAIRIGNPASWSYAVEAAEQSHGEIDMVSDEEILHAYRLLAKSEGVFAEPGSNASLAGVMKHVQSGKIKKGETVVAVLTGNGLKDPDIAISSNTLDIASVSNNIEQIREHIKGVIMS

SEQ ID NO: 10880 - protein, 773 aa, Oryza sativa Indica Group
MELHLVLVLLLLLAAAAHPIAFADAGAAGNATTTTYIVFMDPARLPAAGHAAHLQSLAIDPDRHLLYSYSAAAHGFAAALLPHHLPLVRASPGVLQVVPDEVFDLHTTRTPEFLGLLSPAYQPAIHGFEAATHDVVIGVLDTGVWPESPSFAGGDLPPPPARWKGVCEAGVDFSPSVCGRKLVGARSFSRGLRAANGGGGGGARGGVGRKGFVSARDRDGHGTHTATTAAGAVVANASLLGYATGTARGMAPGARVAAYKVCWPEGCLGSDILAGIDAAVADGVGVLSLSLGGGSAPYFRDTVAVGAFGAAAAGVFVACSAGNSGPSGATVANSAPWVATVGAGTLDRDFPAYVTLPTGARLAGVSLYAGPSPSPRPAMLPLVYGGGGDNASRLCLSGTLDPAAVRGKIVLCDRGVNARVEKGAVVKAAGGAGMVLANTAASGEELVADSHLLPAVAVGKLAGDKIREYASRRAAGGAGAPMAMLSFGGTVLGVRPSPVVAAFSSRGPNTVVPEILKPDMIGPGVNILAGWSGVAGPTGLVKDGRRTHFNIISGTSMSCPHISGVAALLKAAHPEWSPAAIKSALMTTAYTVDNTNSSLRDAAGGLLATPFAFGAGHVDPQKALSPGLLYDISTKDYVSFLCSLNYTTPHIQVITKMSNITCPRKFRPGDLNYPSFSVVFKKKSKHVMRFRREVTNVGPAMSVYNVKVSGPASVSVKVTPAKLVFNKVGQKQRYYVIFASTVDASNAKPDFGWISWMSSQHVVRSPIAYTWKI

SEQ ID NO: 10881 - protein, 421 aa, uncultured bacterium
MWTDVDSSHHRGALSAAASEVIAHAAKTARDQRLPLVLSMGSSGADIIEGVAALHGWGRAARAIADCSGVVPTITIVNGPAVSGPALLIGLSDFVIMTADSYAFVTGPTMVAEFTGVEISNDELGGTDAHARQSGVASMVVSDDQSALIALEHLLTYLPSHVDEIALRVNTSDPVDRLTPEAGRAIPNSATGSYDIRKVIRILADDEEMFELRDRWAPNVVTAFITIGGESVGVVANQPMALAGTLDISASQKAARFVSFCDSFNIPLLTLVVSAGFYPGKDLEWRGMIRHGGQLVFAYARATVPRVCVILRKSYGGAYIVMDSKTMGNDLCLAWPTAELAVMGAGQAAAILQRRATAKERAAFESDYSERLLNPYIAAERGYIDAVIDPSETRREIAAAFVMLRDKRERLISRKHDNTPL

SEQ ID NO: 10882 - protein, 176 aa, Synechococcus sp. WH 8102
MKHTLSVLVEDESGALSRIAGLFARRGFNIDSLAVGPAEADRQSRLTMVVEGDDQTLQQMTKQLDKLVNVLQVLDLTQRPAVERELMLLKVSAPAETRSAVFDLVQVFRAKVVDVADEALTLEVVGDPGKLVALERLMAPFGILEIARTGKVALERASGVNTELLKVSPSENRVPA

SEQ ID NO: 10883 - protein, 498 aa, Oryza sativa Indica Group
MAILLLVALFYRIKKQAAAMAAKRKQQPKLPPGLATMPVVRNMHQMLMNKPVFRWIHRLLDEMDTEILCLRFGRVHVIAVASPEMAGSFGYKNTIMSPGGDQWRKMRRVLTSEILSPAMERRMLGRRVEEADHLVNYVYGHCNDGTVDVRHVTRHFCGNIIRKLVFGRRHFNSGDGNIGPGRDEEAHIDALFTALDYHGAFSVSDYFPTLVGLDLDGHEEVVNGLMNTFNRLHDPIIMERIEEWKSLRTKGDKRREVADFLDVLISLEDAQGKPFLSVDEIKAETLEIILATVDNPSNAVEWALAEMVNNPKVMKKAVDELDMVVGRERLVEESDIHNLTYLKACIREAFRLHPYHPFNPPHVAIADTTVAGYMIPKGSHVMLSRIGLGRNPRAWDKPLEFQPERHLKNTGTVVLAEPELRFVSFSAGRRGCPAVSLGTSITMMLFARLLQGFSWSIPPGGDRIELQESATSLQLSKPLFMQAKPRLLLHLYEADVLN

SEQ ID NO: 10884 - protein, 533 aa, Agrobacterium rhizogenes
MARRRCKHAFLCGNGVTLRETDMADKIHDLFVIGGGINGCGIARDAVGRGYSVALAEMNDFASGTSSGATKLIHGGLRYLEHYEFRLVRESLMEREVLWAMAPHIIWPMRFVLPYQKGGIRPAWLIRLGLFLYDHLGGRKLLPPTAVLDMRRDEAAKPLKALFSKAFEYSDGWVDDARLVVLNARDASDKGALIMPRTKVVSARRENGLWTIETVDTVSGIAAVHRARMLVNAAGPWVDHVIRGAFGKNEARNVRLVQGSHIVVKKKFEGPRAYFFQNPDNRIIFAIPYEDEFTLIGTTDRDFSGDPKDVRISQEETEYLCKAASEYFKEPVRQDDIVWTYAGIRPLFDDGATKAQEATRDYVLKLDGFVGSEVNRAPLLNVFGGKLTTYRRLAEHALEKIGEAIGTKGAPWTAKSHLPGGDFPVQGYEAEVTKLHKAYPFLAASHARRLVRRYGTRASVLLGTAGKIEDLGRLFGSDLYEAEVLYLMAHEWARTTNDILWRRSKKGLHLSHSEVALLDQFISEIIQRQVAAQ

SEQ ID NO: 10885 - protein, 361 aa, uncultured bacterium
MKHRIAVIAGDGIGQEVMPEGLRVLDAACRQFGLDLEFVSFDWAHCDYYLQHGQMMPDDWFAQLKDFDAIYFGAVGWPATVPDYISLWGSLLKFRREFDQYANVRPVRLMPGIPCPLAGKQVGDIDFYVIRENTEGEYSAVGGRMFEGTERETVIQESIFTRQGTDRILKFAFDLAQRRPKKHLTSATKSNGIAISMPYWDERVEAMAGHYPEVRWDKYHIDILTARFVLSPERFDVVVASNLFGDILSDLGPACTGTIGIAPSANLNPDRTFPSLFEPVHGSAPDIAGQGIANPVAMIWSGAMMLDFLGQGDSRYQAAHDAIMAAIEQVLVGGPRTPDMGGTASTVELGRAIAAALEGRD

SEQ ID NO: 10886 - protein, 335 aa, Agrobacterium rhizogenes
MTITPDIELGAYLHETKVDPALASLVESIAASAIVVADHLKEAAFQNHIGSSGTTNVQGEDQKLLDVLADRVFRETCGEAVSLAAYVSEEAEEVTWLKPPAAGDLILYVDPLDGSSNLEVNLSVGSIFAVSQVQADGDTNVLRKGREYLCAGYAIYGPSTLFVITFGLGVVGFTLDPSDGQFKLTNARMRVPTETTEFAVNSSRQRFWDEPIRRYVDECLAGSAGPRGQDFNMRWTASMVADVHRILTRGGVFLYPADESNRRAGGKLRLMYEANPMAFLVEAAGGAASTGTEDILRIQPQAHHQRVSVLLGSSNEIQRLVQFHQIHHSQEEIGS

SEQ ID NO: 10887 - protein, 188 aa, Triticum aestivum
  misc_feature (169)..(169): Xaa can be any naturally occurring amino acid
  misc_feature (178)..(178): Xaa can be any naturally occurring amino acid
TDASQDGGSKENPENNPDCTTVYVGNLGHEVNRDELHRHFYSLGVGAIEEIRVQQDKGFGFVRYSTHGEAALAIQMGNGLVVRGKPIKCSWGNKPTPPGTTSKPLPPPVAPYQPAVAMPGVPQGFTAAELLAYQRQLALSQAAAGQIAGQHGLAGQVSAGLLAAAGSQXALYDGYPNXSSAQQLMYYN

SEQ ID NO: 10888 - protein, 419 aa, Oryza sativa Indica Group
MKNTSSLCLLLLVVLCSLTCNSGQAQVLFQGFNWESWKQQGGWYNMLKGQVDDIAKAGVTHVWLPPPSHSVAPQGYMPGRLYDLDASKYGTAAELKSLIAAFHGKGVQCVADVVINHRCAEKKDARGVYCVFEGGTPDDRLDWGPGMICSDDTQYSDGTGHRDTGEGFGAAPDIDHLNPRVQRELTDWLNWLKSDVGFDGWRLDFAKGYSTDIAKMYVESCKPGFVVAEIWNSLSYNGDGKPAANQDQGRQELVNWVNAVGGPAMTFDFTTKGLLQAGVQGELWRLRDGNGKAAGMIGWLPEKAVTFVDNHDTGSTQKLWPFPSDKFYDHMFDWNLKQEITALAAIRERNGINAGSKLRIVVADADAYVAVVDEKVMVKIGTRYDVGNAVPSDFHQTVHGKDYCVWEKGSLRVPAGRHL

SEQ ID NO: 10889 - protein, 282 aa, Pseudomonas putida GB-1
MTDTARLLRSRSFVELGARQRARVVLDPGSFRELLGPFDRLMSPWLPRQGIVPQADDGVVIAKGLLNGRNAVVAAIEGGFQGGSMGEVGGAKIAGALELAIEDNRNGIPTCAVLLLETGGVRLQEANLGLAAIAEIQAAIVELRAWQPVIGLIAGSVGCFGGMSIAAGLCSHLLVTREARLGLNGPQVIEQEAGIGEYDAKDRPFIWSLSGGEQRHASGLVDAYVADDIEALRERLQQLLGQPSKDRASQHAWFLARLAQLGDDCPQLDAAAVRALYQGETQ

SEQ ID NO: 10890 - protein, 418 aa, Oryza sativa Indica Group
MKNTSSLCLLLLVVLCSLTCNSGQAQVLFQAIVDDIAKAGVTHVWLPPPSHSVAPQGYMPGRLYDLDASKYGTAAELKSLIAAFHGKGVQCVADVVINHRCAEKKDARGVYCVFEGGTPDDRLDWGPGMICSDDTQYSDGTGHRDTGEGFGAAPDIDHLNPRVQRELTDWLNWLKSDVGFDGWRLDFAKGYSTDIAKMYVESCKPGFVVAEIWNSLSYNGDGKPAANQDQGRQELVNWVNAVGGPAMTFDFTTKGLLQAGVQGELWRLRDGNGKAAGMIGWLPEKAVTFVDNHDTGSTQKLWPFPSDKVMQGYAYILTHPGVPCIFYDHMFDWNLKQEITARGGDQGEERHQRREQLRIVVADADAYVAVVDEKVMVKIGTRYDVGNAVPSDFHQTVHGKDYSVWEKGSLRVPAGRHL

SEQ ID NO: 10891 - protein, 236 aa, Agrobacterium rhizogenes
MNGLTADLAEIEKVAWNIGELNADVAICPPATLLQSAVRIIAGSRLLLGAQDCSAQEAGAHTGDISARMIADSRARVVILGHSERRQYQGETDAMVRRKAEIAVSAGLMPVICVGETEAEHLRQETLTVLKNQLQGCLPAEMNELALVIAYEPVWSIGTGRLPEQSEILAAHACIRSSLIDAYGSIGAQLRILYGGSVKPENSAEILALENVDGVLVGGASLRAESFLRICEATGR

SEQ ID NO: 10892 - protein, 416 aa, Rhodococcus sp. RHA1
MVADTPPPPGGRVRPQRRYWVRTLAMAGPAFIAGAWQFGPGNLASAVQAGSEYSYSLIWVIAVSTIFMLVYADMSVRLGIRTPASMISSVKDILGRRVGVSAGVGVFIITLCFSVGNAVGSGLGLSMVFGGSPIVWSAVCTVFVGLILLFRNVYRTVERVLLVIVALLAATFVFSAVIAQPDWFQAVHGLVPSIPPGGQLLVVALVGTNFSLNAAFFTSYGTHERKRTAAEYRQTTIADTIPGIVAPGIMTSLVIIVAAAVLGRQNTEATTLAGLAKIFEPIAGPIGSTIFALGLSGAAFSAMVANATAGGTMLSDALGKGPSPSTPTAKRTSAVILGFGLLITILFTKSPVQLIIFAQALTVLIAPFLGLLLFVMSNNRQLMGNLRNTWWKNIIGALGFLSILSLSGLLIYELLG

SEQ ID NO: 10893 - protein, 233 aa, Streptococcus pneumoniae TIGR4
MTKTILVTGGTSYIGSHTVKALLNAGYQVHVLDNLSTGNRAAVDSRASFKELDVYDASALKAYLEENQIDAVLHCAGEIVVSESIENPSKYFTANVAGMNQVLKVLSEVGIQKIMFSSTASLYGNNCIDKPVTEDTLLDPVNPYAETKLMGERMIYWMANRYDWKYVIFRYFNVAGAEMDASNGLRVKNPTHIIPNINKTALGQNDSLKIFGDDYDTRDGSCIRDYIYVLDLA

SEQ ID NO: 10894 - protein, 119 aa, Chlamydomonas reinhardtii
MTNLSDVLPTLKRFDNDVEEVLASSGHVAMYTMVVESSQWTRRNVEGSLFILKRKSSPRFRLMVLNKLSTENYFEDIHAGLAFEKNPPYLMYTHGNAEIIGVWFYEQGDLSRVEEVLER

SEQ ID NO: 10895 - protein, 267 aa, Shewanella oneidensis MR-1
MDGLTGKVVIITGASEGIGRALAIAMARIGCQLVLSARNETRLASLALEVANYGPTPFVFAADVSSASQCEDLIHATIAHYGRIDILVNNAGMTMWSRFDELTQLSVLEDIMRVNYLGPAYLTHAALPYLKSSQGQVVIVASVAGLTGVPTRSGYAASKHAVIGFFDSLRIELADDNVAVTVICPDFVVSQIHKRALDGAGKPLGKSPMQEAKILSAEQCANMMLPVIATRGRLLITSLRGRLGRWLKLIAPGLIDKIARKAIASGR

SEQ ID NO: 10896 - protein, 379 aa, Burkholderia thailandensis E264
MMRDAANFEPADSRVTRPAFWQALPERWTSDVEETLVCCHVRQETHDVKSFFFRSPQGRAFSFEPGQFVTLELDIDGETINRCYTISSSPARPHTISITVKRVPGGKVSNWLHDNLRPGAPLRVLGPAGEFTCARHPARKYLFLSAGSGVTPLMSMSRAHHDLAEDRDIVFVHSARTPDDIIFARELDLIASTHANFRTAFVCERLGARTNWHGVTGFLSLLLLKLIAPDFLEREIFTCGPAPYMKAVRDLLAEAGFDRGRYHEESFSFETLAQSDVRTEAPAGDAASDAQARRHTVAFAKSNREIACGADEHVLDAARRAGVRLPASCTQGMCGTCKVKLVSGQVDMKHNGGIRQREIDQGMVLLCCSKPLSDLVVDK

SEQ ID NO: 10897 - protein, 368 aa, marine gamma proteobacterium HTCC2080
MKTRAAVAFEAGKPLEIVDVDLQGPQAGEVMIEIKATGVCHTDAFTLSGDDPEGAFPAILGHEGAGVVVEVGAGVTSVKPGDHVIPLYTPECRECNFCLHPKTNLCQAIRETQGQGVMPDKTSRFSLDGKPLLHYMGCSTFSNFTVLPEIAVAKVREDAPFDKICYIGCGVTTGIGAVAFTMNVEAGSTVAVFGLGGIGLNVIQGARLVGATRIIGVDLNNDRIEMAKRFGMTDFVNPNEVDNVVDHLVQMTGGGVDYSFECIGNVNVMRQALECCHKGWGQSCIIGVAGAGQEIATRPFQLVTGRSWRGTAFGGARGRTDVPKIVDWYMEGKINIDDLITHQMPLSDINKAFDLMHSGESIRSVVVY

SEQ ID NO: 10898 - protein, 252 aa, Streptomyces coelicolor A3(2)
MRLADRTALVTGATSNIGRAIAEAFAAEGAHVVVSGRSAERGREVVDGIRAAGGRADFVHADLDGSAAASRALAREATRVLGGRVDVLVNNAGIYPPGTTTDTDEETFDRVYAVNVKAPFFLTAVLAPAMVRAGGGTVINLGSWIARLGVPVGALYSSTKGAVETLTRAWAAEFGARGVRVNAISPGVVQTPPPGEVHPAEVMMRGTPAGRMGTPEAIASAAVYLAGDESSFVHGTVLDVDGGRTAAAVIAA

SEQ ID NO: 10899 - protein, 247 aa, Brucella melitensis 16M
MGVGGYFAPLAEQGRNALCMEVRRFNLVISPLIYQRPIMRDPIETVMNLVPMVVEQTNRGERAYDIFSRLLKERIIFVNGPVEDGMSMLVCAQLLFLEAENPKKEINMYINSPGGVVTSGMAIYDTMQFIRPPVSTLCMGQAASMGSLLLTAGATGHRYALLNARIMVHQPSGGFQGQASDIERHAQDIIKMKRRLNEIYVKHTGRDYDTIERTLDRDHFMTAQEALEFGLIDKVVEARDVSADESK

SEQ ID NO: 10900 - protein, 268 aa, Gibberella zeae PH-1
MTSSHAIYPSLRGKTVLITGGAEGIGSATVELFSLQGCQVIFIDIAEDSAQKTIDRVISRQKDSNSPIKPPIFYKCSVADLPELQETVKSIQDKHGAVHVLVNNAAAAGNRARLTTENVTSDDWDFNVNTNLRHVFFLTQAVIPAMKEAGSGSIINLGSITWRIPAAGTPVYGACKAAIMGLTRTQSKEYGKYNIRINSVMPGAIATQRQRDEVLTPEYREEVMRGQSLQRDLEPEEVAKVIVFLGSDEASGVTGSSYVVDGGWCSDP

SEQ ID NO: 10901 - protein, 428 aa, Thermobifida fusca YX
MRGERLMALTATESVTSATGSFGSASALSCRECGARYDLGPIFACIECFGPLEVAYDFGTVTRESIEQGPKNIWRYKALLPVPVDVEKLPNMNPGLTPLVKADRLAAELGLRSLYVKDDSANPTHSFKDRVVAMAVEAARVFGFTTLSCSSTGNLAGAVGAAAARAGFRSCVFIPAGLEEAKVVMAAVYGGQLVAIEGTYDDVNRFCSELIGDPAGEDWGFVNVNLRPYYAEGSKTLAYEIAEQLGWRVPDQIVIPIASGSQLTKIDKGFQELIALGLVEDKPYRIFGAQATGCAPVARAWEKGYTVVQPVKPDTIAKSLAIGNPADGPYVLDVCRRTGGAVEHVSDEEIVDSIRLLARTEGIFAETAGGVTTGVLRKLLAKGVLDPEAETVVLNTGDGLKTLNAVSGTGVTATIKPSLSAFKDAGLL

SEQ ID NO: 10902 - protein, 294 aa, Ralstonia eutropha JMP134
MTEFASWMRAQGARTEAALDQTLPNADTVPHTLHEAMRYAVLGGGKRVRPLLVHAAGEVTGASAEACDAAACAVEMIHAYSLVHDDMPCMDDDDLRRGRPTVHKAYDEATALLVGDALQTQAFIVLAQAQSVQAEARLKLVAELAVASGSVGMAGGQAIDLQNVGKAMSRDALEAMHRMKTGALLRASVRMGALCGEIDAQGLSALDRYAAAVGLAFQVVDDILDVTADTATLGKTAGKDAAHDKPTYVSLMGLEAARALAAELRESAHAALAGFGARAGRLADLADLIVLRTH

SEQ ID NO: 10903 - protein, 638 aa, Ralstonia eutropha JMP134
MTYALLKKIDAPADLRKLDRRELRTLADELRAYVLESVSQTGGHLSSNLGTVELTIALHYVFHTPDDRVVWDVGHQSYPHKILTGRRERMNTLRQFGGISGFPRRSESQYDTFGTAHSSTSISAALGMALGARTLGEQRVSIAVIGDGAMTAGMAFEALNNAGVYKDLPLVVVLNDNDMSISPPVGALNKHLARLLSGQFYAATKKGIEKVLSVAPPVLEFAKRFEEHAKGMMVPATLFEEFGFNYIGPIDGHDLDSLVPTLQNIRKRALEGAGPQFLHVVTKKGQGYKLAEADPILYHGPGKFNPAEGIRPAAKPARKTYTQVFGEWLCDMAAADKRLIGITPAMREGSGMVEFEKRFPERYYDVGIAEQHAVTFAGGMACEGLKPIVAIYSTFLQRGYDQLIHDVALQNLPVVFALDRAGLVGADGATHAGAYDIAYLRCIPNMMVMTPSDENECRQLLTTAFHQNCPTAVRYPRGAGQGVATEAVLKDVPVGKGVMRRTGGARSGQRVAFLGFGSMVHPALGAAQALDASVADMRFVKPLDVELVKRLAEEHNYLVTVEEGSVMGGAGSAVLEALAEAGIDIPVLVLGLPDRFIDHGDPALLLSQCGLDAAGIERSVRERFGIGQAPVAVASRVA

SEQ ID NO: 10904 - protein, 370 aa, Oryza sativa Indica Group
MAASISSALLLLLNMAGALLSPRAPPPAPAALTGAGDGEDVDFFFFPFLVLYKSGRVVRFIGTDTVPASMDPATGVASKDVVIDADAGLAVRLYLPNVANLTAGKRGGGDKLPVVVFYHGGGFVTESAFSPTYHRYLNALVSKARVVAVSVEYHLAPEHRLPRAYDDAWAALRWVLENAGAGPEPWLSRHGDTARLFLVGDSAGGNIAHNVAMRAGGEGGLHGGAAIRGVALLDPYFWGKRPVPSETADPATRRWRERTWGFVCAGRYEVDDPVIDPVAMARGEWRRLGRARVLVTVASLDTLSARGRAYVAAARASGWGGEAVLYETPGENHVYFLVEPDGEKAAKEMDAVVAFINEGEQVITASRMDA

SEQ ID NO: 10905 - protein, 329 aa, Oryza sativa Indica Group
MNPDTEVDFDFSPLLIRYKSGRVHRLMGTARVDAGTDAVTGVTSKDVVIDAQSGGLAARLYLPGGVPRCEKLPVVVYFHGGGFVVHSAFSRVHSRFLNALVAAAGVVAVSVDYRLAPEHPLPAAYDDAWAALRWTVASCSASGGPEPWLAEHGDAARIFVAGDSAGANIAHNVTMRAGKDGLPGGARIEGMVLLHPFFRGGELVPSERADPELPRRAEKSWGFMCAGRYGIDHPFINPLSTPAEEWAALGCRRALVTVGELDTMRDRARMYVEALRGSAWEGEEAALYETGGEGHVYFLEEAAAAAGGDKAEAELDAVVSFIKRSSAAT

SEQ ID NO: 10906 - protein, 443 aa, Klebsiella pneumoniae subsp. pneumoniae MGH 78578
MSSDKVQILVVDDDVSHCTILQALLRGWGYQVGLAHNGLQALEQIHQQVFDLVLCDIRMAEMDGIATLKEIKAYNPAIPVLIMTAFSSVGTAVEAIKSGALDYLVKPLDFDTLQQTLVQALAHTRQSESDPSVATDSRWGMIGDSPAMQALLNDITLVAPSDATVLIYGESGTGKELVARAIHACSERRDKPLVTLNCAALNESLLESELFGHEKGAFTGADRRREGRFVEADGGTLFLDEIGDISPVMQVRLLRAIQEREVQRVGSNQTLAVDVRLIAATHRNLAEEVSAGRFRQDLYYRLNVVTIEIPPLRRRREDIPQLAQHFLKRYTERNRKTVKGFTPQAMDLLIHYPWPGNIRELENAVERAVVLLTGNYISERELPLAIAGTPLPSVGSEEGGIQPLVEVEKEVILAALEKTGGNKTEAARQLGITRKTLLAKLSR

SEQ ID NO: 10907 - protein, 330 aa, Acidovorax sp. JS42
MKIVVLGAGAWGTALAMSAAAHAACHEVTLWARDAQQAQAMQAKRQNQRYLPGLAFPPGLHVASGDMGALAADADLVVVGTPMAALRGMLERLDGCAAPIAWLCKGFEADTGLMAHEVCAQVAPRLHSGVFSGPSFAQEVATAQPTAMVAASPRATVRDALVQAFHGPALRVYASEDIVGVEVGGAVKNVLAIATGLCDGLQLGMNARAALITRGLAEMTRLGLALGARPETFMGLSGLGDLVLTATGDLSRNRRVGLLLAEGRTLAQAVESLGHVAEGVYSARTVVQRARAVGVEMPIAECVVALLDGELRAAEAVARLMEREPTVERH

SEQ ID NO: 10908 - protein, 333 aa, Oryza sativa Indica Group
MASRSLFALLVVAAAMCASVASALRSRAATDPNMEVKFDFTPFLIQYRSGRVQRLMGTTVVAPSLDVRTGVVSKDVVVDRSTGLAVRLYRPKHRGGRLPVLIYFHGGAFVVESAFDPVYHNYLNALAAKAGAIAVSVNYRLAPEHPLPAAYDDAWTVLRWVAADMQRGADSWLARRGDASRLFVAGDSAGGNIAHNLAMRAGQHGGGATIRGVALLDPYFLGKYVDPTAQRAWGFICAGRYGMEHPYVNPMALPAASWRRLATSRVLMTVSDLDRLGPWQRAYVDALRGSGWPGEARLYVTPGEGHCYFLNNLESPKAAMHMATLAAFINRDT

SEQ ID NO: 10909 - protein, 320 aa, Oryza sativa Indica Group
MGEPDDEITFEFLPLIRCYRSGRVDRLLPDTRVPPSVDAATGVASRDVTIDPATGLWARLYLPDLDGGERKLLPVVVYLHGGGLVVGSAADALEHGFANRLCARARALVVSVDYRLAPEHPVPACYDDAWSALHWAVAAASADPWLRDHGDRERVFVLGYSSGGNIAHNVTLRAGAEELPGGASVKGMALLHPYFMAAKKADGEVKNAWLRGKLEEMWALACGGGRTTAGLDDPRINPVADGAPSLRRLGCDRVLVCLADDELEVRGKAYYDGLLESGWAEDAAELLVSGEDHEYVHRDPDSAKAVVVMDRLAALFGGKN

SEQ ID NO: 10910 - protein, 247 aa, Acidovorax sp. JS42
MHKLVLIRHGESTWNLENRFTGWTDVDLTPTGIEQAKNAGRLLKAEGYDFDLAYTSVLKRATRTLWHCLDEMDRTWLPVEHSWRLNERHYGALQGLNKADMAKQYGDAQVLVWRRSYDTPPPALEPTDPRCERGDIRYAGLAPEQVPLTECLKDTVARVLPYWNEAIAPTIRSGKRVLIAAHGNSIRALVKYLDGISDQDIVGLNIPNGIPLVYELDAELKPLRSYYLGDAEATAKAAAAVAAQGKA

SEQ ID NO: 10911 - protein, 469 aa, Stenotrophomonas maltophilia
MLPILPVILSGGSGTRLWPLSREAYPKQFLPLVGDATMLQATWNRVAAIAGKAPIVVANQEHRFMAAEQLRECNVTPQALILEPIGRNTAPAIAIAALQALAAGEDALLLVLPSDHVVRDDAAFHAAVQQAAVAADAGKLVTFGIVPTSPETGYGYIKAQAGAGVHAVDRFVEKPDLATAQQYVASGEYYWNSGMFLFKASRYLQELEALQPAILAACRTALERASRDSDFIRLDADAFATSPSDSIDYAVMEKTADAAVVPLDAGWNDVGSWSALWEVSDKDADGNAWHGDVIALDCSNSYAYGNRLIAMVGLEDVVVVETDDAVFVGHKDRVQDVKEIVGRIKRDGRSEAAAHRKVYRPWGAYDSIDNGARFQVKRITVKPGATLSLQMHHHRAEHWIVVSGTAEVTRGEEVILLTENQSTYIPLGVTHRLKNPGKLPLELIEVQSGSYLGEDDIVRFEDQYGRAPA

SEQ ID NO: 10912 - protein, 453 aa, Rhodococcus sp. RHA1
MVTNPLDDAPLSRFHKKLAVFSSGGPFLDGFVLSIIGVAMIQIADQWGLSSVEQGLVGASSLIGILLGAFAGGWLTDRFGREVLFTVDLIAIAAFSVAQFFVQDVIWLIVLRLLIGMAVGADYPIATSLLTEFTPRKYRGPFLGAFVAMWFVGAAAAYVVGQVLAETGNDNAWRWMLASATVPAVLIVVARVGTPESPRWLVGKGRIDEANKVLRKVFGPGVSVADLPAEDENSVSVKELLRSGYGKRMAFITLFWTCSIVPLFAVYAFAPAILGALKLEEDAAHIGSAVITILFLVGCIIALFLVNRMGRRPLLIHSFLWAGLALLLMGAFPEAPTTIIMVLFAAYAVLIGGTQILQWVYPNELFPTEIRGTAVGMASSLSRIGAAIGTFLVPLSLSGLGIGATMLIAAVITLLGAVLSHFWAPETRGLSLTESASLGIASSPVSPARASRS

SEQ ID NO: 10913 - protein, 68 aa, Glycine max
MTTSRRLADRKVEKFEKNITKRGFVPDTTTKKGKDYPVGPVLLGCSVFVVIGSSLFQIIRTATSGGMA

SEQ ID NO: 10914 - protein, 1311 aa, Bacillus anthracis str. Sterne
MLDWMKKLFNKEEEQTAMNKEVPKQVESQPKIPRVNHYTEAREAQMASRNAGKCRFPLVPDNGFDEEDVIETGHFEEQPVQAVTYENEPIQRGIKVERSRRQYVEKVVSTYEEPEMQYEPEREPVVKKASTPAQESNRRPFRPTEMISPIYGYNRPSVEKKEEKQEEVKEREDLEISVEGKSVVDAWLEKKGYTLSDFSEGQAPTSSSHRAANEQGERQYEESKKEEKSVVDQWLEKNGYEIERQEPIVEEKEVVQEMSAPQEVPAAELLHETIAERMEGAKQESDVVDKNILQEELVDSKVEHEDTILSEEIKRSTEIEQPTIEVEKQAPEESVIVKAEEKLEETIVVEIPEEVEVIAEAEEPEEVEVIAETEESEEVEVIAETEESEEVEVIAETEELEEVEVTAETEELEEVEVVAETEELEEVEVIAETEKLEELEEVEVIAETEESEEVEVIAETEAPEEVEPVALEEMQQEMVLNEAIEQKNEFIHVAVADEQTKKDVQSFADVLIAEEQSVVEETPIVEEQPVAEEAPVVEEQSVVEETPIVEEAPVVEGQSVVEEAPIAEEQPVAEETSVVEEQPVAEETSIVEEQPVAEEAPVVEEQPVVQKEEPKREKKRHVPFNVVMLKQDRARLMERHASRTNGMQSSMSERVENKPVHQVEEQPQVEEKPMQQVVVEPQVEEKQMQQVVEPQVEEKPMQQVVVEPQVEEKPMQQVVVEPQVEEKPMQQVVVEPQVEEKPMQQVVVEPQVEEKPMQQVVVEPQVEEKPMQQVVVEPQVEEKPVQQVVEPQVEEVQPVQQVVAEQVQKPISSTEVEEKAYVVNQRENDVRNVLQTPPTYTIPSLTLLSIPQQAALDNTEWLEEQKELLDTTFNNFHVGAHVINVSQGPAVTRFEVQPDPGVKVNKITNLSDDIKLSLAAKDIRIEAPIPGKSAIGIEVPNKESKPVFLREILRSPVFTKSESPLTVALGLDISGDPIVTDIRKMPHGLIAGATGSGKSVCINAILTSILYKAKPHEVKLMLIDPKMVELAPYNSVPHLVAPVITDVKAATAALKWAVEEMERRYELFAHAGARDLTRYNTIVSGREIPGETLPYIVIVIDELADLMMVAPGDVEEAICRIAQKARACGIHLLVATQRPSVDVITGLIKSNIPTRIAFTVSSQVDSRTIIDIGGAEKLLGRGDMLFLGNGTSKPVRVQGVYVSDDEIEKTVDHVKKQMKPNYLFKQEDLLAKTEQAESEDELFLDACQFVVEQGGASTSSVQRKFRIGYNRAARLIEEMESQGIISEGRGTKPRDVLISEDEFAAMQETNV

SEQ ID NO: 10915 - protein, 220 aa, Triticum aestivum
  misc_feature (137)..(137): Xaa can be any naturally occurring amino acid
  misc_feature (145)..(145): Xaa can be any naturally occurring amino acid
  misc_feature (164)..(164): Xaa can be any naturally occurring amino acid
MTSVWKTKVLPGLNKIFDKDGKKAAAAEFLKSFNKEEIDKEIGDKKTELEPKVVETIEASPPEIKGLMKDKKTSKIKKNSVAVTKFLDDLAKIDFPGAKLVSDAVAKSGTTPLSPAIVFILDKVAPFVPAPKEEPKXPEPEAAAXAEETTTREVARGGEEEKKXEPLAATGRNGRPCVFLKGPQVTRTQLFLDKGVPLGSRIIRQGLGRRFTTPGTGKTA

SEQ ID NO: 10916 - protein, 388 aa, Oryza sativa Japonica Group
MVSDRDFPSCFDSVLRSSGAPPGEASLAAVLSQAEAKLGVDLAHKATFIRDQMDLFFGPRLQPPLVAKAQAAAAAAPNPPPLVAAPAPAMPQVQVQAQLQQMQQQLAVLQPQLIFQAMPQLPAGVPGGAAGAVSPQPPVPAMAFYPPPPLAFRVTSGLAGVATGGTVSFQQPAPGTGGTASPTAAVQAAGDNKESASKRKRGGPGGLNKVCAISPELQTIVGETVMSRTQIVKQLWQYIRQNNLQDPDDKRKIICNDELRVVFGTDTTDMFKMNKLLAKHITPLDPKDQIREAKKFKPSNVATQPMPLINQPSVVISDALAKFIGMEGTVPQDDALRYLWDYIKANQLEDAITGSILCDSKLQELFGCESIPSSGLSELLAHHFIKET

SEQ ID NO: 10917 - protein, 562 aa, Pisum sativum
APPGTERETLMNQAMATPLSLSCCSPTLTRSTLFFTKTFPFSRSFSTPLPLSTKTLISLSPPHRTFAVRAESQNGADPARQYDFDLFTIGAGSGGVRASRFASNFGASSAVCELPFSTISSDTTGGVGGTCVIRGCVPKKLLVYASKFSHEFEESNGFGWRYDSEPKHDWSSLIANKNAELQRLTGIYKNTLKNAGVKLIEGRGKIVDAHTVDVDGKLYSAKHILVSVGGRPFIPDIPGKEYAIDSDAALDLPSKPQKIAIVGGGYIALEFAGIFNGLKSEVHVFIRQKKVLRGFDEEIRDFVAENMALRGIEFHTEESPVAITKAADGSLSLKTNKGTEEGFSHIMFATGRSPNTKDLGLESVGVKVAKDGSIEVDEYSQTSVPSIWAIGDATNRVNLTPVALMEGVALAKTLFQNEPTKPDYRAIPSAVFSQPPIGGVGLTEEQAAEQYGDIDVFTANFRPMKATLSGLPDRVFMKLIVSAETNVVLGLHMCGEDAAEIAQGFAVGIKAGLTKADFDATVGIHPTAAEEFVTMRTPTRKVRKNQASQGKSDSKAKAVAGS

SEQ ID NO: 10918 - protein, 210 aa, Zea mays
MTSSPRCCCCLTACFIAGCSGGRLAAGSAPSDSDAMTVCIQSRVCVTSDDGFLFLSLGSFYDYDLEVTRLDADADAVTDKASGVNLDCKVDLQHVANSARNAEYNPRFARIVQKLGFPARFKDFKVQNIVGSCDLKFPIRLEGLALASGLSATYEPEIFPGLVYRMVDPKVVILVFVSGKIVLTGAKVQEEICAAFEKIHPMLVQFRKRS

SEQ ID NO: 10919 - protein, 245 aa, Streptomyces coelicolor A3(2)
MSGIEGKVVAITGASGGIGEASALLLAERGAKVVLGARRPERLADLALRIGRSGGEAAWIRTDVTRREDVAALVALARERFGRLDVLVGNAGVGLISPLDELRVEDWERMIDVNLKGVLYGIAEALPVFREQGSGHFVNIVSTAGLRISPLMSVYAGTKNAVRTVSEGLRQEAGDSLRVTVVSPGFVHTDFADGIPDAGARAQILDTRDRVAIPPQAVARAVAFAVEQPDGVDVGDIVVRPTAQD

SEQ ID NO: 10920 - protein, 629 aa, Zea mays
MMRGQAWLALLVVVALALADAAAGRFVVEKNSLEVTSPDELKGKYECAIGNFGVPQYGGTLHGWVEYPKSNRKACQSFDQFDISFKPKQAGGRPIFVLVDRGECFFTTKAWNAQNAGAAAVLVVDDKSEPLITMDNPEEGKEHLENITIPSVLITKKLGENLKKSAENGDMLSVLLDWRESLPHPDERVEYEFWTNSNDECGPKCDMQMDFVRSFRGTAQILEKKGYTQFTPHYITWYCPEAFVDSKQCKSQCINHGRYCAPDPDQDFSQGYDGRNVVVQNLHQICVFKIANETGKPWLWWDYVHDFALRCPMKDKKYNNDCAHDVIKSLGLDIENINKCVGDPEADVENEILKAEQDAQIGHGKRGDVTILPTLVINNKQYRGKLDKVAVLKAICSGFEETTEPAICLSEEIQTNECLENNGGCWLDKANNVTACKDTFRGRVCECPIVRGVKFVGDGYTHCEASGVGRCEISNGGCWQETKDGKTISACSNEISEGCKCPMGFKGDGEKSCEDIDECQEKLYCQCKGCSCKNTWGSYECSCGDDNMLYMREHDTCISKEGTATTVGWSFLWVIFFGLVFAGVGAYAVYKYRLRSYMDSEIRAIMAQYMPLDNQEGANQHQVVHANDI

SEQ ID NO: 10921 - protein, 185 aa, Triticum aestivum
  misc_feature (25)..(25): Xaa can be any naturally occurring amino acid
PAVSRDPDCHATLCRAGSGSQVIPXDKNIAKMSSSEQTFIAIKPDGVQRGLVGPIISRFENRGFKLAAIKLVTPGKEHLEKHYADLAGKPFFPGLIEYMNSGPICAMVWEGRDAVKTGRAILGATNPLASSPGTIRGDYAIDVGRNVCHGSDSVENAQKEIALWFKEGEVVSWKSAQFNWVYEKA

SEQ ID NO: 10922 - protein, 347 aa, Saccharomyces cerevisiae
SIPETQKGVIFYESHGKLEYKDIPVPKPKANELLINVKYSGVCHTDLHAWHGDWPLPVKLPLVGGHEGAGVVVGMGENVKGWKIGDYAGIKWLNGSCMACEYCELGNESNCPHADLSGYTHDGSFQQYATADAVQAAHIPQGTDLAQVAPILCAGITVYKALKSANLMAGHWVAISGAAGGLGSLAVQYAKAMGYRVLGIDGGEGKEELFRSIGGEVFIDFTKEKDIVGAVLKATDGGAHGVINVSVSEAAIEASTRYVRANGTTVLVGMPAGAKCCSDVFNQVVKSISIVGSYVGNRADTREALDFFARGLVKSPIKVVGLSTLPEIYEKMEKGQIVGRYVVDTSK

SEQ ID NO: 10923 - protein, 537 aa, Vitis vinifera
MESSFFSHMRAAANSFLSEYEPLNLLLAPLLALLIARILQCFVGVVNEKGLKATILGFLITSVKLVPGVKRYIDAEKQKVVDKLQSGSKSKRDGWSTELPRTGLGEGVIEKMKEEKRNDVVWQGKCSGTVYIGGSESEGHFSLINEAYSMFAHTNPLHMDVFQSVVRFEVEVVAMTAALLGSKEKASGGQICGNMTSGGTESILLAVKTSRDYMKAKRGITRPEMIIPESAHSAYDKAAQYFNIKLLRVPVNKEFQADVKGIRRHINKNTILIVGSAPGFPHGIIDPIEELGELASSFGICFHVDLCLGGFVLPFARKLGYPIPPFDFSVEGVTSISVDVHKYGLAPKGTSVVLYRNHDIRKHQFVAVTEWSGGLYVSPTIAGSRPGALIAGAWAAMISLGQEGYLNNTRETMEVSKKLQRGIKDIPELFVIGRPDMTIVAFGSNVVDIFEVNDILSSKGWHLNALQRPNSIHICLTLQHVTILEDFLKDLKESVQTVKQNPGPINGGLAPIYGAAGKMPDRGMVGELLVNFMDSTC

SEQ ID NO: 10924 - protein, 363 aa, Synechococcus sp. WH 8102
MLKAGIVGLPNVGKSTLFNALVANAQAQAANFPFCTIEPNVGTVAVPDERLDQLTKLSSSIDTIPTRMEFVDIAGLVKGASQGEGLGNKFLANIREVDAIVHVIRCFEDDDVIHVSGSVGPARDAEVINLELGLADLAQIEKRRERLKKQMRTSKEAQQEDAALERIQTVLEDGGAARSVELGEEEALMIKPLGLLTAKPIIYATNVSEEDLAEGNAFCTEVINLAANEGAETVRISAQVEAELIELGDDERSDYLEGLGVSEGGLQSLIQATYRLLGLRTYFTTGEKETRAWTFKAGMTAPQAAGVIHTDFERGFIRAQTIGWEKLIEAGSFAEARNKGWLRSEGKDYVVDEGDVMEFLFNV

SEQ ID NO: 10925 - protein, 573 aa, Haemophilus influenzae R2866
MKKLSGAEMVVQSLRDEGVEYVFGYPGGAVLDIYDAIHTLGGIEHILVRHEQAAVHMADGYARSTGKVGCVLVTSGPGATNAITGILTAYTDSVPMVIISGQVMSNLIGSDAFQECDMLGISRPVVKHSFIVKKAEDIPSTLKKAFYIASTGRPGPVVVDIPKDTVNPNFKYPYEYPEYVELRSYNPTVNGHKGQIKKALKALLVAKKPILFVGGGAITAECSEQLIQFAQRLNLPVTSSLMGLGAYPSTDKQFLGMLGMHGTLEANTAMHESDLILGVGVRFDDRTTNNLEKYCPNAKVIHIDIDPTSISKNVPVAIPIVGNAKNVLEEFLGLLNEEGLKSQTDLESWWQEINQWKAKKCLEFDRTSGVIKPQQVVEAVYRLTKGQAYVASDVGQHQMFAALHYPFDEPRHWINSGGAGTMGFGFPAALGVKLAHPEGTVVCVTGDGSIQMNIQELSTATQYGIPVVIICLNNHFLGMVKQWQDLIYSGRHSQTYMNSLPDFAKLAESYGHVGIKIATPDELESKLQEAFSIKNKLVFVDINVDESEHVYPMQIRGGAMNEMILSKPQEETN

SEQ ID NO: 10926 - protein, 381 aa, Arabidopsis thaliana
MAISDLPRDLVEEVLSRVPVTSLRTVRSTCKKWNIISKDESFTKKHVGQANAAARESEFQVVIMTEYKVYLMSVNLHGIQNNVDPSIEFKCKLISLDDSDRIGISQVHICHGLFLCITNEKNYKLVVWNPYRGQTKCIEHRISYKRWNSYALGYEMKNNSCLSTQNLENCVDFHPVYETEIYNFHSDSWKNIVDSTPEGDMQYFKQGVSLKGNTYWFARKYVIYEGGQEAWVSFLICFDFTTERFGPRLTLPFDYSTKESVSLLSAREEQLVLLYHPWFTMMMEIWVSNKIELNAVSWIKFLEVNMITFPHYRFSFHHVSFFIDKKNKVVVVLDKDKETRSRNLGYFIGDDGYFKEVELGGSRDRNGYPFVFSYVPSSVQF

SEQ ID NO: 10927 - protein, 193 aa, Oryza sativa Japonica Group
MNAWTHGAQMVAFNMQGHDKALRLMQGFFRANGGCGYVKKPDFLLRTGPNGEVFDPNASMPVKKTLKVKVYMGDGWRMDFSKTHFDTFSPPDFYTRVGIAGVRADCVMKKTRTIEDQWVPMWDEEFTFPLTVPELAVLRIEVHEYDMSEKHDFGGQTCLPVSELKQGIRAVPLHDRRGTRYKSVRLLMRFDFL

SEQ ID NO: 10928 - protein, 503 aa, Rhodococcus sp. RHA1
MPNTTLTGHVAVSRAPGGSLNVRDDLPPTQHYIAGAFDAVDNSGPRTDVVDPSTEQVIAAVPQGTAADVDRAVAAAVAAKNDWARLVPKERSLLLHRIADRIEQNSEVLARLESANTGKPFEVSNDDVAGTVDTFRFMAGALRATTSMAAGDYAENHLSVILREPLGVVGVVTPWNYPLLMAAWKIAPILAAGNTVVIKPSEQTPLTTLKFAELVGDLLPVGVFNVVSGLGPTVGARLTEHPDVDMLALTGSVGSGKAVARGAADTLKRVHLELGGKAPVVIFADADLDDAAVSLRAASYWNSGQECGAACRILVHESVAEEFTRKLVEQVSTFVVGEPGAGDTVEIGPLVSKAHFERVTAYLERAAQQGITAAIGGSALDGPGYFVAPTVLVGVPDGAECAREEIFGPVVTVETFTDEDEATRRANDVPFGLSASVWTENARRSHEVAARIDAGTVWVNSHLVLANEVPWGGFKGSGYGRDLSIYALDDYSRTKHVMHNHGR

SEQ ID NO: 10929 - protein, 150 aa, Triticum aestivum
MYFKAQWISIWSLSQLSVLRLMYFKAPCDGRLVILCYRGKEPPGRRNRTERGAMAARNFLVRSPKEEESSAAVREAVLLGGKNAAIAGTVVAVPTLVACRVLPWAKHNLNYTAQALIISAACIAGFFITADKTILRNARQNTIGRIDKST

SEQ ID NO: 10930 - protein, 384 aa, Photobacterium profundum SS9
MSKSALLVLEDGTVFRGISIGADGSAIGEVVFNTSMTGYQEILTDPSYSQQIVTLTYPHIGNTGTNSEDEESNSIHAQGLVIRDLPLLASNFRNERSLSDYLKSQNIVGIAEIDTRKLTRILREKGAQNGCIMAGDNLDEALALDKAKEFPGLKGMDLAKVVTTAETYQWKQGSWTLLDGLPEAKDDSELPYHVVAYDFGAKRNILRMLVDRGCRLTVVPAQTSAEDVLAMNPDGVFLSNGPGDPEPCTYAIEATKTFLDIGLPIFGICLGHQILALASGAKTVKMKFGHHGANHPVKDIDRDVVMITSQNHGFAADEATLPDTLRATHKSLFDGSLQGIHRTDKPAFSFQGHPEASPGPTDAAPLFDHFIELIKLSVNEARSA

SEQ ID NO: 10931 - protein, 375 aa, Vitis vinifera
MLAGLAFKRKWQQKRKSEGKPYDKPNIVTGANVQVCWEKFARYFEVELKEVKLREGYYVMDPVKAVEMVDENTICVAAILGSTLTGEFEDVKLLNELLTKKNTETGWGTPIHVDAASGGFIAPFLHPDLEWDFRLPLVKSINVSGHKYGLVYAGVGWVVWRTKDDLPEELIFHINYLGSDQPTFTLNFSKGSSQIIAQYYQFIRLGFEGYKNIMTNCMDNANVLKQGLVETGRFEIVSKDIGVPLVAFSLKDTSNYTVFDISNNLRRYGWIIPAYTMPPDAEHIAVLRVVVREDFSRSLAERLLSDIEKVMREMDAVQSRATTRATHVIATVDETREGEGEGSEKLNKKTVMENREEIAMYWKRVVDRKKTSGVC

SEQ ID NO: 10932 - protein, 415 aa, Vitis vinifera
MLSTLLSPLGLSRSLKRSPSLPKLSTKPWKAVCEMEATKQLSFDFLTKKPYAPPSWASHLSPIPSHVFSLAHVPTPIHKWNLPNLPKNTQLWIKRDDLSGMQMSGNKVRKLEFLMADAVAQGSDCIITIGGIQSNHCRATAVAAKYLNLDCYLILRTSKVLVDKDPGLTGNLLVERLIGAQIELVSKEEYAKLGSVTLTNLLKERLLKEGRRPYVIPVGGSNSLGTWGYIEAIREIEQQLPTGTDEVGFDDIVVACGSGATIAGLSLGSSLSKLNTKVLAFSVCDDPDYFYDYVQGLLDGLQAGVRSHDIVDIQNAKGLGYAINTTEELNFLKEVAVSTGVVLDPVYSGKAAYGMIKDMAENPSKWEGRNILFIHTGGLLGLYDKVEQMGSLVGKWCKMNIDDSIPRKDGIGKMF

SEQ ID NO: 10933 - protein, 259 aa, Streptococcus pyogenes str. Manfredo
MTHTKEVAFITGAASGIGKQIGETFLKEGKTVVFSDINKEKLDEVVADYTKEGYDAFSVVCDVTKEEAINAAIDTVVEKYGRIDILVNNAGLQHVAMIEDFPTEKFEFMIKIMLTAPFIAIKRAFPTMKAQKHGRIINMASINGVIGFAGKSAYNSAKHGLIGLTKVTALEAADSGITVNAICPGYVDTPLVRGQFEDLSKTRGIPLENVLEEVLYPLVPQKRLIDVQEIADYVSFLASDKAKGVTGQACILDGGYTAQ

SEQ ID NO: 10934 - protein, 360 aa, Triticum aestivum
MPPVNGGAAAGPSSGSRDVHGPAAAATAAPKRNRPRYHAFTQQQLPACKPILAPNMVIPILVFVGLLFIPIGLACYAASNKVFEVVYRYDTKCVPKNMLHNKVGYIQNASINKTCTINLKIPNAMKRPIFIYYQLDRFYQNHRRYATSFNIAQLSDPKEEANADIKDCKPEAYAGKGIPVVPCGLVAWSLFNDTYSFARRPRRAGGIGGGEALRVIKSGISWRSERERLFGKHVYPKNFQNGSLVGGGRLDPRKPLSEQEELMVWMRTAAMPRFRKLYGRVEADLDAGETVAVAVRNSYNSYSFEGGKAVVLSTAGPLGGRNAFLGRAYLVTGMACLVLALLLTLVCLFFPMTEEHLRLR

SEQ ID NO: 10935 - protein, 572 aa, Oryza sativa
MADATAALSELAAALDEEGKGVAAVAAAVKDANKRTALHFAAREGRTHVCHFLISDLALPVDPKDDDGNLDLMKLFLSKGVDVESESDAGTPLIWAAGHGQQEAVKLLLQHDAKASLCLALNHLSISRSCGLSLTFLLKLVIAWQPNTENDDGITPLLSAVAAGSLPCLDILIQAGAHPNIRAGGATPLHIAADGGNMEIINCLLKAGSDPNACDDDGLKPIQVAALRNNREVVELLLPLTSPIPGVSSWSIDGIIEYTKSVEEKAQVKEATTQKADRLQVPQLVEVSSEAKERSLEAKSRGDDAFRNKDYLVAVDAYTQAIELNPNDATLHSNRSLCWLRAGQAERALEDARACRALRPDWAKACYREGAALRLLQRFEEAANAFYEGVQLEPENGELISTKLIDQLARDDEKIKKKTRKPKPKKTVKQHQQEPQDNSRELPASEPKAPPGWPLQPPMYLPVTPAPPPPPPAFSELEAIRAVLEESEKVQEKLDKQHAGMRDELIKKSKDLRDKEFKLPYQNPTPCTEERSNCRQCYVSNAQDPLKCAEAVKRFEACVRLARQRGNTKVAQ

SEQ ID NO: 10936 - protein, 397 aa, Glycine max
MERLKWAQLGERLKMGGAQMGRMVSGKVKEMLQAPTPESKMVDEATLETMEEPNWGMNLRICSMINSDQFNGSEVVKAIKRKINHKSPVVQALSLDLLEACAMNCDKVFSEIASEKVLDEMIRLIDNPQAHHQTRSRAFQLIRAWGESEDLAYLPVFRQTYMCLKGRDEPLDMAGGNSPPVPYASESYAHQYPVDPPERYPIPEAELHDIDDPAAFSSNYQHTSVEERKENLVVARNSLELLSSILNSEAEPKPLKEDLTMSLLDKCKQSLSIIKGIAESTTNDEATLFEALYLNDELQQVVSKYEELEAAQSYGAQQPQNADTDKHDAEAVQNPNEVPKSDESEAAQNLDRKLPQKSNTLKVNATGGEGDGLAETKIVDDGTKEKNAESSFKRDTE

SEQ ID NO: 10937 - protein, 699 aa, marine gamma proteobacterium HTCC2080
MGTVVNYERHGQIGVIRINNPPVNALSHAVRSGIVDALATAAADDSSAVVLCCEGRTFIAGADITEFGKPPQAPSLPDLLHVLDHHPKLTVAAIHGTALGGGFEVALTCNYRIALASGKVGLPEVKLGLLPGAGGTQRTPRLAGLPAAVELITSGNPINAQRAMALQLVDKVAEDNLLDAAIAYSVALVEQSAPQRQASALTLSVSTEDTDLIASMRAKLLKKTRGERAPQRILDCLLAAADSPFETGLKREREEFMACLEDPQSAALRHMFFAERAAGKIDSLPKDTKALDIASVGIIGAGTMGGGIAMCFAQAGIAVTLVDMTDEAVKGGLEKIAKNYAISVKKGRLTVAQTDAILANITTSSSFDDLANVDMVIEAVFENLEVKKEVFGKLDVICKPGAVLASNTSYQSIDAIAAATSRPESVLGMHFFSPANVMKLLEVVKGASSSDIVIATAMAVGKKIGKVSVLSGMCYGFIGNRMLRHYGREAALCLIEGGTPAQIDSAMESWGMAMGPLAVSDLAGLDIGYKAREQLTAEQKGDPASYMVADRLVEAGRLGQKSGAGYYQYDPETRQRQEDPAVMAIVAEARRELGITPRRFEDEEIINRLTLALANEGAKLLQEGIAQRASDIDVVYCYGYGFPRFKGGPMHTVESMGLDKAVSLLNEFHDQLNPEHWQVAPLLTKLVANGGQLADSHRD

SEQ ID NO: 10938 - protein, 421 aa, Arabidopsis thaliana
MNHKNVLLIKLISAILISFFAFRLFILHSSEFSPIFASVTGKFEARFLPPEIIVPENEDLIPQDIEVEKCDLFAGKWIPDSVGPIYTNKSCGSLIDGHQNCITNGRPDLDFLYWKWKPHDCLLPRFDPRRFLQLMRHKSWAFIGDSISRNHVESLLCMLSTIEEPVEVYHDMEYKSKRWHFPLHNLTVSNIWSPFLVQAAIFEDSNGVSTASVQLHLDRLDETWTSLMPSFDYAIISTGKWFLKSAIYHENAKLVGCHNCQEKPHIEELGFDYAYNASLHNVMDFLAAEDNSKGTVFFRTSTPDHFQNGEWHSGGTCKQTEPVSDEEIEIKDVHKILKDIEIDQFKRAVREKTNQDGGNLKLLDFTRMLLTRPDGHPGEYRQFRPFDKDKNAKVQNDCLHWCLPGPFDYLNDVILETIVNG

SEQ ID NO: 10939 - protein, 446 aa, Pavlova lutheri
MRSVVAAAAFFGSAGAFNSRGALRGSLLARRSASTLRGGGVQLADGHYEYLVIGAGSGGIASARRAAQYGAKVAVVERARLGGTCVNVGCVPKKLFFTAGVHMEAMHTAKGYGLDVGTPPKFDWEGFKARRDAYIANLNGIYLRNMQNSKVEFVEGYASFVDAKTVEVTGHGRFTADNILIAAGGKPIHPPVPGGELAKTSDDFFDLEHQPRTAVVVGAGYVAVELAFIMHELGTDTTLVCRGEKVLRHGFDPMVQDVLNSEMERQGISMRRKTELGSIKLAEDGTYEVTFKDGSMLTGIDVVLYAAGRRPILTGMCLENAGVELSDRGFITVDEYERTNVPGIHALGDVTTTGYELAPVAIAAGRRLSDRLYGGEPRARLEYDRIPTVVFSHPPIGTVGLTEPDALEQYGEASVKVYKSSFKPMHYAMCEPDLKLPMAMKLVCVG

SEQ ID NO: 10940 - protein, 219 aa, Parvularcula bermudensis HTCC2503
MKSSSGLTLYLVRHGETVWNRERRMQGQADSPLTKLGRAQAETHADLLARHEVDRIIASPLGRVRETAAVISRRLVVTPDFDDRLMEWSCGDWAGILYSDLSRLWPKEHAAWLGDRYGVRPPGGENMEDLRARAEAFWGEWQDRLTGRVALIGHGLMNRAIAGVLLDLSRAEIMAIRQKNDRIIRLSFTADRPIVHHFAGLRGPLTGLPGERGMTIPVS

SEQ ID NO: 10941 - protein, 240 aa, Triticum aestivum
  misc_feature (71)..(71): Xaa can be any naturally occurring amino acid
  misc_feature (75)..(75): Xaa can be any naturally occurring amino acid
  misc_feature (228)..(228): Xaa can be any naturally occurring amino acid
STGVFTDKDKAAAHIKGGAKKVIISAPSKDAPMFVCGVNEKEYKSDIDIVSNASCTTNCLAPLAKVINEQXGVVXWGLMTTVHAMTATQKTVDGPSSKDWRGGRAASFNIIPSSTGAAKAVGKVLPELNGKLTGMAFRVPTVDVSVVDLTVRLAKPATYDQIKAAIKEESEGNLKGILGYVDEDLVSTDFQGDNRSSIFDAKAGIALNDHFVKLVSWYDNEWGYSTRXVVDLIRHMHSSK

SEQ ID NO: 10942 - protein, 673 aa, Vitis vinifera
MEFEVKREQSIGSPRENNLPRPDQKSQIVEKANEVLEGKVGKEIVIYSKDENSKRKVTSLSGRVNKVPAGDELSQERVTVLCLMAAQNCPWRRQGKGGLNLDSGMSGSKGKKDGLAGLEKSKSIVRAKTDRAEKSGGKSIKRKSSPTRRAENLGMGQLVVKDEEDSIEHYEEQGDFHVGQRLLDFNVSLPPFGPSSSSGKVEACDSIVTRNKVRETLRLFQAIFRKLLQEEEAKTKQGGNPVRRVDYLASRILKDKGKHVNTGKQIIGPVPGVEVGDEFQYRVELGIIGLHRPTQGGYADDLDNSDVLIYSGQGGNLIDQKLERGNLALKNSIDAKNLVRVIRGFKETKAPEYMDSRAKVVTTYIYDGLYLVEKYWQEIGPHGKLVFKFQLNRIPGQPELAWKEVKNSKKFKVREGLCVDDISMGKEPIPIFAVNTIDDEKPPPFTYITSMIYPDWCHRLPPNGCDCSNGCSDSEKCSCAVKNGGEIPYNYNGAIVEAKPLVYECGPSCKCSRSCHNRVSQHGIKFQLEIFKTVSRGWGVRSLTSIPSGSFICEYIGELLEDKEAEQRTGNDEYFSCEVVEDAGFTIDAAQYGNVGRFINHSCSPNLYAQNVLYDHDNKRIPHIMLFAAENIPPLQELTYHYNYTIDQVRDSNGNIKKKSCYCGSDECTGRMY

SEQ ID NO: 10943 - protein, 252 aa, Rhodococcus sp. RHA1
MYTTETPQDAAKYAVGRAAVERYAHDGAQLGLGSGTTSAWFVRALGEKVADGLDVVGVPTSTATRDLALSVGITLVDLNDLDRPLDVTLDGPDEVDHDGDMIKGGGACLLWERMVAEASSKMVCIADDTKLVEQLGSFPLPIEVIPFGWKATRRSISALLTDLGYTDVKIIQRHRNGQPVVTDSGNFILDAHMVAITDKALLDTNLNWIAGVVENGLFTGIAHEILIASPDGAAKLIELPHRNAARIPEWRK

SEQ ID NO: 10944 - protein, 492 aa, Rhodococcus sp. RHA1
MPAELITPERKAHAMTITTLHNYIDGGWVPSETTFKALNPADEKVIAEVPASTATDVDAAVTAARRAFADWRHVNPTVRARYLHTIGDIVKTRERELAEAITTEMGKTIGEATGEVDKLAKAFHFYAEEATRIHGEVIPNDVDGFASMVVQEPIGVIGAITPWNYPLELVGWKLCAALAAGCTIVIKPSQYASLSPALLFACIDEAGLPAGVANLVLGGGETGPAVAGHPGFDKLAFTGSTATGGKIARGVPAAKPLTMELGGSCPMIVTDRADIDAAVAGAARRGFRNAGQICIAINRIYVHETVYSEFVDRLTAKVSELTVGNGMDPTVDVGPMATRAGLDVVDQHVRDAIARGATVTTGGTRIETLAPGNFYQPTVIAGCNPDMLVMHEETFGPVVGVMPFSDLRNAVDLANGTEAGLAAYVYTGDLAQAHDLGRLLDFGNVAVNNVDAGIMNAPYGGRKGSGFGVEHGKAGLEGYLQYKHLRIQYGTR

SEQ ID NO: 10945 - protein, 309 aa, Klebsiella pneumoniae subsp. pneumoniae MGH 78578
MLATLTRLFPLWALLLSVLAYYTPTTFTPIGPWVTTLLMLIMFGMGVHLKLEDFKRVLSRPAPVAAGIFLHYLVMPLAAWLLALLFHMPPELSAGMVLVGSVASGTASNVMIFLAKGDVALSVTISSVSTLVGVVATPLLTRLYVDAHIQVDVMGMLLSILQIVVIPIALGLIVHHLLPKVVKAVEPFLPAFSMVCILAIISAVVAGSAAHIASVGLVVIIAVILHNTIGLLGGYWGGRLFGFDESTCRTLAIEVGMQNSGLAAALGKIYFGPLAALPGALFSVWHNLSGSLLAGYWSGKPIAKKADKR

SEQ ID NO: 10946 - protein, 532 aa, Burkholderia vietnamiensis G4
MKSSIQRNIGPFALMLTGLGSIIGSGWLFGAWKAAKIAGPAAICAWIIGAVVILAIALTYAELGAMFPESGGMVRYARYSHGSLVGFISAWANWIAIVSVIPIEAEASIQYMSTWPYPWAHALFVNGELSTPGLLLSAVLVVIYFLLNYWGVKAFARANTAITIFKFLIPGLTILGLMLSSFHSENLGTASNASFAPYGWSAVLTAVATSGIVFAFNGFQSPVNLAGEARNPSRSVPFAVITSILLALVIYVLLQMAYIGSVNPADVAKGWAHFNFSSPFAELAIALNLNWLAILLYVDAFISPSGTGTTYMATTTRMIYAMERNNTMPKMFGNVHPIYGVPRQAMWFNLLVSFVFLFFFRGWSSLAAVISVATVISYLTGPISLMALRRAATDIERPLSIPLMKLIAPFAFVCASLILYWAKWPLTGEIILLMVVALPVYFFFQAKAGWGGWGADLKAAWWLVAYLPTMAVLSLIGSKEFGGHGVLPYGWDMLVVAVISLGFYFWGVNTGYRTQYLDERESHDEILEGIGA

SEQ ID NO: 10947 - protein, 449 aa, Klebsiella pneumoniae subsp. pneumoniae MGH 78578
MTDLVVAKFGGTSVADFDAMNRSIDVALLDANTRIVVLSASAGVTNILVALAGGLEPTERFSQLDALRQIQFNILERLRYPNVIREEIERLLENITTLAEAAALASSTALTDELVSHGELMSTLLFVEILRERGIQAQWFDARKVLRTNDRFGRAEPDIAAVAELTQQQLAPRLAEGLVVTQGFIGSEAKGRTTTLGRGGSDYTAALLGEALNATRVDIWTDVPGIYTTDPRVAPAAKRIDVIAFEEAAEMATFGAKVLHPATLLPAVRSDIPVFVGSSKEPKAGGTLVCKTTENPPLFRALALRRRQTLLTLHSLNMLHSRGFLAEVFGILARHNISVDLITTSEVSVALTMDTTGSTSAGDTLLTQALLTELSSLCRVEVEENLALVALIGNELSKACGVGKEVFGVLEPFNIRMICYGASSHNLCFLVPGDDAEKVVQKLHHNLFE

SEQ ID NO: 10948 - protein, 549 aa, Klebsiella pneumoniae subsp. pneumoniae MGH 78578
MKNINPTQTSAWQALQKHFDEMKDVTISELFAKDSDRFSKFSATFDDLMLVDFSKNRITEETLAKLQDLAKETDLAGAIKSMFSGEKINRTEDRAVLHVALRNRSNTPIVVDGKDVMPEVNAVLEKMKTFSEAIISGSWKGYTGKPITDVVNIGIGGSDLGPFMVTEALRPYKNHLNMHFVSNVDGTHIAEVLKNVNPETTLFLVASKTFTTQETMTNAHSARDWFLATAGDDKHVAKHFAALSTNAKAVGEFGIDTANMFEFWDWVGGRYSLWSAIGLSIILSVGFDNFVELLSGAHAMDKHFSTTPAEKNLPVLLALIGIWYNNFFGAETEAILPYDQYMHRFAAYFQQGNMESNGKYVDRNGHAVDYQTGPIIWGEPGTNGQHAFYQLIHQGTKMVPCDFIAPAITHNPLSDHHQKLLSNFFAQTEALAFGKSREVVEQEYRDQGKDPATLEHVVPFKVFEGNRPTNSILLREITPFSLGALIALYEHKIFTQGAILNIFTFDQWGVELGKQLANRILPELKDGSEVSSHDSSTNGLINRYKAWRA

SEQ ID NO: 10949 - protein, 655 aa, Azoarcus sp. EbN1
MIQFRYLRLARGAKILVDAASLQIHPGWRVGLTGANGTGKSSLFALLRGELHQDQGDLEIPAGWRIAHVAQETPALAKPAIEYVLDGDVELRTIEAQLAAAEAAHDDAHESAHREAHIGAHIGNLHARLHEIGGYAARARAAALLDGLGFLPGEADRPVSDFSGGWRMRLNLAQALMCRSDLLLLDEPTNHLDLDAVLWLEQWLRDYRGTLVLISHDREFLDACVTHIAHIESQRLTLYSGGYSDFERQRAERLAQQQSLFDKQQREIAHIEDYIRRFRAKATKARQAQSRIKALERMERIAAAHIDTPFSFSFRDGPPAPDPLLQVEDGVVRYGEHTVLERLRLTLRPGERVGLLGRNGAGKSTLIKLLAGQLPLAAGSRSEGKGLAIGYFAQHQLETLRPDESPLQHLTRLDPRTREQELRDYLGGFDFRGDGVGGTSTPATTPCGSFSGGEKSRLALALMIWQRPNLMLLDEPTNHLDLEMRHALTLALQDYEGGMVLVSHDRALLRATCDRFLLVDDGRIQPFDGDLDDYRDWLAERRAQASAAAKCPDRSADKAARKADREQSAAERQARLAARRPLVKELEQLEKKLANWHGEKKLLDARLADPALYTGAEAGQLQTLLKRQAELAGWVDDAELRWLEISEQLEAMQAD

SEQ ID NO: 10950 - protein, 271 aa, Ralstonia solanacearum GMI1000
MSQDQLPEWFELRGALERMASEGTLLKSVVDRFLNQPRFEGALSILLADQLASARASAAQLLPVIEQAYRDHAELSRLAVSDMRATMERDPATDCLSTVFLFSKGFHALEAYRVAHHYWCAGRQGTALSLSHACSCLLGVDIHPAAKIGAAVMFDHASGIVIGETAEIGDEATLLHGVTLGGNGRHRCDRHPKIGAGTFIGAHASIIGNIRIGKDSIIGAGAVVLADVPDNSVAVGVPAKGKARERKPDAEFQPVLAAAGVAGSPSPVFLG

SEQ ID NO: 10951 - protein, 505 aa, Zea mays
MGLRVAATAPAPAGVRVLGRGAARVTPRPWAAVGGRRRFSVRMSVATTEATTTIAVGASEDQALEARNSKTVVAVILGGGAGTRLFPLTRRRAKPAVPIGGAYRLIDVPMSNCINSGINKVYILTQFNSQSLNRHLSRAYDFSNGVAIGDGFVEVLAATQRPGTEGKRWFQGTADAVRQFDWLFDDAKSKDIEDVLILSGDHLYRMDYMDFVQSHRQRGAGISICCLPIDGSRASDFGLMKIDDTGRVISFSEKPKGDELKAMQVDTTVLGLSKEEAENKPYIASMGIYIFKKDILLNLLRWRFPTANDFGSEIIPASAKEIDVKAYLFNDYWEDIGTIKSFFEANLALAEQPPRFSFYDADKPMYTSRRNLPPSMVNNSKITDSIIAHGCFLDNCRIEHSVVGVRSRIGSNVHLKDTVMLGADYYETAVERGELLAEGKVPIGIGENTTIQKCIIHKNARIGKKVVISNSEGVDEADRTSEGFYIRSGITVVLKNAIIADGLVI

SEQ ID NO: 10952 - protein, 276 aa, Salmonella enterica subsp. enterica serovar Enteritidis
IPATAISFIAVTICVIGSNYLLFDASELADPAFNASKQALKWGLAGFSSTTVWLVFGAFIFALGYEVTGLGRRIALFLVKFMGKRTLTLGYAIVIIDILLAPFTPSNTARTGGTVFPVIKNLPPLFKSFPNDPSARRIGGYLMWMMVISTSLSSSMFVTGAAPNVLGLEFVSKIAGVQISWLQWFLSFLPVGIILLIVAPWLSYVLYKPEVTHSAEVAAWAGGELKNMGRLSRKEWTLIGLVLLSLGLWVFGGKIINATAVGLLAVSLMLALHVVP

SEQ ID NO: 10953 - protein, 359 aa, Dasypyrum villosum
MVQPVFDSAVLSGRADIPSQFIWPEGESPTPDAAEELHVPLIDIGGMLSGDPRAAAEVMRLVGEACERHGFFQVVNHGIDAELLADAHRCVDAFFTMPLPEKQRALRRPGESCGYASSFTGRFASKLPWKETLSFRSCPSDPALVVDYIVATLGEDHRRLGEVYARYCSEMSRLSLEIMEVLGESLGVGRAHYRRFFEGNDSIMRLNYYPPCQRPYETLGTGPHCDPTSLTILHQDDVGGLQVHTDGRWRSIRPRADAFVVNIGDTFMALSNGRYKSCLHRAVVNSRVPRKSLAFFLCPEMDKVVAPPGTLVDAANPRAYPDFTWRSLLDFTQKHYRADMKTLEVFSSWVVQQQQAAMT

SEQ ID NO: 10954 - protein, 253 aa, Dichelobacter nodosus VCS1703A
MEKKTTHFGYQTIDEYEKNARVGAVFDSVSGKYDLMNDVMSLGIHRFWKDWFVWQCDVRAGETVLDLASGTGDIARRLGKKMSRGGTMTGQLIVSDINQSMLERGKVHLIEAGFLQNVTFVLADAEHLPFADESVDLITMAFGLRNVTHQQQALNEMARVLKPNGRVFILEFSHMRSRLLRKTYDWYSFNVLPRLGGMIVGDRESYQYLAESIRMMPTQEELKNMFAAAGFVSCEYQNLMNGMVAIHQGFKPY

SEQ ID NO: 10955 - protein, 178 aa, Rickettsia typhi str. Wilmington
MFIDKIKAKANNNEINVIIEIPMNSGPIKYEFDKESGAIFVDRFMQTTMSYPCNYGFIPDTLSNDGDPVDVLVVAHHPVVPGSVIKCRAIGVLMMEDESGLDEKIIAVPTSKLDITFDHIQELDDLCKMLKKRIVHFFEHYKDLEKDKWVKVTGWGNKVKAEDLIKEGIDRNQQKWNN

SEQ ID NO: 10956 - protein, 187 aa, Dichelobacter nodosus VCS1703A
MPIINRSIPEFKVDAFHNGEFKTITHEDVKGKWAVFCFYPADFTFVCPTELEDLAKHYDEFKALGAEVYSISCDSHFVHKAWHDTSDAIGKIKYPMLGDTTGLLARSFDVMIEADGMAYRGTFLINPEGIIKAAEIQDDNIGRSAKDMLRKLKAAKYVAEHDGEVCPAAWEEGQETLKPSLDLVGKI

SEQ ID NO: 10957 - protein, 566 aa, Magnaporthe grisea 70-15
MHPPAPRNGHQPHHPNGDATSNGHPAPNMEQLYVVPDHGPCPPNRTLFEAFEWYLPAQHNHWRRLADRIPSLAALGVTDLWIPPACKGAWYTSNGYDVYDLYDLGEFDQRGARQTKWGSKEELLRLVDVANRHGVGVLFDAVLNHMTGADETERVLAVNVDTNDRRQEISTPHQIEAWTKFNFPGRGDTYSPLRWTAEHFTGVDYDQASKTNGIWKFLGKEWAPDVDGEFGNYDFLHPEVRRNFFHWVQWLASQMRLGGLRLDAVKHISASFMRDFVGLVQNTVGRDWLLLGEYWSGDVKALLGYLEQLDHRISLVDVPLVESFSRISRGEQPDLRRVFENTLAAIKPNNAVQTGQTLETPVEPFFIPIAYALILLRANHGTPCVFWCDLYGTLLPSRPGPAPLGGLLTARLMLARKLWAYGTEAAYFCGKGAETCVGFTRFGHPARSGGAGLAVVANTGFERAARRMCVGSRHAGERWTDLLRQVWGVVVVDAAGYAEFPVGPRGVSVWVHEMAEGRDVVEGLTSFRAPMQIWPRSRSAVTRFGRLPEPVLHCTCSKGKILARFG

SEQ ID NO: 10958 - protein, 107 aa, Synechococcus sp. WH 8102
MSSAAAVTDASFEQDVLQSDVPVLVDFWAPWCGPCRMVAPIVEEIAKEFDGQIKVFKLNTDENPNVASQYGIRSIPTLMVFKGGQKVDTVVGAVPKATLSGTISKYL

SEQ ID NO: 10959 - protein, 367 aa, Daucus carota subsp. sativus
MAFIQTNTAHENSLLSKNLLFDHLKNTGKTPSSYCTRHHPMKIQGANAVNSTLVQSVNVQELLTNPRVTPGPEFHFEGYMKTSGKKINKALDEAVPVQKPAIIHEAMRYSLLAGGKRVRPVLCIASCELVGGLESWAMPMACALEMIHTMSLIHDDLPCMDNDDLRRGKPTNHKVYGEETAILAGDALLSLAFEHVADATDMVTPGRVVRAIAELGSAVGSQGLVAGQIMDICNQGKDVDLNDLEYIHVHKTSKLLEASVVCGAILGGGNVIEVERLRKYARCIGLLFQVVDDILDVTKSSAELGKTAGKDLVTDKTTYPKLMGLERAKRFATELVAQAEEELSYFGSSTRVAPLYHLAKYIAYRHN

SEQ ID NO: 10960 - protein, 337 aa, Fulvimarina pelagi HTCC2506
MLEKFERYPLTFGPTPIEHLPRLTEALGGKVEIYAKREDCNSGLAMGGNKLRKLEYIVPDALASGADTLVSIGGVQSNHTRMVAATAAKLGLKCVVIQEKWVPHHDAVYDRVGNILMTRLMGADSRLVDDGFDIGIRKSWEDAIRSVEEAGGKPYPIPAGASVHKFGALGYVGFAEEVAAQEAELGFKFDYVVVCVVTGSTQGGMIVGFAAQDRADRVIGIDASGTLDQTRSQVRSIVDNTAVLVGLGRSVREDEIVINPDYAYPAYGVPSEETNDAIRLAARTEAMMTDPVYEGKSMQGMIDLTKKGFFPEGSKVLYAHLGGAPALNGYSYYYKDG

SEQ ID NO: 10961 - protein, 308 aa, Arabidopsis thaliana
MASNPDFLWCKEERKQESFFKVLKRSDMSSEDTRAIPYDFVINFSDNELSGDMKFRVQWGNSWKVKISKNPRFYFMEKSGWEKFVIDNALGDHEFLTFTHKGQMSFTVKIFNKDGKEMMQPPQSRASFASSSRVKTEQDVKREEEVLVSSDSRSRGPTTAAETNRGGSYKRKLNFGKKKAEETQTYKRTERTQNSKRTERVVSKERVYAGEPSSSVAGFKIFISKSYIKSLAIPKPFGNYMPKEKTRVKIHHPDGEKTWKVVFVVKERGQIFSGGWKRLCKEYPVVFGDTCKFTLITPLELLLVVSKP

SEQ ID NO: 10962 - protein, 295 aa, Thermobifida fusca YX
MAPRIAVFGSVNMDLVAYVDTPPARGETVQGRQFSQVPGGKGANQAIAAARAGADVVFLGAVGDDVFGPQLRATLVDNGIDVSGLRTVGGASGIAHIVVDREGNNSIIVIPGANGTVTGLRENDTLLLDGAQALLLQLETPLSGVIAAARAGRSLGVTTVLTPAPAQPLPQELLECVDVLLPNQYEAATITGEDTPERALAALLETVPEVIITLGSRGALYGARDREPLWVPVVQVEAVDTTGAGDTFCGAYAVARTEGQDPESALRFAAKAAALSVRIPGASTSMPTRAEIDAF

SEQ ID NO: 10963 - protein, 128 aa, Hordeum vulgare subsp. vulgare
PSKLNVGADFHCFKDKIEPKWEDPICANGGKWTISCGKGKSDTFWLHTLLALIGEQFDFGDEICGAVVSVRKNQERVAIWTKNAANETAQISIGKQWKEFLDYKDSIGFVVHEDAKRSDKAAKNRYTV

SEQ ID NO: 10964 - protein, 686 aa, Oryza sativa Japonica Group
MRAAWRPASGRRVALAAMVVLSVVVAAAMADDLAGDARALLAFRDAVGRHVAWNGSDPGGACSWTGVTCEGGRVAVLRLPGAALAGRVPEGTLGNLTALHTLSLRLNALAGALPGDLTSAAALRNVFLNGNRLSGEFPRAFLALQGLVRLAIGGNDLSGSIPPALGNLTRLKVLLLENNRFSGEIPDLKQPLQQFNVSFNQLNGSIPATLRTMPRSAFLGTGLCGGPLGPCPGEVSPSPAPGEQPVSPTPANNGDKGGNGGESGKKSKKLSGGAIAGIAIGSAVGAALLLFLLICLCCRSGRTKTRSMEMPPPPSSAPAVVAAGRKPPEMTSAAAVAPMATVGNPHAPLGQSTSGKKLIFFGSAAAVAPFDLEDLLRASAEVLGKGAFGTTYKAVLESGATVAVKRLKDVTLTEPEFRDRIADIGELQHEFIVPLRAYYYSKDEKLLVYDFMPMGSLSAVLHGNRGSGRTPLNWETRSSIALAAARGVEYIHSTSSSASHGNIKSSNVLLNKSYQARLSDNGLSALVGPSSAPSRASGYRAPEVTDPRRVSQKADVYSFGVLLLELLTGKAPSQAALNDEGVDLPRWVQSVVRSEWTAEVFDMELLRYQNVEEQMVQLLQLAIDCVAQVPDARPSMPHVVLRIEEIKKSSERLEGRDPQQQASNLEAGDDQTSKPESAEGLNPFAP

SEQ ID NO: 10965 - protein, 294 aa, Alexandrium fundyense
MWSRLARRAGTAAQHMVTRPATCLPRSSHAAGAAAIAAAAGLAYHQKAGTSCDQVNKEATDSVSTSEFPTLQRYILARTGDHELAVLLMGLTLACKATSRACAKAGIGNLFGLAGEVNSTGDEQKKLDVLSNDIFIDALVNTGAAAVLVSEENDEPIFVPKEKAGRFIIAFDPLDGSSNIDCNVSTGTIFAVYEKKSKGMANMSDVLRTGNDIIVAGYCMYGAATELVITFKGHGVHRFTLDPSLGEFVHIEADVKLPAGGGKKIYSCNEGHSANWDKAITAIVDKYKGGPPKA

SEQ ID NO: 10966 - protein, 472 aa, Ralstonia solanacearum GMI1000
MQRSSHAKIVATLGPASDDHATIEALARAGADVFRLNFSHGAHADHQRRLERIRAVEAALGRPLGVLLDLQGPKLRVGTFAEGRVRLDDGAPFRLDLETGRPGDATRVALPHPEIFAAIRPGVALLLDDGKLRLEVVACGPDHAETRVVNGGMLSDRKGVNVPGVVLPLSALTEKDRADLAFGLALGVDWIALSFVQRAADIAEIRQLVHGRAGIVAKLEKPAAIDSLDAILAETDAVMVARGDLGVELPAEQVPAIQKRIVRACRRLGKPVIVATQMLESMIGAPVPTRAEASDVATAVYDGADAVMLSAETASGQFPVEAVAMMRRIIAQTEADPHYRAAIDASHTPPGANTPDAIGCAAHSVAGLLDVAAMVAYTSSGASALRMARERPRAAILGMTPRPETARRLALVWGVHPVICDGVLDVEAMTDVARQTAVQRRFAQAGQTLVIAAGLPFGTPGSTNLLRIAQVE

SEQ ID NO: 10967 - protein, 466 aa, Streptococcus pyogenes str. Manfredo
MDAKLKYKAKKIKMVFFDIDDTLRVKDTGYMPESIQRVFKALKAKGILVGIASGRARYGVPQEVQDLHADYCVKLNGAYVKDDAKTIIFQAPIPADVVVAYKKWADDMGIFYGMAGRHEAVLSARNDMISNAIDNVYAQLEVCPDYNEYHDVYQMWTFEDKGDGLQLPAELAEHLRLVRWHDNSSDVVLKGTSKALGVSKVVDHLGLKPENILVFGDELNDLELFDYAGISIAMGVSHPLLQEKADFITKKVEEDGILYALEELGLIDKELQFPQLDLENHTGPKVTIKTNHGDMTLVLFPDHAPKTVANFLGLAKEGYYDGIIFHRIIPEFMIQGGDPTGTGMGGQSIYGESFEDEFSDELYNLRGALSMANAGPNTNGSQFFIVQNSKIPYAKKELERGGWPTPIAAAYAENGGTPHLDRRHTVFGQLVDETSFQVLDLIAGVETGAQDKPKEDVIIETIEVFD

SEQ ID NO: 10968 - protein, 368 aa, Dasypyrum villosum
MPTPSHLSNDPRYFDFRAARRVPETHAWPGLHDHPVVDGGEAGGGPDAVPVVDMRDPCAAEAVALAAQDWGAFLLEGHGVPLELLERVEAAIAGMFALPASEKMRAVRRPGDSCGYGSPPISSFFSKCMWSEGYTFSPANLRSDLRKLWPKAGHDYRHFCAVMEEFHREMRALADKLLELFLVALGLTVEQVAAVESEQQIAETMTATMHLNWYPKCPDPKRALGLIAHTDSGFFTFVLQSLVPGLQLFRHGPDRWVTVPAVPGAMVVNVGGLFQILTNGRFHSVYHRAVVNRDSDRISLGYFLGPPAHVKVAPLREALAGTPAAYRAVTWPEYMGVRKKAFTTGASALKMVAIPTDDAAAADDLISS

SEQ ID NO: 10969 - protein, 313 aa, Streptococcus pyogenes str. Manfredo
MTKIYKTITELVGQTPIIKLNRLIPNEAADVYVKLEAFNPGSSVKDRIALSMIEAAEAEGLISPGDVIIEPTSGNTGIGLAWVGAAKGYRVIIVMPETMSLERRQIIQAYGAELVLTPGAEGMKGAIAKAETLAIELGAWMPMQFNNPANPSIHEKTTAQEILEAFKEISLDAFVSGVGTGGTLSGVSHVLKKASPETVIYAVEAEESAVLSGQEPGPHKIQGISAGFIPNTLDTKAYDQIIRVKSKDALETARLTGAKEGFLVGISSGAALYAAIEVAKQLGKGKHVLTILPDNGERYLSTELYDVPVIKTK

SEQ ID NO: 10970 - protein, 219 aa, Oryza sativa Japonica Group
MEWAYYGSGYSSSGTPSPVGGDGDEDSYMTVSSAPPKRRAGRTKFKETRHPVYKGVRSRNPGRWVCEVREPHGKQRIWLGTFETAEMAARAQDVAAMALRGRAACLNFADSPRRLRVPPLGAGHEEIRRAAVEAAELFRPAPGQHNAAAEAAAAVAAQATAASAELFADFPCYPMDGLEFEMQGYLDMAQGMLIEPPPLAGQSTWAEEDYDCEVNLWSY

SEQ ID NO: 10971 - protein, 100 aa, Oryza sativa
MARTFFVGGNWKMNGSLESTKQLTQTLTQAKLDSNVEVVVAPPALHLLTVKEQLAGSKVAVSAQNAYHKASGAFTGEVSVNMLKDASIPWVILGHSERRT

SEQ ID NO: 10972 - protein, 177 aa, Zea mays
  misc_feature (52)..(52): Xaa can be any naturally occurring amino acid
  misc_feature (72)..(72): Xaa can be any naturally occurring amino acid
  misc_feature (82)..(82): Xaa can be any naturally occurring amino acid
IAKKCKGAGHFLKAGIGNCQPRGVPVFPKIMVLFVEQPQEMGHQGTFIRPVXRKCFANVGKTIGYKVGTMIXIPRAALVGDXITEQGEFFSFGKKDLTQMTFGYSRDYVGKFISVYFGQGILQHDPFEVLDQKGVGELVKFSTKRGRKSRPKFKGGICGEHGGKPLFVAFFAKGGVE

SEQ ID NO: 10973 - protein, 498 aa, Zea mays
MTIARRLLRSNASAQAISLLKHVTGTASLQGHAHSPLDASVRHFSSAPSAQSDTTEENGFKGHGMLAPFTAGWQSNDLHPLIIERSEGSYVYDINGNKYLDSLAGLWCTALGGSEPRLVKAATEQLNNLPFYHSFWNRTTKPSLDLAQEILSMFTAREMGKVFFTNSGSEANDSQVKLVWYYNNALGRPDKKKFIARSKAYHGSTLISASLTGLPALHQKFDLPAPFVLHTDCPHYWRYHLPGETEEEFATRLATNLENLILKEGPETIAAFIAEPVMGAGGVIPPPKTYFDKVITAFGRLGTMFGCDYYNIKPDLVSLAKALSNAYVPIGATLVSPEISEVIHSQSNKLGSFAHGFTYSGHPVACAVAIEALKLYRERDIPGHVKQIAPKFQDGIRALADSPIIGEIRGLGMIMGTEFTNNKSPADLFPAEWGVGAIFGEECQKRGMLVRVAGDAIMMSPTLIMTPGEVDELVSIYGEALRATEERVSDLKMKSEKN

SEQ ID NO: 10974 - protein, 354 aa, Erythrobacter sp. NAP1
MKIAILPGDGIGPEVTREAVKVLEAVNLPGLTLFEGDVGGIAYKRHGHPLPPETLTIAKSCDAVLFGAVGDPDCDRLDRHLRPEQAILGLRKELDLFANLRPAKVYEGLEHLSPLKPEIAGQLDMMIVRELTGDVYFGDKGERVAIDGTREGWDMMSYSETEVSRIARVAFRTARAGDDKYRVTSVDKANVLETSQVWRDTVNAAAGAHPDIELSHMYVDNAAMQIISNPGSFGVILTGNLFGDILSDLASAAVGSIGLLASASMGERRTDHGIFGLYEPIHGSAPDIAGRGIANPMATILSAAMMLRHSFGLDSEAARIEAAVEKALADGFLGGDLGGEHGTEAIGAAVRERL

SEQ ID NO: 10975 - protein, 463 aa, Yersinia pestis CO92
MADNAEKKGLHRGLEARHIELIALGGTIGVGLFMGSASTLKWAGPSVLLAYIIAGLFVFFIMRAMGEMLYLEPVAGSFAVYAHKYLSPYFGYLTAWGYWFMWIAVGISEITAIGVYVQFWFPEIPQWLPAIAGVAIVALANLAAVKLYGELEFWFAMIKVTTIIVMILVGLGVIFFGFGNHGQPIGFDNLTAHGGFFAGGWKGFLFALCIVVASYQGVELVGITAGEARNPQVTLRRAINNILWRILIFYVGAIFVIVTIFPWNGIGTEGSPFVLTFAKIGIVAAAGIINFVILTAALSGCNSGMYSGGRMLYALAKNRQLPAGLTKLSASGVPVYCIAITILCLLVGSSLNYIIPNPQQVFVYVYSASVLPGMVPWFVVLVCQLRFRQVHKAALQQHPFKSILFPYVNYLTIAFLICVLVGMGINPDTRLSLLVGAIFLALVTGCYFVLGMHKPKAMEAERL

SEQ ID NO: 10976 - protein, 716 aa, Frankia sp. EAN1pec
MIVDRAHVAAALPGYELGDQIGAGAFGLVLAGWHRRLGRDVAIKVLAARDRSGLTASFAAEAQILASLDHPHIVRVYDYVETDDLRLIVMEMLAGGTLTRHQASISQPGACAVGLAAAGALSCAHSRGVLHRDIKPDNMLFDAAGLIKVADFGIAKLVSGSAATASSVVGTPLFMAPEQIAGGRLGPTTDLYALGVVLYLLLAGTRSFGPAAATQPPWPNPIDQHILPPPIGVPEPVATVVLRMLSPVPADRPPSAHAFAVDLAQAAATAYGPGWIATAGVSLRLDDDVRAAAERPARLTRLPPSSAADDMSPSHPADSSPEDGPASESVASRGRHARSHPRLASSPRHRLAAGVVLLLLAVAGTVLIPVAARSGNPNEPSSHPVALGASAKETPAPAAQALGQPLTDHTDWVASVAFSPDGHTLASSSKDTTVRLWDITDRTRPHPLGQPLAGHTLGVMSVAFSPDGNTLASSSRDTTIRLWDITDRTRPHPLGQPLTGHTDAVTSVAFFSDGRTLASSSRDTTIRLWDITDRTRTRPLGSPLSGHSDWVTSLALTMDGRTLASSSLDSTVRLWNMADRSHPQPIGLPLTGHTGGVNSVAFSLDSRTLASSGRDTTIRLWDVTDRSTPRLLGAPITGHANTVGPLTFSQDGDTLVSGSYDDTVRIWDVTDRSHPRLLGLPLTGHTDWIWSVALSPDGQTLASGSKDNTIRLWALP

SEQ ID NO: 10977 - protein, 128 aa, Hordeum vulgare
PSKLNVGADFHCFKDKIEPKWEDPICANGGTWTISCGKGKSDTFWLHTLLALIGEQFDFGDEICGAVVSVRKNQERVAIWTKNAANETAQISIGKQWKEFLDYKDSIGFVVHEDAKRFGKAAKNRYTV

SEQ ID NO: 10978 - protein, 304 aa, Marinobacter sp. ELB17
MAVRHFLTLNDLTPDELEALLDHGSRLRREWHQGVTRDTLKNRVLAMIFEKSSTRTRVSFEAGMMQLGGSALFLSPRDTQLGRGEPIEDSAIVISSMVDAVMIRTFAHNTVERFAAASSAPVINALTDDFHPCQLLADMQTYRENRGSIRGATVAWIGDGNNMCHSYINAAVMFGFHLNVACPKGYEPDAAVFEAHKEHVTVMHEPADAARDANLLVTDVWASMGQESEQKARELAFSSYQINPQLMSLAAKDALFMHCLPAHRGEEISQDMMEHSGSVVWQEAENRLHAQKALLEFLILKRLD

SEQ ID NO: 10979 - protein, 289 aa, Fulvimarina pelagi HTCC2506
MPTLPIYQVDAFTTELFAGNPAAVVPLNEWLPDETLTQIAAENNLAETAYFVPDGENRWELRWFTPAIEVPLCGHATLATAFVLTECLGVEAATLTFATRQSGELTVTRTEDGRFVMRFPARNWEPHEAHDGLSAALGKDPNELFFTKVAGDTSFLAVFDKASDVVGLDPDIRAIAAVRSRNVVATAPGSDIIVTAKGDAGSSDAAKSETIDFVSRMFAPNAGIDEDPVTGSAHCLLAPFWAQRLGKSELKARQVSKRGGDLWCKVDGETVVVSGYGVIYLEGRIRVPG

SEQ ID NO: 10980 - protein, 171 aa, Zea mays
FQCVLQYLGPPVLGFTIWTEKLYFSSAAAFLGYSLILAILRTSSLRDEASRVMVAAPILAFVTTHILYLNFYELDKGLNMKVCTVISIAQCLLWALWAVMSGHRSRLKIISVAVGGAVAVLVEAYDIPPRWGYADGRAICLAVAIPLSYLWWSFAKEDAEMRTSAILKKTR

SEQ ID NO: 10981 - protein, 131 aa, Opitutaceae bacterium TAV2
MIGRIHIKNLVFHGHHGVLPEETRLGQRFELDLELVLDIAAAAAADDLSQTVNYADVAALCARIVQGERHRLLETLARRLLMEILQHHPTLLEAGLVLRKPSAPVPAIFDTIALETRLTRAEFQRLSLARQ

SEQ ID NO: 10982 - protein, 418 aa, Geobacillus stearothermophilus
MMKCCRRVALVLLGLWFVFCISVLGGRAEAAASRANDAPIVLLHGFTGWGREEMFGFKYWGGVRGDIEQWLNDNGYRTYTLAVGPLSSNWDRACEAYAQLVGGTVDYGAAHAAKHGHARFGRTYPGLLPELKRGGRIHIIAHSQGGQTARMLVSLLENGSQEEREYAKAHNVSLSPLFEGGHHFVLSVTTIATPHDGTTLVNMVDFTDRFFDLQKAVLKAAAVASNVPYTSQVYDFKLDQWGLRRQPGESFDQYFERLKRSPVWTSTDTARYDLSVPGAEKLNQWVKASPNTYYLSFATERTYRGALTGNYYPELGMNAFSAVVCAPFLGSYRNATLGIDDRWLENDGIVNTFSMNGPKRGSTDRIVPYDGTIKKGVWNDMGTYNVDHLEVIGVDPNPLFDIRAFYLRLAEQLASLQP

SEQ ID NO: 10983 - protein, 342 aa, Alexandrium fundyense
MPATLGINGFGRIGRLVCRAALSNPDITVKAINDPFMDLQYMVYMLKYDSVHKTFPGTIATKEEGGKEFLVVNGADIAVFHEKDPASIPWGDSGAGYVCESTGVFTAKEKAELHLKGGAKKVIISAPPKDAVPIYVMGVNHLEYKTSDTVVSNASCTTNCLAPLTKVVHTKFGLIEGLMTTVHAMTATQLTVDGPSRGGKDWRGGRCASQNIIPSSTGAAKAVGKVIPDVNGKLTGMAFRVPTPDVSVVDLTCRLEKPAKYDEIVAAIKEAAAGDMKGVLDWTDEEVVSTDFVTCKASSIFDVGAGISLSDTFVKLVSWYDNEWGYSNRLVDLAIFMSKQDA

SEQ ID NO: 10984 - protein, 277 aa, Synechococcus elongatus PCC 7942
MNLLTNLLAPVESPSGPRIKKQRRGVEIKSSREIDIMRQAGRIVATVLKEVSERVEPGMTTADIDAYAEQRIREMGATPSFKGYHGFPASICASVNDEVVHGIPNSRKVIREGDLLKVDTGAFFQGFHGDSCITIAVGRVSAEAEKLQRVAEEALFKGIEQVKAGAYLLDLAGAIQDHVEANGFSIVEDYTGHGVGRNLHEEPSVFNYRTRSLPNVKLRAGMTLAIEPILNAGSKQTRTLRDKWTVVTIDRSWSAQWEHTVLVTEDGYEILTDRTKV

SEQ ID NO: 10985 - protein, 901 aa, Oryza sativa Japonica Group
MAQRWRSRARRDPDVDDEEGSPPERRRRGARSGSDDEEAGNEDLSLEIVARAARRRRRRKASAGFAADAFSSGDEIDEDAVVKLGEADPSSRKPAQGEEEAAQGEEEAAEGGAARGSGPRPPPPTRRFTWAFLSPDIACALSLHLVHHPMPELSWILFILRLELSWISQVAGTQEGQTGTAQSVLTEDGPDVPLSDNIVLRKLLRIPRYFDPGETLLETCFNCGEEGHVAVNCPMEKRKRPCFVCGLFGHNSKQCTQVGLPSSKALLLGDLDRFQTSSSLITHIYLPLPMLLACVAWPANFRNQTFVNHFCRVKTVSSAKKEVILRKTALKSTIGILNSLLFVYDVENQVMICLDVPMIIHAMMLRKVIYVAPTSLIFVQKKLVVIIVPNLVILVWDVPSNVGKLVPRQLQLCVTNVARKATSHVGAQRTPSRKKGKGKKDFGTRSAPHDARKTSKRKSPLFEERRNSSHFKSKARGGWIADDADDQPYKKCKPNVWASPSTPKKQYNNHQFSSGGDYSTPQSSRWQKHGFASPSATYSPNTRKHSFSSSRFASNTHVRLHGQPTLELFAASNLTSPNDGSQCSLIASETEEMCVSGCIIELELYGLLALEAEERHASGHRVGEVGLKGELTSSVASSYGPRNSASERAAAHTCGLRLFAAADDFEIDWLFESSNRLRFVSSLRYDAPPPRTLRLRSHTTAATVAQGLSRRAVQPADGVFREEAAGDRAVPRGRVREGRGRQRRHRGFIALWASTAAPSPAPSAVGPTPAAAAAELLRRVAAPGVDPCPALRKLAAFLSDDDVDEFDKNALARAAGSGLEARVDAARLVESLLRDGGEDDEVRRDGRRGGGGVRAVGGVPPVQGPARGGGGGGVQGRADEAAPADAERVLAGGEADGLGVP

SEQ ID NO: 10986 - protein, 504 aa, Triticum aestivum
  misc_feature (244)..(244): Xaa can be any naturally occurring amino acid
FSLVALRKVMVIDYKLTYPSGTATAMLINSFHTTSGAELAEKQVSCLGKYLSISFVWNCFKWFFSGVGDSCGFDNFPSLGLAAFKNTFYFDFSPTYIGCGLICPHIVNCSTLLGAIISWGFLWPYISTKAGEWYPAGLGSNDFKGLYGYKVFISVSVILGDGIYNLIKIIYATIKEIMNARSKQGRLPLVRAQDDDESSELSSEEKLLNDVFVKDSIPPWLAGSGYVGLAAISTATVPMMFPQXKWYLVLSAYVVAPLLAFCNSYRTGLTDWNLASTYGKIGLFIFASWVGQHGGVIAGLAACGVMMSIVSTAADLMQDFKTGYFTLSSPRSMFVSQLIGTALGCVIAPLTFWLYWSAFDVGNPDGMFKAPYAVIFREMAILGVEGFSALPQHCLAICSFFFFAAIAINLLRDVTPDSVSKFIPLPMAMAVPFYIGAYFAIDMFVGTVILFVWEKINRKESEDFAGAVASGLICGDGIWSVPSAILSIMRIDPPMCMYFKPSLA

SEQ ID NO: 10987 - protein, 266 aa, Oryza sativa Japonica Group
MGTAKKSAIFVALLCTHILVNHACDSDVVFGYSGSTGPEHWGSLSPNFTTCSKGTYQSPINILKDDAVYNPKLEPLEMDYTAANTTIVDNVFNIALRYNDTAGTVKVDGKKYKLRQLHWHSPSEHTINGQRFAVELHMVHHSDDGNITVIAVLYRHGKPDPFLFQIKDKLAALYLEGCKAEKGEPLPVGLVDMRELKKGADRYFRYVGSLTTPPCTENVIWNIFGEIREMTKEQAAALRAPLHGSYRHNRRPTQPLNGRTVQLNYM

SEQ ID NO: 10988 - protein, 438 aa, Arabidopsis thaliana
MSCSSSSGSEGEEEGFDAYRKGGYHAVRIGDPFSGGRYIAQRKLGWGQFSTVWLAYDTLTSTYVALKIQKSAQQFAQAALHEIEFLSAAADGDLDKTKCVVRLIDHFKHSGPNGQHLCMVLEFLGDSLLRLIRYNQYKGLKLNKVREICRCILTGLDYLHRELGMIHSDLKPENILLCSTIDPAKDPVRSGLTPLLEKPEGNANGGASTMNLIEKKLKRRAKRAVAKISERRVSMVTGEEASSKTEKSLDGIDMRCKVVDFGNACWADKQFAEEIQTRQYRAPEVILKSGYSFSVDMWSFGCTAFELVTGDMLFAPKDGNGYGEDEDHLALMMELLGKMPRKIAIGGAKSKDYFDRHGDLKRIRRLKYWPLDRLLIDKYKLPEAEAKEFAEFLTPILEFAPEKRPTAQQCLDHPWMNVTTQNDAENVDDQMNNLHIKG

SEQ ID NO: 10989 - protein, 339 aa, Sinorhizobium meliloti
MSLLEKFERYPLTFGPTPIEHLPRLTAALGGKVAIYAKRDDCNSGLAMGGNKLRKLEYIVPDAIASGADTLVSIGGVQSNHTRMVAATAAKIGMKCVVIQEKWVPHYDAVYDRVGNILMTRLMGADSRLVDDGFDIGIRKSWEDAIQSVKDAGGKPYPIPAGASVHKYGALGYVGFAEEVAAQEKELGFTFDYIVVCVVTGSTQGGMIVGFAAQDRANRVIGIDASGTLEQTRSQVRKIVDSTAELVRLGRAIREDEIVINPDYAYPAYGVPSEETNEAIRLAARTEAMITDPVYEGKSMQGMIDLTRKGFFPEGSRVLYAHLGGAPALNGYSYYYRDG

SEQ ID NO: 10990 - protein, 365 aa, Rickettsia typhi str. Wilmington
MTLKLGIVGLPNVGKSTLFNALTASQIADAANYPFCTIEPNSSKVLVPDERLQRLVSLAGSNKMVPSYIEFVDIAGLVKGASKGDGLGNKFLSHIREVDAILHVLRCFEDDDIIHVHNNVDPLYDIDVIETELILADIVSLEKHFNKSEKRLRSGDKTMVEQIALLKEIYKVLAEGKPARILNEVLGADNLKQLQLITSKPVLYVCNVVEQDAAIGNEFTRLVSKRAETEKTKSIVISSKIESEIASLESVEEKAELLKCIGLNKTGLSKVIKEGYNLLNLKSFFTIGPKEAHSWTFKDGTLAPAAAGIIHTDFEKGFIRAEVIGYEDYINLGSEAKAKEVGKMRLEGKEYKMQDGDIVHFRFNI

SEQ ID NO: 10991 - protein, 285 aa, Dichelobacter nodosus VCS1703A
MEADGNIGFIGAGHINSAIIRGLLNDEDSFNRQRLMIATRSVESSLAAAKDFGVYTTNHIEDILAKAQYIVIGVKPQDMHALLMQLCQHDLSEHVIITLAAGIKIEDYRKILGDEVTIVRAMPNIAASVQAALTGIYSDDGLSEHDENLIEDIFSAIGSTAWLDDEIQLDGITALSGSGIAYFYRLMQAMAQAGEQYGFEKQELYDIITLTALGAATLAVESIDDVEQNADFATFIDQIAVKGGTTEQAITVFNQQNLDEMVQTAMQKVVGRSHELGEALTKDWA

SEQ ID NO: 10992 - protein, 470 aa, Pisum sativum
ASGSDENDVVIIGGGPGGYVAAIKAAQLGFKTTCIEKRGALGGTCLNVGCIPSKALLHSSHMYHEAKHSFANHGVKVSNVEIDLAAMMGQKDKAVSNLTRGIEGLFKKNKVTYVKGYGKFVSPSEISVDTIEGENTVVKGKHIIIATGSDVKSLPGVTIDEKKIVSSTGALALSEIPKKLVVIGAGYIGLEMGSVWGRIGSEVTVVEFASEIVPTMDAEIRKQFQRSLEKQGMKFKLKTKVVGVDTSGDGVKLTVEPSAGGEQTIIEADVVLVSAGRTPFTSGLNLDKIGVETDKLGRILVNERFSTNVSGVYAIGDVIPGPMLAHKAEEDGVACVEYLAGKVGHVDYDKVPGVVYTNPEVASVGKTEEQVKETGVEYRVGKFPFMANSRAKAIDNAEGLVKIIAEKETDKILGVHIMAPNAGELIHEAAIALQYDASSEDIARVCHAHPTMSEAIKEAAMATYDKPIHI

SEQ ID NO: 10993 - protein, 446 aa, Zea mays
  misc_feature (391)..(391): Xaa can be any naturally occurring amino acid
MDSAAAALLDSASASASSANAAGKEMPTARHIAHRTAHNMSSSSLRKKSDLALLRKVPCAPLRRLLDNLQEVLLATKLALLLPAVLLAIAARIFHFGQEWVFVLSLIGLVPLAERLSFLTEQVAFYIGPTVGGLLNATFGNVTEVIIAIFALYQGKVVVVKCSLLGSVLSNLLLVLGTSLFFGGLANLGTEQLYDKMQVDVSTGLLILGVLCHSLPLMLRYAVSSGEHAESSWDSGLELSRACSIVMLLAYVAYLFFQLKTHRQLFEPQPQEVEDGDDSVSQDEAVLGFSSAMIWLGVMTLMTALLSEFVVSTIEAASESWELSVSFISVILIPIVGNAAEHAGAVIFAFKNNLDITLGVSLGSATQISMFVVPLSVLVAWIMGVPMDLDXLVTAFTLQDGSSHYLKGLLLVFCYIVISLCFFVLRQHGNGSNDDQLGVASKPWRI

SEQ ID NO: 10994 - protein, 420 aa, Yersinia pestis CO92
MSFETISVIGLGYIGLPTAAAFASRKKKVIGVDVNAHAVETINRGAIHIVEPDLDKVVKIAVEGGYLQAVTKPQAADAFLIAVPTPFKGDHEPDMIFVESAAKSIAPVLKKGDLVILESTSPVGATEQMAQWLAEARPDLSFPQQAGEAADINIAYCPERVLPGQVMVELIQNDRVIGGMTPKCSARASALYKIFLEGECVVTNSRTAEMCKLTENSFRDVNIAFANELSLICDEQGINVWELIRLANRHPRVNILQPGPGVGGHCIAVDPWFIVSQNPQLARLIHTARLVNDGKPLWVVDRVKAAVADCLAASDKRASEVKIACFGLAFKPDIDDLRESPAVGVARLIAEWHVGETLVVEPNVEQLPKSLMGLVTLKDTATALQQADVLVMLVDHKQFKAIKPEDIKQQWIVDTKGVWR

SEQ ID NO: 10995 - protein, 218 aa, Debaryomyces hansenii CBS767
MSKCQEVSDNVILLPQTNQLRGLYSIIRDHSTKRGDFVFYSDRIIRLLVEEGLNLLPVEEATIQCYGNQTFKGAKFLGKICGVSIVRAGESMEMGLRDCCRSVRVGKVLIQRDEETALPKLFYEKLPEDISERYVFLLDPMLATGGSAMMAVEVLLSRGVRMDRIFFLNLLAAPEGIRAFHDNYPDVKIITGGIDEKLDENKYIVPGLGDFGDRYYCI

SEQ ID NO: 10996 - protein, 626 aa, Fulvimarina pelagi HTCC2506
MSDLAFQLALIGLAGIAAQWVAWKVQLPAIVLLLAVGLLFGPLLNVMNPAVDFGELYTPLVSTAVAIILFEGGLTLNFREIKETSRAVRRIVFFSGPLVWMLTALAAHYVGGLSWTTSMVLGALLVVTGPTVIMPLLRNAKLKSRPASILRWEAIVNDPLGALFAVIAFEGYLVLHGSHEAEGLAFSLVMALLLAIGGGIAAGRALGWLFARGQSPEYLKAPILFAAVVGMNAVTNLVLEEAGLLTVTVMGITMANAKISSLGELRRFKETITILLVSGLFIALTASLRMETLYSLSWQALGFIFLVLFVIRPIAIGLSTIGVGLDWKERLFVGWIAPRGIVAVAVAGLFGQTLTQMGVADGQDMIAYTFAVVAVTILLHGFTLGPLSKLLNLKAAVRPGILLVGASPFTIAFAKRLKTDEVPVLIADDNWTHISDARYAEIETWYGEILSEAAHHNLNLARFDHMIAATDNDAYNALITTDFAPEIGRSDVFQIGRNGNSERRSMNFTIGGLPLFQPGKTYNELNEMIEKGWVFQSTRLTEEFDYADFRDARPPETQMILWIKPSGAIVFSTLEGISDPVSGDRIISFVPPRLAREKEKIEKASTEREKRQERARQTIEIVTNKA

SEQ ID NO: 10997 - protein, 223 aa, Neisseria meningitidis Z2491
MTTQDELKRIAAEKAVEFVPENEYIGIGTGSTINFFIEALGKSGKKIKGAVSTSKKSSELLAQYDIPVVSLNEVSGLAVYIDGADEVNHALQMIKGGGGAHLNEKIVASASEKFVCIADESKYVSRLGKFPLPVEVVESARSLVSRKLLAMGGQPELRIGYTTFYGNQIVDVHGLNIDQPLTMEDEINKITGVLENGIFARDAADVLILGTEEGAKVIYPCQG

SEQ ID NO: 10998 - protein, 160 aa, Neisseria meningitidis Z2491
MTNIRIGQGYDVHQLTEGRKLILGGVEIPFEKGLLGHSDADALLHAVTDALLGAAGLGDIGSHFPDTAAEFKDADSRVLLRAAYQSVQAQGWQAVNVDTTVIAQKPKLAPHIPQMRANIAADLGIDISCVNIKGKTNEKLGYLGRMEGIESQAAVLLVRI

SEQ ID NO: 10999 - protein, 54 aa, Vitis vinifera
KDFKYYMQTYSIIFGCNSKKSTIDVDLSNLGSGMNISRNDNMHMFSKHVLKICS

SEQ ID NO: 11000 - protein, 309 aa, Synechococcus sp. WH 8102
MTVAATSPDNTSGLADIFDFKAYLAKAKATVEQALDQSLVPERPESLREAMRYSLLAGGKRLRPILCLAACELAGGDAAQAMPTAVALEMIHTMSLIHDDLPAMDDDDLRRGRPTNHKVYGEAVAILAGDALLTRAFEMVALRSPGVPPERLLKVVGELSLVAGAPGLVGGQVVDLESEGKEVDLETLEYIHLHKTGALLSACVITGAMIGGADDELIAALRVYARGIGLAFQIIDDILDITASSEVLGKTAGKDLIADKTTYPKLLGLEESRKRAADLVQEAKGVLKPWASKAQPLLALADYITSRDR

SEQ ID NO: 11001 - protein, 203 aa, Dichelobacter nodosus VCS1703A
MDIMNNLPIPMVVEQTGRGERAFDIYSRLLKERVVFLVGEVNDASANLVVAQLLFLEAENPDQDIHFYINSPGGSVTAGMSIYDTMQFIKPDVSTMVLGQAASMGAVLLAAGAAGKRYALPNSRVMIHQPLGGFRGQASDIDIHAREILFIRERLNQILAKHSGQDLETISRDTERDNFMSAERAQEYGLVDAILTHRESVSA

SEQ ID NO: 11002 - protein, 121 aa, Leuconostoc mesenteroides subsp. mesenteroides ATCC 8293
MAFDKDAIIASLKDATILDLADLVSAIEEEFNVSAAAPVAAAGAADGAAAAKSEFDVELTSAGTAKVKVIKAVREATGLGLKEAKDLVDNAPSVVKEGLSEDDANALKESLEATGASVTVK

SEQ ID NO: 11003 - protein, 462 aa, Thermobifida fusca YX
MTVRSGSGLAANDFQQAAKDHLWMHFTELAAYQDTDVPVITRGEGPYVYDTNGKRYLDGLAGLFVSQVGHGRTEIAEAIAEQSRKLAYFPIWTYAHPTAIELADRLADLAPGDLNRVFFTTSGSEAVESAWKLARQYFKLIGQPTRHKVISRRIAYHGTTMGALSITGLQAIKTPFEPLVPSTIQVPNTNIYRAPVHGDDPEAFGRWAADQVEEAILQNDPESIAAVYVEPVQNSGGCFPPPPGYFQRLREICDRYGVLLVSDEVICAFGRVGAYFGAQRFDYLPDIITFAKGVTSGYVPMGGLIAREHLVEPFREAGNTFLHGSTFAGHPVAAAAALANLDIFEREGLIDHVQANAPAFRATLEKLLDLPIVGDVRGEGYFYGIELVKDKETKETFTDEEAHRLLKGFLSPALFDAGLVCRADDRGEPVVQLSPPLICGPEHFAEMESILREVLTEAWQRI

SEQ ID NO: 11004 - protein, 484 aa, Thermobifida fusca YX
MTSHSDGLRRLRNFINGEYVDSVDGRTAPVVNPATGEAYAEAPVSTAEDVDRAFRAAADAFENGWRDSTPAERQIILNKIADAVEERADELVAAEVENCGKPVKATREEEIWQVTDALRFFAGAARVLEGKAAGEYMADHTSWIRREPIGVVGQITPWNYPMAMAAWKIGPALAAGNTIVLKPSDTTPVSTLLLAEIAAEFLPPGVFNVVTGDRDTGRALVDHPIPRLVSLTGSTRAGYEVAQSASRDLKRLHLELGGKAPVIVFDDADVEKAAEGIAGAGYFNAGQDCTAATRVLAAPGIHDDLAAALAEQAKKTKTAGPDETDAYYGPLNNPNQLDRVSGFFERLPDHAEVLTGGSAVDRPGYFFSPTVVSNLRQGDEMVSEEIFGPVITVQRFDDEDTAVAWANSVKYGLASSVWTKDHARALRVSRRLDFGCVWINTHIPIIAEMPHGGFKHSGYGKDLSLYSLEEYTRIKHVMSYIGRD

SEQ ID NO: 11005 - protein, 193 aa, Symbiobacterium thermophilum IAM 14863
MIVVIDNYDSFTYNLVQCLGELGAAQAVFRNDQITVDQVAALRPEAVVISPGPCTPDEAGISLELIRRLGPTTPILGVCLGHQAIGQAYGGRVVPAPSLMHGKTSLVRHSGEGLFVGLPNPFTAGRYHSLVVDRESLPDDLVVTAETEDGLVMAVQHRVHPVYGVQFHPESILTECGRQLLQNFLRLAQPAAA

SEQ ID NO: 11006 - protein, 378 aa, Arabidopsis thaliana
MEKTSMFSIHEGKPIRCKAAVSRKPGEALVIEEIHVDPPQAYEVRIKIICTSLCHTDVSFSKIDRHEAVGVIESIGEHVNGFQQGDVVLPVFHPHCEECRDCKSSKSNWCARFADDFLSNTRRYGMTSRFKDSFGEDIYHFLFVSSFSEYTVVDIAHLVKISPDIPVDKAALLSCGVSTGIGAAWKVANVEKGSTVAVFGLGAVGLAVGEGARLRGAGKIIGVDLNPEKFELGKKFGFTDFINSTLCGENKISEVIKEMTGGGVDYSFECVGLPSLLTEAFSSTRTGSGKTVVLGIDKHLTPVSLGSFDLLRGRHVCGSLFGGLKPKLDIPILVDHYLKKELNLDSFITHELKFEEINKAFDLLVQGKSLRCILWMNK

SEQ ID NO: 11007 - protein, 567 aa, Oryza sativa
MASSALICDTEQWKGLQAHVGEIQKTHLRHLMHDVERCKAMTAEYEGIYLDYSRQRATGETMEKLFKLAEAAKLKEKIEKMFRGDKINSTENRSVLHVALRAPRDEVINSNGVNVVPEVWGVKDKIKQFSETFRSGSWVGATGKALTNVVSVGIGGSFLGPLFVHAALQTDPEAAESAKGRQLRFLANVDPVDVARSIKDLDPETTLVVVVSKTFTTAETMLNARTLKEWIVSSLGPDAVAKHMIAVSTNLELVEKFGIDPKNAFAFWDWVGGRYSVCSAVGVLPLSLQYGFPIVQKFLEGAASIDKHFRSSSFEKNIPVLLGLLSVWNVSFLGYPARAILPYSQALEKFAPHIQQLSMESNGKGVSIDGVQLSFETGEIDFGEPGTNGQHSFYQLIHQGRVIPCDFIGVVKSQQPVYLKGEIVSNHDELMSNFFAQPDALAYGKTPEQLHSEKVPEHLIPHKTFQGNRPSLSLLLPSLSAYEIGQLLAIYEHRIAVQGFLWGINSFDQWGVELGKSLASQVRKSLHASRVEGKPVLGFNSSTTSLLTRYLAVEPSTPYNTTTLPKV

SEQ ID NO: 11008 - protein, 424 aa, Synechococcus elongatus PCC 7942
MDLKTLIREIPDFPKPGILFRDYTTVLKDPQGWRYSIDRLTELIKPLEPTAIVGIESRGFILGAPLAYQLGLGFVPVRKPGKLPADTHSVEYELEYGSDRLEIHQDALAPGDRVVVVDDLIATGGTASATATLIDRCSATLAGFAFVIELEGLNGRDRPWLEQYGRWLWQVVRYGNFGSSFVYQRPVADLLWERVPNTLLLAICSLITTWAIALPLGIQAAVAQNQRSDRILQLISYLGQGTPSFITALLLLFLAQFLTPLLPIGGMTSLDFEDLTPLQQMADLGRHLILPVLALTLSGFASLQRISRGEMLEVLRQDYIRTARAKGLPEQRVIYVHALRNAINPLITLLGFEFATLLSGAFIAEYFFNWPGLGRLILQAVFAQDLYLVMASLMMGAVMLILGNLLADLLLRWVDPRIRLDDLN

SEQ ID NO: 11009 - protein, 186 aa, Zea mays
MRDRHRSRAEMSSDSSSWARALVQISPYTFSAIGIAVSIGVSVLGAAWGIFITGSSLIGAAIKAPRITSKNLISVIFCEAVAIYGVIVAIILQTKLESVPTSQMYAPESLRAGYAIFASGLIVGFANLVCGVCVGIIGSSCALSDAQNSSLFVKILVIEIFGSALGLFGVIVGIIMSAQATWPAKA

SEQ ID NO: 11010 - protein, 224 aa, Alexandrium fundyense
MGLISFMQHAFGLPQKPAPRIIVLGLDAAGKTTMLYQIKLGKVIETIPTIGMNVESLESKRLSFTAWDVGGRTKIRALWRHYFKGAEGLIFVVDCNDRDRIGDACHELEMVLSDDMDDMKEAVLLVFANKQDLPNAMTASEVTSELGLHGLQHRQWHVQPSCATSGKGLSEGIDWLSSALMRKQAGYLEDDEANGLNEQLAQTSSLKALGSRSLMSAKFLTSLL

SEQ ID NO: 11011 - protein, 228 aa, Borrelia garinii PBi
MENQKMLVAKYAIDRYIKSNMNLGVGTGTTIYYAIKYLSEKIKSGNLKNLKLYATSSDTKYLLSKEQIPCESNFSKLNKNLDIAIDGADEILLEKKSLIKGMGGAHLMEKVIAYNSETLLIIADETKIVKKLGTKMSIPIEVAQNAVGFIMTRLEEMNLDTTLRVCKEKKGPIITDNNNYILDVKMHVENPEGTEKYFKLFPGILEIGIFNHKNTKIVYYQNKQIKEA

SEQ ID NO: 11012 - protein, 399 aa, Vitis vinifera
MQTSCLGSSESKRSRARSHWRSFLNRFTKNSVIRFPSLTPVMSKRSRGKSQSARENVLAVNTFNSSWKNFSLVELQNATKNFHHENLIGKGGYAEVYKGRLKDGQFIAIKRLTQGTPEERVMSFLHELGIIAHVNHPNTAKLIGYGVQGGLHLVLQLSPLGSLGSLLHVTKSKLEWSSRYKIALGTADGLRYLHEHCQRRIIHRDIKADNILLTEDFEPQICDFGLAKWLPKQWTHFNVTKFEGTFGYFAPEYFMHGIVDEKTDIFSFGVLLLELITGRRAVDHMKQSLVVWAKPLLYKNSVAELVDPALDEYDEEEMDRMLLTASLCIEQSPVLRPRMNQASTNFRKVVVLLRGDEYNPDGAQESQNHMPKRTYSNEILDAAEYNSTKCLDERLGEDQ

SEQ ID NO: 11013 - protein, 248 aa, Borrelia garinii PBi
MYKLVLVRHGESEWNKENLFTGWTDVKLSDKGINEALEAGLLLKQEGYSFDIAFSSLLSRANDTLNIILRELGQSYISVKKTWRLNERHYGALQGLNKSETAAKYGEGKVLIWRRSYDVPPMSLDESEDRHPIKDPRYKYIPKRELPSTECLKDTVTRVIPYWTDEIAKEVLGGKKVIVAAHGNSLRALVKYLDNLSEEDVLKLNIPTGIPLVYELDKDLNPIKHYYLGDESKIKSAMESVASQGKLK

SEQ ID NO: 11014 - protein, 5930 aa, Oryza sativa Japonica Group
MPLGNPETSTGSANIISPATSPFSLRVIPRDQHTISRKDISPNALRVLYRLRDAGFGAYLVGGAVRDLLVNGQPKDFDVATDATPEQVKQLFRNCRLIGRRFRLAHVVFGREIIEVATFRANSDDGSGDREMENGMLVRDNVYGTIEDDAIRRDFTCNALYYAIEDFSVRDYTGGFEDVQARLMKLIGDPEQRYREDPVRMLRAVRLAAKLGFQIEEGTAAPIPHLAGLLNEAAPARLFEEVLKLFLSGHGVASFEGLERYGLLDVLFPESAKALKSNRTGALRRMLVEGLANTDARVANDEPVSPAFLFALLLWPAFCRAQATLLKQGVAPEEAQRRAADRVTVQQLSTIALPRRFSLPMQEIWLLQSRFSSRQRKRVFRTLTHPRFRAAFDFLSLRQVASSEHAVDVEFWREAQAQSGRELESSLDAMHSEDGDDESGAPRKRRRRRRRPDQPPFVNAVAAVETTLPADELLQAMLALERGFGRVRDPAVHWGPRALDLDLLLYGTQVLDQPGLQGDNDRVISPGYQHMSTHADSKPWTVPALAEAKRNGQKLVMLTAYDAGFARTFDANGVDLILIGDSLGMVVQGHDSTLPVTVADMVYHTRAVARVLQRALLVADLPFGADATPERALDASLQLLQAGAEMVKIEGAGFKVDIIRYLVEREIPVCAHLGLTPQSVLRLGGFKIQGRGDAARQLVEDARAVAAAGASIMVLECVPTPVAAEVTAAVDVPTIGIGAGPQCDGQVLVLHDFLGLDSGHRRPKFVKDFLAEGGSVAGATRAFADATFNELGALRGQIAQWKREGLRVALVPTMGNLHGGHHSLVALARQYADKVVASIFVNPTQFGPNEDFSRYPRTPEADVAGLEQAGCDAVWLPSVEAMYPLGVDKTTRMHAPGVSEVLEGASRPGHFDGVCTVVARLFLQVQPDVAVFGRKDYQQLAVIKQMVAELSFPVQIVGAEIVRDEDGLAKSSRNQYLSAEQRPVATTIHRTLLGMREGYVAGQARERIEAEATAALQAAGFQVDYAVLRTPELAEPTFDGGGRVALIAARLAPSMHLSLLKTKIHRATVTHSELNYEGSIAIDDNLLAATGIREFEQVHIWDVTNGARFSTYAIRAEAGSGVVSLNGGAARHVQVGDIIIIAAFASMTEQEADSFKPKLDLALRVGPLYVNFARQKYDAAALQALLALAADRDVGGAITRLFRGEQVNLTEGRAALHTALRGDVVDAPVAAEAYATARGIRQRMGVLVRALEDSGVTDVVSVGIGGSDLGPRLVADALRPVTGARLRVHFVSNVDGAAMQRTLATLDPAKTAGILISKTFGTQETLLNGQILHDWLGGSERLYAVSANPERAAKAFAIAADRVLPMWDWVGGRYSLWSAVGFPIALAIGFERFEQLLEGAAQMDAHALDAPLERNLPVLHGLTDIWNRNLLGHATHAVMTYDQRLALLPAYLQQLVMESLGKRVQRDGQPVTVDTVPVWWGGAGTDVQHSFFQALHQGTSIVPADFIGCVHNDDPYTINHQALLANLLAQTEALANGQGSEDPHSDYPGGRPSTLILLDALTPQALGALIAMYEHAVYVQSVIWNINAFDQFGVELGKQLASGLLPALQGEDVAAADRRHCIGHFHFAIVGRAVVLLTEGAQDHRHRGRLRQVIIRAQLDRLHCGGDAGIAGHQQDAHVRAQCAQRLDQRQAGIAAQLQVDQRERRRMLAGQCQGTGGILCGLCFQALAGQAALQGTQRQAEADAAAGPLGRAHPHLAVEAFDGGMGQGQADAHALALAAAEQLARQHGGTGVETMAVVAYFADQVVALDAQVQVHARPAGLLAGIGGIVEQDHQQMAYARVEWQPQRRIVVAMQVDGRPHQAPLLQHLLGAGVAATRCIGRSRGGQCQHALAALNQQLAQGLHVLAHFRLFAALGDIVGEQGHGRQRRVQFMCHRGGMGGQGDDALVAGEALTQRRQFQFALPQGQCQAGGEGQHHCGGNQEVGDHAPAIEIGGVTVGGGKPVVVQSMTNTDTSDVASSVKQVAELWRAGSEMVRLTVNTVEAAAAIPRIVDKLAMMGIDVPLIGDFHYNGHQLLTAEPACAEALAKYRINPGNVGFGKKKDLQFAQLIEFAIRYNKPVRIGANWGSLDQALAARLMDENNLREQPWDAGRVLREALIRSALDSAEQAVELGLPRDRIVLSAKVSGVQELIAVYRDLAQRSDFALHLGLTEAGIGSKGIVASSAALSVLLQEGIGDTIRISLTPEPGQSRTQEVIVAQELLQTTGQRAFTPLVTACPGCGRTTSEFFQELAKVVQNHVREKMPLWKIHHPGAENMTLAVMGCIVNGPGESRHANIGISLPGTGETPAAPVFVDGEKKRADLLIRNATVVDVEHASTLAGQSVVIRGEDIVAVGPDAQLRSQWSAARQIDAKGKYLIPGLWDMHVHFGGGPALIEENKALLPLYIAHGITTVRDCSGDLPEQVLQWRGEIAKGTLFGPRLLSSGAKIEGIKPVWKGTIEVGSEADADKAIARLQHDKVDFVKITDSTLKPELFLYSASAARKAGFKASGHIPMALTVEQAVDAGLASIEHLDYAFKAGSKDEAQIAADFEAGRIDRAEANRRLDASFDRDTAMRAYRDFAKRGVFVTPTLNGGRILDFLDQDDHANDPYLAYIGPGLRATYQWRVDRAAKATPAQIEARHAQYHQVAAVLPLLQEAGVTIIAGTDAGFLNSFNFPGIALHQELQLFVKEGLSAPQALSAATRSGPAWFGQMDRYGGVAQGKAADLVLLTANPLQDIAATEKIDSVILRGNVYDRAALDRMLADTKAKVVAEQARADRKGMRVPLRVMQQQSFARGRRHDDARYFGQRQRDHARFVDRAHPHRAVDAFCNEIRTPIFKDPLQAQLRMPGEECEHGRQQLRLAEGMRHHHPQTAAQCFRLAVEFGLQRLPFVDHALRMALAAQAILGQLQAMGGAQQQAQAELPLQCLQASADRWLGGAQLRGCGREAAGIDDAQEGAQQIQAIGASAYYRRWANAGRIRPLLPPDSPMSTPSLSVAAAPATAPSTPLVLAMAAGAGFSVASLYYSQPMLGLIAQDLGAGERAAGLVPTLTQLGYAMGILLLAPLGDRFDRRNLILLKSALLALALGAAAMAGHLPGLLMASLLVGLMATLAQDIVPAAAVLAPDAQRGQIVGRVMTGLLLGILLSRVVSGVVAEAWGWRTQFVLAAVSVAAMGAVMARALPRFAPTSTLRYPALLGSLLALWREQPQLRRAVASQSLLAVGFSAFWSTLALMLHARLGLGSAAAGAFGIAGAAGALAAPFAGRFADRLGCHAVARLAIAVALLGFGLLLAESWLPAVALLPLLVVSALLFDFGFQSALVAHQTLVYGLVPPARSRLNALLFTGMFIGMAAGGALGSLALAQWGWHGVAWLAVGPAPTRWAAVIQAPGGNRQRDFGSQSGAGPQLQFRTEALCAFAHALQAPMTMAGVLVGDADAIVAHVQQEATRAWWRRALNGQAQRIGAMPRVLGVHIGQCRSQVAAGERAVAQCVDAFAALGQIALGQLHRRLQLAAHCFWRLRGLADFMQAQDQALAALQQGVVQIARNAFTFAISLLQAGAEQRGELATSDAHGQYEQRQHGGHAQQLEPHGLDEGGRDAEAAAGRDRAPDAVLIGGFHVEAIASRRQAQAVPQWLLFAAIQHVADANAGCQCVDVRTLGVQPGQALVGRQPQKTVVGQRGGGDRPALQGNAGHAIHRIEQAGRHLLPCLHCSAQQAALKTHQATAAIEPQMPARIGDHAGDAFEDAGHVGAHCNEGPLADACGESGFAGYQQQVLMLQQGGHRPYRKALRCAEGIDGRGAHPAHATIGVAEQQLAMGVQRQGGAGLLGQATRPLPLLVPVMQHTAFARAYPGLRLVRKQQGVQRLPGERRGQRNQRGTAFDSARQIDPIELPDRRRCLPRCGLQLCGAAFQQGPPQVVGLEVFTVAVHPSVSGAHQRAVGITGADRQGVHAARAEAVEAKIGTYPEVAFARAVGGELHAGSDQVGQAPRLTFGPGQQTMCVCQWRGATDAVGQPYLTLRVFHQCCHLRDGDAGINEGRLVGSAHPYLQIRQYPERATAVMQHPLHAVFRQPGGGRRGLPAPAIEPAQPTIDRCPEAALAVLAEVRHHADRYALLPTVVVQLAACELADAGLEVADPHCVIAPDCQGDHVGGREAAARWWRLAFKTAAVEAVQARTSRQPQQSITVLRNVPYIARRTLADPPCRVLVAGQSAAQGGALHGERGQGGHQQQARQQRRRLVVGLVPAGRSDARTWCADTTGGSDGGRGSVHAARALATGAAASGPAGAGAGRLFAGRTAVRSPRDRPPASPIRAPRTMGHPLAATSMATVTPQEFPAASLAPQQVAALQRALRYVDEHLSQPLRVTELAAAACVSRFHLVRLFRTGTGASPLRYVRRRRIERARQLLPGAQLPMACLAQQLGFFDQSHFVRSFRAETGCSPGHPSMSLATATPAPALLSPTDHALVLIDFQSQMAFATHTIDISALRNNVSLISKGAKGFHVPVLLTTVAEASFSGPMFPELPQIFPGQTVFDRTSMNTWEDQPVIDEINRIGKRRLVMAGLWTSVCIVGPALSALAQGFEVYVITDACGDVSEEAHERAITRMVQAGAVPMTSVQYLLELQRDWARGETYDLTTGIARDHAGGYGIGIQLPAAARAGQAVRLVRRSGALWFRHRAARLRAANGCTFATVAGPVAGAVRAGRAAGMADPYRRACGGRFHRLHRPVGPAQRMVLDARWHLAGRAGAALDSTSKERRMSTLVIRNARITTLDPQQPHAQALAVQDGRIVAVGSDEDIMRGWGNEATLIDAQGRRLLPGLNDSHTHLIRGGLNYNLELRWDGLRSLGDALDMLKAQVDRTPAPQWVRVVGGFTAAQFNEKRLPTLQELNDIAPDTPVFLLHLYDRALLNRAALRACGYSKDTPDPPGGQIVRDSLGNPTGLLLAKPNALILYATLAKGPRLPIEYQANSTRHFMRELNRLGITSVIDAGGGFQNYPEDYQVIEQLHRDDQLTVRIAYNLFTQNKGREVDDFRGWSEILQPRQGDDLLRHNGAGEMLVFSAADFELFNEPRPELPPELEPELHNVVKLLVEKRWPFRIHATYDESISRILDVYEQVNREVPFDGLHWFIDHAETITPRNIERIRALGGGIAVQHRMAYQGEAFVERYGVQAARHTPPVKRMLAEGVPVGAGTDATRVASYNPWVALSWLVTGRTVGGLALYGDENLLEREQALRLWTQGSACLALLAVPSLALACEGGHCTGAGGGQLRWDASLRLRGLYYDPTRFGIGGSEDGHGLLRALASATYAEDSWQAKLQLGLHAENGKAGGPGRTDRSALDVQQAYWRWQRGSFHLQLGRQEAGYGSSRLLSVRDGPNIRLAFDGARVGWKGRLGTLDLMALRPVENRPGAFDDRGEHGAHLWGAYATTVRGQGAGQWDLYLLDYRREGARFSAGFGIERRQTVGARWAVELRTSAATLDIRAWTLATDTGWRWTDLPLQPRLGLKADIASGDGNLHDGRLGTFNALFPKSAYFSEASLLAPANLMDVQPTLTLRLHDAVTTELGVQMAWKHRRADAVYTTPAPLVALPGTAGGARRIGQRTLAMAAAAGLGRCGSCAEAGRWPGHAVCLDRWSMAMVNATASQPPAQAAGAWSPLKIRMFRSIWLAILASNIGTWVNDVAAAWVMAERTGSPLMVALIAAQTAVPAWVRARALALYIMVFSAGMAAGGLSWGALAQRTSPELALLVAAAGAVIGGLLVWRVRIAGTEDLNLRPAGHWPAPELSVPVSNDRGPVLVTIEYRIDDADRAAFQAQMRALGTIRRRDGAVVWGVVEDVASPGIHLEYFVTPSWLEHLRQHERITADDKAIQEVLRELHRGERAPVVRHFVGGHDPLPKTGVPHHHSDI

SEQ ID NO: 11015 - protein, 431 aa, Zea mays
MGDKENAPPLGARGAAAPRLTRAAAKRAAAAAAAAEGPGDAKRRRVALGELPALANNAGLRAPSCPVKPSKPASRPGRHARNVAPEARGPSSAHEAERCASSPPRTADADAESNSVSNPAPRATAYADSCASSSPPRAAAAGAPADPQLCGSYASDIYTYLRSLEVEPQRRSRPDYIEAVQADVTAHMRGILVDWLVEVAEEYKLVADTLYLAISYVDRFLSVNALGRDKLQLLGVASMLIAAKYEEISPPHPEDFCYITDNTYTKEELLKMESDILKLLKFELGNPTIKTFLRRFTRSAHEDKKVANPFLFMRSILLMEFLGSYLAELSLLDYGCLRFLPSVVAASVMFVARLTIDPNANPWNMKLQKTTGYKVSELKDCIVAIRDLQLNRKFPSLTAIRDKYKQHKFKCVSTLLPPVVVPTSYFEDLAE

SEQ ID NO: 11016 - protein, 224 aa, Pseudomonas fluorescens Pf-5
MQPFAIAPSILSADFARLGEEVDNVLAAGADIVHFDVMDNHYVPNLTIGPMVCAALRKYGITAPIDAHLMVTPVDRIIGDFIEAGATYITFHPEATLHVDRSLQMIREGGCKAGLVFNPATPLDVLKYVMDKVDMVLLMSVNPGFGGQKFIPGTLDKLREARALIDASGRDIRLEIDGGVNVGNIREIAAAGADTFVAGSAIFNAPNYQEVIEKMRAELALARP

SEQ ID NO: 11017 - protein, 320 aa, Microcystis aeruginosa PCC 7806
MVQDQKPTVIITGTTSGVGLYAAKSLAQRGWFVVMACRDIPKMEQAAKELNIPRDNYCIEFIDLGSLNSVRRFVKNFRALGRSLTALVCNAAIYLPLLKEPLRSPDGYELSMATNHLGHFLLSNLLLEDLKNSPSPDRRLVILGTVTHNPDELGGKIPPRPDLGDLEGFAKGFKEPITMADGKKFESVKAYKDSKVCNVLTMRELHKRYHESTGITFTSLYPGCVADTPLFRNHYPFFQQFFPWFQKNITGGYVSQELAGERVAIVVADPQYRQSGAYWSWGNRQKKEGKSFVQRVSPQARDEERGEKMWEYSAKLVGLA

SEQ ID NO: 11018 - protein, 507 aa, Thiomicrospira crunogena XCL-2
MPETILRRVLKAPVYDVAEQTPLEKAPLISRRVRNNIWLKREDLQPVFSFKLRGAYNRLYHLTDAEKERGVIAASAGNHAQGVALSATKMGIKAVIVMPRTTPTIKVNSVRNLGGEVVLHGDAYDQAAAHAKMLCEENGYTYIPPYDDVDVIAGQGTIALEMLRQSKPFDVIFVPVGGGGLIAGISAVIKQVSPETRIVGVEPEDAACMTEALKAKERVKLKSVGIFADGVAVAQVGEIPFRIAQTCVDEMVTVKTDEICAAVKDIFEDTRAIAEPAGALALAGMKKFVEEKGVADLNMAVIVSGANMNFDGLRYISERTEIGEKREAIFAVTIDEKPGSFKRFCELLGDRRAITEFNYRYSDRQKAVVFVGVRTEGGTAEKEALIKQLKQCDYELEDLSDDEMAKLHLRFMVGGHAKGVENELLYRFQFPERPGALLQFLIQMSEEWNISLFHYRNHGAAYGRVLVGVQVPPEQKPEFEAYLDNLGYRYFSEQDNIGYQLFLKPIE

SEQ ID NO: 11019 - protein, 514 aa, Rickettsia typhi str. Wilmington
MNQSNIISPELLDERKNIARQGGGEARINAQHKKGKLTARERIEVLLDPNSFTETGMFVSHRCDNFGMQNKKFLGDGVVTGHGTINGRLVFIYSQDFTVLGGSLGEYHAKKICDIIDQAIATGAPVIGINDSGGARIQEGVDALAGYGELFQRNVLASGVIPQITLIMGPCAGGAVYSPALTDFIFMVKNSSYMFVTGPDVVKTVTGEEVTQEKLGGARMHTTKSGVADLAFNNDIEALLEIRKFFNFLPSSNRSTLPVRPTVDPADRVDMSLSTLIPNTPNKPYDMKELVERIVDEGEFFELQPDFAKNIIIGFGYMEGYPVGFVANQPLHLAGCLDINASRKAARFIRFCDAFNISIVSLVDVPGFLPGTSQEHEGIIKHGAKLLYAYAEATVPKITVITRKAYGGAYIVMNSKHLRGDINYAWFNSEIAVMGAEGAAEIIFKEECKDNEAKKQKIDEYRKIVTSPFVAASRGYLDDIIRPQNTRWRICKALNFLRTKKVSLPWKKHDNLPL

SEQ ID NO: 11020 - protein, 220 aa, Thiomicrospira crunogena XCL-2
MTQDELKQQVAIAAIEYVVPDTFIGVGTGSTANFFIDELAKIKGKIKGAVASSEATAERLKDHGIPVMELNSVDELSVYIDGADEADPKLNLIKGGGGALTREKIVLAVAKQFVCIADDSKKVAVLGKFPLPIEVIPMARSYVAREVVKRFGGEPVLREGFTTDNGNVILDIHGLEITDPVAMETELNGIVGVVTNGLFAARNADIFLCGTANGVETIKA

SEQ ID NO: 11021 - protein, 195 aa, Pyrococcus horikoshii
HHHHHHSSGLVPRGSHMMNPFHDLEPGPNVPEVVYALIEIPKGSRNKYELDKETGLLKLDRVLYTPFHYPVDYGIIPRTWYEDGDPFDIMVIMREPTYPLTIIEARPIGLFKMIDSGDKDYKVLAVPVEDPYFKDWKDISDVPKAFLDEIAHFFKRYKELEGKEIIVEGWEGAEAAKREILRAIEMYKEKFGKKE

SEQ ID NO: 11022 - protein, 507 aa, Synechococcus sp. WH 8102
MVATATNPLRVGLRQERVIAPQCLVIFGASGDLTHRKLVPALFELFKQRRLPSEFALLGCARRPWSDDEFRGKMAEALASKIAENQEAWDQFVSKLFYEPVDLQQPEDVVRLGKRLETVDQQCATRGNRTFYLSVSPKFYGSGCRALADAGLLKDPQRSRVVIEKPFGRDYGSAQALNRVVKSCGQENQIFRIDHYLGKETVQNIMVLRFANTIFEPIWNRNYISSVQITAAETVGVEERAGYYETSGALRDMVQNHLTQMLAITAMEPPGRFDPEAIRNEKAKVLQAARLADEQEPWNCCIRGQYGPGGSHDAPLAGYRQEPGVDPNSTTETYVAMKLFVDNWRWQGVPFYVRTGKRLAKRLSEVVLTFREAPVHLFDAATGGPTANQLILRIQPDEGAEFRFEVKSPGSGMRSRPIDMEFSYDESFGEPSDEGYVRLLADAMLSDPTLFTRSDEVEAAWRLYTPLLELIEDSPWQLPIHPYESRTWGPAAADALLARDGLLWRRP

SEQ ID NO: 11023 - protein, 421 aa, Vigna angularis
MDSFSRLSIFCLFISLLPLFSSPALLFQGFNWESSKKGGWYNSLKNSIPDLANAGITHVWLPPPSQSVSPEGYLPGRLYDLDASRYGSKNELKSLIAAFYEKGIKCLADIVINHRTAERKDGRGIYCIFEGGTPDSRLDWGPSFICRDDTAYSDGTGNNDSGEGYDAAPDIDHLNPQVQRELSEWMNWLKTEIGFDGWRFDFVKGYAPSISKIYMEQTRPDFAVGEKWDSLSSGQDGKPNYNQDSHRGALVNWVESAGGAITAFDFTTKGILQAAVQGELWRLIDPNGKPPGMIGVKPENAVTFIDNHDTGSTQRLWPFPSDKVMQGYAYILTHPGTPSIFYDHFFDWGLKEQIAKLSSIRVRNGINEKSTVKILASEGDLYVAKIDNKIMVKIGPKMDLGNLIPSNFHVATSGQDYAVWE

SEQ ID NO: 11024 - protein, 463 aa, Dichelobacter nodosus VCS1703A
MSTGKIVQIIGAVVDIEFPAAEMPNINDALVSQEANVTFEVQQLLGDGVVRTIAMGSSDGLRRGMVIENTGDAIKVPVGKATLGRIMNVLGEPVDHGGAINAEDKWSIHRAAPAYDELSNSTELLETGIKVIDLLCPFAKGGKVGLFGGAGVGKTVNMMELIRNIAVEHSGYSVFAGVGERTREGNDFYYEMKESDVLDKVSLVYGQMNEPAGNRFRVALTGLTMAEYFREEGRDVLFFVDNIYRYTLAGTEVSALLGRMPSAVGYQPTLAEEMGKLQERIASTKKGSITSIQAVYVPADDLTDPSPATTFAHLDSTVVLSRQIAELGIYPAVDPLDSTSRQLDPLVVGEEHYSTARRVQGVLQRYKELRDIIAILGMDELSEDDKAVVTRARKVQRFLSQPFFVAEVFTGAPGKYVPLKDTIRDFKAIVDGEYDHLPEQAFYMVGSMEEAVAKAEKMQAEHK

SEQ ID NO: 11025 - protein, 239 aa, Magnetospirillum magnetotacticum MS-1
MPDLDTIVRDIAEEMRARPDRGEVARYIPELAGVDPQAFGLVVIDGDGRAAVGGDADIPFSIQSISKVFTLTLALGMVGDRLWRRVGREPSGSPFNSIVQLERENGIPRNPFINAGAIAVTDVILSGHQPREALGEILRFMQFLAQDNGIAIDEKVAASEKRTGFRNAALANYMRSFGVIENPVDYTLGVYFHHCAIAMSCRQLATAGLYLAYSGLHPLADTRDLGRAARGQLNHGQVP

SEQ ID NO: 11026 - protein, 408 aa, Bacillus subtilis
MGLIVQKFGGTSVGSVEKIQNAANRAIAEKQKGHQVVVVVSAMGKSTDELVSLAKAISDQPSKREMDMLLATGEQVTISLLSMALQEKGYDAVSYTGWQAGIRTEAIHGNARITDIDTSVLADQLEKGKIVIVAGFQGMTEDCEITTLGRGGSDTTAVALAAALKVDKCDIYTDVPGVFTTDPRYVKSARKLEGISYDEMLELANLGAGVLHPRAVEFAKNYQVPLEVRSSTETEAGTLIEEESSMEQNLIVRGIAFEDQITRVTIYGLTSGLTTLSTIFTTLAKRNINVDIIIQTQAEDKTGISFSVKTEDADQTVAVLEEYKDALEFEKIETESKLAKVSIVGSGMVSNPGVAAEMFAVLAQKNILIKMVSTSEIKVSTVVSENDMVKAVESLHDAFELSKHPSAV

SEQ ID NO: 11027 - protein, 330 aa, Leuconostoc mesenteroides subsp. mesenteroides ATCC 8293
MAILVLGGAGYIGSHMVKRLIEADRDVVVVDALFTGHREAVNPKAKFYQVDIRDKTALSEVFDKENIEQVVHFAAFSIVPESVANPLKYFDNNTSGMITLLEVMKEHDVKQIVFSSTAATYGNPVNIPIKETDPQRPINPYGESKLMMEKIMAWSDQADGVKWVALRYFNVAGAAEDGTIGEDHAPETHLVPIILQAGLGQREYIEMFGDDYNTPDGFNVRDYVHVLDLADAHILALKYLADGNDSNQFNLGSATGFSVKEMVEAARSATGVDIPAKIGPRRAGDPDILIANSDKARDVLGWAPKYDNVQDIIKTAWNWHKNHPSGYNDK

SEQ ID NO: 11028 - protein, 355 aa, Triticum aestivum
  misc_feature (247)..(247): Xaa can be any naturally occurring amino acid
MMTANAKLQKQALLPPRSPFPTAASPSPYADHGPIARPQGATHHRFGHGHGHGHHQRTSSESIIEEQPSWLDDLLDEPETPVRRAGHRRSSSDSFALFDGSAASGAFANGFDEIGGGGQAAPWGGVQEYYAKPSSYGRPQGRPWEQGMPNLAGYRPGPPVLVREKLGGHHGPLSASRDHEHAMDKRALDELGAERKDGVLPKYAQSEADTKRAKQQYAQRSRVRKLQYIAELEGKVQSLQNFFMSEXMQSEGIEVSAEMEFLTQQNIMLDLENKALKQRLESIAQEQVIKRVQQEMFEREIGRLRSLYQQQQQPPQPPTLGRSNSRDLDSQFASMSLKQKDPNSGRDAVSGPLRT

SEQ ID NO: 11029 - protein, 314 aa, Arabidopsis thaliana
ILAELAMEAGLPDGVLNIVHGTNDTVNAICDDEDIRAVSFVGSNTAGMHIYARAAAKGKRIQSNMGAKNHGLVLPDANIDATLNALLAAGFGAAGQRCMALSTVVFVGDAKSWEDKLVERAKALKVTCGSEPDADLGPVISKQAKERICRLIQSGVDDGAKLLLDGRDIVVPGYEKGNFIGPTILSGVTPDMECYKEEIFGPVLVCMQANSFDEAISIINKNKYGNGAAIFTSSGAAARKFQMDIEAGQIGINVPIPVPLPFFSFTGNKASFAGDLNFYGKAGVDFFTQIKTVTQQWKDIPTSVSLAMPTSQKQ

SEQ ID NO: 11030 - protein, 477 aa, Synechococcus elongatus PCC 7942
MNQKLSRFPKSSWAYVVIACSIAIALIFSSPVKAKLPLGDRLTWGNAVTETSPAYRQALNQAKTFRMPAEFEPITSIWMAYPTYENQAGYPSQTVQKAMVKAIAPTVKIDFLLNEPEEKVIINGWLKTAGIPASQVRYHLVPHEDLWIRDMGPIFAVNADQTQVVDFGFNAWSYLAATDPAAMTDEQVDRKVAGDLDLPILRSSLISEGGNREFNGKGTLMLTEAVELQRNPGLTKEKIETELKRVFNLKKVIWLQEGVIDDELSYRGKLPDGSLTVLATGGHIDEYARFVDSNTILLAEVTAEERASDPLAAINYQRLEENLKILQAATDQDGKPFRIVRIPAAKPIYVNMTKEDAVFQALQELTFEDGTVIQDDDQIKTILAASYLNFVIANDVVIVPRYWQPDRNLEYQQKDQAALAAFQSVFPNKKIVAINPENINAGGGGMHCIVQQQAVVDAVARSLSTGAGDRSKSRSNL

SEQ ID NO: 11031 - protein, 181 aa, Alexandrium fundyense
MGLSLSRIWERVIGKVDMRILMVGLDAAGKTTILYRLKLGEVVTTIPTIGFNVETVEYRNLRFTVWDVGGQDKIRRLWRHYYQGTNGLIYVVDSNDRDRIEDAREELAKILIEDEMRDAALLVFANKQDLPNSMTAAEVTEKLGLHSLRHQQWYIQSACATTGDGLYEGLDWLSRTLSGRK

SEQ ID NO: 11032 - protein, 82 aa, Alexandrium fundyense
MIIPIRCYSCGKLIGNKWERYLQMLQSEMSEKEVLDALGLNRYCCRRMLLTHVDLIEKVMNYNIYEKRGLSLSSEAVQMQQG

SEQ ID NO: 11033 - protein, 173 aa, Brassica napus
  misc_feature (61)..(61): Xaa can be any naturally occurring amino acid
SNSAQEAGSPVMIDAMSHITSCFSSDAKVLKKAIQKSLLVSADMAHALHPNFMDKREENHXPKMHGGLVIKHNANQRYATNAVTSFVFREIAEKHNLPVQDFVVRNDMGCGSTIGPILASSVGIRTVDVGAPQLSMHSIREMCAADDVKHSYEHFKAFFQEFTHLDAKLTVDV

SEQ ID NO: 11034 - protein, 173 aa, Alexandrium fundyense
MAANPKVFFDMIIGGASTGRIVMELRADVAPKTAENFRCLCTGEKGTGKSGKPLHFKGSAFHRVIPDFMCQGGDFTAGNGTGGESIYGSKFADENFTLKHTGPGILSMANAGPNTNGSQFFLCTVKTGWLDGKHVVFEIVTDGMDVVKKIEAVGSQSGKTAKAVVVADCGQLS

SEQ ID NO: 11035 - protein, 93 aa, Zea mays
KVNQIGSVTESIEAVRMSKKAGWGVMASHRSGETEDTFIADLSVGLATGQIKTGAPCRSERLAKYNQLLRIEEELGAEAVYAGANFRTPVEPY

SEQ ID NO: 11036 - protein, 794 aa, Opitutaceae bacterium TAV2
MQDAGASFIQDMAVILLVALVVGRICQRIRLSVIVGYLLAGILVGPFMGSFSLVTNEQQIETVAQVGLVFLMFSIGLKLSLRKMRRLGAGMIVAVFSSAGILYFIARSAGSAAGLDGTQTMFLGGAFMVCSSMIMSKVLQEEGVSHEQPGQLALGFGVLEDVVAVIMLTTLNSLVQFGVASTGEAAGSATGTEGAAATMVAAPPAPEIGTTLGHFGAFVVLAGVAGLLLVPWMLRRMSIKIGGELQTLGTAGLLFALATIAQRAGYSLALGAFLLGMIISETPQKNQVERTFEGMRDVFSSVFFVAIGMQINPALLGGAWVAILGLTVAVLAARTLAPTLGLILIGTAPKDALRTGLALTPIGEFSFIIAQLGVSAKVMPAKFYPTVVGVSLLTTLVAPLLTRRSHAISDRLLAWQPRWLASLVRYYQGWLERFDARSQRSALWQQSRPRLIRIGVGVFFVTGVLMFSEPLLELARHWMGPGWDYVHAPDIIFWTCLSLILVGPLVSLWRNASALAVLCARISLQGQPHAAKLMPVVTAGLKTGVSAALYVWLGALLPGTGSLARWLLVVIGVVALLALFLLRRRLMAWHGVAEVELQTFVDDAKGGDGSSGTAVPWLRTHSEWEMQVGECVLPDLADCRGRTLVELNLRHDHGCSVVSIERQGTLIPMPPPSTALYPLDKVLLMGTQAQIEAGRHFLTQVTGTSHASGFEDLGTEKIPLPAASPAAGRTLRELGLIQTHQVQVVGIHREIRRLLNPGGDEMLMPGDELLVLGTSDKIQAFREWLTPQPPSATG

SEQ ID NO: 11037 - protein, 521 aa, Arabidopsis thaliana
MADPISEPLLSHLTDDSGVNEKTRLEALTFDKIVEQSLSDFGFWQFFQISLVGLALLFDAQQIFITVYTDAYPTWHCLNHTICDPSASDICKLPRSAWEWDGGSQGKSVISEFGLECSSSLLRGMPSSAFYIGAIVGGFFLALIPDDSLGRKKLVLFSTFAMSITSISVIFSTNVWIYTFLKFIIGFSRSQTWSYALVLISERVSTRWRPRATMIPFTLFVLGFMSLSGIAFLAQDSSWRYLYLYTSVPAVFYCIFLYLFALESPRWLHMQGKDKEAIDVLTKMSPKEKAYLESVVSKLPLKQENFEQAPTYSIKDFFFRKWAFRRILVVMIIMFGLGISYYGVPLAARDIDVNIYLSETLNALVELPTFVITPILLERFNRRSSVLVNTLLGGASGVLCFVLSILGKTEIAFAFELGTFFCARIGFNLMAVFMVEMFPTCVRSSATMMFRQALVVGGACCPLIASIGRYIPSVSFAIFGIAMSGLGMFVLILPETKGLSLCDSMEEQEKRDQAVNTSHVC

SEQ ID NO: 11038 - protein, 182 aa, Brassica napus
MESDEAAAAAAAASPQGSGGTVTPAPKKRGRKPKIKEDSQTPSSSSQQSGGKKTKQSVDEKYTQWKGLVPILYDWLANHNLVWPSLSCRWGPQLDQATYKNRQRLYLSEQTDGSAPNTLVIANCEVVKPRVAAAEHISQFIEEARSPFVKKYKTIIHPGEVNRIRELPQNSKIIGTHTDSPD

SEQ ID NO: 11039 - protein, 494 aa, Arabidopsis thaliana
MYRTAASRARALKGVLTRSLRPARYASSSAVAETSSSTPAYLSWLSGGSRAALTSLDMPLQGVSLPPPLADKVEPSKLQITTLPNGLKIASETTPNPAASIGLYVDCGSIYEAPYFHGATHLLERMAFKSTLNRTHFRLVREIEAIGGNTSASASREQMSYTIDALKTYVPEMVEVLIDSVRNPAFLDWEVNEELRKMKVEIAELAKNPMGFLLEAIHSAGYSGPLASPLYAPESALDRLNGELLEEFMTENFTAARMVLAASGVEHEELLKVAEPLTSDLPNVPPQLAPKSQYVGGDFRQHTGGEATHFAVAFEVPGWNNEKEAVTATVLQMLMGGGGSFSAGGPGKGMHSWLYRRVLNEYQEVQSCTAFTSIFNDTGLFGIYGCSSPQFAAKAIELAAKELKDVAGGKVNQAHLDRAKAATKSAVLMNLESRMIAAEDIGRQILTYGERKPVDQFLKSVDQLTLKDIADFTSKVISKPLTMGSFGDVGCSEL

SEQ ID NO: 11040 - protein, 124 aa, Glycine max
TAEEINARKPKSALYRTLRLRVGLAKPSRIFFHGGYQSSNGGDHGGGSRGGASGGRRRRQPSNSKAVCLNNQDCALQTSTCKSHGGTVDCSIGIQLAFSGTDRHLAVLNSWYEVKNLRQYSLYG

SEQ ID NO: 11041 - protein, 664 aa, Thiomicrospira crunogena XCL-2
MNTSNKRVQPQLGRRQFVKGIALSTISAAIGSHLPSAWAKEEFSAIGTGNLNPKQPVLIGPEFDLTISETPVNITGSPVKATLINNSLPAPTLVWREGETVTIRVKNTLSVDTSIHWHGIILPFQMDGVPGLSYDGIKPGETFTYQFTVQQHGTYWYHSHSKFQEQTGLYGALVVLPKKADPLDYDHDFVIQLSDWSDSAPDTIYSNIKKMGDYYNYSQRTVGDFWHEVKTYGFSKAWEKRKMWNQMRMTDRDLSDVTGATYTYLMNGLSPKAHWRTVIESGKKVRLRFVNSSAMTFFDVRIPGLKMTVVAADGNLVQPVEIDEFRIGVAETYDVIVEPDTSKQAYAIFAQAIDRSGFAIGSITSDPTQLADTPEMDPLPILSMTDMGMDMNSTSHPMNMDGEMKGMSHSSQSMDMSNGSQSMTPSDHNSMNGMKHNMSSMQQQDYGHALAMEKNQMGMDVSNIDHSKHAHGMDNMNVNLDDITIPMDMSPQLPQIKTPSAEGAQIGMRAMAPQYRLDDPGVGLRENGRKVLTYADLKNRFPTRHDPKPTKELVMHLTGNMERYMWSINGIPFEKAEPLNFQYGDRVRITFINDTMMNHPMHLHGVWSDLETGDENHIPRKHTVIVQPGSKISYRVTMDAKGDWAYHCHLLYHMMGMFRKVQIR

SEQ ID NO: 11042 - protein, 430 aa, Arabidopsis thaliana
MALAMMIRNAASKRGMTPISGHFGGLRSMSSWWKSVEPAPKDPILGVTEAFLADPSPEKVNVGVGAYRDDNGKPVVLECVREAEKRLAGSTFMEYLPMGGSAKMVDLTLKLAYGDNSEFIKDKRIAAVQTLSGTGACRLFADFQKRFSPGSQIYIPVPTWSNHHNIWKDAQVPQKTYHYYHPETKGLDFSALMDDVKNAPEGSFFLLHACAHNPTGVDPTEEQWREISQLFKAKKHFAFFDMAYQGFASGDPARDAKSIRIFLEDGHHIGISQSYAKNMGLYGQRVGCLSVLCEDPKQAVAVKSQLQQLARPMYSNPPLHGAQLVSTILEDPELKSLWLKEVKVMADRIIGMRTTLRESLEKLGSPLSWEHVTKQIGMFCYSGLTPEQVDRLTSEYHIYMTRNGRISMAGVTTGNVGYLANAIHEVTKSS

SEQ ID NO: 11043 - protein, 481 aa, Bradyrhizobium japonicum USDA 110
MRSAHLGEDTMSVVGIDTGFELGAAPSVPDEISRRLEAMPGSPYVWRLVILLSLGGCFEIYDLFLTGYIAPGLSRSGLLSTTTQAFFGFAGIGAFVAATFAGLFVGTFFLGFLADRFGRRAIFTYALLGYTAASVIMACQTSPEGLLFWRFLAGIGIGVEVITIDAYITELVPSRMRGRAFAVNQSIMFVAVPVVAFLAWWLVPLAPYGVEGWRWVVLIGAAASMIIWVLRLFLPESPLWLARHGRNEEALRILTTLEAASGGAGSRPATSPARQAVRSTTNVSFADLFRPPYLSLVVLFMVFNLCQAFGFYGFANWVPTLLVEKGINVTKSLQYSFIVAFAYPIAPLLASSFADKFERRWIIAGACVAIIVFGMAFAQLTEPALLIVCGVLLTACNTTMSYAYHAYQTEVFPTQIRARASGLVYSMSRLSATFSGFIVAYMLKEGGVTGVFGLITAAMLIVVIAMALFGPNVRGKPLDAV

SEQ ID NO: 11044 - protein, 702 aa, Neurospora crassa
MAPRAEGSSTLKRARGSTDDNDSFKKPRRSERLSSQRTGDSPEPKQKTPLKTTKQLPSPVTHDSDEFPQDSKEPTATPPAGRPSQLSQISPRPENQHSQSQASQLNDTQAFSQLPDLDKALSDEVEDEVKEGVWGYLFPLDPRYGGRCVVLRRRAACPLPDTVSQAVGSKRGKRGQKALIKEEHDLDKTKVKGLPSGGYLIGRHPECDIQIEDPIVSNRHCIIFTENKGNDTIAVLEDLSSNGTFVNEAIVGRNRRRELQELDEIAVLGTARFIFRYPKSRHTSAFRQQYTMLQKLGKGHFAEVYLCVEKSTGTQYAVKVFSKTPGVEERSKDEGLQQEIAVLMGVSHPNVLCLKDTFNEPNAVHLVLELAPGGELFNYIVKKTKLSENECRKLFTQLFQGVKYLHDRNIVHRDIKPENILLVDDDLHVKLADFGLAKIIGEESFTTTLCGTPSYVAPEILTDTRHRKYTKAVDVWSLGVVLYICLCGFPPFSDELTSPDFPYSLSDQIRQGKFDYPSPYWDPVDDLALDLIDSMLVVDPEKRFTIDDCLSHPWMTQKTPGVNDSTNGLVNGIAGLDVTRRGVLRERTLLSSINTVEIADKIPLGENKPELKIYKKNPTETVGGPSEHELAGAQAGPSRQKEARPDDNRDPNEFMKMGGKGDEVLFADDPKSNYPTAKKDAKDIVESTTKTNGKGKGKGKKK

SEQ ID NO: 11045 - protein, 350 aa, Tropheryma whipplei str. Twist
MYFRGIINEYRSRLGLDADLKVVTLGEGNTPLVYSEALSSLTASSVWLKFDGANPTGSFKDRGMTVAVSKAVNSGVRTVICASTGNTSASAAAYSAAAGIECVVLIPEGFVSHGKLCQAVAHGARVLQIRGNFDSCLRVARELAEIHPVHLVNSINPDRISGQKTAAFEIIDALGDAPDYHYLPVGNAGNYTAYYLGYSEEKVRGNSTHIPRIFGFQASGAAPIVSGHIVENPQSIATAIRIGNPASWKQALHAQHACNGYFGSIDDSGILEAQKLLARTCGLFVEPASAISVAGLLASKPPEGSSVVCTLTGHGLKDQQLAFRKSDGTEYSLPSLPGDSQSIASYLNLA

SEQ ID NO: 11046 - protein, 415 aa, Bradyrhizobium sp. BTAi1
MSTHPAVANGTYDVARIREDFPALALQVYGKPLVYLDNAASAQKPRAVLDRMTQAYTSEYANVHRGLHYLANAATEAYEGGRERVTRFLNARRNEEIIFTRNATEAINLVASSWGGPNIGEGDEIVLSIMEHHSNIVPWHFLRERQGAVIKWAPVDDEGNFLIDEFEKLLTAKTKLVAITQMSNMLGTLVPVKEVVRIAHARGIPVLIDGSQAAVHLAVDVQDIDCDFYVFTGHKLYGPTGIGVLYGKYDRLAAMRPFNGGGEMIREVARDWVTYGDPPHRFEAGTPMIVEAVGLGAAIDYVNSVGKDRIAAHEHDLLTYAQERLREINALRIIGTAKGKGPVISFEMKGAHAHDIATVIDRQGVAVRAGTHCVMPLLERFNVTATCRASFGMYNTREEVDQLAQALIKARDLFA

SEQ ID NO: 11047 - protein, 184 aa, Zea mays
MCGLNVVGSQKKKKKKKKKKKKKKKKKTHASGLAHGSHGEQRQHTQLSSKRDREAGVMATVSAAVVTTIVARAAIARPNALGLPALRARSERVRCSYAKDAAPVSTKGAGASLLAAAGAVTASAGPALALVDERMSTEGTGLSLGLSNNLLGWILLGVFGLIWSLYTIYTSDLDEDEESGGLSL

SEQ ID NO: 11048 - protein, 356 aa, Magnaporthe grisea 70-15
MSRANPPSNSSGSRKISFNVSEQYDIQDVVGEGAYGVVCSAIHKPSGQKVAIKKITPFDHSMFCLRTLREMKLLRYFNHENIISILDIQKPRSYETFNEVYLIQELMETDMHRVIRTQDLSDDHCQYFIYQTLRALKAMHSANVLHRDLKPSNLLLNANCDLKVCDFGLARSAASQEDNSGFMTEYVATRWYRAPEIMLTFKEYTKAIDVWSVGCILAEMLSGKPLFPGKDYHHQLTLILDVLGTPTMEDYYGIKSRRAREYIRSLPFKKKVPFRTLFPKTSDLALDLLEKLLAFNPVKRITVEEALKHPYLEPYHDPDDEPTAPPIPEEFFDFDKHKDNLSKEQLKQFIYQEIMR

SEQ ID NO: 11049 - protein, 318 aa, Leuconostoc mesenteroides subsp. mesenteroides ATCC 8293
MATKKMILDLDTGVDDALALAYAVADPNVDLIGIISSYGNTLVETAAQNSLNLLHLLGADDVPVFIGASHSSTTNNFEVMPISQLIHGKNGVGEITLETSPRQIETQSAVDFLIESAHQYKENLIFIPTGPLTNLAAAIEKDNDVATLIGNTTLMGGALTVPGNLTPFTEANIHQDPEAADFAFVHQQNLTMVGLDVTLRTLLTKKETAAWRTLGTLAGEKFADLMDFYIDAYANLNINKNGAALHDPLAVAVGIDPSYVTSIALAMRVTYDKESGDYGRTIGDKEKLLVPTTTKAAVLVDSKRFVHDFQNLMLTVLQ

SEQ ID NO: 11050 - protein, 478 aa, Bradyrhizobium sp. BTAi1
MSFSNLGLSDKVLAAVAATGYTTPTPIQEQAIPHVLARRDVLGIAQTGTGKTAAFVLPMLTILEKGRARARMPRTLILEPTRELAAQVKENFDRYGAGQKLNVALLIGGVSFGDQDTKLTRGVDVLIATPGRLLDHTERGGLLLTGVELLVIDEADRMLDMGFIPDIERICKLVPFTRQTLFFTATMPPEIRRVTETFLHNPQKVEVSRPATTAVTVTQLQVPGGREAHQKREVLRKLLREAKDLKNAIIFCNRKRDVAILHKSLQKHGFSVCALHGDMDQSARMAALDQFRKGELPLLVASDVAARGLDIPEVSHVFNFDVPHHSDDYVHRIGRTGRAGRTGTAISIVSPADQKSITAIEKLIGQSIPKAEGDYEVAASADEDSHERRPRDGARRSRGKAPREREPREIRETRPSAAAPRPAQAATPRPAPSPRNDPARTEQPRHEPRRPRRDHDNEPADHSHLPAFLLRPVRAPLP

SEQ ID NO: 11051 - protein, 255 aa, Bradyrhizobium sp. BTAi1
MTGRFDLRGKVAIVTGGNGGIGLGMARGLADSGADIAVVGRNAAKSKTAVADLAGRGVRAIAVTADVSNQYDVAAMVAQVSRELGRIDILINNAGMSIRKPPHLLELEEWREVIDTNLTSAFLCSKAAYPALKANGGGKIINIGSMLSIFGASFAPAYAASKGGIVQYTRACACAWAPDNIQVNAILPGWIDTDLTRAARQQIDGLHDRVLARTPAGRWGDIDDFAGIATFLSSPASDFVTGTAIPVDGGYSISA

SEQ ID NO: 11052 - protein, 541 aa, Desulfotalea psychrophila LSv54
MTVTQLSPLENYKVISGPIVMVVMDGLGLGEDGEQNGVYAAHTPTLDGLFQEKLFTSLKAHGTAVGLPSDADMGNSEVGHNALGAGRIFVQGAKLIDEALSRGDVFSGAAWQKIVECGESAGTVHFIGLVSDGNVHSNISQLFQLLDACAEAGIERVRVHALLDGRDVAQKSALDYIRPLEERLRALSVSGRDYRIASGGGRMVTTMDRYKADWSVVERGWRAHVLGEGRFFSSASEAVETFYREDSTMTDQYMAAFVVVEGETPVGTIEDGDAVVCFNFRGDRAIEISRAFDEEVFQEFDRVRRPDVFYAGIMEYDGDAHIPRNYLVEPPLIDATLGDYLCASGVTSYAISETQKFGHMTYFWNGNKSGYIDEGLELYEEVLSDRVTFDQRPWMKAAEITDKVIEQIEAGERKFIRLNYPNADMVGHTGVPLAVEIAVEAVDLCLARLLPAVEKAGGIVVISADHGNADCMWTEKGGKRLPMVAHTLNPVPCIIKDFSGQNDFVLTDLAERGLANVAATLCLLLGFNPPTDYEPSLLKLK

SEQ ID NO: 11053 - protein, 473 aa, Vitis vinifera
  misc_feature (118)..(118): Xaa can be any naturally occurring amino acid
  misc_feature (388)..(388): Xaa can be any naturally occurring amino acid
MALATRRFFNTICRGTRSFGALPEGIPSSSQHLINLEYEYSAHNYHPIPIVFSQAKGSTIWDPEGKKYLDFLSAYSAVNQGHCHPKVLKALVEQAERLTLSSRAFYNDRFPIFAERLXNMFGYDMVLPMNTGAEGVETALKLARKWGYEKKKIPKDQAIIVSCCGCFHGRTLAVISMSCDNEATRGFGPLLPGHLKVDFGDEVALEKIFEENGDRIAGFLFEPIQGEAGVIIPPDGYLKAVRELCSKFNILMIADEIQSGLGRSGRMLACDWAEVRPDVVILGKALGGGVIAVSAVLADKDVMLSIQPGEHGSTFGGNPLASAVAVASLDVITEEGLSERQEICYLISDQMGQELRNQLMKIHQLFPNLIKEVRGKGLFNAVELNSKXLFPVSAYDICLKLKERGVLAKPTHDTIIRLTPPLSISLDELQEGSNALRDVMEFDVPKMQKAKHKRVPQTTTNICDRCGRNMDDS

SEQ ID NO: 11054 - protein, 455 aa, Zea mays
MASLQSFLAVKPAAGWAAPSRRARVAAFLAPPPPTTAAAVGAARRELSAASLAVVDGEARYLVSTYKRSRVVFEHGRGCKLYDTDGREYLDMAAGIAVTALGHADPDVCATIAEQAGKVVHVSNVFYTKPQVELAKRLVEVSFADRAFFASTGTEANEAAIKFSRKFQRAAHPESGDPPTEFLAFSSSFHGRTMGAVALTSKSQYREPFAPVMPGVTFVDYGDLEAAKKFVRSGRVAAVFVEPVQGEGGIHSATREFLQGLRDACDEAGALLVFDEVQCGFGRTGHLWAHEAYGVEPDIMTLAKPLANGIPIGVVLVKEKVAAAINYGDHGTTFGGGPLACQTAITVFDKITRPGFLAEVSRKGESFKQLLRAKLSGNPHVREVRGVGLLVGVELDVPAGPLVDACLDAGVVVLTAGKGNVVRLVPPLIVSEKELEHAADVIRDCLPALDVVAAA

SEQ ID NO: 11055 - protein, 426 aa, Magnetospirillum magnetotacticum MS-1
FTVPSFRLVHAERIDPKPWGFIRDRLHVMQGDFADEATYRDLADRLSGNVVFYLAVAARFFGPVVEGLGKAGLLKQTDGAFRRVVIEKPFGSDLDSAKALNKTILAQADEAQFYRIDHFLGKETVQSIMAIRFANGMLEPIWRREYVDHIEITAAETIGVEERGGFYEPTGALRDMVPNHLFQLLCMVAMEPPNSFDAEAVRNEKAKLVQAIRPVTPENAVRGQYSAGQEGGHAVPAYRDEPDVAKDSRTETYAALKLEIENWRWAGVPFYLRTGKRMAGRRTEIAIHFKPPPFALFREAGGADLAPNVMRLRIDPEPGSATRINVKRPGPQMHLAPVETGFRYGDFFDPAPTVGYETLLYDCMMGDPTLFQRADSIEASWAAVDPLLKAWKDAPVASYVAGSPGPEEADALLARDGRAWLPLDEG

SEQ ID NO: 11056 - protein, 181 aa, Zea mays
  misc_feature (70)..(70): Xaa can be any naturally occurring amino acid
  misc_feature (145)..(145): Xaa can be any naturally occurring amino acid
MLRAGGRRLLAPGLRRLGLGTGASGEAGPAAAAAGVRAYHERVVDHYNNPRNVGSFDKDDPNVGTGLVGXAPACGDVMKLQIRVDENSGKIVDACFKTFGCGSAIASSSVATEWVKGKPMDEVLTIKNTEIAKHLSLPPVKLHCXMLAEDAIKAAVKDYEAKKSKMGQKGEDSPSQKAAEA

SEQ ID NO: 11057 - protein, 583 aa, Debaryomyces hansenii CBS767
MSKTMSGESMDINSKSSDSNNVYVNYVSSHDGGSRWHHFRDSFKRAERDNTFDDQELNGLEKAIQKTSKTDLTQNLKKRQLQMIAIGGCVGLGLFIGVGPALVNGPASLLIAWGLVSTFLYCTMQSLAELAALFPISGSFSTYATRFVDPSWGFAVGWNYAIFWVVVLPLELVASSMTINFWNSNINSVAWVAIFYVLIIGLNLCGNKGFGEAEFIASLIKVLGIIGFNILAIVLICGGGQKGGFIGAKYWHNPGAFAAGFKGVVSVLITATYSLAGTELVGLTAAETAGNPRIVLPSAIKQVFWRILLFYMITLTLVGFLVPYNSPELLRGSSSSDSSASPFVIAIEAGGITALPSIFNVVVLISLLSIGNSSVYGFSRTILSLAEQGLAPKCFDFVDRKGRPLVGILASAIVGLLSFVAASPKQTDVFAWLMALSGLSTLFTWFSVNLSHIRFRMAMKKQGRSLDELPYRALTGFWGSVYAAVLLFVVLCLQFWISLFPLGEAPNAAKFFENYLGAVVVLVFFVAHKLYSRKLNTIVPLDTMDVDTGRRETDIDKLKQELKEEKDIRSAYPMYRKIWNFLF

SEQ ID NO: 11058 - protein, 523 aa, Candida maltosa
MAIEQIIEEVLPYLTKWYTIIFGAAVTYFLSIALRNKFYEYKLKCENPVYFQDAGLFGIPALIDIIKVRKAGQLADYTDTTFDKYPNLSSYMTVAGVLKIVFTVDPENIKAVLATQFNDFALGARHAHFDPLLGDGIFTLDGEGWKHSRAMLRPQFAREQIAHVKALEPHVQILAKQIKLNKGKTFDLQELFFRFTVDTATEFLFGESVHSLYDEKLGIPAPNDIPGRENFAEAFNTSQHYLATRTYSQIFYWLTNPKEFRDCNAKVHKLAQYFVNTALNATEKEVEEKSKGGYVFLYELVKQTRDPKVLQDQLLNIMVAGRDTTAGLLSFAMFELARNPKIWNKLREEVEVNFGLGDEARVDEISFETLKKCEYLKAVLNETLRMYPSVPINFRTATRDTTLPRGGGKDGNSPIFVPKGSSVVYSVYKTHRLKQFYGEDAYEFRPERWFEPSTRKLGWAYLPFNGGPRICLGQQFALTEASYVIARLAQMFEHLESKDETYPPNKCIHLTMNHNEGVFISAK

SEQ ID NO: 11059 - protein, 121 aa, Glycine max
  misc_feature (54)..(54): Xaa can be any naturally occurring amino acid
MAQKAEKNDTDFKVPETIITPCTTTTATSITEPSRFFDATTPATSSRSPKRSLXPKRVVSRCSCCRRRVGLTGFRCRCGDLFCAEHRYSDRHDCSYDYKAAGREAIARENPVVKAAKIVKV

SEQ ID NO: 11060 - protein, 411 aa, Fulvimarina pelagi HTCC2506
MAYVLAGGRGSRLKELTDTRAKPAVYFGGKTRIIDFALSNAINSGIRRIGVATQYKAHSLIRHLQNGWNFFRPGRNESFDILPASQRVSEDQWYAGTADAVYQNIEIIEDHAPKHMVILAGDHIYKMDYEIMLQSHVDSGADVTVGCLEVPRMEATGFGVMHVDESFKITDFVEKPKDPPAMPGRPDTALASMGIYVFETKFLIDALREDAKDPSSSRDFGKDIVPKIVKNGGAYAHRFNRSVIRSDNEPTHEAYWRDVGTIDAYWQANIDLTDVVPPLDIYDRNWPIWTYAEIVPPAKFVHDVDGRRGVATSSLVSGDCIISGGSLNRSLLFTGVRQRSYSQLDHAVVLPKCRIGRHARIKNAILDRGVEIPDGLVIGEDPLLDAKRFRRTDQGICLVTRPMIDKLRLEQ

SEQ ID NO: 11061 - protein, 331 aa, Oryza sativa Japonica Group
MVGGGRRGAAAEEVKLSTGNVFAALETLKKKKKGGDKAKGGSSSSSGRKREQQGAQPSSQQQQQQQKEVFWAPAPLTTKSWADVEDDDDDDYFATTAPPRPVWGTGHGDDGAKEEDEEDDDDAVHAALQEEVESEDEDLDDEVDDGAVDEPEHEVDDTSAEPAGKKAAVPVAPPKDTERQLSKKELKKKELAELDAVLAELGISGGSSNAAQDENNAEKKGSNQTGDGDAPAPSESKSSKKKKNKKAKEAKESQEPADGTEETASAEPDEDTTSVDVKERLKKMASMKKKKSGKESDTAAKIAAAEAAARSARLAAAKKKEKNHYNQQPVR

SEQ ID NO: 11062 - protein, 540 aa, Fulvimarina pelagi HTCC2506
MYPDAIATAAARAEKIGIQSLFKADPKRFEAMSFRQDDLLLDLSKTAIDPEALSALIDFARERKVEAKRDAMFAGAKINETEGRSVLHVALRAKPGDGFKADGEPVGDAVQAVRWEMTLFADAIRSGAAHGATGKAFTDVVNIGIGGSDLGPAMATLALAPYHNGPNVHYVSNVDGAHIADTITGLDPETTLFIVASKTFTTVETMTNARTARDWIVAKLGEDAVETHFSAVSTALDQVEAFGISEDRTFGFWDWVGGRYSIWSAIGLPLMIAIGPEKFREFLAGGHEMDEHFRSAPLGENLPILLGLVGWWHRVAMDCPTRAIIPYDQRLSRFPAYLQQLDMESNGKRVGLDGEPVAVSGPVAWGEPGTNGQHAFFQLIHQGTDVVPVEFLAAANAHESEKMTVHQDLLLANCIAQSEALMIGRTLEEARRQLLDGGATPDEAQRIAPHRVFPGERPSVTMLYAQLDPRTLGRLIALYEHRVFVEAQLFGINAFDQWGVELGKELAKNLVPVVTGEQDAGSRDGSTRGLVAAIQTMRRT

SEQ ID NO: 11063 - protein, 637 aa, Vitis vinifera
MGETGKRFRSQRDQDGDNKIQKRRVNERDEKGSDELIVYRILCPDGVIGSVIGKSGKVINSIRQDTRAKIKVVDPFPGAKDRVITIYCYVKEKEEVEVDDEFNDKQPLCPAQDALLKVHAAIVNAVASLENSDKKKKDKEECQILVPSSQSANVIGKAGATIKRLRSKTRANIKITAKDSTDPSHSCAMEFDNFVLIAGDSEAVKKALFAISAIMYKFTPREEIPLDTTVPEAPPSIIIPSDVPIYPAGGFYPSADSIVSARSVPPVLAATHVPELQGYSDMGSTWPVYSSNLPVVSGYGASRSEELIIRVLCPFDKIGRVIGRGGSSIKSVREASGAHVEVDDTKADRDECLITVTSTESVDDLKSMAVEAVLLLQAKINDEDDDTVAIRLLVPSKIIGCIIGKSGSIINEIRKRTRADVRISKSERPKCADANDELIEVVGEVGSVRDALVQIVLRLRDDALKDRDTGHNTSAGTDSLYSGGAGLSVSSVLPSAPPVAPLSYDQRAETGSGLGLLSSSSLYGYGSLSLFFAVKVVVVFNGEVGENAYGSMSSYSSKLYGGLPTPSTFDMVIPANAVGKVMGKGGANIANIRKISGAVIEISDSKSSRGDRVALISGTPEQKRTAENLIQAFIMAT

SEQ ID NO: 11064 - protein, 817 aa, Triticum aestivum
  misc_feature (673)..(673): Xaa can be any naturally occurring amino acid
VTSRTSLYKKAGWYRSGIPGISSTHASASIVSPLIEDICKSPEEQLNEVLRELDTAINEASGLIGNWHQTTSKIYFVWQIESVISDIQGCSLQLCQLANSLLPSLTGCACICIQKLQDINYEHMFDLAREVATKLNGNDTQSPENLSIVSSSLSLSTNLELYMEAVSLENLRTRAMRSENRKELELAEEMIPMVNYMHERLLRETQLLNINGVPIPADFCCPLSLELMSDPVILASGQTYERVYIKLWLDEGFTICPETRPRLAHSNLIPNYTVKALISNWCESHDGTRPDPVKSLKLNFPSAASSLQDLSATGNSPLHPSAGRGNIPGSPEADLYMRSLNRASPSHSAVHQNSDALVNRPGHEASTNQSSDYANGSAPDISRLSLASSEARESSVEERHAGSNVQTSEQSTDEAFQASLLDGDSQDHVGSSSVDGSLPNSGQLDGECDDANGMVRVPSDRTNYSGDASGEVADGGPSVSSAPQRENVMLPRLGDLRMEGQFVRRQPSDRGFPRITSPSSMDARGDLSAIENQVRKLIDDLRSDSIEGQRSATSEIRLLAKHNMENRIVIANCGAINLLVGLLHSPDAKVQENAVTALLNLSLSDINKIAIVNADAVDPLVHVLETGNPEAKENSAATLFSLSVIEENKARIGRSGAVKPLVDLLGNGTPRGXKDAATALFNLSILHENKGRIVQADAVKYLVELMDPAAGMVDKAVAVLANLATIPEGRTAIGQARGIPALVEVVELGSARGKENAAAALLQLCTNSNRFCSIVLQEGAVPPLVALSQSGTPRAREKAQALLSYFRSQRHGNSARR

SEQ ID NO: 11065 - protein, 249 aa, Solanum tuberosum
MKFNIANPTTGCQKKLEIDDDQKLRAFFDKRISQEVSGDALGEEFKGYVFKIMGGCDKQGFPMKQGVLTPGRVRLLLYRGTPCFRGHGRRNGERRRKSVRGCIVSPDLSVLNLVIVKKGENDLPGLTDTEKPRMRGPKRASKIRKLFNLSKEDDVRKYVNTYRRNFTTKTGKNASKAPKIQRLVTPLTLQRKRARIADKKKRIAKAKSEAADYQKLLASRLKEQRERRSESLAKKRSRLSAASKPSIAA

SEQ ID NO: 11066 - protein, 312 aa, Borrelia garinii PBi
MKVKCKVNASLALIKYWGKKDAFLNIPATSSLAVSVDKFYSISELELSDQDEIILNSKPVVFQNREKVFFDYARQILSEPNVRFKIKSENNFPTAAGLASSSSGFASIAACILKYFNKYSFNSASNLARVGSASAARAVYGGFTILKEGSKESFQLRDQSYFNDLRIIFAIIDSNEKELSSRVAMNICKHHEFYYDAWIASSKKIFKDALYFFLKKDFIRFGATVVKSYQNMFALMFASSIFYFKSSTIDLIKYAANLRNEGIFVFETMDAGPQVKFLCLEENLNTILKRLKQNFTDINFIVSKVGRGLEWI

SEQ ID NO: 11067 - protein, 346 aa, Rosa gallica
QKWSNGEHSNELLHAQAHIWNHIFSFINSMSLKSAIQLGIPDIINKHGYPMTLSELTSALPIHPTKSHSVYRLMRILVHSGFFAKKKLSKTDEEGYTLTDASQLLLKDHPLSLTPFLTAMLDPVLTKPWNYLSTWFQNDDPTPFDTAHGMTFWDYGNHHPSIAHFFNDAMASDARLVTSVIIDDCKGVFEGLESLVDVGGGTGTLAKAIADAFPHIECTVLDLPHVVADLQGSKNLKYTGGDMFEAVPPADTVLLKWILHDWNDEECVKILKRSREAITSKDKKGKVIIIDMMMENQKGDEESIETQLFFDMLMMALLTGKERNEKEWAKLFTDAGLSDYKITPIL

SEQ ID NO: 11068 - protein, 408 aa, Thiomicrospira crunogena XCL-2
MALIVQKYGGTSVGNVERIQNVADKVAKFIDEGHQVVVTLSAMSGETNRLTALAKEVQEQPSRREMDVLLTTGEQVTIALLSMALQQKGYDSISYTGWQVPIKTNDIHSKARIEEIDSDKIRNQLDQGKVVVVAGFQGVTPEGDITTLGRGGSDTTAVALAAALKADECQIYTDVDGVYTTDPRVVPEAKRLDVVTFDEMLELASLGAKVLQIRSVEFASKYKVPLRVLSSMKEGGGTLLISEEDFEDLDMEKPLISGIAFSRDEAKLMILGVPDKPGVAYQILGPISDANIEIDMIIQNQSVDGTTDFTFTVARGDLHAAQKILEKTAESLGAREVICDDTIVKISMVGVGMKSHSGIASTMFKTLADHNINIQMIGTTEIKISVVIEESYLEEAVQALHAAFELDK

SEQ ID NO: 11069 - protein, 346 aa, Rosa gallica
QKWSNGEHSNELLHAQAHIRNHIFSFINSMSLKSAIQLGIPDIINKHGYPMTLSELTSALPIHPTKSHSVYRLMRILVHSGFFAKKKLSKTDEEGYTLTDASQLLLKDHPLSLTPFLTAMPDPVLTKPWNYLSTWFQNDDPTPFDTAHGMTFWDYGNHHPSIAHFFNDAMASDARLVTSVIINDCKGVFEGLESLVDVGGGTGTLAKAIADAFPHIECTVLDLPHVVADLQGSKNLKYTGGDMFEAVPPADTVLLKWILHDWNDEECVKILKRSREAITSKDKKGKVIIIDMMMENQKGDEESIETQLFFDMLMMALLTGKERNKKEWAKLFTDAGFSDYKITPIL

SEQ ID NO: 11070 - protein, 346 aa, Rosa hybrid cultivar 'Kazanlik'
QKWSNGEHSNELLHAQAHIWNHIFSFINSMSLKSAIQLGIPDIINKHGYPMTLSELTSALPIHPTKSHSVYRLMRILVHSGFFAKKKLSKTDEEGYTLTDASQLLLKDHPLSLTPFLTAMLDPVLTKPWNYLSTWFQNDDPTPFDTAHGMTFWDYGNHHPSIAHFFNDAMASDARLVTSVIIDDCKGVFEGLESLVDVGGGTGTVAKAIADAFPHIECTVLDLPHVVADLQGSKNLKYTGGDMFEAVPPADTVLLKWILHDWNDEECVKILKRSREAITSKDKKGKVIIIDMMMENQKGDEESIETQLFFDMLMMALLTGKERNKKEWAKLFTDAGFSDYKITPIL

SEQ ID NO: 11071 - protein, 166 aa, Tripsacum dactyloides
RKIPVLLLPDGRAICESAVIVQYVEDVARESGDAEAGSLLLPDDPYERAMHRFWTAFIDDKFWPALDAVSLAPTPDARAQAVEDARAALSLLEEALKDRSNGGAFFSGGDAAPGLLDLALGCFLPALRACERLHGLSLIDASATPLLDGWSQRFAAHPAAKRVCRT

SEQ ID NO: 11072 - protein, 388 aa, Chlamydomonas reinhardtii
MKTKVLVVPVYQKHWLWFTFSEATAAEAAAERAVHWTQGGSLPEKAQLLGKEISYKFNAATQKQWKAMQAAEEGSFRNRLYKLARWVLSQEDPTETFLKQLPRQPGELEVIHPASVKERLVRRRMRRMAQAQEAFHNRRILGWALATIPQLPLVLTPLPNVTLYYTAYKMVSHYQAVQGFDRFPVLFLSTQPCSTPLRWETPLDDDRAAQLRDIFAPPAGPKTKTATTTATSKQQQQGKGEAPQQQEGAGDADSGLGPEALPELVARLRRKVLEGAAAGAQGKKRAPGPPTLRQTPEAAALRVPPTGRTPGAPFPAAQRSETAAGQQQRTAELCTPPAPTRPVGSSPARRTRQPDPRVPYSPDPLLAASCAAAWWSTKYNARSCSALT

SEQ ID NO: 11073 - protein, 346 aa, Rosa hybrid cultivar 'Kazanlik'
QKWSNGEHSNELLHAQAHIWNHIFSFINSMSLKSAIQLGIPDIINKHGYPMTLSELTSALPIHPTKSHSVYRLMRILVHSGFFAKKKLSKTDEEGYTLTDASQLLLKDHPLSLTPFLTAMLDPVLTKPWNYLSTWFQNDDPTPFDTAHGMTFWDYGNHQPCIAHFFNDAMASDARLVTSVIIDDCKGVFEGLESLVDVGGGTGTVAKAIADAFPHIECTVLDLPHVVADLQGSKNLKYTGGDMFEAVPPADTVLLKWILHDWNDEECVKILKRSREAITSKDKKGKVIIIDMTMENQKGDEESIETQLFFDMLMMALVTGKERNEKEWAKLFTDAGFSDYKITPIL

SEQ ID NO: 11074 - protein, 239 aa, Oryza sativa
  misc_feature (109)..(109): Xaa can be any naturally occurring amino acid
MGEEANCNVAMESAAPKENGHTTGGAAAEAKAAAAWAEIAVTDAAAVPKPTPPPAAVAVDPRLQGISDAIRVVPHFPKQGIMFNDITPLLLRPGVFKDAVDIFVERYRXGMAIAAVAGIEARGFIFGPAIALAIGAKFIPLRKPKKLPGEVISETYVLEYGTDCLQMHVGAIEPGERVLIVDDLVATGGTLCAAIRLLERAGADVVECACLIGLPKFKDFYKLNGKPVYVLVESREYEK

SEQ ID NO: 11075 - protein, 470 aa, Escherichia coli
MKKTKIVCTIGPKTESEEMLAKMLDAGMNVMRLNFSHGDYAEHGQRIQNLRNVMSKTGKTAAILLDTKGPEIRTMKLEGGNDVSLKAGQTFTFTTDKSVIGNSEMVAVTYEGFTTDLSVGNTVLVDDGLIGMEVTAIEGNKVICKVLNNGDLGENKGVNLPGVSIALPALAEKDKQDLIFGCEQGVDFVAASFIRKRSDVIEIREHLKAHGGENIHIISKIENQEGLNNFDEILEASDGIMVARGDLGVEIPVEEVIFAQKMMIEKCIRARKVVITATMMLDSMIKNPRPTDAEAGDVANAILDGTDAVMLSGESAKGKYPLEAVSIMATICERTDRVMNSRLEFNNDNRKLRITEAVCRGAVETAEKLDAPLIVVATQGGKSARAVRKYFPDATILALTTNEKTAHQLVLSKGVVPQLVKEITSTDDFYRLGKELALQSGLAHKGDVVVMVSGALVPSGTTNTASVHVL

SEQ ID NO: 11076 - protein, 175 aa, Triticum aestivum
MAPTVMASSATSVAPFQGLKSTGGLPVSRRSNGASLGSVSNGGRIRCMQVWPIEGIKKFETLSYLPPLSTEALLKQVDYLIRSKWVPCLEFSKVGFIFREHNTSPGYYDGRYWTMWKLPMFGCTDATQVINEVEEVKKEYPDAYVRIIGFDNMRQVQCVSFIDFKPPGCEESGKA

SEQ ID NO: 11077 - protein, 406 aa, Bradyrhizobium sp. BTAi1
MEDFYRIRRLPPYVFEQVNRAKAAARNAGADIIDLGMGNPDLPAPPHVLEKLKETLGKPRTDRYSASRGIVGLRRAQAAYYDRRFGVKLNPDTQIVATLGSKEGFANVAQAITAPGDVILCPNPSYPIHAFGFLMAGGVIRSVPSEPTPQFFEAAERAIIHSIPKPLALIVCYPSNPTAYVASLDFYRDLVAFAKKHEILILSDLAYAEVYFDDKNPPPSVLQVPGAMDVAVEFTSMSKTYSMAGWRIGFAVGNERIIAALARVKSYLDYGAFTPVQVAATAALNGPDDCIREMRETYRKRRDTLVEAFGRAGWEIPSPEASMFAWAPLPEAFKGLGSMQFATLMVEKSGVAVSPGVGFGEHGEGYVRIALVENEQRIRQAARGVRRFLESGIETLHNVVPIANRR

SEQ ID NO: 11078 - protein, 266 aa, Fulvimarina pelagi HTCC2506
MQETIGILGGTGWLGLALGLRSLTQGVVTAGQLVVANRRGPTSDYDAWPGVTWARNLGELAERSDIVVLSVRPEDYAAQKAPAFAGIVVSFMAGVPLAHLERNWPDARIVRAMPGGGAREGNAHVPICAADGIADADLDLVERLLSVIGTVDRVANEHELAFLTALSGSGAAYPALMAKAMYDRGVAEGITPEVVWRAVTSVVCDAPSLLRGSPAEASHMLETLEGYRGPTAAGIEAARLAGLGKAIGSALDAATKRAETMRPGEK

SEQ ID NO: 11079 - protein, 115 aa, Cicer arietinum
GYTKGDGLGAEIVGTFILVYTVFSATDAKRSARDSHVPILAPLPIGFAVFLVHLATIPITGTGINPARSLGAAIIFNKDLGWDDHWIFWVGPFIGAALAALYHQVVIRAIPFKSK

SEQ ID NO: 11080 - protein, 174 aa, Physcomitrella patens
GMSHEVRERTDALDAAGNTTAAIGKGFAIGSAALVSLALFGAYVSRAGIASVDVIQPKEFVGLIVGAMLPYWFSAMTMKSVGKAALAMVEEVRRQFRTIPGLMEGTTKPDYKRCVKISTDASLKEMIPPGALVMLTPLIVGTLFGVETLAGLLAGALVSGVQIAISASNTGGAW

SEQ ID NO: 11081 - protein, 546 aa, Zea mays
MGHSPSSLSKSGPSSPPRRSRSFSPMAPPQQLRLTAPLQVAAGGSGSDSSSSFVPPARDYTQDLPDEILALVFASLSPTDRNACSLTCSRWMEVDATTRHRLSLDARAALGNAATALFSRFTAVTKLALRCARDSGLDSLSDHGAAALAAALPSERLARLKLRGLRKLSDAGLASLAAGAPAIRKLSIASCTFGPRAFVAVLQSCPLLEDLSVKRLRSVADTSGAASSIAEEIKFPPALSLRSVCVKDLYNALCFVPLVASSPNLRSLKILRCSGAWDLPLEVIAARAPGLVELHLEKLQVGDRGLAALSACANLEVLFLVKTPECTDSGIISVAEKCHKLRKLHVDGWRTNRIGDFGLMAVARGCPDLQELVLIGVNPTVLSLRMLGEHCRLLERLALCGCETVGDAEIICLAERWAALKKLCIKGCPVSDRGMEALNGGCPGLVKVKLKRCRGVSYECIENLKVTRGESFSISLDVVLEHDAGSTSENGAQENGQAQNTELAGQMTGMDLLTNAAGTQSSIHTINRMRSVMSAIRRRFGNPLPP

SEQ ID NO: 11082 - protein, 545 aa, Vitis vinifera
  misc_feature (335)..(335): Xaa can be any naturally occurring amino acid
  misc_feature (342)..(342): Xaa can be any naturally occurring amino acid
  misc_feature (521)..(521): Xaa can be any naturally occurring amino acid
MIAVLLRNLVNLVSEGWSWWWDGLTENTIFRVVAALSTAAIAISWYAWLIKKASRGLPPLPPGPRGLPLLGNLLFIEPDLHRYFSKLSQLYGPIFNLQLGSKTCIVISSSSVAKEILKDHDVIFANRDVPISALAFTYGGQDIAWSHYGPEWRKLRKVFVQEMMSSASLDACSALRRREVQEMVRDVYGKVGTPINMGDQMFLTVLNVVTSMLWGGTLHGEDRNRIGMEFRRVIVEMVGLMGKPNISDLFPALAWFDLQGIESRVKKLVLWFDRIFESLIAQRTQLDGADGGGKNKSKESKDFLQFMLELMHQGDDKTSVSITQLKALFMDIVVXATDTSSXTVEWAMAELLQHPQTMQKAQEELEKVVGNENIVEESHLFQLPYLDAVIKETLRLHPPLPLLVPHSPSTSCIISGYTIPKGSRILFNAWAMQRNPEVWEHPLEFIPERFLEDAASADYKGNNFNFMPFGSGRRICAGLPLAEKMLLYVLASLLHSFDWKLPDGRTSVDLEERFGIVLKKXEPLLAIPTARLSNLGHYDPSERIF

SEQ ID NO: 11083 - protein, 164 aa, Opitutaceae bacterium TAV2
MSLDAPAPINTSAINATELSFGIVAARYNPALVDALVAQVREHLTATGVRPERIQLVRVPGSNELPSATQYLLRRHPALDAVVALGVIIRGDTIHYQLVAEASQQGLQRVSLDTTVPVIVGVVVAENEQQAEDRCRGPINRGAEFARAALEMAALKRNLVPQAS

SEQ ID NO: 11084 - protein, 422 aa, Oryza sativa Indica Group
MSEFSICSSTISFHFGAGMRPWCHYLGDREVDTIDEDLSFGYACGNLGGILGNAHLLELYAGSVQFMDINQPAIEIPWPFVFKPVILPDLGRSTCWPERLYKEFICCCKARKLKDLMLKSDNRICADCGAPDPKWASANIGVFLCLKCGDVHRALGPDVSKVLSVTLDDWSDSDIDSMLEIGGNSYANSIYESFLPKDHPKPKMDSTMEYRTKFIRAKYETQDFLKPSLRITSKGSFDATNAVKSVTSSISSASGKHVADDTREFVGELNITVVRGIQLAVRDMLTSDPYVVLTLGEQKAQTTVKPSDLNPVWNEVLKISIPRNYGPLKLEVYDHDTFSADDIMGEAEIDLQPMITAVMAFGDPSRVGDMQIGRWFMTKDNALVKDSTVNVVSGKVKQEVHLKLQNVESGEMELELEWVPIP

SEQ ID NO: 11085 - protein, 459 aa, Opitutaceae bacterium TAV2
MKPSRKSPAPPTTSSPPLSAACRAAWAISVQKTSPRFARKPVISAFRPPARKKPPRTTSWKSNPRATRNEHPTSNVEHPTSNNVSHSKRPPTQTPTPPPPPPADDSPQLDTLDVGCSTLDVGCSREARTAPWAQLKYFTFQPAIFPRLLGDVSRDARPGDLVTVYDKAGYKLGAGLYNPRAKIVLRVIAHGAEAALGESYFAHAIRRAVALRRDTFKLDQTTDAYRLINSDGDGLSGLIIDRYADTLLCEVTSYGMARRLPEWLPLLHELAGTRFARVHVDHDLGSLEGIKPSWFNETNAAAPRLVKIREHGIRYEVDFTEGHKTGFFCDQRENRRALARFTQGARVLDLCSYTAGFSLNAKVTGNAADVTAVDLDEAAIAQAKRNANLNQARIKFVHTDAFAYARQMQQNGETWDVVVLDPPKLIFTRENPGNAEGRRKYEDLNQLAISLVRPGGVFV

SEQ ID NO: 11086 - protein, 112 aa, Fucus distichus
HRVIPDFMCQGGDFTRGNGTGGESIYGEKFADENFQLRHNEPGILSMANAGANTNGSQFFLCTVVTGWLDGKHVVFGKVTKGLDVVKSVEAVGSQSGKTSVPVVVADCGQLA

SEQ ID NO: 11087 - protein, 346 aa, Rosa hybrid cultivar 'Kazanlik'
KKWSNGEDSNELLHAQAHIWNHIFSFINSMSLKSAIQLGIPDIINKHGPPMTLSELTSALPIHPTKSHSLDRLMRILVHSGFFAKEKLSETDEEGYTLTDTSQLLLKDHPLSLTPFLTAMLDPVLTKPWHHLSTWFQNDDLTPFATAHGMTMWDYGNHQPSFSHFFNDAMASDARLVASVIINECKGVFEGLESLVDVGGGTGTLAKAIADAFPHIECTVLDLPHVVADLQGSKNLKYTGGDMFEAVPPADTVLLKWILHDWNDEECVKILQRSKEAITSKDKKGKVIIIDMIMGNQKGDEESIEMQLFFDMLMMVLLKGKERNEKEWAKLFTDAGFSDYKITPIL

SEQ ID NO: 11088 - protein, 947 aa, Oryza sativa Japonica Group
MERSTPGTMAARSWLLLLCFVAVATAGVLQARAQPDSNGFISVDCGLPGKTGFVDDKTKISYAADDGFTDGGACHNISAEYITPGLAKRYHTLRSFPDGKRNCYTLRSLVAGLKYLFRTTFFYGNYDGLNKLPVFDLYVGVNYWTMVNITGPGDAVIVEAIVVVPDDFVQVCLVNTGAGTPFISGLDLRPLKNTLYPQSNATQGLVLLGRLNFGPTDYTDVIRYPDDPHDRIWFPWVDSTKWSQISSTKKVQDLDNDMYETPTAVMQTAITPRNASRNIEFSWDPVPLPNDPTPGYIAIFHFSELQLLPGNAVREFYINLNGKPWSLTAFKPEYLYNDATFNRNPFLRYPQYNISINATANSTLPPLINAVEVFSVIPTATIGTDPEDVAAITAIKEKYQVVKNWMGDPCVPKMLAWDKLTCSYAISNPARIIGLNLSSSGLSGEVSSYFGNLKAIQNLDLSNNKLTGPIPDALSQLPSLTFLDLTGNQLSGSIPSGLLKRIQDGSLNLRYGNNPNLCTNGDSCQPAKKKSKLAIYIVIPIVIVLVVVIISVAVLLCCLLRRKKQAMSNSVKPQNETVSNVSSNGGYGHSSSLQLKNRRFTYNELEKITNNFQRVLGRGGFGYVYDGFLEDGTQVAVKLRSESSNQGAKEFLAEAQILTRIHHKNLVSMIGYCKDGEYMALVYEYMSEGTLQEHIAGKNNNRIYLTWRERLRIALESAQGLEYLHKACNPPLIHRDVKATNILLNTRLEAKIADFGLSKTFNHVNDTHVSTNTLVGTPGYVDPEYQATMQPTTKSDVYSFGVVLLELITGKPSILREPGPISIIQWARQRLARGNIEGVVDAHMHGDHDVNGVWKAADIALKCTAQTSTQRPTMTDVVAQLQECLELEDRRCGMEDTYNNFYAGNNNDPNSSYNMYNTDQSTDVSQNNTMEHNFERVPTMATGPVAR

SEQ ID NO: 11089 - protein, 346 aa, Rosa hybrid cultivar
QKWSNGEHSNELLHAQAHIWNHIFSFINSMSLKSAIQLGIPDIINKHGYPMTLSELTSALPIHPTKSHSVYRLMRILVHSGFFAKKKLSKTDEEGYTLTDASQLLLKDHPLSLTPYLTAMLDPVLTNPWNYLSTWFQNDDPTPFDTAHGMTFWDYGNHQPSIAHLFNDAMASDARLVTSVIINDCKGVFEGLESLVDVGGGTGTLAKAIADAFPHIECTVLDLPHVVADLQGSKNLKYTGGDMFEAIPPANTVLLKWILHDWNDEECVKILKRSRVAITSKDKKGKVIIIDMMMENQKGDEESIETQLFLDMLMMALVGGKERNEKEWAKLFTDAGFSDYKITPIL

SEQ ID NO: 11090 - protein, 128 aa, Glycine max
MKLNIANPTTGCQKKVEIDDDQKLRNLYDKRISQEVVGDLLGEEFKGYIFKIMGGCDKQGFPMKQGVLTSGRVRLLLHRGTPCFRGFGRRNGERRRKSVRGCIVSQDLSVINLVIVKKGENDLPGLTD

SEQ ID NO: 11091 - protein, 886 aa, Oryza sativa Japonica Group
MERRSSPATMAARSSLFLLCLATATAGVLQARAQPDSKGFISVDCGLPGKTSYIDDKTKISYASDDGFTDGGKHYNVSPEYIKPAVTARYYNVRSFPDGARNCYTLRSLVAGLKYLIRATFMYGNYDGLNKLPVSFDLHIGVNFWTVVNITDPIQPVNREAIVVVPDDSVQVCLVNTGAGTPFISGLDLRPLMNKLYPQVNATQGLLQLARLNFGPSDETSIRYPDDPHDRVWFPWFDAAKWNEISTTNRVQNIDNDLFEAPTAVMQTAVTPINASNNIDFFWNSQPQPNDPAPGYIAIFHFSELENLPNNATRQFYININGILFDDGFTPSFLYAEASYSSKPFVRHPQYNITINATANSTMPPLINAVEVYSVISTANIGTDSQDVSAIMTIKAKYQVKKNWMGDPCLPRNLAWDNLTCSYAISNPARITSLNLSKIGLSGEISSSFGNLKALQYLDLSNNNLTGSIPNALSQLSSLTILDLTGNQLNGTIPPGLLKRIQDGFLNLRYGNNPNLCTNGNSCQPPKNKSKLAIYIVVPIVLVLAIVSVTTLLYCLLRRKKQGSMNNSVKRQNETMRYGPTNNGSGHNSSLRLENRWFTYNELEKITNKFQRVLGQGGFGKVYDGFLEDGTEVAVKVRTESSNQGKGNDGRYLTWKERLRIALESAQGLEYLHKGCNPPLIHRDVKGTNILLNTRLEAKIADFGLSKVFNPENGTHVSTNKLVGTPGYVDPEYQSTMQPTTKSDVYSFGVVLLELVTGKPAILRDPEPISIIHWAQQRLARGNIEGVVNASMHGDYDVNGLWKVADIALKCTALSSAHRPTMTDVVAQLQECLELEDKHQAFFGHVRDERLHRAPEIWAPKICEFNLCRDVLICILRDDSARYMLY

SEQ ID NO: 11092 - protein, 346 aa, Rosa hybrid cultivar
QKWSNGEHSNELLHAQAHIWNHIFSFINSMSLKSAIQLGIPDIINKHGYPMTLSELTSALPIHPTKSHSVYRLMRILVHSGFFAKKKLSKTDEEGYTLTDASQLLLKDHPLSLTPYLTAMLDPVLTNPWNYLSTWFQNDDPTPFDTAHGMTFWDYGNHQPSIAHLFNDAMASDARLVTSVIINDCKGVFEGLESLVDVGGGTGTLAKAIADAFPHIECTVLDLPHVVADLQGSKNLKYTGGDMFEAVPPADTVLLKWILHDWNDQECIKILKRSRVAITSKDKKGKVIIIDMMMENQKGDEESIETQLFFDMLMMALVGGKERNEKEWAKLFTDAGFSDYKITPIL

SEQ ID NO: 11093 - protein, 428 aa, Arabidopsis thaliana
MRSCLLNLAALTEGSFSFSASQTSKFKGFLSLKTQVTMNQEATSLTGVSSAGQPSSATPSDPPPPPVAPMFIPKTEPGICMSKKTKSKVSAPTQRKRQCTAASAKSRSKAPAPALRRLSSRKSNRSASAAGQTEDLVRDSSDLQDGDVTEIAPPLFLSRYRENRRLLAVRDRLGRYKVIGNRCFNDMRFLPLDGNNTASTQQLLFNAGLLPTFTEIDSYVHEVVMEFYANLPDVPESMDEVAIALSNGKANSWKMLTSRLLSPELALLNKICCHNWSPTVNHSVLKPERMTLLYMVAKALPFNFGKLIFDEIWACSNAVANPSSTLRLVLPNLIDQMLRFQRIVPSDEGDTTSSAPLKFTMEVKPVPVLQSDSPTLDAALETLIASLTTMRVRLAGGEYSDVSYSVPDDVGDENVEEEDDDDELDDST

SEQ ID NO: 11094 - protein, 346 aa, Rosa hybrid cultivar
QKWSNGEHSNELLHAQAHIWNHIFSFINSMSLKSAIQLGILDIINKHGYPMTLSELTSALPIHPTKSHSVYRLMRILVHSGFFAKKKLSKTDEEGYTLTNASQLLLKDHPLSLTPFLTAMLDPVLTKPWNYLSTWFQNDDPTPFDTAHGMTFWDYGNHQPSTAHFFNDAMASDARLVTSVIIDDCKGVFEGLESLVDVGGGTGTVAKAIADAFPHIECTVLDLPHVVADLQGSKNLKYTGGDMFEAVPPADTVLLKWILHDWNDQECIKILKRSRVAITSKDKKGKVIIIDMMMENQKGDEESIETQLFFDMLMMALVGGKERNEKEWAKLFTDAGFSDYKITPIL

SEQ ID NO: 11095 - protein, 374 aa, Dichelobacter nodosus VCS1703A
MADKDLYAILGVCRTANQDEIKKAYRKLSMKWHPDRNPNNKEEAEEKFKEINKAYEILSDSQKRASYDRFGFDAANQGAAGGGFSGGNFSDIFGDVFGDIFGNVRQTNGARQTRGHDLAYKIELSLEEAIHGVEKQIRIATQVRCGECHGSGMNAKSKKKTCPTCNGAGQVRMQQGFFSIAQPCPTCHGRGEIIENPCNKCQGTGRVKDTRVLTVNIPAGVDNGDRIRLSGEGEAGELGAPAGDLYIEIFVRAHPIFERQGNDLYCKMPISFTTACLGGDLEVPTLNGRVKLSIPEETQTGKTFRLKGKGVQSVRSNSVGDLYCTVTIETPINLSKAQKELLMNFEQALNEGGKTHTPQAKGFFDNIKQFFDNL

SEQ ID NO: 11096 - protein, 346 aa, Rosa hybrid cultivar
QKWSNGEHSNELLHAQAHVWNHIFSFINSMSLKSAIQLGILDIINKHGYPMTLSELTSALPIHPTKSHSVYRLMRILVHSGFFAKKKLSKTDEEGYTLTNASQLLLKDHPLSLTPFLTAMLDPVLTKPWNYLSTWFQNDDPTPFDTAHGMTFWDYGNHQPSIAHFFNDAMASDARLVTSVIIDDCKGVFEGLESLVDVGGGTGTVAKAIADAFPHIECTVLDLPHVVADLQGSKNLKYTGGDMFEAIPPANTVLLKWILHDWNDEECVKILKQSREAITSKDKKGKVIIIDMMMENQKGDEESIETQLFFDMLMMALVTGKERNEKEWAKLFTDAGFSDYKITPIL

SEQ ID NO: 11097 - protein, 470 aa, Escherichia coli
MKKTKIVCTIGPKTESEEMLAKMLDAGMNVMRLNFSHGDYAEHGQRIQNLRNVMSKTGKTAAILLDTKGPEIRTMKLEGGNDVSLKAGQTFTFTTDKSVIGNSEMVAVTYEGFTTDLSVGNTVLVDDGLIGMEVTAIEGNKVICKVLNNGDLGENKGVNLPGVSIALPALAEKDKQDLIFGCEQGVDFVAASFIRKRSDVIEIREHLKAHGGENIHIISKIENQEGLNNFDEILEASDGIMVARGDLGVEIPVEEVIFAQKMMIEKCIRALKVVITATMMLDSMIKNPRPTRAEAGDVANAILDGTDAVMLSGESAKGKYPLEAVSIMATICERTDRVMNSRLEFNNDNRKLRITEAVCRGAVETAEKLDAPLIVVATQGGKSARAVRKYFPDATILALTTNEKTAHQLVLSKGVVPQLVKEITSTDDFYRLGKELALQSGLAHKGDVVVMVSGALVPSGTTNTASVHVL

SEQ ID NO: 11098 - protein, 331 aa, Neisseria meningitidis Z2491
MNLKNRHFLKLLDFTPEEITAYLDLAAELKAAKKAGREIQRMKGKNIALIFEKTSTRTRCAFEVAARDQGAGVTYLEPSASQIGHKESIKDTARVLGRMYDAIEYRGFGQETVEELAKYAGVPVFNGLTNEFHPTQMLADALTMREHSGKPLNQTAFAYVGDARYNMGNSLLILGAKLGMDVRIGAPQSLWPSEGIIAAAHAAAKETGAKITLTENAHEAVKNVDFIHTDVWVSMGEPKEVWQERIDLLKDYRVTPELMAASGNPQVKFMHCLPAFHNRETKVGEWIYETFGLNGVEVTEEVFESPASIVFDQAENRMHTIKAVMVAALGD

SEQ ID NO: 11099 - protein, 96 aa, Theobroma cacao
IVTGANVQVCWEKFARYFEVELKEVKLKEGYYVMDPVKAVDMVDENTICVAAILGSTLTGEFENVKLLHELLTNKNKETGWDTPIHVDAASGGFIA

SEQ ID NO: 11100 - protein, 83 aa, Symbiobacterium thermophilum IAM 14863
MNLPMSTDPIFEKVKAIIVDQLSVEEEEVTMEASFIEDLGADSLDIVELIMALEEEFDLEVPDEDAEKLTTVGAAVNYIKEHK

SEQ ID NO: 11101 - protein, 125 aa, Schizosaccharomyces pombe 972h-
MSVNPKAFPLADSGLTQQILDLVQQASHYKQLRKGANEATKTLNRGISEFIVMAADTEPIEILLHLPLLCEDKNVPYVFVPSKAALGRACGVSRPVISASITTNEASDLLPQIQAIKLAIEKLLI

SEQ ID NO: 11102 - protein, 173 aa, Helicobacter pylori
MNLDQLEVSHDADSLCVVIEISKHSNIKYELDKESGALMVDRVLYGAQNYPANYGFVPNTLGSDGDPVDALVLSDVAFQAGSVVKARLVGVLNMEDESGVDEKLLALPIDKIDPTHSYVKDIDDLSKHTLDKIKHFFETYKDLEPNKWVKVKGFENKESAIKVLEKAIKAYQG

SEQ ID NO: 11103 - protein, 356 aa, Zea mays
QLRRPPPPPVAGPAADGSKSRPECINSSNPYHECTDYCLRKIAEARQRLDDELPDSWKRPPEHRTVHRDCINASNPYHECSDYCFKRIADAKSGLERGEQQPPADVATAAGTSDAVEQQQLEDNDADGQEGAAADDGYPQMTEKQKKLFELRLKMNEARKANQQAMVAEKKRMEPRGESRGVSKQKWLDDRKKKIGKLLDSNGLDMSKAYMLDTQETAEAKYKKWEKEPAPYGWDVFNQKTLYDAYKKRTKDIEVDMEAYNKAKEADPEFYRDASSLQYGKVSNVPEENIDKMVKELKEREEKRKSFSRRRKFNEDKDIDSINDRNEHFNKKVERAFGKYTLEIKNNLERGTALPD

SEQ ID NO: 11104 - protein, 173 aa, Helicobacter pylori
MNLDQLEVSHDADSLCVVIEISKHSNIKYELDKESGALMVDRVLYGAQNYPANYGFVPNTLGSDGDPVDALVLSDVAFQAGSVVKTRLVGVLNMEDESGMDEKLLALPIDKIDPTHSYVKDIDDLSKHTLDKIKHFFETYKDLEPNKWVKVKGFENKESAIKVLEKAIKAYQG

SEQ ID NO: 11105 - protein, 173 aa, Helicobacter pylori
MNLDQLEVSHDADSLCVVIEISKHSNIKYELDKESGALMVDRVLYGAQNYPANYGFVPNTLGSDGDPVDALVLSDVAFQAGSVVKVRLVGVLNMEDESGMDEKLLALPIDKIDPTHSYVKDIDDLSKHTLDKIKHFFETYKDLEPNKWVKVKGFENKESAIKVLEKAIKAYQG

SEQ ID NO: 11106 - protein, 443 aa, Solanum tuberosum
  misc_feature (353)..(353): Xaa can be any naturally occurring amino acid
MATIKSIKARQIFDSRGNPTVEVDVHVSNGVFARAAVPSGASTGIYEALELRDGGSDYLGKGVSKAVNNVNSIIGPALIGKDPTDQTGLDNFMVHELDGTQNEWGWCKEKLGANAILAVSLAVCKAGAAVRNVPLYKHIADLAGNKKLVLPVPAFNVINGGSHAGNKLAMQEFMILPVGAANFKEAMKMGCEVYHHLKSVIKKKYGQDATNVGDEGGFAPNIQENKEGLELLKTAIEKAGYTGKVVIGMDVAASEFYGKDKSYDLNFKEESNDGSQKISGDQLKDLYKSFVSEYPIVSIEDPFDQDDWETYAKLTTEIGEQVQIVGDDLLVTNPKRVAKAIAEKTCNALLLKXYQIGSVTESIEAVKMSKKAGWGVMTSHRSGETKDTFHCLIFAVGLSTGQIKDWELPCRVRASRKVQPALEDRRGTRIRGCLCRSKLPQAC

SEQ ID NO: 11107 - protein, 60 aa, Oryza sativa
MIDVTFLFYLQDNLVEDLLSDFEYELQPPYLLYRNAAQEVNGIWFYNQHDCEAVARLFGR

SEQ ID NO: 11108 - protein, 356 aa, Aspergillus oryzae
MSTENKMRAVVFHSPYKVAVEERPIPKIQDSGDIVVKVTYTALCGSDLHTFRGIEPAGTGFVMGHEVTGEVVEVGSGVKSIQKGDMVVSAFTTSCGECFYCKQGFSSRCEKSVLFGCDHLDGAQAEYVRIPNADGTVMKAPEGVEEKYLVLMADIFPTGYFAASNAFKGYTPEQISEQTVVLIGCGPVGLCALINALEFKPKHLLAVDSIPSRLELARSLGAEPWNFQQDREGLDKRVKELTNGRGADAVIEVVGLSPALRTGFDLLRPWGTISSVGVHNGEIPWAGNDAYDKNLRIQMGRCPVRSVSPQALDVLKKNQHKLGFMADKIMPLSQAVEGYELFNAMKVQKVIFKAGE

SEQ ID NO: 11109 - protein, 560 aa, Arabidopsis lyrata subsp. petraea
MASSTALISDTEAWKDLKGHVEDIKKTHLRDLMTDANRCQSMMMEFDGLLLDYSRQRAPVETMDKLLNLAKAAQLTEKISRMFNGEHINSTENRSVLHVALRAPKDAVIKADGKNVVQEVWNVLDKIKEFSEKIRSGSWVGATGKPLKDVIAIGIGGSFLGPLFVHTALQTDPEALESAKGRQLRFLANIDPVDVARNIIGLNPETTLVVVVSKTFTTAETMLNARTLREWITAALGASAVAKHMVAVSTNLALVEKFGIDPNNAFAFWDWVGGRYSVCSAVGVLPLSLQYGFSVVEKFLKGASSIDQHFQSTPFEKNIPVLLGLLSVWNVSFLGYPARAILPYSQALEKFAPHIQQVSMESNGKGVSIDGLPLPFETGEIDFGEPGTNGQHSFYQLIHQGRVIPCDFIGIVKSQQPVYLKGEVVSNHDELMSNFFAQPDALAYGKTPEQLQKENVSENLIPHKTFSGNRPSLSLLLPELTAYNVGQLLAIYEHRVAVQGFVWGINSFDQWGVELGKVLATQVRKQLHSSRTQGTALEGFNYSTTTLLKRYLETSSEPQM

SEQ ID NO: 11110 - protein, 704 aa, Oryza sativa Japonica Group
MARYPDDPHDRIWMPWVSPSYWVEVSTTRPVQHTDEDVFDAPTKVMQTAIAPLNASSNIEFAWVPYTQPKDPAPGYITVMHFSELQLRSSNATRQFYINLNGNMVFSQGYTPAYLYADAIFNSNPFLRYPQYNISINATANSTLPPIINAIEVFSVFSTATVGTDGQDASAMMVIKEKYQVKKNWMGDPCVPKTLAWDKLTCSYDSSKPARITDINLSSGGLSGEISSAFANLKALQNLDLSNNNLTGSIPDALSQLPSLAVLDLTGNQLNGSIPSGLLKRIQDGTLNIKYGNNPNLCTNDNSCQPAKHKSKLAIYVAVPVVLVLVIVSVTILLFCLLGRKKKQGSMNTSVKPQNETASYVPTNGSHGHGSSMQLENRRFTYNDLEKITNNFQRVLGEGGFGKVYDGFLEDGTQVAVKLRSESSNQGDKEFLAEAQILTRIHHKSLVSMIGYCKDGKYMALVYEYMSEGTLREHISGKRNNGRYLTWRERLRIALESAQGLEYLHKWCNPPLIHRDVKATNILLNAKLEAKIADFGLSKTFNLENGTHVSTNTLVGTPGYVDPEYQATMQPTTKSDVYSFGVVLLELVTGKPAVLRDPEPISIIHWAQQRLAQGNIEGVVDARMHGDHDVNGVWKATDIALKCTTQVSAQRPTMTDVVAQLQECLELEEGRCAISNANNNFYTDNNSNSNSSYDMYATDHSIDR

SEQ ID NO: 11111 - protein, 346 aa, Rosa odorata var. gigantea
QKWSNGEHSNELLHAQAHIWNHIFSFINSMSLKSAIQLGIPDIINKHGYPMTLFELTSALPIHPTKSHSVYRLMRILVHSGFFAKKKLSKTDEEGYTLTDASQLLLKDHPLSLTPYLTAMLDPVLTNPWNYLSTWFQNDDPTPFDTAHGMTFWDYGNHQPSIAHLFNDAMASDARLVTSVIIDDCKGVFEGLESLVDVGGGTGTMAKAIADAFPHIECTVLDLPHVVADLQGSKNLKYTRGDMFEAVPPADTVLLKWILHDWNDQECIKILKRSRVAITSKDKKGKVIIIDMMMENQKGDEESIETQLFFDMLMMALVGGKERNEKEWAKLFTDAGFSDYKITPIL

SEQ ID NO: 11112 - protein, 692 aa, Aspergillus oryzae
MLPVPTIFSISDNFSPLRQRWSVLFRDNNNTSDLRATLRSEQGENLCNDGLRSICWKAFLHFDNLDRTRWPQKISESRSAYGALKAHFMKYIEHPDDLQSTVDPLADDEESPWQTLRQDEQMRADISQDVDRCLQENFFFREPTTKAKMTDILFIYAKLNPDLGYRQGMHELLAPIIWVIDRDAIEATSWEGVDDTEEDDSSMLQLLDASYVEHDSFTLFCSVMQTARVYYEHNRQRSASGQMDVVPIVNQCEHIHNDLLTTTDLELADHLQALEILPQIFLTRWMRLLFGREFQFQDVLILWDFLFSEGLRQELVEFVCIAMLLRIRWQLLDADSSTALTMLLRYPSPHPHEPYSFVLDGLYLEQNPTSDRGTFIISKYSGKPPDSLKRASQPGTRHVSGRKFHTRGDARNMSEASSPSRSPARNSPKSLEALFQDVSEGIQRRTESWGVAKAVRGAVSEAKRNMQTIQSEHNPRIMRHGDSPLSRTSDARWAQESDTVAQLKTKVQELEERNRMLARSLGQALNDIRSRMMKAEGLDHATADAMKQGLAKIQSVQTCLESTSAPLRSANRSPSIAGDTGSAKLRDQSDVRGDKANRSPSVTSRVGESGTSSSSSVEGELKAHDRARIPTSLPLRPATRPSLADPASVPPEQTRHGTKQNVLFGNGDEEQRPYAEPNDLALRSLRGPKSKQ

SEQ ID NO: 11113 - protein, 359 aa, Pirellula sp.
MNSSIVLLPGDGIGPEIVEQARLVLVKVAERFGHTFDFSSHQIGGIAIDETGDPLPQPTIDACRNAAAILLGAVGGPKWDDPSAKTRPEAGLLKIRKELGLFANLRPIKLFDELADASPLRADIVKGTDILFFRELTGGIYFGESGTSGSGEEETAFQSMTYSVGEVKRIVRMAAQAARGRSNRLTSVDKANVLEPSRLWRRVAAEVMANEFPDVQYDVVLVDSMAMHLINRPSEFDVVVTGNMFGDILTDEASMLPGSLGMLPSASLGDGGPGLYEPIHGSAPDIAGKSVANPLATILAAAMMLRHSLGLTDEAEAIEKAVAGVITDGLRTPDLARGDQSKSVSTEEMGAAVVAKLAS

SEQ ID NO: 11114 - protein, 560 aa, Arabidopsis halleri subsp. gemmifera
MASSTALFCDTEAWKDLKGHVEDIKKTHLRDLMSDANRCQSMMMEFDGLLLDYSRQRAPVETMDKLLNLAKAAQLTEKISRMFNGEHINSTENRSVLHVALRAPKDAVIKADGKNVVPEVWNVLDKIKEFSEKIRSGSWVGATGKPLKDVIAIGIGGSFLGPLFVHTALQTDPEALESAKGRQLRFLANIDPVDVARNIKGLNPETTLVVVVSKTFTTAETMLNARTLREWITAALGASAVAKHMVAVSTNLALVEKFGIDPNNAFAFWDWVGGRYSVCSAVGVLPLSLQYGFSVVEKFLKGASSIDQHFQSTPFEKNIPVLLGLLSVWNVSFLGYPARAILPYSQALEKFAPHIQQVSMESNGKGVSIDGLPLPFETGEVDFGEPGTNGQHSFYQLIHQGRVIPCDFIGIVKSQQPVYLKGEVVSNHDELMSNFFAQPDALAYGKTPEQLQKENVSENLIPHKTFSGNRPSLSLLLPELTAYNVGQLLAIYEHRVAVQGFVWGINSFDQWGVELGKVLATQVRKQLHSSRTQGTALEGFNYSTTTLLKRYLETSSEPQM

SEQ ID NO: 11115 - protein, 954 aa, Oryza sativa Japonica Group
MHVRTTHVAEWIDQQWRLGGGCCCCSASPSPASFAARAARLTRPVSFKLRSPTRRHFGLVYMLFMHREYRAGFISIDCGLPEKTSYVDDATKLKFTSDDAFTDAGTIHNVSSEFATPTTTTDRSLYNVRSFPAGARNCYTVPSVVPGSKYLVRAKFLYGNYDGLNKPPVFDLHLGVNFWQTVTVPSADWLGNAEVIAVVPDDFLQVCLVNTGAGTPFISGLDLRPLPSSLYAPANATQGLVLLDRRNFGASGSTVIRYPDDTYDRVWWPWSNPPAEWSDISTADKVQNTIAPVFDVPSVVMQTAITTRNSSIPIQFSWDTKPNHVYPDPGSIFTLYVTELELLAGNAVRQFNVTINGVIWTKAPYKPVYLSTDAMYNGDRPYRGITRYNFSLNAAGSSTLPPILNAAEAFSVISTADLATDAQDVSAITAIKAKYQVNKNWTGDPCAPKTLAWDGLTCSYAISTPPRITGVNMSYAGLSGDISSYFANLKEIKNLDLSHNNLTGSIPNVISQLQFLAVLDLTGNQLNGSIPSSLLKRSQDGSLTLRYGNNPNLCSNSSSCQLPQKKSNSMLAVYVAVPVVVIGAVAVFLIFFIRKKKNKSKGAVKPQILGNGVQSHSQNGSGGSLLELHNRQFTYKDLAVITNNFQRVLGKGGFGPVYDGFLKDGTHVAVKLRDESSSQGYSEFLTEAQTLTKIHHKNLVALIGYCKDEIHLALVYEHMSEGTLEDKLRGKDRKGRSLTWRERLRIVLESAQGLEYLHKACSPRFVHRDVKSSNILLNANLEAKVADFGLTTAFKCDGDTHVSTVRVVGTYGYLAPEYATALQVSEKIDVYSFGVVLLEVITGQPPIIKLPEPTTIIQWTRQRLARGNIEGVVDVNMPDDRYDINCIWKVADVALKCTAHAPGQRPTMTDVVTQLKECLELEETSFKGDTSSSYMSGSSIDPNSSYNTYTTEMS

SEQ ID NO: 11116 - protein, 346 aa, Rosa odorata var. gigantea
QKWSNGEHSNELLHAQAHIWNHIFSFINSMSLKSAIQLGIPDIINKHGYPMTLSELTSALPIHPTKSHSVYRLMRILVHSGFFAKKKLSKTDEEGYTLTNASQLLLKDHPLSLTPFLTAMLDPVLTKPWNYLSTWFQNDDPTPFDTAHGMTFWDYGNHQPSIAHFFNDAMASDARLVTSVIIDDCKGVFEGLESLVDVGGGTGTVAKAIADAFPHIECTVLDLPHVVADLQGSKNLKYTGGDMFEAIPPANTVLLKWILHDWNDEECVKILKRSRKAITSKDKKGKVIILDMMMENQKRDEESIETQLFFDMLMMALVTGKERNEKEWAKLFTDAGFSDYKITPIL

SEQ ID NO: 11117 - protein, 867 aa, Yarrowia lipolytica CLIB122
MESTPRAPMSWNKRDDRDTRDPPDDRDRSHWRPRSEQSNRGAGSSRNDKSIRGGRGGRGGGSRNNSSRGGGFRDDHFGGSRDAPPPPPPREHGDTYRDDGPDLFSDGAWSGGRSTWQDPPLRKDSYSGDKPWDRLSSRYDNRPDDTPPRQQRSTGGRRPGADNKDWPDRSRGDRSWQNSSSNAPWQQNKGRDDRRDGSSYRPDSDRYDRDRDIRDRDNRGRDSGDGRGNRENRDRETTPLYRDRRVSGPPPSLPSTPSRASSTGPVPPSSAPRPGQRRPLPDQVTFASQSDSGPTSSAKRKRKKAGASTTALTDSNIHNPNNPNYIGYTKKEARERERKKQETEELDPSRSGSVGDISLDSSSLGNGGGASSEASVASRDGSRDGRKRLNPTFSDSSESRSRSDFQNKRPKREASTGPQFDDDVPCYGDDEPGEPVVATTPVDTTKPRVTQHTLTSSIFERVTQVGEGTYGKVYKAVNQVSGTTSALKRLRLETEREGFPVTALREIKLLQSLRHDNIISLKEMMVEENGVFMIFGYMSHDLSGILAQPNVRLEEGHIKFLFHQILSGLTYIHQRGILHRDIKGSNILVDGDGNLKLADFGLSRTIDPSNKRARYSNRVITLWYRPPELLFGATLYDGAVDNWGAGCLLVELYSRLAVFRGADEINQLDCIFDIMGTPTNEYWPDLESLPWFEMLKFNYKKPSKFLQMYDQVCSKPALKLASKLLEMNPAYRMTSQEAMNSDYFNVEPKAERPLVLRELVGEWHEFDAKKLRRAKRKEEDLRRGKERRERKEAEARAKAEGRPEEKPEGLATGGGLAVGTSGQEKVTAENTTEANAEPPSAPGSSREPTCTTAPPSVHPSTTDTDTA

SEQ ID NO: 11118 - protein, 312 aa, Brassica napus
PALRELREVAKGVTKQIGGPMHQLAAKVDEYARGMISGTGSTLFEELGLYYIGPVDGHNIDDLVAILKEVKSARTTGPVLIHVVTEKGRGYPYAERADDKYHGVVKFDPATGKQFKTTNKTQSYTTYFAEALVAEAEVDKDVVAIHAAMGGGTGLNLFQRRFPTRCFDVGIAEQHAVTFAAGLACEGLKPFCAIYSSFMQRAYDQVVHDVDLQKLPVRFAMDRAGLVGADGPTHCGAFDVTFMACLPNMIVMAPSDEAELFNIVATAAAIDDRPSCFRYPRGNGIGVALPPGNKGVPFEVGKGRILKEGERV

SEQ ID NO: 11119 - protein, 473 aa, Synechococcus sp. CC9605
MSKSPQDVLRQIKDEGIELIDLKFTDLHGKWQHLTVCTDLLEEESFTEGLAFDGSSIRGWKGIQASDMAMVPDANTAWVDPFYKHKTLSMICSIQEPRTGQPYERCPRALAQRALNHLASTGLADMAFFGPEPEFFLFDDVRYNSAEGGSFYSVDTIEAGWNTGRIEEGGNLAYKIQVKEGYFPVAPNDTAQDIRSEMLLLMSQLGIPTEKHHHEVAGAGQHELGMKFAELIQAADNVMTYKYVVRNVAKKYGKTATFMPKPVFNDNGSGMHVHQSLWKGGQPLFFGEGTYANLSQTARWYIGGILKHAPAFLAFTNPTTNSYKRLVPGFEAPVNLVYSEGNRSAAVRIPLTGPSPKAKRLEFRSGDALANPYLAFSAMMMAGLDGIKNQIDPGDGEDRDLFELPAEELSKIATVPASLNGALEALNADRGFLTAGGVFSDDFIDNWIDLKYEEVQQLRQRPHPHEFTMYYDA

SEQ ID NO: 11120 - protein, 346 aa, Rosa odorata var. gigantea
QKWSNGEHSNELLHAQAHIWNHIFSFINSMSLKSAIQLGILDVINKHGYLMTLSELTSALPIHPTKSHSVYRLMRILVHSGFFAKKKLSKTDEEGYTLTNASQLLLKDHPLSLTPFLTAMLDPVLTKPWNYLSTWFQNDDPTPFDTAHGMTFWDYGNHQPSIAHFFNDAMASDARLVTSVIIDDCKGVFEGLESLVDVGGGTGTVAKAIADAFPHIECTVLDLPHVVADLQGSKNLKYTGGDMFEAIPPANTVLLKWILHDWNDEECVKILKQSREAITSKDKKGKVIIIDMMMENQKGDEESIETQLFFDMLMMALVTGKERNEKEWAKLFTDAGFSDYKITPIL

SEQ ID NO: 11121 - protein, 532 aa, Zea mays
  misc_feature (114)..(114): Xaa can be any naturally occurring amino acid
  misc_feature (378)..(378): Xaa can be any naturally occurring amino acid
  misc_feature (438)..(438): Xaa can be any naturally occurring amino acid
MAAGIAVTALGHADPDVCATIAEQAGKVVHVSNVFYTKPQVGAPAPSDPPSPASLAMCSTHCSGRPIFLCFICRSASLSQVELAKRLVEVSFADRAFFASTNTWTNEPPNSAPXGPAPHDELSAASLAVVDGEARYLVGTYKRSRVVFEHGRGCKLYDTDGREYLDMAAGIAVTALGHADPDVCGTIAEQAGKVVHVSNVFYTKPQVELAKRLVEVSFADRAFFASTGTEANEAAIKFSRKFQRAAHPESGDPPTEFLAFSSSFHGRTMGAVALTSKSQYREPFAPVMPGVTFVDYGDLEAAKKFVRSGRVAAVFVEPVQGEGGIHSATREFLQGLRDACDEAGALLVFDEVQCGFGRTGHLWAHEAYGVEPDIMTLXAKPLANGIPIGVVLVKEKKVAAAINYGDHGTTFGGGPLACQTAITVFDKITRPGFLAEVXRKGESFKQLLRAKLSGNPHVREVRGVGLLVGVELDVPAGPLVDACLDAGVVVLTAGKGNVVRLVPPLIVSEKELEHAADVIRDCLPALDVVAAA

SEQ ID NO: 11122 - protein, 346 aa, Rosa odorata var. gigantea
QKWSNGEHSNELLHAQAHIWNHIFSFINSMSLKSAIQLGIPDIINKYGYPMTLSELTSALPIHPTKSHSVYRLMRILVHSGFFAKKKLSKTDEEGYTLTDASQLLLKDHPLSLTPFLTAMLDPVLTKPWNYLSTWFQNDDPTPFDTAHGMAFWDYGNHQPSIAHLFNDAMASDARLVTSVIIDDCKGVFEGLESLVDVGGGTGTMAKAIADAFPHIECTVLDLPHVVADLQGSKNLKYTGGDMFEAVPLADTVLLKWILHDWNDEECVKILKQSREAITSKDKKGKVIIIDMMMENQKGDEESIETQLFFDMLMMALVTGKERNEKEWAKLFTDAGFSDYKITPIL

SEQ ID NO: 11123 - protein, 394 aa, Synechococcus sp. CC9605
MATTNSLLPVDDRHRKAFAPIGTPDRLLLGPGPSNAHPTVLTALSRTPIGHLDPLYVDLMCEVQELLRYAWQTDNRLTLPMSGTGSAAMEATIANTVEPGDTVLVAVKGYFGLRLADMAGRYRAEVKTIEKPWGEWFSLDELEVALIEHKPAILAMVHAETSTGVCQPMEGVGDLCRKHDCLLLLDTVTSLGGVPLYIDEWKVDLAYSCSQKGLSCPPGLGPFTMGPRAEAKMTARQGKVPNWYLDVSLLNQYWGSDRVYHHTAPVNMNFGMREALRLLAEEGLDQAWARHRSNAEMLWTGLESLGLSMHVPAERRLPTLTTVRIPDGVDGKAFSQQLLNNHGIEVGGGLGSLAGKIWRIGLMGYNSTPENVNRLLNLFETELPRFSGSVAAAA

SEQ ID NO: 11124 - protein, 481 aa, Frankia sp. EAN1pec
MADPTGFLKHRRELPTRRPVDVRITDWREVYESFPEPALRDQAGRCMDCGIPFCHEGCPLGNIIPEWNDLARRSDWSEAIERLHATNNFPEFTGRLCPAPCEAACVLGIGDDPVTIKQIEVTIINRAISDGSVVPVPPSVRTGRRVAVVGSGPAGLAAAQQLTRAGHEVVVYERADRAGGLLRYGIPEFKMEKRVLDNRLAQMEAEGTSFVTSCNVGVDITADELRSSYDAVVLAGGSTVGRDLPVPGRELRGIHLAMEFLVPANRVQQGDLAETTISAAGKRVVIIGGGDTGADCLGTSHRQGALSVHQLEIMPRPPASRPPANPWPSFPIVYRVSSAHEEGGERVFAVSTERFVGDDEGNVRALLMHEVQMVDGRFQKIEGSETELPCDLVLLAMGFVGPERPGLLEQLGVDLDARGNVARDLGWSTSVPGVFVAGDMGRGQSLIVWAIAEGRSAAAAVDRHLMGTTDLPAPILPTRRP

SEQ ID NO: 11125 - protein, 136 aa, Tropheryma whipplei str. Twist
MEQTLVIIKPDGIRRGLIGQVLSRIEAKGYQIVDIRMLVPDRQSVEEHYLEHRDRHFYLPLVDFMTSGPIVLVRAEGHGVVDALRTLVGVSDPTLALPGTIRGDFGRNWGLGVIQNIVHASDSVKSAKRELDIWFP

SEQ ID NO: 11126 - protein, 526 aa, Thiomicrospira crunogena XCL-2
MSQNNIHEHRILILDFGSQYTQLIARRIREIGVYCEVEPWDIDVEDIVKFGARGIILSGGPETVTGDNAPVAPVEVFELGVPVLGICYGMQTMAEQLGGKVINATEHEYGYAQVRAHGHTKLLNDIEDHVTPEGYGMLDVWMSHGDRVDKMPEGFKLMASTGNCPIAGMANEEKDFYGIQFHPEVTHTTQGQRMIERFVVDLCGCEKLWTTENIIDDSIARIRQQVGSDEVLLGLSGGVDSSVVAALLHKAIGDQLTCVFVDHGLLRHQEGDQVMSMFAENMGIKVIRVDAEDYFMNALAGEADPEKKRKIIGHAFIEMFDQESAKLTGVKWLAQGTIYPDVIESAGSKTGKAKVIKSHHNVGGLPEDMKLELLEPLRELFKDEVRRLGVALGLPSDMVYRHPFPGPGLGVRILGEVKKEYADILRLADHIFIEELRAADLYDKTSQAFTVFLPVKSVGVVGDARRYDYVVSLRAVETIDFMTARWAHLPYDFLEKVSNRIINEIPRITRVTYDISSKPPATIEWE

SEQ ID NO: 11127 - protein, 386 aa, Candidatus Protochlamydia amoebophila UWE25
MADYYEILEVARGATPEEIKKAYRKKAVQYHPDKNPGDADAEKRFKEISEAYEVLSDEKKRQVYDRYGKEALQGAAGGGQGFSSMDEALRTFMGAFGMGGGGESIFDFFGGGNGAEFGGREGGRGARQGASKRVNINVSFEEAVKGVDKELVISNYANCNVCNGKGSSSSQGIKTCSECKGRGQVFEQRGFFSMTMACPKCHGEGKVITDPCKNCKGQGAVKEKQHIKVHIPAGVDSGMRLKMSGYGDVGQHGGPAGDLYVFINVEPHEIFEREGNDILLDLPISFAEAALGCKKEVPSLTNRACRITIPEGTQNGKIFRVKGEGFPNVHGHGKGDLLVRIFVETPTRLSERQKELLQEFSELEGPNNLPKRKGFLDKIKEFFSPN

SEQ ID NO: 11128 - protein, 207 aa, Tropheryma whipplei str. Twist
MYPNSRYILPSLDERTAYGYKQVDPYTKLFEDRIVFLGVQIDDASADDVMAQLLVLEGQDAERDIIMYINSPGGSFTAMTAIYDTMQYIRPQIQTVCLGQAASAAAVILSAGTPGKRLALPNARILIHQPVVASSGYGQASDIEIQAREIMRMREWLEKTLAQHSNKSVKQVSKDIDRDKILSSEQALEYGLIDQILVSRKAGLGKK

SEQ ID NO: 11129 - protein, 297 aa, Physcomitrella patens subsp. patens
MGSDADAKLVRQESQGAENGNKGEKRWSLTDFDIGKPLGRGKFGNVYLAREKQSKYVVALKVLFKNQLQQSQVEHQLRREIEIQSHLRHPNILRLYGYFYDQARVYLILEYAAKGELYKELQRCKVFSEKRAATYVASLARALMYCHEKHVIHRDIKPENLLIGLKGELKIADFGWSVHTCNRRRTLCGTLDYLPPEMVEGKEHDAGVDVWSLGILCFEFLYGTPPFEAKKHSDTYKRIVRVDLRFPSKPVISTSARDLICQLLVKDSAQRLPLNKVLSHPWIVNNADPSGVYNGHN

SEQ ID NO: 11130 - protein, 180 aa, Tropheryma whipplei str. Twist
MSETKQTVFDRLLQERIVWLGEAIDDKLANEICAKILLLNADDPKEDIFLYINSPGGSITAGMAIYDTMQFVSNDIVTVGIGMAASMGQVLLTSGTQNKRYIMPNARVLLHQPLAGFGGTASDIQTQAKLILDMKYRLSQITASRTGKTVEQIMEDGDRDHWFTAEEALEYGFVDHIRTE

SEQ ID NO: 11131 - protein, 231 aa, Prochlorococcus marinus str. MIT 9515
MKQIVADAAVKEVKDGMIVGLGSGSTAALMIKSLAEQIRLGKLKNIKGVPTSFQSEVLSLELKIPLIDLASVSQIDLAIDGADEVDPDFQLIKGGGACHVREKLVASKANKLLIVVDETKLVQQLNLVFPLPVEVLPSAWKQVKDIISEMNGVSDLRMATKKAGPVVTDQGNLILDVLFNTGIKDPKDLEMRINNIPGVLENGLFVNLTDKVLVGKIENNVPVLFSPSKGS

SEQ ID NO: 11132 - protein, 443 aa, Candida glabrata
MGKVLDLALHPLELRAALKLKFIRQPLFSTNDTRATPQLERCYELLNLTSRSFAAVIMELHPELRNVIMVFYLILRALDTVEDDMTIDPQLKVKVLREFDSKLDTTDWSFDGNDLKEKDRVVLTEFPCILGEYHKLKPEYQKVIKRITGLMGNGMADYILDENFNLNGVQTVKDYDKYCHYVAGLVGDGLTELIVLAGFGSDDLYHGKNSFQLYESLGLFLQKTNIIRDYAEDLDDGRSFWPKEIWSEYATKLTDFRDPKNTQKGVDCINHLVLNALTHVIDVLTYLSSIHEQSSFQFCAIPQVMAIATLAKVFNNPEVLRKNVKIRKGTTCDLILNSRTLKGCVDIFQYYLRDMKQRLPVEDPNYLKFNIQVAKIEQFIEEMFQDNLPAGVEPRETMIYLKVQERLKWDTQVIPRVQEEDYKFNMALSVVFCVLLSFYFFTK

SEQ ID NO: 11133 - protein, 665 aa, Neurospora crassa
MASNPTNTAAPTGGLTEKKHDRRSTSSESVSGTGFAEHADRTGTFNQNARLEASKKIANPLAGLSPQRLEAMGEEYAMMAGLTSEEDIRAFRLGARIAGDESNYDLIPELTEREKEECSSMMLTTILQVCSLCAAVQGMDETVVNGAQLFYKDKFGIGTDSQRDTWLLGLVNSAPYLCCALIGCWLTEPMNRIFGRRGTIFVSCIISAVACFHQAFTNTWWHMFIARFYLGLGIGPKSATTPIFAAECSPPKLRGALVMQWQMWTAFGIMVGYIADLAFYFVPDHGIGLGLNWRLMMGSAMIPAVIVVCLAFLCPESPRWYLSKGRHQDAFGALCRLRFEKVQAARDLFYTHTLLEAEKQAMSGVKKGNRFKELFTVRRNRNAVIASSGLMFMQQFCGVNIIAYYSSAVFRDAGFSDVSALAASLGFGVVNWLFAIPAMYTIDTFGRRNLLLTTFPLMSLFLFFTGFSFWIPEDSKAHIGCIALGIYLFGMVYSPGEGPVPFTYSAEAYPLYIRPIGMSLATATTWFFNFILSITWPRMVTAFKPQGAFGWYAGWNIIGFLFTLFLVPETKGKTLEELDHVFDVPLKKLVRYGADQSLWFFHRGKNGNGMRPTAPSAEMYHGDAERMNEVVSGQQLGEGEREKRWNKEQEREGGIMGRGDAAGKV

SEQ ID NO: 11134 - protein, 104 aa, Zea mays
CVRRMEDKNAPTMVAPSQGVHLTLPHDFLPGKRAILIPKTDDGRVLFVVPWNGHTIVGTTDSPRNDLPLDPEAGAQDVDFILSTAARYLSRKPTRDDVTSVWAG

SEQ ID NO: 11135 - protein, 355 aa, Aspergillus oryzae
MSGHENNGAPPVGKEKINTDIVTLTRFLTEEQTKVPEATGDFTLLCHALQFSFKSIAYYIRCAFLINLTGLAGSSNTTGDDQKKLDVIGNDIFISAMRGSGKCRILVSEEEEEAIIFDEHPYARYAVVCDPIDGSSNLDAGVSVGTIFGIFKLPDSVLGPENKVSPKDLLLPGTEMVASGFTMYGASAQLVITMRNGGVNGFTLENSLGEFILTHPNMTLPAKRAIYSVNEGNSSYWEEWTNAYFHSLKFPPEGQKPYSARYIGSMVADAYRTLLYGGVFAYPADKKAPKGKLRILYECAPMAMLFENAGGLAVNSRMERLLGVVPEHIHDKSGVFLGSKDEVQKIIDTYNKYKK

SEQ ID NO: 11136 - protein, 585 aa, Aloe arborescens
MTSDSASVLDLDTKTTVGGGVEDAYGEDQATEEQLVTPWTISVASGYSLLRDPHHNKGLAFTEKERDAHYLRGLLPPVCISQELQEKKLMRSLRQYQVPLQRYMAMMDLQERNERLFYKLLIDNVEELLPVVYTPTVGEACQKYGCIFRRPQGLYISLKEKGKILEVLKNWPERSIQVIVVTDGERILGLGDLGSQGMGIPVGKLSLYTALGGIHPSSCLPVTIDVGTNNEQLLNDEFYIGLRQKRATGQEYAELLHEFMTAVKQNYGEKVIVQYEDFANHNAFELLAKYSKSHLVFNDDIQGTASVVLAGLVAALKVVGRTLAEHTFLFLGAGEAGTGIAELIALEMSRQTKAPIEETRKKIWLVDSKGLIVSSRKESLQHFKKPWAHEHEPVKTLLDAVKTIKPTVLIGSSGVGQTFTKEVAEAMPSFNEKPVILALSNPTSQSECTAEQAYSWSEGRAIFASGSPFDPVEYNGKLFVPGQANNAYIFPGLGLGLVISGAIRVHDEMLLAASEALAQQVTEENFANGLIYPPFTIIRKISAHIAANVAAKAYELGLATHLPRPANLVKYAESRMYSPLYRSYR

SEQ ID NO: 11137 - protein, 298 aa, Gibberella zeae PH-1
MIRKQARQRRDYLYRRALLLRDAEISEKRAKLRSSLASGKPLDPTIANDKSLRKDYQYDESRPDLTTNEELDLDDEYAQLSGIVDPRVLVTTSRDPSARLAAFAKEIRLLLPTAVRLNRGNLILPDLVRSAQSAGLSDVILLHEHRGTPTALTLSHFPHGPTVSFSLHNVVLRHDIPGSVRGTVSESYPHLIFDGFTSRLGERIVKILKHVFPPREAITSKNKVGNRVVTFKNIEDSIEVRHHVFVRTGYDSVELAEVGPRMTMRPFEIRSGTLENKDGDVEWHLTQYTRTAKKKNYL

SEQ ID NO: 11138 - protein, 464 aa, Leuconostoc mesenteroides subsp. mesenteroides ATCC 8293
MQDSTSVNPKHHLVQKTEDDLSLSDVNGSIEVPENGSFWRKLLAFSGPGALVAVGYMDPGNWVTSVAGGAQYRYTLLSVVLISSLIAMMLQYMAGKLGIVKQEDLAQATRDRTNKVGGFVLWIMTELALIATDIAEVIGGAIALHLLFGWSMIASVLTTAFDVILLLLLMKFGFRKIEAIVMTLIITILVIFAYLVILSTPQLSALFGGYLPQLQTLSSHTPIGGGDSQLTLTLGIIGATVMPHNLYLHSSISQTRKVDRSNKSELKEAVRFMTWDSNIQLSLAFVINSLLLILGAALFFGHADKVGTFGSMYNALKDNSIAGAIASPILSTLFAVALLASGQNSTITGTLTGEIVMEGFLHLRIPMWLRRVVTRGLALIPVVAFTLIYGGSEGKLDDLMVQSQVFLSIALPFTMAPLIYFTSSKKIMGEEFANPKWIATLGWIAFAVLTYLNVQLVVQQLMGS

SEQ ID NO: 11139 - protein, 173 aa, Helicobacter pylori
MNLDQLEVSHDASVLSVVIEISKHSNIKYELDKESGALMVDRVLYGAQNYPANYGFVPNTLGSDGDPVDALVLSDVAFQAGSVVKARLVGVLNMEDESGMDEKLLALPIDKIDPTHSYVKDINDLSKHTLDKIKHFFETYKDLEPNKWVKVKGFENKESAIKVLEKAIKAYQG

SEQ ID NO: 11140 - protein, 337 aa, Monascus purpureus
MVVPKVGINGFGRIGRIVFRNAIEHEGVDIVAVNDPFIEVHYAAYMLKYDSTHGRFNGTVEFDGNTLIVNGKKIKFYAERDPAQIPWSETGAEYVVESTGVFTKQEKASLHLKGGAKKVIISAPSSDSPMFVMGVNNDQYTKDITVLSNASCTTNCLAPLAKVINDKFGIVEGLMTTVHSYTATQKVVDGPSNKDWRGGRTAAQNIIPSSTGAAKAVGKVIPSLNGKLTGMSMRVPTSNVSVVDLTARLEKAATYDEIKQAVKEASEGPLKGVLGYTEDDVVSSDLNGDPHSSIFDAKAGIALNSNFVKLVSWYDNEWGYSRRVIDLIAYIAQVDAQ

SEQ ID NO: 11141 - protein, 650 aa, Schizosaccharomyces pombe 972h-
MKKYLWGTPTTNTVFTGKQPKYTKEVRKCISIDEVYNVVRKVGDGTFGSVYLATTKTPSKEVVAIKSMKKKLAKVSDATRLREVHSLLRLSENENIVNIFDLYIDQFRCLHIVMEFLDCNLYQLISTRKNDPLTLEQVQDIMRQIFKGLNHIHTNGFFHRDMKPENILISSNSDSSSFNVKIADFGLAREINSRPPYTEYVSTRWYRAPELLLRDSYYSFPVDIYAAGCMAFEIATLQPIFPGNDDFDQLYKMCEILGSPDEQSQNTGDKGGGIWDRAELLANKLGISLPKMAPLDFGDLFSPPWNLAFASMLSQLLKWDPAKRPTAEMCLDLEFCRVSAPADAVASKEEVNKNTDFRVSISYFPSSSSIPDECNTEEESRINPSTSKFLKQLNKGFNGFTKPFRKSRKQSKNRKNKSSVATQFSEESEDIADSITSSTFFPVLPQIRPSTPLNLKLRNFIISSSEDSTSPKAKEFDRPLPSTEFLVAINKSQEALLNNSPNSKSGSTQLSASTCLSDLISPQLSILSHEDKRENQSVNSESSKYSPRSSNHSPTLHSKDLHRDMATVNNYAKSPPSFHATQDLLRKTLAYTNSSGTSTVLSNDSSAISSTFLDRDFPDFGITSLAGSLTLPDSKIIDRSKTHVSTQLLP

SEQ ID NO: 11142 - protein, 315 aa, Leuconostoc mesenteroides subsp. mesenteroides ATCC 8293
MTIPLIFDTDPGIDDAAAIAILLTNDDFEVRLITSVSGNVSVDKTTNNVLKLTHYFNRPDVKVARGAEKPLVKPFKDASNIHGKSGMPGYEFGELSTRTISKKAVDAIHETLNSYDDQTTLVAVGAFTNIANLIQKYPQDLQKIERLIVMGGSLTGGNLTSVAEFNVFTDPDAAKIVFESDLDITMIGLDVTEKALLTKKSMSELLQMNETGKMLMGLFGHYQDGSNAGGKPMHDVNTLYYLLHPEKYKLEDLWVDVVTDGPAIGATVADILHSTHSQTNVHVAKDIDVPAFNAWYLLQISGISDGNINAGRLEN

SEQ ID NO: 11143 - protein, 503 aa, Arabidopsis thaliana
MAITVPRRQLFIGGQWTEPVLRKTLPVVNPATEDIIGYIPAATSEDVELAVEAARKAFTRNNGKDWARATGAVRAKYLRAIAAKVIERKSELANLEAIDCGKPLDEAAWDMDDVAGCFEYYADLAEGLDAKQKTPLSLPMDTFKGYILKEPIGVVGMITPWNYPLLMAVWKVAPSLAAGCTAILKPSELASLTCLELADICREVGLPPGVLNILTGLGTEAGAPLASHPHVDKIVFTGSTTTGSSIMTSAAKLVKPVSLELGGKSPIIVFDDVDIDKAVEWTMFGCFWTNGQICSATSRLLVHERIADEFLDKLVKWTKNIKISDPFEEGCRLGPVVSKGQYERVLKFVSNARNEGATVLCGGVRPEHLKKGYFVEPAIVSNVTTSMEIWREEVFGPALCVKTFSTEDEAIQLANDSQYGLAGAVLSNDLERCDRVSKAFQAGIVWVNCSQPCFCQAPWGGTKRSGFGRELGEWGLENYLSVKQVTQYISDEPWGWYKPPSKL

SEQ ID NO: 11144 - protein, 548 aa, Thermoplasma acidophilum
MYEDDIRRIALINAYQHEGKADLKSVMGKVMAEIPDLRRDPRSAREMVSRIVDEVNSMSAYEIRETVETRYTSSIRKEKKVEEHRLPDLEGVNGPVVMRMAPSPSGPLHIGHTRMAILNDEYVKRYGGELILRIEDTNPKNIDPDAYHMIPEDLEWLGVNVTKIVIQSDRFDLYYAEAKKLMENGHMYVCTCPREEFKKRKLESIPCKDRDNPPETNLELFDKMIDGTIKEGDAVAVVKTDLKHPNPSVRDWIAFRIIEARHPRVDDKYRVYPMMSFSVAVDDHYLGLTHVLRGKDQLTNTDKQRYIFDYNGWKKPYYYHYGMIKFPGIKLKTSLMKKGILSGQYEGWSDIRLGTVRAFAKRGYRPETFRRYWINSGLREIDAIFSIEIFDSINREIVDPRAYRFSFVKDPVPVRIEGMPNISAKLPLHPTHPEYGFREYEVKGSVYIASRDFAAISEGERIRLKDLCYIRKKGNGIIYDGVEMTEKTKIINWCPEGSRDFSVLKPDGSKDSGLIEPKSSGYRGIAQLERYGYVNFADGDDLAYFTHP

SEQ ID NO: 11145 - protein, 255 aa, Thermotoga maritima
ITRKLILAGNWKMHKTISEAKKFVSLLVNELHDVKEFEIVVCPPFTALSEVGEILSGRNIKLGAQNVFYEDQGAFTGEISPLMLQEIGVEYVIVGHSERRRIFKEDDEFINRKVKAVLEKGMTPILCVGETLEEREKGLTFCVVEKQVREGFYGLDKEEAKRVVIAYEPVWAIGTGRVATPQQAQEVHAFIRKLLSEMYDEETAGSIRILYGGSIKPDNFLGLIVQKDIDGGLVGGASLKESFIELARIMRGVIS

SEQ ID NO: 11146 - protein, 346 aa, Oryza sativa Indica Group
MMLTKPHPSSNLLLPTTTALPNPSPNPSRVTPLASGRGRRGHHRVCASSVAPAQPASVAQPTAPALSRVDVLSEALPFIQRFRGKTVVVKYGGAAMKSPELQSSVIRDLVLLSCVGLRPVLVHGGGPEINSWLGRVGVEPQFRNGLRVTDALTMEVVEMVLVGKVNKQLVSLISVAGATAVGLCGKDARLLTARPSPDAAALGFVGEVTRVNPSVLRPIIESGHIPVIATVAADETGQAYNINADTAAGEIAAALGAEKLLLLTDVSGILADRNDPGSLVKEIDIAGVRQMVADGKVGGGMIPKVECCVRALAQGVHTASIIDGRVPHSLLLEILTDEGTGTMITG

SEQ ID NO: 11147 - protein, 372 aa, Aspergillus oryzae
MYPITTRYQIHENKKSNPPHPRDKLVRRNKRKQPTIKPLRHHFQHLSPWSKIMGQQRRGKPSGGRDVTVSKALSLLLRHAAEKEGLKLDAQGYANVADVLAWRKLKSLKVTFPEIVAAVATSDKKRFALLHIPSTEAQAQQSTSAEASTEHGIPTTSAGQDSATETALAVSESDLDPAHFLIRATQGHSIKSVDAASLMEKLSLDEEAKLPDTVVHGTFHAAWPAILASGGLKSMGRNQVHFATGPSVESVLAQGAQGSKEVTGDHGEKVISGMRRDAQVLIYIDLKKALAAGCPFWRSENGVILSEGMVVEGSSGIVPVEFFDVVVERKHGLGKIWEGGKEVQALPEELVKQGNPKGRRNANKKKEDTTQP

SEQ ID NO: 11148 - protein, 418 aa, Arabidopsis thaliana
MILPMLGGLRGGKVIPTNGQTRRALSNINKNIIGAPVYPCAVKRPFTEKNGICNKKIPPVPVHRPVTRKFAAQLAENNLQIHKEETKKPDLISNEALDRIITDVEEGDFNEPMFVQHTEAMLEEIDKMEGIEMQDSNDIDAEVEESVMDIDSCDKNNPLSVVEYINDIYCFYKKNECRSCVPPNYMENQHDINERMRGILFDWLIEVHYKFELMEETLYLTINLIDRFLAVHQHIARKKLQLVGVTAMLLACKYEEVSVPVVDDLILISDKAYTRTEILDMEKLMANTLQFNFCLPTPYVFMRRFLKAAQSDKKLELLSFFMIELCLVEYEMLQYTPSQLAASAIYTAQSTLKGYEDWSKTSEFHSGYTEEALLECSRKMVGLHHKAGTGKLTGVHRKYNTSKFGYAARIEPAGFLLL

SEQ ID NO: 11149 - protein, 224 aa, Oryza sativa Japonica Group
MDPGGLRPAPQSAAAAAAAAAAGAGAGASAADEPRDARVVRELLRSMGLSEGEYEPRVVHQFLDLAYRYVGDVLGDAQVYADHAGKPQLDADDVRLAIQSKVNFSFSQPPPREVLLEVARNRNKIPLPKSIAPPGSIPLPPEQDTLLSQNYQLLAPLKPPPQFEETEDDNAGANPTPTSNPSNPSPNNLQEQQQLPQHGQRVSFQLNAVAAAKRRGTMDQLNMG

SEQ ID NO: 11150 - protein, 427 aa, Synechococcus sp. CC9605
MELCHAVLNLPFSGPPLDHWTLPNGVRCVTADMPDAPLTCLDLWCRAGSASEQPGEAGMAHFLEHMVFKGSERLAAGAFDEAIEALGGSSNAATGFDDVHFHVLTPPDRAREALDLLLELVLQPSLEPDGFHTERGVVLEEIAQYADQPNEQVLQLLLSKSCDQHPYGRPILGTPRSLKGMTHEAMRAFHQRQYRGSNCCLAIAGPPSTELRSALGSSALAGLLDAIDPSLASSPLSVRPGRESVVVDRLESARLLMLWEAPQAKDQAGVMAADLATTLLGEGRRSRLVNRLREELQIVESVSMDLSVLEQGSLITLEVICPDEHLEAVEDEVNRQLRAMADELVSDQELKRGQQLVSNGLRYALESTGQVSGLSASQTLWDRQQDLLHPLTFLLQWTAERLRSDLFPRLQPEQAFVLTAQAKTKNG

SEQ ID NO: 11151 - protein, 259 aa, Chlamydomonas reinhardtii
YVLGKVIGQGAFGLVRIGKNVSTDELVAVKSVDATRFRNIAEIDQIQEEMSVLASLKHPHIIRLFDVHFQNNTFFLVMEFAGGGSLVHFMRHHGDPVRHCLDEATAGRVFVQMISALDYCHRRRVIHRDLKPENILLDDANNLKIADFGLAAVTAPFSGGLTLQCGTPEFTAPEITVGREYDGTSVDIWSMGVILYEALTGVLPFRGANQAALFKAIQKGVYEPLPASLSSECRDLVRRMLLVDPSSRAAMDDILRHPW

SEQ ID NO: 11152 - protein, 629 aa, Tropheryma whipplei str. Twist
MCTKRQYGLLESIRSPRDLDSFTPHQLDELECQVRDFLIQSVAKTGGHLGSNLGVVELSIALHRSFRSPEDCIIFDVGHQCYVHKLITGRHDFKALRCKNGLSGYPSRHESNHDIVENSHASAALSWADGVSRARTLLGNDNYVIAVVGDGSLTGGMCWEALNNISDDNNRRLVIVVNDNGRSYARTIGGIARFLNAVRASKSYLWLRESSEAVFSHMGSPGRRLYQGIRGAIHGFLSRFSSSNKLFSNLDIRYLGPINGHNRKALEKAFKQAKQYARPIIVHVITEKGHGYPPALEDALDCLHTVGVIDPSTGKSASVQGQVRQDTWTGVFGEELLRLAESNTNIVAVTAAMLHPTGLSMFAEKFPHRVFDVGIAEQHAVASAAGLAYEGLHPVVAIYSTFMNRAFDQVMMDVALHGAPVTFVLDRAGITGPDGASHHGIWDLSLLRIVPGIKLYAPRDASTLRNTLALVCSEDCPTAIRFPRGSVCDDLPALRSLDDGIDVLYGSCDREDIVIVAIGVMAHACVRAAQLLAESGIESTVINPVCFWPLHRQVLARVSKAKLVVLAEEGAKSPGLGDYIAGRRLLEFVIPGDFQPQGSRDELLDAIGLNGEHIARKIKARFNQIINCV

SEQ ID NO: 11153 - protein, 427 aa, Tropheryma whipplei TW08/27
MRHGIVLEDFRAAAKVMHSKFVVHTPVIQSVMLSDLVGSPVYFKCENLQITGSYKIRGVFNYLHNLKKRSTAVVAASAGNHAQSVAYAAKQIGIKAVIFMPSSVSLPKYNATKKYGAEIILDQGDIQTLIFKARRYAKKHKFVFIPPFDHRDIVVGQGTIALELLEQVPDLRTVVVPTGGGGLVAGIASAVTLAQNPSGTIFTKSGLEQPAKSGIRVVGVQAKTSASFIESMVAGKPVKVNITSHFADGIAVPKPGKITFELARCFVDRFVEVGDHEIAGAILTLLEDSKIIVEPAAASAAAAVLSKKITNLKGSTVIVLSGGNIDPMTLSQIILRGLSLRSRRLTLRAQLKDVPGQLAEFSRVVAKAEANVVAVNHSRGNYTDDNGRISFGDVFMDIDLETRGHEHSQSIVRALRDSGFVVEVLGL

SEQ ID NO: 11154 - protein, 272 aa, Frankia sp. EAN1pec
MLRRAAKFEVTLTPTSETLLAPVADEPRRWLLGRALDDFVADVDALDEAAPHMVPGVTRPKIDTAVDEATPTVTGGTLLVSGQEVMQTWERPLMLALARAATRPGGSVCEVGFGLGISAGFIQELRPATHTIIEANADVATTARAWAGADGRQGVEIVPGRWQDALPGLGRFDGILFDTYPLDEREVDDYVVRDATFAEHFFPHAAAHLTGDGSFTYYSNEIDSLSRRHQRALLKHFETFSVRVVDGLRPPADCSYWWAPSMAVIVASGPRR

SEQ ID NO: 11155 - protein, 592 aa, Candidatus Protochlamydia amoebophila UWE25
MQLKAEEIILKGSPICRGIAIGQTYFLDRDEFTVCEKQIDSSDSEKEVERYRHALFRSRQDIKRLQTQLESESAQEAILILEAQLEILQDPLLTTEMELNIRQANQNAEFVFQQSLVKLQTRFESLKDPFFAERFKDLQDVSQRVFSYLYESGSLSLKDVPYNSIVCGVELTASDTAEAKVYHVGAFLTESGGATSHAAIVAKAKGIPFISNINLHLIRENDNQTIIVDGRTGQVILNPTDETLHRYETLKRKMHTQITAFENDVHWPAETCDGYTVRLYGNLDDSHQVDLLKQLGGQGIGLFRSEYIFLPQKEIPGEEEQFNIYSQIVKKMDGLPVVIRTFDLGGDKATFHVPSTTQKNPFLGSRATRYFLREQKLLKSQLRAIVRASIYGQVRILFPMIATVAELREAKKILQEVCQELHFDQHIPMGCMIEVPSAAMVVDHFVKECDFLSIGTNDLVQYALAIDRKDHLLNDFYEPTDPSIIRLIKLVISEGNKAHVPVSVCGEIASDPRFIPLLLGLGVQELSVAPRYLPVIKNVIRSTYIVDAVQLADLALHLTTAQEVLNLLIQEYQKSVPHDLFYNVSYPPQTYI

SEQ ID NO: 11156 - protein, 333 aa, Aspergillus oryzae
MPSKVNIDTSLKDEKNDMLNGDGPNITVVAKEAPITVKRIPATHINEAIDNPGVARADVAVSIEKPSGDQEWANKVRGYTPLQQHVLFWDRDGDGMIFPWDTYIGFRELGFNILFSFLAVLIININFSYPTRLAYSWLPDPWFRVYVRSVHKAKHGSDSGTYDPEGRFIPQLFENLFAKWDSDNDGALTLRELFQLMHGHRCAADPFGWGAALFEWGTTWLLIQKDGKVYKEDLRAVYDGSIFWKIREARKSSPGWTQGFGLGGDGWVRHGRSIRPFAEKIRQVVNGSCKKAHSSLIWWLTRSTRVRTRRHKHLGSTKGLGKLFTFFRRQCLL

SEQ ID NO: 11157 - protein, 187 aa, Neisseria meningitidis Z2491
MPWNLPIFLTWLRVLLIPVMTALFYLPFPWFAEETINLTAAVIFAVAALTDWFDGFLARLWKQTSDFGAFLDPVADKLMVAVSLLLLVKLDRTYVLFAMIIIGREITISALREWMAQMGKRNSVAVATVGKFKTAAQMLAIFLLLLNIPDFYGFNLVVIGNVLMFIASLLTVWSMLYYLKMAWKEIA

SEQ ID NO: 11158 - protein, 522 aa, Candidatus Protochlamydia amoebophila UWE25
MSEYQVIARKFRPQTFKEVFGQEAVVTTLKNAIKFKRLAQAYLFCGSRGTGKTTLARIFAKAINCQNSTEDFEPCNQCTSCREITSGSSLDVLEIDGASHRGIEDIRQINETVGYAATSGQYKVYIIDEVHMLTKEAFNALLKTLEEPPPKVKFIFATTEAHKVLPTILSRCQRFNLSRIPLSQIMIKLKLIADQLEIDVEEEALQLLAYKAEGGLRDAESLFDQIVAFSEGKINAATVQSILGLMPREAYFELDLAGKEGNFVKAFEIAYRIFAEGKDLNHFIEGLIDHFRHILLIQLAGITSPLLTISPKEKQFYERAAHLYTQEQCLDLIDYLIESAQQIRFTHSGKIALEAILLHVIRSHFRLPIEVLVQRLGELEQMLGEASLVNSSVFPPLSKSTPQSSLSTEVKNPPLTPPVPLTNNKPSQNLTTSPIEKNLNSSTATSLLSPSTNNCSLFDHFVSEDPTPTQSDLGRSTQKLPNKDSPSLVAKLNGDNPTPVHQYDTLFQFAAIELEGKLQRKA

SEQ ID NO: 11159 - protein, 112 aa, Pennisetum glaucum
LEYMDGGSLSDFLKTVKTIPEPYLAAICKQVLKGLMYLHHEKRIIHRDLKPSNMLINHMGEVKISDFGVSAIIASSSAQRDTFTGTYNYMAPERISGQKHGYMSDIWSLGLV

SEQ ID NO: 11160 - protein, 494 aa, Physcomitrella patens subsp. patens
MPAIIHHGPQARAQGVPEKKAWEGVKPLPFVLSVGVGLALRFLVKKPEAVSMQAWQLLAIFASTITGLVLSPLPVGAWAFLGLTVAVVTKTLTFAAAFGAFTNDVIWLIVISFFFARGFVKTGLGDRVATYFVKWLGKSTLGLSYGLALSETLLAPAMPSTTARAGGVFLPIIGSLSLSSGSKPKDKSASKLGSYLVMTQFQAAGNSSALFLTAAAQNLLCLKLAQELGVIIANPWVSWFKAAFVPAFTALLTTPLILYKLFPPEVKDTPEAPAAAAKKLEALGPVTQNEWSMVGTMLLAVTLWVFGETLGIASVVAAMLGLCILLCVGVLNWNDCLQEKSAWDTLTWFAILVGMAGNLSNLGLVKWMSDGVAKTLASYSLSWPAAFGVLQATYFISHYLFASQTGHVGALYSAFLAMHIASGVPTGLAALALAFNTNLFGGLTHYSSGQAAVYFGSGYLELKDVFKYGAVMAVWNILVWTVVGGFWWKVIGLY

SEQ ID NO: 11161 - protein, 424 aa, Oryza sativa Indica Group
MQLLGAPPPVLPSGSAAPTNTPATAAAEEEEEESLLEGHKAAREWAQVHGQHEGRTWAVGSGAAATLGQSNGRDAPARAEDGSFGLVLLLFVPHLLLHARLWLLSPTFASQPQQFSQVTSAAESRRVELDLDATTSFFGVYDGHGGAEVAMYCAKRFHTMLLEDVDYINNLPNAITSVCFRLDDDLQRSNEWRESLNPCANRNCLTNICANLHHFTEDYVPPSYEGSTACVVIIRGNQIIVGNVGDSRCVLSKNGQAISLSFDHKPHHEAERERIQRAGGHVFLRRILGMLATSRAIGDFAYKQNRNMPPSQQMVTCVPDIRVENITDDTEFLVIASDGVWDGMRNNNVVQFVRQELRPGEENLRETCEKLVGHCLHSNDNATAILVKFKPIEEDPDEVASARDEHQHNPEGGDEKLDINNDND

SEQ ID NO: 11162 - protein, 553 aa, Vibrio cholerae O1 biovar eltor str. N16961
MFAIYESYKAGQLQPKQWVNNITAGLIVGVVALPLAMAFAIASGVKPEQGIYTAIIAGIIVSLFGGSRVQIAGPTGAFIVILAGIVAEHGVAGLQIATIMAGFILVVLGLARLGSIIRYIPDPVIVGFTSGIGVIIWVGQWRDFFGLPEIKGEHFHQKLVAIFHAFPQFHLTTTLLALLSLALVIFGPKIPKLSKIPGPLLALVVVTSLQYVVGFEGVRTIGSAFGGIPQGLPEFALPDLSLSQMIQLIGPAFAIAMLGAIESLLSAVVADGMAGTKHNSNQELVGQGIANIVAPLFGGIAATGAIARTATNIRNGGNSPIAGVMHALTLVIILLVLAPLAVNIPLATLSAILFVVAWNMSEAPHFVQLAKRAPRADVAILLLTFGLTVFADLVVAVNIGVIIAMLHFVKRMASSVEVKANGSQEMSYELAQHGRSTLPRELAVYALEGPFFFAAAETFERVMGSIQETPQILILRLKWVPFMDITGIQTLEEMIQSFHKRGIKVLISGANSRVSQKLVKAGIVKLVGEQNVYPVFEGALSAALTEIEAQPTE

SEQ ID NO: 11163 - protein, 105 aa, Prochlorococcus marinus str. MIT 9515
MSIIKLEKGDNNNAAVLEKKTAALKNKSPKYKVLLHNDPVNSMEYITIALREVVPQLSEQDAIAIMLEAHNNGVGLVIVCDLEPAEFYSESLKSKGISSSIEKDE

SEQ ID NO: 11164 - protein, 476 aa, Tropheryma whipplei str. Twist
MRADIGVYGLAVMGSNLARNFAGKGIRVAIHNRSSDRSNSLAQQHSECNFIVAKDDKDFIDSLSSPRTVLLMVKAGSIVDEVIARLSTFMQPGDVIIDGGNSLYTDTIRREEELKARGLHFIGLGVSGGEVGALEGPSLMPGGSDYAYSIVGPMLEKIAARANGEPCVAHIGHNGAGHFVKMVHNGIEYADMQIIAESYDLLRRGLGLSPTRISDIFREWNSGELESYLVGVTADILSHRDKRTGKPFVDIVLDQAGAKGTGAWTAQNALDLGVPAGSVSEAVFARSLSSDEQRCQVQQKLSRSQASSHEAPLKEAEFIDAVRNALYLAKILAYSQGFRIISVAAAKHDWGIDLSACARIWRAGCIIRAVFLDKVAHEYSKNPDLTSLMCSPGFSDELVGRLRFLREVVASAARLAIPAPVFSSLLSYIDALASDRLPACLIQAQRDDFGAHTYRRVDVPGIFHTLWSSDLSEVPA

SEQ ID NO: 11165 - protein, 390 aa, Oryza sativa Indica Group
MDSIMEPYVADLLADDITASMVELLSGDGGAAQMDVGVLDAYLRAIGALPAHPAAPGADLAAAAEVESMASNDDTNGNWDTKVDAKVPSAFLPPPPGFPPLPVPALANEPVYAAPVDEGDAIRAFMQQLEWSEQYNGDDDAPAPDDSMASRPQLCAPYDDDIDANLRAMEKDAAERPSPDYLDTVHNGQISAASRASLVAWMGRLTHRYELAAGTLHRAVSYFDRFLSARALPSYTEHQLSLVGATAVYTAAKYEDQGTVFKLDAREIASYGEFASAQEVLAMEREMMAALGYRLGGPNAETFVEHFTRYSKGKEELRVQRLARHIADRSLESYGCLGYLPSVVAAAVISIARWTLNPPGALPWSSELHELTGYSSQHISSCVLTVLNTQ

SEQ ID NO: 11166 - protein, 408 aa, Prochlorococcus marinus str. MIT 9515
MVQINENYLKLKAGYLFPEISKRVNSYTQANQGSEVIKLGIGDVTEPLPNACINAMSKALNEMGTHEGFKGYGPEQGYEWLREKISKNDFISRGCQITPEEIFVSDGSKCDSSNILDILGHDNLIAVTDPVYPVYVDSNVMTGRTGETLKNGTYQGLLYLAINEDNNFLPEIPKNKVDIVYLCFPNNPTGATITKDELKKWVDYANHNKSLILFDAAYEAFIQDKDVPHSIYEIDGAKSCAIEFRSFSKNAGFTGVRCAYTVIPKCLTGQNSKGDKVDLWPLWNRRQCTKFNGVSYVVQKGAEAVYSSQGKKEVNSLIDFYMENAKIMRNKLRSAGFTVYGGCNAPYVWIKVPADMTSWDFFDHLLEKANVVGTPGSGFGLAGEGYFRLSAFNSRLNVSNAMERIINI

SEQ ID NO: 11167 - protein, 173 aa, Helicobacter pylori
MNLEKLEVSHDASVLSVVIEISKHSNIKYELDKESGALMVDRVLYGAQNYPANYGFVPNTLGSDGDPVDALVLSDVAFQAGSVVKARLVGVLNMEDESGMDEKLIALPIDKIDPTHSYVKDIDDLSKHTLDKIKHFFETYKDLEPNKWVKVKGFENKENAIKVLEKAIKAYQG

SEQ ID NO: 11168 - protein, 658 aa, Physcomitrella patens subsp. patens
MPLAQRAGDNSEARYCGVEVGFSDDIQNALAFALGGQFDFIAASLTDPNYRPSEGKPGPPPFAGSDLVLSPSQWSSHVVGKMSPWIDLDSPDELARQDAEVTLKQELSWATHLSLQACLLPTPRPLNCANYARCVNQLLQGLSNLQLWLRIPLVAPELQAVEGTPEEDAVFLKRDPLSGRPLNDSWEWWNMFRSLCEHHSQLSVALDITGSLPSPSSLKRWTGEPLRAAIIHTSAFLTNKRGYPCLPKRHQNFITSLFNHNVQIIVSGDPMHLVDGSENTTASSESSANGSEDGVFPKHPLRPYLEYIGYLYRRMAPPTEQERFEIGYRDFLQAPLQPLMDNLEAQTYETFEKDSTKYSQYQKAVFAALMDRVPDDQTTVVLMVVGAGRGPLVRASLQAAEQAGRSLRVYAVEKNPNAVVTLHSLIKLEGWEDLVTVVSCDMREWNAPEQADILVSELLGSFGDNELSPECLDGAQRFLKPDGISIPSSYTSFIGPITASKLHNDVKSYNDLAHFETAYVVKLHSVSRLAPPQEVFTFEHPKFVGGKIDNRRYKKMLFELAEDTGSALVHGFGGYFDAVLYKDVHLGIEPSTATPDMFSWFAIFFPLRRPIYVPAGSALELHFWRCVGPSKVWYEWSVTSPDVSPVHNPNGRSYWVGL

SEQ ID NO: 11169 - protein, 388 aa, Zea mays
  misc_feature (127)..(127): Xaa can be any naturally occurring amino acid
MASATVLKSSFLPKKSEWGATRQAAAPRPPTVSMVVRASAYADELVKTAKTIASPGRGILAMDESNATCGKRLASIGLENTEANRQAYRTLLVTAPGLGQYISGAILFEETLYQSAVDGRKIVDILXEQGIVPGIKVDKGLVPLAGSNNESWCQGLDGLASREAAYYQQGARFAKWRTVVSIPNGPSELAVKEAAWGLARYAAISQDNGLVPIVEPEILLDGEHGIERTFEVAQKVWAETFYAMAENNVMFEGILLKPSMVTPGAEAKDRATPEQVAAYTLKLLHRRIPPSVPGIMFLSGGQSEVEATQNLNAMNQGPNPWHVSFSYARALQNTCLKTWGGQPDKVKAAQDALLLRAKANSLAQLGKYTSDGEAAEAKEGMFVKNYSY

SEQ ID NO: 11170 - protein, 473 aa, Schizosaccharomyces pombe 972h-
MVTFMVFGASGNLANKKTFPALFHLFKRNLVDRSSFYVLGYARSKIPIGEFRESIRESVKPDTESKQVFQDFIDRVSYFSGQYDQSSSYVEFRKHLESVEKKADSSKALRIFYIALPPSVYVTVSSHIYENLYLPGKSRLVIEKPFGKNYQSAVKLKEEVHKHWKEEEIYRIDHYTAKDMVNNFFTLRFANSSSIDAVLNRHSIQSVEIHMYETGGCEGRIGYYDANGVVRDVVQNHLTQIFCIAAMNEPKSASASDVRAEKVNLLKATRPASLKESMLGQYTTSEDGKIPGYLDLEGVPKDSKATTFAASTLHVDNDRWKGVPFVFVSGKRMKKGEVYIKYYFRLKDSGIFSDVKRRRYLILHVQPEEFVNLTCTINKPMTTDLQPIDAYASLNYNEQFKDLMKEKRDGYEILFEDAIRGDPTKFIRYDEVEYAWKIWDEILDSPKKPIPYPAGSDGPEGLEAYMKRHLGHE

SEQ ID NO: 11171 - protein, 281 aa, Prochlorococcus marinus str. MIT 9515
MRKQVAYLGPEGTYAEKAAHILSELANFESPLFVPCNGLYSVIKAIAYNNCDAAIVPIENSVEGGVTTTLDALWKFSDININRAIVLPIKHALISDGDISEISEVLSHPQALAQCSEWLSENLPEAITLSTNSTSEAVKMVKGSSFRAAIGSKSLTEIEGLKELAFPINDVPGNCTRFVLLSKESILDKANIASFAFSLLSNNPGALLEALNYISDFGFNMSKIESRPSKRELGEYIIYIDVDINTRTNIEAFYELKKKLKPLCEHLVDFGCYLSEKIKLD

SEQ ID NO: 11172 - protein, 366 aa, Leuconostoc mesenteroides subsp. mesenteroides ATCC 8293
MALTAGIVGLPNVGKSTLFNAITKAGAEMANYPFATIEPNVGMVEVPDTRLARIQEVVPADKIIPTTFEFTDIAGIVKGASQGEGLGNKFLENIRQVNAIVHVVRAFDGDEIIHVNGVVDPLDDIETINTELILADLEAVDKRYSKVARAAKGNDKNAKAEFVVLEKIKPVLEAGKSARTITFTEEEQKIVKGLFLLTTKPILYVANLAEDDMADPMGSKYFNQIKEFAATEGADVIGLSASAEEEIAQLPEEEKAEFLEMAGVEEAGLNKLIRAAYHLLDLRTFFTAGGKETRAWTFTAGSKAPQAAGVIHSDFERGFIRAETIAFSDLDELGSVKAVKEAGKLRSEGKEYVVQDGDIIEFRFNV

SEQ ID NO: 11173 - protein, 173 aa, Helicobacter pylori
MNLDQLEVSHDADSLCVVIEISKHSNIKYELDKESGALMVDRVLYGAQNYPANYGFVPNTLGSDGDPVDVLVLSDVAFQAGSVVKARLVGVLNMEDESGMDEKLLALPIDKIDPTHSYVKDIDDLSKHTLDKIKHFFETYKDLEPNKWVKVKGFENKESAIKVLEKAIKAYQG

SEQ ID NO: 11174 - protein, 159 aa, Methanococcus maripaludis S2
MNVTIISVGKIKEKYLSDAIIEYSKRISRYSKLDIIEVADEKTPENPSDVEKSKILEKEAERILKYLKKDSFLITLEILGKELTSEDLAKKINDLSISGKSDITFVIGGSLGLSKNISEISDFKLSFSKMTFPHQLMRVILLEQIYRSFRIISGEPYHK

SEQ ID NO: 11175 - protein, 382 aa, Escherichia coli
MIKSALLVLEDGTQFHGRAIGATGSAVGEVVFNTSMTGYQEILTDPSYSRQIVTLTYPHIGNVGTNDADEESSQVHAQGLVIRDLPLIASNFRNTEDLSSYLKRHNIVAIADIDTRKLTRLLREKGAQNGCIIAGDNPDAALALEKARAFPGLNGMDLAKEVTTAEAYSWTQGSWTLTGGLPEAKKEDELPFHVVAYDFGAKRNILRMLVDRGCRLTIVPAQTSAEDVLKMNPDGIFLSNGPGDPAPCDYAITAIQKFLETDIPVFGISLGHQLLALASGAKTVKMKFGHHGGNHPVKDVEKNVVMITAQNHGFAVDEATLPANLRVTHKSLFDGTLQGIHRTDKPAFSFQGHPEASPGPHDAAPLFDHFIELIEQYRKTAK

SEQ ID NO: 11176 - protein, 542 aa, Desulfotalea psychrophila LSv54
MIHLTNIHKQYGSQVLFRGASLQVLPATRTGLVGANGAGKTSVFRLMMGEEEADKGEISCSKKTVIGYFSQDVGEMSGRSVLDEVMSAAGEIVAMGARMREMEARMGEPMSDDEMAALLEEYGNTVDAFEHRGGYELDSQAKEILTGLRFSNSDLILPVESFSGGWKMRIALAKILLIGPDVLLLDEPTNHLDIESILWLESWLTNEFKGALLMTCHDREFMNRIVSRIIEIGNEGATTYGGDYDFYLKEREIRREQLLASYRRQQEMLSKEEDFIAKFAARVSHAAQVQSRIKKLDKIERIVLPPEQRVMKFDFPVPPRSGDDVLHLKDLGKEWQTAHGEIKPVFSGLTGSIRRLEKIALVGVNGAGKSTLLKVITGQTEATSGEVLTGASLATGYFSQHSMDLLYPGQTVFEAVQETLPLENIGTIRNLLAAFLFQGDDVDKKISSLSGGEKSRVVLAKMLAQPLNFLVLDEPTNHLDIQSREVLLKALKKFEGTLILVSHDRHFLRSLVNRVFEIDHGEMRSYEGDYDYYLREHEKHNI

SEQ ID NO: 11177 - protein, 515 aa, Desulfotalea psychrophila LSv54
MIHASDIALSYGKRVIFKDVNIKFTAGNCYGLIGANGAGKSTFLKILSGQIDADKGEVFVGARERIAILNQDQFAYDETTVAHTVLMGHKRLHEIMVERETLYAKTDFTEEDGIRSGELEGEFAEMNGYEVESEAAALLSGLGVGEELREKKMRELEGGQKVRVLLAQALFGNPDILLLDEPTNNLDSKSINWLEGFLERFQNTVIIVSHDRHFLNQVCTHMADIDYGHIQTYAGNYDFWLQASELAQHQRQDANRKAETKAKDLKDFIARFSSNASKAKQATSRKKLLDKLEIGDLPTSSRKYPFIHFKPGRSCGDIILEVKDLCKNIDGVQVLNNFNLVINKGEKIGFVGLNGPAIAALFQILAGEMEPDSGSCRWGITMTASYFPRENSAFFAKDVTLVDWLSEYTPVTEGESYARGFLGKMLFSGEEATKKTSVLSGGEKVRCMLSKMMLSDANALILDEPTNHLDLESITALNEGLQNFTEIILFSSHDQTLMNTVANRLIEILPRWRDR

SEQ ID NO: 11178 - protein, 530 aa, Borrelia garinii PBi
MINYKNLNELENFKILEGIAPEVLKTALTGKRIKEYDITIEGDSVHYNYASKQINENHLKIFQNLSDEANLIEKYKEVLNGEKINISENRKVLHHLTRGQIGKDVIEDNKENMREFFQSELEKIYNFAKQVHSGNIKSVNGKKFKNVVQIGIGGSSLGPKALYSSIKNYAKKHNLALMNGYFISNIDPDESEEVLNSINLDETLFIIVSKSGNTLETTANMQFLINKLKSNGIKEYKKQMTIITLKNSMLALEETGCLEYFFMHDSIGGRFSPTSAVGLALLTLCFTEKIVKEIIKGANKTDKKSLNKKVKDNAPLLAALISIYERNVLNYSSNCIIAYSKAMENFYLHLQQLEMESNGKSVNRFNETINYKTVRIIWGGVGTDVQHSFFQMLHQGTDIVPMDFIGFNATQLKEDVISDNSSSNDKLKANLIAQIIAFSKGKENSNKNKNFKGERPSALIYSKELTPYAIGAILSHYENKVMFEGFLLNINSFDQEGVQLGKILANQILKNNAFEDEVIESYSKKILKQD

SEQ ID NO: 11179 - protein, 459 aa, Streptococcus thermophilus
MNEKLFREIMEINPIYARPGENTEAPRFKMPTDAMLPETAYQIVHDESMMDGNARLNLATFVSTWMDERADKLYREAFDKNAIDKDEYPETARIETYCWTMLADLWHAPKPKETIGCSTTGSSEACMLGGLALKRRWQEKRKAEGKPIDKPNLVMSSAVQVCWKKFCNYFDVEPRYVPISLEHKVLDGYELEKYVDENTIGVVAIMGVTYTGMYEPVDKIAKVLDGIQEKTGLDIQIHVDAASGGMIAPFLQPDNVWDFRLERVASINTSGHKYGLVYPGLGWVVWRDCQSLPDSLIFKVSYLGGTMPTFALNFSRPGAQILLQYWAFLRYGFEGYKKVQGATSDVARYLANEIKKIGPFELWNDASDIPVFAWMMKKDQKHNWGLYDLSDRLRMKGWLIPAYPMPTNLTDLTVQRIVVRNGLGMDLADQLINDMKTEVAYLEKLDQPLPENHRSGFHH

SEQ ID NO: 11180 - protein, 257 aa, Triticum aestivum
NPFPPPVPTYHLAIPRSHTGKMCTVEKRGRVHLITLTGAGEHRLSPSLISALRTAVATVRASPGAGALVLAAEGKYFSNGFDQAWARTVPPHLHDSMRGAFRALVADLLALPMPTVAAVTGHAAAAGCALALAHDSVVMRASRGFLYMSEVDVGLKFADYFGELLRQKVPNAAARRDMVLGGKKMTAAEAVRLGIVDAAADGGVEDVVAAGVAAAEVLATRGWDGEIVAEIRKAMWPAVWGKVKDHGAEAAAARPRL

SEQ ID NO: 11181 - protein, 398 aa, Chlorobium tepidum TLS
MAKILEGPAMKLFNKWGIPVPNYVVIMDPKRLAQLGEANKWLRESKLVVKAHEAIGGRFKLGLVKIGLNLDEAIQASREMLGAKVGTAEVRQVIVAEMLDHDAEFYVSIIGNRDGAELLISKYGGVDIEDNWDSVRRIQIPLDEHPTIEQLTALAKEAGFEGEIAERVGKICSRLVLCFDNEDAQSIEINPLVIRKSDMRFAALDAVMNVDWDARFRHADWDFKPVSEIGRPFTEAEQQIMDIDSRIKGSVKFVEVPGGEIALLTAGGGASVFYADAVVARGGTIANYAEYSGDPPDWAVEALTETICRLPNIKHIIVGGAIANFTDVKATFSGIINGLRESKSKGYLEGVKIWVRRGGPNEAQGLAAIRKLQEEGFDIHVYDRSMPMTDIVDLALKS

SEQ ID NO: 11182 - protein, 440 aa, Aeromonas hydrophila
MTLSLDHISGQLRHAIDECRLIQIRGRVTQVTGTLLKAVVPGVRVGELCHLRNPDNTLSLQAEVIGFAQHQALLTPLGEMFGISSNTEVSPTGAMHQVGVGEHLLGQVLDGLGNPFSGGQLPEPAAWYPVYRDAPAPMSRKRIEQPISLGIRAIDGLLTCGEGQRMGIFAAAGGGKSTLLASLIRSAEVDVTVLALIGERGREVREFIEADLGEEGLKKAVLVVATSDRPAMERAKAGFVATSIAEYFRDQGKRVLLLMDSVTRFARAQREIGLAAGEPPTRRGYPPSVFAALPRLMERAGQSDKGSITALYTVLVEGDDMTEPVADETRSILDGHIILSRKLAAANHYPAIDVLRSASRVMNQIITPDHQAQAGRLRSWLAKYEEVELLLQIGEYQKGQDKVADEAIARIEAIRQWLRQRTHEPSALPDALATLDALTR

SEQ ID NO: 11183 - protein, 580 aa, Synechococcus sp. CC9605
MAVAETGTQSLSKSEQRKLDSDHLRDPLLSELSNDDVRFTEDAVQLLKFHGSYQQHHRELRKTDKIRSWQMMLRLRSPGGRIPARLFLALDDLSNRLGDGTLRATTRQAFQMHGIAKADLKEVIGTIVRNMGSTLAACGDINRNVMAPPAPFEKGGYPVARRLADEIADLLSPEAAEGAYLDLWVDGDLSYRFKPSRAVQKARKRQSEGGLFSGSTEEPLYGDTYLPRKFKVAVTVPGDNSVDLLTQDIGLVAFTDPSGDLRGCNVYVGGGMGRTHNKEETFARTADPLGYVDAADVLDVVQAILALQRDHGDREVRKHARMKYLLHDKGIQWFRDTMCATYFKGDLKGLRNEPKAKLLDYLGWHRQKAGMWFVGLPLLCGRLNGDLKAGLRQLVETYQLEIRLTANQDLLLCNIGTSQRASIRTQLEALGFEVPEAPAPLARHAIACPALPTCGLAITESERILPDVLDRLDAQLRRLEIEKSLLVRMTGCPNGCARPYMAELGLVGNGVNQYQLWLGGTPNLQRLARPYMEKLPLDDLEKTLEPLLISWKAAGGRRSFGDHIEKLGDQEVSALLTASA

SEQ ID NO: 11184 - protein, 83 aa, Zea mays
  misc_feature (30)..(30): Xaa can be any naturally occurring amino acid
  misc_feature (64)..(64): Xaa can be any naturally occurring amino acid
MAAQVPVSGPCVTCIGKCGSGNFVKMLHNXIEYGCMQLIDEAYDLLKSVSKLINSELHQVFSEXNQGELLSILIKITADIVGI

SEQ ID NO: 11185 - protein, 556 aa, Streptococcus pyogenes MGAS8232
MYQALYRKYRSQTFDEMVGQSVISTTLKQAVESGKISHAYLFSGPRGTGKTSAAKIFAKAMNCPNQVDGEPCNQCDICRDITNGSLEDVIEIDAASNNGVDEIRDIRDKSTYAPSRATYKVYIIDEVHMLSTGAFNALLKTLEEPTENVVFILATTELHKIPATILSRVQRFEFKAIKQKAIREHLAWVLDKEGIAYEVDALNLIARRAEGGMRDALSILDQALSLSPDNQVTIAIAEEITGSISILALGGYVRYVSQEQATQALAALETIYDSGKSMSRFATDLLTYLRDLLVVKAGGDNQRQSAVFDTNLSLSIDRIFQMITVVTSHLPEIKKGTHPRIYAEMMTIQLAQKEQILSQANLSGELISEIETLKNELAQLKQQLSQLQSRPDSLARSDKTKPKTTSYRVDRVTILKIMEETVRNSQQSRQYLDALKNAWNEILDNISAQDRALLMGSEPVLANSENAILAFEAAFNAEQVMSRNNLNDMFGNIMSKAAGFSPNILAVPRTDFQHIRKEFAQQMKSQKDSVQEEQEVALDIPEGFDFLLDKINTIDD

SEQ ID NO: 11186 - protein, 153 aa, Prochlorococcus marinus str. NATL2A
MISIRKNFMLNISHYKIIAIGKIKKKWIQEGIEMYLKRLPGLEVKEIKDSTQLKEEHTIKEIISKNEFLVTLNENGQSFTSKQLATKLLNSHNQNITFVIGGASGLSSSLNNLASWQLSLSPLTFPHEIARLLLIEQLYRAKAITQGGPYHKE

SEQ ID NO: 11187 - protein, 222 aa, Brassica napus
  misc_feature (195)..(195): Xaa can be any naturally occurring amino acid
  misc_feature (219)..(219): Xaa can be any naturally occurring amino acid
NTILDVQGVGLKNFTKSARELITRLQKIDGDNYPETLHQMFIVNAGAGFRLLWNTVKGFIDPKTSSKIHVLGYKYQTKLLEVIDANELPEFLGGACTCADQGGCMLSDKGPWKNPEIVKMVLHGGAHRAKQVVKVLNSEGKVIAYAKPSYPWIKGSDTSTAESGSDADDIGSPKAIMSFSHLRLTPVREEAKIAXETSLAGGLLGYDEYVPMVDKAVDXTWK

SEQ ID NO: 11188 - protein, 577 aa, Chlamydomonas reinhardtii
MASLLAGKPLMGGLKLQRSAKMAVPAVAVPRVATAAAARVGLKGGLGERPFAPKPVEKKPLAPAPQAASGDAPAPEPKKFLGFEPITWAKILPLGAMFFCILFNYTILRDTKDVLVVTAPGSGAEIIPFLKTWVNLPMAIGFTIMYSALSNRLSSEALFYTCIIPFIAFFGAFAALMYPMRDALHPTEFCQNLLEQMGPRFAGPIAILRNWTFCLFYVMAELWGSVVVSVLFWGFANQITTVEEASQFYPLFGLGANVALIFSGQAVKYFSQVRAGLPPDVDGWGVSLNGLMGMVVIGGLLIIGIYFSLQRLVVPKLKSLREGKKKKNKTKMSVGESFAFLAQSSYIRDMATLVVAYGISINLVEVTWKGKLKAQFPNPNDYSSFMGEFSTATGTVTFTMMILSRWIFKQFGWGVAALITPIMLLITGLLFFTLVLAGDTVKPALAAWGMTPLYAAVLVGAAQNVFSKSSKYSLFDPCKEMAYIPLEDEVKTKGKAAIDVICNPLGKSGGALIQQFMIIGLGSLAASTPYLGAILCVIIVAWINAAASLNKQFTALQEETGMYITGEKPANKSEKKD

SEQ ID NO: 11189 - protein, 173 aa, Helicobacter pylori
MNLEKLEISHDADALCVVIEISKHSNIKYELDKESGALMVDRVLYGAQNYPANYGFVPNTLGSDGDPVDALVLSDVAFQAGSVVKVRLVGVLNMEDESGMDEKLLALPIDKIDPTHYYVKDIDDLSKHTLDKIKHFFETYKDLEPNKWVKVKGFENKESAIKVLEKAIKAYQG

SEQ ID NO: 11190 - protein, 450 aa, Tropheryma whipplei str. Twist
MDYDLIVLGAGSAGYATAIRATQLGMKVALAEGDKVGGTCLHRGCIPTKSLVQCAKAAHIAKNASKFGVINSFSGVDINAVNVFKNGIVESKYRGLQSLLRSYGIHVYPNFATLSSQNSVRIGTEDITGKNIVIATGSRPKGIPGLSGGCIFDSDSILEIDHLPSSLAIIGGGVIGVEFASIFNYLGVDVSILEAQETLIPSEERGVSKQLERVFRRRGIKLYLGHKIMDVSQTDGVVVSLDSNEKVNADLLLVAIGRAPATDAIGKVGIEIDGGAISVDEKLRTSVPNVFAAGDVVGGLQLAHRGYQQGIYLAEQIAGLDPSAVADINIPRVIYTSPEVASVGYTEAGAAEIYGVNEIVTYEYNLAGNAKSSIMGAAGSIKVVQHKNKDVLGVHMVGDGVSELVSEAQLIVNWEANPSDVASLIHPHPTQAEAIGEAMLALAGKPLHGI

SEQ ID NO: 11191 - protein, 173 aa, Helicobacter pylori
MNLEKLEISHDANALCVVIEISKHSNIKYELDKESGALMVDRVLYGAQNYPANYGFVPNTLGSDGDPVDALVLSDVAFQAGSVVKARLVGVLNMEDESGMDEKLLALPIDKIDPTHSYVKDIDDLSKHTLDKIKHFFETYKDLEPNKWVKVKGFENKESAIKVLEKAIKAYQG

SEQ ID NO: 11192 - protein, 664 aa, Arabidopsis thaliana
MDLPPKILPTHKYPLTISTRFVNDSCKGCNIKGPIYGGYRCNEPSSTSLFFHKECAEAPPEIINHPSHPQHTLKLHNSLRNPCKCNLCGKTFFAFGYRCSSKCDFIVDLTCGINPLPVSIEHPKSHHHPVIFLKEPAKPGRRRCGICKGYNGGCSYACLECEVHFHVECVNLSQEVNHPSHPQHSLKLLEYESLTSDAEETCLLCGERPDKVLYRCSICNFSVCRFCTKDPPPLAIEHHKTHEHRLVLLSRLISFECNACGMQGDRSPYMCVQCGFVVHRTCIDLPRVININRHDHRISFTHHLGVGYSRCGICRKDISQYHGAYLCPRCPNYAAHSLCATRKDVWDGVELEGTPDDDDEDIVPFKVVGDNLIKHFSHEEHNLRLNKDNINRDEGSRCEACVLPIYSDPIYNCEECRFILHEKCANHPKKKRHVFHTKPFTLWSRPPRTFHSKDFRFYDVFRCYACRTKSTGFRYVSDWWVLDVRCGSRSEPVIHDGHRHPLYYEHKKDHCCDACYKEIDGYLLSCDTCDFDLDLHCTDLPKTVKHSCDNHPLSLCYGENATGKYWCDICEAETDPSKWFYTCSKCVVTAHIECVLGDFSRLMPGRIINYNNVRVEVVLNSYSSRPFCAKCHSRCRAPIILKLCDPYTGYICSDACVVPDYQYS

SEQ ID NO: 11193 - protein, 238 aa, Vibrio parahaemolyticus RIMD 2210633
MKKSLTAIGLSLVFVGSANAANWGYEGSHGPEHWGEFASECAQGKNQSPIDIHSATQAELAKLQLDYQGKVVALTNNGHTLQTSIEGENVLTIDSKAFTLKQFHFHTPSENHVDGKSYPLEAHYVHADEQGNLAVVAVFFEQGKANPALANLLENVPERDQNVAIRAPFDANALIPSDKDYYRFNGSLTTPPCSEGVRWLVIKDPQSISAEQIAQFEHVMGENNRPVQPLNARMVLTK

SEQ ID NO: 11194 - protein, 492 aa, Bacillus halodurans C-125
MTENKGTPEVGWSFDTRYTDLPSMMFSNVEPEPVEAPKLVILNDSLAQSLGLDPVALQHQNSIAVLAGNEVPKGAAPLAQAYAGHQFGHFTMLGDGRAILLGEQITPNGERFDIQLKGSGRTPYSRQGDGRAALGPMLREYIISEAMHALGIPTTRSLAVVTTGESVFRETVLPGAILTRVAASHIRVGTFQFVANAGSEEELKALADYTLARHFPEVEADRENRYLALLQKVIKRQAELIAKWQLVGFIHGVMNTDNMTISGETIDYGPCAFMDVYDPETVFSSIDTRGRYAYGNQPRIGAWNLARFAEALLPLLADDQDEAIKLAEAEISNYAEQFEHHWLNGMRAKLGLFNEESEDLSLIKDLLEVMHKHKADFTNTFRALTFDEQEETGLHDKLEFTEWHERWQARLGRQEQTKDDSHNLMKMSNPAVIPRNHRVEEALEAAVEQEDYQVMERLLKVLANPFAHSPEQKAYAKLPAPCAIPYRTYCGT

SEQ ID NO: 11195 - protein, 601 aa, Oryza sativa Indica Group
MINRIAGVFARRGYNIESLAVGLNKDKAMFTIVVSGTDRVLNQVIEQLNKLVNVLNLEIPRAETFYPNLVKTLALFIENLLRVEDLSKEPQVERELMLIKINVEPDQRPEVMVLVDIFRAKVVDISENTLTIEVTGDPGKIVAVQRNLSKFGIKEICRTGKIALRREKIGATARFWGFSAASYPDLIEALPKNSLLTSVNKTVNGSFDQPSNAGGDVYPVEPYEGSSMNQVLDAHWGVLDDEDVEDLSKEPQVERELMLIKINVEPDQRPEVMVLVDIFRAKVVDISENTLTIEVTGDPGKIVAVQRNLSKFGIKEICRTGKIALRREKIGATARFWGFSAASYPDLIEALPKNSLLTSVNKTVNGSFDQPSNAGGDVYPVEPYEGSSMNQVLDAHWGVLDDEDSSGLRSHTLSILVNDCPGVLNIVTGVFARRGYNIQSLAVGPAEKSGLSRITTVAPGTDESIEKLVQQLYKLVDVHEVQDITHLPFAERELMLIKVSVNTAARRDILDIAEIFRAKSVDVSDHTVTLQLTGDLDKMVALQRLLEPYGICEIICANTVTVLTHIVSKTHSPHVARTGRVALVRESGVDSKYLRGYSFSL

SEQ ID NO: 11196 - protein, 173 aa, Helicobacter pylori
MNLEKLEISHDANALCVVIEISKHSNIKYELDKESGALMVDRVLYGAQNYPANYGFVPNTLGSDGDPVDALVLSDVAFQAGSVVKARLVGVLNMEDESGMDEKLLALPIDKIDPTHSYVKDINDLSKHTLYKIKHFFETYKDLEPNKWVKVKGFENKESAIKVLEKAIKAYQG

SEQ ID NO: 11197 - protein, 352 aa, Kluyveromyces lactis NRRL Y-1140
MSSGTIFKKQKLNPSDGKGQAKPWVEKYRPRKLDDVAAQDHAVTVLKRTLQTANLPHMLFYGPPGTGKTSTILALTKELYGPHLSNSRVLELNASDERGISIVREKVKNFARLTVSKPSESDLANYPCPPYKIIILDEADSMTADAQSALRRTMETYSGVTRFCLICNYVTRIIDPLASRCSKFRFKALDSSNALSRLQFIANEESLKYEDGVLERILDISQGDLRKAITLLQSAAKIVLQNDDANTITLKHANELSGTIHEEILQDLINVIKGKDLNKIIDKVQEFVNQGWSAASALTQLHEYYIKNESYDTEFKNKVSWLLFDSDSKLTNGASEHLQMLNLAMKVSQLYN

SEQ ID NO: 11198 - protein, 420 aa, Bacillus halodurans C-125
MGAIAEKGKESSILSSTQDVIQQALGKLGYEEGMFELLKEPVRMLTVRIPVRMDDGTVKVFTGYRAQHNDAVGPTKGGVRFHPEVTADEVKALSLWMTLKCGIVNIPYGGGKGGIVCDPRTMSFPEIERLSRGYVRAISQIVGPSKDIPAPDVFTNSQIMAWMVDEYSRIREFDSPGFITGKPIVLGGSHGRETATAMGVTICIEEAAKLKQLDLREATVIIQGFGNAGGYLAKILSDRGAKIIGISDAYGALYDETGLDIEYLLDRRDSFGTVTTLFKNTITNEELLEKKCDILVPAAIANQITEANAREIKASIIVEAANGPTTTEATNILTERGVLIVPDVLASSGGVTVSYFEWVQNNLGYYWSEEEVSEKLRSKIVEAFHQVVETATRYNVDPRLAAYMVGVRKTAEASRFRGWI

SEQ ID NO: 11199 - protein, 173 aa, Helicobacter pylori
MNLEKLEISHDANALCVVIEISKHSSIKYELDKESGALMVDRVLYGAQNYPANYGFVPNTLGSDGDPVDALVLSDVAFQAGSVVKARLVGVLNMEDESGMDEKLLALPIDKIDPTHSYVKDIDDLSKHTLDKIKHFFETYKDLEPNKWVKVKGFENKESANKVLEKAIKAYQG

SEQ ID NO: 11200 - protein, 400 aa, Bacillus halodurans C-125
MKMQSSTSAVIEKTEKYGAKNYHPLPIVISEAKGVWVKDPEGRKYLDMLSAYSAVNQGHCHPKIIQALKDQADKITLTSRAFHNDQLAPFYEKVSKLTGKNMLLPMNTGAEAVETAVKAARRWAYDVKGVPDNQAEIIVCEDNFHGRTMTAVSLSSNDEYKRGFGPMLPGIKVIPYGDLEALKAAITSHTAAFLVEPIQGEAGIRIPQEGFLKEAYALCKRENVLFIADEIQSGLGRSGKWFACDWEDVKPDMYILGKALGGGVFPISVVCADRDILGVFEPGSHGSTFGGNPLACAVSIAALEVLEEEKLVERSYEYGNYLLTKLKEIDNPIIKDVRGRGLFIGVELHEPARKYCEQLKEEGLLCKETHETVIRFAPPLVISKEDLDWAIEKIYYVLKP

SEQ ID NO: 11201 - protein, 173 aa, Helicobacter pylori
MNLEKLEISHDANALCVVIEISKYSNIKYELDKESGALMVDRVLYGAQNYPANYGFVPNTLGSDGDPVDALVLSDVAFQAGSVVKARLVGVLNMEDESGMDEKLLALPIDKIDPTHSYVKDIDDLSKHTLDKIKHFFETYKDLEPNKWVKVKGFENKESAIKVLEKAIKAYQG

SEQ ID NO: 11202 - protein, 234 aa, Nicotiana tabacum
MASYSLPSPIAKRLEGKVALITGGASGIGAATARLFVQHGAKVTIADIQDNLGTSLVQEIGNEHTIFIHCNVAVESDVQNVVDATIAKFGKLDIMFQYAGIGGKSISSILDVVRIIKTVFDVNIVGAFFCAKHAARVMIPFKKRFHYLHSKLLSRTHILHQKGAVLGFSKNIGVELGKYGIKVNCVSPHYISTPLVLNALGIAEREIAEKWFAAGGNLKGALLDEEEVAKAVLS

SEQ ID NO: 11203 - protein, 363 aa, Neurospora crassa
MMSRATTRTIKSAVGQIQARSVSNSAASSTPRHLLSISQLSPAEFSKLVLNASAYKQATKAAFAAGPGQVPRTLDGKLKGRTVAMMFSKRSTRTRVSTEAAVALMGGHPMFLGKDDIQLGVNESLYDTSKVISSMTSCMVARVGPHSDVADLARDSSVPVINALSDDFHPLQAIADFQTIHEAFATKPAHEASLGLEGMKVAWVGDSNNVLFDMATACVMLGVDIAVASPAGYGIPDRMKQIILSVAEGVAKPGKLIETTVPEEAVKDADILVTDTWVSMGQEAETQRRLKAFAGFQITNELAKRGGAKPGWKFMHCLPRHPEEVDDEVFYGPQSLVFPEAENRLWAAVSALEAFVVNNGRIL

SEQ ID NO: 11204 - protein, 204 aa, Triticum aestivum
  misc_feature (173)..(173): Xaa can be any naturally occurring amino acid
MPPRRPNTGAGGGGTSSAAPPPPPSRKVPLRSLLRAASVACGVQFGWALQLSLLTPYVQELGIPHAFASLVWLCGPLSGLLVQPLVGHLSDRIAPANSPLGRRRPFIAAGAASIAFSVLTVGFSADLGRLFGDDIVPGSTRFGAIIVYLIGIWVLDVGNNATQGPWRAFLADXKEDDPRRPGLQRLLLVLWPGGNTRDATGEYK

SEQ ID NO: 11205 - protein, 216 aa, Triticum aestivum
  misc_feature (202)..(203): Xaa can be any naturally occurring amino acid
  misc_feature (208)..(208): Xaa can be any naturally occurring amino acid
MMASTSTASATAVAGAFAAAGANRPRGSAACPRVPAGGRRRLSCVVRCDAGPGAQAQAAAKAASVAALEQFKISADRYMKEKSSIAVIGLSIHTAPVEMREKLAIAEELWPRAVAELTNLNHIEEAAVLSTCNRMEIYVVALSWNRGIREIVDWMSKKSGIPASELREHLFMLRDSDATRHLFEVSSGLDSLVLGEGQILAXXKQVAXVGKQWRLG

SEQ ID NO: 11206 - protein, 335 aa, Xylella fastidiosa Temecula1
MTQTITVIRGDGIGPEIMDATLSVLNALQANLNYEFADAGLSALEKHGDLLPESTLNSISKNKIALKSPLTTPVGEGFSSINVALRRKFDLYANVRPAKSFPNTKSRFSDNVDLITVRENTEGAYLSEGQTISPDGEVATSSARVTRKGSERIVRYAFDLARTTGRKKVTAVHKANIIKSTSGLFLKTARDVASQYPEIDFQEMIVDNTCMQLVMRPEQFDIIVTTNLFGDILSDLCAGLVGGLGLAPGANIGNEQAIFEAVHGSAPDIAGQGKANPCALLLGAVQMLDHIGQPQNAERLRNAIVATLNAKDSLTPDLGGNGNTMGFAKAIASRL

SEQ ID NO: 11207 - protein, 543 aa, Borrelia garinii PBi
MITVNNLEVAFGERVLFKDVNIKFSSGNCYGIIGANGAGKSTFLKVLGGMIESTKGEIFIPKNQRVAALEQDQFAYDAYKVIDTVIMGHKRLYSIQKEKDEIYNKLDFSDEDGIRAGELEAEFSELGGYEAESSAAVLLKGLGIDESIHNNLMGDIEGSLKVRVLLAQALFGEPDILLLDEPTNNLDLQSIKWLEEFLINFENTVIVVSHDRHFLNQVCTHIVDIDYGKIQVYLGNYDFWYETSQILNKQLKDAKKRSEDKIAELKTFIQRFSSNASKSRQATSRKKLIEKIKVEDLKPSSRKFPYVNFKSERELGKNVLTIKNLTKEFEGNLILNKFSSIIEPQQKIVFLGNPMSATFLFDIITNEDKNYKGHYEWGSTVNFSYFNKDNGKYFDLDLNLVNWLRQYSKEQDETYIRGFLGRMLFSQDEALKKVNVLSGGEKVRCMLAKAMLSGANVLILDQPTNHLDLEAITSLNAGLKEFKGVVLFTSHDHQFIDTVANRIIEFTPNGIIDRYMTFSEYVDDTKIRDLRNNLYGDNAGFRL

SEQ ID NO: 11208 - protein, 832 aa, Aspergillus oryzae
MEGFSNPEDMGPAFCIGQHESKRTVPITTQVVQAAHESNAASPDAHGTMGTTQNTRPLVIPPLAPSDTHLTPNEAMTQIVGVTSSWIDLCSPDPLIADISRQVLMLEVAYAAFCGIGYLLIPGPKLHHKGMHSEGVVYYARAIQDAINVGPYIQFNIWLGAVDNPDLEIDEMGDLAPLAREEFLVNLDEGQAPKEDPFGTWEAWDTVRRTCKYHSRLFVALSLQKHLPSMSVQSRWHSEPVRLLTFNANSFIKNQKGYPVLSKAHQSLIARFMRLRSPPWILLCDVGTIPGVDADNSHVTNIEGAEYPSLAQAAVSNKKHFDPTPHLSYIRNLQQRQPARTAIERFGVGYQDYLQAPLQPLTVNLESITYEVFEKDPIKYEWYERAIAKALKDWAEQKKPTSNPDGRVVVAVVGAGRGPLVTRALKASAETGVDIDMWAVEKNPNAFVLLQRHNATIWGGKVTLVQSDMRSWKGPRVEKKPSSSQPSAPVGQSLGIEDSMLYDAEADPNNKTKAPEAAAPNPVPELMPTTIDIVVSELLGSFGDNELSPECLDGITHLINPVHGISIPESYTAHFTPISAPKLHADVMHQTISNPAAPETPYVVMLHAVDFLSTNQPAMLGNTTGGGSYHGNVRSSISTLPGSETPAPFVQTAWSFSHPNRHIPPQSPSTSTISNAHNVRRTRLAFPTQNRGVCHGLAGYFETVLYRDVELSTNPVTMDSKSANMISWFPIYFPLKTPLNVPDNGEVVVTMYRQTDDRKVWYEWMVEVFALEGHMEPPAPEFIAPVMSGARGGSPSADSKPQQRKSSGRSGLRRVKVGMSELHSSIKEGCLM

SEQ ID NO: 11209 - protein, 208 aa, Streptococcus pyogenes MGAS8232
MFKKPIIIGVTGGSGGGKTSVSRAILDSFPNARIAMIQHDSYYKDQSHMSFEERVKTNYDHPLAFDTDFMIQQLKELLAGRPVDIPIYDYKKHTRSNTTFRQDPQDVIIVEGILVLEDERLRDLMDIKLFVDTDDDIRIIRRIKRDMMERGRSLESIIDQYTSVVKPMYHQFIEPSKRYADIVIPEGVSNVVAIDVINSKIASILGEV

SEQ ID NO: 11210 - protein, 475 aa, Streptococcus pyogenes MGAS8232
MAKQYKNLVNGEWKLSENEITIYAPATGEELGSVPAMTQAEVDAVYASAKKALSDWRALSYVERAAYLHKAADILVRDAEKIGAILSKEVAKGHKAAVSEVIRTAEIINYAAEEGLRMEGEVLEGGSFEAASKKKIAIVRREPVGLVLAISPFNYPVNLAGSKIAPALIAGNVVALKPPTQGSISGLLLAEAFAEAGIPAGVFNTITGRGSVIGDYIVEHEAVNFINFTGSTPIGEGIGKLAGMRPIMLELGGKDSAIVLEDADLALAAKNIVAGAFGYSGQRCTAVKRVLVMDKVADQLAAEIKTLVEKLSVGMPEDDADITPLIDTSAADFVEGLIKDATDKGATALTAFNREGNLISPVLFDHVTTDMRLAWEEPFGPVLPIIRVTTVEEAVKISNESEYGLQASIFTTNFPKAFGIAEQLEVGTVHLNNKTQRGTDNFPFLGAKKSGAGVQGVKYSIEAMTTVKSVVFDIQ

SEQ ID NO: 11211 - protein, 253 aa, Bradyrhizobium japonicum USDA 110
MDRPGETTHFGFRDVPLGDKQTLVNDVFHSVASRYDLMNDLMSGGLHRVWKDIMINALDPPRGDRPFALLDVAGGTGDISFRAAKAAGPGFHATVCDINSDMLAVGRERAAKRHLETQVDFVEGNAEALAFADRSFDAYTIAFGIRNVPQIDLALREAYRVLRPGSRFLCLEFSTVEMPGLDKLYDLFSFKVIPPLGRMITGDAESYQYLVESIRKFPKPNAFADMIRDAGFARVNWQTLSGGIVALHSGWRL

SEQ ID NO: 11212 - protein, 461 aa, Tropheryma whipplei str. Twist
MSEDFILPALGESVSECVITRWLKEAGDRVEVDEPLVEVSTDKVDTELPSTLTGILEEILVQRDETAKPGQILARIAVDKDETKSNFDHGVKQSDVITGDSTGNLLGNTRPIEDTGWPVTLHTAESKPDLSAKADHIGDEGDKQGNLPTAHNAEIPYATPIVRQLARKLNIDLTNIVGSGVGNRILREDVLLASNRTTNTSTECAQNIPSSPEHDKSAASFDSEVSELRGTRIKMSRLRNIIAERAVHSMQNTAQLSTVIEVDLTRIVDYRNSIKEKFKEAEGVNLTVLPFIINATVQALRKYPVINSHIVDDQIVFPDYENISLAVDTERGLLTPVIKNAGDMTVAQFAKSVFDLARRARNNKLSPDELTGGTFTVTNTGSRGALFDTPVVFLPQLAILGIGAIARRPVIVLDAQGNECISIRSVAFFALSYDHRVIDGADAARFLGYIKSLLETGNCTV

SEQ ID NO: 11213 - protein, 384 aa, Thermoplasma volcanium GSS1
MRVAKNVIITSCYNWSGGVLNLYEYMGKDIFREYGIPVPNGYVVSSPQDVKKFTNPVAVKSQILLGGRGKAGGIKFAKTDEELKNAVSTLLSTKVRNMTVTKVLIEDMLNIKHEYYVSIALNRAAKSPMLIASAMGGMEIENVPDDKIFKRIIDPSLGYSDFIGREASQFMGLPPELSKQFLDILKKLYNVYRGEDCELVEINPLVETGDGKLIAADAKVVIDSDAIYRHREFSIQDPEKTPLELKAEGKGYAFVELDGDIGVIANGAGLTMATLDALLLHKGKPRNFLDLGGTDNVDIVINAFDLVLEAKPKAILVNIFGGVTKCDTVAQGIVEAKKKFDIKIPVVVRLSGVHEVEGRKILQDNGIEAFSEMMPAIERVTKVF

SEQ ID NO: 11214 - protein, 339 aa, Tropheryma whipplei str. Twist
MQLSGYPMRQASCDMKEGGLRNKVAVIGSGSWGTAIANLLCKAGNETILWGRDENVIDEINNARVNSKYLPGVELFLRATCDLDYAVADASHVYIALPSFALSKVLPKLSLDKFSIVISLIKCLEPDTGRRMSEVISEALDLGHNRLAVISGPNLALEVANDEPSVSVVASANIATANIVAGTLKCPGFYCIPSSDIKGVEICAASKNLVALISGIARGMDLGDNTRAALITLGFRELLRLVLENGGTEETVFGVAGLGDVVATCNSHLSRNNKAGVLLAKGAPLDEVKQTAEGVVAISGVLALAERSGVYMPIAQALSQVISGKRTAHSLLDICFSLA

SEQ ID NO: 11215 - protein, 227 aa, Neisseria meningitidis Z2491
MELVFIRHGQSEWNAKNLFTGWRDVKLSEQGLAEAAAAGKKLKENGYEFDIAFTSVLTRAIKTCNIVLEESDQLFVPQIKTWRLNERHYGRLQGLDKKQTAEQYGDEQVRIWRRSYDTLPPLLDKDDEFSAHKDRRYAHLPADVIPDGENLQVTLERVLPFWEDQIAPAILSGKRVLVAAHGNSLRALAKHIEGISDEDIMGLEIPTGQPLVYKLDDNLKVIEKFYL

SEQ ID NO: 11216 - protein, 324 aa, Synechococcus sp. WH 7805
MAHSPNRLTNRAIHRWLSGLMVPVLLVGLLLIHPLPSDAARGGRIGGGSFRAPSMPRSGGYGGGVRRGYNGGYNRGFGGGFGFPFIIPIFGFGGGGLLGFLVLMAIVGVLVNAFRGAGNRPAIGGGVGGYDSPREIPMGPVSLLQLQIGLLASAKDLQSDLRALASSADTSSPAGLQRVLQDTTLALLRQPDLWVYANAESGSVPFNAAESTFNRLSMTERSKLREELTTNVGGVRSNSEDTASRGDADATNEFIVVTLLVASRRSVNLKQADNGEDLRESLRILGSTASSDLIALEVIWQPDGAGDVLSADELVTAYPNLQHL

SEQ ID NO: 11217 - protein, 161 aa, Glycine max
LRFMFIAASLVAVVVIVTGNQTEVILVPQPVPWPAKFRYTPAFVYFVAALSVTGLYSIITTLASLFASNKPALKTKLLLYFILWDALILGIIASATGTAGGVAYLGLKGNSHVVGWNKICHVYDKFCRHVGASIAVALFGSIVTVLLIWLSAYSIHSRVPK

SEQ ID NO: 11218 - protein, 418 aa, Tropheryma whipplei TW08/27
MSLIVQKYGGSSLASANNLKRVAERVSRAYYGNNRLVVVVSAMGSTTDRLLTLAHEVSVEPERRELDVLLSTGECVTASLLAMAINSIGLPARSFTAAQAGIVTDEHHCNARIITITPTLIEDALNAGEIAVVAGFQGVNRKGQVTTLGRGGSDTTAVALAAALKADRCEIYSDVEGVFTADPRIVPKARLLESIPIDHMLELSTAGARILSLRSVVFAKRHNVSVKVGSTFSDTSGTILCNEGEAMEEPVITGIATDTSQARITIVGLPDIPGSAAEVFSALSVAEVAVDNIVQNFSSSNTGFIDLSFTSPKAQGPAVTSALRENQTRIGYKDLQYDDEVGKITVVGSGIQHSADISAQLFRLLSDAKVNVEMISTSEMRISFVVRANVVAEVARLIHTSFGLDADLRAVVHSEGRV

SEQ ID NO: 11219 - protein, 343 aa, Vibrio parahaemolyticus RIMD 2210633
MKIKALSKLKPEQGIWMTEVDKPEVGHNDILIKIKKTAICGTDVHIYNWDEWSQKTIPVPMVVGHEYVGEVVAIGQEVRGFEIGDRVSGEGHITCGHCRNCRGGRTHLCRNTIGVGVNREGAFAEYLVIPAFNAFKIPDEISDDLASIFDPFGNAVHTALSFDLVGEDVLITGAGPIGIMAAAVAKHVGARHVVITDVNEYRLELARKMGVTRAVNVAEEKLEDVMAELGMTEGFDVGLEMSGNPAAFNSMLTTMNHGGRIALLGIPPSDMGIDWNQVIFKGLVIKGIYGREMFETWYKMASLIQSGLDLSPIITHHYKIDDFQEGFDVMRSGMSGKVILDWE

SEQ ID NO: 11220 - protein, 149 aa, Magnaporthe grisea 70-15
MASPNESSPLLPDPNNKPSKRDEMSALTYWRVGAVYGATAVAMGAFGAHGLKKRITDPQKIASWGTAAHYQLLHSGAVMLAASVGTGNPVAAGLFTAGMTMFSGSIYALILDPERFKFLGPVTPIGGVCLIAGWIALGFTKRGAFPRLR

SEQ ID NO: 11221 - protein, 522 aa, Tropheryma whipplei TW08/27
MMRSEQALYRRYRPEVFSEMVGQDGVTGLLSSALDNNRLGHAYLFSGPRGCGKTTSARVFARCLNCVNGPTSSPCGKCQSCIDLGRSGNGSLDVIEIDAASHNGVDDARALRERAIFAPAQSRFRIFILDEAHMVTTQGFNALLKIVEEPPAHVKFIFATTEPEKVLGTIRSRTFSYPFALVSASIMQPYIADICNKEKIRVEDGVLPLVVRAGGGSVRDTLSILDQLMVGKCITYESTVGLLRLAPDILLYDLFLAIAEDDGATAFASIEKVVEAGYEPVQFIEDLMSWVKDMTLAVCNAEGVFDSYAPEKVERIFALSKRFSLKDLDAMAEILFSRSNRLSGPISPRLLLEIMLASLLLAVGKSKLQVSDRVSDTQRQKGYPGNLLHNWSRVLDALKSETANMLQHSKPLRLTGSSLTIGMPQEILSRFVANKAAIDDLKSVLYKITGVQLRLSGKPIDDPDNTVKTPSSCLDNGTVTDNSGYKNTEVDDAETKEKPDNPITGEAVLVQAGAKLISEEEQ

SEQ ID NO: 11222 - protein, 348 aa, Bacillus halodurans C-125
MQALRWHGVKDVRVDDIAEPATLKGKVKIKVKWCGICGSDLHEYAAGPIFIPQNSPHSLTEEKAPIVMGHEFSGQVVEVGDGVTKCEEGDRVVVEPIFACGTCTACKQGKYNLCEQLGFLGLAGGGGGFSEYVTVDEHMVHKIPDTVSFEQGALVEPAAVALYAVRQSQFNVGDQAVVFGTGPIGLLVIEALKASGASKIYAVELSTERRQRAEQLGAIALNPAEVNVVEEIQRLTDGGADVSFEVTGVPIVLTQAIESTKLNGQTMIVSIFEKEASFQPNLVVMRERNIAGIIGYRDIFPAVISLMNQGYFSAETLVTKRIGLHDIVEQGFEALMKTNCNIKCDTTK

SEQ ID NO: 11223 - protein, 173 aa, Helicobacter pylori
MNLEKLEISHDANALCVVIEISKHSNIKYELDKESGALMVDRVLYGAQNYPSNYGFVPNTLGSDGDPVDALVLSDVAFQAGSVVKARLVGVLNMEDESGMDEKLLALPIDKIDPTHSYVKDIDDLSKHTLDKIKHFFETYKDLEPNKWVKVKGFENKESAIKVLEKAIKAYQG

SEQ ID NO: 11224 - protein, 467 aa, Oryza sativa Indica Group
MAAATAAPSIDEAKAKSVLRQVEFYFSDSNLPRDKFLRETVEQREDGLVSLALICSFARMKSHLGLDAAVKPETVPEETVLAVAEVLRRSQMLRISEDGKMVGRASELLKADEIIKQVDSRTVAASPLPYNVKLEDVQSFFAQYAKVNSVRLPRHIANKKHFCGTALVEFSEEDEAKIVLENNLFFAGANLEIKLKKEFDAETESKKEAYEKAHPKKDEQNEGYPKGLIVAFKLKRITVDGGVQQNSADNDTATEEETPKSMKKTSTGESEERTTVNSDMEEQKSSDDMTEAKEVNAGEATESGDKCTVDALLESEKKGDNETSIKDDRGLSGKANSPISREDLKEAFKKFGTVRYVDFSIGDESGYLRFEDSKAAEKARMSAVLADEGGLIVKDHIVTLEPVTGEAEKDYWNTIRGIQGKYKDNRSYKGRTGKSYRGGKQFNGKRGRHSDSSEKGANKTQKVEAAA

SEQ ID NO: 11225 - protein, 213 aa, Desulfotalea psychrophila LSv54
MQSTCFRSVIMNLIPMVVEQTPRGERSYDIYSRLLKERIIFLGSGVNDDVANVIVAQLLFLEAEDPEKDITFYINSPGGSVTAGMAIYDTMQYIKCDIATLCMGQAASMGAVLLAAGTAGKRYALPNSRIMIHQPLGGFQGQATDIEIHTKEILRIRKDLNNILAHHTGKTLKKIESDTERDNFMSSVEAQKYGLIDEVLVKREDVEGAADNG

SEQ ID NO: 11226 - protein, 250 aa, Sphingomonas paucimobilis
MANRLAGKVALITGGASGLGAAQAKRFAEEGAKVVIGDLNEEMAKGVVAEIRAAGGDALFIRLDVTDAASWNNAIAAAVEAFGGLTTLSNTAGIIHPGGFEEESIEGWNKMVAVNQTAIFLGIKAAIPELVKSGNGSIINISSLIGMFPTAGNASYCATKAAVRIMSKAAALEFVDRGVRVNTIVPGGMNTPITANVPPDVLKQQTSQIPMGKLGDPIDIANGALFLASDEAKYITGVDLPIDGGWSVGV

SEQ ID NO: 11227 - protein, 173 aa, Helicobacter pylori
MNLEKLEISHDANALCVVIEISKHSNIKYELDKESGVLMVDRVLYGAQNYPANYGFVPNTLGSDGDPVDALVLSDVAFQAGSVVKARLVGVLNMEDESGMDEKLLALPIDKIDPTHSYVKDIDDLSKHTLDKIKHFFETYKDLEPNKWVKVKGFENKESAIKVLEKAIKAYQG

SEQ ID NO: 11228 - protein, 299 aa, Zea mays
  misc_feature (163)..(163): Xaa can be any naturally occurring amino acid
MAAAPSSLASSHLSPIAAVSTPAVPHQLRIGCSRRRAGRIVAMAGSGKFFVGGNWKCNGTKDSISKLVSELNAATLETDVDVVVAPPFIYIDQVKNSLTGRIEVSAQNVWIGKGGAYTGEISAEQLVDIGCQWVILGHSERRHIIGENDEFIGKKAAYALSQXNVKVIACIGELLEEREAGKTFDVCFRQMKAFADSISNWADVVIAYEPVWAIGTGKVATPEQAQEVHAAVRNWLKTNISPDVASSTRIIYGGSVNAANCAELAKKEDIDGFLVGGASLKGPDFATIINSVTAKKVAA

SEQ ID NO: 11229 - protein, 136 aa, Oryza sativa Japonica Group
MQGARSAAAMAAAAADEEREVRRAVEEKPVVVVGRRGCCMAHVARRLLLGQGANPAVLEVGDDADPAALVDAALQARRRKDGGDKAAAGDGGGGAAVAFPAVFIGGRLVGGLDRLMAMHMAGELVPVLKQAGALWL

SEQ ID NO: 11230 - protein, 518 aa, Zea mays
  misc_feature (452)..(452): Xaa can be any naturally occurring amino acid
MELSRISTEKFDDAVKSMTDAGFLKETVEQALKKLIILYEENWEHIEADNYSTLVEALLGHSDPKAGQKKRAEKNLNVDSDHYNKKLKIKGGQTPRSSMHGSAKKELTEEADSLEERTTGNQLQTSRAETTITGENSCTLLESQDPCTSETPTVMCPKVLGSNRHNGIKRQYHDVNDITRGEECVSIPIVCGEDGVLPPPFHYISQNTTFQDACINLSLARIGDENCCSGCFGDCLAEPLPCACARETGGDFAYTRDGLLKEGFLDACVSMLREPLKQPHFYCKGVCPIEQIMKGVSSAKPDACKGHLIKKFIKECWIKCGCTRNCGNRVVQRGITRKLQASEVFLASRKKGWGLRSAENLPRGAFVCEYVGEILTNTELHKRNTELYGKNNKKAGKARHTYPVNLDADWGTEGVLNDEEALCLDGTFYGNVARFMNHRCIDGNIIAIPVEXETPDHHYYHLAFFTTREVEAFEELTWALWWPIYGFRDMINEYFTALVERERTASLETQILFGIGEG

SEQ ID NO: 11231 - protein, 285 aa, Chlorobium tepidum TLS
MLVEALPYIRKFEGKTFVIKYGGAAMKDEVLKNIFAENVTLLRKVGIKVVIVHGGGDAITKTSAKLGLETTFVHGKRVTDRQTVDVIQMTLAGKVNQDIVQLINKDGGNAVGVSGLDADTILAKPSPNASTLGLVGEVAEINTRYIDLLCDAGLIPVIAPIGYDMEGNIYNINADDAAAAIAVALKAEKLIYVSDVEGVRVGNRILKTICKADAAELIEKGIITGGMIPKVVSAYQTLDGGVGKVHLIDGQITHSLLLEVFTNEGVGTQFVNELEQEPTAEEGAS

SEQ ID NO: 11232 - protein, 338 aa, Chlorobium tepidum TLS
MSQDNKGNGSKKRDFLGFTGLDAAKIIELFDYSLFIKQQRETNRNSDEFRPIRHKTVAMIFNKPSLRTRVSFELGVYELGGHAISLEGKSIGVGERESIEDIARLLSRYNDAIVARLHEHEIIETLAKHADIPVINALTDLSHPCQVLADAFTLYEKGLWRDDIKVVFVGDGNNVANSWIELAGILPFHFVLACPEGYLPDETLLKQARSNAKGTIEILHDPMEAAKQADVLYTDVWTSMGQEEEMAERLKAFAPFQINAKMVAEAKPSAVIMHCMPAHRGQEISAEVMDGPQSIIIDEAENRLHVQKALMVKLMNHDVYRKFHLTHRLHRAANRLKA

SEQ ID NO: 11233 - protein, 160 aa, Synechococcus sp. WH 7805
MTLRIGNGYDIHRLVDGRPLILGGQRLEHPDGVGLDGHSDADVLVHAIMDALLGALSLGDIGLYFPPTDPQWKGADSLELLRQVVALIQQRGWQVVNVDSVVIAERPKLKPHIEAMRTAIAMAMGIAPDQVGVKATTNERLGPEGREEGIACYAVALLGQ

SEQ ID NO: 11234 - protein, 485 aa, Prochlorococcus marinus str. NATL2A
MKILDLARRTKIVATIGPATESASQISKLVEAGATTFRLNFSHGDHEEHAQRIKTIRKVSDDLGIHIGILQDLQGPKIRLGRFKNGPVNVKNGDKFILTSKNIDCNQDQANVTYDKLAEEVNVGNRILLDDGRVEMKVEEVDLKEQRLICSITVGGVLSNNKGVNFPDVQLSIRALTDKDKKDLAFGLKQGVDWVALSFVRNPSDLIEIKDLIRNHGYDTPVVAKIEKFEAIDQIDAVLKLCDGVMVARGDLGVEMPAEEVPLLQKQLIKKANSLGIPIITATQMLDSMASSPRPTRAEVSDVANAILDGTDAVMLSNETAVGDYPIESVATMATIAKRIERDYPQKALESHLPSTIPNAISAAVSSIARQINAAAIIPLTKSGATAKNVSKFRPPTPVLAVTNEKSVASTLQLVWGVTPLLIENQTSTSKTFDDAMNMAKKMKILKQGDLVVETAGTLSGVSGSTDLVKVGIVSSEDENESLFI

SEQ ID NO: 11235 - protein, 227 aa, Yarrowia lipolytica CLIB122
MDALSAPTNPAQAQQFVTQNNLSFPQDAEADTSLIGEVKREQVDSGVSGIVPTLQNIVATVNLDCRLDLKTIALHARNAEYNPKRFAAVIMRIREPKTTALIFASGKMVVTGARSEDDSKLASRKYARIIQKLGFNAKFTDFKIQNIVGSCDVKFPIRLEGLAFSHGTFSSYEPELFPGLIYRMVKPKIVLLIFVSGKIVLTGAKQREEIYAAFEAIYPVLNEFRKG

SEQ ID NO: 11236 - protein, 592 aa, Vibrio cholerae O1 biovar eltor str. N16961
MNEVKAVWIRQWFPGLYQFKDYQRGWLTDDVRAAFSVVAVALPVAIAYAQLTGVPAIVGLYSCVLPMLVYALMGTSRQLIVGPDAATCAVIAAVVTPLAAGDTTKHWQLVMTMTAMTGFWCILASRLKLGIFADFLSRPILLGLLNGVALTIIVGQFAKVLGLKYEKRYLLERIVEAPELLYSLHWQTLGLSALTLAIYLVIKRWQPRWPAAMFAIMVAALLVWALNLESVGVQVVGVIQGGLPEFQAPAFDLGISRELVMPALNLAMVSFVSMMLTARSFAAKNGYDIDADKEFRALGVANVAAAFSQGFAISGADSRTAVNDANGGKSQLVSVIAALFIALVAVFAYQPLQFIPVAALGVVLIIASLSLLDLKGVWNLRKRDKDAFYLALITFIAVLVIGVIPGITLAVLLGLFQFLKLVMRPTDQMMGLDEEGTLRTLDGSEKAKPIPGMVIFRFNSPLTYFNAPYFKRRILDQTEREGAQVGCVIIDAVASFTHLDLSVMAMLADLHGILKKRGIRLILAGRKRSLRHWCDLTGINTAEGGIVLRADMYLAIKLSGCYLSAMEEGHVPVVQKEPDISVLLKPTTTEVA

SEQ ID NO: 11237 - protein, 511 aa, Prochlorococcus marinus str. NATL2A
MEDYLQKILRARVYDVAEETPLEKAKNLSKKFENNIWFKREDLQPVFSFKLRGAFNRMSQLSKEELNKGVIASSAGNHAQGVALSASFLKCRAVIVMPLTTPVMKVRAVESHKAEVILFGETYDECYGKALDISKKENLTFIHPFDDPEVIAGQGTIGLEILRQSQTPPDAIYIAVGGGGLIAGVSAYVKAIWPDTKIIGVEPEDACAMTLSLKANEPIELESIGLFADGVAVRKVGETTFSICKKNIDEMVTVSTDEICAAIKDVFEDTRSILEPAGALSIAGLKKHVVNNQLKNNNLVAIACGANMNFERLRFVAERAELGEEKEAMIAVGIPEKAGSLKLLCKTLGSRSLTEFSYRISEGKTAQIFMGVEVSNNNDRELLTAEIKRGGFDCHDLSNDELSKVHLRHMVGGRLPRAISQISKGEYIELLYRFEFPERPGALMRFVNSMRPEWTISIFHYRNHGADTGRIVIGVLVNDSEIQAWNEFVKKIGYKNWDETDNPAYKLFLGA

SEQ ID NO: 11238 - protein, 404 aa, Tropheryma whipplei TW08/27
MSERISKRCSKLGESVTLSIDSKAKRMKKAGKPIISYAAGEPDFPTPEHIVSRCQLAAATRSNHVYTETAGLAELREAIAEKTLADSFLKVSESQILITNGCKQAVYMACQTILDPNDEVILPTPYWTTYPESIRAAGAKVVIPATDSFYVTVDQLQSVLTNKTKAIILSSPSNPSGAVYSLDSLRDIARFAKKHGIWIISDEIYQNIYYSGRVAPGFGEALPEIKDQLILVNGLSKTYAMTGWRIGWMIGPQDIINASVKLQSHICSHVSNIMQQAALEALTGPQDCVAYMRDEFKKRRDLMLRELGRIKGLSIPKPDGAFYIYPDVSAFIGRRIAGRMIHSSFELAELVLSETLVATVPGEAFGTKGHLRLSYALDETSLLEGTGRLVEFFDTANSDMTKVF

SEQ ID NO: 11239 - protein, 250 aa, Sphingomonas paucimobilis
MSNRMAGKVALVTGAASGLGAAQARLFAKEGAKVVVADLNVEMGNKVVAEIQESGGEALFVRLDITDAASWAGAVEAAVGAFGKLTTLSNTAGIIHGAMIQDETLEGWSKMIAVNQTALFLGLKIVAPEIAKSGNGAILNISSLVSVICEPGLISYAATKSAVRAMTKVAALEYVGQGVRVNTIVPGGVKTPIQANVTPEQVEWYKAQIPMGDLGEPNDIAYGALYLLSDEAKYVTGTELFIDGGWSSAA

SEQ ID NO: 11240 - protein, 305 aa, Pseudomonas aeruginosa PAO1
MIYDSLLDLIGGTPVIRLSKLSARLGVSVFAKLESFNPGGSHKARIALWMILDAERKGILVRGKGQTILEPSGGNTGIGLAMAGNILGYRVSLVVPDNYSPDKRQLLELYGAHVVLSDSRKGNNSHGELAIQILLEHPEFVMLNQQRNPANPQAHREATALEILRDFAGQPPPDFFFAGIGTGGHITGVGEVLRNHWPDMAIYGVQPEQCDLLDDRHASHEIQGLSIGIVPEVCNLGIVTGMVGVSKSACLSMIREVLQNDSVSMGLSSAANLVAVLNMASAMPSGARVLTMIYDGVESYMDAFR

SEQ ID NO: 11241 - protein, 231 aa, Pseudomonas aeruginosa PAO1
MRAALMECCSPQLVERIVAHSMFEEARRWCEEDLQAFASKDPAAQGRTSDIAFGYSSFKAVLHYRLSHMLCLRSTSEGDPERALEATALLVSSRGKLLSGAEIHPRCKIGSRFILDHGHGTVIGETAVIGDDCYILGGVVLGATGISANPAGKRHPTIGSRVQIGAFTRVLGDIAIGDDVFVGPHCVIKDDIPVGSVVTLRSELQVIRGPHIVQQLQPAATQTQIQPMEAS

SEQ ID NO: 11242 - protein, 366 aa, Photobacterium profundum SS9
MTLSNLSSFFTCRVTKDSVILPPVIFHNKLSRGATVMTIKVGINGFGRIGRFVFRASVERNDIEVVGINDLIDVEYMAYMLKYDSTHGRFNGTVEVVDGNLVVNGNTVRVTAVRNPEELKWDEIGVDVVAEATGLFLTDETARKHITAGAKKVVLTGPSGDVPMFVMGVNSADYAGQDIVSNASCTTNCLAPIAKVINDKWGIESGLMTTVHATTATQKTVDGPSMKDWRGGRGASQNIIPSSTGAAKAVGKVIPELNGLLTGMAFRVPTANVSVVDLTVNLKTAATYEEICAEMKRASENEFAGVLGYTEDAVVSQDFIGEVQTSVFDAKAGVALTDKFVKLVSWYDNEIGYSNKVLDLIAHVSK

SEQ ID NO: 11243 - protein, 112 aa, Triticum aestivum
  misc_feature (59)..(59): Xaa can be any naturally occurring amino acid
  misc_feature (93)..(93): Xaa can be any naturally occurring amino acid
  misc_feature (102)..(102): Xaa can be any naturally occurring amino acid
MDSSRRPSGIQQLLAAEQEAQQIVNAARAAKTARLRQAKEEAEREIAEYRAQMEADFQXRKLTETSGDSGANVKRLEQETNVKIEQLKQQASXISPEVIQMXLLRDVTTVKN

SEQ ID NO: 11244 - protein, 250 aa, Sphingomonas paucimobilis
MSDLSGKTIIVTGGGSGIGRATVELLVASGANVAVADINDEAGEAVVAASGGKPAYFRCDIAQEEDVKALVAQTLAAFGGLDGAFNNAAIPQAGLPLAEVSLERFRQSMDINVTGTFLCMKYQILAMIERGTKGSIVNTASVAGVVGVPMHGEYVGAKHAVVGLTRVAAADYGKHGIRVNALVPGAVRTPMLQRAMDNDAGLEPYLNSIHPIGRFSEPHEQAQAAVWLLSDAASFVTGSCLAADGGFTAI

SEQ ID NO: 11245 - protein, 440 aa, Arabidopsis thaliana
MSCSSSSGSEEDDEGFDAYRKGGYHAVRIGDQFAGGRYIAQRKLGWGQFSTVWLAYDTRTSNYVALKIQKSALQFAQAALHEIELLQAAADGDPENTKCVIRLIDDFKHAGPNGQHLCMVLEFLGDSLLRLIKYNRYKGMELSKVREICKCILTGLDYLHRELGMIHSDLKPENILLCSTIDPAKDPIRSGLTPILEKPEGNQNGTSTMNLIEKKLKRRAKKAAAKISGRRVSIVGLSETPKKNKRNLDGIDMRCKVVDFGNGCWADNKFAEEIQTRQYRAPEVILQSGYSYSVDMWSFACTAFELATGDMLFAPKEGNGYGEDEDHLALMMELLGKMPRKIAIGGARSKDYFDRHGDLKRIRRLKYWPLDRLLIDKYKLPEAEAREFADFLCPIMDFAPEKRPTAQQCLQHPWLNLRTQNNEDDIEGQMSNMQIKGSCS

SEQ ID NO: 11246 - protein, 253 aa, marine gamma proteobacterium HTCC2143
MDLGLKGKRAIVTGSTRGIGKAIAETLAKEGVDVAVCSRQQKAVDETIAEFSQYPGKVIGAAVDITDQQGFKQWVDSVAAELGGIDIFVANVTAGDTAERSNPWDAAVTTDILATVSCIDAALPMLKQSEAGAIVYISSMAGIIGTPQIPAYGAAKAGMTHYMKTLAMSLVKDGVRVNTVSPGDIITEGNVWDRIRTTMPDVFKSVLKRNPRGHLGTPEEIAQVVSFMASPMASLVNGAHLVVDGCSTTHVHF

SEQ ID NO: 11247 - protein, 369 aa, Rubrobacter xylanophilus DSM 9941
MLPSDTIPPMKVGIVGLPNVGKSTLFNALTRAGAEAQNYPFTTVDPNVGVAAVPDGRLQRLAEAVGGVRAVPATVEFVDIAGLVRGASRGEGLGNRFLAHIRECDAVAHVVRCFEDENVAHVHGGIDPVGDAETVNAELLLADLATVERRLEQASRAAKSGDPKRRAEAAALERLRDHLAKGGQARTFPEPGEVSEVLRTLLTAKPTLYVANVDEGSLAAGNAYSAAVEELAGREGAGAVRLCARLAAELAELPAEEAREYLGVLGVEESGFEEFVRAAYRLLGLITFFTFNERECRAWTVREGATAREAAGRIHTDMERGFVAAEVGRWEDIVAAGSWARAREEAKVRREGRDYVMRDGDVLLVRFNA

SEQ ID NO: 11248 - protein, 519 aa, Xylella fastidiosa Temecula1
MWPLRFNNRFIDVLPCDPEVSLRSRQVLEAWSRVAPTPVPMPCLLAYSSEVAAILNFDAEELVTPRFVEVFSGNALYTGMQPYAVNYGGHQFGQWVGQLGDGRVITLGELLGADGVYYELQLKGAGPTPYSRGADGRAVLRSSIREFLCSEAMHHLGIPTTRALSLIATGDTVIRDMLYDGHPAPEPSAIVCRVAPSFIRFGTFELPASRGDIDLLRRLVEFTIIRDYPHLHGAGETLYADWFAEICTRTAELVAHWMRVGFVHGVMNTDNMSILGLTIDYGPYGWIDNNDLDWTPNVTDVQSRRYRFGAQPQVAYWNLGCLARALAPLFSDAASLQAGLERFRATYLAAERRDAAAKLGFAACFDEDLELFDALRTCMHQAEMDMTLTFLGLADWEPNMPDSLSLWAEAFYDPVKRDAQAPMLRDWLQRYAARLSVDPLPVAERHERMRLANPRYVLRNYLTQQAIECAEQGDLTELHALLEVMRRPYDFQLGREAYAMRRPEWARSRIGCSMLSCSS

SEQ ID NO: 11249 - protein, 635 aa, Aspergillus oryzae
MTQLFASSPSNVSNEKRGSFPSLSLPSKKHTNESSHLPTKIKNFFRINSSSSNSSHHSHSHSGDRDREGSPHTGAKTESKSAFRQSRFLPTIGRNRSTTVASEGNPLDEGVSPTATANPYFVHQGQPSLQHRNDGSEPSSPPDTPELQVDGVSAAEQATTANKTELARKLRRVASAPNAQGLFARGDNDGRPQTAETGNQPPVEETDSQITIAEDTVGSLAVPKLGADGKIPSPGEIRNQVAFRRTYSSNSIKIRNVEVGPSSFDKIKLIGKGDVGKVYLVREKKTSRLYAMKVLSKKEMIKRNKIKRALAEQEILATSNHPFIVTLYHSFQSEDYLYLCMEYCSGGEFFRALQTRPGKCISEDAARFYAAEVTAALEYLHLMGFIYRDLKPENILLHQSGHIMLSDFDLSKQSGPGGAPTMIPGRSGNSTTSLPTIDTKSCIADFRTNSFVGTEEYIAPEVIKGCGHTSAVDWWTLGILIYEMLYGTTPFKGKNRNATFGNILRDDVPFPEHGGAQQISNMCKSLIRKLLIKDETKRLGARAGASDVKTHPFFRQTQWALIRHMKPPMIPHQSRGTDTLNFRNVKESASVDIGGSNPTKMKGVPMDSGLATPNGEVNDPFEEFNSVTLHHDGDM

SEQ ID NO: 11250 - protein, 79 aa, Zea mays
RVFHFGKGKSEGNKTMKELLGGKGANLAEMASIGLSVPPGFTVSTEACQQYQDAGCALPAGLWAEIVDGLQWVEEYMGA

SEQ ID NO: 11251 - protein, 375 aa, Methanococcus maripaludis S2
MIAERCLGTEQSEIRKIFNMATENSINLGIGEPDFDTPKNIVEAAKLALDAGKTHYVPNAGILELTSAISEKLKKDNNLDISQKNIVTTCGASEALMLSLFTLVNRGEEVLVPDPGFVSYKGLTELCEGKMVPIDLDDKFRIDLESVKNSITDKTKCIVLNSPSNPTGSVMTKEELKGICEIADEKNICVISDEIYEKIIYGKKHYSAMEFTDNCILINGFSKAYSMTGWRVGYLAVNENFDNKYQILENMMKIHQYGFACATSFAQFGAVEALKGDQNCVSEMVSEFERRRDLIYSGMKDIFSVQKPEGAFYIFPDVSEYGNGMDVATKLIQNRILCVPGSAFGKNGENSVRFSYATKYEDIKRALEIMKNVLL

SEQ ID NO: 11252 - protein, 470 aa, Rhodobacter sphaeroides 2.4.1
MERIETDLCVIGAGSGGLSVAAGAVQMGARVVLVEAGEMGGDCLNAGCVPSKALLAAGKAAQAMRTAGAFGIRPVEPEIDFAAVKDHVARTIAAIAPHDSQERFEGLGVRVLRDWGRFVSPTELRVGARTVVARRFVIATGSRPLLPPIPGLDRVKALTNETIFALRERPEHLIVIGGGPVGIEMAQAHRRLGSRVTVIAGEKALPKDDPELAAVLLDRLRAEGVEIVEGARAEAVQPLAHGLEVTAGDRRIAGSHLLVAAGRKPALDALDPAAAGVEVTEKGVKVGPDLRSSNRRIYAVGDAAGGPQFTHLAGYHASVVIRSILFGLPSKATALIPHVTYTEPELAQIGLTEAQAREIHGDRLEVLRVPVAGSDRAQAEAATEGLVKLMVARGRPVGVSIVAPHAGEMIGLWAMALASGAKLSTVAGLVLPYPTLNELSKRAAGAYFSPKLFDSRVVRTAVRTLQRLLP

SEQ ID NO: 11253 - protein, 411 aa, Methanococcus maripaludis S2
MDAIILCAGKGTRLHPITESRPKPMIPIAGKPIIEHIIEKIENHVEKIYLIVGYQKEKIIDYFKDNPKIEYILQEKQLGTGHAVLTAKNFIKGDFLVLNGDVIFEDSIDEILNYENAVSLSNVDNPENFGVIELGYDNKIINLLEKPKKEEITSNLINAGIYKLQNSVFGILENLAPSERGEIELTDALKKLIENGKLHGVELKGYWNDIGHPWDVLSANNHFLNKIISKVSGKIENTVSITGNVIIEEGAVIKPNSVIEGPAIIKSGSIVGPLAYVRPNTVLMKNTFVGNSSEIKGSIIFENTKIPHLSYVGDSIIGANCNFGCNTITANLRFDDKPVIVNIKGKPVKSVRKLGAIIGDCVKTGIQVSFMPGVKIGSNSLIGANCLIDRDIEQESFVYKKDELVITKKRN

SEQ ID NO: 11254 - protein, 227 aa, Synechococcus sp. CC9605
MSTKPLVISPSILSADFARLGEEVKAVDEAGADWIHVDVMDGRFVPNITIGPLIVEALRPVTQKPLDVHLMIVEPEKYVPDFAKAGADIISVQVEACPHLHRNLAQIKDLGKKAGAVLNPSTPLDTLEYCLELCDLVLIMSVNPGFGGQSFIENQVQKIRDLRRMCDEKGLDPWIEVDGGIKAGNAWKVIEAGANAIVSGSGVFNQPDYAEAIKGIRNSSSKEAVLA

SEQ ID NO: 11255 - protein, 628 aa, Prochlorococcus marinus str. NATL2A
MRLSQLSHPNELHGLAISELEDVACQIRERHLQVVSTSGGHLGPGLGVVELTIALYQTLDLDVDKVIWDVGHQAYPHKLLTGRYNRFDSLRQQKGVAGYLKRTESKFDHFGAGHASTSISAALGMAIARDRKGEDYKCVAVIGDGALTGGMALEAINHAGHLPKTPLLVVLNDNDMSISPPVGALSTYLNRMRHSPPVQFISDSVQESVKNLPFMGDAIQEEFKSLTGSVRRLAVPSVGAVFEELGFTYMGPVDGHDIAELTRTFNAAHKVGGPVMVHVATTKGKGYPYAEADQVGYHAQSSFDLTTGKSIPSKTPKPPSFSKVFGQTLVKLCEQDSKIVGITAAMAEGTALNLLQKAIPDQYVDVGIAEQHAVTLAGGMACEGIKPVVAIYSTFLQRAYDQLIHDIGIQNLPVTFVLDRAGIVGADGPTHQGQYDISYLRCIPNFTVMAPKDESELQQMLVTCINHNGPSALRIPRGSGEGAALMEEGWESLEIGKAETLEEGENLLIIGYGSMVFPAIRTAAILKEFGVNSTVINARFIRPLDEDTIHEAAKRIGKVVTMEEGTLLGGFGSAVVESFNDNDIFVPTLRIGIPDKLVDHATPQQSKESLGLTPEMMADQIRNKFNFN

SEQ ID NO: 11256 - protein, 432 aa, Synechococcus sp. CC9605
MHISVVGLSHRTAPVEIRERLSIPEQTMETSLQSLRGNEQVLEASILSTCNRLEIYTLVRNPDLGVSAVSDFLSSHSGLETGELTPHLFSYHHEDAVDHLMRVAAGLDSLVLGEGQILSQVKKMMRLGQEHKSLGPILNRLLTQAVTTGKRVRSETNLGTGAVSISSAAVELAQLKLGQSRGLDHLVTLESEQIAVVGAGRMSRLLLQHLQAKGASGVVLLNRTVERAEQLSADFPDLPVQCRPLTDLDQYLSTCSLMFTSTAADDPIIDAARLAPLNRRSKLRLIDIGVPRNIAADAADVNGVESHDVDDLQEVVARNQEARQAMAREAEQLLQQEAQQFLEWWDSLEAVPTINQLRSSMESIRTEELQKALSRMGPDFSARERKVVEALSKGIINKILHTPVTQLRAPQTRQDRQQALRIVERLFDLEAS

SEQ ID NO: 11257 - protein, 431 aa, Synechococcus sp. CC9605
MKRVLAIILGGGAGTRLYPLTKMRAKPAVPLAGKYRLIDIPISNCINSDINKMYVMTQFNSASLNRHLSQTYNLSNSFGGGFVEVLAAQQTPDSPTWFEGTADAVRKYQWLFQEWDVDEYLILSGDQLYRMDYSLFIGHHRRSGADLTVAALPVDPKQAEAFGLMRTDENGSIKEFREKPKGDSLLEMSVDTSRFGLSVESAKERPYLASMGIYVFSRQTLFDLLDKHPGHKDFGKEIIPEALARGDKLQSYVFDDYWEDIGTIGAFYEANLALTQQPTPPFSFYDEKFPIYTRPRYLPPSKLVDAQITNSIVGEGSILKSCSIHHCVLGVRSRIESDCVLQDTLVMGADFFESPDERAVLKERGGIPLGVGKGTTVKRAILDKNTRIGSGVSIINKDNVEEADRSDQGFYIRNGIVVVQKNATIADGTVI

SEQ ID NO: 11258 - protein, 472 aa, Synechococcus sp. CC9605
MSKSHFGLIGLGVMGENLVLNAERNGFSSVVYNRTYAKTEDFLQGRGKDKNIQGATDLEDFVGKLERPRRILMMVKAGPAVDAVVDQLSPYLEEGDLLIDGGNSDYHDTERRVKQLESKSFGFIGMGVSGGAKGALEGPSMMPGGTKTSYEAIEGLVNKMAAQVEDGPCVTYIGPGGSGHLVKTVHNGIEYGIEQILAEGYDLMKRVKGMSGVQMADVLGQWNATEELSSYLVEITEVCLRTKDPVDGTDLVEKITDQAGQKGTGLWTVVTALQMGASVPTIYASLNARVMSSMKPQRMAAESILKGPAIKDFDLGTPDDAMAPLMDATVLSCIASYAQGMELLRIASQDLDYELHMPSIAQIWKGGCIIRARLLKRIQDAFDADPQLPNLMVDPWFAEQINRRLPGLAQVVAGAAEAGIPVPCFSSTLDYVNSYRSGRLPQNLVQAMRDCFGSHTYQRVDKEGTFHTEWLS

SEQ ID NO: 11259 - protein, 431 aa, Glycine max
SKIREVMTSHMRESGKQLVTDPERLKDPVEYVQRLLDEKDKYDKIINLAFVNDKSFQNALNSSFEYFINLNPRSPEFISLFVDDKLRKGLKGVSEDDVEVTLDKVMMLFRYLQEKDVFEKYYKQHLAKRLLSGKTVSDDAERSLIVKLKTECGYQFTSKLEGMFTDMKTSQDTMQGFYGCHPELSDGPTLTVQVLTTGSWPTQSSVTCNLPAEMSALCEKFRSFYLGTHTGRRLSWQTNMGTADLKATFGKGQKHELNVSTYQMCVLMLFNNADRLSYKEIEQATEIPASDLKRCLQSLALVKGRNVLRKEPMGKDIGDDDAFYVNDKFSSKLYKVKIGTVVAQKESEPEKQETRQRVEEDRKPQIEAAIVRILKSRKQLDHNNLIAEVTKQLQSRFLANPTEVKKRIESLIERDFLERDDSDRRLYRYLA

SEQ ID NO: 11260 - protein, 341 aa, Glycine max
MEHYDLQRQRREMKNKGRNVVWSIAMDKCLIEALAAQAKRGNKIDKCFNENAYTAACVAVNTCFSLNLNNQKVINRLKTIKKRYRVIKDILSQDGFWWNPNTKMIECDSDELWKNYVAAHPNARGLRGKQIEMYDELKIVCGNYQAPSHWAKRKSGTHLMDMKNFEDEAASFVSPSSEDMSETDGTESYTGIPEFDQIPDGFQEPPVAQPVRQLPKRPRNSDALQEALMTVASSIRRLADAMEQSKCSFDASELLHAVMEIDGLEEGKQMYAFEYLNADPVKARAFLTYNARMRKTYLFRQFWWWRIIECIDSRLIGDSHMPETLETSSLPSNHGHLKQAK

SEQ ID NO: 11261 - protein, 501 aa, Chlamydomonas reinhardtii
MKSALSAFVRDSGDQVAETGAPTATRPIPGPAPLSLEALKDVSVIFFEGLHVAQLKFSEKYGPVCRFANPASLNGATSWVFINSPENIQHVCATNVRNYSRRYLPDIYTYVTHGKGILGSQDEYNARHRRLCSGPFRNKWQLQRFSSVVVERSKRLVDIFSAAAAADPSGAFTTDVATQTQRLTLDVVGLVAFSHDFACVEQVQRDLAGATAGDGRSGVLQDRVLWAVNTFGEVLAQVFITPLPLLKAMDRLGAPHLRQLGEAVSVMRAAMLDVIAATEDDGRGLSDEELWEDVHDIMGAGHETTATTTAALLYCISAHPHVRQRLEEELDAVLADGEAPTYESLERMPYLQACAKEVMRLYPAIPVFPREAARPDVLPTGHGVAAGDVVFMSSYALGRSEAVWGPDVLEFDPDRFSPEREARQHRFQWLPFGAGPRMCLGASFAQMSVALMAATLLQRFRFTPLAPCSPLIPVGYDITMNFGPSGGLRMRVAPRQRGQQQ

SEQ ID NO: 11262 - protein, 302 aa, Pseudomonas syringae pv. syringae B728a
MQDLLNEILDEVRPLLGQGKVADYIPALGEVRPDQLGIAVYGNDGQVFSAGDAETAFSIQSISKVFSLVQAINHSGEEIWQRLGHEPSGQPFNSLVQLEFEQGRPRNPFINAGALVICDINQARFAAPSLSMRDFVRRLCGNRAITSDSKVADSEYQHRSRNAAAAYLMKSFDNFHGDVEDVLRSYFHHCALSMNCIDLAKAFGFLAHQGFCAHSGEQVLTARQATQVNSIMATSGLYDEAGNFAYRVGLPGKSGVGGGIVAIVPERASVCVWSPELNAAGNSLVGMAALEKLSARVDWSVF

SEQ ID NO: 11263 - protein, 389 aa, Tropheryma whipplei str. Twist
MRRQKKPYRTSGTIPEKFVIEKKLYSAMEKVYDPELHIPITRLGMVKTITADSKTVSILIHITSPTCPAVDKIKQRVTDAASAVCPEHDIKIEIGVMSHQERQNLKEVLNLQKRSNPFKESKTRIIAVTSGKGGVGKSTIVSNLGVGLARMGFSVSVIDADVYGFSIPRMFGIDEDFIPQRENGMIMPANKFGVKLISIGMFMRRRGAVAWRGPLLHRTINQFLCDVNFADPDILLIDMPPGTGDAAITIAQLLPNSEVLVITTPQIVAADVAIRSGQFALSVKQNIIGVVENMSSCPESKLDIFGHGGGKFVAEFLDKQCKKESTAKDNRITNPHEAIDLITCIPLDVNIRKSGDEGVPLLVENKYEGSPGHTALKELYEKIALKLYG

SEQ ID NO: 11264 - protein, 427 aa, Candida glabrata CBS 138
MYKRYFSTSLKTNQQALKKILEEKTYQVTTYARPSDLCITRGLNAKLFDDFNNKEYIDFTAGIAVTALGHANPKVAEILQTQATKLVHSSNLYFTKECLDLSEKLIEKTKKFGGQHDASKVFLCNSGTEANEAALKFAKKHGITKNPKKQGIIAFENSFHGRTMGALSVTWNKKYRTPFGDLVPHVSFLNINDELSKIKDFINTKKDEIAGLIIEPIQGEGGIFPIPIEKLVALKEICQKNDIIVIYDEIQCGLGRTGNLWAHAALPKAAHPDIFTSAKALGNGFPIAATVVNEKVNNALQVGDHGTTYGGNPLGCAVSNYVLDVIGDQAFLDSVTKKGELLKKGLLKIKEQHPDKISDVRGSGLIWGVEFKDAPGAIVQKARELGLLVITAGKTTVRFVPSLTIEDEVVEEGLTIFNKAVNDVFSK

SEQ ID NO: 11265 - protein, 657 aa, Oryza sativa Japonica Group
MDFTNLLITVLLLLSPLKYESDVATASDDEDFFKTCSSQRCSKHGPEIRYPFRLSTQPPSCGAPGMQLSCSGQDTILDHPVLGSCKVTMIYYRHVIMNAIPLVDSLPHCPLQKLVSVNQSTAVYKPHTSEVASVVGCSRDSIDTNQYGIVGPTSCPSLANNASQFWYLAYPYTYMSILPLGCTIVSKDIPMPYSYDKNGPNFDISIFTETAKRVISTGETVFTWYTSNVTSICQQCEREGRRCGFSSQRESSILPASYVNRVETRTYPSYTTLVRKLCTCIFPAMLCKIIESGPRVTIIAATSSVGTFIVLSLIVATALYISLKSRYNEEIHLKVEMFLKTYGTSKPTRYTFSEVKKIARRFKDKLGHGAFGTVYKGELPNGVPVAVKMLENSVGEGQEFINEVATIGRIHHANIVRLLGFCSEGTRRALIYELMPNESLEKYIFPHGSNISRELLVPDKMLDIALGIARGMEYLHQGCNQRILHFDIKPHNILLDYSFNPKISDFGLAKLCARDQSIVTLTAARGTMGYIAPELYSRNFGAISYKSDVYSFGMLVLEMVSGRRNTDPPAENQNEFYFPEWVFERVMNGQDLVLTMETTQGEKEMVRQLAIVALWCIQWNPKDRPSMTKVVNMLTGRLQNLQVPPKPFISSQNQLVI

SEQ ID NO: 11266 - protein, 173 aa, Helicobacter pylori
MNLEKLEISHDANALCVVIEISKHSNIKYELDKESGALMVDRVLYGAQNYPANYGFVPNTLGSDGDPVDALVLSDVAFQAGSVVKARLVGVLNMEDESGIDEKLLALPIDKIDPTHSYVKDIDDLSKHTLDKIKHFFETYKDLEPNKWVKVKGFENKESAIKVLEKAIKAYQG

SEQ ID NO: 11267 - protein, 650 aa, Oryza sativa Japonica Group
MRVIYVLCVLGVLVPDAAGGRRHHRRHDCPPFTCGHLSDVSFPFRRRGDPPECGVQSYELTCADDKATIQIDKETYSVSDINYGDSTLWVVDASFLDSRSSCLLPRWNPLLRDPRLQAKSHHIIELAPPVGVTWASFVNCSQEIRNSSWMYMPVACLSTSRSFVYVFTGQQSAYIQNLEPSCGYLATTPLGGSKLNSTSALQNVSYQDVVKLMMTGFAVRFPFTVSGWNFKECLALSIRIANIAIIDFYFWSCFLLGDRSHNNLIYTYMVVDTALLILKWTAVLCRFVLAPLAVFIFLAHKYWRNKITIDAVEKFLQMQLTLGPTRYAYTDLTAITGHFGEKLGQGGYGSVYKGVLPGYVNVAVKVLENANCNGEEFISEVSTIGRIHHVNVVRLVGFCSEELRRALVYEYMPRGSLDKYIFSSKRSFSWDKLNEIALGIARGINYLHQGCDMQILHFDIKPHNILLDDNFVPKVADFGLAKLYPRDNSFVPLNALRGTIGYIAPEMISRSFGVISSKSDVYSFGMLLLEMAGGRRNSDMHAGNSSQAYYPSWVYDRLIEQQVGVGEISAATVANMHELERKLCIIGLHCIQMKSHDRPTMSEVIEMLEGGVVGLQMPPRPFFCDDESMSPMMDSYQFSSGLTEILEEDE

SEQ ID NO: 11268 - protein, 520 aa, Ustilago maydis 521
MTASVSSNQTSLSRRSSHNRHSRISSGSSSASSGSSRPRSSRGRSTSPINPTKQEAAVQMAAKRASVSSVGSTISSSYSTLTADSKVADTTAATSTVSASASSNKVPAGLRAMLFEEEYQEEAIEHMHHMELQTVAAVELMDVQPELKWFMRPYLVDFLIEIHQTFRLRPETLFLTMNIVDRYVSKRIVYKRHYQLVGCAALLIAAKFEDAKDRVPTVKELSQMCCNAYDESAFAQMEGHVLSTIGWTLGHPTAEAWLRIESVRGGEDLKTVNLARFFLEVSLFHRDFISLKSSALTTGALILARFICGLPQSTQLSLNAEAAKAAHMLDAYVWENLQDLSLILIKKYSYAYFSSASTVACEWYRARVAAAKSSPPSGLLPAQALTRNAGAVAQEVDDDDSMCSQPTTPASSVQSTPSRSMDEDEDEDEEDDMPVTPLSLYSLHDPLVAAANAAGLPVPMPSSRASAQDKERRLSSSSASTEKPMPSSKSASTHLTVQQPMLGARKPLGNVVWNVNVQQF

SEQ ID NO: 11269 - protein, 577 aa, Streptococcus equinus
MTEMLKGIAASDGVAVAKAYLLVQPDLSFETVTVEDTSAEEARLDAALKASQDELSIIREKAVETLGEEAAAVFDAHLMVLADPEMISQIKETIRAKQTNAEAGLKEVTDMFITIFEGMEDNPYMQERAADIRDVAKRVLAHLLGAKLPNPATIDEESIVIAHDLTPSDTAQLNKQFVKAFVTNIGGRTSHSAIMARTLEIAAVLGTNDITSRVKDGDIVAVNGITGEVIINPTDEQVAEFKAAGEAYAKQKAEWALLKDAKTVTADGKHFELAANIGTPKDVEGVNANGAEAVGLYRTEFLYMDSQDFPTEDEQYEAYKAVLEGMNGKPVVVRTMDIGGDKELPYLDLPKEMNPFLGFRALRISISETGNAMFRTQIRALLRASVHGQLRIMFPMVALLKEFRAAKAIFDEEKANLKAEGVAVSDDIQVGIMIEIPAAAMLADQFAKEVDFFSIGTNDLIQYTMAADRMNEQVSYLYQPYNPSILRLINNVIKAAHAEGKWVGMCGEMAGDQKAVPLLVEMGLDEFSMSATSILRTRSLMKKLDTAKMQEYANRALTECSTMEEVLELSKEYVNVD

SEQ ID NO: 11270 - protein, 449 aa, Vibrio parahaemolyticus RIMD 2210633
MSSTLSHELLSERLSDALASLDSIPVARVTGRLIKVNGLMLQAVGCRFKLEQRCLVETAEGDMIEAQVVGFDHTVAYLMPIRRLGGLFAGAKVIPLDGDSTVQLSSQWMGRVVNGLGEPLDDGMPLKGGDRVSLEPKPINPLKRRPVDTPLNVGVRAINGLLTVGKGQRIGLMAGSGVGKSVLMGMITKNTEADVIVVGLIGERGREVREFIERNLTPEAREKAIIIAAPADESPLMRLRATLLCHRVAEYFRDQGKDVLLLMDSLTRYAMAQREIALSLGEPPASRGYPPSVFSVLPQLLERAGNSENPHGSLTAIYTVLAEGDDQQDPVVDSARAILDGHVVLSRQLAEQGHYPAIDINASISRCMSTCTQPAHSTIANNFRQMYSNYLQVKELLPLGGYQPGQDPELDQSVSMYPHLRSYLQQSANEAVDYTTSLTELAQMFQGAQ

SEQ ID NO: 11271 - protein, 133 aa, Arabidopsis thaliana
  misc_feature (108)..(108): Xaa can be any naturally occurring amino acid
RPKEEEIQHDEVTAYSLLSSTAVVTCAGQATMVAPLTGLNSSGSFPATRKAHNDITYITSNRRRVSCMKVRPPIGKKKGETLSYLPDLSGVESAKVVDYLLRNKWIPXVEFESEHGFVYREHRNTTRFYDGRY

SEQ ID NO: 11272 - protein, 173 aa, Helicobacter pylori
MNLEKLEISHDANALCVVIEISKHSNIKYELDKESGALMVDRVLYGAQNYPANYGFVPNTLGSDGDPVDVLVLSDVAFQAGSVVKARLVGVLNMEDESGMDEKLLALPIDKIDPTHSYVKDIDDLSKHTLDKIKHFFETYKDLEPNKWVKVKGFENKESAIKVLEKAIKAYQG

SEQ ID NO: 11273 - protein, 265 aa, Arabidopsis thaliana
MRKALEICVEELMYGSMKEVMLLVCVVDVGSPRDRRMRSERVSYHDAPSRREREPRRAFSQGNLCNNCKRPGHFARDCSNVSVCNNCGLPGHIAAECTAESRCWNCREPGHVASNCSNEGICHSCGKSGHRARDCSNSDSRAGDLRLCNNCFKQGHLAADCTNDKACKNCRTSGHIARDCRNDPVCNICSISGHVARHCPKGDSNYSDRGSRVRDGGMQRGGLSRMSRDREGVSAMIICHNCGGRGHRAYECPSARVADRGFRRY

SEQ ID NO: 11274 - protein, 206 aa, Prochlorococcus marinus str. MIT 9515
MTDTPTKNENQSKADNLPPSNPNDQRKGNRNNDRKRNRRGDSKNERDSEWQERVVQIRRVFKTVKGGKKMSFRAIVVVGNEKGQVGVGVGKAGDVIGAVRKGVSDGKKHLVRVPLTPNNSIPTLSKGRDGAANVLIRPAAPGTGVIAGGSIRTVLELAGIKNVLAKRLGSKTPLNNARAAMVALSQLRTHKSASRERGISLEQLYS

SEQ ID NO: 11275 - protein, 633 aa, Oryza sativa Japonica Group
MAIPGAYAHAVQALATGILFVVVSLVLDHVEGRHHKCPSFSCGHLKGVSAPFRRAADPPGCGSKSYELVCSDTNATILIDNATYHVNEINYDYRRFWVVDANIAGSTCPLPQWNHLLDQYKRKVSGHRIEIELAPGAYNHAYFVRCSREVKDNGIYRPVTCASSNYSFIYVLLSSDSDNPGYIESLEPSCGYLAMTLLGDWSTTVPRNASYEDVKKFMRGGFTVRFPVNYGAGNINECLMDSISLSRLLLTPVRCMYYAVLCRFVLVPLAILTFLAHKYWKTRLAIDAVEKFLQMQQVLGPTRYAYTDLTAVTSHFRDKLGQGGYGSVYKGVLLSGDVHVAVKMLNGTSTYDGEEFISEVSTIGRIHHVNVVRLVGFCSEELRRALVYEYMPQGSLDKYIFSSERSFSWDKLNEIAIGIARGINYLHQGCDMQILHFDIKPHNILLDDNFVPKVADFGLAKLYPRNKSFVSDRALRGTVGYIAPEMVSRSFGVISSKCDVYSFGMLLLEMAGGRRNADPNTNPNASQSYYPSWVYGQLTGEQVGETSGAADMHELQKKLCLVGLWCIQMKSHDRPTMSETIEMLEGDVNALQVPPRPFFCDGDFMPNVMDSYLHSSELTAISEDDGAIEFASN

SEQ ID NO: 11276 - protein, 173 aa, Helicobacter pylori
MNLEKLEISHDANALCVVIEISKHSNIKYELDKESGALMVDRVLYGAQNYPANYGFVPNTLGSDGDPVDALVLSDVAFQAGSVVKARLVGVLNMEDESGMDEKLLALPIDKIDPTHSYVKDINDLSKHTLDKIKHFFETYKDLEPNKWVKVKGFENKESAIKVLEKAIKAYQG

SEQ ID NO: 11277 - protein, 510 aa, Magnetospirillum magnetotacticum MS-1
MPGSSFGRLDVPPRPADLISSRIGAEPLPVVSASPKPSRRHADLGPDFYDVVAPADFPAAILRYRNGAWARRVGLDGLTDEEWIAHFARFSPLPGSFEQPLALRYHGHQFRSYNPELGDGRGFLFAQLHDLRDGRLLDLGTKGSGQTPWSRGADGRLTLKGGVREVLATAMLEALGVNTSKSFSLIETGEALERGDEPSPTRSAVLVRLSHSHLRIGTFQRLLFLEQPEALARLVDVVVETYYPEIREPDRAERMALFFAAMTARVARMGAQWMAAGFVHGVLNTDNINVTGESFDYGPWRFAPVHDPAFTAAYFDEWGLYSFGRQPEALFWNLSRLAECLLPLVPKERLEAGLKRFGPALQDAFAEALLFRLGIEPAEGEGEAAVHRLVGAFWAFLEKSRAPFEQVFFDWRGGLASETRAARSPAGEHYADEAFRPVHAALQAMRPAPQAHLDHPYFARTEPCTMLIDEVEALWAPIAAADDWSAFSAKLAEIGAMAEAYGTAPLPPEV

SEQ ID NO: 11278 - protein, 255 aa, Zea mays
MAKLMNKLVDSFEHDEIPDVGCVRAVLAELVLTFLFVFTGVSAAMAAGSDGKPGDAMPMATLAAVAIAHALAAGVLVTAGFHVSGGHLNPAVTVGLMVRGHITKLRAVLYVAAQLLASSAACVLLRFLSGGMVTPVHALGRGISPMQGLVMEVILTFSLLFVTYAMILDPRSQVLAIGPLLTGLIVGANSLAGGNFTGASMNPARSFGPALATGDWTNHWVYWIGPLLGGPLAGFVYESLFLVHKTHDPLLNGEI

SEQ ID NO: 11279 - protein, 421 aa, Methanosarcina acetivorans
MRSHLVKPGSVYDGIEPGELGESTESVQDRVRQLESRNSFLEEQCSQIESEKRYLENQKIKYEREIRKLQSELDRMKTSPLIIGTVIDVIKNDRIIVRSSNGPQFLVNVSQYIDEKKLLPGAKVALNQHTLAIAEVIPSTEEPFVAAMEVIESIEVDYDQIGGLDEQIQELQEAVELPLIEPERFARIGIEPPKGVLLYGLPGTGKTLLAKAVAHRTNATFIRVVGSELVQKYIGDGSKLVREIFEMARKKAPSIIFIDELDSIAARRLNETTGADREVQRTLMQLLAEMDGFDKRKNIRIIAATNRPDVLDPAILRPGRFDRLVHVPMPGIEARGKILKIHCGKMTLAGDIDFKKLAKVTEGMSGADLKAIATEAGMFAVRKDKALVEMEDFLEAVEKVSMAADTQKMMPGNLPETTMFV

SEQ ID NO: 11280 - protein, 250 aa, Triticum aestivum
MPVSRIAVGSHREVYEVGALKAALAEFISTLIFVFAGQGSGMAFSKLSPDGAATPAGLISAAIAHAFALFVAVSVGANISGGHVNPAVTFGAFVGGNITLFRGLLYWIAQLLGSTAACFLLRFSTGGLPTGTFGLTGIGAWEAVVLEIVMTFGLVYTVYATAVDPKKGSLGTIAPIAIGFIVGANILVGGAFSGASMNPAVSFGPALVSWEWGYQWVYWVGPLIGGGLAGVIYELLFISRTHEQLPTTDY

SEQ ID NO: 11281 - protein, 154 aa, Triticum aestivum
  misc_feature (58)..(58): Xaa can be any naturally occurring amino acid
  misc_feature (71)..(71): Xaa can be any naturally occurring amino acid
  misc_feature (100)..(100): Xaa can be any naturally occurring amino acid
  misc_feature (123)..(123): Xaa can be any naturally occurring amino acid
  misc_feature (127)..(128): Xaa can be any naturally occurring amino acid
  misc_feature (134)..(134): Xaa can be any naturally occurring amino acid
MAPTVMASSATSVAPFQGLKSTAGLPVSRRSNGASLGSVSNGGRIRCMQVWPIEGIKXFETLSYLPPLSTXASSSSPTTWIRSKWGALPPIQQVGFIFRXHNASPGYYDGRYWDMLKLPISGXTGPXXVINKWXESRRIPDPTPHNRFNIASWV

SEQ ID NO: 11282 - protein, 332 aa, Aspergillus oryzae
MSVPSTMKAVIVEKLGGPEVLEFKSDHPVPTPQEGQLLVKNNISGVNYIDTYFRTGLYPSAKPEILGREGAGTVVALGSGPNPYGFKVGDRVAWMTTGGYAEYTAVPAAKTVKIPDEITDEDAIAGFLSGLTVITLAKETYAVQKGDWVLLHAAAGGAGFLMTQVLKSLGAKVIGTAGGPEKVALVKSLGADVVIDYRSEEGKDWVKKVKEVTDGRGVDVVYDSVGKDTWEGSLEAVKRKGTIVWFGNASGPVPPLPLQKLSPKCVKVARPQLFGYIETREEFEFYVNELFGLLKSGQLKVKIHKVYPLEQAAQAHTDLEGRKTTGKLLLKP

SEQ ID NO: 11283 - protein, 381 aa, marine gamma proteobacterium HTCC2143
MVTPREKVALAHRQSYSVAPQFVIAAPGRVNLIGEHTDYNDGFVLPLAINYQAAVSASKRDDRTIRAFALDEQSQVEISLDVEPEFDHVASWSNYLRGIIAELQNQGFKLCGANLVISGNVPQGAGLSSSAALEIALIKSLVSLSEETIDGVNAALVGQAAENNFVGCSCGIMDQLISAKGERQHALLIDCRSLTLSPVPLPSDTVVLVVNSNVRRALVDGEYNLRRQQCEAVARHLKVAALRDVNLDQLLGVASEISDIEFKRARHVITENQRTLDTAQALVDGDLKQVGLYMAESHASMRDDFEITVPEIDTLVNIIKLVIGEQGGTRMTGGGFGGCVVALFPRQLVPAVIAKINLEYSKVSGTEATIFECEASAGAFT

SEQ ID NO: 11284 - protein, 294 aa, Zea mays
  misc_feature (233)..(233): Xaa can be any naturally occurring amino acid
  misc_feature (246)..(246): Xaa can be any naturally occurring amino acid
MAGDWQDLGQAAAIGLLFAFLLAKLISTVIAFKEDNLRITRSPPSSPTAAAPAPATSPLPSQHDAAIGSGSDSDWEGVESTELDEEFSAASAFVAASAASGTSVPEEAQLRLYGLYKIATEGPCTGPQPSALKLKARAKWNAWHKLGAMPTEEAMQEYITIVQELFPNWDAGTSAKRKDEESITSASASKGPMGPVFSSLMYEEDEGNDSELADIHVLAREGATEDIVKFLAXGVWEVNMRDTEGXTLLHWAVDRGHLSAVEVLAKANADLNAKVSWNYCILIACYYSWQISSI

SEQ ID NO: 11285 - protein, 487 aa, uncultured marine bacterium 561
MNIELTNPTLFRTEAYVNGEWIGADNGARLPVTNPATGALITDVAKTGAAETRRAIAAAETAMLSWRQKPAKQRAQVMRRWFDLIMANQEDLARIMTLEQGKTLAESRGEVAYGASYIEWFAEQAKRIDGDVIPAPSGDKRIICIKQPVGVCAAITPWNFPNAMITRKAAPALAAGCTIVIKPASETPLSALALAELAHQAGIPPGVLNVLAGSSSDIGAELTSNPTVRKLSFTGSTPIGKMLEAQCVPTLKKTSMELGGNAPFIVFDDADIDSAVQGALISKYRNSGQTCVCSNRLLVQAGIAEEFTAKLVAATESLKLGNGLDENVDLGPLVNAKAVNDVHELVQGSISAGAKLVLGGAPSNLGVCFYQPTILTGVRPEMPVFRNEIFGPVAPIISFETEAEAIELANDTEFGLASYFYTRDIGRVWRVAEALEYGIVGINEGIISNEMAPFGGVKESGSGREGSKYGIDDYLEIKYMLMGGLNQ

SEQ ID NO: 11286 - protein, 454 aa, uncultured marine bacterium 561
MLLGQAMTAMIYPTTNPAATEVMVVSRGEGPYIYDQAGKQYLEGMAGLWCTSLGYGNQEIIETATRQMEQLSFSHMFSGKTHPSAIELADKLAAMAPIDDARVFLGASGSDANDTLVKLIRYYAVASGQPDRVKIIARDKGYHGVSVASAALTGLHANHAHFQLPFDALGVLRTGAPHYYRCAEAGETEADFVARRASELEALILDEGPDTIAAMIAEPVNGAGGVIIPPEGYFEAVQAVLDKYGIMLWDDEVICGFGRLGAAFGAEKLNMKPRMMACAKALTSAYVPLSAAIVAGDIADAIAGPAADMGVFGHGYTYSGHPLGCAVASKVLDIYVRDRLFEHAATLGAYMSKRLDEFSDHPLVGEVSAMGLLGALELVANKDSKQPFEGMRVAQFCAKAAEDNGLIIRPLGGNRMALCPPLIIQEAHVDEIMDKLSRALDSTLDFVTAEGLTV

SEQ ID NO: 11287 - protein, 216 aa, Aspergillus oryzae
MPEHEEDLVASKTEGFKVGEKKTINEYTELAAPRASVTVCFLPPCTHISHKNDESLNRWKASLGLATGATIGDPSDPRKCIIKSLALEVEGRPDVVIDVSAPGAVDTLKDKPFTIKEGAHFRIKVVFQVHHEVLSGLKYLQVVKRKGVRVSKDEEMLGSYAPNTTDKPVYEKKFQEEEAPSGFIARGHYNAVSKFVDDDDHTHLQFEWSFDIAKDW

SEQ ID NO: 11288 - protein, 281 aa, Triticum aestivum
  misc_feature (99)..(99): Xaa can be any naturally occurring amino acid
  misc_feature (209)..(209): Xaa can be any naturally occurring amino acid
MAVDYGSREERWSLAGTTALVTGGSKGIGHAIVEELAGFGARVHTCSRNGAELEECRRRWEEKNLQVNASVCDVSIRADREKLMETVRETFNGKLDILXGCGGAIGLACKGVLMVEVNNAGQLLFKPTTECTVKEYSNLLTTNLESSFHLSQLAHPLLIHASIAGGGSIINMSSIGGSIGYAGSAIYATTKGAMNQLIRSLATEWGSKXIRVNGIAPGFVTTDMLKDIDTEYMKKEHLKTPLGRSGKPVEIATAVSFLCMPAASFITGQVICIDGGRTISS

SEQ ID NO: 11289 - protein, 293 aa, Rhodobacter sphaeroides 2.4.1
MTRDPIATARTLSEALPYLQRYAGAVVVVKFGGNAMGDEAAMAEFARDIVLMRQVGVNPVVVHGGGPMINELLGKLGIKSEFVRGKRVTDKATVEVVEMVLSGLVNKRIVQAINDQGGRAVGISGKDDDLMVCVADDPDLGFVGKPVEMNVQVLRDLYNAGIIPVVAPVATGMADNETFNVNGDTAAGAIAGALQADRLLLLTDVAGVKDASGEVLSQLTPSQVREMVASGTISGGMIPKTETALAALDEGVRAVVILDGRTPNACLIEIFTDEGAGTIIRSTEPRVKPRVRR

SEQ ID NO: 11290 - protein, 179 aa, Glycine max
MSSMKRCGRSGTTRKKLYRSTLRKWIHLFEGVSAVIFCAAISEYDQTLFEDENRNRMTETKELFEWILKQPCFEKTSFMLFLNKFDIFEKKILKVPLNVCEWFKDYQPVSTGKQEIEHAYEFVKKKFEESYFQSTAPDRVDRVFKIYRTTALDQKVVKKTFKLVDETLRRRNLFEAGLL

SEQ ID NO: 11291 - protein, 362 aa, Streptococcus mutans UA159
MGKRLLILEDGTIFEGQAFGADLDVTGEIVFNTGMTGYQESITDQSYNGQILTFTYPLVGNYGINRDDYESIKPTCKGVVVSENARRANNWRKQMTLDEFLKSKNIPGISGIDTRALTKIIRHHGTMKATLANEGDSIEHLQDQLRATVLPTNNIEQVSTKTAYPAPGVGKNIVLVDFGLKHSILREFSKRNCNVTVVPYNTTAQEILNLNPDGIMLSNGPGNPQDVPEALEMIRGVQGKIPIFGICMGHQLFSLANGASTYKMKFGHRGFNHAVREIATGRIDFTSQNHGYAVSRDNLPEELIITHEEINDKSIEGVRHRYYPAFSVQYHPDAAPGPHDASYLFDEFLELIDAFQLEKASK

SEQ ID NO: 11292 - protein, 161 aa, Staphylococcus aureus
MSLKITILAVGKLKEKYWKQAIAEYEKRLGPYTKIDIIEVPDEKAPENMSDKEIEQVKEKEGQRILAKIKPQSTVITLEIQGKMLSSEGLAQELNQRMTQGQSDFVFVIGGSNGLHKDVLQRSNYALSFSKMTFPHQMMRVVLIEQVYRAFKIMRGEAYHK

SEQ ID NO: 11293 - protein, 284 aa, Silicibacter pomeroyi DSS-3
MLHGNDPMTHRIAFQGEPGAYSHEACRNARPDMEALPCRTFEDVIEAVRRGEAELAMLPVENTTYGRVADIHRLLPHSGLHIIDEAFVRVHINLLGVPGATLDDIRDAYSHLVLLPQCAGFLKQHGITGRVSPDNARAAREVAERGDKSHAALASELAGEIYGLNVLARHIEDTDNNTTRFLVMSRETDDSRRGDFGMITSFVFEVRSIPAALYKALGGFATNGVNMTKLESYMLDGSFSATQFYADIVGHPEDANVRLAMDELNHFTTNVEILGVYPAAQPRG

SEQ ID NO: 11294 - protein, 561 aa, Prochlorococcus marinus str. NATL2A
MKSEDCYEIEFDDIADALAAIRNGECVVVVDDEKRENEGDLICAAQFATPQQINFMATEARGLICLAMQGERLDELDLPLMVDRNTDSNQTAFTVSIDAGPEFGVSTGISAEDRAKTIQVALNSQTKPIDLRRPGHIFPLRAKIGGVLKRAGHTEAAVDLSLLAGLSPAGVICEIQNLDGSMARLPELKKYARERNLKLISIADLIHYRLENERFVYRQAVAKLPSLFGDFKAIGYKNELDGSEHVAIIKGNPENLKEPVLVRMHSECLTGDAFGSLRCDCRPQLEAALSRISEEGEGVVVYLRQEGRGIGLVNKLKAYNLQDGGLDTVEANEKLGFPADLRNYGVGAQILTDLGINRLKLLTNNPRKIAGLGGYGLQVESRVPLVICPGDHNAAYLEVKREKLGHLIDNNIQRNLTNERQNIVVYWDGKVNNSELKHFEDKACKWSENHFLNISIQTAPRLIALCENPLFIWNVRHRDIKTHLEGNLIDKRLLESLLKELSNWENTERIGIIKTENYERLLHPSSNISIESKKISELSNFENSPLFDWNLKDKTSTIEWS

SEQ ID NO: 11295 - protein, 439 aa, Pseudomonas syringae pv. syringae B728a
MTYKLPTTATAPFCPSATTDSVAIPPNASLLRKMTLFVGPGLLVSIGYMDPGNWATAIEAGSRFGYSLLFVVVLASLSGMVLQNLCSRLGIATGRDLAQLSAARYSRKVAKGQWLLAELSIIATDLAEVLGAALAFHLLLGVSITTGVALTAFDTLIVLALQGANFRRLEAIVLGLIATIASCFAVELFLIKPFWPDVVAGLKPSWDVLSSQEPLYIAIGILGATVMPHNLYLHSSVVQTRVNGSDQASKASAIRYARLDTIGSLSLALLINAAILILAAAAFHKTGHTEVVEIQDAYHLLDPLVGGAIASVLFGIALLAAGQSSTFTGTIAGQVVLEGFLQAKIPCWQRRLITRALALIPALIGVIWLGDSSVGQMLVLSQVVLSLQLPFALWPLIRFTSDPQLMGPFVNSRLVKTAAWGLFGLISAANLTLLWFWIS

SEQ ID NO: 11296 - protein, 483 aa, Pseudomonas syringae pv. syringae B728a
MSTSSDKGTVFETDLPARLDRLPWGRFHTLLVVALGITWLLDGLEVTLAGSVAGALKASPALNLSNSDIGLAGAAYIAGAVLGALFFGWLADRLGRRKLFFITLLLYVGATAATAFSFSMWSFMLFRFLTGMGIGGEYTAINSTIQEFTPARYRGWVDLTINGTFWLGAALGAIGSIVLLDPLWVGAELGWRLCFGIGAVLGLLVLLMRLWLPESPRWLLIHGQAEQARQIVEQIEAGLQRQGHVLPAVSGKPLRLHARDHTPLGEVARTLLVTFRQRSLVGLTLLTAQAFFYNAIFFTYALVLTDFYDVPAERVGWYVLPLALGNFCGPLLLGRLFDVVGRRVMISLTYGVSGVLLAISGYLFQQGVLDVTQQAIAWMVIFFFASAAASSAYLTVAETFPLEIRALAIAVFYAFGTGLGGMIGPTLFGELIETGERSNVLIGYLIGAGLMLLAAVVQSIWGTAAERKSLEDVARPLSQAGDR

SEQ ID NO: 11297 - protein, 479 aa, Synechococcus sp. WH 7805
MSAASFDFDVIVIGAGYGGFDAAKHAAEHGLKVAIIESRDMGGTCVNRGCVPSKALLAASGRVRELADAEHLAGFGIHAAPVRFERQKIADHANQLVATIRGNLTKTLERSGVTIIRGSGRLESAQAVGVREISGVDRVLTAKDVILATGSDPFVPPGIETDGRSVFTSDEAVSLEWLPRWLAIIGSGYIGLEFADVYTALGCEVTMIEALDRVMPTFDPDISRIAARHLIDGRDIDARAGVLAQSIKPGAPVQIELVDMQTREPVETLEVDAVLVATGRVPSSRTLNLEKLGVETQRGFVPINDRMQVLANGQPIPHLWAVGDVTGKLMLAHTAAAQGTVAIDNILGHNREIDYRSIPAATFTHPEISSVGLSEADAKQLAADQGFELGVVRSYFKANSKALAELDSDGLMKLLFNKVSGEVLGAHIYGLHAADLIQEVANAVARRQSVRQLANEVHTHPTLSEVVEVAYKLALSTIA

SEQ ID NO: 11298 - protein, 175 aa, Brassica napus
MGDYSIQITPKLINQLAQGNEKPKRKAKRTKPKVSPTQNNADQARTHRDAAEKPKPVAELPTQTPPFFFPIPQQGAANTELESIKSVLKESEKVLEKVERREKNIVGEVTERAKDLREKEFKIPEPKPMPCSSDHEAWKKCYEENVGNPLICSGLVMRFQDCARWSRQQVSSAQK

SEQ ID NO: 11299 - protein, 311 aa, Ustilago maydis 521
MPATKIAPSVLASDLGNLNCECQRMMDSGADWLHMDIMDGHFVPNIVMGAPVIASVSKAVPNIFMDCHMMVSDPGKWVKDISEAGGASYTFHLEATDDPMDVVRQIKATKMRAAVAINPGTPASEISDELGNAVDMILVMTVWPGAGGQKFMKECMPKVAELRARFPDLDVEVDGGVGPKTIDRCADAGANIIVAGTAIFNHSSPKDVIKFLRTRCDEAQERIKRERERIARGEPVDHEIKHYEDGRKSGWQSGAITPLSYPRVYMSASKREKLRRESQGALERGERPTLSSLQGMSGLSITPAASAVEGK

SEQ ID NO: 11300 - protein, 248 aa, Oryza sativa Japonica Group
MVKLAFGSLGDSFSATSVKAYVAEFIATLLFVFAGVGSAIAYGQLTNGGALDPAGLVAIAIAHALALFVGVSVAANISGGHLNPAVTFGLAVGGHITILTGLFYWIAQLLGASIACLLLKFVTHGKAIPTHGVAGISELEGVVMEIVITFALVYTVYATAADPKKGSLGTIAPIAIGFIVGANILAAGPFSGGSMNPARSFGPAVAAGNFAGNWVYWVGPLIGGGLAGLVYGDVFIGSYQPVADQDYA

SEQ ID NO: 11301 - protein, 265 aa, Zea mays
FPARPRVRAVIAKIESIDSLKNLEEIIRASDGAMVARGDMGAQVPLEQVPSIQQKIVQLCRQLNKPVIVASQLLESMIEYPTPTRAEVADVSEAVRQRADALMLSGESAMGRYPDKALSVLRSVSLRIEKWWREEKRHEALELRSVSSSFSAKISEEICNSAAKMANGLGVDAVFVFTKTGHMASLLSRCRPDCPVFAFTTSTSVRRRLNLQWGLIPFRLAFSDDMESNLNRTFSLLKARGMIQSGDLVIALSDMLQSIQVMNVP

SEQ ID NO: 11302 - protein, 532 aa, Gibberella zeae PH-1
MADNTTSYTTGPLEHTPLDEINAKVDLVRKTFRSGRTKDIEFRMRQIRKLYWAIVDNTELMQDALLKDLGKCKYEAVLAEIDWCKQECLDMTNNMEKWLRDEPVPNVPLQFRLMKHRTRFEPLGVILNIGAFNFPFQLTLPVVVGAIACGNCVVLKPSESSPNSAMVLKKIFDESLDPECFTYVNGALSETQRLLEQKFDKICFTGGKVVGKIIAKKAAETLTPVLLELGGQNPAFVTKNANLKLAARRLLWQKTLNAGQVCMSHNYILVERSVLSPFLGELNNQLRTFFPKGAKNSTDLAHIVSASHFNRLKKMLDGSKGKIVLGGSMDESTLFMEPTAVLVDDIEDSMMVDEAFGPIFAIMAIDSLDQAIDIANSVDPTPLSLSTFGSKDENKKGGATCNDAFFHSQIPQSPLGGVGQSGMGNYHGIYSIRTFSHQRTIAEVPYWADALFRVRYMPYQWPNMNRLKSIAQPKPNFDRDGNKTKGFSYFVALVFGLGSKKAKGALLRWAFLVVAAAVLEAKKGTLSQLLTR

SEQ ID NO: 11303 - protein, 213 aa, Oryza sativa Indica Group
MESAGPKENGHTTGGAAAEAKAAAAWAEIAVTDAAAVPKPPPPPAAVAVDPRLQGISDAIRVVPHFPKQGIMFNDITPLLLRPGVFKDAVDIFVERYRGMAIAAVAGIEARGFIFGPAIALAIGAKFIPLRKPKKLPGEVISETYVLEYGTDCLQMHVGAIEPGERVLIVDDLVATGGTLCAAIRLLEVFSPFAHSQHAILLACNSEALDCAL

SEQ ID NO: 11304 - protein, 173 aa, Helicobacter pylori
MNLEKLEVSHDADSLCVVIEISKHSNIKYELDKESGALMVDRVLYGAQNYPANYGFVPNTLGSDGDPVDALVLSDVAFQAGSVVKARLVGVLNMEDESGMDEKLLALPIDKIDPTHSYVKDIDDLSKHTLDKIKHFFETYKDLEPNKWVKVKGFENKESAIKVLEKAIKAYQG

SEQ ID NO: 11305 - protein, 363 aa, Xylella fastidiosa Temecula1
MGIKCGIVGLPNVGKSTLFNALTKAGIAAANFPFCTIEPNVGVVSVPDPRLNQLAEIVKPQKLLPTVIEFVDIAGLVAGAASGEGLGNKFLAHIREVDAIAHVVRCFEHGEIIHVAGKVDPLADIEIIDTELILADLDTVEKACNRIMRAAKGGGGEAIARKSVLERLQVALNEGKSARSAGLDEDERALVRDLFLLTLKPVMYIANVLENGFQDNVYLEALRVRASSDNAQLVPISAVIEEELAQLEDVDRDAFLVDLGLEEPGLNRVVRAAYALLGLQTYFTAGVKEVRAWTVKSGATAPQAAAVIHTDFEKGFIRAETIAFDDFIKYKGEAGARDAGRMRLEGKEYRVQEGDVLHFRFNV

SEQ ID NO: 11306 - protein, 306 aa, Methanococcus maripaludis S2
MIKKYTYYFIFGEILKILVTGGAGFIGSHIVDMLIENGHDVSILDNLSTGNEKNLNSSAKFINGDILDKNLDLTGFECVIHEAAQINVRTSVENPSLDANINILGTVNILEKMKEYGVKKIIFSSSGGAVYGEPEYLPVDEKHSLKPLSPYGLSKFCAEEYIKLYNMLYDIEYCILRYSNVYGERQDPLGEAGVISIFIDKMKKGEVPVIYGDGNQTRDFVNVKDVARANLMALNWKNEIVNIGSGKETSVNELFKIISSEIGFDKDPIYKKEREGEVYKIYIDYSKAKSLGWMPEVELDDGIKKI

SEQ ID NO: 11307 - protein, 264 aa, marine gamma proteobacterium HTCC2143
MMSTQKDLAFDDKIVLITGAAGGIGLATTLAFVRSGATVFAMDLLGSSLAESVAAMTDLSGSIITIEGDVTQADDWQRAVDTITGEFGGLDILVNNAGIIEAGSRLEKFDENVFDRVMAVNTKGTFLGMKAVIPAMRKRHGGAIVNVSSISGHCGSAVATAYTASKHAVLGMTKSAALDLAEYDIRVNAVCPAPIDTPMVRNLGTRQQAKDPSFDIAAVMSSGTPLKRLGDPGEVASAILFLASEQASFITGAGLPVDGGVLAK

SEQ ID NO: 11308 - protein, 282 aa, Methanococcus maripaludis S2
MIKKAIIPAAGFGTRLLPITKAQPKEMLPVLGKPIIQYVIEDLANAGIEDILVITGRGKYAIENHFDKNFELEERLKKDGKCEPLKKILDINEFANIYYTRQGKQNGLGDAVHCGKEFICEDYTIVMVGDTIYSGNVPKKLLEAHKKYRCSVIALERVPKEDVYKYGVISGKELENGIFEINDLVEKPTVEDAPSNLIITGAYLLSSKIFDHLENTQPGRGGEIQLTDAMKSLLKEEKIIGVEVDFKRYDIGDIKGWLEANVELGIENIDGFKEYIRELCDK

SEQ ID NO: 11309 - protein, 322 aa, Xylella fastidiosa Temecula1
MPTIQDERNLMVFSGNANKPLTQSICKELGVRMGKSLVSRFSDGEEQVEIEESVRRQEVFVVQPTCAPSAENLMELLVIIDALKRASVSSVTAVIPYFGYSRQDRRMRSLRVPITAKVAAKMISAIGADRVLTIDLHADQIQGFFDVPVDNVYASPLLLADIWRAYGTDNIIVVSPDVGGVVRARAMAKRLGDTDLAIIDKRRPRANVATVMNIIGEVNGKTCVLVDDLVDTAGTLCAAAVALKQNGATKVVAYITHPVLSGPAMDNINNSELDELVVTDTIPLSDAARECRKIRQLSVAELLAETIRRIAFGESVSSLYVD

SEQ ID NO: 11310 - protein, 221 aa, Rhodobacter sphaeroides 2.4.1
MNWSIPNILTVLRLLAAPGVAVMFLYFHRPWADWFALTLFILAAVTDFFDGYLARLWKQESKFGAMLDPIADKAMVVIALVIITGYSGMNPWLILPVTLILFREVFVSGLREFLGAKASLLKVTKLAKWKTTAQMVAIAILFLGTGLEHLEGIARQGMTWEQYARAVSAGEADPIRSCGMHGCSSYATWLGLALIWIAAALTFITGWDYFRKALPYLKDEK

SEQ ID NO: 11311 - protein, 110 aa, Aspergillus oryzae
MSEGNVVKIESKKDFQEKVIESKDLVVLDCFAEWCGPCKAIAPQLARLSEEYTGAKFYKIDVDDLSEVAGELGVRAMPTFLFFKDGKKVNEVVGANPPALVAGVQSLVKQ

SEQ ID NO: 11312 - protein, 758 aa, Methanococcus maripaludis S2
MKLITWLDDLRNDDVDIAGGKGASLGEMWNAKLPVPPAFVVTSEAYRYFIKETKLQDEIERILSNIDVNNNEELNKASKEVRYAIENVKMPDDLKLSIIESYHKMCELNGDDETFVAVRSSATAEDLPDASFAGQQETFLNMKGNEQVLQAVQECFSSLFTPRAIFYREEKGFDHFEVALAAVVQKMVNADQAGVMFTVNPINQDYNQMVIEGAWGLGEGVVSGTVSPDTYIVAKDTQEVLSVNVARKDTMFIKDADGVTKEIKTPEDLIEKQVLSEEMIKKLENVGQTIENHYKRPMDIEWSIENGEIYMLQARPITTLTDKKDSKSSNEIEGKIILKGIGASPGVESGKVKIISEIEEIGRILDGDILVTKMTTPDMVPAMKKAAAIITDDGGLTCHAAIISRELGTPCVVGTKGATKNLKDEECVTVDGEKGIVYEGKVGKPEEKAPAQVVYAGAPVITATEIKANVSMPEVAERAAATGADGVGLLRAEHMILGTGVHPGKILKEQGEGALTEVFAEGIRKVADAFYPRPVTYRTLDAPTDEFVGLKGGEDEPHEHNPMMGWRGIRRGLDQSEILKCELKAIKKLREEGYRNINVMIPLVTNVDEIRKVKEIANEVGLKLRLDVEFGVMVETPAAALIIDDIIEEGIDFISLGTNDLTQYTIAIDRNNENVSKYYLENHPAVLKLIELVITSCKRAGVKTSICGQAGSRPQIVEKLVEWGITSISANIDAVETIRNVVARTEQKIILESIRKQK

SEQ ID NO: 11313 - protein, 361 aa, marine gamma proteobacterium HTCC2143
MKAVVVDALNEFSVQEVQLDSPKAGEVRVKMVATGVCRSDWSVISGTIPMPLPAVIGHEGAGIITELGEGVDKFALGDHVVLSFIPECGDCFYCKNDQAYLCASKNNAAGGMLDGTTRVHRGDEDVMVMTQLGCMAEECIAPAISCVKINDDVPLSSAALIGCGVMTGVGAALNAAKVKPGSTAVVFGCGGIGLSTIQGACIAGAKNVVAVDTLPGKLDMAKTFGATHGCLLEDANEFILELTEGRGADYCFEAVGNTALMQLAEASTRPGGVCTVIGVGKMDEQFVLSPFMLPLTGKRIQGTMYGNCNPSKDFPKLLDYYKKGELDLDGMITKTYSIDQASEAFADLTSGANARGVIIYD

SEQ ID NO: 11314 - protein, 456 aa, Zea mays
MGSILSATSTTAKSMDQHEASGTDPNKRVKISTYEYGSNPRIIPTLPDELSLQIPARSPRIHYLNLKLVCRAWKAAIIGYELSQLRRELGVSEEWVYVLTKAEAYKLHWYALDPVFQKWQRLPPMPSFVNQEESNRTASSAFWMWNVVGSSIRIADYVRGLFWRRNSLDQMPFCGCSVGVADGYLYVIGGFSKAVALNRVCRYDPFLNLWQEVSPMMTGRAFCKAAFLNGKLYVVGGVSRGRNGLLPLRSAEAFDPKTGLWSDLPEMPFARAQVLPTAFLVDVLKPIATGMAPYKGKLYVPQSLYSWPFFFDIGGEIYDPDLNAWSTMPDGLGDGWPARQAGTKLGVVIDDRLYTLEPSSSLDSGKIKRYDSEGDAWVTITPQVPVNDFTGAEAPYLLAGLGGRLHVITKAANNTLQVMQAVVQNNSVSEENVVWTTVASRNFGTAELVSCQVLDV

SEQ ID NO: 11315 - protein, 270 aa, uncultured marine bacterium 561
MSLPLYIVNAFTRTTFGGNPAAVMPLEHWLSDETLLAIAAQHNLSETAFFVHTSAGHYELRWFTPGAEVQLCGHATLASAHVLKAHLGFQGDEVIFSTRFSGKLCARYIGEGIELDFPSLKPQPHSPEPALLAALKTPVIAAAIPEIHPWKALYEVESETALREIVPDFPAIAAAVDHAVIVTARGERHDFVSRFFAPNLRVNEDPVTGSAHCVLTPYWAEKLGSDSLSAAQVSERGGELSCVLAGDRVKLTGQSVTYAVADVVGATGLD

SEQ ID NO: 11316 - protein, 295 aa, Guillardia theta
MFTIERGIKYIKKKLIDYGTYGKVFEMMKMKIKKCACKEIEIYYSNNSLKKEYISEVRFLSYIFHPNLIFLQNFLYSKNEDKISLIMDFCELNLRNLIENKIKISTNQILFIGLQLLNSIVYLHLNKIIHRDLKSSNILINRLGIVKICDFGMGTFLCSKKICLSDKIVTLWYRAPEILLGQHFYDYSVDMWSFGCVIGELITGEILFQGKSELDQLNKIFQTIGTPTTEIWLNLHTLKFTKNIVFPIQPYNKLNLKLESKTNKNLIFLLQKILVYDPKKRLKSTEALKFFYSFF

SEQ ID NO: 11317 - protein, 107 aa, Arabidopsis thaliana
  misc_feature (55)..(55): Xaa can be any naturally occurring amino acid
EILSGSPAELIFQSFFRGLLDYLLSRPVFSMIWEGKNVVFTRRKITGTTHPPPSXPGTIPGTLLFTLGRNVIPGIDSFESARKEIAFWFPDGPVHWHSTLHPWVYET

SEQ ID NO: 11318 - protein, 158 aa, Brassica napus
MKLKVFSVSKIHKNVFLIKLFSAILITGLAFSLFIFHSSDFSPVFASVTGRFEARFLPPKVIVPENEDLIPQDIEIEKCNLFAGKWIPDSSGPSYTNSSCGNLIDGHQNCITNGRPDLDFLYWKWKPHDCLLPRFDPRKFLQLMRNKSWAFIGDSIVR

SEQ ID NO: 11319 - protein, 532 aa, Prochlorococcus marinus str. NATL2A
MAITDIFQMNNNDKWARYCDLLYSDDSLGFWLDISRMDVAINDFEDFNEIYSKAFDALESLENGSIANIDEGRQVGHYWLRNPKVAPSPEISDSITKEIQDISKFGSSILNGEITNSDGEKYTDVFWIGIGGSGLGPLLIKESFKRESIGLDLHFLDNVDPEGISHKLNSILPNLNSTLFVVVSKSGGTPEPLIGMEQAMKFVRDNNQNWSSRAIAITSKGSKLDLLAHNENWLDIFDLPDWVGGRTSITGAVGLLPAALIGADINKFLNGASQMDALTRVKDIKNNPAALLSLAWFKSGNGKGLRDMVVLPYRDRLEVFSRYLQQLVMESLGKKFDRDENQVNQGIAVYGNKGSTDQHAYVQQLRDGIDNFFVNFIEILHDPLEIVEVKNKRPGDYLSGFLQGTRSALTEGGRQNLTITFKSFDESSLGALIALFERAVSLYAELINVNAYNQPGVEAGKKAATKIIKLQKEIEELLDDGKQRTLNEINDALSSDSTESIYLILRKLSENSDHYSMIGNQSNPDKLIISKT

SEQ ID NO: 11320 - protein, 437 aa, uncultured marine bacterium 561
MDRKTLEAHWMPYTGNRQFKKDPRIITSAEGVWYTDDKGRKVLDGHSGLWTSGLGHGRKEISAAVSQQINTLDFAPSFQFGHPPAFELADRIKGLMPEDLDYVFFTNSGSESADTSLKMARAYWRLMGQPTKTRFVGRMKGYHGVNFGGISVGGIAANRKFFGQGVEADHLRHTMLPQNRFCRGMPQDGAELADELNEMIALHDASTIAAVIVEPMAGSAGVIPPPVGYLQKLRDICDANDILLIFDEVITGFGRCGAMTGADAFGVVPDILNVAKQITNGAIPMGAVIARAGIYDTFMAHGGPDYALEFAHGYTYSAHPVACAAGLAALDVLTGEALPQRVADEAPFFEALLHDALSDKPHVSDVRNYGFAGAITLEPYPGEPLRRPFEVAMKMWEKGFLVRYGGDTIQLAPMFVMERPEMESLVGALADSLQELA

SEQ ID NO: 11321 - protein, 590 aa, Yarrowia lipolytica CLIB122
MGQIKKKHTAGAARNFITRTQAIRKLQVSLADFRRLCIFKGIYPREPRSKKKANKGSTAPVTFYYAKDIQYLLHEPVLDKFREHKTFAKKLTRALGRGDLHDAKRIDENRPRYHLDHIIKERYPTFMDALRDIDDALSMLFLFAALPASDDVSARLVSEAEAICTQWMAFVARERLVRKVFVSIKGVYYSANIRGVEVMWLVPFRFPQNIPADIDFRVMLTFLEFYTTLLHFVLYKLYNENGLVFPPIINSTKLSGVGGINAYVLESRQNAGVVPQIEGNSEAKVENVSAAVLSKAAKADAGEEEEVEEEEEVEDDGLDSFSAEKGDALAQPTFNSTAGQLFSNFTIFIGREVPLDIIEFLIIAFGGKVISESAMDELIDNEDETRGNVIDEKTLKQKFNLASVTHQITDRPTLREKVPGRTYVQPQWVFDSINEGKLLPVSEYAPGERLPAHLSPWGDAGTYDPTADVSDASDDDEDDEDIEVAPEDYDKDDEEEEAEAEAKQHQRELEAEAKGTKADPAAAPKKAKRKADKMTKAEKQEEEDKKLRMIMMSNKQKKLYKKMQYSNDKKSDREAELKKRRKLNEKKEKR

SEQ ID NO: 11322 - protein, 231 aa, Streptococcus pyogenes MGAS8232
MVKLVFARHGESEWNKANLFTGWADVDLSEKGTQQAIDAGKLIKEAGIEFDLAFTSVLTRAIKTTNLALENAGQLWVPTEKSWRLNERHYGALTGKNKAEAAEQFGDEQVHIWRRSYDVLPPAMAKDDEYSAHKDRRYADLDPALIPDAENLKVTLERAMPYWEEKIAPALLDGKNVFVGAHGNSIRALVKHIKGLSDDEIMDVEIPNFPPLVFELDEKLNIVKEYYLGGE

SEQ ID NO: 11323 - protein, 278 aa, Chlorobium tepidum TLS
MRKSLGVVITGGSAGLGLAMAREFLRAGDRVVICSRRESNLKSALQMLGSDVPDRNVYGMVCDVSLPAQAADFAAFAAAKLGIIDRWINNAGTAGRKRRPLWELDLSDIDETCRTNLSGSMMLCAEALRVMLRQPASADEPLYHLFNMGFSSAGLRSSPTSVPHRASKRAVAIMSKLLRQELEAAGIRSVGIHELSPGLVLTDLLLRDATPAQKRFFNAMAETSETVAATLVPAIRAITGRGSTLRYQPVLFMFAKLAASAFGYRKERFFDSEGKPWG

SEQ ID NO: 11324 - protein, 583 aa, Silicibacter pomeroyi DSS-3
MSDAPSTPYQVLARKYRPETFADLVGQDAMVRTLKNAFAADRIAQAFIMTGIRGTGKTTTARIIAKGMNCIGPDGNGGPTTEPCGKCEHCVAIMEGRHVDVMEMDAASRTGVNDIREIIDSVRYRAASARYKIYIIDEVHMLSTSAFNALLKTLEEPPAHVKFIFATTEIRKVPVTVLSRCQRFDLRRIEPEDMIALMRRIADAEGAQIAEDALALIVRAAEGSARDATSLLDQAISHGAGETSAEQVRAMLGLADRGRVLDLMDMILRGDAGAALTELGAQYAEGADPMAVLRDLAEITHWVSVVKITPDAAEDPTVSPDERARGQQMADALAMRVLTRMWQMLLKALEEVAAAPNAMMAAEMAVIRLTHVADLPSPEELIKRLQDAPPPPNPGGGPRVGQGASAPAQNGVSASYAPAPRGGGGGPVAALAQDPQTALARFPTFEHLVELIRANRDGKLLADIEMDLRLVSYQPGRIEFQPTERAPTDLAQRLGSALQRWTGNRWAVSVVAQGGGKTIDEIRNAEKYALEEKAREHPLVQAVLAQFPKARITHIETPEQRAAKVVTEALPEVEDEWDPFEDG

SEQ ID NO: 11325 - protein, 406 aa, Synechococcus sp. WH 7805
MVEPKADSMSSAVMGTYNRFPLTLVRGRGCWVWDDQNRRHLDAVAGIATCTLGHSDRILRRALSRQLKTLQHVSNLYKIPEQEQLAQWLVVNSCADSVFFCNSGAEANEAAIKLARKHGHRRRGIERPVIITAAASFHGRTLAAVSATGQPRYHQGFEPMVEGFEFFPYNDGDAFEQLLIQLEQNGPRVAAVLIEPLQGEGGVNPGDPAVMQRIRKLCSERDILLIFDEVQVGMGRTGTLWGYQQLGVTPDAITLAKGLGGGHVIGALLVSQHADVFEPGDHASTFGGNPFACRAGLTVANELLRRDLLKNVQTRGKQLHKGLTHLVERYPDHLAGSRGWGLLQGLVLQDNCGFSAADVVKAALEEQLLLVPAGAAVVRMVPPLVIGPREIQTLLTRLDRALQHLM

SEQ ID NO: 11326 - protein, 207 aa, Bordetella pertussis Tohama I
MSLLHRASFYISAARLDQLPPAGAPEVCFVGRSNAGKSSAINVLCNQRRLAFSSKTPGRTRLINMFGLPDPLAPGEQLGFLVDLPGYGYASVAHREKEKWADILGGYLRDRASLAGIVLLIDIRRGVTDLDRRLTNFIAPTGRPVLALLTKADKLPYGQRMRTVFAVRKDLADIGALHMVPFSSTERIGLEEAGAHIENWISPKVVP

SEQ ID NO: 11327 - protein, 349 aa, Chlamydomonas reinhardtii
LLLLITPVGLAAGYLKWSAGYVFTLNFLSLVPLALVLGDVTEDLALRYGSVIGGLINATFGNIVEIILSIAALLNGLYGVVAASLLGSILSNLLLVMGCSFFFGGLWNKTQRFNATGNQASGSLLFLAALGFLIPTGAGLLFGGGALVLGISRGTAVVLLLCYACYLGFQLYTHTDLFEVCVCEIGSDGLPADAEEPMLSLVASVGLLTVITLVVAVASEFLTSSLEEFSKTSGLGEAFLGTIVLPIAGNACEHMTAVIVATKNKMDLSMGVAVGSSIQVALFAVPFAVVVGWATGHPFTLFFDPFSALALMLSVAQANFVTAGATSHWLLGVQLIALYVLISIAYFFK

SEQ ID NO: 11328 - protein, 490 aa, Anthoxanthum odoratum
RPGVPTIDEKSTGRIDQIIGPVLDVTFPPGKLPYIYNALVVQSRDTADKQINVTCEVQQLLGNNRVRAVAMSATDGLMRGMEVIDTGAPLSVPVGGATLGRIFNVLGEPVDNLGPVDSSATFPIHRSAPAFIELDTKLSIFETGIKVVDLLAPYRRGGKIGLFGGAGVGKTVLIMELINNIAKAHGGVSVFGGVGERTREGNDLYMEMKESGVINEKNIEESKVALVYGQMNEPPGARMRVGLTALTMAEYFRDVNKQDVLLFIDNIFRFVQAGSEVSALLGRMPSAVGYQPTLSTEMGSLQERIASTKKGSITSIQAVYVPADDLTDPAPATTFAHLDATTVLSRGLASKGIYPAVDPLDSTSTMLQPRIVGNEHYETAQRVKETLQRYKELQDIIAILGLDELSEEDRLTVARARKIERFLSQPFFVAEVFTGSPGKYVGLAETIRGFQLILSGELDGLPEQAFYLVGNIDEASTKAITLEEENKSKK

SEQ ID NO: 11329 - protein, 215 aa, Vibrio campbellii AND4
MNAITKMHQAIDRVSVDMAEVRARVDFKVGAQSNIDAEILSFQGLKTDKEHVAIIFKRADQTQEMPLVRMHSECLTGDVFHSSRCDCGEQLEETINRMGESGGVILYLRQEGRGIGLYNKIDAYRLQSQGMNTYEANNHLGFDDDLRDFTEAAQMLEALGIKKIRLVTNNPKKIRELSEYGIEISEVVNTSAHIKDGNESYLKAKASHGKHNLKV

SEQ ID NO: 11330 - protein, 124 aa, Oryza sativa Indica Group
MASVWCLSASASAAAPVAAAAAAPGALGASVASVSLARAAVPSRRRRRWDALVEWEKPKPGRRPDIFPKFSPMKTPLPHPLPADDPLDDDEEEEEEEPQPQEEPQEDDPDKEEPEEDDPDKPTE

SEQ ID NO: 11331 - protein, 87 aa, Neisseria meningitidis
VAEIHRILMRGGVFMYPQDKRDPAKPGKLRLMYEANPMSLILEQAGASASNAYQAMLDIQPENLHQRVAVFMGSSEEVAYLDRLHAK

SEQ ID NO: 11332 - protein, 215 aa, Synechococcus sp. WH 5701
MGWTVDDIPSQEGRIAVVTGANIGLGLETTRALAAKGATVVMACRSRSRGEAARRQLLDEGLTGLDLLEIDLADLRSIERAIAVLSDQYGHLDLLLNNAGVMAPPRQLSPQGHELQFAVNHLGHMALTQGLLPLMASQTDPRVVTVTSGAQYFGTIRWDDLSWAQGYDRYGAYGQSKLANVMFALELHNRLQSENSSVKSLAAHPGIARTNLQPA

SEQ ID NO: 11333 - protein, 432 aa, Xylella fastidiosa Temecula1
MTLWVLGLNHQTAPMELRERASFVGDALPRALDSLRNLPNVNEAALLSTCNRTELYAETTNAQMLLNWLEQHRPGLQNHLYQYRDAAAVRHLFRVATGLDSMVLGESQILGQVKDSWSMARTHGTLGNTLDRLFQHSFSVAKHARTNTRIGTNPVSIASTAVRLAQDAFSPLNESTVLLIGAGETIQLAAKHLSEGRVQRLLIANRTHAKAQMLASQHGGYALPLTELNLHLAEADIIFSATAAPTPIVTQSNVESALHIRKRKPILLFDLAIPRDIETEVGTLTDAYLYTIDDLERAVEENRHSRREAAETAEAIIELQVKRYMDTLQAQAHQAPLRRLRTFGTTTRDELLTRARRQLANGRPAEEVLEQLAHGLTNRLLHPPTAALREAALANNTELVRAAEQLFPEKPGYHHPTLQTTIVKTDETDPAS

SEQ ID NO: 11334 - protein, 489 aa, Geranium cinereum
  misc_feature (5)..(6): Xaa can be any naturally occurring amino acid
  misc_feature (25)..(25): Xaa can be any naturally occurring amino acid
  misc_feature (112)..(118): Xaa can be any naturally occurring amino acid
  misc_feature (120)..(120): Xaa can be any naturally occurring amino acid
PGDSXXQKKKPGRIAQIIGPVLDIXFPKGKMPYIYNALVVQGRDTVGQQINVTCEVQQLLGNNRVRAVAMSATDGLMRGLEVIDTGAPLSVPVGGATLGRIFNVLGEPIDNXXXXXXXTXSPIHRSAPDFIQLDTKLSIFETGIKVVDLLAPYRRGGKIGLFGGAGVGKTVLIMELINNIAKAHGGVSVFGGVGERTREGNDLYKEMKESGVINDQKIAESKVALVYGQMNEPPGARMRVGLTALTMAEYFRDVNKQDVLLFIDNIFRFVQAGSEVSALLGRMPSAVGYQPTLGTEMGSLQERITSTKKGSITSIQAVYVPADDLTDPAPATTFAHLDATTVLSRGLASKGIYPAVDPLDSTSTMLQPRIVGAEHYETAQRVKQTLQRYKELQDIISILGLDELSEEDRLTVARARKIERFLSQPFFVAEVFTGSTGKYVGLAETIRGFHLILSGEFDGLPEQAFYLVGNIDEATAKATKLETESNLKK

SEQ ID NO: 11335 - protein, 111 aa, Glycine max
  misc_feature (51)..(51): Xaa can be any naturally occurring amino acid
NSRYRSSNSSSLASDSYFCTNFYVFSSHRFKSKGRIYPVILPVQNNKVNGXVLLGISGVELDILDEFKDVEYTRTDVEVSLKDKSERLQVCAYVWSNPNDPNLYAEWDFED

SEQ ID NO: 11336 - protein, 378 aa, Candida versatilis
MPTPQERLAQLRGNEDAPASVASKYNKRFRVGVIGSGNWGTAVAKIVAENCLEKPYLFHRDVKMWVREEEVSDMKLTDIINSYHENVKYLPEVTLPFNLFAEPDIRKVADGADLLVINLPHQFLGSVCDQMKGIDFSKSSAISCLKGINVSADGVELLHDVVEKKLGLHCGVLSGANIASEVARERWSETTIAFPLPSWYQQGDADDNLIKELFYRPYFHVQVSDDVCGASISGALKNVVALGAGLVEGAGWGDNAKAAVMRRGLLEVIMFGNVFFPGKCRPETFTTESAGVADLITSCAGGRNVKVGRAFARTGKPLEVIEKELLNGQSAQGIITGREVMELLTATKKEDEFPLLGAIYDIVHNKLHISNLPERIAD

SEQ ID NO: 11337 - protein, 464 aa, Vitis vinifera
  misc_feature (296)..(296): Xaa can be any naturally occurring amino acid
MADRQSKENTSKRKNGENQSLLLGRYEIGKLLGHGTFAKVYHARNVRSNESVAIKVIDKEKILKGGLIAHIKREISILRRVRHPNIVQLFEVMATKAKIYFVMEYVRGGELFNKVAKGRLKEEVARKYFQQLISAVGFCHARGVYHRDLKPENLLLDEAGDLKVSDFGLSAVSDQMRQDGLFHTFCGTPAYVAPEVLARKGYDASKVDIWSCGVILFVLMAGYLPFHDQNIMAMYKKIYKGEFRCPRWFSPELARLLTRLLDTNPETRITIPEIMENRWFKKGFKHIKFYIEDDTXRLCNAEEAEDDVESLSDQSMSESESELETRRRLSTLPRPASLNAFDIISFSPGFDLSGLFEEGGGDARFVSGAPVSKIISKLEEIAKVVSFTVRKKDCRVSLEGSREGVKGPLTIAAEIFELTPSLVVVEVKKKGGDKGEYEEFCNRELKPVLQNLKNKRHAEVNLKY

SEQ ID NO: 11338 - protein, 479 aa, marine gamma proteobacterium HTCC2143
MSAIENTIEDSLQKTLQAQKEAYLDEGYVSYETRIDRLDRALSQVLKYQDEICEALISDFGHRSRDLSKLTDVAASVGPLKHAKKHLKKWMKNEKRNTMFPLGLLGARSRIEYQPLGVIGILSPWNFPVNLTFGPLASAFAAGNRAMIKPSEFTPATSSVIKKMLDEVFDETEVAVVTGGPEVGAAFSALPFDHMIFTGATSVGRHVMAAAAKNLVPVTLELGGKSPVLIGRSANLDQTADRVMMGKTMNAGQVCLAPDYLLVAEEQCDNLVELLKVKATAMFPTIKDNEDYTSVVNERHYQRLNSYLDDAREKGATIIPINPANEDFSDQKHHKIPPTLVLGATDDMLIMQEEIFGPLLPVRTYKEYREAINYVNSNPRPLGLYYFGHDAAEEAFTLTRTTSGGVTLNDVIMHITQEDLPFGGVGPSGMGSYHGFDGFKTFSHAKAIYKQSNKNIADMVGLKPPFGKKTKNAIKMQLK

SEQ ID NO: 11339 - protein, 395 aa, Methanococcus maripaludis S2
MSTLEKEQIISDEKKYVIGTYGRVPVVLVKGNGMSVFDTDGKEYLDFLAGIGVNNVGHCHPKVVEAIKNQAETLIHVSNIYYNVPQIELAKKLVNLSGLDKAFFCNSGAEANEAAIKLARKYAKANGKEGEIITMEHAFHGRTLTTITATPKAKYQEGFEPLPTGFKYIPFNDIDALKAGISEKTSAIMIEPVQGEGGIHPADNEYLKAVRKLCDENNIVLIFDEVQCGMGRTGTLFAYEQYGVVPDIVTLAKGLGGGFPIGAMVAKSEIASAFTPGSHGTTFGGNPLACASSAAALDVISELLDNAVEMGEYFKNSLKTLEEKYEFVKEVRSLGLMVGIELTFNGSDIVSKMFEKGFLINCTSDTVLRFLPPLIVEKEHIDAMISALDEVFSEI

SEQ ID NO: 11340 - protein, 784 aa, Chlorobium tepidum TLS
MKTEARILKECLAAAAPNCLHSILPPVVRDDQTRSMNKPMESYYHQFLEEFRLPLTNPVLVFSLVLFIILLAPIVSKRFNIPGTVGLILSGVLIGPHSLNLLEKSSAVELFSTIGLLYILLIAGLELDVNDFRKNRYKSALFGLLTFSIPIVLGYPVCRYLLNYPMSTSLLTASMFATHTLVAYPVVSRMGISKNRTVAITVAGTILSDTAVLILLAVIIGYSRGDINHEFWLHLVIALTLFSAIVFIVLPAIARWFFTKLENEKHAHYIFVLAALFFSAFLAKAAGLEPIVGAFAAGLALNPLIPGSSALMNRIEFIGNSLFIPFFLISVGMLVDLRIILSSPIALIIAALLTFVALAGKWLAALSTQKIFGYSAAHRRLIFGLSSSRAAATIAIALVGYRARILDLNILNAIIILILVTCIVSSLVTEKAAKEIVLEENDAAPEKEHAQGDADEQILLPIAENKPSERVLELAVMIREKRSLNPLTILTVVPNDHEAELNVKKAKKELAPTVDFAASFDTSLNIVATIDYNICSGISRAVKESQSNLIIFDWPSRQGFLGRMINDATESIVECTCKTTMICHLTRPLAIHRRIVVICPPFAEKEKGFGQWLRKMSRLSQELTIPLLFHCDRKSRLAIIETLKTSHSTSPVLYEVFKNFREWEDIASRKLHFREDDIVTFVCARRESISYKPFFDLVPEQLEKHVKDISKIMIYPEQFDSAIIEEEYADVVAPKSFPFGASTIRKIREEISGFMKKNQLQIRKKARGKTAATPKRFGFSRKEP

SEQ ID NO: 11341 - protein, 358 aa, Glycine max
MELDLTPKTAEALFEGDGGGYYTWSSSQVPLLAKNNVGAGRLVLQPRGFALPHYADSSKIGYVIQGTDGVVGMVLPNTKEEVVLKLKKGDVIPVPIGAVSWWFNDGDSDLIIAFLGETSKALVPGQFTYFFLTGALGLVGGFSNELTSKVYGLDNDEVEKLTKSQTGVLIIKLDKSQPMPKPQMNMTKKLVYNIDAARPENVVENAGLVKTLTEKDFPFIGDVGLSVMRVKLEPGAIKAPSYPTNPTVQLIYIARGSGKIEIVDFSGKSVLNTQVEAGHLLVVPQFFVLAEIAGEEGIESYSIVITTKPLFEELAGRGSIWNAFSPTLQQVSLNVDSDFQKFFISKIKESTNLIPPTV

SEQ ID NO: 11342 - protein, 362 aa, Methanococcus maripaludis S2
MKLHEYEAKEIFKENNIPIPKNKLVSGKVESIDYPVVIKAQVLVGGRGKAGGILFADNVDDANEKIESLIGNTVKGELVEKVLLEEQIKIVKEYYVGVVVNRNEKNNVVIFSTEGGVDIEEVASKTPEKIIKLSLNPEKEFLPYLARGMLKKAGIPSAEIPKVADVLCKVYKAFKNMDGILAEINPLVFTEDGKIIAADAVLNVDDDAYFRHNYEKFEEFNKQEKSEFAYVELDGDIAVIGNGAGLTLASMDIVKEFGGNPACFLDVGGGSNRETVKKALLKATSRKNVKGAFINILGGITRCDEVSMGIVDVLKENPNLKFAVRMMGTNEEEGRRILSENGISFESSMEGAAKALTELINS

SEQ ID NO: 11343 - protein, 477 aa, Novosphingobium aromaticivorans DSM 12444
MEFNNNYHMLIGGELVAAEARLDVVNPANEQVIACVPDAGAAELDAAVAAARKAFPGWAATPIAERKAMLDALADSIFANVDGFKRLLTAEQGKPHHEAQGEIMGAGYWLKAYTALDLPETVNEDSDERLSITRHVPLGVVGAIAPWNFPMILAMFKVAPGLLAGNTMVLKPSPFTPLCTLKFAELAKEILPAGVLNVITGGDHLGPLMTAHPGFDKISFTGSTQTGRRVMASAAPTLKRVTLELGGNDAAIVMPDVDVEKIAEQLFWAAFTNNGQICIATKRMYIHKDIYEPLRDALVAYARTVKVGDGSEQGTQIGPINNEAQYNRVLDLIQDAKDNGYKFLLGGEKAEVPGYFVPITILDNPPEDSRIVQEEQFGPVLPLIRFDDFEDVLNRVNASDYGLGGSVWGSDEDKAFELAQRVQSGTVWVNETQHLSPLAAFGGMKQSGVGVEGGLEGLLEYTSAQTLVRRKKAAFVN

SEQ ID NO: 11344 - protein, 371 aa, Novosphingobium aromaticivorans DSM 12444
MTTCCAAVARGANQPFTIEQLTVDGPRAGEVLVQIAGVGLCHTDLVFRDQFDAFAKPGVLGHEGAGVIEAVGEGVTGLAAGDRVVLGFSSCGECARCAEDLPSYCVQFVPLNYAGMRLDDGSTAHAAHDGERVSSHFFGQSSFATLAVTRARNVVKVPDSTTVPLELLGPLGCGLMTGAGAVMNSMACKAGSSLIVFGGGPVGLAAVMAGKVRECSQIILVEPVASRRAIAQELGATHVIDPADGDLGEAIRAILPLGVDAALDTTGNVAVIETGLGNLAPHGIIGLVGVPRDMTASVTFNIAALMTPGLRIIGIIEGDAVPQDFIPELLALNAQGRFPFERMVQTFPLSRINEAIDAQARGDCIKVVLIP

SEQ ID NO: 11345 - protein, 336 aa, Photobacterium sp. SKA34
MAFNLRNRNFLKLLDFSPREIQHLLELSADLKKAKYNGYEQPRLNGKNIALIFEKSSTRTRCAFEVAAFDQGAKVTYLGPSGSQIGHKESMKDTARVLGRMYDGIEYRGFGQAVVEELGQYAGVPVWNGLTDEFHPTQILADFLTMQEHIQGKQLHEVSFAYLGDARNNMGNSLMVGAAKMGMDIRLVAPKAFWPEDELVSQCRKIAEETGAKITMTENVQEGVQGCDFLYTDVWVSMGEAKEAWAERINLMLPYQVNMDTIKATGNPHVKFMHCLPAFHGEDTTIGKELAKEYPELTQGIEVTDEVIESKHSVVFDEAENRMHTIKAVMVATLGN

SEQ ID NO: 11346 - protein, 356 aa, Schizosaccharomyces pombe 972h-
MWGFIVTCGIFLVLLCQLRLLSKRKSKSTPYNALLPNVTVFAMGGTIAGCANSSLEIVNYIPGSVGIEKLIEAVPAIKAIANINGVQVTNMGSENLTPADVLKLAKLILAEVAKPNVHGIVITHGTDSLEETAMFLDLTISTAKPIVVVGAMRPSTAIGADGPMNLLNAVAVASSNQSMGRGTLVLLNDRIGSAFYTTKTNGNTLDTFKSYEAGSLGIVLNQKPFYFFSPAVPTGKVFFDIYNIKQLPRVDILYGYQGLNPKLAESAVHLGAKGLVLAAMGATSWTDDGNEVISSLIREHNIPVVYSHRTAEGYSSNSCLGIPSYFLNPQKARYMLMLAISSGYSIRDIEGLFSIK

SEQ ID NO: 11347 - protein, 429 aa, uncultured marine bacterium 561
MSERLDDLRAFLGEATSPFHAVAALSRRLVDAGFKAVKQLDDLTFEAGQGYFVTANDSSIIAFRAGVGASEEGLRMIGAHTDSPNLSVKPNPLKKRSGTHQLAVDVYGGALLNPWFDRDLSLAGRVSFENSAGELESRLIDFQRPIAIIPSLAIHLDREANKNRSINPQTDILPLIAGLPTADGSSIDWGVLLADQVSAQYPEEGSVRILDFEMSLYDCQPAGLVGIDGAFLASARLDNLLSCHAGLLALLAADPAQWSLLVCNDHEEVGSTSAVGAQGPMLVDVLNSITGTAAASRRLRERSKMLSVDNAHAVHPNFSDRHDEAHGPLLNHGPVVKINRNQRYATSGEGSALLRLLAERAQVPLQHFVVRSDMGCGSTIGPITAAETGITTIDLGVPTLAMHSIRELAGTADVDYLGSLLTAFYNRVA

SEQ ID NO: 11348 - protein, 179 aa, Physcomitrella patens subsp. patens
AASTSTEVENDVVGVKQAPVLPFRVGHGFDLHRLEPGLPLIIGGVNIPHDRGCEAHSDGDVLLHCVVDAILGALGLPDIGQLFPDNDPKWRGAVSSVFVIEAVRRMKAAGYVIGNLDATLILQRPKLSPHKEAIRANLCELLEADPSVINLKAKTHEKVDSLGENRSVAAHTVVLLMRK

SEQ ID NO: 11349 - protein, 448 aa, Rhizobium sp. NGR234
MWHWHRFQEHEARRSDAIVLLRKIMSNESKSNSLYAFESLESNVRFYSRSFPVVFEKAAGAILHDESGREFIDFLSGSGVLNYGHNDPYFLDEATQYLRSNGIIHGLDMATPAKREFMECFDAIILRPRGLTYKFQFCGPTGANAVEAALKLARKATGRHSIVSFTNGFHGMSLGALAVTGNRYYRDAAGFPPAGVAFMPYDGYWGADNDTSEYLDKVLADASSGVDVPAAIILETVQGEGGINAARKEWLQSIQRICRSHGILLIVDDIQAGCGRAGNFFSFEFAGLSPDVVVLSKSISGCGLPLSLLLLKPELDVWRPGEHNGTFRGNNLAFVTGAAALRKYWTNDALSARVMETGRIIAERLRQVAQTNRARSLSVRGRGMMLGLNCGTGKLAERIVRKAFEEGLVVERCGAEDQVIKLLPPLTTDEQTLRRGLDILHKSVAASI

SEQ ID NO: 11350 - protein, 390 aa, Streptococcus mutans UA159
MKKQELNQAFTHVFGREADATFFSPGRINLIGEHTDYNGGRVFPAAITLGTYGAARKRDDKLLRFYSANFEELGIIEISLDHLIFNKKDSWTNYPKGVIKYLQEAGHSIDTGMDVYVFGNIPNGSGLSSSSSLELLIGIMAEELFDLKLDRLDLVKIGKRTENDFIGVNSGIMDQFAIGMGAEKKAIYLDTKTLEYDLVPLDLGDNVIVIMNTNKRRELADSKYNERRTECEKAVEELNVLLDIKSLGELDEETFDEYAYLIKDAKRIKRARHAVSENQRTLKAKKALAAGDLEKFGRLVNASHVSLEHDYEVTGIELDTLAHTAWEQEGVLGARMTGAGFGGCGIAIVAKDKVAALKENVGRIYTETVGYAPAFYIAEIAGGSRVLSRK

SEQ ID NO: 11351 - protein, 199 aa, Arabidopsis thaliana
METDDHNGDVLAPPSNFSMVEDGIYRSGFPRPENFSFLKTLNLRSIIYLCPEPYPEENLKFLEANNIKLYQFGIEGKTDPPTPMPKDTVLDALKVLVDVRNHPILIHCKRGKHRTGCLVGCLRKVQSWCLSSVLEEYQKNAGLKWRQRDLNFIEAFDIVSLRQCLLSIMYQYHGYGFKRRRLAYEEENVKTPKPQAARV

SEQ ID NO: 11352 - protein, 337 aa, Silicibacter pomeroyi DSS-3
MMTQTPIDLLLSDPPARRATVALSEGSDPRVVAGALAAHSAGIADVILVGQAAEIRAALKAQGAPADSLTIHDPDSSPLTAEFAAAYYGLRRHKGVSEAAALAAVRTPLVYAAMLVRGDHAVGTVGGAVATTSDVVRTAIQVIGAAPGAAMVSSFFLMYPPEAATAHARAMLYSDSGLVIDPSVAELAAIAAASAASCRALLRAEPKIAMLSFSTKGSARHPHVSKVTDALARLRADHPDLDADGELQFDAAFVPSVGASKAPGSDVAGQANVMIFPNLDAGNIGYKITQRLGGYTAIGPVLQGLAKPANDLSRGCVAGDVTQMIAVTVLQAMAQTQ

SEQ ID NO: 11353 - protein, 556 aa, Mesorhizobium loti MAFF303099
MYRYDEFDHDFVQARVAEFSDQVQRRLSGEISEDQFRPLRLMNGVYLQLHAYMLRIAVPYGTLNGKQLRMLGHIARKYDKGYGHFTTRQNIQFNWPALSDIPAILADLASVEMHAIQTSGNCIRNVTADHFAGAAADEVADPRPYAEILRQWSSVHPEFSFLPRKFKIAVTGAERDRAAIQTHDIGLHLKKNAAGELGFAVYVGGGQGRTPMVARKIRDFLPEADLLSYCTAILRVYNLYGRRDNKYKARIKILVHETGVEEITRQVEAEWQDLKDAELKLPDADIRAIQAYFAPPELADRPEGDQAVKLARLDSKGFSEWLDQNVVTHRHPDYAAVTISLKGIGEVPGDASDSQMEAIADIAEKYAFDELRVSHEQNLILPHVARADLKAVYDALVDIGLATANSNLISDIISCPGLDYCALATARSIPIAQEISQRFASLERQREIGELKLKISGCINACGHHHVGHIGILGVEKKGSELYQVTLGGSADENTSVGEIIGRGFSSEEITDAIEQIVETYLGLRLNPQEKFIDAYRRVGPAPFKEALYAGETKAA

SEQ ID NO: 11354 - protein, 596 aa, Silicibacter pomeroyi DSS-3
MECVLMKMTTEEAFVKTLQMHGIQHAFGIIGSAMMPISDIFPAAGITFWDCAHEGSGGFMADGYTRATGKMSMMIAQNGPGITNFVTAVKTAYWNHTPLLLVTPQAANKTIGQGGFQEMEQMRMFADCVAYQEEVRDPSRVAEVLNRVIMNAKRASAPAQINIPRDMWTQVIDIALPAIVEFERPSGGEEAVAAAAEMLSNAKNPVILNGAGVVLSKGGIAASKALAERLDAPVCVGYQHNDAFPGSHPLFAGPLGYNGSKAGMELIKTADVVLCLGTRLNPFSTLPGYGMEYWPADAKIIQVDINPDRIGLTKKVSVGIIGDAAKVARGILAQLSDTAGDEGRAARKDRIAQTKSAWAQQLSSMTHEDDDPGTTWNERARADKPDWMSPRMAWRAIQAALPREAIISSDIGNNCAIGNAYPDFDEGRKYLAPGLFGPCGYGLPAVVGAKIGCPDVPVVGFSGDGAFGIAVNELTAIGRGEWPAVTQIVFRNYQWGAEKRNSTLWFDDNFVGTELDQRVSYAGIAKACGLQGVVARTMDELTAALAKAIEDQKAGKTTLIEAMINQELGEPFRRDAMKKPVRVAGIDKADMREQQV

SEQ ID NO: 11355 - protein, 313 aa, Oryza sativa
  misc_feature (253)..(253): Xaa can be any naturally occurring amino acid
  misc_feature (265)..(265): Xaa can be any naturally occurring amino acid
MEQYEKEEKIGEGTYGVVYRARDKVTNETIALKKIRLEQEDEGVPSTAIREISLLKEMHHGNIVRLHDVIHSEKRIYLVFEYLDLDLKKFMDSCPEFAKNPTLIKSYLYQILRGVAYCHSHRVLHRDLKPQNLLIDRRTNALKLADFGLARAFGIPVRTFTHEVVTLWYRAPEILLGSRQYSTPVDMWSVGCIFAEMVNQKPLFPGDSEIDELFKIFRVLGTPNEQSWAGVSSLPDYKSAFPKWQAQDLATIXVPTLDPAGLGLXSPNMLRYEPKQKGTKLKKALGQWKLLREPWERGKRNPRHGGFNLGGGE

SEQ ID NO: 11356 - protein, 493 aa, Arabidopsis thaliana
MSRHFLFLGIIILLFSAFVASAPSSTSPATVPTKSMVKFENGYSVETVLDGSKLGIEPYSIQVLSNGELLILDSQNSNIYQISSSLSLYSRPRLVTGSPEGYPGHVDGRLRDARLNNPKGLTVDDRGNIYVADTVNNAIRKISEAGVTTIAGGKMVRGGGHVDGPSEDAKFSNDFDVVYLGSSCSLLVIDRGNQAIREIQLHFDDCADQYGSGFPLGNIYIPKFSVWVPSCILQSSLSQLLFNVSLIQCFNIAGIAVLVAAVFFGYMLALLQRRLSSIVSYHTDQEVFEAVPDQDPIKPVRPPLILTGDEQEKQEESFLGTLQIFISNAWVFSVELFSGMFPGLRKKQTVGLNFNHQETKHSAFSTTSWPIQESFVIHNKDEPPPVESRNATPGKIYPFMSKDATEKMQQLRQSRALYRSLDAEFLQEQQQEKHQQYHHRHHSTIPYTLYEQSSEKTNEIVFGPGQEQDQMNTHQNIHHRAHQFVSYPYGYYS

SEQ ID NO: 11357 - protein, 85 aa, Hyacinthus orientalis
SLYFSCSRLVSASFEDQRRHQGALLTRKIAKFQKNITKRGSVPETTVKKGNDYPVGPILLGFFIFVVIGSSLFQIIRTATSGGMA

SEQ ID NO: 11358 - protein, 448 aa, Pseudomonas syringae pv. syringae B728a
MSFIVCMGVLGVLLMLLALTSSYLRWMPVTTSAVCLGFGFGIGPMGLDIVDLDFEKSYEWLERLTEVAVLFSLFGTGIKLRLPLRGKAWHSAYWLAGPVMLATIAGVTVAGHYIIGLDWGVSLLLGAMLSPTDPVLAGMVQVNNAQDQDRLRFGLSGEAGLNDGTAFPFVIFALLYLSSGGAMSDWVQGWLIKDLIWAVPAGLLIGYGMGRGVGHLMIFLRIKNADSTTSPNDFLALALIALAYVVAQSVGAFGFLSVFAAGFGLRQAEVRVTRSELPSEHVAQPVLGHMTSSLEQGTVAQVDDMSDSQLAAGVMMGDMLAFGSLVERAMEVLLITLLGAALAMYWDWRAIGLGIALFCVIRPASVWLLVSRRLLNVRQKALVGWFGIRGIGSLYYLCFALSHGLAHDVGHVVIGMTLSVVALSILVHGISIQPLLERYERSAAASPD

SEQ ID NO: 11359 - protein, 1211 aa, Oryza sativa Japonica Group
MLCLTLSLSLSLSISFSFLELELCIDGHLAPLNCFPLTPSPLTVLALAFGSKGTLFLKGEGQAQEAAGSPQGVVLEEEIKVKEEFNNHKDYDYLFRFHFEVHTIDVSLLCMWLIIAKCLESIPFSYDHSFLDEAAMEGHVIVPLEKLSLELNNGGIMLNHDKDISALQEEISALRSRQRHLDHRRQEALDKLIDLKGSIRVFCRVRPSISANNFMTKSPVTVENEKIVVRAVGIKKEFSVDRVFDQESTQEDVFQEVKPILRSALDGHNVCILAYGQTGTGKTYTMEGNNGKLGIVPRAIQELFSHASQDSSSTYSFSISMLEVYMGTVRDLLTPRQPLFRSTECNTSSIISILATKSGAVEVEGLTDVAIQDLKKANQCLTRITIKRSSGGTTEECSKLWLVDLGGSERLLKTGASGLTMDEGKAINLSLSALGDVIAALRRKRSHVPYRNSKLTQILSDSLGDGSKVLMVVHISPSDDDIGETVCSLSFAKRARSIESSKELSEDIKKLKQKRIAELDKEICDAEQELKDLNEQIKRAETSLEERKKLSSSACQALSDEKGSPRSTLVVVGHIDSAESPQATEKTKSRASHGSVPHFMSPTVCSRQRHSSASHSATKTRLTKSVNRYPAAELSGSHSFSYSSCKNAAKARSRRRPAIFPVVFIPSWPRVMTVALTASCKILTEALNIDRVIVQQLQNSENSQFLYLPLHQCTGIWQEEAKNMLHVEWQLAREISRTSNAESNADIWTHVDREQHGHVAHRFQVKKKQFFRNFMTITLFGAIGTLISFSVISLGSLGLISRLNIGSLDLGDYLALGAIFSATDSVCTLQVLNQDETPFLYSLVFGEGVVNDATSVVLFNAMQNFDLANFSSVKFLQFIGNFLYLFATSTFLGVAAGLLSAYIIKKLYFGRHSTDREVSIMMLMAYLSYMLAELLDLSGILTVFFCGIVMSHYTWHNVTESSRVTTKHAFATLSFIAETFLFLYVGMDALDMEKWKIVGETFSPMKSIALSSTILFLVLVARAAFVFPLSFLANLTKKTEEGKISIKQQVIIWWAGLMRGAVSIALAYNKFTRSGHTQLPSNAIMITSTITVVLFSTMVFGLLTKPLIRLLIPARHLNRESSALSDPPSPKSFLDPLILNGSDVDPEIGVGIRRPTSLRLLLASPTQSVHHYWRKFDNAFMRPVFGGRGFVPFVPGSPTERSVPLLQGNEN

SEQ ID NO: 11360 - protein, 308 aa, Schizosaccharomyces pombe 972h-
MSESRQELLAWINQVTSLGLTRIEDCGKGYAMIQIFDSIYQDIPLKKVNFECNNEYQYINNWKVLQQVFLKKGIDKVVDPERLSRCKMQDNLEFVQWAKRFWDQYYPGGDYDALARRGNRGPANTRVMNSSAGATGPSRRRQVSSGSSTPSMTKSSANNNNVSSTANTAAVLRAKQAQQQITSLETQLYEVNETMFGLERERDFYFNKLREIEILVQTHLTTSPMSMENMLERIQAILYSTEDGFELPPDQPADLTTALTDHDTNNVAEEAQMTDLKDSETQRVPSAPDFVHARLQSLEVDDDENITF

SEQ ID NO: 11361 - protein, 448 aa, Lactococcus lactis
MSQATEYIKEVRANLAQRDGNQAEFLEAVDNFLATITPVFEAHPEYIEANILGQITEPERAFQFRVPWVDDAGKVQINRGFRVQFNSAIGPYKGGLRFHPSVNLSVVKFLGFEQIFKNSLTGLPIGGGKGGSDFNPKGKSDGEVMRFAQSFMTELQKHIGPDIDVPAGDIGVGGREIGYLFGQYKRLNGFSGGILTGKGLSYGGSLVRPEATGFGLLYYVDAMLKAHRDDLSGKKIKLSGAGNVAIYAIQKATELGAKIVTVSDSDGYIYDERGIDYKVVQQIKEVERGRISEYAKRVSTAEYSKGSVWEAPIDCDVALPCATQNEIDVDGAKLLISSGVQVVAEGANMPSTPEAIKAYRQAGLLYGPAKAANAGGVAVSALEMSQNSQRLAWSFADVDQRLQKIMQDIFQKSADAAKQYNLGDDYVAGANIAGFLKVADAMYAQGIV

SEQ ID NO: 11362 - protein, 207 aa, Neisseria gonorrhoeae
NISVGTIFSILAKPEGALATESFLQTGRQQLAAGYVLYGPQTQLAFTFGHGVYVFTLNAENEFVLTKENPKVPESTKEFAINMSNRRHWLPPVQQYVDELLAGETGTRGKNYNMRWVASMVAEIHRILMRGGVFMYLQDKRDPSKPGKLRLMYEANPMALILEQAGASASNAYQAMLDIQPESLHQRVAVIMGSSEEVDYLNRLHSK

SEQ ID NO: 11363 - protein, 490 aa, Brachypodium pinnatum
RPGVSPIEEKSTGRIDQIIGPVLDVTFPPGKLPYIYNALVVQSIDTADKQINVTCEVQQLLGNNRVRAVAMSATDGLMRGMEVIDTGAPLSVPVGGATLGRIFNVLGEPVDNLGPVDSSATFPIHRSAPAFIELDTKLSIFETGIKVVDLLAPYRRGGKIGLFGGAGVGKTVLIMELINNIAKAHGGVSVFGGVGERTREGNDLYMEMRESGVINEKNIEESKVALVYGQMNEPPGARMRVGLTALTMAEYFRDVNKQDVLLFIDNIFRFVQAGSEVSALLGRMPSAVGYQPTLSTEMGSLQERIASTKKGSITSIQAVYVPADDLTDPAPATTFAHLDATTVLSRGLASKGIYPAVDPLDSTSTMLQPRIVGNEHYETAQRVKETLQRYKELQDIIAILGLDELSEEDRLTVARARKIERFLSQPFFVAEVFTGSAGKYVGLAETIRGFQLILSGELDGLPEQAFYLVGNIDEASTKAITLEEENKSKK

SEQ ID NO: 11364 - protein, 179 aa, Schizosaccharomyces pombe 972h-
MESESVPTVPQTTRPGPRCYNCGENGHQARECTKGSICYNCNQTGHKASECTEPQQEKTCYACGTAGHLVRDCPSSPNPRQGAECYKCGRVGHIARDCRTNGQQSGGRFGGHRSNMNCYACGSYGHQARDCTMGVKCYSCGKIGHRSFECQQASDGQLCYKCNQPGHIAVNCTSPVIEA

SEQ ID NO: 11365 - protein, 94 aa, Zea mays
IHGLVELLESRNPTPEPTAKLQDKVDGCWKLIYSTISILGKKRTKLGLRDFISLGDFLQIIDVKQVSKGHTCCKVFPLRVLVWMLSIDLNPHVL

SEQ ID NO: 11366 - protein, 490 aa, Briza minor
RPGVSTIDEKSTGRIDQIIGPVLDVTFPPGKLPYIYNALVVQSKDTADKQINVTCEVQQLLGNNRVRAVAMSATDGLMRGMEVIDTGAPLSVPVGGATLGRIFNVLGEPVDNLGPVDSSATFPIHRSAPAFIELDTKLSIFETGIKVVDLLAPYRRGGKIGLFGGAGVGKTVLIMELINNIAKAHGGVSVFGGVGERTREGNDLYMEMKESGVINEKNIEESKVALVYGQMNEPPGARMRVGLTALTMAEYFRDVNKQDVLLFIDNIFRFVQAGSEVSALLGRMPSAVGYQPTLSTEMGSLQERIASTKKGSITSIQAVYVPADDLTDPAPATTFAHLDATTVLSRGLASKGIYPAVDPLDSTSTMLQPRIVGNEHYETAQRVKETLQRYKELQDIIAILGLDELSEEDRLTVARARKIERFLSQPFFVAEVFTGSPGKYVGLAETIRGFQLILSGELDGLPEQAFYLVGNIDEASTKAITLEEENKSKK

SEQ ID NO: 11367 - protein, 531 aa, Kluyveromyces lactis NRRL Y-1140
MTQEKKKQQSVAIIGAGAAGLTALFELLHTKKDGSTSLKYNADGSFDSANSVNDDPAFGEIVLFEQAGKVGGVWNPSFDTPDFIPQDIFDTERYDDPSVLRPKTEVPAEFTGQSFEQPLEKTIDSTTKSPIRWDRSAIYKSLYSNVTRRHLRNSFIPFKESTGEKESPIGPFLTNFEVTDNILKFVKTHSLDQYVRTQSEVVDVSKASDNDQWVVTIRQTNDKDKTESWYSQNFDNVIVSSGHYSIPHIPRIEGLSIWNKAFPNSILHSKSFRDESIFKDKRVLFVGTGLSGLDILQYAFPLAKEVITARTPGKKEIYDWLNTAAVSKDIVAKPRVSSVDYANGKTVHFVDGTKIEDVDIIVFSTGYHWHYPFLNEKDTGISVGADEEEGKVPNNNSLVTGIYKSIFSVKDLSLAFVGVLTTQFKWPSFEVASSIIAAVWTGKSQLPSLEEREAWAKERKQVRGSNLLVHVYLNGEFAEFVRENHTLLPKDRNIKNIFDDEYVGEEIASQKVAERLFYELKDGSISIHDTL

SEQ ID NO: 11368 - protein, 482 aa, Prochlorococcus marinus str. MIT 9515
MLEILSHQYLKRFIRFHKTDWNHIYSFGRIISKCLKTNDTYLINSEIFSTNNWIPALLISLFLFEENSTFVLSQEKIEFLKKNQLGDLKKFGFDFILENDQIIFSNHRVYLITLEKLLHDLDLFSSNNHRIIFSGIENIKEDLKNNFRILLLKKNWFHNFDKSSSTYQKIIGTYSFLKKKFFLRKSLNNEYIFLDKEEINFLAQFFYEHSSYSDQFLKVSNALSEGWACWVTLDEINFEWNFYLEPINELSLIKKLFNNNKFVFLSALRKDNFFQNYLKKESIDIDLVMNFKSNFNEKKIVVYAPPRQILPNNPMFTQIIIDKCKKLIIFRKGLTLILSDDLNLKHNLATELASTHGKQVLLETIPSHNNEILCASYVWWINNSYLIKSPEQIIIPLLPIPNMSEPINEITVLNKINLSKDWFREFLLPEAIQKLERSISPLRKNSGKLIILDGRLNKRKWGRSILQSIQPSKQINYVLPYD

SEQ ID NO: 11369 - protein, 173 aa, Helicobacter pylori
MNLDQLEVSHDADSLCVVIEISKHSNIKYELDKESGALMVDRVLYGAQNYPANYGFVPNTLGSDGDPVDALVLSDVAFQAGSIVKARLVGVLNMEDESGMDEKLLALPIDKIDPTHSYVKDINDLSKHTLDKIKHFFETYKDLEPNKWVKVKGFENKESAIKVLEKAIKAYQG

SEQ ID NO: 11370 - protein, 944 aa, Candida glabrata CBS 138
MYGAVLMDSDTRNNEGKSGRRRDSVSTTPRMFSTNTEQTGAQIDTAREKHSKSSQPRVFHRKSLSGWDFMETVGAGSMGKVKLAKNKNSNEVCAIKIVHRATKAYMHKAQQLPPPADENEAKERQKRLNKEISRDKRTVREASLGQILFHPNVCKLYEMQTLSNHYYMFFEFISGGQLLDYIIQHGSLKENHARKVSRGILSALQYLHANNIVHRDLKIENIMLSKTGEIKLIDFGLSNMYDPRKSLQTFCGSLYFAAPELLKAHPYLGPEVDVWSFGVVLYVLVCGKVPFDDENSSALHEKIKKGKVTYPQFLSIDVISLLSKILVVDPQKRATLQQVVNHQWMLKGYDFPPQSYLPRRVPLTVDDINIDVIKEMYRFEFVESIDAAYKTIIDIITEPEYKQLADQYWELADKSSFSEDSKFFTDDFKDPTQAYHPLISLYYLTFEKMQRDAKKENKDWLSTKSSEITNSDVGLNKEYKFTPKKMESIQKEPSPSELLEEQGNVTPEDISPQISNDKEQSPIAGQSGSKAPRSSIKALTNRADQSAQVGKNAGISPKPSVENTEKSGFTNIFRRFSQRHQRPSNINNSIASKNNNIRTHTRAVSDYMSVAPNELQKPVEIVSQNLPDLPTDAKLIIEKTRNSSKNKSDENETLQPVPHAKGKKLHPTARAKSVGHARRESLNFTRPAVVPPNMADIEEVVDTGFLQTPDEEKLVKDKAFGEALSNTIVEDLTDDEILKEASKAPPGSMPSIDYPRTLFLKGFFSVQTTSSKPLPIVRYKIISVLKKHNIEFVEVKGGFVCSKSPTVTILNTKTAPEKVDVYSGYDNDDTPDWSSQQSPKSMNDARLVFSDLDKSSNPHLTEGHSNSSLNDFENDNLSVGGKGDYLDNIQGPRAKVMDRAPIKFEIHIVRVRIVGLAGIHFKKLSGNTWMYKELATRILHDLKL

SEQ ID NO: 11371 - protein, 173 aa, Helicobacter pylori
MNLEKLEISHDANALCVVIEISKHSNIKYELDKESGALMVDRVLYGAQNYPANYGFVPNTLGSDGDPVDALVLSDVAFQAGSVVKVRLVGVLNMEDESGMDEKLLALPIDKIDPTHSYVKDIDDLSKHTLDKIKHFFETYKDLEPNKWVKVKGFENKESAIKVLEKAIKAYQG

SEQ ID NO: 11372 - protein, 292 aa, Prochlorococcus marinus str. MIT 9515
MQKLSHFEVSEICNQLGEGSPKSIKQVFGGDIHKSWEIEFQNAKFFLKRNERKAKFLKFEEFCLKNLQKYINYENLIIPKIVSYIEINNVELLLMEWIDMSNSDQQKLGQGLAEMHIESNKFNPQSFGCPVDGYIGTKNQTKGWRENWIKCFIDLRIEPQLAILDKDFLEINIKNKIKSKIESELHYHEPFNALVHGDLWSGNVGVNQTSKGVIFDPASWWADCEVDIAMTKLFGNFRSEFYENYYKIIPIKKGFEKRTIVYNFYHVLNHANMFGGSYCHQVKDYIKKILSF

SEQ ID NO: 11373 - protein, 712 aa, Ustilago maydis 521
MDRFDVINFADLSGPNGGEWVRIGGGSFGVVFKGEYLGTEVAIKEVLPNNTYDVEKYFERECVLMKEARHPNIVQYIGLTKSPGPDGRIYIISEFVGSNVRSYIADKSKPFPWRLRMSFAMDIARALAYLHARNCMHRDLKGENLLITANERIKVCDFGFARIAARNEEEMRRISYCGTDGYMSPEILLGVDFSLPSDVFSLGVIFAEIASRHLVDSYTFKRVMPTFGLDADEVREMASEGCPTAFIQLALDCVAEDPRDRPDMRQVVSRLRDIEREVLLREETENRYAIGSVRGATIQSIMGTKIKRAAPPKLPSFNGALKLNSSYSNAGSDDSGDEIEEALAALEKVGVEPDDARSPVTIKGSSTLKVAGHGNPWWSEDVPDALPSINRSWLASPGAAAERIRHESEAGLLEGADYAESDYSTSVVRSSKMTQRHAPLAMLEERASTLSVRTLRQGDSPLLIPTRRGSADVLAARSGSNDASAMQSYMTARTHRPDPSMALATIASVSSGLNEPIPICHRFTLVKNGTRRPNNVVAAAQQAMASSSTHQHPPPPVSSYYPSLVPPAVMLSNALAKCWVCGKRIGWKPFMDCDDCPYKTHVVCAELAPPTCQDLAIPLSSAVGGGSVQPILSPLNASRRNSKANDIVSCRRSSKAADVGDQREISAAAAALRRASLADSNDEPSSPQIGKAKAKKKLFGGSSAVNKSAVRA

SEQ ID NO: 11374 - protein, 342 aa, Glycine max
  misc_feature (165)..(165): Xaa can be any naturally occurring amino acid
  misc_feature (225)..(225): Xaa can be any naturally occurring amino acid
MAKLHFALSFTLLLLLCNASAAPSTTLPAKIVSGFLSNAVPAFTKWVWSLKAPTKTAIGAKSMMKFESGYTVETVFDGSKLGIEPYAVEVLPNGELLILDSANSNIYRISSSLSLNSRPKLVAGSAEGYSGHVDGRFREARMNHPKGITVDNRRNIYAADIMNMXIRKISDSGVTTIAGGKWSRGGGHIDDPSEEAKFPNELDVVYVGSSCSLLVIDRGNQAIRXIQLHFDDCAYQCENGFTLGIAMLVGAAFFGYMLALLQRRLGTIVASQDVEGAAMSGISPSPYQKFLKSVRPPSIPSYLGKDYIFTSLLHLSDNLNVTNIFLHYQLCIDADTLLKINN

SEQ ID NO: 11375 - protein, 173 aa, Helicobacter pylori
MNLDQLEVSHDADSLCVVIEISKHSNIKYELDKESGALMVDRVLYGAQNYPANYGFVPNTLGSDGDPVDALVLSDVAFQAGSVVKARLVGVLNMEDESGMDEKLLALPIDKIDPTHSYVKDIDDLSKHTLDKIKHFFETYKDLEPNKWVKVKGFENKESAIKVLEKAIKAYQD

SEQ ID NO: 11376 - protein, 159 aa, Bacillus halodurans C-125
MNISIISVGKLKEKYLKQGIAEYTKRLGAYAKIELIEVPDEKAPEQLSDTEMEHVKQKEGERILAKLHPDTYVIALAIEGSMKSSEELADTMDRLATYGKSKVAFVIGGSLGLSDAVLKRADEKLSFSKMTFPHRLMRLILLEQVYRAFRINRGEPYHK

SEQ ID NO: 11377 - protein, 439 aa, Zea mays
  misc_feature (59)..(59): Xaa can be any naturally occurring amino acid
MASPSFAAAATSPASSPLTLDAIPLASRPAPGAAAAQRKRSVFLLNHRPHPRLPYAPAXPTAAASAQHARRKKTSHPPRPRWQTVLSIAAKNAALLAALLYLGDLAWRWSHPPPPSPPPDRAALEGYAARVDEVEASLTRTFRMIQVQLEAVDRKIDGEVGAARGDLLALLEDKRLALERQLTRLDARAGELGDALAGLKRMEFLRKDEFEKFWDEVKGSLGSSSESEVDLDQVRALAREIVMREIEKHAADGIGRVDYAVASGGGRVVRHSEAYVPKRGFMVWMSGVDVGPKPEKMLQPSFGEPGQCFALQGSNGFVEVKLKSGIIPEAVTLEHVSKDVAYDRSTAPKGCRVYGWYEETPGETQSGHAAKMALAEFAYDLEKNNVQTFDVTAPDVGVINMVRLDFTSNHGSSQLTCIYRLRVHGHEPVSPGSSAGSQA

SEQ ID NO: 11378 - protein, 382 aa, Escherichia coli
  misc_feature (269)..(269): Xaa can be any naturally occurring amino acid
MIKSALLVLEDGTQFHGRAIGATGSAVGEVVFNTSMTGYQEILTDPSYSRQIVTLTYPHIGNVGTNDADEESSQVHAQGLVIRDLPLIASNFRNTEDLSSYLKRHNIVAIADIDTRKLTRLLREKGAQNGCIIAGDNPDAALALEKARAFPGLNGMDLAKEVTTAEAYSWTQGSWTLTGGLPEAKKEDELPFHVVAYDFGAKRNILRMLVDRGCRLTIVPAQTSAEDVLKMNPDGIFLSNGPGDPAPCDYAITAIQKFLETDIPVFGIXLGHQLLALASGAKTVKMKFGHHGGNHPVKDVEKNVVMITAQNHGFAVDEATLPANLRVTHKSLFDGTLQGIHRTDKPAFSFQGHPEASPGPHDAAPLFDHFIELIEQYRKTAK

SEQ ID NO: 11379 - protein, 312 aa, Methanococcus maripaludis S2
MKGTKKGMREAYGETLAELGEVNENIVVLDADLSGSTKTGIFAKKYPERFFNAGIAEQNMMGMAAGLSRTGKTVFASTFAMFATGRAWEQIRNSIAYPGLNVKICATHSGVTVGEDGASHEMTEDIAIMRAIPKMIVISPSDYLETKSAVRWAADYEGPVYVRMPRGNTEIIFEGEEEAKFEFGKARVLKDGTDITLIATGELVPEALNASKILSEKGISAQVIAIATIKPIDKDAIKNSKDFIVSIEDHSIIGGLGGAISEVIAEDGLNKKLLRVGINDEFGKSGKAGDLLKYYKLDSESIAETVMNAYKK

SEQ ID NO: 11380 - protein, 346 aa, Novosphingobium aromaticivorans DSM 12444
MKALRYYGARDIRHESMDDPTPQSDRDAIVKVDACSICGSDLHIYHGHGFSEDIGFCVGHEAVGEVVEVGRGVHRLKVGQKVMIPAAVGCGACRSCLAGVVNTCENNGSGCYGLSAKLQGSQAEAVRVPAADANAVAIPEGVSTEQALMMTDALATAWFGARQADIRPGSSVGIIGLGPIGLMAAESAFVMGAHVVYAIDPVPERRAIAESLGAIALHPDEASARIKEDTHGRRLDCVVEVVGSDATVDMALRLVRVRGTVSVIGVQQSRRFPFPLERAFAGGLTFRVGTCSVPEELPALFPLVASGRLRPERYISHRLPLSQGAEAYRMFEAREAGALKMVLVPD

SEQ ID NO: 11381 - protein, 219 aa, Methanococcus maripaludis S2
MVMIGASILSADYGHMAEEVKKAEEGNVDFFHVDIMDGHFVPNLSMGLRVPHYLKSITDVPIDVHLMVENPDLFIPKLADAADMIAFHAESSKYLFRTVDMIKEHDAKPIVALNPSTPIGNVEYVLENLYGVLVMTVEPGFSGQSFINPMIKKIDNLKNKILTEGYDTKIFVDGGINLETAPKAVEAGADGLIAASAIYGKEDVKKAVNDLRNSANFRI

SEQ ID NO: 11382 - protein, 385 aa, Novosphingobium aromaticivorans DSM 12444
MIAQVEPFHAIAISRLAHDLEAAGQSVIHMEFGQPSTGAPAEAIALAHEVLDNEAMGYWESVPLKERIARSYAENHGVKVEREQVILTCGASPAFVMALSCLFRPGARIALARPGYVAYRNSLKAMYLEPVEMECGPAERFQVTAAAVDALDPVPDGLIVASPANPTGTIIEPGELAAIAEVCCRKGIRVISDEIYHGLSYGKAAASMLEYLPDAVIVNSFSKYFSMAGWRLGWLVVPPSLIDAARARMGSLFLTPPVLAQKAGLKAFDCRAELDGHVETYARNRAILLEALPQMGLGRIAPPDGAFYIYADASEFTDDSLALCEALLRDTGVATAPGLDFDPVNGKRFIRFSFAVSTPLIEEAVRRIGPWFAARRAVSPAQAPS

SEQ ID NO: 11383 - protein, 440 aa, Schizosaccharomyces pombe 972h- [sequence omitted]

SEQ ID NO: 11384 - protein, 354 aa, Streptococcus mutans UA159
MQVSASSFLFCSVVYGLGILIMAILVLGGAGYIGSHMVDRLIEKGEEEVVVVDSLVTGHRAAVHPAAKFYQGDLADREFMSMVFRENPDVDAVIHFAAYSLVAESMKKPLKYFDNNTAGMIKLLEVMSEFGVKYIVFSSTAATYGIPDEIPIKETTPQRPINPYGESKLMMETIMKWSDRAYGIKFVPLRYFNVAGAKPDGSIGEDHSPETHLLPIILQVAQGVREKIMIFGDDYNTPDGTNVRDYVHPFDLADAHLLALNYLRQGNPSTAFNLGSSTGFSNLQILEAARKVTGQKIPAEKAARRSGDPDTLIASSEKAREVLGWKPQFDDIEKIIASAWAWHSSYPKGYDDRD

SEQ ID NO: 11385 - protein, 643 aa, Physcomitrella patens subsp. patens
MGGKIGSEDEFHETLEDITSASSSDAEEGGRRSMRARVAGVAPATSHERPPIWTPSSFHSKFSVWKDDPSSITDRRQRLFQTWGIKNLREESNTGSATSLATKRLLPAENIRGDQQVVKVPKGVSCTTVADDDVSESHTLLEKSSRGACDGAEKAADRNSVGNSCMSTIDSDNKRLQENSGAVLREGNNKLVPVLTRLGPVSAVICRDGSHGITFRSSGSSPDVSPYREGSSKVLASPEGSLSPVRNGCAHTEAGDLHQVSSSQEKLPHLYDTDNGYETRSQDGFSAAEDYGMDDVLKIRDLDSGKEFLVNRLNRDGSLHMLREVDTGRELTLAEFEKVVGLSPITQEMMRRQRAAESGISNEKHRSGKTSGKKKNGWLKYFGSKKSTKEKPISGGSTRSDNHSLSGEDTDGSSKGERLSRNGSSKRGNSRESSFADTDREGSTKVGIPADDSTGPSWRQPQKVKVKLRRKSVKDLSDLHMGQEIQAHEGVIWTMKFSPDGRCLATAGQDHIIHVWAIIDHPSVSEPDSSHGQEKGNFGNDGLGKDSSVRTSSKSDKEGSTKDDKAESIKVDENGCTKSAKEGTTKGAKEASLRGGKTSSQPTKAGHSDKDPLPNLFWLSEKPMCSFQGHTGDILDLSWSQSK

SEQ ID NO: 11386 - protein, 301 aa, uncultured marine bacterium 561
MNPAENSYPTIESVVGETPLVRLQRLTQNSSNHVLCKLEGNNPAGSVKDRPALSMIVEAEARGDIRPGDTLIEATSGNTGIALAMAAAIRGYHMRLIMPAHMSSERKLAMAAYGAELIQVTREEGMEGARDLAEAMQARGEGTVLNQFGNFDNPLAHYRGTGPEIWRQTGGQVTHFISSMGTTGTIMGVSAFLKEQNPDIEIIGLQPQDGSQIPGIRRWSEAYRPTIFQSAKVDRTIDISQAESEVMMRRLASEEGIFAGVSSGGSISAALQVSQEVEGATIVAIVCDRGDRYLSTGVYGI

SEQ ID NO: 11387 - protein, 305 aa, Physcomitrella patens subsp. patens
MDKTVRLWHISEEECLRVFSHNDFVTCVQFNPIDDSYFLSGSLDYKLRTWSIPGRQVVDWVDLPEIITAITYSPDGAKAIVGSHKGTCRFYNTTGNKLQLDASIDVRTENKKGRGKRITGVHCMPGDPQKVLITSNDSRIRVYDGQELCAKYKGLKNVNSLISASYTSSGDYIISASEDSRVLIWSSDNKDPSSAKSLYRRDKQLSCEEFSCHLVSLAIPWPGSRTVSSYSEPGSGTSAGDEVDEMDEEPDGVVQGDSTRFDDVKFENQGKATSLVSALWGVVIVTAGLDGKIRTFQNYGHPVRL

SEQ ID NO: 11388 - protein, 183 aa, Physcomitrella patens subsp. patens
MASAVASSVVAPVSLAAASPAAVSRDSTSVKAFSGLKSATLFSSQAQTLSSVQNGSRVQCMQVWNPIGQPKFETFSYLPPLTDDEIAKQVDYMIQQNLIPCIEFDTVGSVSRTNFSGAGSSGYYDGRYWTMWKLPMFGCTDSSQVLREIQECKTQFPSCWVRVLGFDSKKQVQICGFLVSRPN

SEQ ID NO: 11389 - protein, 97 aa, Raphanus sativus
ATYKVKFITPEGEQEVECDDDVYVLDAAEEAGIDLPYSCRAGSCSSCAGKVVSGSVDQSDQSFLDDDQIAEGFVLTCAAYPTSDVTIETHREEDMDV

SEQ ID NO: 11390 - protein, 314 aa, Chlamydomonas reinhardtii
MEVDGTRQSASGLEWKLHPLVLINISDHHTRTRANTPGATAPGVPAPAVMGCLLGSQSGRSVDIRNSFEVRYAAGPDGTLDIDITYLLKKQEQYKQVFKNLDVVGWYATGAAITEGHRLAHRKISEVVESPVFLLLDPAVDHTRKDLPVSLYETELHLSPETGAPGMVFVKSPYSIETSDAERIGVDQVARILAGGKATGSEQLSAQLVSLHSAIKMLLERLRVIHGAMGKVAGADGAAAEAAYPHSLLRQVSSLVHSLPACNTDAFNREYLTEYNDTLLTLYLASMTRGTHAANEVVDKFCLAYDKAGRRRGL

SEQ ID NO: 11391 - protein, 174 aa, Triticum aestivum
MAPAVMASSATTVAPFQGLKSTAGLPVSRRSSGSLGRVSNGGRIRCMQVWPIEGIKKFETLSYLPPLSTEALLKQVDYLIRSKWVPCLEFSKVGFVFREHNSSSGYYDGRYWTMWKLPMFGCTDATQVLNEVEEVKKEYPDAYVRVIGFDNLRQVQCVSFIAFRPPGCEESGKA

SEQ ID NO: 11392 - protein, 748 aa, Vibrio campbellii AND4
MLSQLREVVEKFSRVDDVHLALDILVRETCAALCTECCTVYLVNEEMQRLELMATQGLIFEGDSIHINFNEGLVGLVTRSAEPLNLAEASSHPDFKFFPQLGEQVYHSFLGTPIIHRKQVLGVLVIQQKAPRLFSEMEESFLVTLSAQIAIQIAHAQNLGYWQLASKPKVNKGQPASSGIAIGEFWFDNTQPNLSDVFPACALDKDREHELLAVAVERALSDFRRMRKKLDSEINKDALAIFDLFTHLLNDPMLRGDLKKQIEKGDRADWALRQVVETYSNRFARMSDVYLRERAQDVRELGQRLLYFLHNSEQEQASIDRPVILIANELTATLLASIPKQHLLAVVSLEGAANSHAAILSRALGVPAIMGANINASVVNGKKGIVDGYTGEIYIEPNRQLLREYRSLIIEESELFTMVNKDLALPAITQDNCHVEVMLNAGLSADSNIAINSGVDGVGLYRTEIAFLLQHHFPSEDEQYHQYRAILNSYAHQRVVMRTLDIGGDKPLPYLRIDEDNPFLGWRGIRFTLDHPDIFLIQLRAMLRASAESQNLSILLPMVSGIKELEDAVTLINQAYSEVVLLDDRIQAPKVGVMIEVPSMVYLLPAIAHRVDFVSVGTNDLTQYLLAVDRNNSRVADVYESMHPAVLLALKQIHDVCHQYQVPVCICGELAGDPFGALLLLGLGYSSLSMNTSNVAKVKYLIRHSQRKELEKLVETAMSCSYGQEIHQMMHDFFIQQGFAGFIRSGKK

SEQ ID NO: 11393 - protein, 396 aa, Bacillus pumilus SAFR-032
MEFQQSDVLKQLPTQFFASLVQKVQKKVEEGADIINLGQGNPDQPTPVHIVKAMQEAVAKPENHQYSSFRGTAKLKKAAAAFYEREYGVTLDPMTEIAILFGGKAGLVELPQCLLNPGDTLLVPDPGYPDYWSGAVLAGAQMVTMPLLEQNDFFPDYDRLPEDVKKKAKLMYLNYPNNPTGATASQSFFEETVTFAKDHKLCVVHDFAYGGIGFDGEKPISFLQTDGAKETGIEIYTLSKTYNMAGWRVGFAAGNPSVINAIELYQDHLFVSLFKATQDAAVEALLSDQTCVQVQNDRYEKRRNVWIAACKEIGWEVTAPKGSFFAWLKVPEGYTSESFAAVLLEKAHVVVAPGNGFGTHGEGYVRVGLLTNEERLKEAAQRIAALNLFENKPLTT

SEQ ID NO: 11394 - protein, 203 aa, Hyacinthus orientalis
HCTLHSDRMGNVLRRAVLQHVRVINPAFRPVIFSRSESVSSARLEEHGFESTTVSDVLKSKGKSADGSWLWCTTDDSVYDAVKSMTQHNVGALVVVKPGEEKDIAGIITERDYLRKIIVQGRSSKSTKVGDIMTEENKLITVTPGTKVLQAMQLMTDNRIRHIPVIGDKGMIGMVSIGDVVRAVVSEHREELDRLNAFIHGGY

SEQ ID NO: 11395 - protein, 607 aa, Arabidopsis thaliana
  misc_feature (39)..(39): Xaa can be any naturally occurring amino acid
MENYEVLEQIGKGSFGSALLVRHKHEKKLYVLKKIRLAXRQTGRTRRSAHQEMELISKIHNPFIVEYKDSWVEKGCYVCIIIGYCKGGDMAEAIKKTNGVHFTEEKLCKWLVQILLALEYLHANHILHRDVKCSNIFLTKDQDIRLGDFGLAKVLTSDDLASSVVGTPSYMCPELLADIPYGSKSDIWSLGCCMYEMTAMKPAFKAFDMQGLINRINRSIVPPLPAQYSAAFRGLVKSMLRKNPELRPSAAELLRQPLLQPYIQKIHLKVNDPGSNVLPAQWPESESARRNSFPEQRRRPAGKSHSFGPSRFRGNLEDSVSSIKKTVPAYLNRERQVDLSTDASGDGTVVRRTSEASKSSRYVPVRASASPVRPRQPRSDLGQLPVSSQLKNRKPAALIRRASMPSSRKPAKEIKDSLYISKTSFLHQINSPDVSMNAPRIDKIEFPLASYEEEPFVPVVRGKKKKASSRGSYSPPPEPPLDCSITKDKFTLEPGQNREGAIMKAVYEEDAYLEDRSESSDQNATAGASSRASSGVRRQRFDPSSYQQRAEALEGLLEFSARLLQDERYDELNVLLRPFGPGKVSPRETAIWLSKSFKETTTTKLGD

SEQ ID NO: 11396 - protein, 397 aa, Pyrococcus horikoshii OT3
MEIGVVGKPNVGKSTFFSAATLVDVEIANYPFTTIEANVGVTYAITDHPCKELGCSPNPQNYEYRNGLALIPVKMVDVAGLVPGAHEGRGLGNKFLDDLRMASALIHVVDATGKTDPEGQPTDYHDPVEDIEFLEREIDYWIYGILSKGWDKFAKRIKLQKIKLESAIAEHLSGIGVNENDVWEAMHKLNLPEDPTKWSQDDLLAFASEIRRVNKPMVIAANKADAASDEQIKRLVREEEKRGYIVIPTSAAAELTLRKAAKAGFIEYIPGASEFKVLRDMSEKQKRALMVIKEKVLDRFGSTGVQEVINRVVFDLLKLIPVYPVHDENKLTDQFGNVLPHVFLMKKGSTPRDLAFKVHTDLGKGFLYAINARTKRRVGEDYELQFNDIVKIVSVTR

SEQ ID NO: 11397 - protein, 310 aa, Kluyveromyces lactis NRRL Y-1140
MSTSNESPSLKLNTGASIPVVGLGTWKSPEEDAYNAVVSALQNGYRHIDTAAIYGNEEAVGKGIRDSGVPREEIFVTTKLWGTQQRDPEAALDLSLQRLGLDYVDLYLIHWPVPLNASSITDGNYLTFPRTADGKIDIDIEEWNFIKTWEKMQHLPKSGKTKAIGVSNFSIKNIEALLAANPDFIVPAANQIEIHPQLPQTELIDYCKSKGILIEAYSPLGSSSSTILTDPTIEGIASKYNAEPANILISWGASRGYVVLPKSVNPQRIKTNLKLLDLSTEDLEKINKLTESVGAKRYVAPDFSPFAIFE

SEQ ID NO: 11398 - protein, 471 aa, Kluyveromyces lactis NRRL Y-1140
MTVTAAPEQSYVFQAAIDKTGTQVVGGKGVRIDIERDGKVYKNILDAITGAAVGAIGWADEEALEIINKAALESTYSYPCLISNKNAEKLAKFYIDNSPEGAFASALWCTSGSESNENALRIVRQYYLERGLPKKLKLISREDSYHGFTLGAQSISNNPRIEKFKDYFIDQKNICLSMPSAYTYRNKLKSESEEDYANRLLKILEDKIITEDPDTVAAVIVETLPGSSLGTTPPPKGYLKGIRDLCNKYDIIFYLDEVMCGTGRCNPNGKLNCWENFLAPEDAPDIQTVGKTLGSGYVTIAGVLIGPKIRDAYLQGSGTVVGGHTYASHAFNCAVALGIQEKIQRENLTANVFKMGNLMGEKLKDALLSEDNIAGDVRGVGGFWSVEFVADRDTKKPFEPSQDIAGRVKELCFQNGLNVMAMGVTPTASCSDRILLAPSFIITEDDVNEIVEKVVKSVTELSKTLKEEGSI

SEQ ID NO: 11399 - protein, 90 aa, Zea mays
FTTGELPHKFEAGTPAIAEAIALGAAVDYLTDLGMENIHNYEVELTHYLWQGLGQIPQLRLYGPNPKHGDRAALASFNVAGLHASDVATM

SEQ ID NO: 11400 - protein, 152 aa, Zea mays
SSNRQPASPSHLISLDRTPCAEPFQHKTTAKMSSTATVTRAHLENKLALAKRCSREATLAGAKAAAVATVASAVPTLASVRMLPWAKANLNPTGQALIVCTVAGMAYFVAADKTILSLARRHSYESAPDHLKDTSFAGAAAARPRPPAFFRP

SEQ ID NO: 11401 - protein, 618 aa, Haemophilus influenzae 86-028NP
MSQLANPELMKVVILLASSVTIVPLFKRLGLGSVLGYLVAGCLIGPSVFGIVQDPTAVVHLAELGVVMFLFIIGLEMYPERLWAMRKAIFGRGLLQVGLCGCLLTFSGIYLLGLTKEVSFIAGMGFTLSSTAIVMQSLEERGLTSTSKGQRVISTLIFEDIAIVPLLASVAFLAPHSKEATPHTDWVSIGIALSAVVGLIVTGKWLMNPLFRLISKARIREMMTAGALLVVLGAALAMEIGGLSMAMGAFVAGVMMSESAFRHQLEADIEPFRGLLLGLFFMGVGMSLDLHLVFNHWILLLGIVFLYILGKASAVYIIARITRLDHREAIGRMSLMAHGGEFAFVLFSAAATAEVISNEEQATFTAAVIISMLFSPIIAQIARKLIQRTEPKHLDQLDENDLDSIVDLEDNVLVIGFGRFSQIVCQTLLIRGISVSVIDRNIENIRAAAKFGFKVYYGDGIRLDVLRAAGIEKAKCVVLGINDTQRIEHIVSQMKEAYPNLPILTRTYDRKTTVSLIKQDVDFIVRETFESAITLSRATLMKLGIDKIEAEEIIKEVRTLDQERLNEEVLHGFSNEIVKKYWTPRPFIKPHLDTKALNKETEEILSEKIEEEISNDHS

SEQ ID NO: 11402 - protein, 594 aa, Zea mays
MGSFLWKQPSYLFILIILHLVAHEARTLSSDGEALLAFKKAVTNSDGVFLNWHEQDADPCNWKGVRCDSHSKRVINLILAYHRLVGPIPPEIGRLNQLQTLSLQGNSLYGSLPPELGNCTKLQQLYLQGNYLSGYIPSEFGELVELVALDLSSNTLSGSVPHSLDKLSKLTSFNVSMNFLTGAIPSSGSLVNFNETSFVGNLGLCGKQINSVCKDALQSPSNGLQSPSPDDMINKRNGKNSTRLVISAVATVGALLLVALMCFWGCFLYKNFGKKDMRGFRVELCGGSSVVMFHGDLPYSSKDILKKLETMDEENIIGAGGFGTVYKLAMDDGNVFALKRIVKTNEGLDRFFDRELEILGSVKHRYLVNLRGYCNSPSSKLLIYDYLQGGSLDEVLHEKSEQLDWDARINIILGAAKGLSYLHHDCSPRIIHRDIKSSNILLDGSFEARVSDFGLAKLLEDEESHITTIVAGTFGYLAPEYMQFGRATEKTDVYSFGVLVLEILSGKRPTDASFIEKGLNIVGWLNFLAGENREREIVDLNCEGVHTETLDALLSLAKQCVSSLPEERPTMHRVVQMLESDVITPCPSDFYDSE

SEQ ID NO: 11403 - protein, 392 aa, Methanococcus maripaludis S2
MAILGLVGKPNVGKSTTFNAMTEKIADIGNYPFTTINPNIGTSFVTKPCPCDTLNLKCTPNNSKCFSGMRYIPVEVIDVAGLVPDAHKGKGMGNKFLDDLRQADAFILVVDASGKTDLEGNPSENNDPVEDVKFLLNELDMWIHGILTKNWERLSRKAQQEKNLLKALSEQLSGLNISENQVFAVIKEFDESPMKWTEEDLINVSTNLRKASKPMIIAANKADHPDAEKNIEKLKEEFKDFLVIPTSAEIELALKNAQKAGLIKYDGKSMEVLDESSLNDAQKNALNYMKSYLDKFGGTGIQDLINVAYYDLLDMIVVYPVEDEGKFCDKKGNVLPDAYLVKKGATAKDLAFKIHTEIGQKFIYAVDAKKKLRISADQELNDGDIIKIVSAA

SEQ ID NO: 11404 - protein, 360 aa, Vitis vinifera
MVIHLLILYINSRKKNSNTIVEKKRESFTLEKMTITSKSPLVVAFGEMLIDFVPDSAGVSLAESTGFLKAPGGAPANVACAITKLGGNSAFIGKVGDDEFGHMLVDILKKNGVNSEGVCFDAHARTALAFVTLKKNGEREFMFYRNPSADMLLTESELNMGLIKQAKIFHYGSISLISEPCRSAHMAAMKAAKEAGILLSYDPNVRLPLWPSAQAAIDGIKSIWNHADFIKVSDDEVGFLTQGDAEKEDVVLSLWHDNLKLLVVTDGEKGCRYFTKGFKGRVEGFSVQTVDTTGAGDAFVGALLVSIAQDPSIFQDEGKLKEALKYANACGAICTTQKGAIPALPTNSDALDLVNKSKAK

SEQ ID NO: 11405 - protein, 411 aa, Oryza sativa Japonica Group
MAGVHSSIYSSLRLNSPREVCGFSDFPFRPTNGGGGDARRYPVHGELLRYIREFCDVFGLMDAVRLDTTVVRVAMAPPRRDGSLRWTVRSKHNGDAETEEVFDAVVVATGQYSQPRLPSIDGMDKWRRRQLHSHSYRVPDSFAGEVVVIVGCNLSGKEVALELLRVAKEVHLSSKSTKEAMTPSMSKMLARYDNLHLQPLVEHLCEDGRVVFDDGSFVVADAVIYGGEGHRRRQPRRAAVRARVPTGARAVALLRGHPGQGDPAAVRRGAGEVGGAGAVRGGGRCRRRGRCCAPSRSTTAAKEAAGLPKRQTHDLFLDLEYCDEYGERHCGFPRTEQWKKELIWSSISDMCDDIENFRDDYHDSDIVRDGRRLHGWASSPPLAPRPQEKDDDHDKEEDKHLGFGPSKFSLR

SEQ ID NO: 11406 - protein, 563 aa, Photobacterium sp. SKA34
MTDQKLSDNERLKRESNALRGTIEQDLGDRMTGGFTADNFQLIRFHGMYQQDDRDIRAERAKQKLEPLHNVMLRARMPGGIITPKQWLEIDKFADEHTSYGSIRLTTRQTFQFHGVLKPNIKLMHQTLNSIGIDSIATAGDVNRNVLCTTNPVESELHQEAYEWAKKISEHLLPKTRAYAEIWLDGEKLETTDEEPILGSNYLPRKFKTTVVIPPQNDVDVHANDLNFIAIADNGKLVGFNVLVGGGLAMTHGDHSTYPRRADDFGFIPLEKTLDVAAAVVTTQRDWGNRSNRKNAKTKYTLDRVGSDVFKAEVEKRAGIQFEDSRPYEFTDRGDRIGWVEGIDGKHHLALFIENGRLLDYPNKPLKTGVAEIAKVHGGDFRMTANQNLIVAGVLTKDKDEIEKIARDHGLIDDGVSEQRKNSMACVSLPTCPLAMAEAERFLPEFVTDVEGILEKHGLDDDENIILRVTGCPNGCGRAMLAEIGLVGKAPGRYNLHLGGNRNGTRVPKMYRENITVAQIMDEIDSLVGRWSTERQESEDFGDFTIRTGIIDEVKVSKRDFYG

SEQ ID NO: 11407 - protein, 622 aa, Streptococcus mutans UA159
MSDFIVERLSKTVGDKTVFQNISFIIHDKDRIGIIGVNGTGKTTLLDVISGRLGFDGDNSPFSAKNDYKMAYLTQEPVFNETKTILDTVLSSDLREMQLIHTYESFMANYDEANQEQLEKVMAEMDALDVWSIESEVKTVLSKLGISDLSQKVGNLSGGLKRRVQLAQVLLNDADLLLLDEPTNHLDIDTIAWLANFLKNSKKTVLFITHDRYFLDSIASRIFELDRAHLIEYQGNYQDYVRLRAEQDERDAAALHKKKQLYKQELAWMRRQPQARATKQEARINRFKNLKSDLSGMDTSSDLEINFQTSRIGKKVINFEQVDFAYPDKTILTHFNLLIQNKDRIGIVGENGVGKSTLLHLMNGDLQPNSGKLDIGETVRIGYFSQQIKDMDENKRVINYLQEVADEVTTAVGISSVTSLLEQFLFPRSTHGTLISKLSGGEKKRLYLLKILIEKPNVLLLDEPTNDLDIATLTVLESFLQDFSGPVITVSHDRYFLDKVANKILAFEHNAIREFFGNYTDYLDEKAFEKDSSAMVVKKEAAKVEKEKSERKRMSYFEKQEWATIEDDITALEERIENIEATMQEHASDYGQLAGLQRDLDTANEQLLEKYERYEYLSELEK

SEQ ID NO: 11408 - protein, 259 aa, Hyacinthus orientalis
GLVNGYFPQLAEGYMMLVLGQIAVTRVETIQLIAVGWSFQLWKIAIYQTSRDASTDSLPQAGENIPQSQDATWKQMKMPKEFVGNLLIDGKTVNVFEGLKLYEELLDSSDIVRLNSLANELRAAGHKGEFSGLTYVVYKRPMKGHGRELVQLGLPIAEGSAQGETITGTAAEPRVEPIPSLLQDVLDGFVQKQVLGVKPDFCVIDFFSEGDHSQPHLWPCWYGRPVCNLFLTACDMVFGRTIEGDHRGNYRGPLSFSFY

SEQ ID NO: 11409 - protein, 198 aa, Prochlorococcus marinus str. NATL2A
MTTNECLRVGMQAPDFATTAVVDQEFKDITLSQYRGKYVVLFFYPLDFTFVCPTEITAFSDRYSDFSSKNTEVLGVSVDSKFTHLAWIQTPRNEGGIGDINYPLVSDLKREICQSYNVLNEDGEADRGLFIINPSGIIMHSTINKAPVGRNIDETLRVLQAYQYVESHPDEVCPAGWTPGDKTMKEDPKGSKEYFSAL

SEQ ID NO: 11410 - protein, 348 aa, Photobacterium sp. SKA34
MKMTNVVDETMKNNLSTQSVTGDFPMQRFSVAPMLDWTDRHCRYFHRLMSKEALLYTEMVTTGAIIHGKGDFLAYNEEEHPLALQLGGSNSIDLARCAKLAQERGYDEINLNVGCPSDRVQNGMFGACLMGEAELVAQCVTAMRDVVDIPVTVKTRIGIDDQDSYEFLKDFIHVVSEKGGCDNFTIHARKAWLSGLSPKENREIPPLDYPRVYQLKQDFAHLTMAINGGIKTFEEMEAHLKHMDGVMVGREAYQSPYLMAEVDQRLFGSERPVMKRREVVEAMYPYIEKQLANGSYLGHITRHMLGLFQSMPGARQWRRHISENAHKPGAGIEVVQQALDKIPAHLDV

SEQ ID NO: 11411 - protein, 396 aa, Bacteroides fragilis NCTC 9343
MSKITKQQNGVLSVPDVPTIPFITGDGVGAEITPAMQAIVDAAVDMSYGGVRRIEWKEVLAGERAFRATGSWLPDETMEVFKEYLIGIKGPLTTPVGGGIRSLNVALRQTLDLYVCLRPVRWFRGVVSPVKEPEKVKMYIFRENTEDIYAGIEWEAGTPEAKKFYRFLHEEMGVSKVRFPETSSFGVKPVSREGTERLVRAACRYALQHELPSVTLVHKGNIMKFTEGGFKKWGYELAEREFADALASGKLVIKDCIADAFLQNTLLIPEEYSVIATLNLNGDYISDQLAAMVGGIGIAPGANINYDSGHAIFEATHGTAPNIAGKNVVNPCSLILSAVMMLEYIGWQEPADLIVEALEASFAEGKATNDLARFMHKGQPLSTSEFTREIINRIKN

SEQ ID NO: 11412 - protein, 420 aa, delta proteobacterium MLMS-1
MFRQSELANGVRIVTEQAPSKVVAVGIWIEVGARDEHDLTSGFAHFVEHMLFKGTERRSAHQIAREFDVMGGMANAFTSTETTCVQATVLADRLPQVADLLADIVLAPAFVPAEVENEREVIGQEIAMVEDTPDDLIHDLFNRQLWGRHPLGNPVLGSARVIGALNSEHLRSFHRRHYIPQRILIAAAGQLEHEQFCQLWADSFGALSAPEGTGAGAGRQPPRFAEPERRVFDRGLEQLHLMLGTYGPAENDPDRYAFHLLNTILGGNMSSRLFQEIREKRGLAYAVFSYLNCHSDSGNFGLYLGVDPLAAEEAAGLAAREIRRLRREPVTAGELDEARDYARALIMLAEENMEARMSRLARNTMAFGRELPVTEILAKLDRVSVDDIMAVADQTFTRPLNGVALGPLDDELLDWDVLDA

SEQ ID NO: 11413 - protein, 134 aa, Oryza sativa
  misc_feature (55)..(55): Xaa can be any naturally occurring amino acid
  misc_feature (100)..(100): Xaa can be any naturally occurring amino acid
RVRNEPSQISIDTNAYCLARYTIICHANRVPPHVPPDILDDGSHHIARFTYVTQXILLGYYTTSITHVLRTASLMKPNIATRGSKSKKVCPNVIAEYTVXALQRTVPAAVPAISFLSGGQSEEEATENSNAMNK

SEQ ID NO: 11414 - protein, 153 aa, Panax notoginseng
TVEDDTSISTEVKVPILMAFHRHIYDNDWHFSCGTKEYKVLMDEFHHVSNAFLDLGSGYKEAIEDITMRMGAGMSKFICKEVETIDDYDEYCHYVAGLVGLGLSKLFHASGAEDLATDSLSNSMGLFLQKTNIIRDYLEDINEIPKSRMFWPR

SEQ ID NO: 11415 - protein, 358 aa, Rhodobacter sphaeroides 2.4.1
MDAQKIRTTEGRGRLYDSVLDTVGNTPVIRINNLSPEGVTIYVKAEFFNPAASVKDRLALNIIEAAERSGKLKPGMTVVEATSGNTGIGLAMVCAQKGYPLVITMSEAFSVERRRLMRLLGAKVVLTPRGGKGFGMYRKAQELAEANGWFLASQFETDANADIHEATTAREIVADFAGERLDWFVTGYGTGGTVTGVARVLRRERPEVKIVLSEPANAQLVASGVPQDRNADGTAASGHPAFEAHPIQGWTPDFIPKVLQEGLDAGAYDELIPVAGEDGMKWARELAAKEGILTGVSGGSTFAVARQVAERAPKGSVILAMLPDTGERYMSTPLFQAIGEDMNEEEKALSASTPSFQL

SEQ ID NO: 11416 - protein, 685 aa, Vitis vinifera
MPGPIAKPHCPDKCGNISIPYPFGIGDVKCAKDDKFLLQCNNGQPLLLGSLPVRHLSIKGTVNVTMKTKRQCFSNGVSEVNFYGGIKLAGSPFTFFHNRNKFVVLGCNITALIDNNREYRRACLSFCRGYPPSAAPGFCTTSLPKQLKTLNITLFSIDPSSDSNHKFCLHAFVAAKSTYSISEINLSKHPVTTQVTLQWVVGEEKCEASGNRSETYACGKNTECQSSTNGPGYRCICKQGFQGNPYLPGGCQDIDECDDPSGYPCDGFCQNTAGDYTCRRSDESEVNSRRHGVAILASAIILSIGFLLLIAGIYWLNALVKKRKIIKLKKKLFKRNGGLLLQQQISSDKGKLEKLKIFSSEELEKATDYYNENRILGKGGQVIVYKGMLPDGSVVAVKKSKKMDKAQIERFANEVVILSQINHRNVVKLLGCCLETEVPLLVYEFVSNGTLSNHIHDQMEESPMKLSDRLRVAKEVAGALSYMHSAADVPIYHRDIKSSNILLDGKYRAKLSDFGISRSVPTEKSHLTTSVRGTFGYLDPEYFQSSQYTEKSDVYSFGVVLVELLTGQKPISGLRSEDMGLAAHFICSAKKNRLFDVLDPQVVMEGEKEELVILANLAMRCLKLSGSKRPTMKEVSWELENLKKLQKHLPVELDHQEDDYYFAESSRSLEPGDELELDMHPRSTE

SEQ ID NO: 11417 - protein, 254 aa, Populus trichocarpa
MARKFFVGGNWKCNGTSEEVKKIVSALNNSQVPSSDVVEVVVSPPFVFLPLVKSTLRPDFHVAAQNCWVKKGGAFTGEVSAEMLVNLDIPWVILGHSERRSLLNESNEFVGDKVAYALSQGLKVIACVGETLEQREAGSTVEVVAAQTKAIAARVSNWADVVLAYEPVWAIGTGKVATPAQAQEVHYELRKWLQENTSPEVAATTRIIYGGSVSGANCKELAAKPDVDGFLVGGASLKPEFNDIIKSAEVKKSA

SEQ ID NO: 11418 - protein, 545 aa, Staphylococcus aureus subsp. aureus COL
MNKDKQLHNDKINLSQLVLLGLGSLIGSGWLFGAWEASSIAGPAAIISWVLGFLVIGTIAYNYIEIGTMFPQSGGMSNYAQYTHGSLLGFIAAWANWVSLVTIIPIEAVSAVQYMSSWPWHWAKPMRYLMENGSISTYGLLAVYLIIVIFSLLNYWSVKLLTSFTSLISVFKLGVPMLTIIMLMLSGFDTSNYGHSASTFMPYGSAPIFAATTASGIIFSFNSFQTIINMGSEIKNPEKNIARGIAISLSISAVLYIILQSTFITSMPQSMLQHSGWNGINFNSPFADLAILLGINWLAILLYIEAFVSPFGTGVSFVAVTGRVLRAMEKNGHIPKFLGKMNEKYHIPRVAIIFNAIISMIMVTLFRDWGTLAAVISTATLVAYLTGPTTVIALRKMGPTMTRPFRAKILKVMAPLSFVLASLAIYWAMWPTTAEVILIIILGLPIYFFYEYRMNWRNTKKQIGGSLWIIVYLIVLSILSFIGSKEFKGLNMIHYPFDFIVIIIVALIFYYIGTTSSFESVYFRRATRINTKMRESLNNESKSSH

SEQ ID NO: 11419 - protein, 296 aa, Schizosaccharomyces pombe 972h-
MTEHSFKQIDVFSNKGFRGNPVAVFFDADNLSQKEMQQIAKWTNLSETTFVQKPTIDKADYRLRIFTPECELSFAGHPTIGSCFAVVESGYCTPKNCKIIQECLAGLVELTIDGEKDEDTWISFKLPYYKILQTSETAISEVENALGIPLNYSSQVSPPVLIDDGPKWLVIQLPNATDVLNLVPKFQSLSQVCKNNDWIGVTVFGELGKDSFESRSFAPLIHVNEDPACGSGAGAVGVYIGSSQKTPTSLSFTISQGTKLSRQAISKVSVDVSSNKSIAVFVGGQAKTCISGKSFI

SEQ ID NO: 11420 - protein, 509 aa, Arabidopsis thaliana
MGRDFLVLSILILLLSGIVSSAPSANSPAKILNGFISNHGSSLMKWLWSLKTTTKTTIATRSMVKFENGYSVETVFDGSKLGIEPYSIEVLPNGELLILDSENSNIYKISSSLSLYSRPRLVTGSPEGYPGHVDGRLRDAKLNHPKGLTVDDRGNIYVADTVNNAIRKISEGGVTTIAGGKTVRNGGHVDGPSEDAKFSNDFDVVYVGSSCSLLVIDRGNKAIREIQLHFDDCAYQYGSGFPLGIAVLVAAGFFGYMLALLQRRVGSIVSSHNDQEMFEADPDQKPMKHSRPSLIPAGDEQLEKQEETFVVSLGKLVSNAWESVMEILRKKQTGTSFQQYHGTTKQSAAFSTSTPWPIQESFVIRDEDGPPPVEPRNPTPRKTYAFMSKDAEKMQQLRQSRAFYSSWDAEFPNQQQQQQKQHQKHQHQQQQQQQHRRHYSSIPHTYYEQDSEKSNEIVFGAVQEQSSKRVAKPKPKPIESGDQMNNNTQQNLHYRSHSVSYPYGYYPNT

SEQ ID NO: 11421 - protein, 360 aa, Schizosaccharomyces pombe 972h-
MWSSIISFLFFSVALCQPLLFQKRSSNVSDFISFNASLPNVTIFAMGGTIAGYASSSTETVDYAAGSVGIATLVDAVPAIKNFSNIRGVQVTNVGSEELTPANVLNLTQLILAEVAKPDVHGIVVTHGTDSLEETAIFLDMTVNTTKPIVVVGAMRPSTAISADGPMNLLNAVVVAASNRSIGRGTMILLNDRIGSAFYTTKTNGNMLDTFKSYEAGFLGMILDQRPHFFYSPATPTGKVHFDVSNTTELPAVEILYGYQGLNPNLAKAAVDLGAKGLVLAGMGAASWTDPGNEVIDGLISNQSIPVVYSHRTMDGFSDYYYNGIPAYFQNPQKARYMLMLSINAGYSIQNITDIFSLEY

SEQ ID NO: 11422 - protein, 449 aa, Streptococcus mutans UA159
MTTGKEYVASVFEKVKAQNAHEPEFLQAVEEVFESLIPVFDNYPKYIEENLLERLVEPERIVSFRVPWVDDKGQVQVNRGFRVQFSSAIGPYKGGLRFHPSVNQSIIKFLGFEQIFKNSLTGQPIGGGKGGSNFDPKGKSDNEIMRFCQSFMTELSKHIGADTDVPAGDIGVGGREIGYLYGQYKRLRNEYTGVLTGKGLTWGGSLARTEATGYGAVYFAEQMLKARGQDFAGKTAIVSGSGNVAIYATEKLQTLGAKVVAVSDSSGYVYDPDGIDVALLKELKEVQRARIIKYADARPNASFTPAGGDSIWTIKADLAFPCATQNELNEADAKTLVANGVIAVSEGANMPSTLEAIDVFLKAGVSFGPAKAANAGGVAVSALEMAQNSQRTAWTFEEVDRKLYDIMKGIYDNSAAAAKSFGQEGNLVVGANIAGFLKVADAMSAQGIV

SEQ ID NO: 11423 - protein, 491 aa, Rhizobium sp. NGR234
MTLTSALTRHLKCPELFRNLANEPHPSVAGQRQRFSVFNPSTGELLAEVPDMGAADAHAAIERADAAQEPWSGLTARARSDILWKWHRFILEHSDDLAAILTAEMGKPLGEAKSEVQHAAAYLQWYAEEANRIYGETISAPSTDRRMLVIKQPIGVVGAITPWNFPASMVARKISPALAAGCTVVLKPAEQTPLVAGAMFALAKLAGFPDGVLNLVYASEGDAIGRELCTNPKVRKISFTGSTEVGRLLMRQCSDQIKRISFELGGNAPFIVFDDADIDAAVDGAIQAKFRNAGQTCVSANRIYVQSGVYAEFAEKFTERVRTLKVGDGFDPNVAIGPLINQEALKKIELHISDAVQKGARVRSGGRRTGSSGTFFEPTVVTDVSKTMRLAEEETFGPLAPLLRFDDADHVVREANDTIYGLAAYFYASNLKRVWRVAEALEYGMVGINTGRMSSEAAPFGGVKQSGIGREGSRHGLEDYLDMKYLCVGGL

SEQ ID NO: 11424 - protein, 295 aa, Solanum lycopersicum
MTYMFKYDSVHGQWKHHELKVKDEKTLLFGEKAVTVFGFRNPEETSMDRLGADYIVESTGVFTDKDKPAAHLKGGAKKFIISAPSKDAPMFVVGVNEKEYNPELNIVSNASCTTNCLAPLAKVINDRFGIVEGLMTTVHSITATQKTVDGPSAKDWRGGRAASFNIIPSSTGAAKAVGKVLPALNGKLTGMAFRVPTVDVSVVDLTVRLEKEATYDEIKAAIKEESEGKLKGILGYTEDDVVSTDFVGDNRPSIFDAKAGIALSKNFVKLVAWYDNEWGYSTRVVDLIIHMSSVQ

SEQ ID NO: 11425 - protein, 424 aa, Mesorhizobium loti MAFF303099
MIGLGYVGLPLAVATARAGFPVSGFDIEARKVERLNNGQSYIEAVTSTALAGEVASGRFRATADFAELTVCDVIIICVPTPLTKHREPDLSFVRNTAGTIAKHLRLGQLIVLESTTYPGTTDDVIKPILEETGLQSKIDFFLGFSPEREDPGNRSFEVATIPKVVAGDGVDAATLVQAFYQGVIETVVPVSTTATAEAVKLTENIFRSVNIALVNELKIVLGAMGIDIWEVIEAAKTKPFGYMPFYPGPGLGGHCVPIDPFYLTWKAREYELPTRFIELAAEINTAMPRHVVDELAKALDRRCGKALSRSRILIIGLAYKKNVPDIRESPSLRLIELIEEWGGKAEFHDPHVTEIPTTREHMAIKGRRSVELTEAALKDFDAVVVATDHDAIDYQAIADHALLIVDTRNVFGRLGLARETVVKA

SEQ ID NO: 11426 - protein, 550 aa, Photobacterium sp. SKA34
MLKNINPTQTQAWQDLTAHFEQAQDFQLSDLFANDSARFSKFSAQFGSDILLDYSKNLITEETLTKLFALAKETELDVAIADMFSGEKINRTEDRAVLHVALRNRSNTPIMVDGEDVMPAVNAVLEKMKSFSDRIISGEWKGYTGKEITDIVNIGIGGSDLGPYMVSEALGAYKTRLNMHFVSNVDGTHIAETLKDLNPETTLFLIASKTFTTQETMTNALSARDWFLAKAEDKAHVAKHFAALSTNGEAVAEFGIDTDNMFEFWDWVGGRYSLWSAIGLSISLSVGFDNFVALLDGGHAMDKHFAEAPLEQKLPVILALIGIWYNNFHGAETEAILPYDQYMHRFAAYFQQGNMESNGKYVDRGGNPVDYQTGPIIWGEPGTNGQHAFYQLIHQGTKLIPCDFIAPAISHNPLGDHHPKLMANFFAQTEALAFGKSREKVEAEFFAAGKSQEEVNELAEFKVFEGNRPTNSILVKEITPYTLGALIALYEHKIFTQGVIWNIFSFDQWGVELGKQLANQILPELNNKEEVSSHDSSTNGLINAFKQWRA

SEQ ID NO: 11427 - protein, 256 aa, Vibrio campbellii AND4
MRRPVVMGNWKLNGSKAMVTELLAGINAELEGVEGVDVAVAPPALYIGVAECVIAEGGNKVILGAQNTDLNNSGAFTGDMSPEMLKDFGASHIIIGHSERREYHNESDEFIAKKFNFLKENGLTPVFCIGESEAQNEAGETEAVCARQINAVIDTCGVEALNGAIIAYEPIWAIGTGKAATAEDAQRIHASIRALIAAKDKAVAEQVIIQYGGSVKPENAEAYFSQPDIDGALVGGASLDAKSFVAIAKAAAAAKA

SEQ ID NO: 11428 - protein, 411 aa, Xanthomonas campestris pv. campestris str. 8004
MAIAFGDASMQRSFWRSGHTPTLFASFLYFDLSFMVWYLLGPLQVPIAQALGLDTQQRALMVAVPILCGAVLRLVLGMLADRIGAKRAGVVAQLAVIASLFGAWQLGVHSMGQVLLLGVLLGIAGASFAVALPLASRWYPPEHQCTAMGIAGAGNSGTVLAALFAPMLALAFGYQNVFGLACIPLVLTLLVFVLIAREAPIPVARKRWADYGRVLVGNRDAWRFMFFYSVTFGGFSGFASALPGYFHDQFGFDARTAGWATAACVLAGSVMRPLGGVIADRVGGTRALLAVYLLVATLVGIAGFGAGGATITLGLFVLTLLCLGAGNGAVFQLVPQRFGQDIGVMTGLIGMAGGVGGFALAAGLGVLKQHTGSYAIGMWLFAAFALGGWALLAGVKTQWRSEWSTAGAARV

SEQ ID NO: 11429 - protein, 400 aa, Pseudomonas syringae pv. syringae B728a
MTATCLMSTYQPLALSFTHGLGTRLWDHSGREYLDAVAGVAVTNVGHSHPLLVEAIRDQAGLLLHTSNLYTIDWQKRLAQKLTALSGLDAVFFNNSGAEANETALKLARLHGWHKYIERPLVVVMENAFHGRTLGTLSASDGPAVRLGFSTLPGDYIKVPFGDLAAFDKVCTTYGHRICAVLVEPIQGEGGAQVAPAGYLKALRERCTRRDWLLMLDEIQTGMGRTGKWFAFQHEGIVPDVMTLAKGLGNGIPIGACLARGRAAQLFTPGSHGSTFGGNPLACRVGCTVIDIIERQVLVENAALQGRQLLEGLRTALGAHPNVLEVRGQGLMIGIELRQAIPELTRIAAEQHGLLINVTRGKIIRLLPPLVLDAAEVGQIVQGLTASLDSACDRSFARSA

SEQ ID NO: 11430 - protein, 69 aa, Glycine max
  misc_feature (40)..(40): Xaa can be any naturally occurring amino acid
VCIIYDPSRPDQGVLALKDLKLSDSFMELYRNNNFTREKXLREKNLSWVGIFEEIPTSFSKICLSLKWV

SEQ ID NO: 11431 - protein, 108 aa, Hyacinthus orientalis
LTVSVASGQYFCLHFEAFQLGMAPVYRAFLRFMGDDSEAKNYSYSREVGATGRKMIWQGVPRSIRDSHRKVRDSYDAIVIQRNIALFFSGGDRKELKLRVTGRIWKEQ

SEQ ID NO: 11432 - protein, 146 aa, Pseudomonas syringae pv. syringae B728a
MKTVAQLLKLKDLQNQQVHTIGPDQMVLDALKLMAEKNIGALPVVEGNVVVGVISERDYARKVVLKGRSSVGTPVRDIMSSKVITVDSQRSVEACMGIMTDSHLRHLPVVEGGQLLGLLSIGDLVKEAIAEQANLIQQLEQYIRGE

SEQ ID NO: 11433 - protein, 478 aa, Leptospira interrogans serovar Lai str. 56601
MPCMKILNRKKTKIVCTIGPASSSEETILSILKAGMDIARMNFSHGTHDSHKRVYDTLRKCEQIFGFPLGIMADLQGPKIRTGKLKLNSILLHKNQEIEIVPDSDILGDEHKIGCTYPNLIRDIQEEDKILIDDGKLILKVISKKSNSAILKVIVGGILWSNKGINLPGTPISAPALSEKDIEDLKFALSLGVDYAALSFVRTGADLELARSYLEGTYTGLIAKIERPEAIGNIEEIIERADGIMIARGDLGVEIDTEKVPILQKELIYKLNQAGKPVITATQMLESMIENPRPTRAEASDVANAVMDGTDAVMLSAESANGHYPVESVEIMSKIIQETETIDHIYEIHWNIKKTFLESERTALGNAAREIAHGIHAKAIVNFTRSGYSALITSEMRPKVPIYSFTPFATTARKMKLYRGVVPFVMPFFTRLEDMIAYMNQKLKEDEFLFPGDKVVILSGAPGTTVRSVDFLQVYKIH

SEQ ID NO: 11434 - protein, 468 aa, Pseudomonas syringae pv. tabaci
MSKSVQLIKDHDVKWIDLRFTDTKGTQHHVTMPARDALEDDFFEVGKMFDGSSISGWKGIEASDMILLPDDETAVLDPFTEEPTLILVCDIIEPSTMQGYDRDPRAIARRAEEYLKSTGIGDTVFAGPEPEFFIFDEVKFKSDISGSMFKIFSEQGSWMSDQDVEGGNKGHRPGVKGGYFPVPPFDHDHEIRTAMCNALEEMGQTVEVHHHEVATAGQNEIGVKFNTLVKKADEVQTLKYVVHNVADAYGRTATFMSKPLYGDNGSGMHVHMSIAKDGKNTFAGEGYAGLSDLALYFIGGIIKHGKALNGFTNPSTNSYKRLVPGFEAPVMLAYSARNRSASIRIPYVNSPRGRRIEARFPDPSANPYLAFAALLMAGLDGIQNKIHPGDAADKNLYDLPPEEAKEIPQVCGSLKEALEELDKGRAFLTKGGVFSDDFIDAYIALKSEEEIRVRTFVHPLEYELYYSC

SEQ ID NO: 11435 - protein, 1156 aa, Vitis vinifera
  misc_feature (338)..(338): Xaa can be any naturally occurring amino acid
MGEESLATVPFDRAVEQAIVTLKKGAYLLRCGRRGKPKFCPFRLSTDEKFLIWYSGQEEKQLRLSSITKIIPGQRTVNFQRQLQEERECRSFSLVYANGERSLDLICKDKAQADSWFLGLKAVISRCQHPRQLSTFRNCVGVQTCFNSPAGYFRRKHNLGLLEDTPKFSQVRSLCGSPTQSLSERCFSDGLSYSADSFYSSESSVSNVKNVVDVSLPSSPYVEPDHLKQGEEIYAGTEIQTDMLSQVAAPSHASPQMEKNDILRDVMIWGEGIEGGILGGGVYRFGNQNGMQSDALLPKLLESTTMLDVREISLGGKHAALVTKHGEVFCWGEGSGGXLGHKVNMDMGNPKIVESLTGVLVKSVSCGEYQTCALTHSGELYTWGDNGSGIDLVGERRKRSQWIPSRLSGPLNGTSISNVACGEWHMAIVSTSGQLFTYGDGTFGVLGHGKLESISQPKEVESLSGLWVKAAACGPWHTAAIVEVRADRLKFNTKGGKLFTWGDGDKGRLGHGDQERKLLPTCVAQLVDHDFVQVSCGRMLTVGLTCLGTVYTMGSAVHGQLGNPQAKDKSIAIVGGKLKDEFVKEISSGSYHVAALTSKGSLYTWGMGANGQLGLGDTEDRNSPAVVEALRDRQVESIACGSGFTAAICLHKSISSTDQSACSGCRMAFGFTRKKHNCYNCGLLFCRACSNKKVLNASLAPNKKKPFRVCDPCYTYLQRIKHSSRLLKLENHNPRQLLMTQKTSFDEKEDRGEGTPARTQFSSVGQPCNEASQSYEKKPFKNQVENQQTVEPVSSLSNGLPRWGQVPCPFLFEKYCRENSIALVPLSNNQLSSVPLCWKHSPRGSKYMVSTVVNMEKDFPDTDKILIEEVERLRSEARSLEKLCQMRSEKIQECQQKLQETWSLAREEAAKCKAAKEVIKALSSRLHTMSEKLSSERDAKDGIDSKLPQIITRYVDTPKERQLDSLCGSPIVFSNSLRSMYGRDECQGHTRSVEDSCLEKIDPRQNGTKPSKLEWVEQYEPGVYITFITLASGQRGLKRVRFSRKRFTEKEAERWWEENQIGVYQNYGIEGYISSSQNKMKDKGEIFFVFKSPSTCSYAVQCIVVNKEKQRIYMVVLLNKIKSSVYLNVEQFCYFPYVEITAIPPIYQRPINHTSA

SEQ ID NO: 11436 - protein, 534 aa, Physcomitrella patens subsp. patens
MAAGTACVYTSCSSIKCVQEGCGRTWQQLNVATIPSLPRSAFCGKKLASSLKAQAWLPVAPLKRRNDSKHALKVSSVLMEPRPLENTIVGTGEEKRVDPRTVLSIILGGGAGTRLYPLTKRRAKPAVPIGGGYRLIDVPMSNCINSGINKVFILTQFNSTSLNRHLARTYNFGKINFGDGFVEVLAATQTPGDRGADWFQGTADAVRQYLWLFEDAKNKVVEDVVILSGDHLYRMDYMDFVQKHRDSGADITISCVPMDDSRASDYGLMKIDGEGRVMSFSEKPKGDDLKKMQVDTTILGLSPEEAAEKPYIASMGIYVFKKDVLMKLLRWRYPTANDFGSEIIPASAKEFNVQAYLFNSYWEDIGTIKSFFDANLALTAQPPQFSFYDAAKPIFTSPRYLPPTSIEQCMVKDSIISHGCFLKKCSVEHSIVGVRSRLESGSVLKDTMMMGADFYDTEKEVADMLRNGKIPLGVGENSRISNCIIDKNARIGKNVVIANTDNVQEATRPELGFYIKTGVTVIEKNGIIKDGTVI

SEQ ID NO: 11437 - protein, 208 aa, Yersinia pestis
METKDLIVIGGGINGAGIAADAAGRGLSVLLLEAQDLACATSSASSKLIHGGLRYLEHYEFRLVSEALAEREVLLKLAPHIAFPMRFRLPHQPHLRPAWMIRTGLFLYDHLGKRTSLPASKGLRFGPESVLKPELVRGFEYSDCWVDDARLVVLNVQEVVKHGGEVRTRTKVTRTWREQGLWMVEALDVNTGKTFTWRAKGLVNATGP

SEQ ID NO: 11438 - protein, 142 aa, Triticum aestivum
  misc_feature (4)..(4): Xaa can be any naturally occurring amino acid
  misc_feature (11)..(11): Xaa can be any naturally occurring amino acid
VNDXIGASNSXDATLNDILDKDVENDSVKKQGSHSRNLRRVRLGLGLIKALFEQFLATEGGSLYDAATTAYGQVCAPFHSWAIRKAVGAGMYTLPSREQLIMRLNETDCSVQKEMRRYIDASSPIIEYIDNLFLSRNIVLDW

SEQ ID NO: 11439 - protein, 339 aa, Physcomitrella patens subsp. patens
MIRRLHHRRHTVLIPESPWKSGGRSNQPSFHTTCPLLKREELEAACEDFSNIIGSSPDGFLYKGTLSDGTEIAVTSIRMCAADWSPKYELSFRRKVEGLSRMKHKHLVNLVGYCVEEEPFTRMLVFEYASNGTLSDHLHNPKEMEHLDWPTRMRVIMGAAYGLEYMHHDLTPPCSHLNFDANAIYLTDEHSAKIANFGIARMSAGNPKQDQMLHGCNSWMGCTGNMYDFGVFILQTISGRPPYCELEQENLVNWAERYLSDPKLMLHLVDPELKLHNAQELVALCKIVQMCLSDKGYKRPSMRKVSRMLAEALNMTPEAATMRASPLLWAQLSILDDST

SEQ ID NO: 11440 - protein, 493 aa, Catharanthus roseus
MDYLTIILTLLFALTLYEAFSYLSRRTKNLPPGPSPLPFIGSLHLLGDQPHKSLAKLSKKHGPIMSLKLGQITTIVISSSTMAKEVLQKQDLAFSSRSVPNALHAHNQFKFSVVWLPVASRWRSLRKVLNSNIFSGNRLDANQHLRTRKVQELIAYCRKNSQSGEAVDVGRAAFRTSLNLLSNLIFSKDLTDPYSDSAKEFKDLVWNIMVEAGKPNLVDFFPLLEKVDPQGIRHRMTIHFGEVLKLFGGLVNERLEQRRSKGEKNDVLDVLLTTSQESPEEIDRTHIERMCLDLFVAGTDTTSSTLEWAMSEMLKNPDKMKKTQDELAQVIGRGKTIEESDINRLPYLRCVMKETLRIHPPVPFLIPRKVEQSVEVCGYNVPKGSQVLVNAWAIGRDETVWDDALAFKPERFMESELDIRGRDFELIPFGAGRRICPGLPLALRTVPLMLGSLLNSFNWKLEGGMAPKDLDMEEKFGITLQKAHPLRAVPSTL

SEQ ID NO: 11441 - protein, 151 aa, Triticum aestivum
GVCPICATRVGMDLIGHLTMQHGSYFKMQRRRRVRKVSTGSHSLLSLLRKDLRNGSLQSFLGGSSYVSNPPAAAPDPFLSSLICSLPVAEPSKDLHSDSSDNNFLLNKFPDEKTVERAEPSLSEKDQKERIQRSKFVRGLVLSTIFDDDNL

SEQ ID NO: 11442 - protein, 486 aa, Synechococcus sp. WH 8102
MWMAGGFTEQSQRFRPSSKEEHVVQKAEEHFERTLITIRGELAGSVAALEHPSDDEALNYGEIFLRDNVPVMIYLLLKRRFSIVRQFLTVCLDLQSTSVQTRGVFPTSFVEENEELVADYGQRSIGRITSVDASLWWPILCWIYVKRSGDTEFGRSAEVQRGLQLLLDLVLHPSFEGTPVLFVPDCAFMIDRPMDVWGAPLEVEVLLFAALRSSIELMELCQRHESSVLLEERLRLSRRWMHDLRQYLLKHYWVTSKTMQVLRRRPTEQYGDNQYQNEFNVQPQVIPDWLQDWLDNRGGYLIGNMRTGRPDFRFYSLGNSLACLFGLLTAPQQRALFRLVQHNRQHLMAQMPMRICHPPMEGVEWENKTGSDPKNWPWSYHNGGHWPSLLWYFGGSILLHERIHPHADMLLMTQMKTLVEECYWSQLNQLPRQQWAEYFDGPTGTWVGQQSRTYQTWTIVGFLLLHHFLRVEPNDVLMLHLDAGLS

SEQ ID NO: 11443 - protein, 133 aa, Brassica napus
MGIGEHFEGVKQHWVRNFAFLDYFKKVYGRDQPLPKWSDADVEEFIASDPVYGPQLKALRESRKFALGGALAGAAHLGGVAFKYSKSPHGVVLATGFGALTGAVLGSEVAEHWYELYKMDKQGANLRFIYWWE

SEQ ID NO: 11444 - protein, 223 aa, Populus trichocarpa
MSPAVPLSEIQIENVTFPPAVKPPASNNTLFLGGAGVRGLEIEGKFIKFTAIGVYLEDNSLQSLAAKWKGKIAKELTDSVEFFRDIVRGPFEKFMRVTMILPLTGLQYSEKVAENCVSIWKSLGIYTDAEAKAIEKFREVFKEETFPPGSSILFTLSPHGSLAISFSKDGSVPEIENAVIENKLLSEAVLESMIGKHGVSPAAKQSLATTLSELLKESNENGN

SEQ ID NO: 11445 - protein, 278 aa, Brassica napus
  misc_feature (105)..(105): Xaa can be any naturally occurring amino acid
MNNIILFVSCLALASSALAADETETEFHYVTGAYADPSKWSSVKQEWKICGVGKRQSPVNLSPKVARLVHNSTALIQTYYKPVEATLKNRGYDMAVSWQEDAGKXVINNTDYKLIQSHWHAPSEHFLNGKRLAMELHMVHKSADGHLAVIGVLLREGEPNAFISRIKDKINSIADILQGEASIGKIDPREFGWDLTKFYEYRGSLTTPPCTEDVIWTIVNKVGTVSRQQIDILVDARRAGYETNARPAQPLYLPGGRPDAQSQHTGGRTSGSSSDQLA

SEQ ID NO: 11446 - protein, 188 aa, Vitis vinifera
MTSYLLKSLTKNPLSPSSPTLKSLLVSSLRSYAKASQKERVIVPEPEPEPERLDDVVPTSGISRPLSEILKELSKKVPDTLVKVRTEDGFSIKYIPWHIVNRIMNLHAPEWSGEVRSITYSADGKSVSVVYRVTLYGTDAEMYRESTGTALVEDTGYGDPVQKAEAMAFRRACARFGLGLHLYHEDML

SEQ ID NO: 11447 - protein, 441 aa, Brassica napus
  misc_feature (183)..(183): Xaa can be any naturally occurring amino acid
MSNIDIEGILKELPNDGRIPKTKIVCTLGPASRTVPMIEKLLRAGMNVARFNFSHGSHEYHQDTLNNLRTAMQNTGILAAVMLDTKGPEIRTGFLKDGNPIQLKEGQEITITTDYDIQGNESTISMSYKKLPLDVQPGNTILCADGSISLAVVSCDPESGTVRCRCENTAMLGERKNVNLPGXVVVDLPTLTDKDIEDILGWGVPNGIDMIALSFVRKGSDLVNVRRVLGSHAKSIMLMSKVENQEGVVNFDEILRETDAFMVARGDLGMEIPIEKIFLAQKLMIYKCNLAGKPVVTATQMLESMIKSPRPTRAEATDVANAVLDGTDCVMLSGESAAGAYPEIAVKVMAKICIEAESSLDYNTIFKEMIRATPLPMSPLESLASSAVRTANKAHAKLIIVLTRGGSTAKLVAKYRPSVPILSVVVPVMTTDSFDWTCSDE

SEQ ID NO: 11448 - protein, 172 aa, Clostridium tetani E88
MDLKDKIRVIQGFPKEGISFKDVTTILQEKEAFKYTIDTLVEELKDKNVDVVVGPEARGFLFGAPLAYALGAGFVPVRKKGKLPSTTISSKYELEYGSDELEMHKDSIKPGQRVVIADDLLATGGTICSVIEMIESLGGEIVSINFLIELTDLKGREKLGKYDISSLVQYDI

SEQ ID NO: 11449 - protein, 411 aa, Zea mays
MNALAATSRNFKQAAKLVGLDSKLEKSLLIPFREIKVECTIPKDDGTLASYVGFRVQHDNARGPMKGGIRYHHEVDPDEVNALAQLMTWKTAVANIPYGGAKGGIGCSPGDLSISELERLTRVFTQKIHDLIGIHTDVPAPDMGTNSQTMAWILDEYSKFHGYSPAVVTGKPVDLGGSLGRDAATGRRVLFATEALLAEHGKGIAGQRFVIQGFGNVGSWAAQLISEAGGKVIAISDVTGAVKNVGGLDIAEVVKHSAENKGIKGFKGGDAIAPDSLLTEECDVLIPAALGGVINKDNANDIKAKYIIEAANHPTDPEADEILSKKGVLILPDILANSGGVTVSYFEWVQNIQGFMWDEEKVNAELQTYMTRAFGDVKQMCRSHSCDLRMGAFTLGVNRVARATVLRGWEA

SEQ ID NO: 11450 - protein, 472 aa, Neisseria gonorrhoeae FA 1090
MSIKNAVKLIEESEARFVDLRFTDTKGKQHHFTVPARIVLEDPEEWFENGPAFDGSSIGGWKGIEASDMQLRPDASTAFVDPFYDDVTVVITCDVIDPADGQGYDRDPRSIARRAEAYLKSSGIGDTAYFGPEPEFFVFDGVEFETDMHKTRYEITSESGAWASGLHMDGQNTGHRPAVKGGYAPVAPIDCGQDLRSAMVNILEGLGIEVEVHHSEVGTGSQMEIGTRFATLVKRADQTQDMKYVIQNVAHNFGKTATFMPKPIMGDNGSGMHVHQSIWKDGQNLFAGDGYAGLSDTALYYIGGIIKHAKALNAITNPSTNSYKRLVPHFEAPTKLAYSAKNRSASIRIPSVNSSKARRIEARFPDPTANPYLAFAALLMAGLDGIQNKIHPGDPADKNLYDLPPEEDALVPTVCASLEEALAALKADHEFLLRGGVFSKDWIDSYIAFKEEDVRRIRMAPHPLEFEMYYSL

SEQ ID NO: 11451 - protein, 298 aa, Klebsiella pneumoniae subsp. ozaenae
MNMANLKAVIPVAGLGMHMLPATKAIPKEMLPIVDKPMIQYIVDEIVAAGIKEIVLVTHSSKNAVENHFDTSYELEALLEQRVKRQLLAEVQAICPPGVTIMNVRQAQPLGLGHSILCARPVVGDNPFVVVLPDIILDGGTADPLRYNLAAMIARFNETGRSQVLAKRMPGDLSEYSVIQTKEPMVAEGQVARIVEFIEKPDEPQTLDSDLMAVGRYVLSADIWAELERTEPGAWGRIQLTDAIAELAKKQSVDAMLMTGESYDCGKKMGYMQAFVTYGMRNLKEGAKFRESIKKMLA

SEQ ID NO: 11452 - protein, 332 aa, Rhizobium sp. NGR234
MNELSNLSLESIERARERIEEHVFRTPLTTSRSLTELTGTQVSLKLEHYQRTGSFKLRGATNAILQLSPSDRARGVIAASTGNHGRALSYAAKAVGSRATICMSDLVPENKVSEIRKLGATVRIVGSSQDDAQVEVERLVAEEGLSMIPPFDHPHIIAGQRTVGLEIVEAMPDVAMVLLPLSGGGLAAGVAAAVKALRPHARIIGVTMDRGAAMKASIEAGHPVQVKEYRSLADSLGGGIGMANAWTFQMCRALLDDVVLVNEGEIAAGIRHAYEHERQILEGAGAVGIAALLSGKVAARGGSVGVVLSGQNIDMGLHREVINGVVRATEED

SEQ ID NO: 11453 - protein, 467 aa, Rhodobacter sphaeroides
MSKVADALKLMKDEEVEYVDIRFTDPRGKLQHVTLVADLVDEDFFEEGFMFDGSSIAGWKSIDQSDMKLIPDAGSVYIDPFYAEKTLCVHCNVVEPDTGEAYSRDPRGAAVKAEAYLKASGIGDVAYFGPEAEFFIFDDVRYSVTPAKVAYQIDADAGAWNTDSEYEMGNLAHRAGHKGGYFPVNPIDEAQDLRGEMLSTMKRMGMKVDKHHHEVATCQHELGLIFGGLTEQADNILKYKYVIHNVAGMHGKTVTFMPKPMKGDNGSGMHVNMSIWKEQALFAGDKYADLSQEALWFIGGILKQPSVNALTNPATNSYKRLIPGFEAPVLRAYSARNRSGCVRIPWTESPNAKRVEARFPDPSANPYLAFAALLMAGLDGIKNKIDPGPASDKDLYDLPPEELAAIPTVCGSLREALEELEKDHDFLLAGDVFTKDQLEGYMALKWEEVYAYEHTPHPVEYQMYYSC

SEQ ID NO: 11454 - protein, 208 aa, Yersinia pestis
METKDLIVIGGGINGAGIAADAAGRGLSVLLLEAQDLACATSSASSKLIHGGLRYLEHYEFRLVSEALAEREVLLKLAPHIAFPMRFRLPHQPHLRPAWMIRTGLFLYDHLGKRTSLPASKGLRFGPESVLKPELVRGFEYSDCWVDDARLVVLNAQEVVKHGGEVRTRTKVTRAWREQGLWMVEALDVNTGKTFTWRAKGLVNATGP

SEQ ID NO: 11455 - protein, 572 aa, Bacillus pumilus SAFR-032
MQQLKGIGASAGVAIAKAYRLEEPDLTVHQKDINDPETEVKRFEEAIHVSKQELEAIKEHALKELGQDKADIFSAHLLVLSDPELLNPVKDKINSDKVNAEFALKETATMFVTMFEAMDNEYMKERAADIRDVTKRVTGHLLGVDIPNPSMISEEVIIIAEDLTPSDTAQLNRQFVKGFATDIGGRTSHSAIMARSMEIPAVVGTKEATKTVKNNDLIIVDGISGDVIIQPSEDEVKAYQKKHEDYLAQKAEWAKLVDQPTVTKDGVHVELAANIGTPEDVKGVLENGGEAVGLYRTEFLYMGRDQLPTEEEQFDAYKTVLEKMEGKAVVVRTLDIGGDKELPYLQLPKEMNPFLGYRAIRLCLEEQEIFRTQLRALLRASTYGNLKIMFPMIATLSEFREAKAILLEEKEALVAAGTDVSDSIEIGMMVEIPSTAVIADQFAKEVDFFSIGTNDLIQYTMAADRMNERVSYLYQPYNPAILRLITLVIEAAHKEGKWVGMCGEMAGDEIAIPLLLGLGLDEFSMSATSILPARTQLSKLSKEEAASFKEHILSLSTTEEVVDFVKKTFQHN

SEQ ID NO: 11456 - protein, 103 aa, Zea mays
MAAAALRPAILRRIRLSPSPSLTRDEVIDRILDVIKSHPKIDPSKVTPEAHFEKDLGLDSLDTVEVVMAIEEEFKLEIPDMEADKIDSLPLAIEYVANHPMAG

SEQ ID NO: 11457 - protein, 776 aa, Ustilago maydis 521
MHAVAFAASPIRLDTMQAANSHSVVTQGDLEFLDALTSMPSSFPHQPNYASSSSSSARTRPLSTLNALRRPPIDPMVLAASLSSGPHVTRHHFHHSFGSHAHTTKSQQMPASQRKAAAAAAAAAAASDAPPRASSRPVQTRPRKPSGASGSYANCDYDDFEDPASNVNVASSSSIKVDPVPEVTDEERSYYASRQAPRTVRLQQQQQHELEQKRAQAQVQAALPADVRNQASTQAVGIRASDEPAQPELPAQPGNQAAKTVLVPPSAPADTIAQALDQRKAAVAAATVAPTQIPLTPAAETLASMPTQVGTPLGNPGMSSIVRPPPVRVRCYARTRVPTPHGEVFCHLYKNTHDTKEHLAIVIDPYQNDEASTRMGPDGRPVKESDPLYQQHALRSKSLDEVWGSEETDMERIVRGAYVGRLGPSFQVASKPLARHSQPHMHSNSADTLAPLVRIHSECFTGETIGSQRCDCGEQLDEAIRLISEAYDTSKPRDPGAAQQKLGRGVIVYLRQEGRGIGLLDKLMAYNLQDMGHDTVSANILLGHLPDARKYDIASAILKDLGVDECRLLTNNPEKMEALEAEGVRVAERVGMVPRVWKFGKKLRRRKKGGKRKEKGGSARGSPLRAATGARKASSLLRQISFGGMDASIISQAGTSDSEVDPTTAGLRHQGEDIVNPHDTFESDDDQIDDSEAEDSASDSGDSYIDHVLRRSGTTMIGASITKGPELEKYLRTKVQRMGHLLTVPDESPDTHDHRPVSQPDSDHESSHLPTTNNPS

SEQ ID NO: 11458 - protein, 327 aa, Neisseria meningitidis MC58
MAAYDSLMVFTGNANPELAQRVVRHLDISLGNASVSKFSDGEVAVELLENVRGRDVFILQPTCAPTNDNLMEILTMADALKRASAGRITTAIPYFGYARQDRRPRSVRVPISAKLVANMLYSAGIDRVLTVDLHADQIQGFFDIPVDNIYATPILLNDIKQQRIENLTVVSPDIGGVVRARAVAKSLNADLAIIDKRRPKANVAEVMNIIGDIQGRTCLIVDDMIDTANTLCKAAVALKERGAERVLAYASHAVFSGEAVSRIASSEIDQVVVTDTIPLSEAAKNCDRIRQVTIAGLLAETVRRISNEESVSYLFNEEVMTGSMLLP

SEQ ID NO: 11459 - protein, 388 aa, Pseudomonas aeruginosa PAO1
MRALTFHGSHDVRIDRVAEPRLQEPDDLLLRVTATAICGSDLHLYRGKIPMVEQGDILGHEFMGVVEEVGSAVTAVRPGDRVVVPFVIACGECFFCRLNLHAACETTNPGRGAILNKKQIPPGAALYGYSHLYGGVPGGQAEYVRVPKANSGPFVIPDVMEDERVLFLSDILSTGYQAVRNAGVRQGSSVAIYGAGPVGLMAAACARMLGAERIFIVDHHPYRLDFAARTYGAIPIDFDQEDDPAAAIIERTDGHRGVDAVIDAVGFEAKGSVTETVLTALKLEASSGKALRQCIAAVRRGGTVSVPGVYAGFIHGFLFGDAFDKGLTFKMGQTHVQALLPALLEHIGNGDLHPEAIISHRLRLDDAPEGYALFDEKREDCRKVVLRP

SEQ ID NO: 11460 - protein, 209 aa, Brassica napus
MAGMIMMNEHVAEKLCSELQELEREKAEETNTPLRQYDTEDFKSFNERVTQFAGMLSYDSLGKLHYLHAVVTETLRLYPAVPQDPKGVLEDDILPNGTKVKAGGMVTYVPYSMGRMEYNWGSDAAMFKPERWLKDGMFQNASPFKFTAFQAGPRICLGKDSAYLQMKMAMAILCRFYRFHLVPNHPVKYRMMTILSMAHGLKVTVSRRS

SEQ ID NO: 11461 - protein, 335 aa, Nocardioides sp. JS614
MSAGKVAVFSAGSWGTAFSIVLADAGNDVTLWARREEVAAAITEQRENPEYLPGVELPPQVSATHDVEKALHGADLVVLATPSQSLRANLSEWAPYVEPNAVLVSLMKGVELGTLERMSQVIAEVTGAGPERIAVISGPNLAKEIARREPAASVVACEHEEVARQLQARIHSPAFRPYTSVDVLGCEVGGAYKNVVALSVGMAVGLGFGDNTTASVITRGLAETARLATALGANPMTLMGLAGLGDLVATCSSPLSRNRTFGEKLGQGMTAAEIYATTRQVAEGAKSCASLLALAERTGVDAPIAHHVTAVVDGRMTAQEMMDSFIARDTKAETD

SEQ ID NO: 11462 - protein, 508 aa, Neisseria meningitidis MC58
MNTPLPYSDYLIRILTASVYDVAVETPLEPARSLSVRLKNNILLKREDLQPVFSFKIRGAYNKMSKLPKDALACGVIAASAGNHAQGVALSAQRLGCRAVIVMPETTPKIKVDAVKSHGGEVVLRGVSYNDAYDYAMELAEKEGLTYIAPFDDPDVIAGQGTVGMEIVSQHPDPIRAVFVPIGGGGLAAGVAAFIKQVRPEIKVIGVQTNDSCCMKQSVEAGEIVHLKDVGLFSDGTAVKVVGNETFRLCKELLDEIITVDTDAVCGAVKDIFDDTRSITEPAGALALAGLKAYIAREGAENQTLIAVTSGANMNFHRLRHVSERSELGEGNEGIFAVTIPEERGSFLKFVNILGNRNITEFNYRYGDDEKAHIFVGLQAAGPQDLAVIGSRLDEAGLPNVDLTNNEIAKIHIRYMVGGRTDKVENERLVSFEFPERPGALARFLNHMQGGWNITLFHYRNHGADYGRILVGIDVPPHDAAAFDGFLESLGYSYHEETQNAAYKLFLA

SEQ ID NO: 11463 - protein, 364 aa, Oryza sativa
MSQPKTHKIALLPGDGIGPEVCAEAVKVLEAVGALRGHTFAFERALCGGASYDVHQSHLPQETIDIVARSDAVLFGSVGGPPDAQEDPKWKDAEKNCLLGLRKNFGLAVNIRPAKIYSMLPDLSPLKPSLIASGVDMVIVRELISGIYFGEHATNGDVATDVMRYTEAEIKIPMRFAFETAMSRTKKLTVVDKANVLDCSRLWRKVAKEMHAEFPQVALEFMYIDNAVMQIIQKPSHFDVIATGNMFGDILSDAASVLPGSLGLMPSASLGDKIHLFEPIGGSAPDIAGKGVANPIAQILSAALLLRYSFALEAEAQLIEKAVEDVLQDGLRTGDLTHDRASAVGTAAMGDAIVAKIHALHQQQ

SEQ ID NO: 11464 - protein, 222 aa, Brassica napus
MDSVRLPTAPSSLRSQMLGQPLHRIPLPPCNGRSNLRFKPVIGTNLSRENHVSPVAVITRDETSVAPLASPQPRLKVSPSSLQYPAGYLGAVPERASDPENGSIAEAMEYLTNILSTKVYDVAIESPLHLAKKLSERLGVRLFLKREDLQPVFSFKLRGAYNMMVKLPAEQLAKGVICSSAGNHAQGVAWSAAKLGCTAVIVMPRTTPEIKWPSGENWGATV

SEQ ID NO: 11465 - protein, 206 aa, Bacillus sp. SG-1
MKIYDITAPIYNGMPVYKNKPEKQPEINTNTNGHVTESRISMDVHTGTHVDAPLHMINDGETIESIDIQQLVRPVKVLDLTSVEEKITKKDIENQDIQENDFLLFKTKNSWDTEFNFEFIYVAEDAAEYLKEKKIAGTGIDSLGIERAQEGHPTHRALMGSGIIIMEGLQLKDIEEGTYFMVAAPLKIQGTDASPARVILMDELIG

SEQ ID NO: 11466 - protein, 411 aa, Zea mays
MNALAATSRNFKQAAKLVGLDSKLEKSLLIPFREIKVECTIPKDDGTLASYVGFRVQHDNARGPMKGGIRYHHEVDPDEVNALAQLMTWKTAVANIPYGGAKGGIGCSPGDLSISELERLTRVFTQKIHDLIGIHTDVPAPDMGTNSQTMAWILDEYSKFHGYSPAVVTGKPVDLGGSLGRDAATGRGVLFATEALLAEHGKGIAGQRFVIQGFGNVGSWAAQLISEAGGKVIAISDVTGAVKNVDGLDIAQLVKHSAENKGIKGFKGGDAIAPDSLLTEECDVLIPAALGGVINKDNANDIKAKYIIEAANHPTDPEADEILSKKGVLILPDILANSGGVTVSYFEWVQNIQGFMWDEEKVNAELRTYMTRAFGDVKQMCRSHSCDLRMGAFTLGVNRVARATVLRGWEA

SEQ ID NO: 11467 - protein, 613 aa, Rubrobacter xylanophilus DSM 9941
MLSGASLAIEAGEKVGLVGRNGAGKTTLLEILAGRLRPDEGSVEYPGGARVGMTDQSLYAGERGRSTLEEEITSAFAPLMRRESELRELEERISGDPSGELLERYGRLQGEFERDGGYSYRARAASAISGLGFDPEDWRRPLASFSGGEQSRIALARLLLEEPDLLLLDEPTNHLDLKAMEWLEGFLKGLRSAVLVVSHDRHFLDAVADSILELEDGRLERYPGNYTRYAAEKAAREERLARKAKANAERRAQLERFIERNRAKARKASQAKSKQKLLERMEKVEPPRRKARRGMRLELGGASRTGRVVLEMEDVAYAHGDGEAVISGADLVIERGEKVALVGPNGAGKSTLMRLAAGQLSPQRGSVNLGHNVRPAYQDQQLTGLDDGKTLLRETMDKTGLDPDEARDLLGAFLFSGDDVFKKVGSLSGGERSRLALAEIVAGEANLLLLDEPTNNLDIPSREALEEALAGYGGTVLLISHDRYLLRRVATRIIELEGGGLRDYPGGYDYYRSHRRVEAREPGGRRGRRSRIQPGQSPQQSVLAARLVAVEGEIEAVERRINRLEKELATADLYADGRRSREVVLEHRELKGVLERLYADWGELLEEAEEAGL

SEQ ID NO: 11468 - protein, 310 aa, Streptococcus mutans UA159
MTVKSVKVKSYANIAIIKYWGKTNTKKMIPATSSISLTLENMYTETRLTLLRNAEADEFYIDHILQNEAEHRKISKVLDFFRKETPFFVKVETSNNMPTAAGLSSSSSGLSALVKAANIFFETNATQEELAQIAKFASGSSSRSFFGPLTAWDKDSGEIYPVPSDLKLAMIMLVLNDTRKPISSRQGMQRCSETSTNFADWIAQSEKDYVAMLDYLKAADFEKVGDLTEANALAMHATTRTANPPFSYLTKASYQAMERVKELRRQGERCYFTMDAGPNIKVLCLEKDLERLSRIFAQDYQIIVSKTKEL

SEQ ID NO: 11469 - protein, 637 aa, Triticum aestivum
  misc_feature (393)..(393): Xaa can be any naturally occurring amino acid
  misc_feature (492)..(492): Xaa can be any naturally occurring amino acid
  misc_feature (498)..(498): Xaa can be any naturally occurring amino acid
  misc_feature (552)..(552): Xaa can be any naturally occurring amino acid
RGRGRGLFSTASFLLGAITSLVSGFLGMKIATYANARTTLEARKGVGKAFITAFRSGAVMGFLLSSSGLVVLYITINVFKMYYGDDWEGLFESITGYGLGGSSMALFGRVGGGIYTKAADVGADLVGKVERNIPEDDPRNPAVIADNVGDNVGDIAGMGSDLFGSYAESSCAALVVASISSFGINHDFTAMCYPLLVSSVGIIVCLLTTLFATDFFEIKAASEIEPALKKQLIISTALMTIGVAVISWLALPAKFTIFNFGAQKDVSNWGLFFCVAVGLWAGLIIGFVTEYYTSNAYSPVQVDADSCRTGAATNVIFGLALGYKSVIIPIFAIAVSIYVSFSIAAMYGIAMAALGMLSTMATGLAIDAYGPISDNAGGIAEMAGMSHRIRERXDALDAAGNTTAAIGKGFAIGSAALVSLALFGAFVSRAGVKVVDVLSPKVFIGLIVGAMLPYWFSAMTMKSVGSAALKMVEEVRRQFNTIPGLMEGTAKXPDYATXCVKISTDASIREMIPPGALVMLTPLIVGTLFGVETLSGVLAGALVSGVQIAISXASNTGGAWDNAKKYIEARQQRTNKGPLAPRVQTCHKAAVIGDTIGDPLKDTSGPSLNILIKLMAVESLVFAPFFATYGGVLFKYI

SEQ ID NO: 11470 - protein, 559 aa, Legionella pneumophila str. Paris
MCSIGEYLAKRLEELNISEYFAIPGDYNLILLDEVLKNEKLKMINCCNELNAGYAADGYARVKGVSALFVTYSVGGLSTVNAVAGAYAENLPILVISGGPNTNSIQDAEILHHTLATEDNLYVRDIFSRITAHVVCIRKPEQAAMQIDEAIAIAIAKKKPVYIEIACNIANYPISKPTQRAFNTYKISDSSSLAAAVEHAAEKLNSALKPSLIVGSKVRHCNAINSVSELAKCTGYAMAAMPDAKGFISEQHPNFIGIYWGPVSSSGCAEIIDSSDAYLLIGPNENDYTTVGYVWGINPHKSIKTTKGGVIIGETVYTNIFMNDFLRELSKKLKFNDASYKAYKRIAEETVVYPELDQPDAPLSSRYLFGQIQKMLSDKKALLAETGDSWFNCMRLSLPEGCPFEIQMQYGSIGWSVGALLGMQAALHNQKRVIACIGDGSFQMTAQEISTMIRYGYKPIIFLMNNACYTIEVQIHDGPYNVINNWRYAELVNVFRGEQSNAKSFVVKTNKELLTAIKQAEKTDALCFIEVFLDKDDCNKNLLEWGSRVANYNSRPPRR

SEQ ID NO: 11471 - protein, 99 aa, Odontella sinensis
MATYKVTLLSEEHDIDATIDCNDDVFLLDAAEEQGIELPYSCRAGACSTCAGKVTEGDIDQSEQTFLDDDQVGAGFVLTCIAYPKSDCTVLVHQEDELY

SEQ ID NO: 11472 - protein, 262 aa, Arabidopsis thaliana
MEEIADKTFFRYCLLTLIFAGPPTAVLLKFLQAPYGKHNRTGWGPTVSPPIAWFVMESPTLWLTLLLFPFGRHALNPKSLLLFSPYLIHYFHRTIIYPLRLFRSSFPAGKNGFPITIAALAFTFNLLNGYIQARWVSHYKDDYEDGNWFWWRFVIGMVVFITGMYINITSDRTLVRLKKENRGGYVIPRGGWFELVSRPNYFGEAIEWLGWAVMTWSWAGIGFFLYTCSNLFPRARASHKWYIAKFKEEYPKTRKAVIPFVY

SEQ ID NO: 11473 - protein, 467 aa, Rhizobium sp. NGR234
MTIDIKDISEKDRNTVLHPFTQLKDFATGKLREPTIVETGKGIRIQDARGNQLIDGFAGLYCVNVGYGRTEVAEAISRQAYRLAYYHSYAAHTTDELAILSDRLVKMAPGKMSKVFYGMSGSDANETQAKLVWYYNNLRGKPTKKKIISRERGYHGCSVVSGSMTGMSFYHDHMDLPLPQICHTGVPHHYWGANPGETEREFSARRAAELDEMIETLGPDNVGAFIAEPVLGTGGITPPPEGYWEAIQAVLKKHDVLLIADEVITGFGRTGSMFGSQHYGIEPDLITVAKGLTSAYFPLSASIVGEKVYKVLEDGADRVGAFSHGYTYSGHPIGAAAANAVLDIVEKEDLPGNAREVGGYFQAQLKEKFAQLPIVGEVRGVGLMGAIEFVGDRENKKRFDPLLKVGARVSKAARDRGLIARAMPHGDILGFAPPLVTTKEEVDEIVAMAEKAVRSVMDELVRDGQKL

SEQ ID NO: 11474 - protein, 389 aa, Bacillus pumilus SAFR-032
MEHLLNPRVKDIEISGIRTFSNLVSSYEDVVSLTIGQPDFYTPHHVKTAAKAAIDENFTSYTHNAGFLELRQAIQHYIKKKVNLDYEAESEIIVTTGASQAIDAAFRTILSEGDEVILPGPVYPGYEPIIRMCGGKPVHIDTTNAGFKLNAKLIEDALTENTKCVVLPYPSNPTGVTLSEEELKEIAQLLEGKDIFILSDEIYSELTFDRPHHSIASFLKEQTIVINGLSKSHSMTGWRIGFLFASAPIAKHVLKVHQYNVSCASAVSQKAALEAVTNGVDDALIMREQYKKRLDYVYDRLISMGLPVIKPSGAFYIFPSIESFGMSSFDFCMELLESTRLAVVPGSAFSPLGERYVRLSYAYSLETLKEGLDRLEQFVLEKRSIHLTD

SEQ ID NO: 11475 - protein, 326 aa, Arabidopsis thaliana
MLFSGSAIPLSSFCSLPEKPHTLPMKLSPAAIRSSSSSAPGSLNFDLRTYWTTLITEINQKLDEAIPVKHPAGIYEAMRYSVLPQGPKRAPPVMCVAACELFGGDRLAAFPTACALEMVHAASLIHDDLPCMDDDPVRRGKPSNHTVYGSGMAILAGDALFPLAFQHIVSHTPPDLVPRATILRLITEIARTVGSTGMAAGQYVDLEGGPFPLSFVQEKKFGAMGECSAVCGGLLGGATEDELQSLRRYGRAVGMLYQVVDDITEDKKKSYDGGAEKGMMEMAEELKEKAKKELQVFDNKYGGGDTLVPLYTFVDYAAHRHFLLPL

SEQ ID NO: 11476 - protein, 426 aa, Zea mays
  misc_feature (260)..(260): Xaa can be any naturally occurring amino acid
  misc_feature (370)..(370): Xaa can be any naturally occurring amino acid
TVDERSYELLLVPCLFKENKKPSAEGAAAAPQPANRGAARVAGKQNAAAAAAGTRRALGDIGNVVSDALDRAIKLPEGIHRPITRSFGAQLMKAALANKNADAAVAPAQPVAARAVTKPARKVTTKNVPRPGAGQAPKAACGLTEKPKEPIEDIDKFDGDNQLALVDYVEDIYTFYKTAQHESRPIDYMGNQPELSPRMRSILADWLIESHRRFQLMPETLYLTIYIVDRYLSLQPTPRRELQLVGVAALLIACKYEEVXVAQVNDLIHIADGAFNRSQILAAEKAILNSMEWNLTVPTPYHFLLRFAKAAGSADEQLQHTINFFGELALMDYGMVMTNPSTAAACAVYAARLTLGRSPLWTETLKHHTXPQRAADHVSAKTLVGSHAASASPDARLKAVYQKYATEQFGRVALHPPAPAALPDLV

SEQ ID NO: 11477 - protein, 380 aa, Lactococcus lactis
MEDILQITIILFFSMLATLLSKKLKIPEVVGQMLIGIILAPSVLGLINGGHTIEVMSEIGVILLMFLAGLESDLEVLKKNLKPSILVALSGVIIPITIFGIVAFYSGRSISTSLFYGIVFAATSVSITVKVLQEYGYLSTKAGNIILGAAVVDDILAILILSVFKSFKNGEGNLIVQFSMEILFFVFLFFVHKFIPKVWKFINKLPIYAKNTTSALIICLGLSLLADKVGMSAVIGSFFAGIAISQTEVSEIIEEYVSAIGYVIFIPIFFVSIAISISFDVLFEHPFIVILFTLLAILTKFLPAYYSGKVCNLKKSESLLIGTGMVSRGEMSLIVAQIGLSGAIINKNIYSELVIVIILTTLLAPFLIKMVIKKDSTRNI

SEQ ID NO: 11478 - protein, 489 aa, Bacillus sp. SG-1
MIFGATGDLAKRKLFPSLYHLFRKGKIAKNFAVIGVARRELSNEEFQAHVKDSVLTSIGRDENIEEFISHFYYKSNDVSDSDSYIELNQLAAQLDEKYKLEGNRIFYLAMAPEFFGTITDHLKQDGLTDTEGFQRLVIEKPFGHDLESAEVLNNQIRASFSEEEIYRIDHYLGKEMVQNIEVIRFANALFEPLWNNRYISNIQVTSSEELGVEDRGRYYEKSGALRDMVQNHMMQMVALLAMEPPIKLTTDEIRSEKVKVLRALRPMKQEEVKDYFVRGQYDAGSMKGTDVPGYREGSNVDPDSNTETFVAGKLMIDNFRWAGTPFYIRTGKRMKAKSTKIVIQFKDIPMNLYYNTDKQLSPNLLVIHIQPEEGITLHLNAKKTGQNIETTPVKLNYVNNGVDGMNTPEAYEKLLHDCMRGDATNFTHWDEVKLSWAFTDTISNVWENTTEEEFPNYQAGTMGPLAADKLLAQDGFFWWPFSELEVDEC

SEQ ID NO: 11479 - protein, 177 aa, Yersinia pestis
METKDLACATSSASSKLIHGGLRYLEHYEFRLVSEALAEREVLLKLAPHIAFPMRFRLPHQPHLRPAWMIRTGLFLYDHLGKRTSLPASKGLRFGPESVLKPELVRGFEYSDCWVDDARLVVLNVQEVVKHGGEVRTRTKVTRTWREQGLWMVEALDVNTGKTFTWRAKGLVNATGP

SEQ ID NO: 11480 - protein, 539 aa, Zea mays
MERSVDYSSEEECTEDYRRGGYHAVRVGDAFNNGRYIVQSKLGWGHFSTVWLAWDTLNSHYVALKIQKSAQHYTEAAMDEIKILKQIAEGDPDDKKCVVKLLDHFKHSGPNGQHVCMVFEFLGDNLLTLIKYSGYRGLPLPMVKEICFHILVGLDYLHRELSVIHTDLKPENVLLLSLINPSKDPRKSGAPLILPNTKDKAVSNNGTNQDNKILNGDPMKNQKKKMQRKAKVAQGCVEKETSEEAEDYKGLEQEDSGNDVKLSVESVEDKHNSSLSKDESSSSKIFEKDVSQGSHGHRRGSRSMRKKLLEAVDLKCKLVDFGSACWTYKQFTNDIQTRQYRCPEVLLGSKYSTPADLWSFACICFELATGDVLFDPHSGDNYDRDEDHLALMMELLGKMPPKIALGGRYSREFLNRHGDLRHISNLRFWPMDKVLMDKYNFNEQDTNDLVDFLVPILDFVPEKRPTAAQCLSHPWMSAGPRTLESSITTVQPDAINEELSKRRKRETAEKEAVEIGLRNISIKETSEPLKDSQPLKSFK

SEQ ID NO: 11481 - protein, 417 aa, Zea mays
MTDGDDEYKREESVALLVIVFLAALSLLSVIAAFAYYCYITRKVSRRLQAFHIPKRSSSHHTLPPRALPPQQQGTDNPSSNSTRDGVGAAAMSVVAAGERGVQVFSYRQLHAATGGFDRAHMVGQGSFGTVYRGVLPDGRKVAVKLMDRPGKQGEDEFEMEVELLSRLRSPYLLGLIGHCSEGEHCLLVYEFMANGGLQEHLYPNRGSCGGISKLDWDTRMRIALEAAKGLEYLHEHVNPPVIHRDFKSSNILLDKDFHARISDFGLAKLGSDRAGGHVSTRVLGTQGYVAPEYALTGHLTTKSDVYSYGVVLLELLTGRVPVDMKRSPGEGVLVNWALPMLTDREKVVRILDPALEGQYSLKDAVQVAAIAAMCVQPEADYRPLMADVVQSLVPLVKNRSNQKACNPNVQSSKPLD

SEQ ID NO: 11482 - protein, 316 aa, Nocardioides sp. JS614
MNDPLLSLVAMADNVDDIKIAFDESSRMLLRVIIACILFGIALDTTLDDFRRAARRPKAIAVGVGAQFLILPAITFVLTLLLGVGGSVALGMILVACCPPGNVSNIVTHQARGDVALSVSMTAVSNLLAIVLMPLNFALWGNLHPTGGPMMRSIDLDVVDMLIEVLVVIGLPFVLGITAAHLWPRVASRSGKVVGPLAFAALGLLILLALAKNFDLFLTWIGVVAIAVLLHDALALGLGYAIARVFRLPGDATKAMTFEVGVRNAGLGLLLVFSFFDGLGGMALVAAWWGIWDIIAALAVARVWRARTRTPVPARG

SEQ ID NO: 11483 - protein, 900 aa, Arabidopsis thaliana
MAVSSFAVLPPFGSSYSSTTDRSSSSSFYSSSKLLRISQYRFQSNSRCPNVFVSCSLNQPSDDASDAALFLESNSIADYMRFKRRPDPGNGTSELQTAIVSYKKRFPWILLNPFLQVTSPSLLLAGFPFKSIKVDLVSTIHIADKEYFTTLQKELEPYDSILYEMVASKETLENRRNPIASKRLKSSRSRGFSILGFIQRQMARVLTLDFQLDCLDYDTENWYHADLDFETFQLLQKEKGESFFSFARDMTIRSTKAMIQPALVTEGRDTWRSKLLWVSRVFPMPLVGLFLIGAFCADFGDQTSDYPELEALSRLDFGAAMKVFLAKRLTSELTLETSDIEEKSVIIGERNRAATEALRRAIEQGHKRIGILYGGGHMPDLGRRLREEFDLVPSEVRWVTAWSIRNPTDLETSSYPILRKMAEALRWPLNRYQTLALLIFSSVLALDLCFWELFFGSTIDWATQIDPLSAISIPCLVMDSVFSNVARAPEDPILGVTVAYNNDPSPVKINLGVGAYRTEEGKPLVLDVVRKAEQQLVNDPSRVKEYIPIVGISDFNKLSAKLILGADSPAITESRVTTVQCLSGTGSLRVGAEFLKTHYHQSVIYIPKPTWGNHPKVFNLAGLSVEYFRYYDPATRGLDFKGLLEDLGAAPSGAIVLLHACAHNPTGVDPTSEQWEQIRQLMRSKSLLPFFDSAYQGFASGSLDTDAQSVRTFVADGGECLIAQSYAKNMGLYGERVGALSIVRNQTSQFLIRFYSFDIMVCKSADVASKVESQVKLVVRPMYSSPPIHGASIVATILKSSDMYNNWTIELKEMADRIKSMRQQLFEAIQARGTPGDWSHIIKQIGMFTFTGLNKEQVEFMTKEFHIYMTSDGRISMAGLSSKTVPHLADAMHAAVTRLG

SEQ ID NO: 11484 - protein, 391 aa, Vitis vinifera
MVGSGGSDRSKEAVGMMALHDALRSVCLNSDWTYSVFWTIRPRPRVRGGNGCKVGDDNGSLMLMWEDGFCRGRVGECLEEIDGEDPVRKAFSKMSIQLYNYGEGLMGKVASDKCHKWVFKEPSECEPNVSNYWQSSFDALPPEWTDQFESGIQTIAVIQAGHGLLQLGSCKIIPEDLHFVLRMRHTFESLGYQSGFYLSQLFSSTRNTSSSSSLPSKQSTIPSRPPPPIFNWGQRSLPSATSMLASPNFQNSARLGFPHTKDETHMFLLPHSSETRIEDIMADHENDIKWPNGLSFYNALTGRNQNHHPLILEGKNPNPHSDSNPNEFLSLDSHPETVRKMENKFKRSFTLPARMASSSSSTSLDHHQHHPVEYRNSEAGMYPDVMETFLE

SEQ ID NO: 11485 - protein, 280 aa, Thermus thermophilus
MAAKKDYYAILGVPRNATQEEIKRAYKRLARQYHPDVNKSPEAEEKFKEINEAYAVLSDPEKRRIYDTYGTTEAPPPPPPGGYDFSGFDVEDFSEFFQELFGPGLFGGFGRRSRKGRDLRAELPLTLEKAFHGGERVVEVAGRRVSVRIPPGVREGSVIRVPGMGGQGNPPGDLLLVVRLLPHPVFRLEGQDLYATLDVPAPIAVVGGKVRAMTLEGPVEVAVPPRTQAGRKLRLKGKGFPGPAGRGDLYLEVRITIPERLTPEEEALWKKLAEAYYARA

SEQ ID NO: 11486 - protein, 636 aa, Physcomitrella patens subsp. patens
METVRSLRIAILVMTVILVVEPALGSFMVEKNSLTVITPKSLKGTYQSAIGNFGVPQYGGTLSGVIVYSTVNLKGCDKFPDDYFRSKPGAWPNFALIDRGDCYFSTKVWNAQQAGAAAVLVADDKHEDLITMDSPEEDPSASQYLQKISIPSALIEKKFGDSLKKALSDKEFISMKLDWRESLPHPDDRVEYEFWTNSNDECGPKCDAQVEFVRNFKGVAQILERGGYTQFTPHYITWYCPQAFIESKQCKSQCINNGRYCAPDPEKDFNKGYDGKQVVTENLRQLCVFKVANESNPRQPWKWWDYVTDFQIRCRMKDNRYGPECAEEVIKSLNIDVDKVRKCMGDPNADADNDLLKHEQEAQVGSGVRGDVTILPTLGINQRQYRGKLDKTAVLKAICSGYQETADPPVCLSDTVETNECVDNNGGCWERGSVTACKDTFRGRVCQCPLIDGVQFEGDGYTHCEAHGPERCKVDNGGCWEETRLGVHHSACHGHHHHHGCHCPWGFEGNASRVEGDVDECSRKLKCQCPECKCTNTWGSYKCECSGDLLYFHQHDTCISECSASSYQKGAQSETAGWVVSLIVLAGISVLGLGSYVVYKYRLRTYMDSEIRAIMAQYMPLDSQSEIQNHSRDDVI

SEQ ID NO: 11487 - protein, 3896 aa, Streptomyces hygroscopicus
MAASREDLVKALRTSLMDAERLKRENDRLIAESTEPVAIVAMACRLPGGVTDPESLWELVDEGRDAIGPFPTDRGWDLETLFDSDPDAVGKSYVREAGFLEGAGGFDAAFFGISPREALSLDPQQRLLLETAWETFERAGMDPRSVEGRDIAVFAGGSGQGYGGGPGEAPKGLEGYLGVGASGSVISGRVSYTLGLTGPAVTVDTACSSSLVAAHLAVQALRSGECSMALAGGVAVMGQPTAFVEFSRQRGLAPDGRCKSFGAGADGTTWSEGVGLVLLERLSDARRNGHEVLAVIRGTAVNQDGASNGLTAPNGPSQERVIRQALSNAGLTVADVDAVEAHGTGTALGDPIEAQAVLATYGQSRPEGRPLWLGSLKSNIGHAQAAAGIASVIKTVMALRHGRLPKTLHAEQPTSQVNWTSGAVSLLAEARAWPETGHARRAGISSFGVSGTNAHVILEQAPEEAEATGENTADQEPPVRSAESADPGPVATGHVVPWLLSGHTQEALRAQAARLLTQVRETPSDSPRDVGWSLATTRTRLDHRAVVLCADAEQAVAGLEAVASGTSARSAVTGSVASGKVAVLFTGQGSQRAGMGRELHGAHPVFARAFDAVCAQFGDLRDGDDKVSLAEVIFAEEGSATAALLDRTEFTQPALFALEVALFRLVESWGVRPAYVLGHSIGEVAAAHVAGVLSLPDACTLVRARGRLMQQLTATGAMVAVEAAEDEVAPLLAGKEHKVSIAAVNGPASVVVSGDEDVVTAVAETLARQGRKTKRLVVSHAFHSPHMDGMLDAFREVASRLAYAPPRIPVVSNLTGAVADPEELCSPEYWVRHARGAVRFLDGVRTLADEGVRTHLELGPDGVLTAMGQDCLPEADAAFVPSLRPGVQEPHAVLAGLAGLYVRGVRVDWDAMFAGSGARPVALPTYAFQHEHYWLERAAGSGDVGAVGLGEAGHPLLGAVVQLPETGGVQLSGRLSVRAQPWLGEHVISGAVLVPGTAMVELAVRAGDETGTPVLEELVIGQPMVLPGDTALSVQVVVGADEGGRRTVRIYSRTDGGTDWTEHATGTLAAQGPAPLDGAAGGAAVEWPPAEAEPIPVEDFYRSLVDAGYAYGPAFRGLVAAWRRDGEIFGDVALPEASVAEAERFGIHPALLDAALHAGSFCLPSDPARQVTLLPFAWNTVRLHAGGASAVRVHVRPVGDDAFSVRLTDGSGQTVASVDSLTLRAVDPAQLKIGTADDALWTVRWSETSLPDGAVSWAPLGESATGATGGYGATGDGGGPGGALPDVLVADTRAWAEDLTGPPTARARELTGRLLEEIQRWVADDAMAGTRLAVVTRGAVAVHDDTEVTDPAATALWGLVRSAQAEHPGRVALVDADGACEELPAGVWSGDEPQLAVRGGAVWVPRLTRVEPGLRVPAQASWHLDSAEYGTLDNLALLPDEAEPAPPAAGQVRIEVRAAGLNFRDVLVALGMYPGRSVIGTEGAGVVTEVGPGVTGLAVGDRVMGLFSGSFGPLATADARTVIRMPEGWSFGTAAGVPVAYLTALYALQDLGRVQPGETVLVHAAAGGVGMAAVQLAQHFGATVLGTAHPSKHHALHRLGVPAERLASSRDLAYADTFPTADVVLNSLTGEHIDASLGLLNPGGRFLEMGKTDLREPGEVGARHPEVTYRAFDLGGEAPAERVRELLHQLVELFEAGRIEPLPVRQWDITRAPEAFRWMSQGRHTGKIVLTLPRALDPDGTVLVTGGTGTLGATIARHLLTQHGARHLLLVSRRGPDAPGATDLTTELTELGATVRITACDTADRDQLAALLADIPADHPLTAVVHTAGTLDDGVLTALTPDRLDTVFRPKVDAVTHLHDLTRDHDLAAFVVYSSAAGVLGGPGQGNYSAANAYLDGLAQWRRAHGLPATSLAWGMWAQTSGMTAGLGSGDLHRVRRGGIVGLSTAEALDLFDRSVASGLSLLVPLRLDIAALGAEAAEPPPLLRGLVRPARRTARPVPKAGEGGLAERLAGLSAAEQERLLIELIREQAASVLGFPTVDPIGPEQAFRDMGFDSLTAVELRNRLNTATGLRLPATLVFDHPSPLATAEFLRDQLGGRAVEAAPRPARRDRSAPDGAEDPVVVVGMGCRLPGDVRSPEDLWRLIATGTDAIGPFPQDRGWDLAGLFDSDPDAQGKSYVREGGFLTDAGGFDATFFGISPREALSMDPQQRVLLETAWETLERSGIVPTSLRGQEVGVFVGASGQGYGTGPGAAPEGLEGYLGVGGATSVASGRVSYTFGLTGPAVTVDTACSSSLVALHLAAQALRSGECTMALAGGVAVMGQPGAFVEFSRQRGLASDGRCKSFGEGADGTNWSEGVGLVLLERLSDARRNGHEVLAVIRGTAVNQDGASNGLTAPNGPSQQRVIRQALANAGLTVADVDAVEAHGTGTALGDPIEAQALLATYGQDRPGDEPLWLGSLKSNIGHAQAAAGVASVIKMVLAIRQGTLPRSLHINEPTTQVDWTSGAVCLLTDARPWPETGHPRRAGISSFGVSGTNAHLILEQAPQPEPEPASKADEGTDTPGLVTTGGTTPWVLSAKTPAALRAQARRLLDHLESDMDAHPVDIGWSLATTRTLHDHRAVVITDTEADSDEAAAALTALATGQPHPRLTTGHATTHGKTVFVFPGQGAQWVGMGAQLLKTSPVFAERLHECAAALAPYTDWSLIDVITGTPDAPSLERVDVVQPATFAVVVSLAALWQSVGIHPDAVIGHSQGEIAAACVAGHLTLTNAAKIVTLRSQTIAHHLAGHGGMMSVLTSREQVEEALTPWHGKLWIAAHNSPNATVIAGDTDALHQLHTHYTDQGIRARIIPVDYASHTGHVDTIKNQLHQTLADTTTEPGTIPWLSTVTGQWIEPDTVDSGYWYRNLRQTVQFEHTIHTLANDGYRTFIEISPHPVLTTAIQETLEANDTPNTTITGTLRRDDDTPTRFLTHLAELSTRGTPMDWPTAYTGSQPSQIPLPTYPFEHETFWLDRGGPGDVRAVGLEDTGHPLVGAVVSVPDTGGVLLTGRLSLRSHPWLADHAVSGTVLLPGTAMVELAVRAGDEADTSTLEELVISRPMTVPDEGTLHVQVLVGGEDRGRRKVGVYSRPEGTRQWTEHATGTLTGRATGTLTAGATAPPPEAAQPWPPEGSEPVALEGFYEHLAEVGYEYGPAFRGLRAVWKRDDEVFAEVSVPEEQTGVAGRFGIHPALLDATLHAGNFCFQSDGERPTMLPFAWTDVRLHAVGATTVRVRATVSDGDGLCVRISDPQGVPVATIGSLQLRETTPDQLRALSAASGGNALWAVDWAECGLDATEARWATLGESRLPDSPPSYPDLSTAVEAVESAEAGERPAVLVADVSAWVPEKTGPIDRTHALCARVLDLLRQWVDRRELADTHLVVLTHGAMAAHDTAEVTDPAAAAVWGLVRSAQSEHPGRIRLIDIDDHSHQALPTALATTEAQLALRDATAYTPHLTPAPATTPEPLTLDPEGTVLITGGTGTLGALTARHLITHHHARHLLLVSRQGPDAPGATDLTTELTELGATVHITACDTADRDQLAALLADIPAAHPLTAVVHTAGTLDDALLTDLTPQRLDTVFRPKVDALTHLHDLTRDHDLTAFVIYSSATGTLGTPGQANYAAANTYADALAHQRHATGLPATSLAWGLWETTSSLTAGMTATQQQRTRDSGVVPLTDADGMRLLDTALATRHPHLVPLELDLAALQNNTGPHTLPPLLRTLIRGHHRPTAHTTAQPEDDAPSLAEQLAALDPTQRHQRLTALVRAEAAAVLGHPTPDAVGPDDALFEIGFDSLTAVELRNRLNAATGLQLAAAMLFDYPTPSMAAEHLQEQLALDAATTETHVAAREAAEDDDQSTER

SEQ ID NO: 11488 - protein, 480 aa, Vitis vinifera
  misc_feature (382)..(382): Xaa can be any naturally occurring amino acid
MAAPRIFSLLSASSTAASLRSFGRYSRWGRGSSRFSTAVATEEEPITPPVQIDYTQLLINGRFVDAASGKTFPTLDPRTGDVIAHVAEALESWDNGKPYEQAANVEIPMVIRVFRYYAGWADKIHGLTVPADGLHHVQTLHEPIGVAGQIIPWNFPLLLYGWKVGPALACGNTIVLKTAEQTPLSALYASKLLYEAGLPPGVLNVVSGFGPTAGAALSSHMDVDKLAFTGSTGTGKIVLGLAAKSNLKPVTLELGGKSPFIVCEDADVDKAVELSHTALFYNQGQSCCSGSRTFVHESIYDEFIEKAKARALKRVVGDPFKKGVEQGPQIDSQQFNKILGYIKSGIEAGATLEAGGEKFSSKGYYIQPTVFSNVHIFPPFTXFYAFTNNRDLDEVIRRANATHYGLAAGIFTQNLDTANTLTRALRVGTVWINCFFVFDAAIPFGGRKMSGHGREKGIYGLSNYMQVKAVVTPLKNPAWL

SEQ ID NO: 11489 - protein, 285 aa, Olea europaea
MESKEEDVRVGANKFAERQPIGTAAQSQDKDYKEPPPAPLFEPGELSSWSFYRAGIAEFIATFLFLYITVLTVMGVSKSDSKCKTVGIQGIAWAFGGMIFALVYCTAGISGGHINPAVTFGLFLGRKLSLTRAVFYMVMQCLGAICGAGVVKGFGKTLYMTKGGGANVVAHGYTKGDGLGAEIIGTFVLVYTVFSATDAKRSARDSHVPILAPLPIGFAVFLVHLATIPITGTGINPARSLGAAIIYNKDKAWDDHWIFWVGPFIGAALAALYHVVVIRAIPFKK

SEQ ID NO: 11490 - protein, 354 aa, Arabidopsis thaliana
MAEHLASIFGTEKDRVNCPFYFKIGACRHGDRCSRLHNRPTISPTLLLSNMYQRPDMITPGVDPQGQPLDPSKIQDHFEDFYEDIFEELNKFGEVESLNVCDNLADHMIGNVYVLFKEEDHAAAALQALQGRFYSGRPIIADFSPVTDFREATCRQYEENSCNRGGYCNFMHVKQISRELRRKLFGRYRRSYRRGSRSRSRSISPRRKREHSRERERGDVRDRDRHGNGKRSSDRSERHDRDGGGRRRHGSPKRSRSPRNVREGSEERRARIEQWNRELCRQRDLMVVIQWERRDGPWVCHPKDTIFCERVGRQYIGKPLTKFSIEGATTVAKLHHLCMYKQFWQNLTESILEQ

SEQ ID NO: 11491 - protein, 547 aa, Pseudomonas stutzeri
MSHILRAAVLAAMLLPLPSMADQAGKSPNAVRYHGGDEIILQGFHWNVVREAPNDWYNILRQQAATIAADGFSAIWMPVPWRDFSSWSDGSKSGGGEGYFWHDFNKNGRYGSDAQLRQAASALGGAGVKVLYDVVPNHMNRGYPDKEINLPAGQGFWRNDCADPGNYPNDCDDGDRFIGGDADLNTGHPQVYGMFRDEFTNLRSQYGAGGFRFDFVRGYAPERVNSWMTDSADNSFCVGELWKGPSEYPNWDWRNTASWQQIIKDWSDRAKCPVFDFALKERMQNARSPTGSTPERQSRPAWREVAVTFVDNHDTGYSPGQNGGQHHWALQDGLIRQAYAYILTSPGTPVVYWSHMYDWGYGDFIRQLIQVRRAAGVRADSAISFHSGYSGLVATVSGSQQTLVVALNSDLGNPGQVASGSFSEAVNASNGQVRVWRSGTGSGGGEPGALVSVSFRCDNGATQMGDSVYAVGNVSQLGNWSPAAALRLTDTSGYPTWKGSIALPAGQNEEWKCLIRNEANATQVRQWQGGANNSLTPSEGATTVGRL

SEQ ID NO: 11492 - protein, 339 aa, Oryza sativa Japonica Group
MAPLVPSSQPWVEKYRPRQVKDVAHQEEVVRVLTTTLQTADLPHMLFYGPPGTGKTTTALAIAYQLYGPELYKSRVLELNASDDRGINVVRTKIKDFAAVAVGSARKGGYPCPPYKIIILDEADSMTEDAQNALRRTMETYSKVTRFFFICNYISRIIEPLASRCAKFRFKPLSEEVMSNRILHICNEEGLSLDAQALATLSTISNGDLRRAITYLQSAARLFGSSISSTDLISVSGAIPEDVVKSLLASCKSGEFDVANKEVNNIIADGYPVSQLISQFLDVIVNADDIPDEQKARICKKLGEADKCLVDGADEYLQLLDVASETIRALFDMPQTLVF

SEQ ID NO: 11493 - protein, 160 aa, Glycine max
  misc_feature (106)..(106): Xaa can be any naturally occurring amino acid
NNSIPSIASNGGKVQCMQVWPLVGNKKFETLSYLPFFDDAQLAKEVKYPLSKGWIPCLELEFEHGFVYREHNRSPGYFDGRFCPMWKLPMFDCSDASQVLKELQAXARPAYPSGFIRIIGFDNVRQVQRISFIAYKPHRLLSVKNLQSICSRHPPLFVCT

SEQ ID NO: 11494 - protein, 384 aa, Staphylococcus aureus subsp. aureus COL
MISNKLANIPDSYFGKTMGRKIEHGPLPLINMAVGIPDGPTPQGIIDHFQKALTIPENQKYGAFHGKEAFKQAIVDFYQRQYNVTLDKEDEVCILYGTKNGLVAVPTCVINPGDYVLLPDPGYTDYLAGVLLADGKPVPLNLEPPHYLPDWSKVDSQIIDKTKLIYLTYPNNPTGSTATKEVFDEAIAKFKGTDTKIVHDFAYGAFGFDAKNPSILASENGKDVAIEIYSLSKGYNMSGFRVGFAVGNKDMIQALKKYQTHTNAGMFGALQDAAIYALNHYDDFLEEQSNVFKTRRDRFEAMLAKADLPFVHAKGGIYVWLETPPGYDSEQFEQFLVQEKSILVAPGKPFGENGNRYVRISLALDDQKLDEAAIRLTELAYLYE

SEQ ID NO: 11495 - protein, 348 aa, Neisseria gonorrhoeae FA 1090
MFELKECENLMINKELIEHKGKRRLCVAPMLDWTDRHYRYLARQITRNAWLYSEMVNAGAIVYGDKDRFLMFNEGEQPVALQLGGSDPSDLAKAAKAAEEYGYNEVNLNCGCPSPRVQKGAFGACLMNEVGLVADCLNAMHDAVGIPVTVKHRIGVDRQTEYQTVADFVGTLRDKTACKTFIVHARNAWLDGLSPKENRDVPPLKYDYVYRLKQEFPELEIIINGGITTNEAIAGHLQHVDGVMVGREAYHNPMVMREWDRLFYGDNRAPIEYADLVQRLYTYSQVQIQAGRGTILRHIVRHSLGLMHGLKGARTWRRMLSDATLLKDNDGGLIFEAWKEVERANTRE

SEQ ID NO: 11496 - protein, 466 aa, Novosphingobium aromaticivorans DSM 12444
MDARRIGLLAGPLGFAATLLLAPPAGMPDNAWAAAGLVWWMAAWWMTEAMPLSATALLPFLVLPLTGVADANKTAGSYYSPIMFLFVGGAFLALAIERTGLHRRLAVFIMGLAGTKPSQLLLAVMAATATLSSFISNTSTALIMMPMALAMLAAGGVREGETRGMAGALPMGIAFAASIGGLATLIGTPTNAIAAGLIEKSLGTEITFLRWAMYGVPIVLIAVPLAAWIIARVQKLDEDSFDPLAAREAIGSATAWTTPERRLVPVALLAFLAWVAQPWLEGLFPKGGLTDGTIAAAAGLVLFFLPDGTGRPMLTWPEANRAPWDVVLMFGGGLAMAMGMTESGLTKWMGEMLLPLAGVPLPVVALVLVAFVILVTEFASNIAAASGIMPVVAALVAALGADPIMLALPAAFAATWGFMLPAGTGPNALAWATGHCSMRSMIKAGFALDVAGVFLLVGVVWTVTSL

SEQ ID NO: 11497 - protein, 180 aa, Wolbachia pipientis
GHMNKAEQPAIKQYELPKSVVNGEQREERVKMSKIRQVIAARLKASQNTAAILTTFNEIDMKNVMDLRAKYKDAFEKKYGIKLGFMSFFIKAAVQALKEIAEINAEISGDEIIYKHYYDVGVAVGTDKGLVVPVIRGADQMSFAEIELTLVALGKKAREGKLQVSEMEGATFTISNGGVY

SEQ ID NO: 11498 - protein, 247 aa, Saccharomyces cerevisiae
ARTFFVGGNFKLNGSKQSIKEIVERLNTASIPENVEVVICPPATYLDYSVSLVKKPQVTVGAQNAYLKASGAFTGENSVDQIKDVGAKWVILGHSERRSYFHEDDKFIADKTKFALGQGVGVILCIGETLEEKKAGKTLDVVERQLNAVLEEVKDWTNVVVAYEPVWAIGTGLAATPEDAQDIHASIRKFLASKLGDKAASELRILYGGSANGSNAVTFKDKADVDGFLVGGASLKPEFVDIINSRN

SEQ ID NO: 11499 - protein, 120 aa, Brassica napus
  misc_feature (79)..(79): Xaa can be any naturally occurring amino acid
  misc_feature (95)..(95): Xaa can be any naturally occurring amino acid
MDDWEAEDFQPTPAKVELKSNWDDEDVDENDIKDSWEEEEDDDEPTPAAVVKPAPKKAAAAKVVEKKVKSVEEPSKEEXPFDPIADKLRMQRLVXEEADYQATAELFGAKTEAKSVDIFI

SEQ ID NO: 11500 - protein, 468 aa, Klebsiella pneumoniae subsp. ozaenae
MSKQQIGVVGMAVMGRNLALNIESRGYTVSIFNRSREKTEEVIAENPGKKLVPYYTVQEFVESLETPRRILLMVKAGAGTDSAIDSLKPYLDKGDIIIDGGNTFFQDTIRRNRELSAEGFNFIGTGVSGGEEGALKGPSIMPGGQKEAYELVAPILKQIAAVAEDGEPCVTYIGADGAGHYVKMVHNGIEYGDMQLIAEAYALLKGGLALSNEELAQTFTEWNEGELSSYLIDITKDIFTKKDEEGKYLVDVILDEAANKGTGKWTSQSSLDLGEPLSLITESVFARYISSLKDQRVAASKVLSGPQAQPAGDKAEFIEKVRRALYLGKIVSYAQGFSQLRAASDEYNWDLNYGEIAKIFRAGCIIRAQFLQKITDAYAQNAGIANLLLAPYFKQIADDYQQALRDVVAYAVQNGIPVPTFSAAIAYYDSYRSAVLPANLIQAQRDYFGAHTYKRTDKEGVFHTEWLE

SEQ ID NO: 11501 - protein, 443 aa, Rhizobium sp. NGR234
MSFLDLPEGLPERIIQCNSPYTVRFGVRLRGRMYSFIGWRSVREHCEPVKGDIRYASNADAEEVEALAALMTLKCSLVDVPFGGSKGALKIDPRGWTPQELEHITRRFTQEMNKRPDRARRQCVGSDIGTGEREMAWMMDEFRRANPTDVVTSGACVTGKPLSKGGIAGRAESTGRGVQFAIQSSLRDTRTPGLDGRRNLKGASTVIQGFGNVGYHAARFLSEEDDARVTVLAERDGYVANPEGLSIEALKQHQIRTGSILGFDGAKSIAGDMCGVEQPCDVLIPAAMENAIHAENAERMKAHLVVEAANGPVTFEADEILRSRGVTILPDLYVNAGGVVVSYFERVKNLTHIPFGLMERRRRERGNHTIATALERMTGKESPADMRDEFLEGGAEIDLVRSGLEDVMRSTWTRIADLMEQQPELGDYRTAAYVASIRQVADL

SEQ ID NO: 11502 - protein, 180 aa, Wolbachia pipientis
GHMNKAEQPAIKQYELPKSVVNGEQREERVKMSKIRQVIAARLKASQNTAAILTTFNEIDMKNVMDLRAKYKDAFEKKYGIKLGFMSFFIKAAVQALKEIAEINAEISGDEIIYKHYYDVGVAVGTDKGLVVPVIRGADQMSFAEIELTLVALGKKAREGKLQVSEMEGATIYHLKRWSI

SEQ ID NO: 11503 - protein, 197 aa, Streptococcus mutans UA159
MSEFLNTHNASILLSAVNKSHYPQDDLPEIALAGRSNVGKSSFINTLLGRKNLARTSSKPGKTQSLNFYNIDDKLRFVDVPGYGYAKVSKKERAKWGKMIEEYLTSRENLRAVVSLVDFRHDPSSDDVQMYDFLKYYEIPVILVATKADKVPRGKWNKQESAIKKKLDFDSNDAFIIFSSVDRTGLDTSWDAILESL

SEQ ID NO: 11504 - protein, 174 aa, Glycine max
KGQAYNLSRDHKPDLEIEKERILKAGGFIHVGRVNGSLNLARAIGDMEFKQNKFLSAEKQIVTANPDINTVELCDEDEFVVLACDGIWDCMSSQQLVDFVREQLHLKTKLSAVCESVLDRCLAPSTAGGEGCDNMTMIVVQFKRPAQSSAPAEEQSSSSNGQAEPETKLERSES

SEQ ID NO: 11505 - protein, 458 aa, Streptococcus mutans UA159
MENHNFENEGQFKRKMTSRHLFMLSLGGVIGTGLFLSSGYTIAQAGPLGAVISYLVGAIVVYLVMLSLGELAVAMPVTGSFHTYATKFISPGTGFTIAWLYWICWTVALGTEFLGAGMLMGRWVPYVPTWVFAALFALLIFGLNALSVRSFAEAESFFSSIKVLAILVFIILGFGAMLGLVSFNGKHEVFLFSHLTAHGALPKGLPALMSVMLAVNYAFSGTELIGIAAGETNNPKEAVPKAIKTTIGRLVIFFVLTIVVLASFLPMKEAGVSSAPFVDVFDKMGIPFAADIMNFVILTAILSAGNSGLYASSRMLWSLANEGMISPRVVKINEHGVPMRALLLSMAGAVLSLFSSIYAADTVYLALMSIAGFAVVVVWLSIPMAQINFRKEWLKSHAQEDLFYKTPFTPILPYITIMLLLISIIGIAWDASQRAGLYFGIPFILLCYLYYYWRHKTL

SEQ ID NO: 11506 - protein, 326 aa, Escherichia coli
LPNITILATGGTIAGGGDSATKSNYTVGKVGVENLVNAVPQLKDIANVKGEQVVNIGSQDMNDNVWLTLAKKINTDCDKTDGFVITHGTDTMEETAYFLDLTVKCDKPVVMVGAMRPSTSMSADGPFNLYNAVVTAADKASANRGVLVVMNDTVLDGRDVTKTNTTDVATFKSVNYGPLGYIHNGKIDYQRTPARKHTSDTPFDVSKLNELPKVGIVYNYANASDLPAKALVDAGYDGIVSAGVGNGNLYKSVFDTLATAAKTGTAVVRSSRVPTGATTQDAEVDDAKYGFVASGTLNPQKARVLLQLALTQTKDPQQIQQIFNQY

SEQ ID NO: 11507 - protein, 311 aa, Guillardia theta
MDFSFKCIWNEKYHSDAITSISNCKNNKSLFASSSRDKTILIWKVEDEESDKMVIALKRLKGHSHFVSCVKLSNNGDFCISSSWDNSLRLWDLMSAKTLRTLNGHKKSVLSVSFSEDERQIISCSRDCTIRIWNTVGECKKTLIDKGSSSWICNVILITNRNDEIISSNWDGEINLWNLRESKIQKKLIGHKNYVKELAISPDGSLCASGGGDKSIILWDLNEGKHLYSLEINDRIVSITFSPNHYWLTIGSYTKIMIWDLETKKMIFEYSLNDTVHDKIKAGKIYSLFWDNAGSKVIIGTIDGLIKILKY

SEQ ID NO: 11508 - protein, 747 aa, Mesorhizobium loti MAFF303099
MVSLGKFDRAWGSNMIKLTRRTLLVGTSALVAAGTVSFRAMAASRTYHALLVACTEYPALPQRNWLIGPKNDAGLVHEYLLKNVPDPVRFAPENVTLLAKDVPGAKGLPTHAAIKAALADLAAKVQRDDFVYLHLSGHGAQQPERAKGDETDGLDEIFLPVDIEKWINRDAGVPNALVDNEIGDALDAIRNKGAFVWAVFDCCHSGTATRAVEVDDELERKVEFADLVGGDEAARAAAIKTYEDTVAGASRGLDENGARKPAFNLTPTGGEPITKGKLVAFYAAQTVETTPEMPLPKGTADAPRFGLFTFTILSKLAENPNVTYRQLGQAVLQQYSADSRTRPTPLFEGELDARVFGTDKTDAVMQWPIIVKDGQATIGAGLLHRLTPGSKLAILPSALSSLSDAVGYLEVESAKNLESRVKPVEFEKKPALKLADIPANAYARVAEIAVDYRLTVARPAETKGLEKETELVNSVLDELATAKETGFNIELVDPGKSAELRFAVMCENAIAGAAKDASDKPALWFLPASGDVTLKDGSKPPLIIIHPDDRQKLVDPTTRNLRTIFRATGLSRLAAASDYKPEDVDVQFQVKRRDKDGLEPLQASAVPRVSPGDEVHVLAKNSSDQLVDINVLYVGSDYSITHIVAERLAPQATLEEGLLAFTDTSFGMERMIAVLTEAPPESEKEDLSFLAQDGVAAMTRGLGPASFSDMLADIGMAAPTRSVMRLADKSGPKGAVMIFPMETVPRA

SEQ ID NO: 11509 - protein, 129 aa, Hyacinthus orientalis
MGTEMAVNPKAYPLADAQLTITILDLVQQAANYKQLKKGANEATKTLNRGISEFVVMAADAEPLEILLHLPLLAEDKNVPYVFVPSKQALGRACGVSRPVISCSVTSNEGSQLKSQIQQLRYAIEKLLI

SEQ ID NO: 11510 - protein, 349 aa, Solanum tuberosum
SVFSSRNDSKFGNQQQLKTLIKALHDHGIKSVADIVINHRTADNKDSRGIYSIFEGGTSDDRLDWGPSFICKNDTQYSDGTGNPDTGLDFEPAPDIDHLNTRVQKELSDWMNWLKSEIGFDGWRFDFVRGYAPCITKIYMRNTSPDFAVGEFWNSLAYGQDGKPEYNQDNHRNELVGWVKNAGRAVTAFDFTTKGILQAAVQGELWRLKDPNGKPPGMIGVLPRKAVTFIDNHDTGSTQNMWPFPSDKVMQGYAYILTHPGIPSVFYDHFFDWGFMDGISALISIRKRNRICATSNVQIMASDSDLYIAMIHHKIIVKIGPKLDLGNLIPPNYEVATSGQDYAVWEQKA

SEQ ID NO: 11511 - protein, 196 aa, Hyacinthus orientalis
ELPLVGNSAPGFEAEAVFDQEFIKVKLSEYIGKKYVILFFYPLDFTFVCPTEITAFSDRYSEFEKVNTEVLGVSVDSVFSHLAWVQTDRKSGGLGDLNYPLVSDVTKSISKSYGVLIPDQGIALRGLFIIDKEGVIQHSTINNLGIGRSVDETMRTLQALQYVQENPDEVCPAGWKPGEKSMKPDPKRSKEYFASI

SEQ ID NO: 11512 - protein, 992 aa, Mesorhizobium loti MAFF303099
MAGALITASAACAEDAPDFRLDLDTGGHTARIARLAFTPDGEDIVSASDDKTIRIWDWQSGVTLRTIRGYLGNGSDGKIFAVSVSPDGKTIAAGGYFGAGLGDKPPYGDIRLFDFATGKMKAVLRAADYATYDLAFSPDGKTLAAGGGDGMVYLWRLDDKSATGWTLDKKLDADSWHIDKLAFAAAGTRLAATTTDNGIRLWDVAKGEEIALPDEAEPLRDVSVLALAISQDGSLFATGSKDGQVQLWRAADGTLVHAMPKQDFLIGSLTFAKGSRLVASCGYRCADKHRSIVWNTDSGEKLLDYSGHDGTVYASAANADGSLVATAGGTRNAIQVWDPATGERKALLQGVGEPVTAIGIDAANGIIAWGNTNPCPERVACPEQLGALDKRLELPTTERFFDDPQPLTEPGSFARAAQSDGEWSLHATKGGKDALENAVLEIANGGKVVRSIENDATNGFAHSAFTLIDNGLGLITGGNDGTLLEYKAATARVSGEFTGHTGEINAMAASEKAGLLVTGSADQTLRLWNLKTHELIVSMFFAGPQWIAWMPQGYYYSSDEGDKLIGWHVNQGRDHEGRFIRAGQLKKYLWSPEMVRRAIILRSAKQAVKEMRPGVDNELQKLLQRKPPEFGVRLADDQSKVRDGYVAVEITGAKEAGTDVAGFSILSNSRNVGDIATRSAEGDKTTVEVPVENGQNTIRITGTNEYGYLTERSVTALARKTEKAEAKGKLYVAVIGVDKYPFLTDACSGHACDLRYPVDDATEFLEVVAQKSAPLFSSMETLVLVNREALDESPDKAKQTYTVASADNIMEPDSHTIDDQLADFLDRPGEHDTTIVFVAGHGINIDEDYYFIPTDGRKQDADRWKRSSLVDWGDIQKSVERAKGMRFMLLDTCHAANAFNPRLEKDAQDARIVVFSATAANNTAAELPELGHGVFTYSILEGLRGKARTSDGGITLFGLADFISHEVVRLTASKQKPFYYVGGVENIVLAEP

SEQ ID NO: 11513 - protein, 307 aa, Ajellomyces capsulatus
MVSLAILPLWISDDQGDYLVASGDDEALQVFDIKEGKLTKTVPSKKYGVHLAKFTHHSRQILHASTKVDDSLRLLDLHNESYLRYFSGHTDKVTSIAVSPGTDAVLSCSKDDTVALWDLNSRNAQGKLKLATPYLVAFDPSGSVIAIASQSTSSVLLYDFRNYDKPPCATFDLAAQEDRFTPSTRGRAWTRLEFSNDGKHLLVGTDYHGHFLLDAFEGNVKAFLIGDVCFTPDGRYVLGSAGDQPDTLVWDTQHPPDSSLYLKPTFRLPYRARSVIVQANPRYNMFATADKEITFWLPDDNAKPAEK

SEQ ID NO: 11514 - protein, 273 aa, Magnaporthe grisea 70-15
MPTKKWEDEESSSGSSDESSPAVAVSVPRRKFDDEEANDSDVLDSWDAAEDSEVEREKAKKAAEAKAKAEAEAKANKKTKAARINEHKQRRKEAEESDESDDETESQRRERLRRTEKEADLAHAEDLFGDIGVPAGRKVKAASTSVSIDPSDPSKTVELSDMPIFNPKTKTQFEDMRQALIPLITASSGRKPHYNNFMEEFVRQLCADMPSENIKKISSKLTALSNEKMKQEKAAAGTKKTKAAKTKTSLVANRAGVTDTNSYEDTFGDDDFM

SEQ ID NO: 11515 - protein, 642 aa, Salmonella enterica subsp. enterica serovar Paratyphi B str.
MSYQVLARKWRPQTFADVVGQEHVLTALANGLSLGRIHHAYLFSGTRGVGKTSIARLLAKGLNCETGITATPCGVCDNCREIEQGRFVDLIEIDAASRTKVEDTRDLLDNVQYAPARGRFKVYLIDEVHMLSRHSFNALLKTLEEPPAHVKFLLATTDPQKLPVTILSRCLQFHLKVLDVEQIRHQLEHILNEEHIAHEPRALQLLSRAADGSLRDALSLTDQAIASGDGQVSTQAVSAMLGTLDDDQALSLVEAVVDANGERVMSLINEAAARGIEWEALLVEMLSLLHRIAMVQLSPAALGSDMAAIEQRMRELARTVPPGDLQLYYQTLLIGRKELPWAPDRRMGVEMTLLRALAFHPRMPLPEPETPRQSFAPVAPTAVMTPPQVQQPSAPAPQTSPAPLPASTSQVLAARNQLQRAQGVTKTKKSEPAAASRARPVNNSALERLASVSERVQARPAPSALETAPVKKEAYRWKATTPVVQTKEVVATPKALKKALEHEKTPELAAKLAAEAIERDPWAAQVSQLSLPKLVEQVALNAWKEQNGNAVCLHLRSTQRHLNSSGAQQKLAQALSDLTGTTVELTIVEDDNPAVRTPLEWRQAIYEEKLAQARESIIADNNIQTLRRFFDAELDEESIRPI

SEQ ID NO: 11516 - protein, 254 aa, Bacillus pumilus SAFR-032
MTKQTVIVTGGSSGMGKAMAVHLAHEGWNVVITGRTEETLEKVANEIKQNGGSIAYFQMDVRNPEDADQMVKFAVDTFGDVDALINNAAGNFLVPAEKLSPNGWKAVIDIVLNGTFFCSHAVGNYWIRQKKRGSMVNMVATYAWGAGVGVAHSAAAKAGVLSLTRTLAVEWGKQYRIRVNAIAPGPIERTGGADKLWESEEAAQRTLDSVPLGRLGTPEEIAELASFLLSEQASYINGDCITMDGGQWLNQSPF

SEQ ID NO: 11517 - protein, 418 aa, Vibrio campbellii AND4
MSLLAIGINHNTASVDLREKVAFGPDKLGPALEQLRDHEAVNGSVIVSTCNRTEVYCDAKQGARNKLIDWLAQFHQVSQEDLMPSLYVHEEQAAIKHLMRVSCGLDSLILGEPQILGQVKQAFSDSRDHQAVDAAIDKLFQKTFSVAKRVRTETDIGGNAVSVAYAACTLAKHIFESLSDSTVMLVGAGETIELVAKHLASNGCTKMIVANRTRERALGLGEQFGAEVISLNEIPEHLSRADIVISSTASPLPIIGKGMVETALKKRRHQPMLLVDIAVPRDVESQVGELNDAYLYSVDDLQSIIDSNLEQRKVEAIQAEAIVSEESAAFMTWMRSLQAVDSIRDYRKSANEIREDLLGKSLQSLATGTEPEKVLRELSNKLTNKLIHAPTRALQSAAEQGEPAKLTVIRQTLGLDDL

SEQ ID NO: 11518 - protein, 440 aa, Bordetella pertussis Tohama I
MKITVVGTGYVGLVSGACLADMGNEVLCLDTDAAKVAMLREGHIPIYEPGLEDLVKRNVAGGRLQFTDDIAASVAFGDVQFIAVGTPPGEDGSADLQYVLAAARSIARHMTARKVVVDKSTVPVGTADKVRAAMQEVLAERGVEVPFSVASNPEFLKEGAAINDFMSPDRIIVGTDDEHTIDTMRRIYAPFQRTHERVMVMDVRSAELTKYAANAMLATRISFMNEMANLAEALGADIEQVRRGIGADPRIGYHFLYPGIGYGGSCFPKDVQALMRSAGEHALPMRVIEAAETANQAQKLRLAHKVVARYGADLQGRTFALWGLAFKPNTDDMREAPSLSTIADLTRRGARIRVYDPVAMPQAAKVLDDNPAVELVDDMYQALDGADGLLIATEWKVFRAPDLTRVKQLLKAPLIIDGRNLYVPADMRAQGFDYQGIGRA

SEQ ID NO: 11519 - protein, 664 aa, Arabidopsis thaliana
MDLPPKILPTHKYPLTISTRFVNDSCKGCNIKGPIYGGYRCNEPSSTSLFFHKECAEAPPEIINHPSHPQHTLKLHNSLRNPCKCNLCGKTFFAFGYRCSSKCDFIVDLTCGINPLPVSIEHPKSHHHPVIFLKEPAKPGRRRCGICKGYNGGCSYACLECEVHFHVECVNLSQEVNHPSHPQHSLKLLEYESLTSDAEETCLLCGERPDKVLYRCSICNFSVCRFCTKDPPPLAIEHHKTHEHRLVLLSRLISFECNACGMQGDRSPYMCVQCGFVVHRTCIDLPRVININRHDHRISFTHHLGVGYSRCGICRKDISQYHGAYLCPRCPNYAAHSLCATRKDVWDGVELEGTPDDDDEDIVPFKVVGDNLIKHFSHEEHNLRLNKDNINRDEGSRCEACVLPIYSDPIYNCEECRFILHEKCANHPKKKRHVFHTKPFTLWSRPPRTFHSKDFRFYDVFRCYACRTKSTGFRYVSDWWVLDVRCGSRSEPVIHDGHRHPLYYEHKKDHCCDACYKEIDGYLLSCDTCDFDLDLHCTDLPKTVKHSCDNHPLSLCYGENATGKYWCDICEAETDPSKWFYTCSKCVVTAHIECVLGDFSRLMPGRIINYNNVRVEVVLNSYSSRPFCAKCHSRCRAPIILKPCDPYTGYICSDACVVPDYQYS

SEQ ID NO: 11520 - protein, 314 aa, Vibrio campbellii AND4
MPDMKLFAGNATPELAQRIADRLYISLGDASVSRFSDGEVAVQINENVRGSDVFIIQSTCAPTNDNLMELVVMIDAMRRASAGRITAVIPYFGYARQDRRVRSARVPITAKVVADFLSNVGVDRVLTIDLHAEQIQGFFDVPVDNIFGTPVLLEDMQSRGLENPVVVSPDLGGVVRARATAKALGDIDIAIVDKRRPRANVSEVMNLIGDVEGRDCVIVDDMIDTGGTLCKAAEALKERGAKRVFAYATHAVFSGNAADNIKNSVLDQVIVTDSISLSKEMAATGKVTTLSLSRMLAEAIRRISNEESISAMFN

SEQ ID NO: 11521 - protein, 158 aa, Triticum aestivum
MLPAAMAAGLAWSRPRFDPCKEMAYIPLDEDMKVKGKAAIDVVCNPLGKSGGALIQQFMILSFGSLANSTPYLGGILLVIVIAWLGAVRSLDSQFSPLAKQDLEREQKLKAEAVETTAQVVGTGNGSLQENVASTNGTVIKQSQEPEITAPEKSGKQS

SEQ ID NO: 11522 - protein, 395 aa, Neisseria meningitidis MC58
MNTLLNQLKPYPFARLREAMQGISAPEGLEAVPLHIGEPKHPTPKVITDALTASLHELEKYPLTAGLPELRQACANWLKRRYDGLTVDADNEILPVLGSREALFSFVQTVLNPVSDGIKPAIVSPNPFYQIYEGATLLGGGEIHFANCPAPSFNPDWRSISEEVWKRTKLVFVCSPNNPSGSVLDLDGWKEVFDLQDKYGFIIASDECYSEIYFDGNKPLGCLQAAAQLGRSRQKLLMFTSLSKRSNVPGLRSGFVAGDAELLKNFLLYRTYHGSAMSIPVQRASIAAWDDEQHVIDNRRMYQEKFERVIPILQQVFDVKLPDASFYIWLKVPDGDDLALARNLWQKAAIQVLPGRFLARDTEQGNPGEGYVRIALVADVATCVKAAETIVSLYR

SEQ ID NO: 11523 - protein, 594 aa, Physcomitrella patens subsp. patens
MTSDSEPLVHPRNWDENGAKTTGRHFYEDEDERTYEKSELVHVAFGEEPDVDEEGADRDFLPRFSWKKLWMFAGPGFLMSIAYLDPGNIESDLQSGATAGYALLWLLMWATVMGLFTQKLAARLGVATGSHLAELCREEYPVWARMVLWIMTEIAIIGADVQQVIGSAIAFRILSNGWIPLWAGVLITGVDGFLFLFLENFGVRKLELLFCIFIGIMALSFAWMFGETNPDVKAVASGLIFPSVPRTAVDKAVGIVGAVIMPHNIFLHSALVQSRDIDISKKSRVREALRYYNIESSVALFITFLINLCIMAIFAKAFHGKEEAGVIGLANAGEYLQKRYGGGFFPILYIWAIGLLAAGQSSTMTGTYTGQFVMTGFLNLRVKKWIRVLVTRAVAIVPTIIVALIFDSSANELDNLSEWLNVLQSIQLPFALIPLLCLVSNARVMGVFVITKVTKVIAWTIAVLVISINMYLLLVTVLSRLANSTPIIVILTVIILFYVCFVIYLVLDPAQEDGNWVYFKRTFLSSRSAIFLTYYDSYMNFHSFNEYSLDKSTPLISILKSVFALILYSCNVGLCSDHLLFVNWFLELSWCLLR

SEQ ID NO: 11524 - protein, 537 aa, Ralstonia eutropha JMP134
MPSKALPCQDPRRIWPPARRDEFQTRIRLCRVRLPPHPDTMTTTTLPDQNAAEQTFESFGLDARILRALSEQGYTKPTPIQAQAIPVVLLGKDVMGAAQTGTGKTAGFALPIIQRLLPMASASASPARHPVRALMLTPTRELADQVYDNVARYAKHTDLRSTVVFGGVDMNPQTDALRRGVEILVATPGRLLDHVQQKSVNLSQVQMLVLDEADRMLDMGFLPDLQRIINLLPAQRQTLLFSATFSPEIKRLAASYLKQPVTIEVARSNSTNENVRQMVYQVEDGQKQAAVVHLLRQRAEQGLSKQCIVFVNSKIGCSRLARHLEREGINAAAIHGDKTQTERMQTLEGFKNGTIDALVATDVAARGLDIADMPCVINFDLPFSAEDYVHRIGRTGRAGASGDALSIFVPGDERLLTDIEKLIKRSVPRGTLEGFDPTGEKARQEDSDRRRQRTDVRRARGNGDGEGEDRRRRHDHGGSRSAFRPSDDPFFSRPYEPSPNSASAKPADEMIAAALSRGRQAPKRPVAALLGGAPRKS

SEQ ID NO: 11525 - protein, 113 aa, Oryza sativa
MADTTTTTRADQPRGERRGFGRRGDRRGDRRGRRGDRGDKEEAAWVPVTKLGRLVKDGKIARLEDIYLHSIPVKEYQIIDYFFDGGKGLKDEVLKISPVQKQTMAGQRTRFKA

SEQ ID NO: 11526 - protein, 224 aa, Vitis vinifera
MDSDHWSSRLAVAKRQFMLHQTNKSHSDRLFIDDLEVEDDIPCPYCYEDHDIASLCSHLEDEHSFESRVAVCPICSVKIARDMLGHITMQHRHFYLQRRRRLRRVAIPNSQALSLLGRDLREAHLQVLLGGGGYRPSNANASNSLTESLLSSLVLNFPLCEAEEITKSVVPDLEDISGANSSKKTWNTSVYSSLSSEEREKKIRQTTARAGFIQDLLISTMFDD

SEQ ID NO: 11527 - protein, 180 aa, Wolbachia pipientis
GHMNKAEQPAIKQYELPKSVVNGEQREERVKMSKIRQVIAARLKASQNTAAILTTFNEIDMKNVMDLRTKYKDAFEKKYGIKLGFMSFFIKAAVQALKEIPEINAEISGDEIIYKHYYDIGVAVGTDKGLVVPVIRSADQMSFAEIELTLVALGKKAREGKLQVSEMEGATFTISNGGVY

SEQ ID NO: 11528 - protein, 237 aa, Streptomyces hygroscopicus
MTVKGALFDFSGTLFRIESAESWLRTVLERSGTAVPDEDVLRYARNLEEAGALPGGAPPLAVPPHLEEVWAVRDRGAEPHRAAFTGMAREVPLPRPELYDALYDRHMEPAAWRPYPDAREVLGELRRRGVRIAVVSNIGWDLRPVFRAHGLDPLVDAYALSYEHGVQKPDPRLFQAACDALGVAPGDAVMVGDDRRADAGAAALGCRVHLVDHLPVDRRPDALRAVLGLPPDAATAP

SEQ ID NO: 11529 - protein, 475 aa, Chromobacterium violaceum ATCC 12472
MDAIKMPPQEEAALLDAFARLKAVARAAPNPSLETRKSWLNALERLIQENRQALVDTVNQDFGQRSSVETRLAELFPSLEGIRHARRHLKSWMRPRRRGVSLWFAPARASVHPQPLGVVGVVVPWNYPLFLAFGPITAALAAGNRVMVKMSEYTPATGELLQRLARQHFGEDLLAVVNGGPELAQAFVRLPFDHLLFTGSTAVGRHVMRAAAESLTPVTLELGGKSPALVARGANLRRAAEAIVAGKMMNAGQTCVAPDYLLVNDKDCALLLDEIRAAAKRAYPTLARNPDYSAIVNDRHYQRLRGWLEGARQAGARIDEINPAGEDLAAVRKLPLALVQRCPDDCALMQEEIFGPILPVVAYDKFDEALAYINARPRPLALYLFDDDPLRIDRVLQETISGGVSINDTLLHVVQEDLPFGGVGPSGMGHYHGREGFLTFSKLKPVFRQSRLSGAWLTRPPYGAAVEWLLKLMLR

SEQ ID NO: 11530 - protein, 333 aa, Rhodobacter sphaeroides
MKPFPTHPDAIPAELQDVMDRLGSVAIEVANRIARGGIDEDLAGLCGTNTDGDGQKALDVIADDAFRVALEGSAVRFYASEEQDTAVTLNEAGTLALAIDPLDGSSNIDTNLSVGTTFAIWPAAPRPNPSFLRLGSELIAAGYVIYGPQVCMMVSFGKGTQKYVLDPGSRSFVLVDRAVKVPPSSTEFAINASNYRHWPKPIRAYIDDCVAGTEGPRGRNFNMRWLASLVAETHRILARGGVFLYPRDSRKGYEQGRLRYLYECAPIAFVITQAGGGATDGENPILGQTPSRLHARTPFVFGSAEKVARITAYHDLPEQETSALFGNRGLFRS

SEQ ID NO: 11531 - protein, 364 aa, Xanthobacter flavus
MLEPNADHRAAVAQAAGVAASRITLTVMLDEWAGADARRRAVADTVCALATGCASLAAAIAEGPLAGDLARTLSSGEAGEGQKALDVISNDIVIGALKAAPVAAVASEENDAPVLLDPTAPLLVAIDPLDGSSNIDTDISVGTIFAVFPRPEGADASEPSAFLQNGRDMLAAGYVIYGPHTAMMLTLGAGTWHFALDRAGLFRLVDAEVKVKEGAAEFAINMSNYHHWDVPVRDYVDDCLAGKKGPRERDFNMRWVASMVADAHRIFQRGGIYLYPGDGRKGYTHGRLRLLYEAFPVAFLMEQASGSATDGRGAILDLSATGLHQRVPFIFGSRDEVARVSRYHLEPNGHGERSPLFARRGLFI

SEQ ID NO: 11532 - protein, 455 aa, Burkholderia xenovorans LB400
MMDQATYSSAGFIAARLDRLPNSGWHILVRCVVGATVFFDAFDALSIALVLPVLSTRWHLTSMSIGILIASGYVGQAIGALLFGSVAERIGRIKTISLTIVIFAFASLASAFAPNYAWLCAMRVIGGIGLGGEGPAALAYISEIAPVERRGAFILSFQFMYAAGFVAASLMGAWIVPRFGWQSIFIVGSLPIILLPVLRRLCPESPRWFASRGRLEESDAALWEIEKRVSKNGKVTLSDVAPTAGPVLNRDSSVRELFSPVYRKRTINLWILWAATYFVVYGMTNWLPTLLKTVYHLPLQETLNIALLSATLGLCGNIACVALIDRIGPKHWFIGAFAGAAALFSLWLAMGDGKLVPFLILGLAAFVLSVTVSFGLFLYTAEIYPTRMRGIGAGFASFWLRVASVLAPMVIGYLLPRHGISGVFAVFAGVSAIGFLASLIGMIKTKGLRLEDIAP

SEQ ID NO: 11533 - protein, 402 aa, Legionella pneumophila str. Paris
MKHSLATIEEAVATLKAGKMIILMDDEDRENEGDLVIAAEHATPEAINFMSRLGCGLICLPMAEELIDKIQLPMMARHNKSPYGTAFTVSIEAANGVSTGISARDRARTIQVAIDPKSGPSDIISPGHVFPLRARKRGVLERPGQTEGSVDLVRLAGLTPAAVICEIINEDGTMSRRDELALFSKKHQIPLVTIKDLINYRIRHENLINPVATTQIPLEENGVFTMTVFENQIDSGEHFVLVKPPLYGNQVPLVRIHSECITGDVFGSRKCDCGKQLELSLSQIGAEGGILIYLRQEGRGIGLANKLKAYALQEQGFDTVDANLELGLPADDRDYAVAYQILKYLGVDALRLLTNNPLKIASLERYGMKITQRIPLEIKPSRENHCYLKTKKIKLGHLLAID

SEQ ID NO: 11534 - protein, 341 aa, Spinacia oleracea
MDHAGDAMRTDLMTITRYVLNEQSKRPESRGDFTILLSHIVLGCKFVCSAVNKAGLAKLIGLAGETNIQGEEQKKLDVLSNEVFVKALTSSGRTCILVSEEDEEATFIEPSLRGKYCVVFDPLDGSSNIDCGVSIGTIFGIYMVKDFETATLEDVLQPGKNMVAAGYCMYGSSCTLVLSTGSGVNGFTLDPSLGEYILTHPDIKIPNKGKIYSVNEGNAKNWDGPTTKYVEKCKFPTDGSSPKSLRYIGSMVADVHRTLLYGGIFLYPGDKKSPNGKLRVLYEVFPMSFLMEQAGGQAFTGKQRALDLIPTKIHERSPVFLGSYDDVEDIKALYAAQEKTA

SEQ ID NO: 11535 - protein, 188 aa, Rhizobium sp. NGR234
MPVKKRVPFVAFRTRVRDETIGGPNPYRWEVRTTEDYFSGKRVVLFSLPGAFTPTCSTQQLPDFERLYDEFGKVGIEAVYCLSVNDAFVMNAWGKALGLEKVRLIPDGSGEFTRKMGMLVAKDNLGFGMRSWRYAAVVNDSVVEQWFEEEGFSDNCESDPYWASSPQNILETLRTFDTARLGRVPIKF

SEQ ID NO: 11536 - protein, 227 aa, Myxococcus xanthus DK 1622
MSGSVAERLASVRERVVAACARAGRPVESVTLVAVSKLKPADLIREAYAAGQRDFGENYAQELRDKAAELADLEGLRWHSIGALQTNKVKYVARAAGAFHALDRLEVARELSKRREGAPPLPVYVEVNVGGEATKSGLAPDALGAFLDEVRALPGLQAVGLMALPPPTEDEARARADFQALRELARVHGLPGLSMGTTHDFEWAIEEGATVVRVGTAIFGERALKSP

SEQ ID NO: 11537 - protein, 382 aa, Glycine max
  misc_feature (79)..(79): Xaa can be any naturally occurring amino acid
MSCQAWPEPIVRVQSLAESGLSSIPSRYIRPHSQRPSNTTSFPTPKPFQTDHHHGHDQKTSDHDHDHDHVNIPVIDLKXFSPEDPILREQVFGQVDQACREWGFFQVVNHGVSHELMKSSRELWREFFNQPLEMKEEYANSPTTYEGYGSRLGVQKGATLDWSDYFFLHYMPPSLRNQAKWPAFPESLRKVIAEYGEGVVKLGGRILKMMSINLGLKEDFLLNAFGGESEVGACLRVNFYPKCPQPDLTFGLSPHSDPGGMTILLPDDFVSGLQVRRGDEWITVKPVPNAFIINIGDQIQVLSNAIYKSVEHRVIVNSNKDRVSLALFYNPRSDLLIQPAKELVTEEKPALYSPMTYDEYRLYIRLNGPCGKAQVESLASQT

SEQ ID NO: 11538 - protein, 425 aa, Zea mays
  misc_feature (201)..(201): Xaa can be any naturally occurring amino acid
MPRTTVLESPGCPPLRALTTDILGLVKVVEAHARPAGAAKVVETWGAPDASCAIVAASLADRATDPVLAVARMNGVVELLNPLNGDTLAAVKAVGPAPNDGGAEGDPLTALHLFTRQASDSILGTFLACTEQGKASIRSITKENAASGSHIEPSATWDVCGGANVQFCSVDHGENYVMFGGKGIEVSLWDITSCSKTWSAXSVRLYDTALQRRSAISGELRESPIKAVAADPNGHDVYIGTGTGDLASFDMRTGKLLGCYIGKCSGSIRSIVRHPELPLIASCGLDSYLRIWDTNTRQLLSAVFLKQHLTTVVLDSHFSVEEPGEMKFKQLESLVEAEAEVRKEKKKKKSRPTEEDEEQVGVVDHSDNNGEMYARKEKKKKKKKKSRTIERDEEPDNDGEMCSPKRRKSVERSKCLKKSKKQQVA

SEQ ID NO: 11539 - protein, 175 aa, Zea mays
MRRASCVPGRGGDRRGGAGGGGLAGAAAILFERLRSCTCGVGSAPSSDAEMWSRFPCIEARGFIFGPAIALAIGAKFIPLRKPKKLPGEVFSESYVLEYGMDCLEMHVGAIEPGERVVVVDDLVATGGTLSAAIRLLERAGANVVECACLIGLPKFKDFYKLNGKPVYILVESRK

SEQ ID NO: 11540 - protein, 475 aa, Mesorhizobium loti MAFF303099
MEKAEIGLIGLGTMGSNLALNIAEHGHRIAVFNRTRARTDAFVENAGALKDMVVPCYSLEELAAAIRPPRPIIIMVLAGKPVDEQIEALRGVLSGNDIVIDAGNANFRDTMRRFSELSGSGLTFIGMGVSGGEEGARHGPSIMVGGTEDSWKRVEKVLTAISAKFKDEPCAAWLGTDGAGHFVKTIHNGIEYADMQMIAEIYGILRDGLGMGPKDIGTVFSNWNKGRLNSYLIEITAKVLAADDPKTGKPVVDIILDRAGQKGTGKWSVIEAQQLGIPATAIEAAVAARVLSSIKDERLAAEKAYGNIGVSKISGDKDALLKDLELALFAGKIAAYAQGFAVMSGASKEFNWNLPMPTIARIWRAGCIIRSQMLDTMAEAFSSGGASTNLLMAPAFISLMQEAHPSLRRIVAKASEAGAPVPALSSALAYFDSYRQGRGTSNLIQAQRDFFGAHGFERIDEQGAFHGPWGSGAAG

SEQ ID NO: 11541 - protein, 124 aa, Capsicum annuum
CSYAQGMNLLRAKSGEKGWNLNLGEMARIWKGGCIIRAVFLDRIKKAYQRNPNLANLMVDPEFAREMVQRQAAWRRVVGLAVQKGISVPGMSASLQYFDTYRRSRLPANLVQAQRDYFGAHTYE

SEQ ID NO: 11542 - protein, 474 aa, Bacillus cereus E33L
MAQVNNTNNELKRTMKSRHLFMIALGGVIGTGLFNGSGFIISQAGPGGSVLAFMAGGLLMYFVMLCLGELAVAMPVSGSFQEYATKFINPATGFTIGWLYWLSWANTTGLEFTTAGITMQRWFPDIPVWVWCLIFGVTIFTINALSARSYAETEFWFSSIKVSAIIAFIILGGAAMFGLIDLKGDEPAPLFSNFVNHGGLFPNGLAAILLTMVTVNYSFQGTELVGIAAGESEDPAKTLPRSIRNIIWRTMFFFVLAIFVLVALIPWEEAGLTKSPFVAVFDNIGIPYAADIMNFVILTAVLSVANSGLYAATRMLWSLSKNEMAPAFLKKLSSRGIPLNALIMTIAISAFSLLTSVVAAETVYLWLISISGVITIIVWMSICVSQFFFRKHYVADGGKLEDLKFKTPLYPLVPMLGFGLYGIILISLIFIPEQRLGIYCTVPFIIFCYTYYHFKVKKRISTNTSSENKISETI

SEQ ID NO: 11543 - protein, 468 aa, Methylococcus capsulatus
MTPKDVLQIIKEKEVRYVDLRFADTRGKEQHVTVPASTIDEAAFEEGKMFDGSSIAGWKGINESDMILMPDASTAVMDPFFDDPTLILRCDIVEPATMQGYERDPRSIAKRAEAYMKSTGIADTALFGPENEFFIFDDVRWGANMSGSFYKVDSEEAGWNSEKVYEDGNIGHRPGVKGGYFPVPPVDSFQDLRSAMCNTLEDMGMVVEVHHHEVATAGQCEIGVRCNTLVKKADEVLLLKYAVQNVAHAYGKTATFMPKPLVGANGNGMHVHQSVAKDGKNLFSGDLYGGLSETALHYIGGYISMPKALNAFCNASTNSYKRLVPGFEAPVMLAYSARNRSASIGIPYVMNPKARRIEVRFPDSTANPYLAFAAMLMAGLDGIQNKIHPGDAMDKDLYDLPPEEEKAIPQVCYSFDQALEALDKDREFLTRGGVFTDDMIDAYLDLKGQEVTACDEHSSVEFDMYYSL

SEQ ID NO: 11544 - protein, 272 aa, Bacillus cereus E33L
MDKQIGFIGCGNMGMAIVGGMLNKKIVSSNKIMCSDLNTTNLENASEKYGISITTDNKKVAKNADILILSIKPDLYTAVINEIKEVIKNDAIIVTIAAGKSIESTENAFNQKLKVVRVMPNTPALVGEGMSALCPNEMVTEKDLEEVLNIFNSFGQSEIVSEKLMDVVTSVSGSSPAYVYMIIEAMADAAVLDGMPRNQAYKFAAQAVLGSAKMVLETGIHPGELKDMVCSPGGTTIEAVATLEEKGLRTAIISAMQRCTQKSVELSGQTKK

SEQ ID NO: 11545 - protein, 471 aa, Physcomitrella patens subsp. patens
SIVTDMLNFLNESWTPFHATAEAKRQLLKAGFQQLNEEQEWTVQPGGRYFFTRNMSSIFAFAIGQKYEAGNGFNIVAAHTDSPCPKLKPVSAASKAGFLNVGVQTYGGGLWHTWFDRDLSVAGRVLLRKKNGTIVQGLIKVDRPIMRIPTLAIHLDRTVNTDGFKPNLETHLAPVLATQIKAELLGKSETGGQSEGGNGAINSSKKPHHSLLLEVLAEQLNCSVEEIVDFELNVCDTQPSCVGGARKEFIFSGRLDNLASSYCALRALLDTCPDSASLADESCIRAIALFDNEEVGSDSAQGAGSPVMFQAMSRITKWLTRDTPTEGIEERTIRKSFLVSADMAHALHPNYADRHEENHQPKLHEGLVIKYNANQRYATNTVTAFLFKEVAKVAGVPTQNFVVRNDMGCGSTIGPILASGIGIRTVDVGMPQLSMHSVREMCGTEDVDLSYRHFKAFYELFTTIDKLTVDS

SEQ ID NO: 11546 - protein, 506 aa, Oryza sativa
MAARVPGGGGAAAAAEAEVVPTFSSLEPIYGDGSPLDEARLRLARLADKFHAVYAARPALFARSPGRVNLIGEHIDYEGYSVLPMAIRQDMIVAIRRAEGKEVRVANVDDKYPICVYPADPDKEIDIKNHKWGHYFMCGYKGVYEYCRSKGIDMGGPVGLDVVVDGTVPTGSGLSSSAAFVCSATIAIMGVLEKNFPKKEVAQFTCQSERHIGTQSGGMDQAISIMAKPGFAELIDFNPIHATDVQLPPGGTFVIAHCLAESKKAETAATNYNNRVVECRLAAIVLAIKLGMETKKAVSSVTTLSDVEGLHEAFAGKEGSSDPGVAVKKLLHEESYTTEEIEKITGQSLTSIFQSSQTSLDVLRAAKHFKLFQRAFHVYSEARRVYAFRDTVLSKLSAEDMLQKLGDLMNESHYSCSVLYECSCPELEELVKVCRDNGALGARLTGAGWGGCAVALVKEGIVPQFILNLKETYYKSRIDRGVINQKDLGLYVFASKPSSGAAIFKL

SEQ ID NO: 11547 - protein, 338 aa, Nocardioides sp. JS614
MHANQLTTPAHLSHHPLLWTDVDRPEPSRGQLLVKVAGCGVCRSNLHMIEGDWVEGGVPAISPIIPGHEVTGRVAAIGAGVEGFEVGDPVGVQPLWWTCGECEFCTTGREQLCHERIITGEHVDGGYAEYMLSFAEHTYRIPESLDLIDAAPLFCPGITAYGALDKIDVGPGDVVAVFGLGGVGHMAVQMAVLTGAEVVAVGRTPAHLEVAKELGAARTVDSTDQDALDLIADTADAVLTFAGSDEVTAQAMRTLKWGGTLVNGVPINVEEFHFNKGQTIKGSILGNREQMRAVLQLAAEGKIRTVVERFPMAQAEDALTRLANGELRSRGVLYNSTE

SEQ ID NO: 11548 - protein, 526 aa, Physcomitrella patens subsp. patens
MAAALAAVAAAAASTAAASPARLSVERTTRGAFVSGGNAQLGSSSSSLRGTGVALSSSNVTLRRQRHRKVVVSPRNVSDSPVSVEACLDPDASRSVLGIILGGGAGSRLYPLTKKRAKPAVPLGANYRLIDIPVSNCINSNINKIYVLTQFNSASLNRHLSRAYASNMGGYKNEGFVEVLAAQQSPENPNWFQGTADAVRQYLWLFEEAQVLEYVILAGDHLYRMDYQHFIQVHRETNADITVAALPMDEARATAFGLMKINDQGRIIEFAEKPKGDELKAMQVDTTVLGLDAERAKEMPYIASMGIYVVSKEAMITLLRNEFPEANDFGSEVIPGATKMGMKVQAYLYDGYWEDIGTIEAFYNANLGITKKPVPDFSFYDRSAPIYTQARFLPPSKMLDADVTDSVIGEGCVIKNAKIFHSVVGLRSWVAEGAVVEDALLMGADYYETDEQRNELLASGGIPMGIGRNSVVKRAIIDKNARIGENVKIINVGGVEEAARETDGYFIKSGIVTIIKDAIIPHGTVI

SEQ ID NO: 11549 - protein, 432 aa, Burkholderia vietnamiensis G4
MQLLTIGINHHTAPVALRERVAFPLEQIKPALVTFKNVFLGPQAPNTPEAAILSTCNRTELYCATHDRAARDGAIRWLSEYHRIPVDELAPHVYALPQSEAVRHAFRVASGLDSMVLGETQILGQMKDAVRTATEAGALGTYLNQLFQRTFAVAKEVRGTTEIGTQSVSMAAAAVRLAQRIFEKVADQRVLFIGAGEMIELCATHFAAQGPRELVVANRTAERGQRLAERFGGRAMPLSDLPTRMHEFDIIVSCTASTLPIIGLGAVERAVKARRHRPIFMVDLAVPRDIEPEVGKLKDVFLYTVDDLGAIVREGNASRQAAVAQAEAIIETRVQNFMQWLDTRSVVPVIRHMHTQADALRRAEVEKAQKLLARGDDPAAVLEALSQALTNKLIHGPTSALNRVSGADRDSLIDLMRGFYQHAPRSNDQSGH

SEQ ID NO: 11550 - protein, 413 aa, Glycyrrhiza glabra
MGSLGAIVRHPDEVYPLLKLKMAARHAEKQIPAEPHWAFCYTMLLKVSRSFALVIQQLDPQLRNAVCIFYLVLRALDTVEDDTSIATDVKEPILIAFHRHIYDRDWHFSCGTKEYKVLMDQFHHVSTAFLELEKNYQAAIENITKEMGAGMAKFICNEVETVDDYDEYCHYVAGLVGLGLSKLFHASGKEDLAPDHLSNSMGLFLQKTNIIRDYLEDINEIPKSRMFWPRQIWSKYVNKLEDLKYEENSVKAVQCLNDMVTNALLHAEDCLKYMSALRDMSIFRFCAIPQIMAIGTLALCYNNIEVFRGVVKMRRGLTAKVIDRTKTMADVYGAFFDFSCMLKSKVDKNDPNATKTLSRLEAIQKTCRESGLLSKRKPYILRNESTNSSTMVLILVIILSIIFAYLSAKRQDN

SEQ ID NO: 11551 - protein, 250 aa, Rhodococcus sp. RHA1
MTGRVAGKVAVVTGANGDLGGATARMLAREGALVAALDLKVPDAPWDSTAITSFAVDVTDEAGVAETVAAVVETVGVPDILVNCAGIIGRPAPSHEASVAEFDQIFDVNVKGVWLTTKHVVPHMIGRKKGSIVNFSSIHGLTGGSNVPLYHASKGAVRLLSKADAVTYGPHGIRVNSIHPGSMRTAMSRRSAEGSAIGSEEYYRQLVSGNPLPRQGEPDEIAYGVLYLASDESGFTTGTELVVDGGYTAH

SEQ ID NO: 11552 - protein, 412 aa, Glycyrrhiza glabra
MGSLGAILKHPDDLYPLLKLKIAARQAEKQIPREPHWSFCYTMLHKVSRSFAFVIQQLGPDLRNAVCIFYLVLRALDTVEDDTSIATDVKVPILIAFHRHIYDCDWHFSCGTKEYKVLMDQFHHVSTAFLELGKNYQEAIEDITKRMGAGMAEFICKEVETVDDYDEYCHYVAGLVGMGLSKLFHASGSEDLASDYLSNSMGLFLQKTNIIRDYLEDINEIPKSRMFWPRQIWSKYVNKLEDLKYEENSVKAVQCLNDMVTNALMHAEDCLKYMAALRDLAIFRFCAIPQIMAIGTLALCYNNIELFRGVVKMRRGLTAKVIDRTKTMGDVYGAFFDFASMLESKVDKNDPNATKTLSRLEAIQKTCRESGLLNKRKSLLRNGNGYGSTMILILVILFGIMFAYLSANHHNN

SEQ ID NO: 11553 - protein, 623 aa, Oryza sativa Indica Group
MASISGAAAAAPSSSGASCGLRLRRDHLPRSSHFRLARPSSITDVSRSCSSSSSSPPRSLSSKQSGHADVLAHGAVDKDPIRLWNRYVEWLYQHKQLGLFVDVSRIGFTEEFLRRMEAPMGRAFAAMRELEKGAIANPDEGRMVGHYWLRNPALAPNSFLRDKIETTLERILAFASDVISAKIRPPSSPAGRFTQILSIGIGGSSLGPQFVAEALAPDNPPLMIRFIDNTDPAGIDHQIAQLGPELASTLVIVISKSGGTPETRNGLLEVQKAFRDAGLEFSKQGVAITQENSLLDNTARIEGWLARFPMFDWVGGRTSEMSAVGLLPAALQGIDIKEMLVGAAQMDEETRNTEIKENPAALLALCWYWASDGIGSKDMVVLPYKDSLLLLSRYLQQLVMESLGKEFDLDGNRVNQGLTVYGNKGSTDQHAYIQQLREGVHNFFVTFIEVLRDRPPGHEWELEPSVTCGDYLFGMLHGTRSALYANDRESITVTVQEVNPRAVGALVALYERAVGLYAYLININAYHQPGVEAGKKAAGEVLALQKRILLVLNEASCKDPAEPLTLDQIADRCHCPEEIEMIYKIIQHMAANDRALIAEGNCGSPRSIKVYLGECNVDDDMNS

SEQ ID NO: 11554 - protein, 180 aa, Wolbachia pipientis
GHMNKAEQPAIKQYELPKSVVNGEQREERVKMSKIRQVIAARLKASQNTAAILTTFNEIDMKNVMDLRAKYKDAFEKKYGIKLGFMSFFIKAAVQALKEIAEINAEISGDEIIYKHYYDVGVAVGTDKGLVVPVIRGADQMSFVEIELTLVALGKKAREGKLQVSEMEGATFTISNGGVY

SEQ ID NO: 11555 - protein, 72 aa, Triticum aestivum
  misc_feature (11)..(11): Xaa can be any naturally occurring amino acid
  misc_feature (14)..(15): Xaa can be any naturally occurring amino acid
  misc_feature (65)..(65): Xaa can be any naturally occurring amino acid
GGAADDTKSGXEAXXVDLKEKMKKIAASKKKKSSKEVDAAAKHAAMEAAARSAKLAAAKKKEKSXYNQQPVR

SEQ ID NO: 11556 - protein, 184 aa, Triticum aestivum
MAVSELEVDGVVFPPLARPPGSEHAHFLAGAGVRGMEIGGKFITSTAIWVYLQADTTAPALAAKWAAKPAADLASDAAFFPDPSTGEFEKFTRVTMILPLTGAHYSDKVTETCLSYWKARGVYTDSEAAAVDKYEEALGGHRCSPGPMILFTHSTAGVLSTGFSKESSVPVLRRRGHLKAPGLC

SEQ ID NO: 11557 - protein, 475 aa, Lentisphaera araneosa HTCC2155
MNKPVSVVIMGASGNLALTKLLPSLYTLYTSGALPAQFTISGYARTGMTHEEFRAKVKANLMDSVEETQLVESLVNTFISKIFYHAGNYGSVEDFGQLKTELDEVNAEFGDDIKRVFYLSIPPAVFEPVINSLRESNLVEKGNLDHFVVVEKPFGYDTDSARELNATIEQTFDESQVCRIDHYLGKEAIQNLMVMRFANIIFEPVWNRNYIESVTISWEEDKAIGDRGGYFDDAGIIRDVIQNHLLQILALVAMEQPSELTSDEIASEKNRVLRKITPFKAEDVVVGQYTDGVCSGRSVNSYRDEPGVPKDSMRDTFAAVRCEINNQRWSGVPFVVKAGKAMTKSCTEIIIQFKDVVGSIFANQPHHANKLVIRVQPEAGMIFNITNKVPGKGMVLKDVKMDFTYNSGFDVAMPGAYERLLLDAINGDKSLFISYDELIQSWELFTPILKKIDAGENEVHFYRAGTSGPEEADFK

SEQ ID NO: 11558 - protein, 314 aa, Schizosaccharomyces pombe
MFVASRRVKELRIDYTDCMNIGDEFKQVPSTNIEFQYKNVKNVTAMWKSSGDVCTLRFQIPEEMTSPVFAFYRLKNFYQNHRRYTVSADMFQLLGEARTVAQLKSYGFCKPLEANEEGKPYYPCGIIANSLFNDSYSSLLRYESFDSSNSLGLYNMTTNGTAWPEDRERYKKTKYNASQIVPPPNWAKMFPNGYTDDNIPDVSTWDAFQIWMRAAALPTFSKLALRNVTTALQPGIYEMNITYNFPVTEYKGTKTIMFSTTSVIGGKNYFLGILYFVIGGLCAASGVILSIACLIKPRRVGDPRYLSWNRGKSS

SEQ ID NO: 11559 - protein, 368 aa, Populus trichocarpa
MSQTGKLMPHLDQQSTKMLNLTVLQRMDTFIEEILITAAHVTFYAFNIETNQWSRKDVEGSLFVVKRNTQPRFQFIVMNRRNTENLVENLLGDFEYEVQAPYLLYRNASQEVNGIWFYNPRECEDVANLFTRILNAYSKVPAKPKVASGKSEFEDLEAVPNMSVFEGPLEPSSTASAANDSAEDSSFENFFSTAMNIGSTASTVTNSRQQYQPSPTILLSSHTPNVVMPSAPVPQIPSLPLSSLTTSKSIHGPPDPISSGSHVANLVKPSSFFAPPSSSSALMAPPLSSPLPSAPSLQPPLNLQRPYGTPMLQPFPPPAPPPSLTPSSTTTPPLIGRDEVRDALLMLAQDDKFIDMFHQALLKVHHHP

SEQ ID NO: 11560 - protein, 238 aa, Zea mays
MAATAAALRCCFPGSSGVGSGFVKPNSSRRGWCAAAVAAPSREAEPVSSLGHRTRVDFPILHQEFDDAKLVYFDNGATSQKPCSVMKTLDEYYRSYNSNVHRGIHALSAKATHAYEDARRKVANFVNAADSREIVFTRNATEAINLVAYSWGLSNLKEGDEKTGATLKYVGLTKENVPDIEQLKGFLSNKTKIVVVHHVSNVLGSMLPIEEIVTWSNRVGAKVLVDACQSVPHMPVDV

SEQ ID NO: 11561 - protein, 249 aa, Physcomitrella patens subsp. patens
MKLNIANPTTGCQKKVEIDDDAKLRQFYDKRLAQEVSGDQLGDEFKGYVFKIMGGCDKQGFPMKQGVLTQGRVQLLMHRGVSCFRGYGRRNGERRRKSVRGCIVSPDLSVLNLVIVKQGDNDLPGLTDIEKPRMRGPKRATKIRKLFNLTKEDDVRKYVNTYRRSFVSATGKKRSKAPKIQRLVTPLTLQRKRRRIAIKKERVAKSKAEAAEYQKLLALRLKEQREHRSESLAKKRASRASVAKPDSSA

SEQ ID NO: 11562 - protein, 434 aa, Burkholderia xenovorans LB400
MERIPPGRWFRKLRLTMGMATFFDAFDSLAIAAALPALSAIWHLKPTDMGVLISVGYAGQLLGALVLGRLAEARGRTNAALISVAIFTLFSALCALAPSYTWLCACRFLQGVGLGGEVPIAAAYINEFSRAKGRGRSFVLYEASFTLGLVFSSLVGAWIVPQMGWRVLLALGAVPAVIILWARRSLPESPRWLAEHGRLAEADEVVSRIERSVEEEGKTLPPPAKAVPRPAMARTRILTRTSLVRSLSVWAMWFACYFLSYGVGTWAPTILRTALHLPLQQALLFSFVLQTLYLCGTLGTAVLVDRLGRKIYFRVAFAGVSIALFCAYSMAGNEIALMALIAGAFVFNAAISVTLYLYTPEIYPTTVRAKGSAFATSFARLASITSPLAIGAIMQHAEFSQIFLMLGLVALVIGGSGALFVTETRNRVLEDIPQ

SEQ ID NO: 11563 - protein, 180 aa, Wolbachia pipientis
GHMNKAEQPAIKQYELPKSVVSGEQREERVKMSKIRQVIAARLKASQNTAAILTTFNEIDMKNVMDLRAKYKDAFEKKYGIKLGFMSFFIKAAVQALKEIAEINAEISGDEIIYKHYYDVGVAVGTDKGLVVPVIRGADQMSFAEIELTLVALGKKAREGKLQVSEMEGATFTISNGGVY

SEQ ID NO: 11564 - protein, 305 aa, Pseudomonas aeruginosa
MSVRHFLSFMDYSPEELIGLIRRGSELKDLRNRGVLYEPLKSRVLGMVFEKASTRTRLSFEAGMIQLGGQAIFLSPRDTQLGRGEPIGDSARVMSRMLDGVMIRTFAHATLTEFAAHSKVPVINGLSDDLHPCQLLADMQTFHEHRGSIQGKTVAWIGDGNNMCNSYIEEEMKFDFQLRVACPEGYEPKAEFVALAGDRLRVVRDPREAVAGAHLVSTDVWASMGQEDEAAARIAMFRPYQVNAALLDGAADDVLFMHCLPAHRGEEISEELLDDPRSVAWDQAENRLHAQKALLELLIEHAHYA

SEQ ID NO: 11565 - protein, 734 aa, Physcomitrella patens subsp. patens
MNPAKKKNFKIEPFKHKVEMDPKYAEKTWKILEDAIHEIYNHNASGLSFEELYRNAYNMVLHKYGEKLYSGVVQTMTQHLREIAKIIEGAQGGLFLEELDVKWREHNKSLQMIRDILMYMDRTFVNNFNKTPVHELGLNLWRDHIVRSPQIRDRLLNTLLDLVRRERTGEVINRGLMRNITKMLVELGTNVYQEDFERPFLDAASDFYRLESQQLIETSDCPDYLRKAEKRLNEEIERVAHYLDSKSEPKITQVVEREVIGNRMRLLVEMENSGLISMLIDDKYDDLGRMYNLFRRISTGLQTMRELMTAHLRETGRQLVMDPERLKDPVEFVQRLLDEKDKYDRIIQQSFHNDKMFQNALNSSFEYFINLNIRSPEFISLFVDDKLRKGLKGASEEDVELVLDKVMMLFRYLQEKDVFEKYYKQHLAKRLLSGRTVSDDAERSLIVKLKTECGYQFTSKLEGMFTDMKTSRDTMQGFNATGAGAEGNEGPTLTVQVLTTGSWPTQSGARCNMPTEILAMCDKFKMYYLSTHTGRRLTWQTNMGTADLKATFGDGNKHELNVSTYQMCILCLFNQADRLSYREIEQATDIPAPDLKRSLQSLACVKGKNVLRKEPMSKDISEDDTFVFNDKFSSKFYKVKISTVVAQKESEPEKQETRQKVEEDRKPQIEAAIVRIMKSRRLLDHNNIISEVTKQLQARFMPNPAVIKKRIESLIEREFLERDRMDRKLYRYLA

SEQ ID NO: 11566 - protein, 175 aa, Burkholderia xenovorans LB400
MAGKYYSFDGVSPEVSGSAFVHPTAVLIGRVTISDHCYIGPHATLRGDGGVILLREGAIVQDSCTIHGRNAVLEVGSCLGHNAVVHGARIGEGALVGISSVVLDEAVVGSQAILGALSLLTARTLLPDRHLATGIPAKVLRALSGNEVSRMVEGGKHYEALTMLSIRTMNEERNA

SEQ ID NO: 11567 - protein, 429 aa, Mycobacterium leprae [sequence omitted]

SEQ ID NO: 11568 - protein, 180 aa, Wolbachia pipientis
GHMSKAEQPSIKQYESPKSVASGERREERVKMSKIRQVIAARLKASQNTAAILTTFNEIDMKNVMDLRAKYKETFEKKYGIKLGFMSFFIKAAVQALKEIREINAEISGDEIIYKNYYDIGVAVGTDKGLVVPVIRDADQMSFAKIELTLVALGKKAREGKLQVSEMEGATFTISNGGVY

SEQ ID NO: 11569 - protein, 395 aa, Bdellovibrio bacteriovorus HD100
MKPLIVQKYGGATLADPEKIKSVSSRIAAQSKENSLIVVVSAMGKTTNSLIDLANQVSSHPQRREMDMLLTVGERISMSLVSMALNDLGCPAISFTGSQAGIFTDDSHVNAFIKDVKPMRLDEALKNNRVVILAGFQGVSPVTKEITTLGRGGSDTSAVAMAAAFNAERCEILKDVPAVFTADPNIVKSARPLSELNYDQLMEMTFWGAKVLHYRSVELAKMRDVTLYIGPASSKTSDGTIVKKGLNMFESCKALSLNSHELVLGIHCREKNPAKALQGLQNLLDKNQIAFPQLLSCETSLDKTEIFLTGPQEIMFAVKKELEKHPDFTLLPTDYSTVTLTCTGATSPEMTQKVLNTLTGKNLETQKILISAMSLTVLVEAPLRKQVIECLHPLI

SEQ ID NO: 11570 - protein, 517 aa, Trametes sp. C30
MAKFQSLLTFITLSLVASVYASIGPVADLTISNGAVSPDGFSRQAILVNDVFPSPLITGNKGDRFQLNVIDNMTNHTMLKSTSIHWHGFFQHGTNWADGPAFVNQCPISTGHAFLYDFQVPDQAGTFWYHSHLSTQYCDGLRGPIVVYDPQDPHKSLYDVDDDSTVITLADWYHLAAKVGPAVPTADATLINGLGRSISTLNADLAVITVTKGKRYRFRLVSLSCDPNHTFSIDGHSLTVIEADSVNLKPQTVDSIQIFAAQRYSFVLNADQDVDNYWIRALPNSGTRNFDGGVNSAILRYDGAAPVEPTTTQTPSTQPLVESALTTLEGTAAPGNPTPGGVDLALNMAFGFAGGRFTINGASFTPPTVPVLLQILSGAQSAQDLLPSGSVYSLPANADIEISLPATSAAPGFPHPFHLHGHTFAVVRSAGSSTYNYANPVYRDVVSTGSPGDNVTIRFRTDNPGPWFLHCHIDFHLEAGFAVVMAEDIPDVAATNPVPQAWSDLCPTYDALSPDDQ

SEQ ID NO: 11571 - protein, 448 aa, Arabidopsis thaliana
MGIHFVDKADLWKSALLFNLKLRDRFRIAVDDHRGRATVFSPDGCFSSTIHRWVTRFRNFRRESLPSPPAFYRRRVSKDLTAEEESALFRMLQTVAVPLIGNACHVFMNGFNRVQVYGLEKLHDALLNRPKNKPLVTVSNHVASVDDPFVIASLLPPKFLLDARNLRWTLCATDRCFKNPVTSAFSRSVKVLPISRGEGIYQQGMDIAISKLNNGGWVHIFPEGSRSRDGGKTMGSAKRGIGRLILDADTLPMVVPFVHTGMQDIMPVGASVPRIGKTVTVIIGDPIHFNDILSTEGAQHVSRKHLYDAVSSRIGQRLYDLKAQVDRVYIEQQSMMSHNAKTPSDRAAEIFHRVDWDSFGMGAQFSEESSPSSKPIGQSDDRIVRSPKRRVSPEGGVSLKIKKLMDSTEMMGFAARGLLMNEYKSRVESANVGRPLKAWREYFMNRGL

SEQ ID NO: 11572 - protein, 390 aa, Legionella pneumophila str. Paris
MKAKVILVNGKQNTVLRGHPWIYPKAIAQYSGKLITGELVEIIGSEGESLGFGAYNEHSLYRVRVLALSNEQINSFDYKSLITHRIKQASLVRRCLDLPNEQTNAYRLFNSEADGLSGLTIDCFNDYCVIASSAYWVELNKSIIVQVLQELFPHSHVIWLPQNKPLSQDGWKEIHTEKSQGSTQVLEEGVLYHVEFAQTQKTGLFLDQRENHKRIAKLSRGKRVLDLYTFTGGFALHAAKAGALQVTAVDSSAQAIEQAKNNAVLNHLNTIEFIKADAREYLKMAGEYDVVILDPPKLVPSQKHLQQAKNYYRFLHREAFKYMKPGSLLMTCNCSSALSSQDFCSLVSAQAVAMGKQARILGVYGPASCHPTLAAFPEGNYLTAVLLALV

SEQ ID NO: 11573 - protein, 488 aa, Burkholderia thailandensis E264
MPSGDILIGGEWRRGRGATTPNFYPADGSLNTEIHMADAADTREAVEAADAAWRRANWSGLKPHQRAGVLYRVADLIHANREALAQLQRRDNGKPINETRALVASAANTFRYFAACAETLDEALTPSRGDYLSMSVHEPLGVVAAITPWNSPIASDAQKLGPALAAGNAVVLKPAEVTPLASLALARLCEQAGVPRGVISVLPGKGSVIGDALVRDPLVKKVSFTGGTEVGRGIARLAAEKLMPLSLELGGKSPTIVFGDADLDHAVNGVLYGIFSSSGESCIAGSRLFVQRSIYDAFVARLVDAARKLRVGDPASERTQMGPLITAQHRDTVERYVALGRDEGARVLCGGERPTGEGRDAGFFYLPTILDGLSNRARICREEIFGPVLVALPFDDEAALVAEANDSVFGLAAGIWTRDYKRAWRVARALDAGTVWINTYKQFSISTPFSGWKESGMGREKGSLGIREYMQQKSLYWGLNDSPLPWAN

SEQ ID NO: 11574 - protein, 330 aa, Bacillus thuringiensis serovar konkukian str. 97-27
MNSILICGGAGYIGSHAVKKLVDEGLSVVVVDNLQTGHEDAITEGAKFYNGDLRDKAFLRDVFTKENIEAVMHFAADSLVGVSMEKPLQYYNNNVYGALCLLEVMDEFKVDKFIFSSTAATYGEVDVDLITEETMTNPTNTYGETKLAIEKMLHWYSQASNLRYKIFRYFNVAGATPNGIIGEDHRPETHLIPLVLQVALGQREKIMMFGDDYNTPDGTCIRDYIHVEDLVAAHFLGLKDLQNGGESDFYNLGNGNGFSVKEIVDAVREVTNHEIPAEVAPRRAGDPARLVASSQKAKEKLGWDPQYVNVKTIIEHAWNWHQKKPNGYEK

SEQ ID NO: 11575 - protein, 632 aa, Ralstonia eutropha JMP134
MTQHDTRAEQAIASATDASITSAVQSPLDKLDAMLNPAQVTETVAAEEVTNGFATLGLDAAILRALSELNYNNPTPVQAQAIPAFLAGRDLLVSSQTGSGKTAAFMLPAIQRISEKPATNRPTEPAKRMKGKRPRPSPAQPSLLVLTPTRELALQVTEAAAKYGRNLRRIVCASILGGMPYPKQLAALSKMPDILVATPGRLLDHISAGRIDLSALDMLVFDEADRMLDMGFADDIDAIVDATPASRQTLMFSATLDARIAQLASRQLKDPQRIEIAAARADQSHIEQRLHFTDDMSHKERLLDHLLRDATLKQAIVFTATKRDADSLAERLSDTGFAAGALHGDMTQGARNRTLTALRRGNLRVLVATDVAARGIDVPDITHVVNFDLPKQAEDYVHRIGRTGRAGRSGVAINLVNHNDTFQWKRIERFTNNRIDASVIEGLEPRRSPKPRSNFGGKPGGRGNGGGYRGGERSFGDRNFGDRKFGGESRGFGNRGNQEGGRSFGDDNRGFGNREGSGYRGGEQRSFGGGDRNFGGERKFGGDNRGFGQRANPEGGRSFGDDNRGFGNREGGGYRGGEQRSFGDRSFGDRKVGGEGRSFGDRGGRDGGRSLGNREGGFGGQRNGNSRSRYER

SEQ ID NO: 11576 - protein, 390 aa, Mycoplasma pneumoniae M129
MAAGKRDYYEVLGVSRSATAQDIKRAFRKLAMQYHPDRHKGEGETVQKQNEEKFKEVNEAYEVLSDTEKRGMYDRFGHEGLNASGFHETGFNPFDIFNSVFGEGFSFDMDGGSPFDFIFSRGKKSRQNRVVLPYDLEIAVGVDISFFEMTNGCTRTIEYTKRVTCSACDGFGAEGGETGMVSCNSCEGNGFILKNQRSIFGTVQSQMLCQSCGGQGKQAKHKCKTCKGSKYKKVPTTKEIQIPAGIYHGDALVDDHGGNEFGGHVGKLVVHVGVLPSKIFKRVDHNVVANVLVDPMIAITGGKIELPTLEGIKEFNLRAGTKSGEQIVIPGGGIKFTKNFRKKAGDLIIIISYARPSEYSAPELRKLKEFIKPNQEVKQYLNALKNEYKS

SEQ ID NO: 11577 - protein, 463 aa, Burkholderia vietnamiensis G4
MSGSNTGLGTGLKQRHVTMMSIAGVIGAGLFVGSGHAIAEAGPASILAYAIAGVLVVLVMRMLGEMAVAHPDSGSFSTYADRAIGHWAGFSIGWLYWWFWVLVIPIEATAAATILNAWFPGVATWIFALGITLLLTITNLFSVKNYGEFEFWFALIKVVAIVVFLCIGGAAILGIVPAPAVSGVSNLFAHQGFMPNGAGAVLAAMLTTMFSFLGTEIVTIAAAESDNPQRQIVRATNSVIWRITLFYLGSILVVAAIVPWNDPLLPKHGSYQRAMELIGVPNAKAIIDVIVLVSVASCLNSALYTASRMLFSLSKRKDAPAFLHRTDSTGTPRAAVLASTAFGFLTVIANYLMPEQVFGFLLATSGAIALLVYLVIAISQLRMRKTLESTGADLALRMWLFPWLTWAVILFICGTLTVMFVSEAHRMEVGATAVLALLVLFASWLNKRARDARAVAGGRVSAT

SEQ ID NO: 11578 - protein, 472 aa, Pseudomonas putida GB-1
MQPTCNAQSAVPEESRVLKRRLENRHIQLISISGAIGTGLFMGSGKIIALSGTSIILVYAIIGFFVFCIMRAMGEMLLANLQMESFADLVHNYLGPRAGYILSWSYWLSWVVAAVGDVVVVAGFVQYWYPDVPTWLPAFGTMFLLLGLNMLAVKAFGEVEFWFGLIKIVAIVLLVVTGLVMVATSYTSPAGVTASFSHLVAPGVVMPHGILGFLAGFQIAIFSFVGTELIGTAAAEAKDPEKTLPKAINTIPVRILLFYICSLVCIISVVSWANVPANRSPFVELFLLGGLPAAAGIINFVVLTSAASSANSGVYSGSRMLYGLSHQQQAPVAFGRLSGSGTPVRALVFSGVCMAIALTLLFVIPEVMTVFTLVSTISAVMIIVTWSLILLSYFAYRRQNPQAHERSRFKLPGGKATAALAQLFLIFVLCLLALEPDTRTALYVMPLWYAGLLLAYRRRAKACMRPQAATAA

SEQ ID NO: 11579 - protein, 364 aa, Burkholderia vietnamiensis G4
MSLKCGIVGLPNVGKSTLFNALTKAGIAAENYPFCTIEPNVGIVEVPDTRLKALAEIVKPERVLPAVVEFVDIAGLVAGASKGEGLGNQFLANIRETDAITHVVRCFEDDNVIHVAGKVSPIDDIEVINTELALADLGTVEKALTRYSKAAKSGNDKEAVKLAAVLEKVRAQLDQGKAVRSLDLSDDEQALLKPFCLITAKPAMYVANVKDDGFDNNPHLEAVRKYAESENSPVVAVCAAIEAEIADLDDADKEAFLADMGMEEPGLDRVIRAGFKLLGLQTYFTAGVKEVRAWTIHIGDTAPQAAGVIHTDFERGFIRAQTISFDDFVAYKGEQGAKEAGKMRAEGKEYVVHDGDVMNFLFNV

SEQ ID NO: 11580 - protein, 430 aa, Haemophilus influenzae R2866
MMDEQSLLAFDTQHIWHPYSSVSSDMPLYAVERADGVMITLKDGRRLIDGMSSWWAALHGYNHPRLNAAAQNQLAKMSHIMFGGFTHDPAVELAQLLVQILPNGLDKIFFADSGSVAVEVAMKMAIQYQHAKGEVQRQKFATIRSGYHGDTWNAMSVCDPTTGMHHLFHHSLPVQYFLPQPNIPFNESWNDCVIEPLADLLKKKGSEIAALILEPVVQGAGGMYFYSPTYLVKAQALCKQYGVLLIFDEIATGFGRTGKLFAAEHAGISPDIMCIGKALTGGYLTLSASITTTEIAQTICSGEAKCFMHGPTFMANPLACAIATESIRLLLESPWQQNIQRIEHYLKQQLSPLSEKDYVKEVRVLGAIGVVEMKSAVNMKTLVPRFVEQGVWIRPFGKLVYVMPPFVIKDDELQKLTEGMILALIQEYEH

SEQ ID NO: 11581 - protein, 276 aa, Magnaporthe grisea 70-15
MSPTHNLLSHKDNGASAAKTGGGGQSRSNSGSIRLHFVAALGEFVGTFMFLFFGYAGHFMVARSSTPSETDTTSGDSAQTTIFVALAYGFSLLITVWTMYRISGGLFNPAVTFGLSLAGKLPWIRTCVLIPTQIVASMCAGAVVSIIVPGRISQVNTTLAPHVSIAQGLFLEMFFTAYLLFVVLMVAVEKSKDTFIAPIAIGLAAFVALIPEFPPYHWIYWAGPLLGSLLGTGLYKIFKVLHYEDANPGQDAAHPDEVAQIEESRDLESGVATESR

SEQ ID NO: 11582 - protein, 362 aa, Mycoplasma pneumoniae M129
MLSAGIVGLPNVGKSTLFSAITNLQVEIANYPFATIEPNAGIVNVIDERLDKLASLIKPDKVTHTTFRFVDIAGLVKGASKGEGLGNQFLANIREVDLICHVVRCYEDKKIVHVNNQVDPVFDFEIIVNELIQADIEVVNTRIGKIKRKAESGDKQSKEEYQLLAPVLQGLQQNQMVLHLVNEVDLKKLKSLNLLTAKPILVVANVSEADLSNLDHNPHLTQLNQFLKQHNLPHAIPVCALLENELSSLDANGRQDWLKELGLSDYQGLNQLIKTAYDAIGLWSFFTFGKQEVRAWAFKKGWLAPQCAGEIHTDFERGFIKVEVISWNQLYELKSLQEAKKQGLVRLRGQGLRDARWWCVSL

SEQ ID NO: 11583 - protein, 596 aa, Pseudomonas putida GB-1
MKFSTPLMSALCLVAASGWACADQVLPAPPELASGYRSGLQPVHASRHMAAAANPLASEAGRAILRAGGSAIDAAIAMQMVLTLVEPQSSGIGGGAFILYWDGRRVQAFDGREAAPAAVTEKLFLQADGTPVPFRAAQIGGRSVGVPGGLRALKLAHDQHGKLPWRDLFAPAIALARNGFAVSERLHTLLAGDPYIGRSPAMARYFLDEQGKPLAVGTTLRNPELAYTFERIAAEGPEAFYSGEIAEAIVAKVRSHANAGYLSLQDLQQYQAKEREPVCGPYKAWRICGMPPPSSGGVTVLQTLGMLEAVQRAAPQRDLAALRPLATSSPARLEAPPLAVHLIAEAERLAYADRAQYLADSDYVPVPVKALTDPAYLASRAALIGEYSMKRALPGRPQGADLALAPDRSPLRISTSHLSAVDDSGQALAMTSSVEAAFGSHLMVKGFLLNNHLTDFSFTPQEHGKPVANRVQPGKRPLSAMAPTLVFSRASGELVASLGSPGGSQIIGYVNKALVGLLDWQLDPQQAAGLPNFGSRNAGTEVEAGLASPSLIRQLAAWGHDVTPMTMTSGMQIIQRSGEGWSGGADPRREGVALGD

SEQ ID NO: 11584 - protein, 180 aa, Wolbachia pipientis
GHMSKAEQPAVKQYESPKSVASGERREERVKMSKIRQVIAARLKASQNTAAILTTFNEIDMKNVMDLRAKYKETFEKKYGIKLGFMSFFIKAAVQALKEIREINAEISGDEIIYKNYYDIGVAVGTDKGLVVPVIRDADQMSFAKIELTLVALGKKAREGKLQVSEMEGATFTISNGGVY

SEQ ID NO: 11585 - protein, 488 aa, Carica papaya
MGFGTNQSLLSKIATNDRHGEDSPYFDGWKAYDRNPFHPTRNPDGVIQMGLSENQLCFDLIEKWVKKNPNASICTAEGVENFKHIANFQDYHGLKEFRQEVAKLMGKARGGRVTFDPERIVMSGGATGASETIMFCLADPGDASLVPTPYYPAFNRDLRWRTGVQIIPVQCSSSNNFTVTREAVEAAYQKAQEANINVKGLIITNPSNPLGTTLDSQTLQSLVNFVNDKTIHLVCDEIYAATVFSSPEFVSIAEIIQEMDVNRDLIHIIYSLSKDMGLPGFRVGIVYSYNDGVLSCGRRMSSFGLVSSQTQYFLATLLSDDEFVDYFLRESSKRLARRHHKLTRGLEQVGIKCLKSNAGLFVWMDLRRLLEGPTSFDAEMKLWRTIVNDVKLNVSPGSSFHVAEPGWFRVCFANMEEETMDVALQRIQAFVCRAKEREAAAAATTNKKRGTMNLRLSFSSRNQVYEEQYYAMSPHMMSPRSPLVEART

SEQ ID NO: 11586 - protein, 655 aa, Acidovorax sp. JS42
MAQAPVWLTYGFTYLAAAVIAVPIARALGLGAIIGYLAAGIAIGPWGLALVSNVQDILHFAEFGVVLMLFLVGLELQPSRLWSLRRPIFGLGTAQMVGCAALLWAAAWAFGLPWRVGLVGALGLALSSTAIALQVINERNLMRTDSGQKAFSILLFQDVAAIPILALLPLLGVAVRAAELDHPHEVQELLLEAAKILGVVGAIVLGGRLALRPLLRWIAKSKTPEIFTATSLFLVVGIAMLMLSVGLSMALGAFLAGVLLADSEFRRELETDIEPFKGLLLGLFFIAVGMSIDFGVILRTPWGMLALLLGFLGIKALVIWTLARVTAMPYQERPVFTLLLAQGGEFAFVVFQAGAGFRAIPAEMASLLIGAVALSMLISPLLLVLLDRVLLKRFATLKTAPQAQEISEPQSAPVIIAGFGRYGQIVARMMLAQGVPATVLDHSVEMLEVAHTFGYRVFYGDATRVNLLRMAGAEHARILVVAVDAPEQSLKIVQLAKKHFPQLQIVARARRDALARAARSGRGACGTRGVRVQPAHRTHRAGAQRPVAARGRHLGRALPRAQHGAVQPHVRAPQRPRGHDRRRQAGPRPAGGADGQGAPGTPGRGGGWRRPAARCAPGTQGSITKEPVAPVHQALQALVSIADYRYPSTRRVREG

SEQ ID NO: 11587 - protein, 457 aa, Rhodococcus sp. RHA1
MSHRSADVVILGGGSGGYAAAIRSAELGRSVILVEENELGGTCLHQGCIPTKALLHSAEVADSARTASQFGIDVTFDGVDLEKVLSYQNTIVTRLHKGLQGLVDSYGITVVNGRGRLVGPNGVEVDDELITGAAVVLATGSSPKTLPGISIGGRIVTSEQALVLPSVPKKAIILGGGVIGVEFASVWASFGASVTIVEAMPRLVPNEDETTSKYLERAFRRRKIAAKTGVRVTEVTQDEDAVSVTLDSGDVLDADVVLVAVGRGPNTASMGYEETGVMLDKGFVVTSDRLRTTVPNVFAVGDIVPGLQLAHRGFQQGIFVAEEIAGLRPDVVDETGIPRVTYSHPEVASVGLTETAAREKFGENVETVTYDLAGNGRSQILKTSGAVKLVVAPTGVVVGVHMVGDRVGELIGEAQLLYNFEVDAAQAAKFVHAHPTQGEALGEALMAVAGKPLHVHG

SEQ ID NO: 11588 - protein, 365 aa, marine gamma proteobacterium HTCC2080
MSHSILLLPGDGIGPEVVAQARRVLERAADLYKLTIELDEANLGGVAIDREGQAYPESTQAKARSAAALLLGAVGGPQWDGLPAEERPERGLLAIRADLDLFANLRPAILFPQLADASSLKPELVAGLDILIVRELTGGIYFGEPRGIRTREDGEREGYNTYIYRESEIERIAKLAFELATKRGGRLTSVDKANVLEVTQLWREVVTNVAGNFPEVDLDHLYVDNAAMQLVRAPKQFDVLVTGNIFGDILSDTAAMLTGSIGMLPSASLNAHSAGLYEPVHGSAPDIAGQDCANPLATILSVAMLLRYSLDAPDAAIAVEAAVSAVLDQGCRTADIAAKGDVVIGTEAMGTAVLNALEGPQGNQL

SEQ ID NO: 11589 - protein, 325 aa, Cryptococcus neoformans var. neoformans JEC21
MSLGRTLKLNNGVVAPQIGFGTWQAAPGEVEKAVEEAIKVGYRHIDCALIYRVFDATGVYGTVAQGIKASGVPRKDLFLVSKLWNNSHRPEKVEADLDTSLKQLGTDYLDVYLIHWPVPFAPGDNLFPKTEDGKVAIDWDGPSVVDTWKELIRISKETKKVKAIGVSNFNVELLEKLIKETGVVPTMNQIECHPSLIQPELFKYCKEKNIVITAYSPLGNNTTGKPRIIDQPQIIDIAKKLNKEPAQVLINWAAHQGFAVIPKSVTPSRIKSNFEDFKLNDDVFEEINKVGKANAARANIPAEYNPSWPINVFGEKSEEQYKKVW

SEQ ID NO: 11590 - protein, 590 aa, Xylella fastidiosa 9a5c
MPHSAHRPTPTLHTQMNVRLQGHGAARGAALGRAWVRQMNVMEIQDKYITDTNAELHSLYQAMSAARQEIQVLRERMHGTLSHEVGEFLDLHTLLIDDPELLRSPNELILTHNYSAEYALKIQRDRLTTEFEAMEDHYLKSRMDDLNHVLGRIHAFLKKHSPEPKDAAGEILICNNIAPSELAQVQAQGIIGIVIAAGNTLSHSAILAHSLHLPLIVGAGDLQLQKITNGDMLIIDGNSGEIIVNPSPQDLRHYHSRLRERAKEQRELEQLRSKHSRTRDNVDIVVQANAESPDDVSQAYALGAAGVGLYRTEFLFLQRNKLPDEEEQFQTYRDTVLRMNGRPVTIRTLDLGADKTDCTGLTLSNEENPAMGLRGIRLSMAHPAVANTQLRAILRTSTYGHVRILVPMISCREEIILLRKQIKALSIQLRTEGHDIAEQVPLGAMIEVPAAAIALNSFIKEIDFLSIGTNDLVQYLLAADRNNAAISEIYSPLHPGVLAVLAQIIVTAHTHATPVAICGEIAGDPHYVPMLLALGLTEFSLHPATLLEVRRAIRNSDLGALKTSATTLLHARDRKSIEEWMAAHANTTPT

SEQ ID NO: 11591 - protein, 170 aa, Physcomitrella patens subsp. patens
PIGVGDKIPNGELTYLDGCGKLQTHLIYDLVREKRVVFFGVPGAFTPTCSLKHVPGFIERAAEILDRGINEIVCITVNDPFVVKEWEKTYPENKHVRFLCDGSAIWTKKIGLELDLYDRGMGVRSRRYSLMICDTVVRIANIEEGGGLETSTASRMLKDLNTGKDMVLPP

SEQ ID NO: 11592 - protein, 221 aa, Pavlova lutheri
ARGFTLLSTSLAFSPAARSAMAGRGHAASAVSMASDFLIAPSILSADFARLGDEVTNVLASGADVVHFDVMDNHYVPNLTIGPMVCKALRKHGVTAPIDVHLMVSPVDRIIGDFAEAGASYITFHPEATGHIDRSLQLVKSLGCKSGLVFNPATPLDCLEYVMDKVDIILLMSVNPGFGGQAFIPATLDKLRQARALIDKSGRDIRLEIDGGVTPKNIGEI

SEQ ID NO: 11593 - protein, 707 aa, marine gamma proteobacterium HTCC2080
MSNLGALDVRETVAGVTFNGGLGVGYRACLHSRLANRIILQLSEFAASSADDLYDGMANLPWCDHLAPSSTLAIDFSGRSEDIRNTQFGAQRCKDAIVDVFRSRGLSRPNVDTRAPDLRIHVRLHRGRVSVGIDLSGTSLHQRGYRTDPGKAPLKENLAAAVLIRSGWPELLAAGQPLVDPMCGSGTFLIEAAMMATARPPGLDRNRWGFQGWLGHSPAQWQTIEADGRDRLRPAPEGVELRGYDGDIRAVRRAEASIAALGLEDLIRVRPKALNTLTRPTHRVMQEGLIVCNPPWGERLGQLSTMQLLYRELGQVIHREFQGWKAGILTAHNELGRAVGLRSHKQYALNNGSIDIQLLLFDLSSSNRLAPDPADGHTKNNNAGQVSLAAETLTDGATMLANRLVKNKRRLKSWLKSSHTTCYRLYDADMPEYAVAIDVYEGVPHVAEYAPPKTIDEEAAEHRFQEALAAVRSVLQWPDDQPIPAKRRQRQRGAGQYNKLDQTGERITVHEGQARLLVNLNDYLDTGLFLDHRPLRLTLSEEAAGKHFLNLFCYTGAATIHAALGGAATSTSVDLSNTYLKWLVDNLALNGLSERQHRVVRADCLTWLEACDRKFDLVLLDPPSFSNSKATEGTLDIIRDQAELVDAAMSVLNSDGTLYFSNNHRRFELAEDLKQRYRVEDITRQTIPEDFKRRKDIHHCWRFQHLI

SEQ ID NO: 11594 - protein, 484 aa, Burkholderia thailandensis E264
MRNESHTDRERRRSTKIVATLGPSSSTEAAIEALARAGADVFRLNFSHGTHADHASRHAAVRAIEARIGHPIGILLDLQGPKLRVGQFAGSRAQIAKGQPFVFDRDPAPGDSRRVSLPHPEIFDAARPGHLLLVDDGKLRFRVEAVSAARIETIALLDGIVSDRKGVSVPDATLAIPALSAKDRDDLEFGLSLGVDWVALSFVQTAQDVRDARALIGSRAAIVAKIEKPQAVENIADIVDAADAVMVARGDLGVEMSLEDVPSVQKRIIRLARAAGKPVIVATQMLESMTLAPTPTRAEASDVASAVYDGADAVMLSAESASGQYPVEAVGFMRKIIATTEADPIQPQLMKAIVTAHAPNATDAIGAAIEVVSDTLRLGVAVTYTASGATAIRLSRLRPSTAILSLTPRADIARRLTLAWGVRSRVALEATGIENIVEIAIEAAHAEGFATDEYPIVVAAGVPFGHPGSTNLMRIVWPTEMTRQ

SEQ ID NO: 11595 - protein, 128 aa, Glycine max
MLKFLSRVKIEFNALDPRTASCIEFLAQCNSRRAKESNPTCEVDVKRVREERAPQITVTFVNGVEEVFDATATPAQSIRNLILEKGQHLETEQMFREAGEPWPVIIPDEELSQIALPTKPRKAEDKKQ

SEQ ID NO: 11596 - protein, 216 aa, Pavlova lutheri
AGIRHEERRKIMRALGARVVLTPATERGSGMVKKAIELAREHGWFLARQFENEANREFHAMTTGPEILQDFATRRLDYWVTGYGTGGTFAGAGAVLKLARPNVKIVLSEPAGAALVTSGAGQERMDDGSPAKTHPAFTPHPIQGWTPDFIPLNLHAGLEAHTHDEVITVTGDEAIATAQRLAREEGIFTGISGGAGMASALKVAERAPAGSVILTM

SEQ ID NO: 11597 - protein, 122 aa, Bacteroides fragilis NCTC 9343
MTTQHYIFLENVRFYSYHGVAPQETAIGNEFIINLRLKTDFGKATETDEVEDTVSYADIYAALKEEMELPSKLLEHVCGRIVKRLFRDFRKIREIEIKLAKRNPPMGADIDSAGVEMHCTRD

SEQ ID NO: 11598 - protein, 352 aa, Xanthomonas campestris pv. vesicatoria str. 85-10
MSTAHAYAAQAADQPLAPFVFERRAPGPHDVQIDIAYCGVCHSDLHTARNEWHNTLYPSVPGHEIVGRVTAVGNAVTGFKVGDLAGVGCMVDSCRSCASCQEGEEQYCEQGFTGTYNGPMFGGGENTYGGYSDHIVVDQKYVLRITHSDNLAAVAPLLCAGITTYSPLAHWKVGPGQKVGVVGLGGLGHMAVKIAKAMGATVVLFTTSESKRADAMRLGASEVVISKDEAQMAAQYNTLDFILNTVAAPHNLDPFLNALKRDGAMVLVGVPEQSHPSPAVFNLVMKRRTLAGSLIGGIRQTQEMLDFCAKHNIVSDIETIRADQINEAYERMLKSDVKYRFVIDMATLDKAA

SEQ ID NO: 11599 - protein, 493 aa, Xanthomonas campestris pv. vesicatoria str. 85-10
MSRKQAFQFLDLPRTMPTRIPVELRTSGDWGELYGKFDKADAQYQAGRCLDCGNPYCSWKCPVHNAIPQWLQLVQENRIEEAAALCHSTNPLPEVCGRVCPQDRLCEGSCTLEEFGAVTIGAVEKYIVDTAFKMGWRPDLGNVQPTGHRVAVIGAGPAGLACADRLARAGIEAVVYDRYEQIGGLLQFGIPSFKLDKSVIGKRREILEGMGVQFRLGVEIGKDVSIEQLLGEYDAVFLGTGAYRYTDGGLPGQDLKNVLPALPFLVQNSRIVSGNDPHGRPIAGWEDQLALPDLSGKRVVVLGGGDTGMDCVRSAIRLGAAKVTCAYRRDEASMPGSAREVANAREEGVRFLFNRQPLSIESGADDEAIGVTVVETRLGEPDASGRRNAVPVEGSESLLEADVVIIAFGFSPTLPDWLASQGVEAGSNGRIVAPADCNGRLPYQTSNPRLFAGGDCVRGADLVVTAVAEGRDAAGSIVQLLGVNAQVKEPAAA

SEQ ID NO: 11600 - protein, 313 aa, Klebsiella pneumoniae subsp. pneumoniae MGH 78578
MLDWTDRHCRYFLRLLSRHTLLYTEMVTTGAIIHGKGDYLAYSEEEHPVALQLGGSDPQALAQCAKLAEARGYDEINLNVGCPSDRVQNGMFGACLMGNALLVADCIKAMRDVVSIPVTVKTRIGIDDQDSYEFLCDFIETVSGKGECEMFIIHARKAWLSGLSPKENREIPPLDYPRVWQLKRDFPHLTMAINGGIKSLDEARVQLEHMDGVMVGREAYQNPGILASVDREIFGVAGADADPVAVVRAMYPYIERELSKGTYLGHITRHMLGLFQGIPGARQWRRYLSENAHKAGADIAVLEHALKLVADKR

SEQ ID NO: 11601 - protein, 155 aa, Triticum turgidum subsp. durum
LNKVTDGCVGRVAAKLESMEPCSSVKDRIGYSMITDAEEKRFIVPGKSVLIEPTSGNTGIGLAFMAAAKGYRLVLTMPASMSTERRIILKAFGAELILTDPLLGMKGAVQKAEELAAKTPNSYILQQFENAANPKIHYETTGPEIWKGTGGKIDG

SEQ ID NO: 11602 - protein, 228 aa, Burkholderia vietnamiensis G4
MTQFRIAPSILSADFARLGEEVRNVVAAGADWIHFDVMDNHYVPNLTIGPLVCEAIRPHVQVPIDVHLMVRPVDRIVPDFAKAGANLISFHPEGSDHIDRTLSLIRDHGCKAGLVFNPATPLNYLDHVMDRLDFVLLMSVNPGFGGQSFIPETLNKLREARARIDAYTERTGREILLEVDGGVKTDNIAEIAAAGADTFVAGSAIFGKPDYRKVIDEMRAALATVERS

SEQ ID NO: 11603 - protein, 327 aa, Klebsiella pneumoniae subsp. pneumoniae MGH 78578
MATRIEFSKHGGPEVLQAVEFTPRDPAEHEIQVENKAIGINYIDTYVRSGLYPPPSLPSGLGTEAAGIVSKVGHGVTHIKVGDRVVYAQSALGAYSTVHNVLADKAAVLPDAISFEQAAASFLKGLTVWYLLRKTYEIKPDEMFLFHAAAGGVGLIACQWAKALGAKLIGTVGSAQKAQRAKEAGAWQVINYREESIVERLKALTDGKKVAVVYDSVGKDTWEASLDCLQRRGLMVSFGNSSGPVTGVNLGILNQKGSLYVTRPSLQGYITNREELEEACSELFSLIASGVIKVDVAESQIYPLSEARRAHEVLESRVTQGSSLLLP

SEQ ID NO: 11604 - protein, 337 aa, Oryza sativa Indica Group
MPSTTARAGGVFLPIVKSLSLSAGSKPNDPSARKLGSYLVQSQLQASGNSSALFLTAAAQNLLCLKLAEEIGVKIANPWISWFKVASLPAIISLLATPYLLYKIFPPEIKDTPEAPAIAAQKLKNMGPVTRNEWIMVATMILAVSLWIFGDTIGVSSVVAAMIGLSILLLLGVLNWEDCLNEKSAWDTLAWFAILVGMAGQLTNLGIVSWMSNCVAKVLQSFSLSWPAAFGVLQASYFFIHYLFASQTAHVGALYSAFLAMHLAAGIPAILSALALTYNSNLFGALTHYSSGQSAVYYGAGYVDLPDVFKLGFTTAAINAVIWGVVGTFWWKFLGLY

SEQ ID NO: 11605 - protein, 207 aa, Anaplasma marginale str. St. Maries
MQRIFMSLVTKEAIDFAAKAVMSDGKVCDLNLSKHIAGKCAVLFFYPRDFTFVCPTEILSLHSRVPKFTARNVEVIGISTDSEFAHSHWRNTPVEQGGIGMVSFPLVADDSHTISESYGVLYGGKVALRATVIIDEDFIVRHHSVNDLPIGRNIDEVLRIIDAIAHHKKHGEVCPAGWTEGKVAMEATQHGVEHYLQSYADSLGPQE

SEQ ID NO: 11606 - protein, 510 aa, Oryza sativa Indica Group
MRLGKQRVFIFTASTEISGVSTREHGEGYGFLYCKSHVTAEQHLQPTQDFWIAASPSKVVQADAAALGTIAADMAPVVDGFSADDDELDLDSPTEGFSSIPEAIEDIRQGKYVIVVDDEDRENEGDLIMAASKVTPEAMAFIVRHGTGIVCVSMKEDDLERLELPLMVTTKENEEKLRTAFTVSVDAKEGTTTGVSAKDRANTVLALASPNSKPEDFNRPGHIFPLKYREGGVLKRAGHTEASVDLAMLAGLPPAAVLCEIVDDDDGSMALLPKLQDFARRENLKIISIADLIRYRRKRDRLVERVCVTPLQLQWGSFQSYCYRSLIDGMEHIAMVKGDVGDGQDILVRVHSECLTGDIFGSARCDCGNQLALAMTMIEKTGRGVVVYLRGHEGRGIGLGHKLRAYNLQDDGRDTVEANEDLGLPVDSREYGIGAQILRDLGVRTMRLMTNNPAKYTGLKGYGLSVLGRVPLLTPITNENRRYMETKRLKMGHVYGTRPSVIQALGLMAA

SEQ ID NO: 11607 - protein, 226 aa, Anaplasma marginale str. St. Maries
MGVPSASRQSACVFGERMFLISERLKSVQPSPTLEVSRLAAELRSQGVDVISLGAGEPDFDTPDHVKEAAIAAIHAGKTKYAPVDGIPELKEAVVLSIQSDYGLAYSTDQVLIGSGAKQCIYNLFMATLDPGDEVIIPAPYWVSYTDIVSISGGKPVVVDCGEEFKLTADLLERAITPRTKWLIINSPSNPTGVVYSRDDLRAIADVLLKHPTVYVMTDDIYAKLV

SEQ ID NO: 11608 - protein, 206 aa, Anaplasma marginale str. St. Maries
MLLKHPTVYVMTDDIYAKLVYDVEFVNILQVESALYDRVVIVNGVSKSHAMTGWRIGYIAGDARVIKAMSTIQSQSTTTANSIAQVAAVTALSGDSGFLDHRCKIFSKRRDMVMKAVEDSKILKAQLPHGAFYVFVSCKGAVGKRAEGFVIANGTDFAKYLLQHKVAVVPGVAFGAPDFFRISYALADDELSRACDRIVSACAALL

SEQ ID NO: 11609 - protein, 140 aa, Agrobacterium rhizogenes
MDMIQGQQTSGATSIAQWAAVEALNGTQDFIPANKKIFEGRRDLVVSMLNQAKGIVCPVPEGAFYVYPSCAGLIGKTAPSGKVIETDEDFVSELLESEGVDVVHGSAFGLGANFRISYATSEALIEEACRRIQQFCSNCS

SEQ ID NO: 11610 - protein, 293 aa, Hordeum vulgare subsp. spontaneum
MSPTLSLKLKKSSHTPQSSVSSSTKLRLFKKEAACQSPSTLPVAMDMGLEVSSSSPSSSSVSSSPEHAARRASPAKRPAGRTKFRETRHPVYRGVRRRGNTERWVCEVRVPGKRGARLWLGTYATAEVAARANDAAMLALGGRSAACLNFADSAWLLAVPSALSDLADVRRAAVEAVADFQRREAADGSLAIAVAKEASSGAPSLSPSSGSDSAGSTGTSEPSANGVFEGPVVMDSEMFRLDLFPEMDLGSYYMSLAEALLMDPPPTATIIHAYEDNGDGGADVRLWSYSVDM

SEQ ID NO: 11611 - protein, 439 aa, Clostridium tetani E88
MMSQIRDELIKKLENKTAKLGVVGLGYVGLPLAVEKAKAGYEVIGFDVQDEKVKMVNEGHNYIGDVVNSDLEEIVKKGKLRATTDFSFVGEVDVVAICVPTPLDLYKQPDLSYVENSTKSVATYLKKGMLVVLESTTYPGTTEEVLKPILESTGLKCGEDFFLAFSPERVDPGNKQFKTKNTPKVVGGCTEECTEVAAVLYRNVLEGEVFTVSSPAIAEMEKIFENTFRNINIALANEIAMLCNKMNIDVWEVIDAAKTKPYGFMAFYPGPGLGGHCIPLDPFYLEWKAKEYDFHTSLIQTSGRINDSMPEFVLKNVMKLLNGKKKSLNGSKVLLMGVAYKNDIDDMRESPALKVIEQLEAHGAEIVYHDANIPEFQHKGKTYHSVNWKEVVSDSDVVVITTAHSDVDYQALADKADLIYDTRNATKDVKGNEEKIYKL

SEQ ID NO: 11612 - protein, 300 aa, Clostridium tetani E88
MMKGDIIMKVKKAVIPAAGLGTRFLPATKAQPKEMLPIVDKPTIQHIIEEAVASGIEEILIITGRNKRAIEDHFDKSVELEQQLKDTGKKDMLEMVEDISNMAEIYYIRQKEPKGLGHAINCARTFVGNEPFAVMLGDDVVYGDKPCLKQLIECYNEYKTTILGVQQVVREDVYKYGIVEGKHIENNVYKVKDLIEKPDVDEAPSNIAILGRYIITPKIFEILSTIEPGKGGEIQLTDALKKLSLQEAIYAYDFEGRRYDVGDKLGFLEATIEFALRKDEIKNDFEKYILGIAEQIQSEE

SEQ ID NO: 11613 - protein, 412 aa, Rhodococcus sp. RHA1
MPSVGASLFWIVACAVIAPLLAGMFPRKLVPEVVLLLVAGIVIGPHVFDIAVEGSEIELLRDLGLGLLFLLAGYEIDTAEITGRGGRRALLTWLVSLALAFAVVSLLSIVHVVDAGTAVAIAMTSTALGTLLPILRDAGALDTRLGRTILNHGAFGELGPVVAMAVLLGSRGSVASIVVLGLFTAAAVLVAFIPARVRREGSRITAIIRSGSETTSQTTVRLTMLLLVALTVLAASFGLDTILGAFAAGFILRRATPEGDETLEKKLDGLAFGFLIPIFFVTSGMAIDVAAVASEPGVLIAFVLLILLVRAGPVYVAGRFDRGANGTDPPFTARERTQLALYAGTGLPLIVAVTGVAVDSGDMTSANASVLVAAGAITVLLFPLAASLLASSPEPAADTAGPRGDQNPGSRQ

SEQ ID NO: 11614 - protein, 146 aa, Zea mays
TIKLKYGNRAHNIPALDTTTGRCHITSQNHGYAVDASTLPSDWKPYFVNLNDSSNEGMIHKTRPIFSTQFHPEAKGGPLDSSYLFDIYLDSVVKYKNHQLAFHPNRNTVPSPLLVDLLAKERVGVQPTIGMQNVAAAAAAAAAAAA

SEQ ID NO: 11615 - protein, 444 aa, Oryza sativa Japonica Group
MATHAALAASRIPATARLHSKAASKQRVDFADFSGLRPGSCSISHAAREASFSDVLGSQLVARATGENAVRAPAEAKLKVAINGFGRIGRNFLRCWHERENSPLEVVVVNDSGGVRNASHLLKYDSMLGTFKADVKIVDDQTISVDGKLIKVVSNRDPLKLPWAELGIDIVIEGTGVFVDGPGAGKHIQAGAKKVIITAPAKGADIPTYVLGVNEGDYSHEVANIISNASCTTNCLAPFVKILDEEFGIVKGTMTTTHSYTGDQRLLDASHRDLRRARAAALNIVPTSTGAAKAVALVLPQLKGKLNGIALRVPTPNVSVVDLVINTVKTGITADDVNAAFRKAAAGPLSGILDVCDVPLVSVDFRCSDVSSTIDASLTMVMGDDMVKVVAWYDNEWGYSQRVVDLAHLVASKWPGAAVQGSGDPLEDFCKDNPETDECKVYEN

SEQ ID NO: 11616 - protein, 262 aa, Legionella pneumophila str. Paris
MKSLPIYQVDAFASNLFKGNPAAVCPLDKWLSDETMQAIAAENNLSETAFFAPETDGYRIRWFTPNEEVALCGHATLASSYVLFNQLGFSGEEIIFNSLSGKLWVKNTDQGLVMDFPVLPYEEINFSAELQHLNLKRPFKALRSQFDLMFVYQNAEEVVEAKPDLNAVAHLDYRGLILTAPGISTDVYSRCFYPGCNVPEDPVTGSAHCVIAPYWCEQLRKNHITALQGSLRQGDLYCEVKENRVLLYGNCHLYLEGRIYLP

SEQ ID NO: 11617 - protein, 379 aa, Burkholderia thailandensis E264
MCRSPRAFASPSARSDRSSRAARLKKATRGEAAARVSFDASHHRAAAACRAHHEISMSLHKIIYDTDPGVDDSMALVFQVLHPDIELIGVTSVFGNASIDTTTRNALYLAGRFAPGVPVARGAAAPLRRPAPEPLGGIHGDDGLGNTGLALSVDVAHAPNLDARPAHRFIIDTVRAHPHEVTLLAVGPLTNLAHVLAEDPEVATLVKQVVIMGGAFGTAGVLGNVSPAAEANIAGDPDAADIVMSAAWPLAIVGLDVTQATIMTTEYLAALRDDAGDAGRFVWDVSRHYEAFHCASAGLAGIYVHDSSAVAYVVAPQLYETRTGPVRVLTSGIAAGETIQKPATMTVPAPDWDGRPPRDVCVGVDAAAMLALYRKTLVG

SEQ ID NO: 11618 - protein, 520 aa, Burkholderia thailandensis E264
MSPHPNSDNSTAQSNPPQLRRSLKARHLTMIAIGGSIGTGLFVASGASISQAGPGGAVLAYLLIGLMVYCLMMSLGEMAAFMPVSGSFATYGAKYVEEGFGFALGWNYWYNWAVTIAVELVAAQLVMHYWFPDVPGVWWSAAFLGVMFLLNVLTVRGFGEAEYWFALIKVVTVLAFIGVGLLMIFGILKGGPSNGWSNFTIGDAPFAGGLPAMMGVAMIAGFSFQGTELIGVAAGESENPRTTIPRAVRQVFWRILLFYVLAIFVIGVLVPYTDPNLLKSDVTDVGVSPFTLVFRHAGLAFAAGVMNAVILTAVLSAGNSGMYASTRMLHNLATEGRAPKLFAKLSAGGVPRNALYATTAVGALCFLSSLYGDKTVYLWLLNTSGMTGFIAWLGIALSHYRFRKGYVRQGFSVDQLPYQSNLYPYGPIFAFALCIVIALGQDYQAFLANKIDWVGVLATYVGIPLFLVVWLGYRLVHKTRFVGYEDMDIASWVAEHERAAAHEAREAAAIRVPSSPEAAS

SEQ ID NO: 11619 - protein, 277 aa, Pavlova lutheri
TRLVLTSALFAFSPQSVTSRLNRSALRTPAQQVVMATQDELKKLAGYKAVDDYVRSGMVVGLGTGSTAAFAVERVGMKLKSGELKDIIAIPTSVRTKEQAEALGIPLVTLGTHSDLDVAIDGADAVDPRLNLIKGGGGALLREKMVEVCAKKFIVIVDDTKLCAGLGPSFPLPVEITPFCWEHTLRKVAACPAAAGCEAKLRLGSAATGSKVDGTDPAVTDNDNYIVDLFFKQPIADPVALAAQLKATVGVVDHGLFCGMTTACIIAGKDGISVQTP

SEQ ID NO: 11620 - protein, 91 aa, Zea mays
  misc_feature (50)..(50): Xaa can be any naturally occurring amino acid
MALRALYNEIRSMKVRDVPAYLKPRLTWDNVKKSADQAVDRYIEKYIDTXSPDPLYHVCIGGMIFSYFVNLPWERAHLAHLEEMERTGGKH

SEQ ID NO: 11621 - protein, 238 aa, Oryza sativa Indica Group
MGLIPVLCWGMRLSPCLASFSWVTIIDALVFNVCLNLAISLSRMAEEKKTPCLNERILSSLSKRSVAAHSWHDLEIADADAFSLSKCCIGPGAPQVFNVVVEITKGSKVKYELDKKTGMIKVDRVLYSSVVYPHNYGFIPRTLCEDGDPMDVLVLMQGEKDDKIIAVCVDDPEFRHFNDLKELSPHRLAEIRRFFEDYKKNENKEVAVNDFLPPATAQEAIKYSMDLYAEYILHSLRR

SEQ ID NO: 11622 - protein, 243 aa, Salmonella enterica subsp. enterica serovar Paratyphi B str.
MNYGDAVPITEGLADNPSIRLQSVQQVFSIFIQETEMSYSGERDNLAPHMALVPMVIEQTSRGERSFDIYSRLLKERVIFLTGQVEDHMANLIVAQMLFLEAENPEKDIYLYINSPGGVITAGMSIYDTMQFIKPDVSTICMGQAASMGAFLLTAGAKGKRFCLPNSRVMIHQPLGGYQGQATDIEIHAREILKVKGRMNELMAHHTGQSLEQIERDTERDRFLSAPEAVEYGLVDSILTHRN

SEQ ID NO: 11623 - protein, 337 aa, Triticum aestivum
MGNCSSFSLPKWIFGDLHNNGMVSIEGDGTHEGIKTIRIQKACEFTASSVLCVCIITWNMNGKMSVEDIRKLVSSTRKFDLLVVGLQEVPKCGVEQVLQEAMADTHILLCQKAMQSIQMFLFGAKSSEAYIKEMKVDEHAVGGCGGVIGRKKGAVAMYVNFSGIRMVFVSCHLAAHERKVEKRNSECRHISHSLFSKNDIHYAKSADITVWLGDLNYRLEGISSMPARKMIEENRQSKLRDRDQLLQEAEKGQVFNGYCEGTLSFKPTYKYNVGSSNYDSSYKIRVPSWTDRILFKVDHSSGLDAVLSSYEALDCVSSSDHKPVKAHLCLKVRGGNT

SEQ ID NO: 11624 - protein, 139 aa, Solanum tuberosum
NSEKIGEGTYGVVYKARDRVTNETIALKKIRLEQEDEGVPSTAIREISLLKEMQHGNIVRLQDVVHSEKRLYLVFEYLDLDLKKHMDSCPEFSKDPRLVKMFLYQILRGIAYCHSHRVLHRDLKPQNLLIDRRTNVLKL

SEQ ID NO: 11625 - protein, 747 aa, Arabidopsis thaliana
METESDDATITVVKDMRVRLENRIRTQHDAHLDLLSSLQSIVPDIVPSLDLSLKLISSFTNRPFVATPPLPEPKVEKKHHPIVKLGTQLQQLHGHDSKSMLVDSNQRDAEADGSSGSPMALVRAMVAECLLQRVPFSPTDSSTVLRKLENDQNARPAEKAALRDLGGECGPILAVETALKSMAEENGSVELEEFEVSGKPRIMVLAIDRTRLLKELPESFQGNNESNRVVETPNSIENATVSGGGFGVSGSGNFPRPEMWGGDPNMGFRPMMNAPRGMQMMGMHHPMGIMGRPPPFPLPLPLPVPSNQKLRSEEEDLKDVEALLSKKSFKEKQQSRTGEELLDLIHRPTAKEAATAAKFKSKGGSQVKYYCRYLTKEDCRLQSGSHIACNKVYIDLLLWCLCCFAEIYLVFMNSVYFQRHFRRLIASHTDVSLGDCSFLDTCRHMKSNHYFEFGQTCKYVHYELDMADAMMAGPDKALKPLRADYCSEAELGEAQWINCDIRSFRMDILGTFGVVMADPPWDIHMELPYGTMADDEMRTLNVPSLQTDGLIFLWVTGRAMELGREWYLEKSQQIFLELWGYKRVEEIIWVKTNQLQRIIRTGRTGHWLNHSKEHCLVGIKGNPEVNRNIDTDVIVAEVRETSRKPDEYDSGLLCDENACQPPDVCNVREDHAKSKKARVIRPYAQCSCRVKWLSLGNQLNGVRLINEGLRARFKASYPEIDVQPPSPPRASAMETDNEPMAIDSITA

SEQ ID NO: 11626 - protein, 123 aa, Marinobacter sp. ELB17
MLLPGLVAIALMPLVIYLMYPPEIKATPNAVDFVRERLGKLGKLSRDEGIMLDVFVVLLLLWAGVPAWIFGDTFKLNSTTTAFVGLSILPVTGVLNWKDVLGEKSAWDTLVWFGALVMMANPA

SEQ ID NO: 11627 - protein, 293 aa, Hordeum vulgare subsp. spontaneum
MSPTLSLKLKKSSHTPQSSVSSSTMLRLFKKEAACQSPSTLPVAMDMGLEVSSSSPSSSSVSSSPEHAARRASPAKRPAGRTKFRETRHPVYRGVRRRGNTERWVCEVRVPGKRGARLWLGTYATAEVAARANDAAMLALGGRSAACLNFADSAWLLAVPSALSDLADVRRAAVEAVADFQRREAADGSLAIAVPKEASSGAPSLSPSSGSDSAGSTGTSEPSANGVFEGPVVMDSEMFRLDLFPEMDLGSYYMSLAEALLMDPPPTATIIHAYEDNGDGGADVRLWSYSVDM

SEQ ID NO: 11628 - protein, 599 aa, Magnaporthe grisea 70-15
MHAIFLLAGLGLAAQTRRYNFTVTNQWSAGDGHGRPVFAINGQTPGPLIEADEGDEIEVFLENQLGFETTMHWHGIYQIDKPWNDGVPGVTQYSVQPRDNYTYSFTVQQQYGSYFYHGHFGPAFADGMRGPIWIRPAAWRPRPYHLISSSPADVAGMKAAEANPRHVVISDWNAEPMDTLLIMYRDTGIVPWCSNSIVLNNKGRTFCHSAEEIEAVGGPGRNSLGCLMQDGQALYSNLPTCEETFADLEVFEAQPGEEWMWINFIHSGAHHELQISIDEHEFYVVAADGEFVHPQKVHAANCNLGERIAILVRLDQAPGDYAVRVTSLRREQMIQGVGILRYSDRPAGARSGSARIAVPETRPWVHLNGTFISPSSVAMDESRLAPYPARPPPQKSDHTLRFFVNMTGPGSWALNIGPHQAFRQQLPPLLWEGDSRGDTTYGGTRGEIGDGRHGGAGSLPNGTVVDIIFENGANVNSQHPFHKHNNKAWIIGTGTGGFPWSSVDEALEQGGMSQHFNLVDPPLRDGCRLGNSTGDWTVIRYDISFPAASMLHCHMIHHFAAGQQVVLLEGVESMSKIPDHVKNMVHSDFQPPLRYGPLD

SEQ ID NO: 11629 - protein, 337 aa, Marinobacter sp. ELB17
MDIHAELLSTIQGLVQPGKGVLAADESLPTISKRFDAVGVASTEDKRREYRSLVFSTPGLGEFVSGVILFEETLGQNSLDNVPIAKLLESQGIVPGIKVDTGKKPLINAPGDEITYGLDGLDDRLEIYKNQGARFAKWRAVYNVSDTLPSRQAVEANAEMLARYAALCQSKGIVPIVEPEVLIDGNHTIKRSAEVNEAVIAEVFNALRRHRVQLETIILKPSMVTPGKACAKASPAAVAEATLRVLRRVVPAAVPGINFLSGGQAPEEATLNLNAMNSLGQQPWNLSFSYGRALQEPAQRAWAGKLDNAHAAQTAILKRARLNGAASSGAYKTDMEG

SEQ ID NO: 11630 - protein, 392 aa, Glycine max
MHANPITVSNMANLPVEVVTEILSRLPVKSVIRLRSTCKWWRSIIDSRHFILFHLNKSHTSLILRHRSQLYSLDLKSLLDPNPFELSHPLMCYSNSIKVLGSSNGLLCISNVADDIALWNPFLRKHRILPSDRFHRPESSLFAARVYGFGHHPPSNDYKLLSITYFVDLHKRTFDSQVQLYTLKSDSWKNLPSMPYALCCARTMGVFVSGSLHWLVTRKLQPDEPDLIVAFDLTSETFCEVPLPATVNGNFDMQVALLGGCLCVVEHRGTGFHVWVMRVYGSRDSWEKLFSLTENHHHEMGSGKLKYVRPLALDDGDRVLFEHNRSKLCWYDLKTGDVSCVKLPSGIGNTIEGTVCVQSLVPPTLLSLRDESQEKNRKKRDDFLSKGFKLTL

SEQ ID NO: 11631 - protein, 362 aa, Oryza sativa
MAGARAVGSLPVPNVQALAETCNGPDEHIPERYIRPEASSEEVISNYHGEAIPIIDLNKLLSPQSSEECVKLRSACQYWGFFQHYLWNKLQLINHGVPDEVIANLKRDIVDFFSQPLDAKKEYTQLPNSLEGYGQALVFSEDQKLDWADMLYLQVHPSDSRDLRFWPTSPASFRRSLDAYSSETKSLALCLFEFMAKAVGAKPEADKAGYRAPPRGLRMTYYPPCLQSDKVMGISPHSDVVGLTLLLQVNDVQGLQIKKDGKWLSVDAPNGAFIVNIGDTLEILSNGKFRSVEHRAVINPNKERISASLFHYPCENMVIRPLTEFVKDGKVNYRSISYLDFMTQFFTQQLDGKNRLEMLKLE

SEQ ID NO: 11632 - protein, 293 aa, Hordeum vulgare subsp. spontaneum
MSPTLSLKLKKSSHTPQSSVSSSTKLRLFKKEAACQSPSTLPVAMDMGLEVSSSSPSSSSVSSSPEHAARRASPAKRPAGRTKFRETRHPVYRGVRRRRNTERWVCEVRVPGKRGARLWLGTYATAEVAARANDAAMLALGGRSAACLNFADSAWLLAVPSALSDLADVRRAAVEAVADFQRREAADGSLAIAVAKEASSGAPSLSPSSGSDSAGSTGTSEPSANGVFEGPVVMDSEMFRLDLFPEMDLGSYYMSLAEALLMDPPPTATIIHAYEDNGDGGADVRLWSYSVDM

SEQ ID NO: 11633 - protein, 253 aa, Klebsiella pneumoniae subsp. pneumoniae MGH 78578
MTEAQRESLCALIRQAGAHAQALRDAGLQVDKKARQDFVSQADLAVEQEIKGWLQAHFPEEGFLGEESGFEGDDQTVWVLDPVDGTTNFILGMDYWCISLARVCQGELSLGIIYAPDRDEFFFAARGEGAYLNGRRLTLREPEPDAVVIGMGRSSRAPASDYARAIDTLLDAGLEYRRFGAGALMLAHVAAGQLHAYYEAHMNSWDALAGMLLIEEAGGTCNAFLANAGLRRGNLVLAGCASVQPRLAALLAK

SEQ ID NO: 11634 - protein, 377 aa, Triticum aestivum
MAKDGAGGGPDWNGLLKWSLAHGSDGTNPPRALSEEDRKWFMEAMQANTVDVVGRMKEIAQVMKTPDDVLQSHGVTPENIEDMLDELQEHVESIDMANDLHSIGGLDPLLGYLKNSNAGIRAKAAEVVSTVVQNNPKSQQLVMESNGLEPLLTNFRSDPSTTARTKALGAISSLIRNNQSGLAAFRLGNGHAALKDALGSDDARLQRKALHLTQYLLNNKADRNVAEKIGLPNQLIHLASSDDSGVREAALGGLLELARDKTPAARNALPDQDKLKDVLKSRIEGISAMDADDLQAAREERQLVDSLWKECYGEPSSLREKGLVVLPGEDAPQQPPPDVVGKMFEPPLRVWAVPRPAPAEDPDSGSGKKDPPLLLGP

SEQ ID NO: 11635 - protein, 450 aa, Chlamydomonas reinhardtii
MALRLFGRRAGQLGSSLAQATRAAAVATGELSASCSELFSRQSSVASSSHVREELAAFGVADARFRGLLHMRGLQTSALAMDAFEVQVPSMGESITEGTIANVLKKQGDAVKEDDIIAQIETDKVTIDVKYTGKAPGVISKVLINAADLVKVGQQVAIVETGGAAAAAAPAAAAPAAAAPPPPPPKPVAAEPAKPAAPKAPAPAPAAPTGPSSPTPGPRPERRVKMTRLRMRVAERLKGAQNTYAMLSTFNEVDMSAAIELRSTYKETFLEKHNVKLGFMSVFVKAAAHALQEVPSVNAVIEGDEIIFRDFYDISIAVATPKGLVVPVLRRADELSFADVEKNINALGKKARDGTIGIDDMAGGTFTISNGGVYGSLLSTPIINPPQSAILGMHAIVDRPVVVKGKIEIRPMMNIALTYDHRLIDGREAVTFLRRIKDVVEDPRRLLLDI

SEQ ID NO: 11636 - protein, 587 aa, Oryza sativa
WRGWDSAPCVLDLDDAATVGGGVGDTYGEDCATEEQLVTPWTVSVASGYNLLRDPRYNKGLAFNERERETHYLRGLLPPAIVSQELQERKIMHNIRQYQLPLQKYMAMMDLQEGNERLFYKLLIDNVEELLPVVYTPTVGEACQKYGSIFSRPQGLYISLKEKGKILEVLKNWPERSIQVIVVTDGERILGLGDLGCQGMGIPVGKLALYTALGGVRPSACLPITLDVGTNNEALPNDEFYIGLRQKRATAQEYADFLHEFMTAVKQNYGEKVLIQFEDFANHNAFELLAKYGTTHLVFNDDIQGTASVVLSGLVAALKLVGGSLSEHSYLFLGVGEAGTGIAELIALEISRQTKAPIEECRKKIWLVDSKGLIVSSRKETLQHFKKPWAHEHEPVGNLLDAVKTIKPTVLIGTSGKGQTFTQEVVEAISSFNERPVIFALSNPTSQSECTAEQAYTWSKGRAVFASGSPFDPVEYDGKIYVPGQANNAYIFPGFGLGVVMSGAIRVHDDMLLAASEALAQQVTQENFDKGLTYPPFSNIRKISAHIAANVAAKAYELGLASRRPRPKDLVKYAESCMYSPLYRNYR

SEQ ID NO: 11637 - protein, 1648 aa, Shewanella sp. MR-7
MNNLQFKRSAIASLTALYVSGACTFALAAPGMEKVAGSSFYTPTFTAEDVLKVTNERKAELSGDIYVGTPGQLNRVKKARTPEEIFQPEASSQGVQTYIVQLDAEPLATYEGDIPGFAATKAPVNRSIIAKGRVSVNTAAAQSYKSFLLGKQDKFVSRVRQAGVNLKINKQFTIASNALVVEMTQEDAIRMSHQAGVKRISPNRIFELRTDRGPEFIGADQMWQGTATQGGLPVKGEGMVVGIIDTGINTDHVAFADDEEYARLNPYKGQAIGDCGAFPELCNNKLVGLHSYPEITDVYAAPEFQTSSGAKKRIRPANAEDYAGHGSHTASTVAGNTLKDTPLQGFTGDKVSDGVDVPFTFPQTSGVAPRAHIIAYQVCWPGSSGDPYAGCPESAILSAFEDAIADGVDAINFSIGGAENMPWGDPMELAFLSAREAGISVAAAAGNSGAFWTADHSSPWVTTVGASTHDRKLKAGIKSITAFEGTGKPTTAIQGTSFSGSITGEVVLAEKYADPNPNDSYKAASCNVPFPAGTFTSDQIVVCERGDIARIEKAKNVAAGGAGGVILQNMSSSVDNLEADMYVIPGIQVKYTDRLKIRNWVLKNPGTARATITDFTNDYSFDASAGNNLATFSSLGPSKTNNTLVPDLTAPGVDIYAANADDQPFTNNPSASDWTFMSGTSMAAPHVTGAMTLLTQLHPDWTPAEIQSALMLTAGPVVLNTGYELIEPYYNFMAGAGAINVARAADTGLVMDETIENYRNADPTNGGVVNWLNLPSMVEMECEKTCSWMRTVKATRDGTWTVEGVGKEEGFEVSVSPASFSLKAGESQSIIITAKTPNLIEHKVEPEDGSSPWSAVLNQNTFFNGQVLLKEVNSSSPDVHMPVVVASVAEQLPISHRFEISRDQGTESLVVNTDSYSQLTPRFYGPVKPEIASSKLTAVSAILSKANIDKGWDIRPLVVPEGTKRLVVEVQKAELVSTLENLNPRYTQLHPFIMVGLDKNGSNTFVPEGDSPTSSEIRAEYIDELMCISTSQSEHNYCSFESPTPGTYWIATAMAYASGQGDVAIETGYALVMENDDKGYLSMSGPASHDGNGNYEIGLNWNIPETKAGDVYYGGFDLGNMPGAEGTLGFTALDIRRADDAVTWSVSQDKARSMDVIDVKLNIAPNLETQDRNYKFEMKLPEGMRLATGTIKTNNDEVATAIVADEHTLTLSGLQLSTRNVEREYKVSTNLTDKMCHTPIIDEYSKGGYIDLWGEFRIQPNADWFVGDFNNAFDVPINWLFYKQDAKFEVYNQPNAGYMRMHTVGALQFNTGYWYMSQHRGPGFLNEALAPFWRGTFTSKYRRDPSSPWGLTIASQYAAERPDLGDLLFLEFDNVTDTKTGEEFDFETILRSGIDDRPGQFEIIYAYSNLGENVAKGAVFVEGFDSPWSKTVGPKNGTLYEVLGFDDLDEKLQNDLVVCYDYVGPEQSRMEVSFKVAVQPEATGKTLDLELNYDLEGATPTSLVHTVTVNGNIKLVPIANQVVAENTRLEGLSVSYLDANKVPNTVEVTGEHISAEINGNDFTLIPEANFHGDTLVTVTVRDNEIGSDAASTSFMLTVESDGVEPTPVTPVTPEKPEPESSSGGALGWSLLSLLSMAFIRRAKKATRA

SEQ ID NO: 11638 - protein, 547 aa, Neisseria gonorrhoeae FA 1090
MDAFTRAWYALERHYQDTCHILLRDRFAAEPDRFERMHERLDGMLFDYSKNRFGEDTLQLLCRLAETADLEGKMRALRTGAKVNGSEGRAALHTALRLPDGADAVYADGRDVLPEIRRELNRALKFAHSLDDGLYQGITGKRIADFVHIGIGGSDLGPAMCVQALEPFRRQISVHFVSNADPACLDEVLCRLNPETTMFCVASKSFKTPETLLNAEAVKAWYRGAGFSESETAHHFCAVSADTEAAQSFGIAAERVFAMYDWVGGRYSVWSPVGLPVMVAVGGARFRELLAGAHAMDSHFFHTPPRRNIPVLMALIAVWYNNFQHADGQTAVPYSHNLRLLPAWLNQLDMESLGKSRASDGSPAACKTGGIVFGGEGVNCQHAYFQLLHQGTRLIPCDFIVPMTAQGAEDGRSRFTVANAFAQAEALMKGKTLDEARAELADLPEAERERLAPHKEFPGNRPSNSILLDRLTPCNLGMLMAAYEHKTFVQGAIWNVNPFDQWGVEYGKQLAKTIIGELEGGTSVHDASTEGLMAFYRECRLKGGGAA

SEQ ID NO: 11639 - protein, 259 aa, Streptomyces coelicolor A3(2)
MPAPAPSPVLLGVSLKMYFGHHQTLNWSRRIAALAERHPAVTSGAARLFVLPTFPALVPATGILAPYGVALGAQDIATEDSGPYTGEVGGPVLKEIGCRYAEVGHAERRRLYGEGDTVVAAKTAAALRNGLTPVLCVGERDAADPADAASRTVAEAERLLGGLSGAVVLAYEPQWAIGAPEPASADHIATVCTALRGWLDSHPRHAGSTVIYGGSAGPGLLTRLAGTAEGLFLGRFAHDPANVGAILDEIRSPAPAAVA

SEQ ID NO: 11640 - protein, 488 aa, Mycobacterium bovis AF2122/97
MADPGGFLKYTHRKLPKRRPVPLRLRDWREVYEEFDNESLRQQATRCMDCGIPFCHNGCPLGNLIPEWNDLVRRGRWRDAIERLHATNNFPDFTGRLCPAPCEPACVLGINQDPVTIKQIELEIIDKAFDEGWVQPRPPRKLTGQTVAVVGSGPAGLAAAQQLTRAGHTVTVFEREDRIGGLLRYGIPEFKMEKRHLDRRLDQMRSEGTEFRPGVNVGVDISAEKLRADFDAVVLAGGATAWRELPIPGRELEGVHQAMEFLPWANRVQEGDDVLDEDGQPPITAKGKKVVIIGGGDTGADCLGTVHRQGAIAVHQFEIMPRPPDARAESTPWPTYPLMYRVSAAHEEGGERVFSVNTEAFVGTDGRVSALRAHEVTMLDGKFVKVEGSDFELEADLVLLAMGFVGPERAGLLTDLGVKFTEHGNVARGDDFDTSVPGVFVAGDMGRGQSLIVWAIAEGRAAAAAVDRYLMGSSALPAPVKPTAAPLQ

SEQ ID NO: 11641 - protein, 186 aa, Bdellovibrio bacteriovorus HD100
MNPWHDLSPGEKAPEVVTALIEIPAGSKTKFELDKVSGLLKVDRVLYSSVHYPANYGFIPRTYCGDHDPLDILVLGQAQVYPLSIMRARPVGCMRMLDQGEMDDKVIAVHEDDPEMAHIHSIKDLAPHQLKEIRNFFEIYKGLENKKVEVEGFHDLPETLKIIKEAFDLYKQERTTLLKQSESGHD

SEQ ID NO: 11642 - protein, 411 aa, Xylella fastidiosa 9a5c
MSAVSESVLSLSRYYLPVYRPCQVVLVRGQGSRVWDEQGRDYLDLAAGIAVCCLGHCDPDLVAALVEQAGRLWHTSNVFYSEPSLRLAQELVDVSRFAERVFLCSSGTEANEAAIKLVRKWAAAQGRLPEHRTIVTFHGSFHGRTLAAVTATAQPKYQEGYEPLPGGFRYVDFNHIEALEAAMVGGDVAAVMLEPIQGEGGVMPVVSGYLAQVRALCDRYGALLVLDEIQCGMGRTGTLFAYWQEEVVPDIVTLAKGLGGGFPIGAMLAGPKVAEVMQFGAHGTTFGGNPMAAAVARVALRKLASVEIAANVQRQSVALRAGLEEISEAFGGVFTQVRGRGLMLGAVLAPLYAGQASAILEVAVEHGVLLLQAGPDVLRFVPALNVSDEELADGLVRLRAALGDYVSRFGG

SEQ ID NO: 11643 - protein, 872 aa, Burkholderia thailandensis E264
MPNHFSNGRTNQSRTVVIRSGAMPRLLGQPALKFLSLRGEEHLGKLYTYELLLRTPDDFHVPLATSANLDLKAMIGTEMTVGIQLDGIGTGAQGGVGAGAREISGLVVKAGFLRSEGRYNVYRIELRPWLWLATLTSDYKIFQDKSVVEIIDTVLHDYPYPVEKRLDIDKYSVAGESARNEPRAFQVQYGETDFDFVQRLMEEWGIYWFFEHSDNKHRLVLCDHIGGHRKAPSEAYHEIAHHPEGGKIDIEYINYFSTDEALRPGRVVIDDFDFTRPLASLVTSNHQPRETNWGEGELFEWPGDYTDSKHGDLISRVRMEERRATGSRAYGRGNVRGLACGHTFVLAKHKHDDANREYLVIESALMLTEVADETGSGYRYECDNELVVQPSNEVFRMPRETPKPTTNGPQSAIVVGPPGHEVWTDEFGRVKIRFLWDRYARNDATDSCWVRVSQAWAGVNFGGIYIPRIGQEVIVGFMNGDPDRPLILGSLYNTITPPPWDLPGDATKSGFKSKSITGGRENYNGIRFEDKLGAEEFHMQAEKDMNRLTKNDESHTIGANYSIGVGITHTRAVGAMFSSIVGGAASYAVGGAESTMIGGAYALNVGGAHAVAVGGASSVSVGGAYARNVGGAYALTVGGVLSIVCGASSITMTACGSIKIVGKNIRIIGSDEVVVQGAPLQLNPGDSDCGGGGGGGGGGGAIPPIPLPSFFLDITKPILPPPPPPPTEVPPEPTPTPEPTPTPEPTPTPTPTPTPTPTPTPTPTPTPTPTPTPTPTPTPTPTPTPTPTPTPTPTPTPTPTPTPTPTPTPTPTPTPTPTPTPTPTPTPTPTPTPTPTPTPTPTPTPTPTPTPTPTPTPTPTPTPTPTPTSSEI

SEQ ID NO: 11644 - protein, 436 aa, Candida albicans SC5314
MSSTPDFKVSSETAREYETKYSAHNYHPLPVVFSKAEGAHVWDPEGKEYLDFLSAYSAVNQGHCHPKIVAALVDQASKLTLCSRAFSSDVFGVYAKYITEYFNYEMVLPMNTGAEAVETGLKLARKWGYDKKGIPSGEAIILSAVNNFHGRTLGVISMSTDPDATTNFGPYLRGVGPQIPGEPEGTLLRYGVIEDVEKAFANAGDKIAAILLEPIQGEAGIVVPPEDYLPRVQELCKKHNVLLICDEIQTGIARTGKMLCYEHSKGVKPDIVLLGKAISGGVMPVSAVLSSKEVMSTLEPGSHGSTYGGNPLACRVAIAALDVVRDENLVERAQKLGALLREKLEELQKESNGMISEVRGKGLLSAIVIDESKTNGRTAWDLCLLMKNHGVLAKPTHDNIIRLAPPLVISEEDLLKGVDSIRKSLKELPNVAKTEH

SEQ ID NO: 11645 - protein, 175 aa, Oryza sativa Indica Group
MASSSSAQETGRWSLAGATALVTGGSKGIGRAIVEELASFGATVHTCARNEATQNSCLEEWSAKKLSITSSVCDVSARADREALAGRVAAIFDGKLDILVNNVGFLFLKPAVNVTPEELSRVMAGNLESCFHLSQLMHPLLKTSGKGNVVNISGISTVTGFPSLPICAFCAAKGS

SEQ ID NO: 11646 - protein, 193 aa, Erythrobacter sp. NAP1
MFIETETTPNPSSLKFLPGRAVMPSGTREFASPEAAEASPLAQAIFDTGEVVNVFYGWDFVTVTAAPGVDWSALKPQVHAILLDHFVSEAPLFVGGTADGISVPPEEAEMVVEDREEDAEIIASINELLETRVRPAVAGDGGDIAYRGFSDGVVYLTLQGACAGCPSSTATLKHGIESLLKHYVPEVVEVRAA

SEQ ID NO: 11647 - protein, 163 aa, Ralstonia eutropha JMP134
MRHIISVLLENEPGALSRVVGLFSARGYNIETLTVAPTEDASLSRMTIVTSGSDDVIEQITKHLNRLVEVVKVVDLTEGAHIERELMLVKVRAVGKEREEMKRTADIFRGRIIDVTEKTYTIELTGNGVKLDAFLDAIDRTAILETVRTGGSGIGRGERILKV

SEQ ID NO: 11648 - protein, 335 aa, Geobacter metallireducens GS-15
MGEKIGVIGAGSWGTTLANLLAKKGLDVTLWAYEPELVAEMRATRVNTLFLPGTELAAGLAFTNSLEEAAAGKDVLVLVSPSQVMRSVLTQLAPLLKPGVTLVNASKGIELDTLMTMDQVCGAVLPPAVAGRFCVLSGPSFAREVAQEMPTAVVAASADLEAAAQVQRLFTAPYFRVYTNSDVVGVEIGGALKNVIALAAGISDGLGLGHNTRAALITRGLAEMNRLGRAMGADPATFAGLAGMGDLVLTCTGDLSRNRTVGMKLGQGMRLAEILGEMRMVAEGVKTAESAWRLASQMGVDMPITEKVYQVLYEDKPARQAVLELMTRDPKAERG

SEQ ID NO: 11649 - protein, 631 aa, Glycine max
MGSPVNGVYSSSEVHNSVSVVDHDPPSTSGIPRSSRPPLRAPRNYGASSSQKHSYQEADNVERDRVPNMDKQYYDANGKSDNASLNKAVESCLGKNISSMETKLSIKQPLDASKNCDSGGVLESDNCKLGSSKGVVDPTKSYCQSEITFCPSPQNSFYSEAKESFVNTGASECVSVDKSVESGEVTNSCEFNESRKTSICRGSTGSDVSDESSTSSLSSTLYKPHKANDIRWEAIQAIRVRDGVLEMRHFRLLKKLGCGDIGSVYLAELSGTRTCFAMKVMNKTELASRKKLVRSQTEREILQSLDHPFLPTLYTHFETETFSCLVMEFCPGGDLHALRQRQPGKYFSEIAARFYVAEVLLALEYLHMLGVIYRDLKPENVLVREDGHIMLSDFDLSLRCAVSPTLVKSSNSSLETKSSGYCIQPACIEPTCVIQPACIQPSCFTPRFFSSKSKKEKKSKPKNDLQNQVTPLPELIAEPTNARSMSFVGTHEYLAPEIIKGEGHGSAVDWWTFGIFLYELLFGRTPFKGSANRATLFNVVGQPLKFPESPTVSFAARDLIRGLLVKEPQNRLAYRRGATEIKQHPFFHNVNWALIRCANPPEVPRQAMKALAAEKVPGVKPSGNYLDIDFF

SEQ ID NO: 11650 - protein, 508 aa, Geobacter metallireducens GS-15
MNNLKILIVDDEADIALILKLQLEDAGYRTTRARDGLEALEMLAREHYDLILLDIRMPRLDGIEVLERIRQEWPELVVVMMTAHGSEDIAVEAMKKGAVDYISKPFSSDDMKKRVERAIEYNRTRLENERLQREVEEERRKMEAILQGMAEALVAVDRQGLVMSINRTAAELFGVDAAAVHARPVEELLSAAIPADRLPCRVVLATGEPCLDVAYDLRLPGRIVPVLSSAAPLANAAGEMIGSVEIIRDISALKALEQEREDFVSMLSHDLKTPITAIIGSIDLVKEGRLGPVNPEQSMYLDAAVESCAEMVDMIDTLLDVHRFEAGRMVTTLVEEELGPLLQRTVGRFEPVARHSGLELTLSLPGAPVTFLVDRKQFGRLLGNLLSNALKFTTEGGIEVRAELPENAAAAAQGITPGAYPTERLPREGRYLLVSVSDTGAGIPADSLVTIFDRFVQARNRKMGKSSGTGLGLAFCRKVMDAHHGFIWAESEPDRGSTFRMLFPLGTD

SEQ ID NO: 11651 - protein, 303 aa, Oryza sativa
  misc_feature (294)..(294): Xaa can be any naturally occurring amino acid
MTKSFAHTLGKGGYGTVYKGSLSDGSEIAVKMLEDTMGDAEDFINEVVSIGRTSHINVVTLLGLCLHRSKRALVYEYMPNGSLDKYAVGVVDTVQGEKSLSWEKLYEILVGNAQGLDYLHRWCNHRVVHLDIKPQNILLDQDFRPKISDFGLAKLCKPKESKISIGGARGTIGYMAPEVFWRHHGAVTTKSDVYSYGMLILQMVGARENTNASMQTVSKYFPEWLYDNLNQFCGAATEGIDSRNTCISEVARKLVTIGFWCIQCTPEDRPSMSEVIDMFDRSMHELQLPPRMSXCGIDNPSIV

SEQ ID NO: 11652 - protein, 271 aa, Bacillus sp. SG-1
CAMSNWQEIDTYVKHWIKEAGERIRQSFKTQLNIQTKSNRNDLVTNVDQETEQFFIERIRNIYPDHHILGEEGFGDELKDMKGTIWIIDPIDGTMNFVHQQRNFAISIGIYHDGEGMLGYIYDVVHDELYHGRKGHGAYMNDLELPPLQEVDVRDSIIGVNALWVTDNNRINKEVLGPLVRDVRGTRSYGSAAMEMAYVASGRIDGYMTMRLAPWDFAAGKILIEEVGGVVTSLDGKELDMLQKSSVFSCKPGLHENISKTYLKDVSIKKI

SEQ ID NO: 11653 - protein, 287 aa, Hordeum vulgare subsp. spontaneum
MSPTLSLKLKKSSHTPQSSVSSSTKLRLFKKEAACQSPSTLPVAMDMGLEVSSPSPFSSSVSSSPEHTAKRPAGRTKFRETRHPVYRGVRRRGNTERWVCEVRVPGKRGARLWLGTYATAEVAARANDAAMLALGGRSAACLNFADSAWLLAVPSALSDLADVRRAAVEAVADFQRREAADGSLAIAVPKEASSGAPSLSPSSGSDSAGSTGTSEPSANGVFEGPVVMDSEMFRLDLFPEMDLGSYYMSLAEALLMDPPPTATIIHAYEDNGDGGADVRLWSYSVDM

SEQ ID NO: 11654 - protein, 303 aa, Streptomyces fradiae
MNDRPRRAMKGIILAGGSGTRLRPLTGTLSKQLLPVYDKPMIYYPLSVLMLAGIREIQIISSKDHLDLFRSLLGEGDRLGLSISYAEQREPRGIAEAFLIGARHIGGDDAALILGDNVFHGPGFSSVLTGTVARLDGCELFGYPVKDAHRYGVGEIDSGGRLLSLEEKPRRPLEPGRHRLYLYTNDVVEIARTISPSARGELEITDVNKVYLEQGRAAHGAGAVVAWLDMGTHDSLLQAGQYVQLLEQRQGERIACIEEIAMRMGFISAEQCYRLGQELRSSSYGSYIIDVAMRGAAADSRAQ

SEQ ID NO: 11655 - protein, 244 aa, Lentisphaera araneosa HTCC2155
MLVNKEKQNVPSVTFRTRVNNDWKDLSTGEIFKNKTVVVFALPGAFTPTCSSTHLPRYNQLAPVLKANGVDDIYCLSVNDSFVMNAWAADQDSANIKLLPDGNGEFSDGMGLLVDKDDLGFGKRSWRYSMLVKDGVIEKMFIEPDKPGDPFEVSDADTMLNYINPQAKLPKLVSMISKPGCSHCQRARQVLEDQAMPYEEIKLGQGGMSLTTLKAVSGNATTPQVFIDGQLIGGADELIKYLNQ

SEQ ID NO: 11656 - protein, 111 aa, Triticum aestivum
AATRRLLPTLLRTLTGTRHAGAARGLATEKAVGAAAVVGSHTAKWMQDTSKKSPMELINEVPPIKVEGRIAACEGDKNPALGHPIEYICLDLDAPAVCKYCGLRYVQDHHH

SEQ ID NO: 11657 - protein, 225 aa, Burkholderia xenovorans LB400
MSNLFALSSQQTHRSLTGRVQRALSAMRDGRPVVVVDDLDREDEADLVIAAERITVESMALMIRECSGIVCLCLTGETLQRLQLPPMVERNESRHGTAFTVSIEAKVGVTTGVSAADRVTTVRAAIADHARAEDLARPGHIFPLMARPNGVLERRGHTEGAVDLARMAGLKPAAVLCELMNEDGTMARGAQIVRFAAIHRLPVISIADIAAYRCAQELAVSATAV

SEQ ID NO: 11658 - protein, 498 aa, Zea mays
  misc_feature (318)..(318): Xaa can be any naturally occurring amino acid
MVSSKKVCVVGAGVSGLACARELLREGHDVTVMEQSGGVGGQWLYDPRADGGDPLGAAGAHSSMYASVRLISPRELTGFSDFPFFPRDDGTGDSRRYPGHAEFLRYIRDFCDAFGLMDVVRLNTKVLRVGLAAPRAADDGDGIKRWTVSWSRHRGCDGEVVTTEEEVFDAVVVAVGQYTQPRLPTIRGMDKWSRRQLHSHSYRVPDSFHGEVVVIVGFRHSGVDIALELSKLAREVHVSVKSMEALTPAVSKAVARHSDLHLHLQERKPCSYKSMLQYSLIECLREDGQVTFADGSRVAADSIIYCTGYDCSFPFLDXGGLVTVDDSRVGPLYEHTFPPALAPSLSFVGLPRMVLVPRFYEAQARWVAQALSGRRLLPPAEEMLRAAEEYHRAREKAGVPRRMSHAIFFDFDYCDEFGEKHVGLPRPPEWKKELMRAAVARLLQDTETFRDDYRDGDLVLESLRLEGWSSAPSPGTLNDENGIAMHDMMHDRDGETLE

SEQ ID NO: 11659 - protein, 502 aa, Brassica rapa subsp. pekinensis
MARKMLSDGELNKAAAAGEEATTETHYDFDLFVIGAGSGGVRAARFSANNGAKVGICELPFHPISSEEIGGVGGTCVIRGCVPKKILVYGATYGGELEDARNYGWEINGNVDFNWKKLLQKKTDEILRLNNIYKRLLANAAVKLYEGEGRIVGPNEVEVRQIDGTKISYTAKHILIATGSRAQKPNIPGHELAITSDEALSLEEFPKRAIVLGGGYIAVEFASIWRGMGATVDLFFRKELPLRGFDDEMRALVARNLEGRGINLHPQTSLAELIKTDDGIKVISSHGEEFVADVVLFATGRIPNTKRLNLEAVGVELDQAGAVKVDEYSRTNIPSIWAVGDATNRINLTPVALMEATCFANTVFGGKPAKADYTNVACAVFCIPPLAVVGLSEEEAVEKATGDILVFTSGFNPMKNTISGRQEKSLMKLIVDEKTDKVIGASMCGPDAAEIMQGIAIALKCGATKAQFDSTVGIHPSSAEEFVTMRTVTRRIAYKAKPQTSL

SEQ ID NO: 11660 - protein, 320 aa, Cuphea lanceolata
MATATAAGCSGAVALKSLGGRRLCIPQQLSPVLAGFGSHAAKSFPILSTRSIATSGIRAQVATAEKVSAGAGQSVESPVVIVTGASRGIGKAIALSLGKAGCKVLVNYARSSKEAEEVSKEIEAFGGQALTFGGDVSKEEDVEAMIKTAVDAWGTVDILVNNAGITRDGLLMRMKKSQWQEVIDLNLTGVFLCTQAAAKIMMKKKKGRIINIASVVGLVGNAGQANYSAAKAGVIGFTKTVAREYASRNINVNAVAPGFISSDMTSKLGDDINKKILETIPLGRYGQPEEVAGLVEFLAINPASSYVTGQVFTIDGGMTM

SEQ ID NO: 11661 - protein, 530 aa, Arabidopsis thaliana
MTVNGEFPGPTIKAFAGDTIVVNLTNKLTTEGLVIHWHGIRQFGSPWADGAAGVTQCAINPGETFTYNFTVEKPGTHFYHGHYGMQRSAGLYGSLIVDVAKGKSERLRYDGEFNLLLSDWWHEAIPSQELGLSSKPMRWIGEAQSILINGRGQFNCSLAAQFSNNTSLPMCTFKEGDQCAPQILHVEPNKTYRIRLSSTTALASLNLAVQGHKLVVVEADGNYITPFTTDDIDIYSGESYSVLLTTDQDPSQNYYISVGVRGRKPNTTQALTILNYVTAPASKLPSSPPPVTPRWDDFERSKNFSKKIFSAMGSPSPPKKYRKRLILLNTQNLIDGYTKWAINNVSLVTPATPYLGSVKYNLKLGFNRKSPPRSYRMDYDIMNPPPFPNTTTGNGIYVFPFNVTVDVIIQNANVLKGIVSEIHPWHLHGHDFWVLGYGDGKFKPGIDEKTYNLKNPPLRNTAILYPYGWTAIRFVTDNPGVWFFHCHIEPHLHMGMGVVFAEGLNRIGKVPDEALGCGLTKQFLMNRNRN

SEQ ID NO: 11662 - protein, 229 aa, Xylella fastidiosa 9a5c
MTLRPFIETVVMPPNAQPPQTCDPKQMSSPLECAKYLLSAHTTHQLPADDGSEVAFAGRSNAGKSSVLNTLTRQNALARVSKTPGRTQQLVYFTVTPQRYLVDLPGYGYAKVPKELQIHWQTFIDSYFHQRQALRGLVVVMDIRHPLKEYDLQMLAYARQRGLPAQALLTKADKLGRGQQAQTLQKVRNELTKHFADHINIQTFSSKSRQGVEQLHTVIETWLGLARLA

SEQ ID NO: 11663 - protein, 231 aa, Brassica napus
  misc_feature (206)..(206): Xaa can be any naturally occurring amino acid
EDWGATVVLVGDTYDEAQAFAKQRAEEEGLTFIPPFDHPDVIAGQGTVGMEITRQAKGPLHAIFVPIGGGGLIAGIAAYVKRVSPEVKIIGVEPADANSMALSLHHGERVILNQIGGFADGVAVKEVGEETFRICRKLIDGVVLVTRDAMCASIKDMFEEKRNILEPAGALAIAGAEAYCKYYGLKDVNVVAITSGANMNFDKLRXVTELANVGRQQEAVLATIWPEKLEA

SEQ ID NO: 11664 - protein, 547 aa, Zea mays
MEIYYSMFIAPFTTMLSFSTLLAFITFALSHLFKLQWQRNAQKPKQPSLPPGPKPWPIVGNLPELIINKKKTSVSYWIHSFMKEMNTEIACIRLGNVHVIPVTCPEISLQFMRKQDAIFASRPLTMATDVLSKGHLTTIFSPLGDQWRKMKRVMVSEMLSHERHRWLHEKRVEEADNLVRYVLNQCKNGDEGGLVDLRLVARHYCCNVIKKLIFNRGYFGEGKADGRPGFEEEEYVDAILALVIHLYSFCISDYWPFLRGLDLEGHEKIVEDATRVLEKYNNPIIEDRIQQWRDGKKHEPQDLLDVLVSLTDDNGTPLLSADEIKAQVNEIMIAAVDNPSNNLEWALAEMLNKPETLQKARDELDNVVGKYRLIQESDVPQLNFTKACAREAFRLHPVAAFSPPHVSVTDTTVGDYFIPKGSHVIVSRVGLGRNPKVWDEPCEFKPERHLQNCNKGEEVVLEEPDLRLFTFGRGRRGCPGVVLGSLMTTMLFARLLQGFDWSIPTNQGTIDLCPGRGVPFLAKPLLAVAKPRLPPHVYSFLTESEIQ

SEQ ID NO: 11665 - protein, 204 aa, Zea mays
MAGEEGLKVLGLQVSPFVLRVCLALNMKGVSYEYVEEDISNKSELLLKSNPVHKKVPVLIHNGKPICESLVIMQYVDELFAGRPILPTDPYERATARFWAAYADDKLFPAWYGMVKAQAEEERAEKAKETLAAIEHMEVTFAKCSGGNAFFGGDSIGYVDIVLTVFDLEIINASKTPLLAAWAERFVGTVEAKEVVPLPTADMA

SEQ ID NO: 11666 - protein, 943 aa, Arabidopsis thaliana
MSLFLKPFLFLYDTTLSLLLLLFNGWSLEDTAAAQKRREADKNAAETEWIQLQYLWTKTRSVVLLPVFKGLVVMCLVLSIIVFFESFYMNFVILFVKLFKRKPHKVYKWEAMQEDVEVGPDNYPMVLIQIPMYNEKEEGVDVEIAKWQSQGINIRCERRDNRNGYKAGAMKEALTQSYVKQCDFVAVFDADFQPEPDYLIRAVPFLVHNPDVALVQARWIFVNANKCLMTRMQEMSLNYHFKVEQESGSTRHAFFGFNGTAGVWRISAMEAAGGWKSRTTVEDMDLAVRVGLHGWKFVYLNDLTVRNELPSKFKAYRFQQHRWSCGPANLFRKMTMEIIFNKRVSIWKKFYVIYSFFFVRKVAVHFLTFFFYCIIVPTSVFFPEIHIPSWSTIYVPSLISIFHTLATPRSFYLVIFWVLFENVMAMHRTKGTCIGLLEGGRVNEWVVTEKLGDALKSKLLSRSEFQGSDGGAYNEKQLFQPLETENANAMTAVMERGLKTQRRPEHKNAYATMMYMGTPRDYEFYVATRVLIRSLKSLHVDADIVVIASLDVPINWIHALEEEDGAKVVRVENLENPYKKQTNFDNRFKLSLNKLYAWSLSDYDRVVMLDVDNLFLKNTDELFQCGQFCAVFINPCIFHTGLFVLQPSMEVFRDMLHELEVKRDNPDGADQGFLVSYFSDLLNQPLFRPPPDNRTALKGHFRLPLGYQMDASYYYLKLRWNVPCGPNSVITFPGAVWLKPWYWWSWPVLPLGLSWHHQRRYTISYSAEMPWVLTQAVFYLGIILVTRLARPNMTKLCYRRSDKNLSMIQTAFKFVALLFILSAYIIPFFIIPQTIHPLIGWSLYLTGSFALSTIPINAFLLPILPVITPWLGIFGTLLVMAFPSYPDGVVRALSVFGYAFCCAPFLWVSFVKITSHLQIMIDKEVLFPRLGESGVTSGLSKLY

SEQ ID NO: 11667 - protein, 478 aa, Nocardioides sp. JS614
MHGLSVHLSRRCLRARPAPAVRRDPHPDGSPSARATHEQTARPAPGHLRLRCIGTARLPIHLKSTRERTDRCTTCTPTGVPPATTPTTRAATRTSPRPSRPRSTCGTTAASARTTTSLGRMTTTHTGTSGSLRLAVIPGDGIGPEVTAEALKVLEVASPAGVKFEQTRYDLGAERYLATGEVLPDSVLEEIREHDAILLGAVGGKPNDPNLPPGILERGLLLRLRFELDHYVNLRPSRIFPGVASPLANPGEVDFVVVREGTEGPYTGNGGALRVGTPHEIATEVSVNTAFGVERVVRDAFARAQRRPRKKLTLVHKTNVLVNAGAVWWRITQQVAAEYPEVSVDYMHIDAAMIFMTTDPARFDVIVTDNLFGDIITDLAAAITGGIGLAASGNVNPDRTAPSMFEPVHGSAPDIAGQQKADPTAAILSASLLLDHLGYADAAAVIETAAIADLAAREPGAARRTADVGEAIAARVAG

SEQ ID NO: 11668 - protein, 396 aa, Oryza sativa Indica Group
MAASHGNAIFVLLLCTLFLPSLACDSGGVKFGYTGSIGPDFWGNLSADFTRCSNGKQQSPIDIDTNNLVHELNMEPLHRNYTAANATLVDNIFNVALRYEEAAGVLSINGVKYTLKQMHWHSPSEHTINGFRFPLELHMVHTNENGNITVLAFLYRFGRPDPFFEQDKLAALNAEGCKAEKGSPVPAGSVSLLTMRQHVHIYYRYVGSLTTPPCAENVIWNIPAMPREMTPQQAADLMAPLDEGYRRNSRPTQQMNGRTVQLYHRTFEECNAVRAAIEAHDVKLIERDVSMDSGYREELRLLLGGREVRVPAVFVRGRHVGGAAEVTKLEEEGKLKALLQGLPRARVWCAGCAGVRFVMCRDCNGSRKVRVDGERKETVQCGECNENGLVRCPICS

SEQ ID NO: 11669 - protein, 535 aa, Burkholderia thailandensis E264
MQSDDAVTETPEALTPDARPRATIAPRAGTLDDYLKLTLNARVYDVARETALERARNLSARLDNAVYLKREDNQPVFSFKLRGAYNKMAHIPADALARGVITASAGNHAQGVAFSAARMNVKAVIVVPVTTPQLKVDAVRAHGGPTVEVIQAGESYSDAYAHAVKVQAERGLTFVHPFDDPYVIAGQGTVAMGILRQHQGPIHAIFVPIGGGGLAAGVAAYVKAVRPEIKVIGVQTDDSCAMKQSLAAGKRVELAEVGLFSDGTAVKLVGEETFRLCAAYLDDVVTVDTDALCAAIKDVFQDTRSVLEPAGSLAVAGAKRYAERAGIEGETLVAITSGANMNFDRMRFVAERAEVGEAREAVFAVTIPEERGSFRRFCSLVGERNVTEFNYRIADAQSAHIFVGVQIRRRDETDEIARNFAAHGFTTVDLSGDELSKQHIRYMVGGRSPLAHDERLFRFEFPERPGALMKFLSSMAPDWNISLFHYRNQGADYSSILVGLQVPQADHAAFDRFLAALGYPCREESGNPAYRLFLG

SEQ ID NO: 11670 - protein, 302 aa, Marinobacter sp. ELB17
MSAEQLVHLVNVQIVPISLFLIMLGMGLSLVPDDFRRVLAYPKAVAIGLSCQLVLLPLIGFGLANLVPLSPELAVGVMLLVVCPGGTTSNLYAHIAKGDVALSVTLTAVASVVTVFSIPFIVNGSLLHFMGESEAITLPIGRTMVSLVLLTIIPISIGMTVRRFMPVLAIAVEQRVKYFAVIFLALLIAFLVYQQRETFADSIISAGPVALLLNLSTMLIGFYGARLFALNRQQSISITLETGLQNSGLSMVLALGMLNNYAMSLVPAIYTGVMFITAGVLVYCLNRSKPHAVGVVGGGGPV

SEQ ID NO: 11671 - protein, 578 aa, Nicotiana tabacum
MASLGFLFFFLLPLILLELSSSRSVMAAKTRHFKWDVEYIHWSPDGEESVVMGINGQFPGPTIRAKAGDTVAVHLTNKLHTEGVVIHWHGIRQIGTPWADGTAAISQCAINPGETFLYRFKVDKAGTYFYHGHYGMQRSAGLYGSLIVEVGEGEKEPFHYDGEFNLLLSDWWHKGSHEQEVDLSSNPLRWIGEPQTLLLNGRGQYNCSLAARFSKPPLPQCKLRGGEQYAPQILRVRPNKIYRLRVASTTALGSLSLAIGGHKMVVVEADGNYVQPFSVQDMDIYSGESYSVLFKTDQDPTKNYWISINVRGREPKTPQGLTLLNYLPNSASKFPTLPPPIAPLWNDYNHSKSFSNKIFALMGSPKPPPQNHRRIILLNTQNKIDGYTKWAINNVSLVLPTQLYLGSIRYGINAFDTKPPPDNFPKDYDVLKQAPNSNSTYGNGVYMLKFNTTIDIILQNANALAKDVSEIHPWHLHGHDFWVLGYGEGKFSEKDVKKFNLKNPPLRNTAVIFPFGWTALRFVTDNPGVWAFHCHIEPHLHMGMGVIFAEGVHLVKKIPKEALACGLTGKMLMSNKHN

SEQ ID NO: 11672 - protein, 245 aa, Ralstonia eutropha JMP134
MRQKLVIGNWKMHGSLAANAALLEGIKAAPARARLAVCAPFPYLAQCQALLNGSQVAWGAQDVSAEARGAFTGEVAASMLGEFGCTYALVGHSERRTYHGESDAVVAAKALRALEFGIIPVICVGETLAQREAGETEVVVGRQLQAALDALSVEQLGRVVLAYEPVWAIGTGKTASSEQAQAVHAFLRAEVRERDAGVADRMAILYGGSVKPDNAAELFSMSDIDGGLIGGASLKSEDFLAIGNA

SEQ ID NO: 11673 - protein, 624 aa, Candida albicans
MRTFLSSFIILTTFLASLIAAETHTWYFKTGWVDANPDGVYPRKMIGFNDSWPLPTLRVKKGDRVQLYLINGFDNLNTTLHFHGLFVRGANQMDGPEMVTQCPIPPGETYLYNFTVTDQVGTYWYHSHTGGQYGDGMRGVFIIEDDDFPYHYDEEVVLTLSDHYHKYSGDIGPAFLTRFNPTGAEPIPQNFLFNETRNATWKVEPGKTYFVRILNVGGFVSQYLWMEDHEFTIVEIDGVYVEKNTTDLIYITVAQRYGVLITTKNSTDKNYVFMNGVDTTMLDSVPADLQVNGTNYIVYNESSALPDAYDIDSYDDALDDFYLKPLSKQKLMDDADYTITVDVQMNVLNDGINYAFFNNISYKAPKVPTLLTVLSAGEAATNELIYGTNTNSFVLQGGDIVDIVLNNFDTGKHPFHLHGHVFQLIERHEAIGSKESAVTFNVSDHAEWPEYPMIRDTVYVKPHSYMVLRFKADNPVVWFFHCHVDWHLEQGLAVVLIEDPQAIQKNEKITENHKRICEKVGVPWEGNAAANSNDYLDLKGENVQVKRLPTGFTTKGIVALVFSCVAAFLGLFSFSFYGMNDIAHVEDKVARDLDIDLEAENEDEEEAVVLNQNSSSSDSNSKPH

SEQ ID NO: 11674 - protein, 168 aa, Burkholderia vietnamiensis G4
MIQVGEALPDAQLFEYVDDAREGCTLGPNAVSVREQVAGKRVVIFGLPGAFTPTCSAQHVPGYVEHAEQLRAAGIDELWCVSVNDAFVMGAWGRDLHTAGKVRMIADGSAAFTHALGLTQDLSARGMGIRSLRYAMVVDDGVVKTLAVEAPGKFEVSDAASVLATLRP

SEQ ID NO: 11675 - protein, 427 aa, Anaplasma marginale str. St. Maries
MVGCMYNFENLWLPYSGVLSPIDAVKVVSGSGCYLELENGRKLLDGISSWWSVCHGYSHPHIVAKMREQVERLSHVMLCSGLVHEGACELASRLMGLAPPGLQKVFFSDSGSMAVEVAMKIAVQYWHIVGKPQKTGFVAFKNAYHGDSMGCMSVSDPMAIHGTQFSGYYPTQHLFDLPVDERDFELLGRKIEQIAHRTAAIVVEPILQAAGGMRIYSPDVLASLLKLAREANILFIVDEVATGFGRIGTMFACEQAKISPDIMVLGKAMTGGMCPLSATLVSSEICGPFESCGERLMHGNTFAANPLACAAANASLDLFEDGSLMSRVQVIEERMGRGLEPLRGLKYVHNIRVKGAVAAMEIAADNFDHLQENFLRKLIDCEIWIRPIGNTVYLMPPLIISDAELEHLLTAVCTLVHSCRERLELVV

SEQ ID NO: 11676 - protein, 258 aa, Pseudomonas putida
MTAEGFLEGRRLQMARGVLLQCIMGGYPPAKFYGCDDGDLALVAEPSQVHRLPWSDDGRALAICDANELDGRPSALSTRGQLKAVIARYAALGLAPVVATELEFFVFAPNSDPQQPFQPPLGTDGRRELGHSAFSVSSNNGLRPFFNEVYQCMAALGLPRDTFMHEMGVSQFEINLLHGDPLLLADQTFLFKHLLKEVALKHGLTVVCMAKPLARTPGSSMHIHQSLVDTGSGRNVFSDEQGQPTDTFHHFIGGLQAC

SEQ ID NO: 11677 - protein, 268 aa, Anaplasma marginale str. St. Maries
MVEHLTCNQGVVGSSPAAGSLVLSVELMSFLVVANWKMNGDTALVRDFLAAIDTSFASDLLNKGSLELVICPPFTLMSAFDSRCPSVRLGAQNCFSGVSKGCTGEISAAMLKECGCDYVILGHSDRRGTFAEENSDIRLKAESAIEEGITPIICVGETLQERNSGISSDILVEQCSKCCPKYGEFIIAYEPVWAIGGSTIPDLEIIRESFDTIRSHGSARTILYGGSVNQGNIRALKSQIDGLSGVLVGSAGTKVDEFCGIISNVLEL

SEQ ID NO: 11678 - protein, 137 aa, Streptococcus pneumoniae TIGR4
MEQTFFIIKPDGVKRGLVGEVLKRIEQRGFTIEKLEFRSQVSEELIDQHYQDLVGQSFYPPIREFMTSGPVLVGVISGPKVIETWRTMMGATRPEEALPGTIRGDFAKAAGENEIIQNVVHGSDSEESAKREIALWF

SEQ ID NO: 11679 - protein, 225 aa, Halobacterium salinarum
MTIPSFAIGIAGGTGAGKTTVAREITDNVGESATLIPLDNYYEDLSDRPFEERANANYDHPSAFEWELLRTHIDALLSGQSIEMPQYDFERHVRKADRVVVEPTDVIVLEGILALSDETVNDMLDLHIYVETDADVRILRRIERDVVERGRELEGVMDQYLSTVKPMHEQFIEPTKRHADIIIPEGANSVAVNLLEEKVQAETSEMTAWAARDDTAFEDATYNPQ

SEQ ID NO: 11680 - protein, 496 aa, Thlaspi arvense
MDLLYIVAALVIFASLLIAKSKRKPKKNLPPGPPRLPIIGNLHQLGEKPHRAMVELSKTYGPLMSLKLGSVTTVVATSVETVRDVLKTYDLECCSRPYMTYPARITYNLKDLVFSPYDKYWRQVRKLTVVELYTAKRVQSFRHIREEEVASFVRFNKQAASSEETVNLSQKILKMSGSVICRIGFGINLEGSKLENTYQEIIVQAFEVLGSLAAVDYFPVIGTIIDRITGLHAKCEKVFHGIDSFFDQAIQRHIDDPSIKDDIIDLLLKMERGEGSLGEYELTREHTKGILMNILTAGIDTSAQTMTWAMTHLLANPRVMKKLQAEIREKIKNIDEITDDDVEQLDYFKLVLKETFRISPIVPVLVPRVAAKDLKIAGYDVPEKTWIHVNMWAVHMSPSIWKDPETFNPERFIDNQTDFKGLNFELLPFGSGRRMCPGMGMGLAVVHLTLINLLYRFDWKLPNGMKAEELSIEENYGLICVKKLPLEAIPVLTQWT

SEQ ID NO: 11681 - protein, 388 aa, Arabidopsis thaliana
MASSKGSQSVRNLMYPGKHALLPPKIPFPSVSASYSEYIPTGLIGSRHGQKLSNEKTHHQRTSSESHLVEELPFWLDDLLNEQPESPARKCGHRRSSSDSYAYLDVANATNISLTLQNDFSYRNTVLSTQRGVQELDRNKNAQDAAFYSGASFLKQKSRQRDSLVATGACPSWLPFARENGGGKNLGALYMSQDATVISSERKNYAEPFSHDPKMLSSEENNSNPSPVTYEADNTKRAKQQFAQRSRVRKLQYISELERNVQTLQAEGSKVSAELDFLNQRNLILSMENKALKKRLESIAQEKLIKQLEQEVLEKEIGRLRALYQQQQQTQKPSASRGRATSKDLDSQFSSLSLNTKDSNCRRDSVSVMGPGDSTRSDPYLPPHHRRF

SEQ ID NO: 11682 - protein, 506 aa, Petunia x hybrida
MMLLTELGAATSIFLIAHIIISTLISKTTGRHLPPGPRGWPVIGALPLLGAMPHVSLAKMAKKYGAIMYLKVGTCGMAVASTPDAAKAFLKTLDINFSNRPPNAGATHLAYNAQDMVFAHYGPRWKLLRKLSNLHMLGGKALENWANVRANELGHMLKSMSDMSREGQRVVVAEMLTFAMANMIGQVMLSKRVFVDKGVEVNEFKDMVVELMTIAGYFNIGDFIPCLAWMDLQGIEKRMKRLHKKFDALLTKMFDEHKATTYERKGKPDFLDVVMENGDNSEGERLSTTNIKALLLNLFTAGTDTSSSAIEWALAEMMKNPAILKKAQAEMDQVIGRNRRLLESDIPNLPYLRAICKETFRKHPSTPLNLPRISNEPCIVDGYYIPKNTRLSVNIWAIGRDPQVWENPLEFNPERFLSGRNSKIDPRGNDFELIPFGAGRRICAGTRMGIVMVEYILGTLVHSFDWKLPSEVIELNMEEAFGLALQKAVPLEAMVTPRLQLDVYVP

SEQ ID NO: 11683 - protein, 508 aa, Petunia x hybrida
MVLLSELAAATLIFLTTHIFISTLLSITNGRRLPPGPRGWPVIGALPLLGAMPHVSLAKMAKKYGAIMYLKVGTCGMVVASTPDAAKAFLKTLDLNFSNRPPNAGATHLAYGAQDMVFAHYGPRWKLLRKLSNLHMLGGKALENWANVRANELGHMLKSMFDMSREGERVVVAEMLTFAMANMIGQVILSKRVFVNKGVEVNEFKDMVVELMTTAGYFNIGDFIPCLAWMDLQGIEKGMKRLHKKFDALLTKMFDEHKATSYERKGKPDFLDCVMENRDNSEGERLSTTNIKALLLNLFTAGTDTSSSAIEWALAEMMKNPAILKKAQGEMDQVIGNNRRLLESDIPNLPYLRAICKETFRKHPSTPLNLPRISNEPCIVDGYYIPKNTRLSVNIWAIGRDPEVWENPLEFYPERFLSGRNSKIDPRGNDFELIPFGAGRRICAGTRMGIVMVEYILGTLVHSFDWKLPSEVIELNMEEAFGLALQKAVPLEAMVTPRLPIDVYAPLA

SEQ ID NO: 11684 - protein, 175 aa, Rickettsia typhi str. Wilmington
MSKVKKNEEALSEVLVDVNRVTKVVKGGRRFAFSAYVVVGDKAGRVGAGHGKAKEVNEARGKAKQAAKKRMMKVPLYQNRTIHHDVVGKSGAAKVILRRAKAGTGVIAGGSMRAIFDSLGVHDIVAKSIGSTNVYAMISATFDALNKLASPKSIAIRRGKKVHEISVKSYIQVNK

SEQ ID NO: 11685 - protein, 544 aa, Mycosphaerella graminicola
MGLLQEVLAQFDAQFGQTSLWKLVGLGFLAFSTLAILLNVLSQLLFRGKSSDPPLVFHWVPFIGSTITYGIDPYKFFFSCREKYGDVFTFILLGKKTTVCLGTKGNDFILNGKLKDVNAEEIYSPLTTPVFGKDVVYDCPNSKLMEQKKFVKYGLTTSALQSYVTLIAAETRQFFDRNNPHKKFASTSGTIDLPPALAELTIYTASRSLQGKEVREGFDSSFADLYHYLDMGFTPINFMLPWAPLPQNRRRDYAQKKMSETYMSIIQKRRESKTGEHEEDMIHNLMQCKYKDGNAIPDKEIAHMMIALLMAGQHSSSATESWITLRLASRPDIQDELLQEQKDMLGVNADGSIKELTYANLSKLTLLNQVVKETLRIHAPVHSILRKVKSPMPIEGTAYVIPTTHTLLAAPGTTSRMDEHFPDCLHWEPHRWDESPSEKYKHLSPTTALGSIAEEKEDDGYGLVSKGAASPYLPFGAGRHRCIGEQFAYVQLQTITATMVRDFKFYNVDGSDNVVGTDYSSLFSRPLSPAVVKWERREEKEEKN

SEQ ID NO: 11686 - protein, 571 aa, Legionella pneumophila str. Paris
MLDFSLNRDPQTGELYIETSLCGKPLLTTPQLNKGTAFTQEERKDFGLLGKLPHRVETLDEQVKRAYLQYSSYTTRLQQHIYLNNLHDKNQIVFYKLLSRHLGEMLPIIYTPIVGAAAKRFSHEYRQPRGLYIAHSDKNQLEEIINNRSNPDIDLVVVTDGEGVLGIGDQGIGGMDIPVAKLMVYSLCGGIDPTRTLPIFLDVGTNNQELLNDPMYLGCRHPRIKSSEYDDFIKTFVNEIHKQFPNAFLHWEDFGRGNARRILDQFQDELCTFNDDIQGTGAVTLAAILAACDVTGLPLHEHRIVVFGAGSAGTGISDQIVDAMVKSGLSLTDAYDRFWLIDKQGLLLATDQELTDAQKPYAWNPIDIQSWEINNKQHPSFTDTIRHVKPTILIGCSAQTGAFSQDIVETMSTACERPIIFPLSNPDEKCEAQPSDILAWSKGRALIATGTAFAPIEYQNRMVQIAQCNNALVFPGIGLGVLAVSASRLTKDMILAAAQTLSKFAPSKKDSFLPLLPSLDNAQIVAKEIAIAVAQCAIDSGYAQKNQDKDLPRLIDELFWEPRYLPFRKRG

SEQ ID NO: 11687 - protein, 335 aa, Triticum aestivum
  misc_feature (280)..(280): Xaa can be any naturally occurring amino acid
  misc_feature (294)..(294): Xaa can be any naturally occurring amino acid
  misc_feature (317)..(317): Xaa can be any naturally occurring amino acid
MGALRALLASFLLAALATQAFVSVSARTGPTDKAGQDDVKKPDCVPSLDPHNFPGHGGTTVPLPSHGGSSGTPPYHGGSGTTPSHGGSGSTPSHSGSGSLPDPSHGGYGTPPSHGGSGSLPDPSHSGGGYGSTPDAPSHGGGAYGSSPTPSTGGAYGSSPTPSHDGGAYGSSPTPAHDGGSYSGTPAAPSHSSHGSVTPTPLVPVDPNSLGTCDYWRTHPMQIWSALGSWPSSVSHFFGAAGGAVAGGPSMSIQDALANTRTDGAGALLREGTAALLTPXDPPGFAYTTQQVRXTVAAAAAGGSDSAWAAQAAAFQXANEGRKGLMTDRHREGFS

SEQ ID NO: 11688 - protein, 744 aa, Mycobacterium bovis AF2122/97
MSITRPTGSYARQMLDPGGWVEADEDTFYDRAQEYSQVLQRVTDVLDTCRQQKGHVFEGGLWSGGAANAANGALGANINQLMTLQDYLATVITWHRHIAGLIEQAKSDIGNNVDGAQREIDILENDPSLDADERHTAINSLVTATHGANVSLVAETAERVLESKNWKPPKNALEDLLQQKSPPPPDVPTLVVPSPGTPGTPGTPGTPITPGTPITPGTPITPGTPITPGTPITPIPGAPVTPITPTPGTPVTPVTPGKPVTPVTPVKPGTPGEPTPITPVTPPVAPATPATPATPVTPAPAPHPQPAPAPAPSPGPQPVTPATPGPSGPATPGTPGGEPAPHVKPAALAEQPGVPGQHAGGGTQSGPAHADESAASVTPAAASGVPGARAAAAAPSGTAVGAGARSSVGTAAASGAGSHAATGRAPVATSDKAAAPSTRAASARTAPPARPPSTDHIDKPDRSESADDGTPVSMIPVSAARAARDAATAAASARQRGRGDALRLARRIAAALNASDNNAGDYGFFWITAVTTDGSIVVANSYGLAYIPDGMELPNKVYLASADHAIPVDEIARCATYPVLAVQAWAAFHDMTLRAVIGTAEQLASSDPGVAKIVLEPDDIPESGKMTGRSRLEVVDPSAAAQLADTTDQRLLDLLPPAPVDVNPPGDERHMLWFELMKPMTSTATGREAAHLRAFRAYAAHSQEIALHQAHTATDAAVQRVAVADWLYWQYVTGLLDRALAAAS

SEQ ID NO: 11689 - protein, 309 aa, Zea mays
MAGGGSRRAGAAEQPKIGSGNVFAALETLKKKKKPADKGAKPAAREDPKPEVFWAPAPLTAKSWADVEDDDDDDYFATTAPPPRPVWGDAHRDAAKDQHDAPALEEEIESEDDGLDDDADEDHEDKADDAVPAEPTAKNATAPPAPPKDTERQLSKKELKKKELAELDAVLAELGLGTSNNSIQEEPNGKKGADQVADGEKKEDAPAPLESKNSKKKKSKKEKSSKELKEAQDQANGSEAAAVAEPDEDTASVDVKERIKKVASMKKKKSSKEMDAAAKIAASEAAARSARLAAAKKKEKSHYNQQPVR

SEQ ID NO: 11690 - protein, 337 aa, Oryza sativa Japonica Group
MAKIKIGINGFGRIGRLVARVALQSDDVELVAVNDPFITTDYMTYMFKYDTVHGQWKHHEVKVKDSKTLLFGEKEVTVFGCRNPEEIPWGETGAEFVVESTGVFTDKDKAAAHLKGGAKKVVISAPSKDAPMFVVGVNEKEYKPDIDIVSNASCTTNCLAPLAKVINDRFGIVEGLMTTVHAITATQKTVDGPSSKDWRGGRAASFNIIPSSTGAAKAVGKVLPALNGKLTGMAFRVPTVDVSVVDLTVRLEKPASYDQIKAAIKEESEGKLKGILGYVEEDLVSTDFQGDNRSSIFDAKAGIALNDNFVKLVSWYDNEWGYSSRVVDLIRHMYNTQ

SEQ ID NO: 11691 - protein, 182 aa, Synechococcus sp. WH 8102
MRDSASGSSDVPTVLVRDSDGRDLLCFLEQLIRLDGTDYVLLTPVDTPVSLFRLQDDADPEPIITLNSSEPILSVADVVLQEHDLTLVRSAVTLTVSGELDEPDPDELEDEDDDDGDEDSETFELLVSFMVEEQEFGLYIPLDPFFVVARMVDGQAELVEGEDFDLIQPRLEAELEEREWPE

SEQ ID NO: 11692 - protein, 357 aa, Synechococcus sp. WH 8102
MAQHRVVLLPGDGIGPEITAVARQLLEAVSQRHGFELCFDGQLIGGSAIDACGEPLPASTLDACKAADAVLLAAIGSPRFDNLPRDKRPETGLLGLRSGMALFANLRPVKIVPALIGASSLRPEVIEGVDLMVVRELTGGIYFGQPKGRIQADGEERGFNTMTYSSSEVDRIARVAFDLARERRGNLCSVDKANVLDVSQLWRDRVDAMAPAYSDVEVSHMYVDNAAMQLVRSPRQFDVLLTGNLFGDILSDEAAMLTGSIGMLPSASLGSDCPGLFEPVHGSAPDIAGQDKANPMAMVLSAAMMLRIGLKQTEAAADLEAAVDKVLAAGFRTGDLMAEGCTALGCRAMGDALLKAL

SEQ ID NO: 11693 - protein, 300 aa, Synechococcus sp. WH 8102
MSKRHPVVAVTGSSGAGTSTVKRAFEHIFAREGITPAVVEGDSYHRYERMPMKQAMADALARGENFSHFGPEANLFDKLEELFRSYGETGAGQKRYYLHSAEEAAEHNARLGVDLGPGQFTPWEDIPAGTDLLFYEGLHGGVKGDGYDVASLADLLVGVVPITNLEWIQKIHRDNAERGYSAEAIVDTILRRMPDYINHICPQFGETDINFQRVPTVDTSNPFICRNIPTPDESFVIIHFRKGAREKWGIDFNYLLNMIHDSFMSSPTSIVVNGGKMGFAMELILTPIIHRMIEEKKNLG

SEQ ID NO: 11694 - protein, 456 aa, Vitis vinifera
MIRLWILALQMSELFVSSVVHLVYGFYIFSTAVAFDLSQALNDCFKPNEDESRGGSPSVDGLPPIVLVHGIFGFGKGRLGGLSYFAGAEKKDERVLVPDLGSLTSIYDRARELFYYLKGGQVDYGEEHSKACGHSQFGRIYEQGNYPEWDEDHPIHFVGHSAGAQVVRVLQQMLADKAFKGYENSSENWVLSITSLSGAFNGTTRTYLDGMQPEDGRCLKPICLLQLCRLGVIVYDWFDIPWLKAYYNFGFDHFNLSWKKIGVWGLVDCLLGNTGPFVSGDWILPDLTIQGSIRLNYHLNTFPNTFYFSYATKRTRKIMGVTVPSSILGIHPMLFIRVLQMSQWRHPPDVPPPYKGYRDEDWQDNDGALNTISMTHPRIPIEHPSHFVVNDSECQPLQPGIWYYKIVEADHVLFIVNRERAGVQFDLIYDSIFERCRKHVFRKTPPTLPDQSVPNQ

SEQ ID NO: 11695 - protein, 279 aa, Enterococcus faecalis V583
MITSLADTVTLNNGTKIPGMGLGVFQIPDEETAKVVEEGIINGYRLIDTAQIYGNESGTGAGIKAGLAATGLNREDLFVTSKVWNAHISYDETIQAFNDSLERLGLDYLDLYLIHWPGNNSYKESWQALETLYAEGKVKAIGVSNFQVHHLEDLLSYAKVVPVINQVELHPKLDQKEVRDFCEKHDIKVQAWSPLMQGQLLSNETILAIAENHNKSAAQVILRWDIQQDILLAVKSVHKERMISNAAVFDFELSAEEMAQINQLNESLRVGPDPDTFDF

SEQ ID NO: 11696 - protein, 287 aa, Hordeum vulgare subsp. spontaneum
MSPTLSLKLKKSSHTPQSSVSSSTKLRLFKKEAACQSPSTLPVAMDMGLEVSSPSPFSSSVSSSPEHTAKRPAGRTKFRETRHPVYRGVRRRGNTERWVCEVRVPGKRGARLWLGTYATAEVAARANDAAMLALGGRSAACLNFADSAWLLAVPSALSDLADVRRAAVEAVADFQRREAADGSLSIAVPKEASSGAPSLSPSSGSDSAGSTGTSEPSANGVFEGPVVMDSEMFRLDLFPEMDLGSYYMSLAEALLMDPPPTATIIHAYEDNGDGGADVRLWSYSVDM

SEQ ID NO: 11697 - protein, 379 aa, Aspergillus nidulans FGSC A4
MPPTIRVIGSLNADMVSVTPRFPDAGETITSSSYFTSAGGKGANQAVACGRLSRSQPQSSSFSTSINTGDVNVEMVGAVGGLDGHFSALLKPTLEKSGVDTSRVKVVEDAYTGVAVIIVDSSAGGENRILFSPGANYSGMQADPSVVGMALAEPAPDVIVMQGEIPTETTVAILREIARWKEQQRADGKRGIDAGPDVMFNPAPAPPGGLPEDVYKGVDHLIMNETEAELMTPDEDVLLRVPGIESAQDGKEKVARYFHSLGVRYVIVTLGAKGVWYSAADPDTLGDRVVNEVPAAKVSRVLDTTAAGDTFVGAYAVQAARWREGRRREGKAGKDLDAEEKKHRYKNVMDEAMGVATRASARGVERQGAMDSIPWENEI

SEQ ID NO: 11698 - protein, 287 aa, Hordeum vulgare subsp. spontaneum
MSPTLSLKLKKSSHTPQSSVSSSTKLRLFKKEAACQSPSTLPVAMDMGLEVSSPSPFSSSVSSSPEHTAKRPAGRTKFRETRHPVYRGVRRRGNTERWVCEVRVPGKRGARLWLGTYATAEVAARANDAAMLALGGRSAACLNFADSAWLLAVPSALSDLADVRRAAVEAVADFQRREAADGSLAIAVPKEASSGAPSLSPSSGSDSAGSTGTSEPSANGVFEGTVVMDSEMFRLDLFPEMDLGSYYMSLAEALLMDPPPTATIIHAYEDNGDGGADVRLWSYSVDM

SEQ ID NO: 11699 - protein, 1163 aa, Oryza sativa Indica Group
MGGVTSSVAAKFAFFPPDPPAYGVADEEEPPPPGSAAPAAAATARRVSLTGVPWREGVEARRVRTRRGTEIIAVYVRCPKARLTVLYSHGNAADIGKMYELFVEFSARLHVNLMGYDYSGYGRSSGKASEANTFADIEAAYKCLVEVYGTREEDIILYGQSVGSGPTVDLAAQLHRIRAVVLHSPILSGLRVMYSVKKTYWFDIYKNIEKMPLVKSPVLVIHGTNDDIVDCSHGKQLWELCQNKYEPLWIEGGDHCNLQTFPVYIRHLKKFISTIENMPLEKESSSTENEKLLAETETASDGSALSDAPWTTSQRLEPPRKSTRHELPPRLSNDRVDKRRRSTGRREKPRSIVEKKEKSRRSVDTFDRTRDEHDQPDKPRKSIDRSLGASSVAALRPCAGRVRAPGAGAARGSGSARCGRGVRWEAGSGSRGRLVRVRCDAAVAEKAEETAEEEKFEYQAEVSRLMDLIVHSLYSHKEVFLRELVSNASDALDKLRFLGVTDSSLLADGGELEIRIKPDPDAGTITITDTGIGMTKDELKDCLGTIAQSGTSKFLKALKENKDLGADNGLIGQFGVGFYSAFLVAEKVVVSTKSPKSDKQYVWEGVADSSSYVIKEETDPEKMLTRGTQITLVLRPDDKFEFADPGRIQGLVKNYSQFVSFPIYTWQEKSRTVEVEEDEEAKEGEEAKEGEQKKKKTITEKYWDWELANETKPIWMRSPKEIEKTEYNEFYKKAFNEFLDPLAYTHFTTEGEVEFRSVLYIPGMAPLSNEEIMNPKTKNIRLYVKRVFISDDFDGELFPRYLSFVKGVVDSNDLPLNVSREILQESRIVRIMRKRLVRKTFDMIEEISEKDDKEDYKKFWESFGKFIKLGCIEDTGNHKRLAPLLRFHTSKNEGDLISLDQYVENMPENQKAIYYIATDSLQSAKTAPFLEKLVQKDIEVLYLIEPIDEVAIQNLQTYKEKKFVDISKEDLELGDEDEDNKESKQEYTLLCDWVKQQLGDKVAKVQISKRLSLSPCVLVSGKFGWSANMERLMKAQTLGDTSSLEFMRGRRIFEINPDHPIVKDLNAACKNEPESTEAKRAVELLYETALISSGYTPDSPAELGGKIYEMMTIALGGRWGRSDTETEAATTGDASTETGSSEATVTEVIEPSEVRPESDPWRD

SEQ ID NO: 11700 - protein, 293 aa, Hordeum vulgare subsp. spontaneum
MSPTLSLKLKKSSHTPQSSVSSSTKLRLFKKEAACQSPSTLPVAMGMGLEVSSSSPSSSSVSSSPEHAARRASPAKRPAGRTKFRETRHPVYRGVRRRGNTERWVCEVRVPGKRGARLWLGTYATAEVAARANDAAMLALGGRSAACLNFADSAWLLAVPSALSDLADVRRAAVEAVADFQRREAADGSLAIAVPKEASSGAPSLSPSSGSDSAGSTGTSEPSANGEFEGPVVMDSEMFRLDLFPEMDLGSYYMSLAEALLMDPPPTATIIHAYEDNGDGGADVRLWSYSVDM

SEQ ID NO: 11701 - protein, 464 aa, Thermus scotoductus
MDPMKTYDLIVIGTGPGGYPAAIRGAQLGLKVLAVEAAEVGGVCLNVGCIPTKALLHAAETVHHLKGAEGFGLKAKPELDLKKLGAWRDGVVKKLTGGVAGLLKGNKVELLRGFARFKGPREIEVNGETYGAQSFIIATGSEPMPLKGFPFGEDVWDSTRALRVEEGIPKRLLVIGGGAVGLELGQIYHRLGSEVTLIEYMPEILPAGDRETAALLRKALEKEGLKVRTGTKAVGYEKKQDGLHVLLEAAQGGSQEEIVVDKILVAVGRRPRTEGLGLEKAGVKVDERGFIQVNARMETSAPGVYAIGDVARPPLLAHKAMKEGLVAAENAAGKNALFDFQVPSVVYTGPEWAGVGLTEEEARKAGYNVKVGKFPFSASGRALTLGGAEGLIKVVGDAETDLLLGVFVVGPQAGELIAEATLALEMGATVSDLGLTIHPHPTLSEGLMEAAEALHKQAIHILNR

SEQ ID NO: 11702 - protein, 462 aa, Burkholderia xenovorans LB400
MQKTIHAGARLDRLPLSAFHWRLFFLIGSGLFLDAFDVYLGGVVTGALLKSGWSTLEMNAWFTTMTFAGLMVGAWAAGLLGDWFGRRFSYQVNLIIFGGASLAAVFAPSMYWLIGLRFIMGIGMGAEIVISYGMLSEFVPPRYRGRLLAALSLFANSAVFVASLASLWIIPAFGWRYMFAITGIAATIVWFMRKSMPESPRWLENEGRLAEADALLDSIEGKIALTHTLPDYSRDDVLQTGKVPLGVLFQPPVLWRSIVGSLIMITIGFSIYGLINWLPSFFVQQGFNIVKSLTYSTVMSLGAPAGTIIGVLLADRVGRRPAIIGAALVTAVMGVFYQHASSANALLVAGFLLVAGIYVMVAVGQGAYVPELFATSYRLRGSGVCGTAGRAASALCQFFVLWMFSIGGVNMVVGSVIGIQLLLALAVWLLKIETSGLRLEETVDEGTTLAADNRRQIVDVGH

SEQ ID NO: 11703 - protein, 248 aa, Lentisphaera araneosa HTCC2155
MNKPLINKVIWICGAKTGIGLAVAKELIQKGARLCVSSRDGQVVKELEGRVKALKCDVKSMDDWHHCAKEITEEFGKLDIFIYNAGDCTYVDDVEIKAEDFETMMDINFHGMVRAAQVVLPLLKKSQSAQFVGMASSVAWLALPRAEAYGASKAAAHYFLKSLRLDLSQYGIDVSIICPGFVKTPMTDKNDFPMPFLVSSERAGREICQGIIKRKPVIHFPKRFTYLVKFIAALPHFLEFRICRSFAK

SEQ ID NO: 11704 - protein, 269 aa, Vitis vinifera
MLLSLDSLQLLVNLNSSLRFSQFNIANPTTGCQKKLEIDDDQKLRAFYDKRISQEVNGDALGEEFKGYVFKIMGGCDKQGFPMKQGVLTPGRVSLLLHRGTPCFRGYGRRNGERRRKAVRGCIVSQDLSVLNLVIVKKGESDLPGLTDTEKPRMRGPKRASKIRKLFNLSKEDDVRKYVNTYRRTFTTKSGKKCSKAPKIQRLVTPLTLQRKRARIAEKKKRIAKAKSEAAEYQKLLATRLKEQRERRSESLAKRRSRLSAASKPSVAA

SEQ ID NO: 11705 - protein, 337 aa, Shewanella oneidensis MR-1
MAIKIGINGFGRMGRLALRAAWDWDEVEFVQINDPAGDAHTLAHLLEFDSVHGRWRYPVTANADAIQIQDKTIRTTRNKAIADTDWSGCDVVIEASGVMKTKALLQAYLDQGVKRVVVTAPVKEDGVLNVVMGVNHQLYDPAMHPIVTAASCTTNCLAPVVKVIHEQIGIKHGSMTTIHDITNTQTILDAPHKDLRRARACGLSLIPTTTGSATAITHIFPELKGKLNGHAVRVPLANASLTDCVFELERAVTEAEVNALLKTAAEGELKGILGYEERPLVSVDYKTDPRSSIVDALSTMVINGTQLKLYVWYDNEWGYANRTAELARLVGQLDLPR

SEQ ID NO: 11706 - protein, 348 aa, Zea mays
MAPAPCGRSSQRVFHFGKGKSEGNKNMKELLGGKGANLAEMASIGLSVPPGFTVSTEACQQYQEAGRALPPGLWAEVLDGLRWVEEYMGAALGDPRRPLLLSVRSGAAVSMPGMMDTVLNLGLNDQVAAGLAAKSGDRFAYDSFRRFLDMFGNVVMDIPHALFEEKLEAMKKAKGLKNDTDLTATDLKELVSQYKNVYVEAKGEPFPSVTQRPDTLKLPAADPKRQLELAVLAVFDSWESPRAKKYRSINQITGLRGTAVNVQCMVFGNMGNTSGTGVLFTRNPNTGEKKLYGEFLVNAQGEDVVAGIRTPEDLDAMNDVMPQAYEDLVENCRVLESHYKKCRHRAMG

SEQ ID NO: 11707 - protein, 163 aa, Salmonella enterica subsp. enterica serovar Paratyphi B str.
MNPGRENMNIIKANVAAPDARVAITIARFNQFINDSLLDGAVDALTRIGQVKDDNITVVWVPGAYELPLATEALAKSGKYDAVVALGTVIRGGTAHFEYVAGGASNGLASVAQDSGVPVAFGVLTTESIEQAIERAGTKAGNKGAEAALTALEMINVLKAIKA

SEQ ID NO: 11708 - protein, 260 aa, Parvularcula bermudensis HTCC2503
MNTVSFGRRQVEEQEKEHLVRAVFDSVAPQYDLMNDLMSAGIHRIWKSVLLDRLAPQPGQTLLDVAGGTGDIAEGFLARAAARNPRGRSPATAIVMDINHSMLVAGAERTKRPEDKTLVAEDGSPLLRVCGNAEELPFPDRSVDKVTIAFGIRNVTRRAAALAEFHRVLKTGGQFICLEFSRPITATMEKLYYLYAENMIPRLGAWVAKDRDSYDYLVESIKRFPPQDAFALEVQGAGFQRVKVENMSAGVASLHSGWKY

SEQ ID NO: 11709 - protein, 191 aa, Magnetospirillum magnetotacticum MS-1
GLHAAQTQGFFDGPVDHLWAMPILTDYVRSRVDTSNVTVVSPDAGRIRVAEQWAAKLGGGPLAFVHKTRDVTRPNQAVANRVVGDVEGRDCVLVDDLIDTGGTIAEAVRVILAAGARSVIVAATHGVLSDPAAQRLSECGASEVVITDTLPIAAEKQFPQLTVLSIAPLIARAIREVFDDGSVTSLFDGNS

SEQ ID NO: 11710 - protein, 337 aa, Arabidopsis thaliana
MSISELSQDLLEEILCRVPAISLKKLRSTCKLWNSLFIDKRVRNELRRVTVSQVFHCDGLLLYINGVDTIMVVWNPFMGQTRWVQPIARDQTHKYVLGSYQDIKSRITSYKILRYRYTLCGSKLAFEICELYSSSWRVLDITMDFDLYHNSCVSLKGKTYWLTFDKKDRELDMFSFDYATESFGNRMPLPYQFPRCSYETVALSVVREEKLSVLLQLRGTSRKEIWVTNKINETTQVLSWSKVLTLDNSDFGYCPGLSFFVDEEKKQVLCFEKCRVFHIHTNDEVFENKVYTVGEDNKVTQLRFEQSFCPKMDPYVFGYVPSLVQIEQPRRKRKRGD

SEQ ID NO: 11711 - protein, 285 aa, Glycine max
MAKHDVEGGSFSAKDYHDPPPAPLIDAEELTQWSFYRALIAEFIATMLFLYITVLTVIGYKSQSDVKAGGDVCGGVGILGIAWAFGGMIFILVYCTAGISGGHINPAVTFGLFLARKVSLIRAIMYMVAQCLGAICGVGLVKAFQKAYYNRYGGGANELSEGYSTGVGLGAEIIGTFVLVYTVFSATDPKRNARDSHVPVLAPLPIGFAVFMVHLATIPVTGTGINPARSLGAAVMYNQQKAWDDHWIFWVGPFIGAAIAAFYHQFILRAGAAKALGSFRSNPAI

SEQ ID NO: 11712 - protein, 321 aa, Synechococcus elongatus PCC 7942
MSETQQPTVIITGASSGVGLYGAKALAARGWHVVMACRNLQKAAEAAKSLGINPENYSLMEIDLGSLASVRRFVDQFRATGRSLDALVCNAAVYLPRLKEPQRSPEGYEISVATNHFGHFLLCNLLLDDLKRSPAPEKRLVILGTVTANSKELGGKIPIPAPADLGNLEGLEAGFKAPIAMIDGKKFKPGKAYKDSKLCNMITTRELHRRFHDSTGIVFSSLYPGCVADTPLFRNTPKLFQKIFPWFQKNITGGYVTQELAGERVAQVVADPEFKTSGVHWSWGNRQQKDRQSFVQELSDKASDDRTAQRLWDLSAKLVGL

SEQ ID NO: 11713 - protein, 487 aa, Rhodococcus sp. RHA1
MTDLLGGETWSGKIFDGNWVTASGGSIKVTEPATGAVLGEIGAADASDIDRAARRAAAAQPDWAARTGHARADVLRKAAMTLDANRAEVERWLIREGGAVPGKAAFEVDLVLSELWEASALPTQPWGHLLPTSQEGRVSIGRRVPLGVVGVISPWNFPLVLAMRAVAPALALGNAVVLKPDVQTAISGGVVIAQLFAAAGLPEGVLHVLAGDAEPGQALSEHPAVSLISFTGSTSVGRQVGATAGRTLKRVSLELGGNNALIVLDDADLDAASSAGAWGSFLHQGQVCMTAGRHIVLESVADRYLEKLTARAANLPVGDPNTGQVALGPLINEHQVANVDRIVRATRDAGAEIRTGGTFDGLFYRPTVLAGVTPAMPAFQEEIFGPVAPVVVVKDEAEAIAVANDTEYGLVAAIQTGSVERGERLADQLRTGMVHINDQTLNNDAYAPFGGTGASGNGTRFGTQSSWDEFTQWQWRTSRSVAQQFPF

SEQ ID NO: 11714 - protein, 302 aa, Anaplasma marginale str. St. Maries
MSPRPKKPAPLDRLYSKCLQNTVVKHKCAVMIQNGIATVEQIRYSERVLAWGCMGIEMFDVSGKRFLVVGASGGIGSAISVALSRANAELCISGTRADALQNVASQCAKSAHVLQCDLLNREEVDTLVDRAAELMSGIDGVVCSAGIVLDKLSLRITDEDWDRVIAINLNAVFKINRSACRAMLKNAGGRIINISSIVGVTGNVGQANYSASKAGIIGMSKSLALEFASRGITVNCVAPGFIDTPMTAPLPEKQKEHILNNIPMGRMGTPEDIASVVLFLASDASSYITGQTIHVNGGMLMC

SEQ ID NO: 11715 - protein, 201 aa, Magnaporthe grisea 70-15
MANPRVEELPDEEVKKTVVDDHDDDSSSDSDGEEETNLPAGSTAVIHSRNEKKARKAIEKLHLIRVDGITRVTLRRPKNILFVINNPEVYKSPNSGTYIVFGEAKIEDLNASAQAAAAQQLASSAGHDHDHAGHSHGEAKASEGDAKKEEEDDDEEVDADGIEDKDIELVMTQAGVSRTKAIKALKENDNDIVNSIMALSV

SEQ ID NO: 11716 - protein, 355 aa, Botryotinia fuckeliana
MTARAPNPASGSRKISFNVSEQYDIQDVVGEGAYGVVCSALHKPSGQKVAIKKITPFDHSMFCLRTLREMKLLRYFNHENIISILDIQKPRNYESFTEVYLIQELMETDMHRVIRTQDLSDDHCQYFIYQTLRALKAMHSANVLHRDLKPSNLLLNANCDLKVCDFGLARSAASQEDNSGFMTEYVATRWYRAPEIMLTFKEYTKAIDVWSVGCILAEMLSGKPLFPGKDYHHQLTLILDVLGTPTMEDYYGIKSRRAREYIRSLPFKKKVPFKTMFPKTSDLALDLLEKLLAFNPVKRITVEEALKHPYLEPYHDPEDEPTANPIPEEFFDFDKNKDNLTKEQLKKLIYDEIMR

SEQ ID NO: 11717 - protein, 439 aa, Triticum aestivum
MRVLPLALAAAIFSGVTAILIYISGLSSYGGAGLSEADLAALAALQGGFSKCVDANGLGLQAFGGEDYCRVVIQYPSDTVSKWTDPKTGESEGLAFEFNLCEAVASWEQVRNSTTILTKEYVDALPNGWEEYAWRRINKGILLNKCKNRTLCMEKLSLVLPDTSPYVPQQFGSCAVVGNSGDLLKTKFGDEIDSYDVVIRENGAPVQNYTEYVGEKSTFRLLNRGSAKALDKVVELDETKKEALIVKTTIHDVMNKMIRELPITNPVYLMLGTSFGSSAKGTGLKALEFALSICDSVDMYGFTVDPGYKEWTRYFSESRKGHTPLHGRAYYQMMECLGLVKIHSPMRGDPGRVVKWLPTKDTIEAARVASEKLLKRPGAGSVDPLRTCTMIKKRKNGKAPNRSVLRNAATNHLRYMKGATRYPLERSAGGGYLCMINDR

SEQ ID NO: 11718 - protein, 567 aa, Ralstonia solanacearum GMI1000
MDSATGHPATALQHPEHFAPLGTPPLPPRQRVLRDVLAGLSIAGLLLPEAVAYAGIANLPPQAGLIALLSGLVVYALIGTSRFAIVSATSSSAAVLVATVLAEPAADAAVLMALTAALIIATGVLFMLAGAARLGGMSDFIARPVLRGFTFGLALTIVIKQLPKILDVAVHHSDTPRLALDLLREAGQANVYSTALGAIALAMLFTLGRWGRVPSTLVVIVASLVAGAWIDWHPYGIAVVGAIDLQHITFGLPVLERTQWMQSAELGFALMLILYAESYGSIRNFALKHGDPVSANRDLFALGCANLVSGLLHGMPVGAGYSATSANEAAGAQTRLAGLCAAAVVALIVWLFLPQLSRIPEPVLAAIVIFAVSHSLHPSVFKPYWAWRRDRLVVVAALLAVLLLGVLHGLLAAIGVSLLLTLRKLSEPNVSVLGRLRDSHDFVDIALHTDARQIDGVLIARPEVPLFFANTERVLGKVRALLAQSGQSGTDTIMLSLEETPDVDGSAIEALRIFAAECAARGQRLVLVRLKPAALAAMSRATDDTLRIDMLRELSVDECVRSLTTSR

SEQ ID NO: 11719 - protein, 449 aa, Burkholderia thailandensis E264
MSNHSALERIPIMLSSTTMSQSAGDFAPAGDVTSRTIRAARDALEGRRKGVAAALPFVGPAVIASIGYMDPGNFATNIQAGAAYGYELLWVVLAANVIAMMFQAMSAKLGIVTGRNLAELCREHFPQPVVWGMWVASEIAAMATDLAEFLGGALAFGLLFHLPLIVGMGATAVLTCAILTLEKRGFRPLEAAIAALVGVIGASYLGELLIAPQDWHAAAYHLVAPQLRDGAALTLAVGIIGATIMPHTLYLHSGLTQRRTAPRDERERRLLLRFSNREVAVALGVAGFVNIAMVMMASSAFHETMPGMADIGDAYHTLIPLLGPAAGALFLVALFASGVSSSVVGTLAGQVVMQGFLRRQVPIWVRRLATIAPAFAIVALGCDVTRAMVLSQVALSLVLPLPMAALLLLSSRRAVLGDHALRMPMRVVASAAAAAIVALNGYLIWAAFH

SEQ ID NO: 11720 - protein, 106 aa, Arabidopsis thaliana
  misc_feature (28)..(28): Xaa can be any naturally occurring amino acid
  misc_feature (45)..(45): Xaa can be any naturally occurring amino acid
RTRGIRTTATYTLSSATRAACPTQATLXAPINGLKNSGALPSHTXMANHYFTSITSNEGRDNCMHVRPPIGENKFETLSYLPDHIHFECSNAVDYLIRIMRVSRDQ

SEQ ID NO: 11721 - protein, 190 aa, Rickettsia typhi str. Wilmington
MFIQTEDTPNPDAIKFFPGQEISIDQPVFFSELAEVKGRSTLAESLFHINNVKSVFFGSDFITVTKHAGGNWQVIKPEILMVIMDHFISGFPVFNENTKIDNEKHNIDMLSEIEKQIIETIETRVRPFVTQDGGDIIYKGFESGVVKLALRGACLGCPSSTITLKNGIESMLRHFIPEVQEVQAVEEDFE

SEQ ID NO: 11722 - protein, 226 aa, Geobacter metallireducens GS-15
MTIHDITVPLSPDLPVYPGDPPVTCEPVTRIARGDTANVTRITMTTHSGTHLDVPGHCRDGGATVDHLPLSLLMGKARVLDIRGERAIGRRELSRLPVRGEERLLLRTDNSLLWESPGFQDDFAHLTEEGAAFLIEAGVRLVGIDYLSIEGIASGITVHRMLLDAGVVILEGITLAEVEPGEYELVCLPLKIAGGDGAPARAILRGREPKGGETPFDPHTTRWPVA

SEQ ID NO: 11723 - protein, 446 aa, Schizosaccharomyces pombe
MSGQNNVVGVHYKVGRRIGEGSFGVIFEGTNLLNNQQVAIKFEPRRSDAPQLRDEYRTYKLLAGCTGIPNVYYFGQEGLHNVLVIDLLGPSLEDLLDLCGRKFSVKTVAMAAKQMLARVQSIHEKSLVYRDIKPDNFLIGRPNSKNANMIYVVDFGMVKFYRDPVTKQHIPYREKKNLSGTARYMSINTHLGREQSRRDDLEALGHVFMYFLRGSLPWQGLKAATNKQKYERIGEKKQSTPLRELCAGFPEEFYKYMHYARNLAFDATPDYDYLQGLFSKVLERLNTTEDENFDWNLLNNGKGWQSLKSQNAETENQRSSKPPAPKLESKSPALQNHASTQNVVSKRSDYEKPFAEPHLNSASDSAEPNQNSLPNPPTETKATTTVPDRSGLATNQPAPVDVHDSSEERVTREQVQNATKETEAPKKKKSFWASILSCCSGSNEDT

SEQ ID NO: 11724 - protein, 427 aa, Burkholderia thailandensis E264
MNNADLHARKNAATPRGVGVMCDFYAARAENAELWDVEGRRFIDFAAGIAVLNTGHRHPKIVKAIAEQLEQFTHTAYQIVPYASYVELAEKINARAPIAQPKKTAFFTTGAEAVENAVKIARAYTGRPGVIAFAGGFHGRTMMGMALTGKVAPYKIGFGPFPGDVFHAPYPNALRGVTSADSIAAVETLFKADIDPKRVAAIIFEPVQGEGGFNPAPAEFVRALRKLCDAHGILLIADEVQTGFARTGKLFAMEHYDVSADLMTIAKSLAGGMPLSGVVGRADVMDAAAPGGLGGTYAGNPLAVAAAHAVLDVIDEEKLAERAAVLGDKLKAKLAALRADVPQIADVRGPGAMVAAEFVDPDTRASDAAFTKRVQTLALERGLLLLICGVDANVIRFLFPLTIQDAVFDEALGILESVLKEAVGVPA

SEQ ID NO: 11725 - protein, 483 aa, Brucella melitensis 16M
MAPPLQNRNLSITLEAGISMTGFDYDLFVIGGGSGGVRAGRLAGAIGKKVGLAEEYRMGGTCVIRGCVPKKLFVYASQFPEHFEDSAGYGWSMGEAAFDWKKLIAAKDKEISRLEGLYRKGLENSHVDIFASRAELIDEHTIELKADGRRVTADKILIATGGRPNTHESLPGHEYCISSNEAFHLEELPKSIVIAGGGYIAVEFANIFHGLGVETTLVYRGKEILSRFDHDIRSLLHETMEAKGIRILCGAIFEKVEKKADGKLSVELSNGETLETDQAMLALGRIPNTDGLGLEKAGVKIDKSGAIEVDDYSRTNVENIWAVGDVTNRVQLTPVAIHEAMCFLETAFKDNPTKPDHELIATAVFSQPEIGTVGLSEDEAAKKYPELEIYRALFRPMKNTLSGRSEKTLMKLVVESKSRKVLGAHIMGPDAGEMAQLLGISLKAGATKDDFDRTMAVHPTATEELVTMYKPTYRVVNGKKIEG

SEQ ID NO: 11726 - protein, 340 aa, Synechococcus sp. WH 8102
MRIGINGFGRIGRLVFRALWGRPGIELVHVNDPAGDAATAAHLLEFDSVHGRWDRGISSDADGFSVEGSPLTWSSEKDPTAVPWTARGVEMVLEASGKIKTPETLSPYFEQVGLKRVVVACPVKGDVAGEEALNIVYGINHDLYEPDRHKLVTAASCTTNCLAPVVKVVHESFGIEHGMITTIHDITNTQVPIDAFKSDLRRARSGLTSLIPTTTGSAKAIAMIFPELKGKLNGHAVRVPLLNGSLTDAVFELKQSVTVEQVNDAFKAASEGALKGILGYEERPLVSCDYTNDNRSSIIDALSTMVVDDNQLKVFAWYDNEWGYSCRMADLTCHVVGLDA

SEQ ID NO: 11727 - protein, 435 aa, Schizosaccharomyces pombe
MNSQTSVVGVHYRVGRKIGEGSFGVIFDGMNLLNNQLIAIKFEPKKSEAPQLRDEYRTYKLLVGNAGIPNVYYFGQEGLHNILVIDLLGPSLEDLFEWCGRRFSVKTVAMTAKQMLSRVQTIHEKNLVYRDIKPDNFLIGRPSSRNANMVYMVDFGMAKYYRDPKTKQYIPYSERKSLSGTARYMSINTHLGREQSRRDDLESLGHVFMYFLRGSLPWQGLKAANNKHKYEKISEKKQSTSISELCAGFPNEFSKYMTYVRSLEFDEEPDYAFLQELFDDVLRANGDTNDGVYDWMLLNDGKGWESSSSHFSVVAMKRRKNYLGLNVVQNDDSRKKNSTLQTQNMRFKSSYGVRGPRNYSSFDALPSKNAPLVRQEQSASKKTIYAHSSRGYDRVRPMYVSQPSNNAVGVNHPNDNSDSEAKGGFFDMICCRCFS

SEQ ID NO: 11728 - protein, 1511 aa, Trichophyton rubrum
MDDRYEHEHDDYESGAMYETVRTWSPQSRPELVRIASVFSRIDSHPDVAPTTEDGGQLNRRDTLAGVKIGDPVLDPTKPEFDFYKWARMFTHVMEKEGIKRNRTGVMFRNLTVLGSGSAVQYQDTFLSPFAAPFRPGELCGKGRNPEKVILHDFNGAIREGELLMVLGRPGSGCSTFLKAICGELHGLQKKKESIIHYNGVSQHTFKKELRGEAVYSAEDEHHFPHLTVGQTLEFAAAARTPSKRVLGLSRKDFSTHLARVMMSVFGLSHTYNTKVGDDYVRGVSGGERKRVSIAEIALSGAPICCWDNSTRGLDSATALEFTKALKIGSQVGGITQCLAIYQASQAIYDIFDKVIVLYEGRQIFFGPTRIAKQYFEEMGWYCPPRQTTADFLTSVTNPKERIAKEGYENRVPRTAVEFERYWKQSQNNKLLLANMDRFEAEYPPEEGHLEKLRETHGQAQAKHTASKSPYRISVPMQVKLCTVRAYQRLWGDKSSTIATNISQIMMALIIGSLFFDTPQTTDGFFAKGSVIFFAILLNGLMSITEINGLDAQRPIVVKHVNFAFYHAYSEALAGIVADIPIKFLLALVFNIIIYFLGGLERSAAKFFIFFLFTFITILTMSAIFRTLAAATKTIPQALALAGVMILALVIYTGFTLQPSYMHPWFKWILYINPIAYAYEALLVNEVHGNRYRCATPIPPYGSGKNFACAVAGAVPGEMSVSGDAWVESSYDYSYAHIWRNLGILLGFLAFFYFVYLMVSELNLSSASSAEFLVFRRGHLPKNFQGSKDEEAAAGGVMHPNDPARLPPTNTNGAAGETAPGGSTVAVIPPQKDIFTWRNVTYDITIKGEPRRLLDNISGWVRPGTLTALMGVSGAGKTTLLDALAQRTTMGVITGDMLVNGRPLDSSFQRKTGYVQQQDLHLETTTVREALRFSADLRQPKSVSRKEKYEYVEDVIKMLSMEDFSEAVVGNPGEGLNVEQRKLLTIGVELAAKPQLLLFLDEPTSGLDSQSSWSIVTFLRKLADNGQAVLSTIHQPSGILFEQFDRLLFLAKGGRTVYFGDIGKNSETLLNYFETHGAEPCGPSENPAEYMLNIVGAGPSGKSNIDWPVVWKESEESRHVQQELDRIQSETSKRNEGHGQSAEKEPGEFAMPFTSQLYCVTTRVFQQYWRTPSYIWGKLLLGLASALFIGFSFFLQNSSMAGLQNSLFSIFMLTTIFSSLVQQIMPRFVTQRDLFEVRERPSRAYSWKVFLLANIIVEIPYQILLGIIAWASLFYPTFGAHLSSERQGILLLYCVQFFIFASTFAQMIIAGLPDAETAGGIATTMFGLMVTFNGVLQKPNALPGFWRFMWRVSPITYTVGGLAATSLHSREVKCAQNELAIFDPPSGATCAQYLQKLVEAGAPGKLYNPMSTSQCQYCPLSSGDQFLGGSEIHWSDRWRNFGIGWAYIVFNIFATVALYYLIRVRKSSGRPNRIISVITYHLSQFGTYCRAFITGRKEKCPRKREQIGKIY

SEQ ID NO: 11729 - protein, 432 aa, Geobacter metallireducens GS-15
MTTITPSLTTLPNGLRVVAVEMPHLNSAEIAVYLRVGGRHDSREKAGLAHFLEHMLFRGTAEHPSSLELEADFEAIGGCINAATDAETTCYYTRVHPDHVAEGVRLLSVMLLSPLLTGLEIEKKIITEEALEDINEQGEEVNPDNLASRLLWPGHGIGMPTIGYLDTIAGFTEEDLRGHMARHYVPENAVVVAAGRVSVEEVFAAAGRAFASWSGPPAPVQESVSDVQDAPVSLFVKDSDSQVNLQLAFRSFPREDQRLAAARLIRRILTGGGCSRLHLNLRERLGIVYSVDAQLAAYDDTGCFAVELSTAPENLAVAVTEVLRETLRLATEPVGDEELDRVRQGYFFDLDYSRDSTFDMQVRYGWGELMGMVRSIEEDQAEAGAVDAAAVMATARELFAPARLNLVAVGPVKAAVKREIAGIVRRYEAEFR

SEQ ID NO: 11730 - protein, 82 aa, Zea mays
  misc_feature (43)..(43): Xaa can be any naturally occurring amino acid
NLVEEKEKKIKELQDNVAAVNFTPSSKLGKMLMAKCRTLQEEXEIGAMASEGKIREKFALLKSQNNELRFPYSCLTLPPCKF

SEQ ID NO: 11731 - protein, 381 aa, unidentified eubacterium SCB49
MTTVNGTQIELNTIEEAIADIKKGKVIIVVDDENRENEGDFIAAAEMVTPEMINFMATHGRGLICAPLTEERCKELELTMMVENNTVLHHTQFTVSVDLIGNGCTTGISVHDRSKTIKALVDEDTKPNDLGRPGHIFPLRAKEGGVLRRTGHTEAAIDFARLAGLKPTGILVEILNEDGTMARLPQLVEVAKRFDLKLVSIEALVAYRMEHDSLIEKKEDFTINTNFGSYRLRAYQQTTNDQVHIALTKGTWTASESVMVRMNSTLVNNDILGTLTNSVDKKLEDMFTALNAEGKGAMVFINQEAQSFNLLNRLKTLREVQKDEEIAKAPSIKMDSKDFGIGAQILHDLGIHKIKLLTNSQQSKRVGMIGYGLEITDYATY

SEQ ID NO: 11732 - protein, 97 aa, Gymnadenia conopsea
MTLFSARNPRILLLPLLIGLLLASYSQMASSQSAFCGEKCKVRCSKASDHDRCLRYCGVCCNLCGCVPSGTYGNKDECPCYRDKYTGVGQRRRPKCP

SEQ ID NO: 11733 - protein, 380 aa, Photobacterium profundum SS9
MSKRDFYEVLGVGRDAGERDIKKAYKRLAMKFHPDRNQEADATEKFKEVKTAYEILTDPQKKAAYDQYGHAAFEQGSGGGGYGGGGGADFGDIFGDVFGDIFGGAGGGRRQQQRAQRGSDLRYNMELTLEEAVRGCSKEIRVPTLVGCDSCDGSGAKRGSSATTCGTCHGQGQVQMRQGFFAVQQACPHCHGRGKIIKDPCNSCHGQGRVEKTKTLSVKIPAGVDTGDRIRLSGEGEAGEFGAPAGDLYVQVHVAEHSIFERDGNNLYCEVPVSFTMAAVGGEVEVPTLNGRVNLKVPSETQTGRMFRMRGKGVKSVRGGAVGDLICKLVVETPVNLSSHQKELLKELEESFGGKAAGKHKPKSEGFFNGVKKFFDDLTG

SEQ ID NO: 11734 - protein, 1938 aa, Oryza sativa Indica Group
MEELFMQVFERRDWVKAQVQEQVVSYSESLACAILAAGRRPPPWLLPALDSVPARGNNTKMSSIDLAHMRNENSLHHAQSQTYQRVKPKTHEFGGCKPGGLHIVNYAGEIDQSQICVSESVVQEFNIAHSLNEGLPSTSPVEVPHSVMSSLLQEDTSQPVESNLQGIPHSVSSPLPEQITMGVSETDSLTGMTCMASQLPENVSLLSLKSIALEGPDSVFTPLSQKEIADAGDTVSLMEPIAKTESVAGLISMASPQFDNDRLQTNLLEGPDSVPTSLSQADARHTAETDSVEILDQEEDTDTPREYSFPDKRVDENLKILEHQSSECHVRSPPCDGSSLRPDYLANAICEAPKMLSTPQENMLGDEQQGSECHVLSPPCDGSSLQPDYLASTVCEAPKMLSTLQEKCFEAQSEAYDVYVRNDMNGSVIPERFSTESAEKLLRSHDGTECKIFSFDIAMEIDSDSCETVSDKQALATQPSAQHLLHSSRCGEITSKKSDAQSNNSHQGRSVADVIQVQGNSSFEGIEINCQSDHALYSLCSTMSTSMDCQPDILDKMENRADMSGKPQHPVHHLDRLGSSECISLDLERRIVTSNWKSSVSYKVHTSVDSSSQRTMSSLSDIIHFNSLRMKSLSSSSSSLSGNVATVPQDSLPNCSDILSDGDGEYTRKTNNCSVYPGADVKYVAVDDQILNHTDYVSSGCEVLNPENHPSSTPPSTFPSYASSDQQSQQACASNCSNKELGEKCIHDDPGQPVSDGHIPLQNGDNCADFDETVEVHQSCGIPIPANSPTIKERVLEAYRDSTKWVNLSSNLSSKCKINSSITDLACFQIDEDSSTSEASRKYMDVGRLDLPTTTASSRESDHQAHLIIDQAMQNPKENRAPSIRKEVKVTQSLHDRESKGRILGNQNEIHKSEVNLDKGWKPSNIVTSMTSFIPLVKQKQRPTTVCVKRDVRVKALEVAEAVKRCEQKKQNEREMRKAAAELERERVKQEREQKLKQMEQKKKTDARKRQWEDDGRKEKEKKKKFIEEPRKQQKQLGERMHAGNSREDASQKDPDDTEIRKNTVRVVINQLLSDEKTESFPILVTSGSNNVKAVVADGNSGSSGHQIHGRLSDDADKSYEMSPYEDSDEEDGGDLEHKEKVRRRQKHIPPWTRKEILDEILLSNRTLDPREIFERKCSFSLSDGFFITIYLVICTLPCLSVWTKLNQEKQLLGISFCLCSSLGSGACDIIQKLLASHSGGLHIATIDLSSCFASNWEYSPATVNSRKSELNFPFLLLTSSRFGSAKLLNLFVLQPPPPPPSNCPTPHRKPLLSSCFPQIVVSSQQLEQSSHGFLGLPRRRKWSELFSRFAVVQAILTIMSVEAVKQIVPAHLVKPAVDPVHAKASKAGKDGRSDLIAKEILEEQKPAHRRQESSESILDKGPSNVGSDSGVLDVPLTPKGDSGELKEIQGLDCNGNQEKKTAQKSSTSESFASAKVSDGTNGLRKTCGSGKVSDTADSTESGKSSMCRPSTSSNVSDESSCSSLSSSTTKPHKGSDSRWEAIRMIRSKDGILGLSHFRLLKKLGCGDIGSVYLSELSGTRSYFAMKVMDKGSLASRKKLLRAQTEREILQSLDHPFLPTLYTHFETDKFSCLVMEFCPGGDLHTLRQRQPGKHFSEQAAKFYVAEVLLALEYLHMLGIIYRDLKPENVLVREDGHIMLSDFDLSLRCAVSPTVVKSANPGPDALQRNNQAYCVQPACIQPSCIQPSCVAPTTCFGPRFFSSKSKSKSKKEKKSKPEVVNQISPLPELIAEPTDARSMSFVGTHEYLAPEIIKGEGHGSAVDWWTFGIFLYELLFGKTPFKGSGNRATLFNVVGQPLRFPESPMDPQHRLAYKRGATEIKQHPFFEGVNWALIRCASPPEIPKPVELERPPKPAPATEKVAPAANQKGSDNYLEFEFF

SEQ ID NO: 11735 - protein, 136 aa, Vitis vinifera
MQEALPYKTWLPIPREPRINTPTTPLHNQLLLPGTTNITNMVSENAVIVFGRRGCCMTHVVKRLLLGLGVNPAVCEVNEEDEIGVLDELGMGKQGAVQFPAVFIGGRLFGGLDRVMAAHITGELVPILKQAGALWL

SEQ ID NO: 11736 - protein, 431 aa, Anaplasma marginale str. St. Maries
MGVRAVVLSARSVAKINRVVARQILDSRGRPTVEVEVLLSDGAVGRVSVPSGASVGKFEAVELRDGDQAKYAGHGVLKPVQRVNTTVADSLAGVSPFDQRAVDEILLSLDGTKNKSKLGANATIGVSLAVAKAAADSVGIPLYKYLGGAVAREMPLPLVNVINGGLHADNLLDFQEFMIVPVGAKTFADAAQICAEVFYKLKEVLKKMGHSTNTGDEGGFAPNLENNTDVLDVLVEAIEKSGYRASSDVALAMDVAASTFYDGTSYKFSGKCLTSGELIACYEDMVSRYPIISIEDAMAESDIEGWKAVTKRLGDKIQLVGDDLFVTNPALIANGVENKLANAVLVKPNQIGTLTETIDAIRSAQRNNYNVIISHRSGETEDVTIAHIAVAANCGQIKSGSFSRSERLAKYNELLRIEEDLGKSALLYNVI

SEQ ID NO: 11737 - protein, 478 aa, Rhodococcus sp. RHA1
MTHPASPPSTVAAHLPPNEPGPHSKRLGMIAVVATFGGLLFGYDTGVVNGALKPMKEDLGLTPFTEGFVVSALVIGAAFGALIGGRLSDRFGRRNNILMLAGVFAFGTLGCVFSPTWEVLGAFRFILGLAVGGASVTVPVYLAEVAPFEKRGSLVTRNEVMIVSGQFAAFVINAIIFNVWGEHSAVWRFMLLIAVLPAFALFIGMLRMPESPRWLSSQGRDDDALAVLHQVRSPRRAEAEMAEVHQLAEEEEKAQTGGWTDLAVPWIRRLVFIGIGLGIVQQVTGINSIMYYGTQLLEDSGFSANGAIVANTLNGLFSVLGITVGIMLINRVNRRTMLLVGYGLITTFHILIGLSALLIPDGSVIKPYLILAFVVCFVFSMQGTLGPLAWLMLAEIFPLKIRSLAMGVCVFVLWMTNAGVAFGFPPVVASLGIAPTFFIFAGLGVLSWIFIVRYVPETRGKTLEEFEEEYSAAYSARR

SEQ ID NO: 11738 - protein, 380 aa, Pyrococcus abyssi GE5
MEVFLELAIILVIAKIFGYLSVRLGFPAALGQLLGGVIIGPSLLDVVEYGSEVRLLSELGVVMLLFLAGLETDVEEFKHVGLSAFIVAVMGVFVPFLLGYLVSVLHGYGSLKALFFGGVLTATSVGLTTSILMDMKKLRTKVGTTILAAAIVDDVLGIVILTLLVAMSSRGKVEVEDIEIILLEVAIFFILGILIGHPLVKEVLTLSERITLPETVTTFAIVIMLIFAYLAEKFQLAGITGAYLAGLLVSMTEGSRKITDKIMTIGYSLFIPIFLVSIGIETDIRVLTHAGVFALVYSLIAVVGKIIGCGFGALVARFKPIEAIQVGIGMIPRMEVALIIANVGLKEGILTRGDLAVPVTMVVITTLITPFLLKWAFSKG

SEQ ID NO: 11739 - protein, 712 aa, Rhodococcus sp. RHA1
MSEQNIINWEQDADGIVVLTIDDPNQGANTMNDAYISSMKATVDRLVDEKDSITGVVITSGKKTFFAGGDLKNMIKVGPENADEIYSHSVAIKSDLRRLETLGKPVVAAINGAALGGGLEIALATHHRVAADVKGVKIGLPEVTLGLLPGGGGVVRTVRMLGLQNALMQVLLQGQQRGPVQAKEVGLIDEVVSSVEELVPAAKAWIKANPEGGVQPWDKKGYRIPGGTPSTPAFAANLPAFPANLRKQLKGAPMPAPRAIMAAAVEGSQVDIDNALLIEARYFTSLVTGQVAKNMIQAFFFDLQAINSGASRPEGIEKTPITKVGVLGAGMMGAGIAYVSAKAGFDVVLKDVTIEAANKGKAYSEGIEAKALSRGKTTEEKSKTLLDRITPTADPADFAGVDFVIEAVFESQDLKHKVFQEIEDIVEPTALLGSNTSTLPITGLATGVKRQEDFIGIHFFSPVDKMPLVEIIRGEKTSDEALARVFDYVQAIRKTPIVVNDSRGFFTSRVIGTFINEAIAMLAEGIEPATIEQAGMQAGYPAAPLQLSDELNLTLMQKIRKETAEAAKAEGKELPADPAGDVINTMVDKFDRKGKLGGAGFYDYADGKRTGLWPGLRENFGSKELEVPFQDLIERMLFIEAIETQKCFDEGVLLTTADANIGSIMGIGFPAWTGGVSQYIQGYEGGQAGFVKRAEELAAKYGERFTPPASLK

SEQ ID NO: 11740 - protein, 416 aa, Xylella fastidiosa 9a5c
MDRINTSAAPPTSPDWERLRTDFPLLQRHVHGKPLIYFDNANTAQKPQAVITATDTFYRRHNANISRAVHTLGTEATEAYEATRTALATLLNAPTHELVLCSGTTFAINLIAYSWALPRLRAGDVILVSRMEHHANIVPWQLIAERTGARIQVADILPNGTLDLDALHTLMTPQVKLLAITHVSNVLGTVNPIHDICRQARQRGITTVVDGSQAAPHRHIDIPAIGCDFYAITGHKLYGPTGTGALWARREHLHIMPPFLGGGEMIKEVSFDGTLFNTPPHKFEAGTPNIAGFIGLRAAVDYVRRIGIEQIETRETELLAHLTEELQKIDGMRLFGTAPNKAAVVSFMIEGTHAHDLATLLDLEGVAIRSGQHCAHPLLQYYGVTATCRASLAFYNTHEEIERFIAALLKVRKLLG

SEQ ID NO: 11741 - protein, 448 aa, Burkholderia thailandensis E264
MTTVFHRAPRASLPVAVAGDGIEIIDSTGKRYIDACGGAAVSCLGHSNPRVIDAIKRQAQQLPYAHTSFFTTQPAEELADRLVAAAPAGLEHVYFVSGGSEAVEAALKLARQYFVEKGEPARRHFIARRQSYHGNTLGALAIGGNAWRREPFLPLLIEAHHVSPCYAYREQRADETEEAFAQRLADELESRILELGPDTVAAFVAETVVGATAGAVPPVREYFRKIRTVCDKYGVLLILDEIMSGMGRTGYLFACEEDGVAPDILTIAKGLGAGYQPIGATLVSDAIYRTIVGGSGFFQHGHTYIGHAIACAAALEVQRVIDEDRLLENVKARGEQLRASLAARSAEHPHIGDVRGRGLFVGVELVRDRVTKAPFDPKLKLNAIVKREAMQRGLMVYPMGGTVDGQLGDHVLLAPPFICTAPQIDAIAERLGDAIDAALASIGAAASR

SEQ ID NO: 11742 - protein, 278 aa, marine gamma proteobacterium HTCC2080
MERRLEGQVAVITGGASGIGAATAEKLVAHGAKVVLGDIQEDRLASFVESLNGQAMGLRCDVTREEDVKGLVDAAIANHGRIDVMFNNAGIVGAIGPMDTTPTDEWKFTLDILLNGVFYGMKHASGHMKRAGRGSIISMSSTAGVMGGLGPHAYAAAKHAVVGLTKNLAAEACAFGVRVNCLAPGLIATPLAAAATVGDPDGIEQALPAFAELSPLPGRAGMPEDVANAVLWLASDESGYVNGQTIAIDAGLTTGSKPGDPNFAEYQPILREAGKSGL

SEQ ID NO: 11743 - protein, 255 aa, Brassica napus
  misc_feature (244)..(244): Xaa can be any naturally occurring amino acid
  misc_feature (249)..(249): Xaa can be any naturally occurring amino acid
VDPRVRTEYLPTPLNLKIWKLNGKINNSIKRIIDARLKAKSKNVEKDYGNDLLGIMLASARSNVSEKKMSIDEIIEECKTFFFAGHETTANLLTWTSMLLSLHQDWQEKLREEVFNECGKDKIPDSDNCSKLKLMNMVLMETLRLYGPVLNMIRSASQDMKLGSLVIPKGTTIVVPIVKMHRDKAVWGSDSDKFNPLRFENGVSRAANHPNAFLAFSLGPRVCIGQNFALMEAKTVLTMILQRXRFNIXDEYKHA

SEQ ID NO: 11744 - protein, 226 aa, Parvularcula bermudensis HTCC2503
MTEDDVIANYEQVQSRIRRAAQEAARSPDAVELTVVSKTWPTEKISPLLAHGHRRFGENRVQEAQAKWPALKSAYPDCCVHLIGALQSNKAADTIGLFDVVESLDREKLVHAFRRLADDGARLPAFFVQVNTGEEAQKSGVLPADAVAFVDWCRNDQHLDILGLMAIPPQDDPPAPHFALLHELAAEAGVSALSMGMSGDYETAVHLGATMVRVGSAIFGPRGTPQ

SEQ ID NO: 11745 - protein, 552 aa, Erythrobacter sp. NAP1
MSDTKKASDVFIDCLEAEGCEYIFGVPGEENLDFLDSLGRSKKIKLILTRHEQGAGFMAATYGRHTGKTGVCVATLGPGATNFVTSAAYAQLGGMPVLMITGQKPIKKSKQGRFQIVDIVSLMEPVTKYSIQIAAGDNIPSRVREAYRLAEEEKPGATLIELPEDIAEEQATDFKPLPKSVARRPSAEPKAVRAAVKAIENAKNPVLVIGAGANRKLCGRMLEQFVEKTGIPFLTTQMGKGVIDERHPKFLGCAALSAGDFVHRAVEASDCIINVGHDVIEKPPFFMKDNGVTVIHVSTKTAEVDPVYFPQIEVIGDIANAVWQIKEDISPNRDWDFEQMLGYHKAELEHTGKLAADDRFPIFPPHLVQQVRDAMPRDGIICLDNGVYKIWFARGYTAYLPNTVLLDNALATMGAGLPSAMMSAMLYPDRKVMAICGDGGFMMNSQEMETAVRLGLNLTVLILRDDAYGMIRWKQANMGFDDFGLTYGNPDFVQYAESYGAKGHRVESSAHLAELLKHCNETPGLHLIDCPVDYSENDQILNIDIKKLSAEL

SEQ ID NO: 11746 - protein, 77 aa, Zea mays
  misc_feature (37)..(37): Xaa can be any naturally occurring amino acid
RRHDAEGLPPLSENNNVWNAPEYITRTKPSNYLQVSXQSLGELWIRNGVFARPPEKKVERNHDTYYHTKDSAFLAHD

SEQ ID NO: 11747 - protein, 684 aa, Debaryomyces hansenii CBS767
MLDQRLKLLNKQAIDNLIDILHGVYTTKNLLILDQRLSTLINFLTPFLKLKEIAKIDKTIWIGDNVEQDILQSFDGFIFIFNESHDNLQALLKTIKQIGKKKIHIIVKQLTKSFIYETNKALNGNVTFEKICDINTGKEVIKFTSMIRLYNWEINPIVIDEEARVLSIEAPYGGLDSYFNQPLLQLYELSNSFITLLENSFKASDMSFLKLKNIYGKGDHANLLINIINNERIPEYLSLKLSSLEQEFYLTKARGNTDLIVVERNLDFISVILNQLNYQGLIDDLFGIDIDNVKVGENRYKLNDELYNELKHLNFASIGVKLNKLAIFIQNEFSTRDNLQSLGEMKKLVSNLGNLTSKQDLIKKHTFLSESILNYIRNGDIENKPTRSSKKYNEYEKFLNFENELFDIDYKTHISYLRDFLSENFNYKIVLSTIILISTVNDGIKERDFDWVYNEILDNFGMEIIFVIDNLVDNKVVKINDNNDLLGGALTYLTNQDKSDDNDKENKVNTKLGISGGSNTYKSNYTLINKFWNLHPLVEETTGTKSGLLIDEYPNPSFTLPSSTVPLLSRIIESLYVRDFLQYKPVNNTSKRPNWDKLGLDTMFQGKTTDINIDDTLDDRNTDSNAGQGEQYVVVIFVGGVTRGEISCLRYLEQRLQTIGIIKRFIILTSGIVNSDKLLDVFKR

SEQ ID NO: 11748 - protein, 157 aa, Geobacter metallireducens GS-15
MRIGHGYDVHCLVEGRKLILGGVDVPYERGLLGHSDADVLLHAIADAILGALALGDIGKHFPDTDPQFKGADSRKLLRHVMALAGQKGYVLGNVDATIVAQRPKLAPFIPEMRANLAEDLIAEIDRINVKATTTEQLGFAGRGEGIAAYAVVLMERR

SEQ ID NO: 11749 - protein, 170 aa, Triticum monococcum
LLVLGTSLFFGGLANLGVEQPYDRKQADVSTGLLILGVLCQSMPLMLRYAVSAGEHAVNSDDSGLVLSRACSVLMILAYGAYLYFQLKTHRQLFEPQEVEDDGDDLVSEDEAVLGFTSAMVWLAVMTVITALLSEYVVSTIEAASKSWELSVSFISIILIPIVGNAAEHA

SEQ ID NO: 11750 - protein, 437 aa, Oryza sativa Indica Group
MAIAVRSAAAVARHSLRPPLAAPGSIRGASLLPPQRARGVGPCRARARAASSSATGGGGHLPPLFSVAPMMDWTDNHYRTLARLISKHAWLYTEMVVAETIVHQKDNLDRFLAFPAEQHPIVLQIGGSNLDNLAKATELANAYSYDEINLNCGCPSGKVAGHGCFGARLMFDPEFVGDAMSAIAANCNVPVSIKCRIGVDDRDSYEELCEFVDKVVSKSPTRHFIIHARKALLSGLSPAENRKVPPLKYEYYFALLRDFPDVQFTLNGGITTIDQVTASIRQGAHRVMVGRAAYNNPWNMLGHVDSEVYGMPTRRSSRRQILESYQVYGDSIMGQYGPSRPNVRQLVKPLLNLFHSEPGNGLWKRKADSTLRHCKTLESFLEETLDAIPNSVLDAPIGKEAYIEEGHFADMDSLLPPRYSSLTNGSCEIPALVTAST

SEQ ID NO: 11751 - protein, 172 aa, Synechococcus sp. WH 8102
MDLQTYIRSIPDFPKPGILFRDINPLLRNPAAMVEVMRRLGAICDAVQPDLIVGIESRGFIVGTPLALQRSLGFVPVRKPGKLPGAVIGVDYALEYGTDRLEIQSDALTGNPRVLVVDDLLATGGTAAATGSLVRAAGGELVGFAFVIELEPLGGRSALPDEVLAESLIRYP

SEQ ID NO: 11752 - protein, 434 aa, Marinobacter sp. ELB17
MLNHKMALVTLGINHRTAPVAIRERVAFTPERMAEAFAELRAAAGATEAAILSTCNRTEIYLAADEDCAPLILRWLAGFHNVDAGDLEDVIYVHHDSEAVRHLMRVSAGLDSMVLGEPQILGQLKDAYALAREHKACGSFLARLFEHTFSVAKRVRTQTAIGENPVSVAYAAVSMANRIFADMSRNKALLIGAGKTIELVARHLADAGVKDFLVANRTLERAQTLAQVHGGKGILLSDIAEHLHEVDIIISSTASPLPVLGKGTVERALKKRKHQPFFMVDIAVPRDIEPEVAELDDVYLYTVDDLRQVIEENIRSREGAAREAENLIDLGVQEFLNQLRALDAVFTLKQFRQRAEDLRDVETEKALRSLRNGADPETVMRSLARGITNKLLHQPSIQVRKATTAGRTEVTEWLRELHQLDAEETDHKTPVGKL

SEQ ID NO: 11753 - protein, 175 aa, Triticum aestivum
MAPTVMASSVTSVAPFQGLKSTAGLPVSRRSNGASLGSVSNGGRIRCMQVWPIKGIKKCETLSYLPPLRTEALLKQVDYLIRSKWVPCLEFSKVGFIFREHNASPGYYDGRYWTMWKLPMFGCTDATQVINEVEQVRKEYPDAYFRIIGFDNMRHVQCVRFIAFKPPGCDESVKD

SEQ ID NO: 11754 - protein, 308 aa, Synechococcus elongatus PCC 7942
MQEAKVAAILGAGAWGTTLAQLLRSNGLEVRQWSRRSETSLAATLAEADLWIMAVSMAGLASVADQVAALQLGDRAIWVSATKGLADLGWRTPSQVLSDRFPLQPITVLSGPNLSKEISQGLPAATVIASRDRHAAAVVQQAFASDRFRVYTNRDPLGTELGGALKNVIAIAVGVCDGLCLGANARSALVTRALAEILRVGAYFGARTETFFGLSGLGDLLATCTSPLSRNYQVGFRLAQGESLAAALTAIAATAEGVSTARVLAQLASREGLELPIAACVAELLDNRISPTTAIERLMARDLKAELV

SEQ ID NO: 11755 - protein, 324 aa, Pseudomonas putida GB-1
MVTRIILNGTGTADVMQLEHMAAQTPGPGQVWLEQTAMGVNPLDVLQRKGGAGLALPSGLGLEGAGRVTALGDGVRNVQVGDRVAYAMGPVGAYASGRLFPAERLVNLPPQLEDEAAAAVLFKGITAQYLLKTTFAVGPGTQVLLYGAAGALGQLMAPWARHLGATVIGVVSRPQSVARAQAAGCQHVLVFDAATLASQVRKLTQGQGVDVVYDCVGKVSLEASLDSLRVRGLLVSFGGTSGAPAAIEVATLNAKGSLYLTRPSLAAHTRTVEEYQQRAADVLTAVAEGIIQPRVWRRYPLADAAKAHGDLEQGRSEGALVLTA

SEQ ID NO: 11756 - protein, 316 aa, Marinobacter sp. ELB17
MSKLMIFAGNANPDLAHAISKQLHIPVGNATVGCFSDGETTVEINENVRGHDVFIIQPTCHPTNDNLMELIVMADALRRASASRITAVIPYYGYARQDRRVRSSRVAISAKVVADMISSIGVDRVLTVDLHADQIQGFFDIPVDNIYATPVLIEDIEKQRFENFVVVSPDVGGVVRARAVAKRLDDADLAIIDKRRPKANVSQVMHIIGDVRGKVCILVDDIVDTAGTLCKAAEALKKHGASRVVAYITHPVLSGKAIDNINNSELDELVVCDTIPLGDKARQCDRIRPLSMAGLLAESIRRVSNEESISAMFENV

SEQ ID NO: 11757 - protein, 244 aa, Synechococcus elongatus PCC 7942
MPSSMFSSHASLPIHSRRLAAGLDSRWQQPQIQAIAGSQAIVPTVVEQSGRGERAFDIYSRLLRERIVFLGTGVDDAVADSIVAQLLFLEAEDPEKDIQLYINSPGGSVTAGMAIYDTMQQVAPDVATICFGLAASMGAFLLSGGAQGKRMALPSARIMIHQPLGGAQGQAVDIEIQAREILYHKSTLNDLLAQHTGQPLEKIEVDTDRDFFMSPEEAKAYGLIDQVLTRPTMAITDHNDAVLQ

SEQ ID NO: 11758 - protein, 82 aa, Zea mays
  misc_feature (59)..(59): Xaa can be any naturally occurring amino acid
  misc_feature (61)..(61): Xaa can be any naturally occurring amino acid
MSDKGRPLPKFGEWDVNDPASAEGFTVIFNKARDEKKTGGKPGSPGKSSDGHAKSGGGXRXDPSKPHPKKWLCCMQSPAVDS

SEQ ID NO: 11759 - protein, 308 aa, Erwinia amylovora
MKKRIWVLGDAVVDLLPGQDNLLLKCPGGAPANVAVGIARLGGNSAFIGCVGDDPFGEFMQTTLQREGVDIGKMFRIDGQRTSTVLVSLDTEGERHFTFMVRPSADLFLRTDCLPSFAQGEGLHLCSIALSAEPSRGAALHAMHAIRQAGGWVSFDPNLRADLWPDADEMARSVAQAFELADIIKLSEDELVFLTGLAILEQGIDQFTARYQPALLLVTRGSQGVSVWQAGRLQHFAAPQVEVTDTTGAGDAFVAGLLAALVQETNPLQPQRLDFAVQQAQHSGAAATTAKGAMTALPYAKDLVRFSQ

SEQ ID NO: 11760 - protein, 267 aa, Shewanella sp. MR-7
MDGLTGKVVIITGASEGIGRALAIAMARVGCQLVLSARNETRLASLALEIANYGPTPFVFAADVSSASQCEALIQATIAHYGRLDILVNNAGMTMWSRFDELNQLSVLEDIMRVNYLGPAYLTHAALPYLKSSQGQVVVVASVAGLTGVPTRSGYAASKHAVIGFFDSLRIELTDDNVAVTVICPDFVVSQIHKRALDGEGKPLGKSPMQEAKIITAEQCANMMLPVIATRGRLLITSLRGRLGRWLKLIAPGLIDKIARKAIASGR

SEQ ID NO: 11761 - protein, 172 aa, Glycine max
YTGIGVYLEDKAVPSLAAKWKGKTSEELVHTLHFYRDIISGPFEKLIRGSKILPLAGAEYSKKVMENCVAHMKSVGTYGDAEAAAIEKFAEAFKNVNFAPGPLFLYRQSPDGILGLSFSEDVTIPEKEAAVIENKAVSAAVLETMIGEHAVSPDLKRILASRLLRIEHGIIV

SEQ ID NO: 11762 - protein, 248 aa, Rickettsia typhi str. Wilmington
MHQTNFGFNKVDYTKKQWLVNNIFSRVADKYDLMNDLMSIGLHRLWKNEFIMQIPNLNSNILDVASGSGDIALQLAKKAKARGNNISLILSDINEEMLNNAKKKSIDLNLFQNMKFIVANAEELPFLDNSFDYYTIAFGIRNVPDINKALKEAYRVLKPMGKFICLEFSKVKEGILKDFYKFYSFTIIPSIGQIIARNKEAYEYLVESIALFPSQDDFRIMIKASGFEEVHYKNLSGGIVAIHSAYKI

SEQ ID NO: 11763 - protein, 368 aa, Streptococcus pyogenes str. Manfredo
MEHKWKLWLFIVGVVLLIGGASVLIQKGQAKAFSQGKPQLPAKKVKSTKVDPNAPVDQKVIYLAGGCFWGVEEYFSQVDGVLDAVSGYANGRGDTTNYQLIHQTGHAETVEVTYDANRISLKELLLHFFRIIDPTSLNKQGNDRGSQYRTGIYYTDKADLAIIDEVFKEKAKDYKKKIVVEKAPLKHFIKAEDYHQDYLKKNPNGYCHIDINQATYPVIDESKYPKPSATEIKAKLSADEYRVTQKNETEKAFSNRYWDSFDAGIYVDVVTGEPLFSSKDKFESGCGWPSFSRPVSPDVIRYKEDKSFNMTRTEVRSRSGDSHLGHVFTDGPKDQGGLRYCINSLSITFIPKVDMEAKGYGYLLSSVE

SEQ ID NO: 11764 - protein, 377 aa, Chlamydomonas reinhardtii
NMARTGALLLVALALGCAQACIYKFGTSPDSKATVSGDHWDHGLNGENWEGKDGAGNAWVCKTGRKQSPINVPQYQVLDGKGSKIANGLQTQWSYPDLMSNGTSVQVINNGHTIQVQWTYNYAGHATIAIPAMHNQTNRIVDVLEMRPNDAADRVTAVPTQFHFHSTSEHLLAGKIYPLELHIVHQVTEKLEACKGGCFSVTGILFQLDNGPDNELLEPIFANMPSREGTFSNLPAGTTIKLGELLPSDRDYVTYEGSLTTPPCSEGLLWHVMTQPQRISFGQWNRYRLAVGLKECNSTETAADAGHHHHHRRLLHNHAHLEEVPAATSEPKHYFRRVMLAESANPDAYTCKAVAFGQNFRNPQYANGRTIKLARYH

SEQ ID NO: 11765 - protein, 253 aa, Xylella fastidiosa 9a5c
MSESSEKTGTTHFGFRQVAAKDKKTLVAEVFTSVSRRYDLMNDLMSLGIHRAWKRYFVATAQVKSGDRVLDLAGGTGDIAMLLKNRVGAEGSIVLGDINASMLSVGRDRLIDRGVVAHLDYVQCNAEALPFQDKCFDLVTMSFGLRNVTDKDTALCEMFRVLKVGGQARVLEFSTVTAEWFKPIYDFHSFQVLPRLGRLFARDAASYRYLAESIRKHPPQEELQAMMGAAGFERCRYRNLTGGIVAIHSGYKY

SEQ ID NO: 11766 - protein, 221 aa, Geobacter metallireducens GS-15
MKKIAPSILSADFSRLGDEVRAVAAAGADYIHVDVMDGHFVPNITIGPPVVEAVRKVTELPLDVHLMIENPDRYIPDFAKAGSDIIVVHAEASVHLHRTIQLIKSLGKKAGVSLNPATPLSVLEYVLDELDLVLLMTVNPGFGGQSFIEACLPKIQALRAMLDRRGCNAELEVDGGVKIDNIDRIAHAGANVFVAGSAVFGSKDYKETIKELKRRAKEPIL

SEQ ID NO: 11767 - protein, 96 aa, Triticum monococcum
TEEGRRSGWSDMDGMRRQVPPPAINAGSLAKQKSPIRHDQSTSKDAMFSSSTLLGRSSGSSRRPAVSSSQSRARTRSRRAAARLTRAQGVPAVVCP

SEQ ID NO: 11768 - protein, 363 aa, Marinobacter sp. ELB17
MGFNCGIVGLPNVGKSTLFNALTKAGIGAENFPFCTIEPNAGVVAMPDPRLTKLAEIVKPQRVVPTTMEFVDIAGLVAGASKGEGLGNQFLANIRQTEAIAHVVRCFDDSNVIHVSNKVDPADDIEVINTELALADMDTVEKAIRRVQRIAKGGDKEAKAQLDIFERLLPVLNEGQPVRGMGLNKDELLLIRELCLLTIKPTMYIANVAEDGFENNPYLDTVREIAAAENAVVVPICNKIEAEISELEDDEKSMFLDEMGMGEPGLDRVIRAGYGLLGLQTYFTAGVKEVRAWTVKIGATAPQAAAVIHTDFERGFIRAEVIGYEDFIQFKGEAGAKDAGKWRLEGKEYIVKNGDVVHFRFNV

SEQ ID NO: 11769 - protein, 183 aa, Triticum aestivum
  misc_feature (134)..(134): Xaa can be any naturally occurring amino acid
MAASPATSSSAARATSFARLSNAPLRAPRAGAVSFPSPNSARPAALVADARASRLPVVAAAAAGHQRLMGSLTNTEGLRFAVVVARFNEIVTNLLLQGALEAFERYSIKAENVTVVSVPGSFEIPVAAQKLGKXSGKYDAILCIGAVIRGDTTHYDAVANSCCFRVYSNAGLPAGLPCVFGCS

SEQ ID NO: 11770 - protein, 243 aa, Synechococcus sp. WH 8102
MRRPVIAGNWKMHMTCAQARDYMAAFLPQIERAPQDREIVLAPPFTALSTMAAAAEHSVVGLASQNVHWQDHGAFTAEISAEMLLEHGVAYTIVGHSEPRKYFSESDEQINHRARCSQAKGLIPIVCVGESDEQRERGEAERVIRRQIEQGLEGLDANKLVVAYEPIWAIGTGKTCEAAEANRICGLIRSWVGATDLIIQYGGSVKPTNIDELMAMSDIDGVLVGGASLKPDSFARIANYQAI

SEQ ID NO: 11771 - protein, 322 aa, Marinobacter sp. ELB17
MKNTVVLISLGGTIASLPGSSGRAIAGALSGKELMDKLQIKSDGPVEVINLCQKPSNAITTDDLLQLRVLCLELSQRKDVAGLVVSQGTDTLEDTAYFLDTSLALEDTALVVTGAQRAPYASGSDAGPNLRDALKVANAPQARGAGALVVFNEEIHAASSVRKLSSYQLNGFGSPGIGPVGFVDGDEVRLTKRVQRLSAIAPGEQLPRVDILPVAIGASPALLEAAVASGAQGLVIDAVGRGHVPPNWMKPLGVLRAAGVPVAVVSSTQWGRLAEVYEYRGSLAEQVSIGVLKASHLNARKARLRLMCALSCNMPIDQSLFS

SEQ ID NO: 11772 - protein, 598 aa, Lolium perenne
MEAPPFSLQQQLAAAVLLAVVSSPFTAALLSPKGVNNEVQALIGIKSLLKDPHGVLRNWDQDSVDPCSFAMVTCSTDNFVTGLEAPSQNLSGILAPAIGNLTSLETVVQLFICDWELFGCSLLQNNVISGPIPAEIGNLASLKTLDLSSNRFYGEIPASVGHLQSLQYLIVGNPLICDANMEKDCYGTAPMPISYNLNGSQGAPPAKTKSHKFAVAFGVVTGCMTFLFLAAGFLFWWRQRRNRQILFDMDDQHLENVSLGNAKRFQFKELQVATDKFSSKNILGKGGFGHVYMGQLPDGTLVAVKRLKDGNAAGGELQFKTEVEMISLAVHRNLLRVLGFCMTATERLLVYPYMSNGSVASRLKGKPPLDWITRKRIALGAARGLLYLHEQCDPKIIHRDVKAANVLLDDCCEAIVGDFGLAKLLDHQDSHVTTDGAGHRWTHRGLSTSPLGSRLRKRTFFGFGILLLELITGQTAVEFGKASNQKGAMLDWVKKMHQEKKLDVLVDKGLRSSYDRIELQEMVQVALLCTQYLPGHRPKMSEVVRMLEGDGLAERWQASQRADSHKFTVPEFTFSRCYSDLTDDSSMLVQAVELSGPR

SEQ ID NO: 11773 - protein, 334 aa, Lolium perenne
MAAAALCFRGFALSVSCFLLAVPLLMAQDPSNLSLEHYAKTCPNVEHVVRTEMECAVRDEPRNAALMLRLHFHDCFVQGCDGSVLLDDTATLIGEKQAEQNVNSLKGFELVDKIKEKLEAECPGTVSCADLLAIAARDATVLVGGPYWDVPVGRLDSKEASLDLANKDIPTPQQGLITLISKFWEKGLDATDMVALVGSHTIGFARCANFRERIYGDFEMTSKSNPASATYLSKLKEICPLDGGDDNISAMDSYTSSTFDNAYFETLIKGEGLLNSDQEMWSSIAGYSTADTVNKYWADPALFFKQFSNSMVKMGNITNPAGGEVRKSCRFVNT

SEQ ID NO: 11774 - protein, 590 aa, Yarrowia lipolytica CLIB122
MLTTLKNIKKTSSFTARMAPDALFPTLQSVKEAPEELLRKDRYLKSGNFTWVYPEQRPEYKMLAVSPPAVHDIGLEAAEATSDYFKDIVMGKKYVEDPFPYAQAYAGWQFGEWAGQLGDGRALSLFETHNPVTGKRYELQLKGSGLTPYSRFADGKAVLRSSIREFLGSEYVNALGIPTTRALSLAELPGTTARRGRGKEPCAVICRFAESWVRVGTFDLLRNRGDRPGVKQLADYVVDDVFGGEDKLLNNDHTRDAIAKSAIPYKHNNRYVKLYREIVTRNAYMCALWQVFGYLNGVVNSDNTSVYGLTIDYGPYAFMDAFDPNYTPNHDDGLLRYSYKNVPTAVWWNMVRLGEDLAELLGVAEGTDLENLTKSEKNELLDTAEAVITSAGEEYKAVFLYTYKKFISKRYGLLEQRDSDFDELMTPTLNMLEDSALDYHRFFRLLGDLPFFTGENASKSEPADFAPDVEQFISPEKNINAIKTPSQTRTELSQFLADFKKRLAAENNTDDAARKVRSREINPKFVLRSWVMQEVVEDAHKGDYDKLERVLNMALHPFQETWDEDWDDEEARFCGHVPKYCDSIQQTCSS

SEQ ID NO: 11775 - protein, 1035 aa, Pichia pastoris
MSDTSNDEVIKDILKKIERERNIAQGASNIRKKTNNAEIIQNCNTSIREAQQNIEYLEQTLSKLQLEQHNRAARGSNQGELTQQKVLKTSPPTFTFLDLLKYDCPSLGHRIHYMLQLLEFKLQVEKQYREANEKISRLYQVDGDRRSIAAAEGGKVESDMKIHLMKMALKNYHDVHVNIDEVARDTEVMNTFRKKPLSGTLSITINSIRDILHVSSIFSKKLETLVSIRLMTVEKARTKPTKNQRVNDSFQIHVEKGNELSLIVYDKVGDTLTPVAMIWFLLSDIVEEIRKKKVDRELNATGWMSASNLAGRPEQQQPQQLGSHPFDNQQGNLQSLQTHTSHSNGDTDPAQLSASAWFVLAPAGQILLTMGFNKTNDAGQKKEFMGGLGRHGAIRQRKEEVLEQHGHKFVPRQFCNIMMCAMCGDFLPYSGYQCEDCRFLCHKKCYQKVITKCISKSSIDVDPEETKLNHRIPHKFEPFSNHGTKWCCHCGYILPWSRKNVYKCSECGVVCHAQCTHLVPDFCGMSMEMASKILSTIKETTATRQQRQAMSMSSKSSGKSDTHISQKQLPPVPSAAQRLSQSDEAPKTKPIRRPPPPPPPVSNEQRVLPQREEPQVEPERTPNQAIAEAEYALEKQISSTSSSKETDHHHQHHHYHPQQQPQQQVKTVKTAVASDVSPTKVAVKKQEAARRSSERHHGRHRQKYGLDDFRFIAVLGKGNFGKVMLAESIHTGQLCAIKVLKKDFIIKNDEVASTKSEKRVFIIANRGKHPFLLNLHQCFQTENRIYFVMEYVSGGDLMWHAQQRTFSPSRAKFYAAEVLLALQYFHENGVVYRDLKLDNILLTADGHIKLADYGLCKEEMWYGSTTATFCGTPEFMAPEILKEQKYDKAVDWWAFGVLLYQMMLGKSPFKGEDEDEVFNSILTDEPRYPIQMDRESVDILQQLLTKDPYKRLGASEEDAEEIKRHPYFHGINWDDIMQCKVPPPLIPTIKDRHDVSNFDVEFTTEAPKLTPVNSVLSLSMQEQFRGFTYVNDDHT

SEQ ID NO: 11776 - protein, 600 aa, Dehalococcoides sp. VS
MAKTKAPVEKLESAEEIQKDGKVVSTKRPKGSEFFWTQSRCTGCNRCASVCPVDAIKLDRDKTPTKRVGTSPCTRACPAGLDIPRYVRFVADGNASAATAVMREKIPFPSVCGYVCFHPCELECQRQKFDEPIAIRALKRYAAENDDGSWKNNLKIAPPTGKKVAIIGSGPAGLTSAYFLTLLGHEATIFESMEYAGGKMFYSIPEHQLPKDILNKEIKTITDLGVTIHTSCQVQSVQTLFKQGYNSVLLSTGVLGLDEGLLLPCDETVESNLIKGSDFLKSIKSTTKESLGDKVVVIGGGSEAYNSAFAAKNLGVSEVHLVCSRHTGSKEASPEEVDRAIDAGVTVHPSLDFVKLVKSDDKIEGVELFRIRSYGYDKDNRLHYEIINDTRCLIPADTVITTVAPDEKPGADYLTVVQPGVFAAGDGISGARSVIEAMAAGRSVAGLIDKYLGGEGNLDETLAPPEKDIKPLSEPKGQNRSQIELNLVKQAGGDKVEIEKTLSPEAAKKEARRCLRCDIVHQVHDYSLDTSSCTYCGRCVNACYWDAITSGYGYEAAAKKRQAEIAALEEKHSVYNYAIRILPIAIGLMILAAAVAKLFK

SEQ ID NO: 11777 - protein, 69 aa, Triticum aestivum
DSPRKQTIAAVSSSAPSSGLLPPRRAAPCSAGFVRKSGATLRANAARKDQAQIVCANCNGLGKLGQIDK

SEQ ID NO: 11778 - protein, 274 aa, Zea mays
  misc_feature (93)..(93): Xaa can be any naturally occurring amino acid
  misc_feature (111)..(111): Xaa can be any naturally occurring amino acid
  misc_feature (127)..(127): Xaa can be any naturally occurring amino acid
  misc_feature (151)..(151): Xaa can be any naturally occurring amino acid
MASVASSTTLISSSASVLPATKSSLLPSPSLSFLPTLSSPSPSASLRLARPSPLTSIRSSSRRSFAVKAQTDDLPLVGNRAPDFEAEAVVDQXVIRVKLSEYIGKKYVILXFFYPWDSTFVCPTEIXTAFRGPGCAEFGKLNTPRGVRGLXCDDRGVSHLAWVQTDRKSGGLGDLNYPLISDVTKSISKSFGVLIHDQGIALRGLFIIDKEGVIQHSTINNLGIGRSVDETMRTLQALQYIQENPDEVCPAGWKPGEKSMKPDPKLSKEYFSAI

SEQ ID NO: 11779 - protein, 475 aa, Shewanella sp. MR-7
MSNEIKTQVVVLGAGPAGYSAAFRAADLGLETVIVERFSTLGGVCLNVGCIPSKALLHVAKVIEEAKAVAAHGVVFGEPTIDLDKLRSFKQKVISQLTGGLGGMSKMRKVNVVNGFGKFTGPNSLEVTAEDGTVTVVKFDQAIIAAGSRPIKLPFIPHEDPRIWDSTDALELKEVPGKLLVMGGGIIGLEMGTVYSSLGSEIDVVEMFDQVIPAADKDVVRVFTKQIKKKFNLILETKVTAVEAREDGIYVSMEGKSAPAEPVRYDAVLVAIGRTPNGKLIDAEKAGVKIDERGFINVDKQLRTNVPHIYAIGDIVGQPMLAHKGVHEGHVAAEVIAGMKHYFDPKVIPSIAYTDPEVAWVGLTEKEAKEQGIAYETATFPWAASGRAIASDCSEGMTKLIFDKDTHRVIGGAIVGVNGGELLGEIGLAIEMGCDAEDLALTIHAHPTLHESVGLAAEIYEGSITDLPNPKAKKK

SEQ ID NO: 11780 - protein, 671 aa, Shewanella sp. MR-7
MAELKEVFVPDIGGDEVQIIEICASVGDTLAAEESILTVESDKATMDIPAPFAGVLAELKVAVGDKVSEGTLIAMMQAAGTANVQAAPVAQAAAPAPAPAAPAPVQAAPAPVAAAPATGATQVVEVTVPDIGGDTDVSVIEVLVAAGDKIEVDAGLITLETDKATMDVPSPFAGVVKEVKVAVGDKVSQGSLVIMLEVGGAAPAAAPQASAPAASAPVAQAAPAAPVAPVAAASPVVAVKEIQVPDIGDASNVDVIEVLVSVGDDITVDQGLITLETDKATMEVPAPFAGKLLSLTVKVGDKVSQGSVIATIETVTAGAAPAPQAAAPAPVAQEAAPAPVAAAPSRPPVPHHPSAGAPVATGVVHASPAVRRLAREFGVDLTQVTGSGRKGRIMKEDVQAYVKYELSRPKATAATSVAAGNGGGLQVIAAPKVDFSKFGEVEEIPLSRIQKISGPNLHRNWVTIPHVTQFDEADITEMEEFRKQQNDAAAKKKADYKITPLVFMMKAVAKTLQQFPVFNSSLSSDGESLIQKKYYHIGVAVDTPNGLVVPVVRDVDKKGIIELSRELADISVRARDGKLKSADMQGSCFTISSLGGIGGTAFTPIVNYPDVAILGVSKSEIKPKWNGKEFEPKLMLPLSLSYDHRVIDGAMAARFSVTLSGILSDIRTLIL

SEQ ID NO: 11781 - protein, 976 aa, Oryza sativa Japonica Group
MAGTRQTTSVPMDNAAVVDAKPLRTLTPMFPAALGLHTFTAKENSSSIVCITPFGPYAGGTEQAMPASIPPMFASPAAPADPNQRQPYAVHLNGAAPANGTANNTGVIPDLQIAVAGTVESAKRKRGRPKRVQDSSVPSAHLVPSAPGGNITAVQTPPSATTDESGKKKRGRPKRVQDVPVLSTPSAPQVDSTVFQTPASAVNESVTRKRGRPRRVQDGADTSAPPIQSKYNEPVLQTPSAVTLPEDGKRKRGRPKRVPDGALIPLSHSGVSIDDDSGEIITGKRGRPRKIDVNLLNLPSLFSDDPRESVDNVLMMFDALRRRLMQLDEVKQGAKQQHNLKAGSIMMSAELRANKNKRIGEVPGVEVGDMFYFRIEMCLVGLNSQSMSGIDYMSAKFGNEEDPVAISIVSAGVYENTEDDPDVLVYTGQGMSGKDDQKLERGNLALERSLHRGNQIRVVRSVRDLTCPTGKIYIYDGLYKIREAWVEKGKTGFNVFKHKLLREPGQPDGIAVWKKTEKWRENPSSRDHVILRDISYGAESKPVCLVNEVDDEKGPSHFNYTTKLNYRNSLSSMRKMQGCNCASVCLPGDNNCSCTHRNAGDLPYSASGILVSRMPMLYECNDSCTCSHNCRNRVVQKGSQIHFEVFKTGDRGWGLRSWDPIRAGTFICEYAGEVIDRNSIIGEDDYIFETPSSEQNLRWNYAPELLGEPSLSDSSETPKQLPIIISAKRTGNIARFMNHSCSPNVFWQPVLYDHGDEGYPHIAFFAIKHIPPMTELTYDYGQSQEVGDCCRTMKQQGAFSVSRCHVIRLAFVWMRMQKRQSIPDIYLFIRCPGHGNSSCTEQFAKSDEMIRAIAFRESSGRYDSSEKCMFCRLINNLDNAHEQIDTAIATALSESKPVYISVGCNLAGLSHPTFSREPVPLFISPRLSNKANLEYAVEAAADFLNKAVKPMMVGGPKFRVAKAKKAFAGIAESSGY

SEQ ID NO: 11782 - protein, 178 aa, Pyrococcus abyssi GE5
MNPFHDLEPGPNVPEVVYALIEIPKGSRNKYELDKKTGLLKLDRVLYSPFFYPVDYGIIPRTWYDDDDPFDIMVIMREPTYPLTIIEARPIGLFKMIDSGDKDYKVLAVPVEDPYFKDWKDIDDVPKAFLDEIAHFFKRYKELQGKEIIVEGWEGAEAAKREILRAIELYKEKFGSKE

SEQ ID NO: 11783 - protein, 7111 aa, Streptomyces halstedii
MADEEKLQYFLRKVTVDLRESRHRVKELEGRWAEPLAVVGMACRFPGGVNSPEQLWDFVLDGRDGISGFPTERGWDLDSLYHPDPDHPGTSYASEGGFLHDAGEFDPAFFGISPREALAMEPQQRLLLQTSWEAIENAGIDPLSLKGSRTGVFVGAINQEYGPRLYDAAPDDNVEGYLLTGTANSVVSGRVAYVLGTEGPALTVDTACSSSLVALHLAGQALRQDECSMALVGGVTVMTTPTGFVEFSRQRGLAADGRCKSFAAAADGTGWAEGVGVLVVERLSDAQRLGHPVLAVIRSSAVNQDGASNGLTAPNGPSQQRVIRQALAAADLSSADVDVVEAHGTGTALGDPIEAQALLATYGQNRPEDRPLRLGSIKSNIGHTQAAAGVAGVIKMVMALRHGVLPATLHVDGPTPHVDWTSGAVELLADTTVWPEVDRPWRAAVSSFGISGTNAHTIIEQAPPVEVGAPEPAVKGNVLVPWVVSGRGADALRAQAARLREWVLEHPEHRLVDVGHSLVVSRSAFEDRVVVLGSDRDALLDGLAAAAQGEPGPGVVVGSSAGAGGGVAFLFTGQGAQRLGMGHELAARFPVFASALDEVCVQLDAHLERPLREVLFAEPDTEAAALLDETVFTQAALFAVEVALYRLVESWSLTPDYLLGHSVGGLAAAHVAGVLSLEDAAEVVVARGRLMQALPKGGAMVSLQASEDEVLESLSGLVSIAAVNGPQAVVISGDEDAVTAVAEEWRARGRKVKRLTVSHAFHSALMEPMLATFEQVLSRVTLNAPRIPVISDSTGLPLTPEQATSPAYWTGHVRNPVLFHQAVTHLTEQGVSAFLELGPDGVLSAMTRTSVVGRDNTVVTPLLRADRDEPYSALTALAELYVNGTHVDFRAVQEGTGARLVTLPTYAFRHQWFWLPTGTRPATGLDDDPFWGMVERGDAAELATIFAELGAEASAEEWGQLLPALTSWRQAQHARSTTDSWRYRITWKPRTGAPTTALSGTWLVITPTGYDETATECAAALRRHGAAVIPVTLDASTSETDRHAWHTRLEAEAAAMDGRLSGVVSLLGLAEAASDTSPAVPHGVAGTLALVQALGDARIQAPLWCLTRGAVSTGRPDPLRSPLQAMIWGFGQVVGLEHPARWGGLADLPETVDDHGWDQLCSALADGAEDQVAVRPAGLLVRRLVPAAPAPVVATGADARAAGGTVLITGGTGALGGSIARWAAERGAQRLLLLSRSGDRAPGAEALLTELEAAGCPAEIVGCDIADRDALAAVLAAIPAEHPLSAVIHTAGVLDDGVIDSLTPDRMATVLAAKHTGANNLHELTADLPLSAFVLFSSAAATWGGVGGQGSYAAANAYLDALAEHRRDLGLPASSIAWGPWADGGMAAAGDLGRALDRRGLQPMRPESATGLLSRVLDRGDTTVTIADVAWERFYPLLATARPKPLLHDIPQIAALLAETGADTLPSELGSRLAGLPDEDRSRLVLEAVRSHAAAVLGHANTAGVEPNRAFRELGFDSLTAIEFCNRLIRTTGRPLPPTLVFDYPTPLAVADFILGELTGTDPAGTPHRSDTVATASPDEPLAIVGMACRLPGGIRTPEQLWRLVAEGGDAVSGFPTDRGWDIESLYHPDPDHPGTSYANEGGFLHEAGEFDAGFFGISPREALAMDPQQRLLLETSWEAIESAGIDPLSLKGSSTGVFTGMSYHDYASPMTPVAEGLEGYLGTGNAGSVVSGRVAYVLGTEGPAVTVDTACSSSLVALHWAAQALRQGECSMALAGGVTVMATPGMFVEFSRQRGLAPDGRCKAFAAGADGTGWAEGVGMVLVERLSDAQRLGHSILAVVRSSAVNQDGASNGLTAPNGPSQQRVIRQALSTAGLTTADVDAVEAHGTGTNLGDPIEAQALLATYGQDRPEGRPLLLGSLKSNIGHTQAAAGVAGVIKMVMALRHGVLPATLHVDEPSPHVDWASGAVELLTEATAWPETGRPRRAAVSSFGISGTNAHTILEQAPAVSSGETDVPSRETGAEPTAWVISGRGKEGLIRQAARLRDWANEQPEHSATDIGFSLLSSRSLHRDRLVVLGSDRQVLVDGLAAFVEGAPWPGVVGGSGGGVVADRPVFVFPGQGSQWVGMGRELYASSPVFRARLDECAAALDPLVDWSLIDVVRGESGAPGLERVDVVQPVLWAVMVSLAAVWESWGVTPAAVVGHSQGEIAAACVAGALSVEDAAQVVALRSRAVRGMAGDGAMVSVALPAAEAEALTGDGVSLAAVNGPSSVVLSGDRSALTPVVEGLTAQGVRTKWVPVDYASHSAHMDRIHDELLEILSGIEPKTSRIPLYSAVSAEVIDTSRMDASYWFDNIRGTVRFHETVQALITDGLTAFVEVSPHPVLAMSVQDTLDQAEATGLSIGTLRRDENEHETLLTAAAELFVAGLPIDWNTAAYTGRSPQRVDLPTYAFARERFWLRAASTTPTDARGLGLGTVGHPLLGAVVAMAEGDTTVLTGQISLRTHPWLADHAVLGSVLLPGTAFLELAIRAADHVDCPQVEELILQAPLVLAEDRATDLQIQVGPADGDGIRAVDIYSRPHPEDEPAAQERWTHHASGTLAPTTRTDTEDTGLSVWPPHDATPLPVTDIYPRLNRTGLEYGPLFQGLRAAWRSGEEIYAEVALPDHQDDTAAPGDYGVHPALLDAALHAIGFHLGDRATDTEGQGWLPFSWTGAALHAVGASTLRVRLTPQGPDAVSLLAADTTGAPVISIDSLTLRPVSAEQLRTRPGAGQNSLFALDWIPAGPVTGTEAATGPWAILDIAGIGGGETEALADALTVRGVPTEVHPGLEAVPADGQNAPVDVLLPVLTTTAANEADALVSRLLGVLQEWLRRPEPTASRLIVVTRGAIATESDADITDLAAAAVWGLIRTAQLEHPDRFLLVDADQQALTDGSVVDAVRGGEPQTAIRHGELLVPRLHRAMMEETGAPTEWATEGTVLITGGTGVLGAALARHLADRGARRLLLVSRQGARAAGSETLLADLRATGTLAEAVACDTTDRGALAELLAAVPDAYPLTAVVHAAGVLDDAMLESLTPARIGAVLAPKATAAWNLHQLTAELPLSAFVLFSSATGTFGNAGQAGYGAANAFLDALAQHRRAHGLSAISLGWGLWAEASAMTGHLAEQDRGRMHRKGADPLTTEQGLALFDTATAQSRAHLLPVPLNTGALRDRAVPVTCPISSATWYGYRVAAPRAPARAAGTGLAARLALLPLAERQRETLELVRANAAAVLGHAGADSVGAERAFRELGFDSLTSVELRNRLNAATGLRLPATLVFDYPTPLAIALHLLDSMFPDGDDRTPSAPQQAALAAIDEPIAVVGMACRYPGGVTSPEQLWQLVTKGEDAISGLPLDRGWDIEKLYDPDPANPGTSYTRHGGFLHDAGEFDAGFFGISPREALAMDPQQRLLLETSWEAVESAGIDPLSLKGTDTGVFAGVMYHDYATQLDAVSEDVGGYLGTGNASSVVSGRIAYAMGLEGPALTVDTACSSSLVALHLAAHALRQGECSMALAGGVTVMATPGTYVDLSRQRGLAVDGRCKAFAAAADGFGPAEGVGVLVVERISDAERLGHPILAVVRSSAVNQDGASNGLTAPNGPSQQRVIRQALASAALSTADVDVVEAHGTGTALGDPIEAQALLATYGQGRPEGRPLRLGSLKSNIGHTQAAAGVAGVIKMVMALRHGVLPATLHVDEPSPHVDWASGAVELLTEAMPWPEVGRPRRAAVSSFGISGTNAHIVVEQAPESQIEVAASREETPAGSVAWVLSGRGEGALRAQAARLREWLLERPEDRPVDVGFSLLSSRSVFEDRLVVLGSQREALLDGLAAAAEGAPWPGLVQSSGDVSLSRAVFVFPGQGSQWVGMGRELYASSPVFRARLDECAAALDPLVEWSLIDVVRGESGAPGLERVDVVQPVLWAVMVSLAAVWESWGVVPAAVVGHSQGEIAAACVAGALSVVDAARVVALRSRAVRGMAGDGAMVSVALPAAEAEALTGDGVSLAAVNGPSSVVLSGDRSALTPVVEGLTAQGVRTKWVPVDYASHSAHMERIHDELLEILSGIEPKTSRIPLYSTVSAARIDTSRMDASYWFDNIRGTVRFHETVQTLIADGLTAFVEVSPHPVLAMSVQDTLDQAEANGLSIGTLRRDENEHETFLTAAAELFVAGLPIDWNTAAFTGMSARRVDLPAYAFQRRHYWLDTASQTAGDAQELGLGAVDHPLLGASVGVAESDLVVLTGHLSLRTHPWLADHAVLGSVLLPGTAFLELAVRAGDQVGRTRLEELVIQAPLLLADDARDLQVVVGAADETGRSTVDIYSRPHADGDLDSERAWTHHAGGILAGGPVEEFADADLSIWPPQNATPLDIADFYSQLDLAGYEYGPAFRGLRAAWRRGDEVFAEVELPESEQDRAAEFGLHPALLDAALQAIGLTALGDSEPSEEAQPGKLPFSWNGVSLHASGAPMLRARLRPHGDEAISLVAADAHGEPVLSVDSLVLRALDPQQLNGARTAVQEDLFALEWAPLGELPEQEAVELGDWALLDVPGLSGSVDGLLGGLLGRGIEPRVCGSVGELMVDGVEPDVVLLPVVGGGGGGDAVDVVCGVLGVVREWLGLVGGVSRLVVVTWGAVSVGSGEGVGDVGGAGVWGLLRSAQSEHPGRFVLVDVEGVEGVGWGGLVDGVVCGEGQVVVRGGGLLVPRLVRAGGGGLVIPETFTGGVSGVGSAGVGVESSGEVLGSSVGGVGSGWCVGVGVGSGVGTLEGLGVVSAGAGAGVGVGVGSGVGGGLGVGEVRVAVRAAGVNFRDVLIGLGVYPGEALLGSEGAGVVVGVGEGVVNVGVGDRVMGLFLGGFGPEVVVDARMVVRLPVGWSFVEGATVPVVFLTAWYGLVDLAGVRAGERLLVHAAAGGVGMAAVQLARHWGVEVFGTASEGKWEVLRGLGLDDAHIASSRDLGFVEKFGRGSSGNGGGVDVVLNSLVGEFVDGSLGLLGEGGRFVEMGKLDVRDAGVVGELWSGVWYRNFDLVEAGLDRIQEMLCELVGLFDVGVLEALPVRCWDVREVVDALRFVQQARHVGKVVLRVPGGWGSGTVVVSGGTGVLGRAVVRYLVGCGVGRLLLLSRSGAAGEGVAGLVGELEGLGVVVDVVACDVGDREALAGVLGGVSGEFPVTGVVHLAGVLDDGMVESLSEGQVRRVFAGKVDGLVNLDVLTRGMPVEGFVVFSSAAGVFGNAGQGNYAAANACVDAVVARRRVEGLPGVSLAWGLWSEASGMTGHLDAGDHDRMNRAGLAGFSTDHGLALLESALALPHAQLLPIRLDRARLQARADVGDVHPLLRGLVRSRSRRAASAVGIGVGGLGGRLVGLVEGERRRVVLDLVRSHAATVLGHGDVAGVGAGRAFRELGFDSLTAVELRNRLNTATGVRLPATLVFDYPTPTELADYLLVQMVGESGAADSVQVPISVSSEEPLAVVGMACRFPGGVGSPNELWDFVLAGGDGISGLPVDRGWDVAGLFDPDPEREGTSYTREGGFLHDAAEFDPGFFGISPREALAMDPQQRLLLETSWEAVENAGIDPLSLKGTSTGVFAGVTYHDHALRLQSISGTPDGLLGTGSSASVVSGRVAYVLGLEGPALTVDTACSSSLVALHLAGQALRQGECSMALAGGVTVMATPGTFVDFSRQRGLAADGRCKAFDVSADGFGPAEGVGMLVLERLSDAQRLGHPVLAVIRGSAVNQDGASNGLTAPNGPSQQRVIRQALASAGLSTMDIDAVEAHGTGTALGDPIEAQALLATYGQDRPEDRPLRLGSIKSNIGHTQAAAGVAGVIKMVLAMQHGVLPPTLHVNEPTPHVDWASGAVELLTEATAWPETGKPRRAAVSSFGISGTNAHTIIEQAPQVEVGALEPAVKGDVLVPWVVSGRGADALRGQAARLREWALKHPEERLIDVGHSLVMSRSAFEDRAVVLGSDREALLDGLAAAAQGEPWPGVVQGSSVGSGGGVAFLFTGQGAQRVGMGRELSARFPVFASALDEVCVQLDAHLERPLREVLFAEPDTEAAALLDETAFTQAALFAIEVALYRLVESWSLTPDYLLGHSIGGLAAAHVSGVLSLEDAAEVVAARGRLMQALPKGGAMVSLQASEDEVVESLDGRVSIAAVNGPQAVVISGDEDAVTAVADEWRARGRKVKRLTVSHAFHSVLMEPMLAEFEQVLSRVTLNAPRIPVISDSTGLPLTVEQATSPAYWTGHVRNPVLFHQAVTHLTGQGVNSFLELGPDGVLSAMTRTSLADDSDITVVPLLRRDREESEAALTALAELYVNGAVVEWSAVFGGGEAVRRVDLPTYAFQHERFWLEGGDSKASATVTDGLDAGFWGAVERGDVEGLAGVLGSGVSVDVWGEVLPELSSWWLGRRARSVVEGWRYRVEWRRVGGGLLSGGGGLSGTWVVVVPVGVDVGLVDGCVGALVGCGVRVVVVGVDVGVLGDVEGLGSLVVGGLPEGVGVGDVSGVVSLLGLVEGWFEGLGGVSLGVVGTLGLVRGLGGVGVVAPLWCVTRGAVGVGGGDVVVSPVQGLVWGLGRVVGLEHPERWGGVVDLPVSVDGRGWERFCSVLAGGGGEDQVAVRSSGVFVRRLVPAPVPVAVSGGGWVGGLSGGSVVVTGGTGVLGGRVARWLAGCGVGRLVLVSRSGAAGVGVDGLVGELEGLGVVVDVVACDVADREAMAGVLGGVSGEFPLRGVVHAAGASGMGALEGLGVEEFAGVVGAKVGGAVVLDELVGGVPLVLFSSGAGVWGGGGQGAYSAANAFLDGLAEYRRGRGLPAVSIAWGPWADGGMVDAQAEQQLERRGLNSMSPELAIAAMEQAIESGDASLTVADVDWVKFYSAFASARPRPLLHDIPQVAEFLAETAAAENNTRQESGLAERLAGLSETERNRSVLELVRSHAAGVLGHANLEAVGSERGFLDIGFDSLTAVEFRNRVSKSTGLSLPPTLLFDYPNAASLARHIVGQLTSSDASSMLFSTLEMLESMLLDESVTDQMRLAVRQKIDPLLSPTPAITSDSSGEKTAEHFDGLSPDEIFKMIDGSLGIDSSDAADAESGEA

SEQ ID NO: 11784 - protein, 188 aa, Triticum aestivum
LSPPHLAIHVLHHGPPAVMASSATTVAPFQGLKSTAGLPISRRSGSAGLSSVSNGGRIRCMQVWPIEGIKKFETLSYLPPLSTEALLKQVDYLIRSKWVPCLEFSKVGFVFREHNSSPGYYDGRYWTMWKLPMFGCTDATQVLNEVEEVKKEYPDAYVRVIGFDNMRQVQCVSFIAFRPPGCEESGKA

SEQ ID NO: 11785 - protein, 415 aa, Coprinopsis cinerea okayama7#130
MSEPIYEATASAPVNIAVIKYWGKRDTSLILPTNSSLSVTLSQDHLRSTTTSRASSSFDKDRLWLNGQEDVIKPGSRLETCIREMKKLRKELVEDKDANAPKLSTLPVHIASYNNFPTAAGLASSASGFAALVSSLAHLYTLTPPLTSPSTLSLIARQGSGSACRSLFGGFVAWEMGSTPTGTDSLAVQIADEAHWPEMHALICVVSDDKKGTSSTAGMQRTVETSTLLQHRIKDVVPRRMDEMIRAIKEKDFDSFARITMADSNSFHAVALDTEPPIFYMNDVSRAIIALIVELNRVSLEKGEGYKAAYTYDAGPNAVIYTLDKNVKEVIQLIVKYFPQKAGEFKDNLQVLGGGVADINQVAQVPEGFNEKVAVVREVGAVKGLIHTKVGDGPRRLGDEESLLGKDGFPKTLVA

SEQ ID NO: 11786 - protein, 396 aa, Pyrococcus abyssi GE5
MAKIIVDAQAARAIGKGAMIVFKKGVVRVEGTIKPGDIVEVYTRGGKFLGKGFANPNSNIMVRIVTKDKDVEINKDLFKERIKKANEYRKKVLKYTNVYRMVYGEADYLPGLIVDRFNDIASLQISSAGMERFKLDVAEAIMEVEPEIETVFEKNTGRSRRREGLPEIERVLLGKEKYRTIIEEGKAKFIVDMRGQKTGFFLDQRENRLALEKWINPGDRVLDVFTYTGGFAIHAAIAGADEVIAIDKSPRAIETAKENAKLNGVEDKIKFIVGSAFEEMEKLQKKGEKFDVVILDPPAFVQHEKDLKPGMRAYFNVNFAGLNLVKDGGIFVTCSCSQHVDLQMFKDMIIAAGAKAGKFLKMLEPYRTQAPDHPILMASKDTEYLKCLFLYVENMR

SEQ ID NO: 11787 - protein, 412 aa, Saccharomyces cerevisiae
SATLFNNIELLPPDALFGIKQRYGQDQRATKVDLGIGAYRDDNGKPWVLPSVKAAEKLIHNDSSYNHEYLGITGLPSLTSNAAKIIFGTQSDALQEDRVISVQSLSGTGALHISAKFFSKFFPDKLVYLSKPTWANHMAIFENQGLKTATYPYWANETKSLDLNGFLNAIQKAPEGSIFVLHSCAHNPTGLDPTSEQWVQIVDAIASKNHIALFDTAYQGFATGDLDKDAYAVRLGVEKLSTVSPVFVCQSFAKNAGMYGERVGCFHLALTKQAQNKTIKPAVTSQLAKIIRSEVSNPPAYGAKIVAKLLETPELTEQWHKDMVTMSSRITKMRHALRDHLVKLGTPGNWDHIVNQCGMFSFTGLTPQMVKRLEETHAVYLVASGRASIAGLNQGNVEYVAKAIDEVVRFYA

SEQ ID NO: 11788 - protein, 77 aa, Triticum monococcum
KWYGVEGDYNVLVMDVLGPSLEDLFSFCNRKLSLKTVLMLADQMINRVEFIHSKSFLHRDIKPDNFLMGLGKRZNHV

SEQ ID NO: 11789 - protein, 587 aa, Lactobacillus plantarum
MMTKMIAGQALVKVLEAWGVDHIYGIPGGSINHTVEGLYLEKADIDYIQVRHEEVGALAASADAKFTGKIGVSFGSAGPGATHLFNGLYDAKMDHVPVLALVGQVPQATMNTNYFQEMDETPMFSDVAVYNRTVTTAGQLPYVINQAIREAYRQKGPAVVIIPENLSAEEIDYQPVSTPNTVSDTFEQRVDPQAITATLKMLKAAKHPLVYAGRGLLGAKADLVKFSEQFNIPVMNTVPATGVIPTNHPNAIGTFGRLGSKSGFEALQHADLILFLGSEFPFASFWPKGIKIIQVNNNSFDIGKMVPIDYAVISDAQAYLQAMIATGETLPETAWLTTNRQNKRNWDKWLQQLAADDHDGLAPEAVMHKVASMVGPRDTYGVDTGNVSEWAVRGLPMDQEQRFALSGLFATMGFGLPAGMAGALSVPDSQAWSFSGDGGFAMVAPDIITEARYGLPVINVIFSNQRFGFIYREQVDTKQHLYGVDLTDADWAKVADGLGGIGFTVQNNQEVETVFDQIKALQAKGNKRPIVVNAVIKNDDPIGTAYMPLDPELYGQAEVDAYAKANHIDIKEQPSLGALLRAQGDQL

SEQ ID NO: 11790 - protein, 320 aa, Arabidopsis thaliana
MASTAATAALSIIKSTGGAAVTRSSRASFGHIPSTSVSARRLGFSAVVDSRFSVHVASKVHSVRGKGARGVITMAKKSVGDLNSVDLKGKKVFVRADLNVPLDDNQNITDDTRIRAAIPTIKFLIENGAKVILSTHLGRPKGVTPKFSLAPLVPRLSELLGIEVVKADDCIGPEVETLVASLPEGGVLLLENVRFYKEEEKNEPDFAKKLASLADLYVNDAFGTAHRAHASTEGVTKFLKPSVAGFLLQKELDYLVGAVSNPKRPFAAIVGGSKVSSKIGVIESLLEKCDILLLGGGMIFTFYKAQGLSVGSSLVEEDKL

SEQ ID NO: 11791 - protein, 124 aa, Theobroma cacao
YNLGGMGCSAGLISIDLAKNLLQVHPNSYALVISMENITLNWYFGNDRSKLVSNCLFRMGGAAILLSNKRSDRRRSKYELVHTVRTHKGADDKCFSCVTQEEDSAGKVGVTLSKDLMAVAGDAL

SEQ ID NO: 11792 - protein, 216 aa, Oryza sativa Japonica Group
MAPAVEAVEKKTGSAPVKAPALNERILSSMSRRSIAAHPWHDLEIGPGAPTIFNCVIEIPRGSKVKYELDKKTGLIVVDRVLYSSVVYPHNYGFIPRTLCEDSDPLDVLVIMQEPVIPGCFLRAKAIGLMPMIDQGEADDKIIAVCADDPEYKHYNDIKELPPHRLAEIRRFFEDYKKNENKEVAVNDFLPASAAYEAIKHSMDLYATYIVEGLRR

SEQ ID NO: 11793 - protein, 413 aa, Dichelobacter nodosus VCS1703A
MALIVQKYGGTSMGSVERIETVADRIVRARQAGHDVVVTVSAMSGETNRLIALAQRFAAQPSPRELDVLMSSGEQVSMALLAIALEKRGCPALSLAGWQVGIFTDSQHTKARIQHIDDGAIYRALSAGKVVIVAGFQGVDEAGDITTLGRGGSDTTAVALAAVLKADECQIYTDVDGVYTTDPRIEPRARKLEQISFVEMLEMASLGSKVLQIRSVEFAGKYHVPVRVLSSFSDDETGTLISSVEGAIIEATHVTGIAFTRDEVMIQLMHLPDDMNTLYQILRPIGCADISLDMVAQTRNDDGSINFSFIVPHQEKDRVIEFIVEQFSHIAALSVLQTEIAKISLVGLGLRSHTGIIGRILQALMQENIPVHCFATSETRVSLVTDLLYLERAVHCLHDAFQLEKADECRESF

SEQ ID NO: 11794 - protein, 535 aa, Bradyrhizobium sp. BTAi1
MTLHSTIDPSSADFARNAEAMRVLVEDLKAKLGQVAAGGGEASRKRHLARGKMLARQRVDLLLDPGTAFLELSPLAAHGLYGGDVHSASIVTGIGRIAGRECVVVANDATIKGGTYYPMTVKKHLRAQDIARQNNLPCVYMVDSGGAFLPLQDEIFPDERHFGRIFFNQAQMSAQGIPQIAIVMGSCTAGGAYVPAMSDESIIVRNQGTIFLGGPPLVKAATGEVVSAEELGGADVHSRQSGVTDHYAQNDAHAIGIARRIVGTLKPPGARAVLNMREVRAPRYPAEEIYGVVPADGRKPFDVRDIIARVVDGSEFDEFKKLYGQTLVCGFAHIFGYPVGIIANNGILFSESSLKGAHFIELCCQRNIPLVFLQNITGFMVGKKYEAGGIARDGAKLVTAVATASVPKFTVVIGGSYGAGNYGMCGRAYAPRFLWMWPNARISVMGGEQAAMVLSQVRRDGIEAKGESWSTEEEEKFRSPIRAQYEAQGNPYYATARLWDDGVIDPADTRLVLGLGLSAAANAPVEPTKFGLFRM

SEQ ID NO: 11795 - protein, 278 aa, Oryza sativa Indica Group
MLMWFLRQSSVLHLCRVALNIPIDDEQWNDGLLATIREKVHMEADRKAMANQANVPADPQFQSRTTYRVKNKVIYCLDGARIGIQYETYFAGEPCEIYHCVLESKSFLEKMTVIEHTLPFFLPIREVESEFLSSNAIKFIDHLEEILQSYVDRREQVRLIKELYGNQIGELFHSLSYNLIEFVMEDFECKVTVSIRYSDLLFTLPSQARVLAWPLRSSRGISVTERRASRSASAQLVPFRLPYAEDALKTLSLPEAFAEIVLSLPRALKRILSSQESD

SEQ ID NO: 11796 - protein, 414 aa, Issatchenkia orientalis
MPWVGSAVVYGMQPYEFFENCRKQHGDVFSFLLLGKVMTVYLGPKGHEFVLNAKLSDVSAEDAYTHLTTPVFGKGVIYDCPNWKLMEQKKFAKVALTKESFIRYVPLIKDEMLKYFNANFRGDSGKTDVLKSQSEMTLFTASRSLFGDALRNRLDASYAEMYSDLDKGFTPLNFVFSYLPLPNYWKRDAAHKNISNTYLDLINTKRAGGEIKNEDLVDALLKNSVYKDGTRMTDEELAHLMIGVLMGGQHTSSATSAWFLLHLGEKPQLQEEIYREIQSVLGENFERELTYDDLQKLDLVNATIKETLRLHMPLHSIFRKVTRDLPVPNTSYIVPKGHYVLISPGYTMLSERYFPNASEFQPHRWDEIKSIDGGISFGAEGENAKETVDYGFGKISKGVASPYLPFGGGRHRCT

SEQ ID NO: 11797 - protein, 220 aa, Triticum aestivum
  misc_feature (173)..(173): Xaa can be any naturally occurring amino acid
MAASPATSSAAARASTFARLSNAPLRAPRAAAVSFPSPNSARPAALVADARASRLPVVAAAAAGHQRLMGSLTNTEGLRFAVVVARFNEIVTNLLLQGALEAFERYSVKAENITVVSVPGSFEIPVAAQKLGKSGKYDAILCIGAVIRGDTTHYDAVANSAASGVLNAGLSAXVPCVFGVLTCDDMDQALNRAGGKAGNKGAETAITAIEMASLFRHHLA

SEQ ID NO: 11798 - protein, 154 aa, Brassica napus
LGMTPLLAAVYVGALQNIFSKSAKYSLFDPCKEMAYIPLDEDTKVKGKAAIDVVCNPLGKSGGALIQQFMILSFGSLANSTPYLGMILLVIVTAWLAAAKSLEGQFNALRSEEELEKEMERASSVKIPVVSQDEEGSLGESSSSSPEKSAPTNI

SEQ ID NO: 11799 - protein, 515 aa, Penicillium italicum
MDLVPLVTGQILGIAYYTTGLFLVSIVLNVIKQLIFYNRKEPPVVFHWIPFIGSTIAYGMDPYQFFFASRAKYGDIFTFILLGKKTTVYLGVEGNEFILNGKLKDVNAEEVYGKLTTPVFGSDVVYDCPNSKLMEQKKFIKYGLSQEALESYVPLIADETNAYIKSSPNFKGQSGTIDLAAAMAEITIFTAARTLQGEEVRSKLTSEFADLFHDLDLGFSPINFMLPWAPLPHNASAIKHTTYARDLSGNYPSATGSWRRRQRRRQDKSKGTDMISNLMRCVYRDGTPIPDKEIAHMMITLLMAGQHSSSAISCWILLRLASQPEMAEKLHAEQIKNLGADLPPLQYKDMDKLPLLRNVIKETLRLHSSIHTLMRKVKNPMPVPGTDFVVPPSHTLLSSPGVTARDERHFRDPLRWDPHRWESRVEVEDSSDTVDYGYGAVSKGTRSPYLPFGAGRHRCIGEKFAYLNLEVIVATLVREFRFFNPEGMEGVPDTDYSSLFSRPVQPATVRWEVRS

SEQ ID NO: 11800 - protein, 143 aa, Vitis vinifera
MQPVGSMRHGDPAHCDRIRKMLRRWRRKAASSGGRIRVPSDVPAGHVAICVGSGCRRFIVRASYLNHPVFKALFLEAEEEYGFANHGPLAIPCDESVFEEVLRVVSRSESSHPPRLTIGDDFQRRCHVESRPLLHGFAEKSIC

SEQ ID NO: 11801 - protein, 171 aa, Vitis vinifera
MKPTIGNGDKIRHIVRIQKMLRRWRRMAACSSSCASDVVIRVPSDVPAGHVAICVGSRYRRFIVRASYLNHPVFKTLLLQAEEEYGFANHGPLAIPCDESVFEEVLRVVSRRESSLSPRVTMVDDFQRSCHVESRPLLHRFAENSILSGTPALRLSGSPALLLIACNQAPM

SEQ ID NO: 11802 - protein, 505 aa, Emericella nidulans
MPSFSLLTGHFGALKQTIDGMPPNATLHSIMLKLSQKFRSGMFYINMWPFSGTWLVVATPSGAAQIQSLNLSKPNILRRPLETITGGPSLMSMHGETWKRWRALFNPGFNPNYLIGLAPLIADEVVVFCEQLRQKARTGTVFQLEPLTLRLTVDTICSVTLYVVTPVGRWPFLTPDLEIHSSTTKLRTTPLPQRCNGRSNGPRLELPSTPLRRYLTVRPLVMWYNNRLMNRFIDQEVDRAYREQSGRQSKSVISLALRDYMKEKDGSLEDFKRRVAPQLRVFLFAGRDTTSSTLLYAFYLLSRHPEALAKVRLEHDQVFGPYHQQVHEKIHQDAKLLNQLPYTTAVLKETLRLFPPSASMREGGPGVEITDDNGQVYPTAGCNVWTLTVALHHNSAHWAEAESFIPERWLVGSDHPLYPAKGAWRAFEFGPRSCIGQTLAMLELRVALAMTLREFDIAPAYDKWDHIYPNDAVKEFNGHRAYQAEKGGGGAHPADGMPCLVTFRV

SEQ ID NO: 11803 - protein, 357 aa, Helicobacter hepaticus
MQKRIAVIYGDGIGKEVITQALKILKAVAKKYEHTFIFEEVLAGGAAIDECGECLPMKSLQICKQSDSVLLGAVGGPKWDNEPSHNRPEKALLTLRKELGLFANIRPATLLPQLSKASPLKDEILNRGIDFIIVRELIGGVYFGEHKLEEINGEKVASDAMTYSASQIESIAKVAFNIARNRKKEIVCVDKANVLSSSRLWREVVDKVAQNYKDVHLSYMYVDNAAMQICRAPSQFDVILTENMFGDILSDEASIITGTIGVIPSASLSNGTLGMYEPIHGSAPDIAGQDKANPIGTILSAAMMLELSFGLTKESEVIQKAVQNALDKGYRTGDMMSEGMQLVGCEQMGDVILESVI

SEQ ID NO: 11804 - protein, 205 aa, Photobacterium profundum SS9
MRSTKMVLVGRQAPDFTAAAVLGNGEIVDSFNFAEFTKGKKAVVFFYPLDFTFVCPSELIAFDKRFEDFQAKGVEVIGVSIDSQFSHNAWRNTAIEDGGIGQVKYPLIADIKHEICKAYDVEHPEAGVAFRGSFLIDEDGLVRHQVVNDLPLGRNIDEMLRMVDALNFHQKNGEVCPAQWEEGKAGMDASPKGVADYLSEHTADL

SEQ ID NO: 11805 - protein, 309 aa, Thermobifida fusca YX
MTDEQHSVTPVTKAVIPVAGLGTRFLPATKSTPKEMLPIVDKPAIQYVVEEAVSAGLNDILMITGRNKRSIEDHFDRAYELEEALRAKGDIERLNAVRHPSDLAQLHYVRQGEPRGLGHAVLCGAAHVGNEPFAVLLGDDLIGARETLLQRMIEVRQTYGGSVIALMEVEPDQVSLYGCAAIEPTDEPDVVTVTDLVEKPPADQAPSRWAIIGRYICDPEIFEVLRKTPPGRGGEIQLTDALRELAQRSSNGGGRVHGVLFRGQRFDTGNKLDYLRTVVEFACESPDLAKEFVPWLRDFLTRYATDSTR

SEQ ID NO: 11806 - protein, 218 aa, Arabidopsis thaliana
MAEIKDEGSAKGYAFPLRNPNVTLNERNFAAFTHRSAAAHPWHDLEIGPEAPTVFNCVVEISKGGKVKYELDKNSGLIKVDRVLYSSIVYPHNYGFIPRTICEDSDPMDVLVLMQEPVLTGSFLRARAIGLMPMIDQGEKDDKIIAVCADDPEFRHYRDIKELPPHRLAEIRRFFEDYKKNENKKVDVEAFLPAQAAIDAIKDSMDLYAAYIKAGLQR

SEQ ID NO: 11807 - protein, 589 aa, Oryza sativa
  misc_feature (376)..(376): Xaa can be any naturally occurring amino acid
MATTASKIIPQTLPEIPTTPEPQQYTKTAPDIPKSNNSRSSVPKLLQESDRGKLNHKLEPKEQKPNHHLKESVDVSSAKCPTEVSEEMVSEGIASQEKKVVEYESVNGSSTSFHTCEGSGPGKASGSARMTDRSETGERGSSSRCRPSTSSDISDESSCSSMSSTTKPHKSNDSRWEAIQTIRVRDGIIGLSHFRLLKKLGCGDIGSVYLSELSGAKSYFAMKVMDKASLASRKKLLRAQTEKEILQCLDHPFLPTLYTHFETDKFSCLVMEFCPGGDLHTLRQRQPGKYFPEQAVKFYVAEILLALEYLHMLGIIYRDLKPENVLVREDGHIMLSDFDLSLRCAVSPTLIKSSNPDAEALRKNSQGYCVQPACVXEPSCVIQPSCAAPTTCFGPRFFSKSKKDRKPKPEIATQISPWPELIAEPSDARSMSFVGTHEYLAPEIIKGEGHGSAVDWWTFGIFLYELLFGKTPFKGSGNRATLFNVIGQPLRFPEYPIVSFSARDLIRGLLVKEPQHRLAYKRGATEIKQHPFFEGVNWALIRCASPPEVPKPVEIERPPKLPPSTSGTTDVSSGAPQKGSDGYLEFDFF

SEQ ID NO: 11808 - protein, 489 aa, Ralstonia solanacearum GMI1000
MSVPAFDMVLFGGTGDLARRKLIPALFDAHQGGELHSRGRIFAIGTQPLETAGYLALLEREVRPTMRLYSGAPVSDDAWASFVARIVYQQVDARKPEQFDALAAALGENRAPVTVCYLATAPGIFVDICAQLARVGLNTPNVRLVLEKPLGTDLASNERINSAVAEFFAEDQIYRIDHYLGKESVQNLMAIRFGNALFEPLWRREWIKDVQITIAEQLGVEKRGDFYDGVGALRDMVQNHLLQLVCIVAMEPPASLSQDAIRDEKLKILKALKPIPLQEVPEKTVRGQYLEGAIAGQPVQGYLDEHGIPHDSRTETFVAIKAEIANWRWAGVPFYLRTGKRMPQRLAEIVVRFHDVPHALFPKPLVQFPENRLVIRLQPEESIRLQFLTKTPGAALGLQPSTLDLDFTNHGGVRHAGAYERLLMDAVNGQLGLFVRRDEQAEAWRWVEPIIEAWNQARTPPKGYTAGSWGPAASSALLSRDAAAWHEEM

SEQ ID NO: 11809 - protein, 569 aa, Coprinopsis cinerea okayama7#130
MASSNSRSSTALSLPTVFAKELLAPLFGTLSKIDIAKSALFYYVIAIYSLKAYRHLRARGVTTTGKEVFNYVSQFVVRLILRVPSTKRKVAAQMDKAKLDVENKLVPKGPDVTRHLALPEEGKSIEWILAEMDKMDAELDGKSNVWREGKLSGAVYHGGDDLQRIIVAAYERYCVSNPLHPDVFPAVRKMEAEIVAMVLKLYHAPDGAAGVMTSGGTESIVMAVKTYRDWARKVKGITEPEIIIPASAHAAFDKGAAYLKIKVHTIPVNPYSRKVDIKRVRRAINANTILLVGSCVNFPDGNQDDIAALSDLAVRYNIGLHVDCCLGSFIVPFLEPTGLSGGNGKGKYKLEPFDFKLPGVTSISCDTHKYGFAPKGTSVIMYRSSELRAYQYYINPTWTGGVYASPSLAGSRPGALIAGAWAVMQAVGTKGYLESCRAIVLGARQIADAITSSIPELYVLGDPPASVVAFGSKHPNVNVLEVGDAMSKKGWHLNGLSGPPAVHIAVTRLTVPLVDQFIADLKDAVREAKVSPSGQGTMVALYGLGNSSAVGPDMVGELATAFLDALYKA

SEQ ID NO: 11810 - protein, 454 aa, Brassica napus
  misc_feature (216)..(216): Xaa can be any naturally occurring amino acid
MVIAAAASSFSLGPSHCHHHSYTDDFPSYKRHGSARNRAFDGSASANLSVLSSRCKIPSFGSAFHVATGGHDLGLTKVSVAADYSDSVPDSSFYGYHPLEDLKPGKRVQETKLSPAEVARTTVEANSSAVLVFPGAIHCEPHDHNSWSEFKYVIDDYGDIFFDIPDDVNILEDPGASNPVKAFFGMDVPRYENSRLHEEYNISEIGNLDQIIFDDXHYFEMMDSEAGDIPVDWGMPDTSNGVHPIYFAKHMSKAISMDYDRKMDYPSNGVSILACLRPAFLDEESYIRRLFLSEDRDDYSWEVQGDENQNTSSRDDENDMSSSLYRLEIVGIELLSLYGTESSISLQDFQDAEPDILVHSTSAIIERFNNRGVSSDIALKALCKKKGLHAEEANLISVDSLGMDVRVFAGAQVQTHRFPFKTRATTEMAAEKKMHQLLFPRSRRRKLKSNDESL

SEQ ID NO: 11811 - protein, 53 aa, Zea mays
  misc_feature (39)..(39): Xaa can be any naturally occurring amino acid
  misc_feature (45)..(45): Xaa can be any naturally occurring amino acid
DIAFLAHDPLIEKFREIKVHRRKVKKAVAKKKTGDLAEXGLLNRXPTYKLDRL

SEQ ID NO: 11812 - protein, 282 aa, Pyrococcus abyssi GE5
MFVIGSGAKHLEEEISRHGNLINVEIKKFPDGEKYVRVLERGKEAIVIQSTYHPQDENLIEALLLGDALSEAGFKKLKIVIPYLAYSRQDRVTKEGEPISVRAIMKMLGLYYDELYVFDIHNPKTLEHFPGIAKNIYPAEAIANYFKDKLGEGLILAPDKGALERAKRVAEVLGLEYSHFEKERISPTEVRMKPVDVDVNGKNVLIVDDIISTGGTMIKAANILRELGAKEIFVVATHGVFAEGAIERVSKAVNELAVTNTIPTEVSKISIVDYIVKLGEKE

SEQ ID NO: 11813 - protein, 783 aa, Parvularcula bermudensis HTCC2503
MTDDTTTKFTDAEALDFHSRGKPGKLEIMPTKPMATQRDLSLAYSPGVAVPVKKIAEDPESAYDLTTKGNMVAVISNGTAILGLGNLGALASKPVMEGKSVLFKRFADIDSVDLEIDTEDPEEFINAVKYLGPSFGGINLEDISAPESFYIEQRLKELMDIPVFHDDQHGTAIISAAGLINALDIVGKRIDEVKVAVSGAGSSALSVVGLIKAMGIKHENVILCDRQGTLYEGRTERMDQWRSAHAVPTDKRTLAEVMDGADVAIGLSAGGAFTKEMVKSMAKNPIIFAMANPTPEITPEEVAEVRGDAIMATGRSDYPNQVNNVLGFPYIFRGALDVRARTINEEMKIACAKALAELAREDVPDEVALAYGKRLQFGPGYIIPTPFDPRLLSKIPPAVAKAACETGVARRPLDDVAAYEGRLATRLDPSASFLQKIHANVKASETPKRIVFAEGEEEVIIRAAYAFQQQGLGQAILIGRDDLVNREFNRLGLSQTHNIEIWNARHSANGPAYTQYLYNRLQRDGYLERDCRRLVNQDRNVFAACMLALGHADGMVTGITRHYSAALNNVQLALDSRPSERVIGMSVLLARGRTVFMADTTIADLPQPEELADIAIQSAHAVRQMGFTPRVAFVSHSNFGNPNTEGVNRIAAAVRLLDESDQMADFEYEGEMTPRMALDHNRLKALYPFARLTGPANLLICPGLHSGGIASKLMAEIGGATVLGPLLIGLSRPVQILQTGAQSGDIVTMAAIAAYELDRDHRVWAEGSSGADQLRKTSRLLPL

SEQ ID NO: 11814 - protein, 163 aa, Parvularcula bermudensis HTCC2503
MDFPTLESAKVSPLASALFDIDGVVEVYLGADFLTVTKDPSVEWQHLKPAVLGTVADYLAAGIPVVDQGAAADSADTPDDYEGETKEIVEQIIDLIETRVRPAVAQDGGDIVFHRFVPGDGIVFLSMRGACSGCPSSTMTLKSGIENLLKHYVPEVTAVEAVG

SEQ ID NO: 11815 - protein, 273 aa, Debaryomyces hansenii CBS767
MNIARRYLSRFVEKCPIERGCECNILSELPNDKPIDFEKNLNGTSVIPWKHLLVLSHGFNHADEWPSKLELLPGSLTNEMDLLKRKVVSPYHPIMISNAIVPNVTRGAKEKVYLYPDNKMIEFDIKDTKDFMHTYLVPPEEEMAQFEPVYNPFKKTTAITWEKKKIDFKEQDIGKDLILVCGHTQRDVRCGKIAPILVDQFKKSLKDRGLDVDVGVVSHIGGHAYAGNVIYFPLDKTKKSIWYGRVFPEKVAGIVDETVIGGNIIKELYRGEV

SEQ ID NO: 11816 - protein, 270 aa, Physcomitrella patens subsp. patens
DIDNDHCDPQMCSSYATDIYEHLRMAEMKRRPSANFMESIQQDVNPTMRGILVDWLVEVAGEYRLVPDTLYLAVSYIDRYLSAQVVTRQRLQLLGVACMLIAAKYEEICAPQVEEFCYITDSTYCREEVLEMERGVLNVLKFELTTPTTKSFLRRFVRAAQASCKGPSLVLEFLGNYLAELTLVEYGFLPFLPSMIAASAVYLAKLTLDSSTCPWDATLQHYTGYRPWELERCVRAMHELQRNTKSCSLPAVREKYRQHKVSCERRPRGR

SEQ ID NO: 11817 - protein, 419 aa, Arabidopsis thaliana
MARAACSSVVTAMALLPSKSLLCRNQLLFSGNSKFVGVLTLQKRCFSSKVSMSLKAGIVGLPNVGKSTLFNAVVENGKAQAANFPFCTIEPNVGIVAVPDSRLQVLSKLSGSQKTVPASIEFVDIAGLVKGASQGEGLGNKFLSHIREVDSILQVVRCFEDNDIIHVNGKVDPKSDIDVINLELIFCDLDQIGKRIERLKKGKAKDSQSKEEAEKSALERIQEALLEGKPARSVALSDLEMEVVKHLCLLTMKPMIYVANVAETDLAEPEKNAYVEEVKGLSSDLQSGHVVVSAQVESELTELPLEERTEYLNSLGVSESGLGNLIRATYSLLGLQTYFTSGEKETRAWTIHAGMTAPQAAGVIHSDFEKGFIRAETVAYEDFVTAGSIAAAREKGLLRSEGKEYIVKEGDVMLFRFNV

SEQ ID NO: 11818 - protein, 423 aa, Yarrowia lipolytica CLIB122
MLASAAVAFSPINVHSIEPLINSSESLQVREILKVDRTRLLCAVDGAGNKRACLTEFNNKNIDVLAASLNNVLLGKQLEARSEASSSFSGAGRNSDEELDCSFEPRDLKKPIRIGALFAVLATSALGVFPPVLATSVFKINLQSLPMTFVKQFGTGVVLSTAYVHLAAESQEDFTNECLGDLSYDPTAMSLALAGTFIAFVLEYGSARWLRARHERKKPNHSSESDDCDKDQVKGAVDVIETQIDMSGAANMGCAAHNATLIDPNDKISVIIMEGGIIFHSVLVGVAVTIADDDGFISLFIAILFHQAFEGIGLGSRIAGLRDSSLFFKMSMCTYFTIITPIGMAIGLGVMDSMNSNDPATIWAIGTISALSAGVLIWAGVVEMLAFDWLFGDLSFAPKKRVFFAMSGLVGGMICMSLIGKWA

SEQ ID NO: 11819 - protein, 435 aa, Desulfotalea psychrophila LSv54
MKNSMSAQDLLHFDKTHLWHPYTSIEEPLPVYSVASASSSTLTLTDGRQLVDGMSSWWAAIHGYNNPVLNRALVEQVSRVSHVMFGGLTHEPAVELGKILLQLVPKSLNRIFYCDSGSVAIEVAMKMAMQYMHALGQPQKKRFVTIRGGYHGDTFHGMSVCDPVNGMHGLYAGVLPEYFFADRPTTSFFASWDAADFVGMRRLVEENQQNICAIILEPIVQGAGGMYFYHPQYLREVRALCDEYGLLLIADEIATGFGRTGKLFACEHAGIEPDILCLGKAITGGYMSFAATLATEEVGRVISSAAPGVFMHGPTFMGNPLACSVAKASLQLLIENDWQTQVEGLAKGLEEGLAPCLDLDCVAEVRVLGGIGVVELHAPLSSQGMVQIQAAFVEAGIWVRPFGRLVYLMPPYIMSKEELAFLTAAVFKVLATGDY

SEQ ID NO: 11820 - protein, 452 aa, Vitis vinifera
MATLDAPELAKPEADPKTVASIILGGGAGTRLFPLTKSRAKPAVPIGGCYRLIDVPMSNCINSGINKIYILTQFNSQSLNRHIARTYNLGSGVNFGDGFVEVLAATQTSGESGKKWFQGTADAVRQFIWLFEDARHRHIENILILSGDHLYRMDYMEFVQKHIDSDADISVSCLPMDESRASDFGLIKIDEMGQIRQFLEKPKGETLKSMRVDTTALGLSPVEAKKFPYIASMGIYLFKTDVLLKLLRWSYPTANDFGSEVIPMAAEECNVQAYLFNGYWEDIGTIKSFFDANLALTDQPPKFHFYDPLKPIFTSSRFLPPTKIEKCRVMDSIISHGCFLRECSVEHSIVGIRSRLDYGVEMKDTMMMGADYYQTEEEIAAFLAEGKVPIGVGKDTKIMNCIIDKNARIGKNVVITNKDKVEEADRPSEGFYIRSGITVVLKNSVIMDETII

SEQ ID NO: 11821 - protein, 96 aa, Glycine max
MATPNNSNINNATAKPGTLGVGVGAAPTPPKSQRGHNKPKCKQCGNVARSRCPYECCKSCCSRNQNPCHIHGSFLILLFSFSHHKETFLFFFATLK

SEQ ID NO: 11822 - protein, 111 aa, Picea abies
MGPSDSPYAGGVFLVTIHFPPDYPFKPPKVAFRTKVFHPNINNNGSICLDILKEQWSPALTISKVLLSICSLLTDPNPDDPLVPEIAHMYKTDRGKYESTARSWTQKYAMG

SEQ ID NO: 11823 - protein, 266 aa, Photobacterium profundum SS9
MHPMLNIAIRAARKAGDHVIKSLEKPQGIEVANKGSDVVTNIDHEAEAIIINSILKSYPDHCILAAESGTKEGRDKECQWIIDPVDGTKNFVRGLPHYAISIALRMRGRTEVSVVYDPSRNELFTATRGSGAQLNSQRLRTSQPRDLSGTIIATGLPFAAKQHAEALNKVQSAIFVECDDMRQSGCSALDLCYLAAGRVDGVVKLGQKPWELAAGELIAREAGAICTDFTGNTNYLTSGNIVAGNARVVKPIIAKIREHGGEALAK

SEQ ID NO: 11824 - protein, 496 aa, Hordeum vulgare
MDRARNFMPGPNQELLDAKPLRSLAPMFPAPMGVNINQSSTPPLVVVTPVGQFPTGFGAGSLPAFGPFASFSATANTFSPAGTSANVPIDVTPVSAYKTRPSGVTPLNDDDEPYSVAQTSASERKAKRPAGLAADGSNGVKFKHPKPIYKNHVAGKLLAFLPTSYSTPREAVEAVHMTFEALRRRHLQMDETQDVSRRADLKAGAIMMASEIRANAGKRVGTAPGVEIGDIFYFRMELCIIGLHAPSMGGIDYMSAKFGNGEDSVAICIVAAGGYENDDDDTDTLVYSGSGGNSRITEERHDQKLERGNLALERSLHRKNEIRVVRGFKDPAALAGKIYIYDGLYRIQESWKERTKFGINCFKYRLQREPGQRDGAAIWKRTQRWIQNASTRGTVIQHDLSSGAETFPVCVVNEVEHEKGPGHFTYTTQVKYPRPLSSMKALQGCGCQSVCLPGDANCACGQHNGGDLPYSSAGVLVCRKPVIYECGEACMPAGRL

SEQ ID NO: 11825 - protein, 486 aa, Vitis vinifera
MDVDNKFFNVALLIVATVVVAKLISALLIPKSRKRLPPTVKAFPVIGGLLRFLKGPVVMLREEYPKLGSVFTLNLLNKNITFFIGPEVSAHFFKAPEADLSQQEVYQFNVPTFGPGVVFDVDYSVRQEQFRFFTESLRVTKLKGYVDQMVTETEDYFSKWGDSGEVDLKYELEHLIILTASRCLLGQEVRDKLFADVSALFHDLDNGMLPISVIFPYLPIPAHRRRDQARTKLAHIFANIIASRRETGKSENDMLQCFMDSKYKDGRQTTEAEVTGLLIAALFAGQHTSSITSTWTGAYLFRHKEFLSAVLDEQKNLMKKHGNKVDHDILSEMDVLYRCIKEALRLHPPLIMLLRSSHSDFSVTTKDGKEYDIPKGHIVATSPAFANRLPHIYKDPERYDPDRFAVGREEDKVAGAFSYISFGGGRHGCLGEPFAYLQIKAIWSHLLRNFEFELISPFPEIDWNAMVVGVKGKVMVRYKRRVLPVD

SEQ ID NO: 11826 - protein, 128 aa, Photobacterium profundum SS9
MAYSEKVIEHYENPRNVGSFDKNDKNIGSGMVGAPACGDVMKLQIKVSDEGIIEDAKFKTYGCGSAIASSSLITEWVKGKSLDEAAAIKNSAIAEELELPPVKIHCSILAEDAIKAAVSDYKKKHEAN

SEQ ID NO: 11827 - protein, 762 aa, Chlamydomonas reinhardtii
MAAPDALIAAFIPASAVVAILFAVFLWKRVAAIQMTGGRVLSSQNGREYLLEEEQRGGEEEIVAKAADIQKSISEGASSFLATEYYYLGIFMVIMSVVICSLLSIVTPEEGRTSADELRNGVFSTIAFALGGATSILSGYLGMQIATFANARTAVEARKGIAPAFMCAFRSGAVMGFLLSGFGLLNLFLAITIFSKFFGDDWKGLFEAIGYGLGGSSIALFGRVGGGIYTKAADVGADLVGKVEKDIPEDDPRNPAVIADNVGDNVGDIAGMGADLFGSFAESTCAALVISAVSSLGKEHDYAGMMFPLLISATGIFVCLITTFLATDLKPAKVIAEIEHTLKMQLIISTLLMTPVALGVALWSLPPEFTLSVPSSSPDKPFDEKVVKSWYMFVCISTGLWGGLLVGLQTEYFTSNRYKPVQDVADACRTGAATDIIFGLALGYKSCIIPTIVIGVAIYVGTSLAGMFGIACCALGMLSTLATGLAIDAYGPISDNAGGIAEMAGMGEDIRERTDALDAAGNTTAAIGKGFAIGSAALVSLALFGAYVTRAKIDMIHSSILDPRVFAGLLLGAMLPYWFSAMTMKSVGKAALAMVHEVRRQFNTIAGLMEGTARPDYKRCVAISTQAAISEMIAPGALVIFTPVVVGALFGTQCLAGVLAGSLVSGVQLAVSMSNTGGAWDNAKKYIEAGATEHARELGGKGSDCHKAAVIGDTVGDPLKDTNGPSLNILIKLMAVESLVFAPFFYNCAHGQGLIFSFFGIA

SEQ ID NO: 11828 - protein, 215 aa, Oryza sativa
MAPPLQVATTASSSTREGKAPALNERILSSMSKRSVAAHPWHDLEIGPEAPTIFNCVIEIPRGSKVKYELDKKTGLVDRVLYSSVVYPHNYGFIPRTLCDDSDPLDVLVIMQEPVIPGCFLRAKAIGVMPMIDQGEADDKIIAVCADDPEYKHYNDIKDLPPHRLAEIRRFFEDYKKNENKEVAVNDFMPATSAYETIRHSMDLYATYILEGLRR

SEQ ID NO: 11829 - protein, 244 aa, Glycine max
MTERPTRKRKMGDTKERATKKPAAKWPLIKPKKNLQISRLRDFDLFTVQNFFSSAESKAFVKIAEEIGFTHQGSLGPTYGEAFRDNDRMLVDDPVLADTIWESGLSKLFSDIKIRGKVAVGLNPNIRFYRYKVGQRFGRHIDESVDLGDGKRTYYTLLVYLSGGPGELKSKPKNDSSNPSVSSVDPLVGGETVFYGQRNKTVAEVAPTEGTALLHLHGDKCLLHEARNVTKGVKYVFRSDVVFA

SEQ ID NO: 11830 - protein, 331 aa, Parvularcula bermudensis HTCC2503
MAEDLTLPPEWAPHAALWVGWPHLPEEWGGALDKARAEIAGFVETVSPHVPVRIAIGSDAAATAAEAHGLDKLADLVQVPTGDIWLRDTGPIVVYEDGRRVARTFAFNGWGGKFEMPGDKETAVAIAEAELIPQTRDAFVLEGGSIEGDGLGDLLTTRECLLNPNRNPSLGQIDIEKRLRERLGVARIHWLPQGLAHDHTDGHIDNAARYVGPGHILCQDPFGTDDPQAERLQQIKTRCEAIGVDLSTIPAPGRVLGPDGGPLPASHLNFVITNGIVVMPGFGTPSQSAAREGLEAVFPDRRVVVLPSSFLLHGGGSFHCMTCPIPASKDT

SEQ ID NO: 11831 - protein, 119 aa, Isochrysis galbana
LARAAAVAAKRGPGLSRAVLSRTAVPTLQRSFASATFLDEADVTDRVLGCVKSFEKVDPTKVTAKAHFLNDLGLDSLDTVEVVMAFEDEFVIEIQDADAEKIQTCEDAIKYIMLHPAAK

SEQ ID NO: 11832 - protein, 419 aa, Sulfolobus solfataricus P2
MEELLTSNLLVQQVKKLYKVGELLGLDSETIDVLSQPERVMQVKIQIRSSDGKLRTFIGWRSQHNSALGPYKGGVRYGPNVTQDEVIALSMIMTWKNSLLLLPYGGGKGGIRVDPKKLTLKELEDLSRKYVQLIHKYLGSDVDIPAPDINTNPQTMAWFLDEYIKITGKVDFAVFTGKPSELGGIGVRLYSTGLGVATIARDAANKFIGGIEGSRVIIQGFGNVGFFTAKFLSEMGAKIIGVSDIGGGVINENGIDVNRALEVVQSTGSVVNYLEGKKVTNEELLISDCDILIPAAVENVINKFNAPKVRAKLIVEGANGPLTADADEIMKQRGVIVIPDILANAGGVVGSYVEWANNRSGGIISDEEAKKLIVDRMINAFNTLYDFHKRKFADQDLRTVAMALAVDRVVGAMKARGLL

SEQ ID NO: 11833 - protein, 276 aa, Frankia sp. EAN1pec
MRRAFQQVDVFTSGSCLGNPVAVVLDAEGLPSAAMRRFAAWTNLSETTFVQAPTAPGADYRVRIFTPTAELPFAGHPTLGTCHAWLTSGHTPRDPDRIVQECEAGLITVRRDDASGLAFSGPPLLRYEPADAELVRHLAEMLRLDPADILAAQWVDNGPGWVGVLLDSAAAVLAIRPGAVDLAVGVVGPHPPGGPGAFEVRAFTPQITTVEDPVTGSLNASLATWLFDIGKADGAYVVSQGTMLGREGRVRLSRDPDGSVWVGGDTVTCISGTVDL

SEQ ID NO: 11834 - protein, 287 aa, Frankia sp. EAN1pec
MTGSQKIAYQGEPGANSHIACRDVYPDFEAVPFQTFEECFTALEDGTVGLAMIPVENSTAGRVADIHHLLPNSSVHIIGEFFLPIRHQLLGLPRATMDDLKTVHSHPQALAQCRNAIRGLGLTAVPAADTAGSAREVAEWGDVTKAAVASRLAAEEYGLQVLRPDLEDEDHNTTRFLILSNERLRAAAGVGPIVTTFVFKVRNMPAALYKALGGFATNGINMTKLESCMISGEFVATQFLADIEGSPEDPAVERAFAELGFFADYRILGVYRASRYRERFDPLRLSS

SEQ ID NO: 11835 - protein, 287 aa, Zea mays
MEGKEEDVRLGANKFSERHAIGTAAQGTDDKDYKEPPPAPLFEPGELKSWSFYRPGIAEFVATFLFLYISILTVMGVSKSTSKCATVGIQGIAWSFGGMILALVYCTAGISGHINPAVTFGLFLARKLSLTRAVFYIIMQCLGAICGRGVVKGFQQGLYMGNGGRRNVVAPGYTKGDGLGAEIVGTFILVYTVFSATDAKRRARDSHVPILAPLPIGFAVFLVHLATMGITGTGINPARSLGAAVIYNQHHAWADHWIFWVGPFIGAALAAIYHQVIIRAIPFKSRS

SEQ ID NO: 11836 - protein, 208 aa, Magnaporthe grisea 70-15
MATNQPPEIPAEQPPAASQTAGEQQPEEEQPAPLPEPKAVTRKDIPLKDFLAKMDDYAPIIPDAVTNYYMTRAGLPPPPQTDQRLARLLALATQKFIADIAADAYQYSRIRASNSSASNNPMGHLGAAAGFPVPGQPGGVQGGAGGAGGGGGAGGKDAGRGPPLGVQRPGYGGGGQGGGQNRTVLTMEDLGMAVGEYGVNVKRSEFYR

SEQ ID NO: 11837 - protein, 118 aa, Arabidopsis thaliana
MSRSLALVYLSLLCLQTHLSISVTVPIPSVNGEIDAMLNRNGVIGEEEGEEMMPSEISRRVMMMRKQYISYETLRRDMVPCQKPGASYYACRSGQANAYNRGCSVITRCARDTNDIKT

SEQ ID NO: 11838 - protein, 124 aa, Arabidopsis thaliana
  misc_feature (23)..(23): Xaa can be any naturally occurring amino acid
  misc_feature (119)..(119): Xaa can be any naturally occurring amino acid
RGFPGRTTPVRATMVVQLTGLKXSVFFPVTGRANTAITSITGNGGGVSCLKGWPPIGKKKLETFFNLPALRDVKWVKEVDSLFRTRGIPGVESKWEHGFGSRGHGTTPGYYDGRSWTLXKLPLF

SEQ ID NO: 11839 - protein, 296 aa, Dichelobacter nodosus VCS1703A
MVTDKINLAVFPVAGFGTRFLPATKSTPKEMLPVVDKPLIQYAVEEAYDAGIRNMVFVTGRNKWSITEHYDVAFELESELQAKNKTEFLQLVRQIKPKDMNVIFIRQEMMLGLGHAVLCAEPVVRNRPFAVLLADDLVANPDGAPVMKQMVELYEKHQQGVIGVQEILPEHTKRYGIITEAAKLDERTSMIAGVVEKPEPEVAPSRLAIIGRYILPGQIMEVLKTTPKGAGGEIQLTDAIAVLIQQKTLLAYRFLGKRYDCGDKLGYLQANVEFGLAHPQFGSDFKAYLQSLSFTE

SEQ ID NO: 11840 - protein, 118 aa, Arabidopsis thaliana
MASKNMMKNAIALFLTINLVFLVFTKAQAPPPQAPVHAPDSTQFLSCTNVLNLSLILINNQSVLPCCTLVTGLDAATASACICNAVRITIFNFLTINVRVNQVLRLCRIIPPLGFRCP

SEQ ID NO: 11841 - protein, 336 aa, Neocallimastix frontalis
MDVSFENVKHFITLADFTPKQVLWLIKRSMEIKSELKKGNKLPQYFSGKTLGMFFTKRSTRTRVSSESGWACYGGHPMFLGKDDIQVGGGEPWKDTSIVVSSMVDCILARLGGHEEIEVLSKYSSVPVINALTAKFHPLQILADVVTMYEHFMPNYQSISSGDLPLPMFKNFKVAWVGDANNIINSMLVTLPRIGIDLAVCTPPQYQILDDVAKFANENSKATNPDYGAVSYTHDPKVAIKDADVIVTDTWISMGQESEKERRIKEFAGYQVTEKLAKEGGAKPNWKFMHCLPRKQHEVDDEVFYNPERSIVFPEAENRKYTVMAVFEMLMVNAKN

SEQ ID NO: 11842 - protein, 393 aa, Bradyrhizobium sp. BTAi1
MTISQRTAAILVAAGRGLRAGTGGPKQYRAIGGRTVIHRALAAFSEHPDVAVVQPVVNPDDIDVFNAAVSGLRHEVPAHGGATRQASVLAGLEALVPHRPDIVLIHDAARPFVTSAVISRAIQAAGKTGAAIPVVPVTDTIKEVTASGDIIATPERAKLRIAQTPQTFKFEVILEAHRRAARDGLTEFTDDAAIAEWAGLTVATFEGDVANMKLTTPEDFVREEARLAAQLGDIRTGTGYDVHAFGEGDHVWLCGLRVPHSKGFLAHSDGDVGLHALVDAILGALADGDIGSHFPPSDMKWKGASSDQFLKYAIERVTARGGRVANLEVTMICERPKIGPLRDQMRARIAEISGVDISRIAVKATTSERLGFTGREEGIAATASATIRLPWSA

SEQ ID NO: 11843 - protein, 390 aa, Vitis vinifera
MDIGLEGEPFLSSRLEPILEVEVEVETEGEGEVDDQFPFNISEPTISNQDIRDPCAPGPSTTHFLPRKTIHRCKTAPALAVMRDAKSQPAQLPKPNSDSTSIIRQAFFLLFLYLSLGVVIYSFNRDNFSGIETHAVVDALYFCIVTMCTIGYGDIAPLTPATKVFACVFVLVGFGFIDILLSGVVNYVLDLQENMILTGIQVGGAPAGGFSARNYIVDVEKGRMRIRLKVGLALGVVVLCIGMGTMVLYFVENLDWIDAVYLSVMSVTTVGYGDRAFKTLPGRLFAAIWLLFSTLAVARAFLYLAEARIDKRHRRITKWVLHREITVEDLLAADINNNGFISKSEYVIYKLKEMGKIAENDVLQICNQFNKLDPNNSGKITLPDLLENHL

SEQ ID NO: 11844 - protein, 148 aa, Glycine max
MEQTFIMIKPDGVQRGLVGQIICRFEQKGFTLKGLKLITVDRPFAEKHYQDLSAKPFFSGLVDYIISGPVVAMIWEGKNVVLTGRKIIGATNPAASEPGTIRGDFAIDIGRNIIHGSDSVESANKECALWFPDGPVNWQSSLHSWIYE

SEQ ID NO: 11845 - protein, 160 aa, Picea abies
YNEEAWEKKAPNFLPKDPYDLAIARFWAAFVDDKLFPCIRGVFIGQGEQLQKAAEDSVANFLLIEEALRANNRFSGKTYFGGDEIGLVDIALGSMSAFLKAIEKATDTVLIDPEKMPLLSAWMDRFCESDGVKEVMPDPANELEIVVARRAKFTTPPAVN

SEQ ID NO: 11846 - protein, 280 aa, Oryza sativa Japonica Group
MRVEAGGLPELGSGARDPAGARRQRRRRQQRRPAMPSAGAAAQPAPSPAVQGLFEACREVFGASAGAVPSPAGVERIKSVLDSISAADVSLTRNMSYFRRVNSNGIPKITYLHLYECEAFSIGIFCLPPRGVIPLHNHPNMTVFSKLLFGELRVKSYDWADASQDSTDAQLQGARLAKVKVDGTLNAPCATSVLYPEDGGNLHCFTAHTACAVLDVLGPPYDDGSGRHCQHYNVSSSAPSAGDSKPLPGDDGYAWLEECEPPDNFHLVGSTYMGPRIVDN

SEQ ID NO: 11847 - protein, 409 aa, Mycobacterium avium 104
MVTNTDALRRRWEAVMMHNYGTPPVALASGEGAVVTDVDGNTYLDLLGGIAVNVLGHRHPAIIEAVTKQLSTLGHTSNLYATEPSLALAEELVALLGAGHEPAGHESGGTESAGTARVFFCNSGTEANEVAFKLSRLTGRTKLVAAQEAFHGRTMGSLALTGQPSKQAPFAPLPGDVTHVPYGDTEALAAAVDDGTAAVFLEPIMGESGVVVPPEGYLAAARDITARHGALLVLDEVQTGMGRTGTFFAHQHDGITPDVVTLAKGLGGGLPIGACLAVGPAADLLTPGLHGSTFGGNPVCAAAALAVLRVLASENLVRHAEVLGKSLHQGIEGLGHPLVDHVRGRGLLCGVVLTAPRAKDAEAAAREAGFLVNAAAPGVIRLAPPLIVTEAQIDGFIAALPGILDRAAA

SEQ ID NO: 11848 - protein, 142 aa, Photobacterium profundum SS9
MTIEKTFSIIKPDAVKRNLIGAIYQRFENAGLKIVASKMVHLDATKAQGFYAEHEEKPFFNELVEFMTSGPVMVQVLEGEDAIHRYRELMGTTNPENAACGTIRSDFALSMRYNSVHGSDSPESAAREIAYFFTEDEICPRD

SEQ ID NO: 11849 - protein, 289 aa, Glycine max
SAREKIEDEVRGLRRELNEKIEEKGEILENGLKKMEAKNEELERYLSELKGEDWLSKEEFEKFVDEVRSVKGSGYEGGGLDEIREFARRVIVKEIEKHAADGLGRVDYALASSGGAVVKHSEVFDLVRGNWFLKSARNGVHPNAEKMLKPSFGEPGQCFPLKDSRGFVQIRLRTAIIPEAVTLEHVAKSVAYDRSSAPKDCRVSGWLQEHNADSAINTEKMHLLAEFTYDLEKSNAQTFNVLNSAASGVINTVRLDFTSNHGSPSHTCIYRFRVHGHEPDSVSMLALEL

SEQ ID NO: 11850 - protein, 87 aa, Glycine max
MAMRALYNEIRAMKVREVPAYLKPRLTWSNVKKSTDQAVDRYIEKYIETSSVDPLFHVCFGGMAFSYLVGLPQERRHLEHLEKHGGH

SEQ ID NO: 11851 - protein, 160 aa, Arabidopsis thaliana
MAQRTEKEETEFKVLETLTTTTTTLCTNNCGVTANPATNNMCQKCFNASLVSAAAGVVESGSILKRSARSVNLRSSPAKVVIRPREIDAVKKRDQQIVNRCSGCRKKVGLTGFRCRCGELFCSEHRYSDRHDCSYDYKTAGREAIARENPVVKAAKMVKV

SEQ ID NO: 11852 - protein, 417 aa, Sulfolobus solfataricus P2
MSEKKLLTFWQALFIGLGNIIGAGIFVMAGSTISVAGPGAIIAFIFTAIFAMSIGLNSAELSSIFTDVEGGVYSFTLKTLGEMSGFLVGWFRVISYVIGGAATALGFSGYLLLFGLPKTLYYTLAVILIVILLVLDYFGIGTVAEVDTIFVIINISSLILFSLTIPIIVGIKVHNFVPLFPHGIQGVLTTSNLAFFSYSGFNTIVTLTPSTKNGEKVIPRAIVMSLIITSIIYISVIFSMVDAMPWYYYGQTSAPLSLALSQIHAPTWLFLITSISAILATISVTLSIIVASERTLRQLSRDFQLPVKHELLVVGGIMLASLLLGNVEAIALASNFGIIFSYMLTGLEVIIVRRKGLRGSFRSPAFPVIQVFAIILSALFMISLGLNSLEIGVVTLFIGILVYETLREVKAHENRKK

SEQ ID NO: 11853 - protein, 556 aa, Parvularcula bermudensis HTCC2503
MYQYDKIDRQVVQARVDEFRDQVARRIDGQLTEDQFKPLRLMNGLYLQLHAYMLRVAIPYGTLSSDQLRALGRLAREYDRGYGHVTTRQNMQFNWIRLADMPDILQLLADHDMHGIQTSGNCIRNTTCDPFAGATSDEIEDPRVWCEIIRQWSTFHPEFSFLPRKFKIAVSAASSDRAAVQVHDIGLYLHRNEAGESGFRVLAGGGLGRTPYIGSVIRDFLPKEQLLGYLEAILRVYNLHGRRDNIYKARIKILVNALGEDEFRRQVEEEWTALLAEGPGGSVDLPEAERARIAAFFTGPSLVPDPDGQAHLDAASAEDGVLKRFVRNNLSAHKVEGYGIVTVSLKPVGSPPGDITSAQMSALADLADEYGCGEIRTTHEQNLVLPYIRLRDVPSLHGALVDIGLGTANAGQITDIIACPGLDYCNLANTRSIPLANRIQERFADPERGEIIGGLKIKISGCINACGHHHVGHIGILGVDKKGEEFYQVTLGGTADEQAAIGSIVGKGLSADEVVDAVDRVVETYLSIRSAAEESFIDVYRRVGDTPFKEALYAEA

SEQ ID NO: 11854 - protein, 314 aa, Microcystis aeruginosa PCC 7806
MPTYSYYTADVFSDRIFGGNPLAVFPEASGLTRTQMQKIAAEFNFSETVFVFPPETPQGTKKVRIFTPSTELPFAGHPTVGTAYILALIGAIPPYQETTIYLEEGVGLVPVKIIMEGEKPVYSELKVAQLPELVTDTYALDDLAAILSLSVADFLPGYPPRAFSCGLPFLFIPVKNRDILGKIKLNLTLWSSLLGQSPANSLFVCCFDPESPQSRLYGRMFAPSLGVMEDPATGSAVAALAGYLGALESSREGMNQWTIIQGVEMGRPSNIQLKFQKNNQEITEVSVGGASVLVCQGKMIIPDGETKSPTKGLL

SEQ ID NO: 11855 - protein, 465 aa, Desulfitobacterium hafniense Y51
MNIGKIVQIMGAVVDVEFASEALPEIYSAVKVTVPEQKIDLTLEVAQHLGNNTVRCVAMSSTDGLQRGMAALNTGAPITVPVGPATLGRIFNVLGKAIDNGEEVHTDTSYPIHRPAPAFVDQDPSTVMLETGIKVIDLLAPYSKGGKIGLFGGAGVGKTVLIQELINNIAMEHGGLSVFAGVGERTREGNDLWNEMRESGVIDKMAMVFGQMNEPPGARLRVGLTGLTMAEYFRDVQNQDVLLFIDNIFRFTQAGSEVSALLGRMPSAVGYQPTLATEMGALQERITSTRNGSITSVQAIYVPADDLTDPAPATAFAHLDATTVLNRAISEKGIYPAVDPLDSNSRILSPQIIGEEHYKVARDVQQILQKYKELQDIIAILGMDELSEDEKLVVSRARRIERFLSQPFHVAEVFTGSPGKYVPIKETIRGFKEIVEGKHDNLPEAAFHMVGTIEEAIEKAKALGA

SEQ ID NO: 11856 - protein, 390 aa, Arabidopsis thaliana
  misc_feature (63)..(63): Xaa can be any naturally occurring amino acid
MGKSKKKVLNKSLITHPSTSDDTLQLFDPTSSPTKEKVNWNNVLGISDYLSKQATRGFRVLCXYLLISRFFFFVISSSQFGYYLIMIVKTLWTGETPKAESVKETMESYFKALLGFLLCCHGSTLGAGPTLSSIVHGSVKQIVDSSFRLFQGSVSLYDGSYEKGEKPSISQLSGAVLEACSSFKKVPTTNLIAIGSAISQVSVIMKDVLNEMKKVKPACPSSEGEASGDDFSPEQIEVAKMVADIVYEAMTVIIVIRVITRMMEKENSNENSVFVESLEKLLKLCQRSGVVIEELGTCVYHPPLKIDKITQTVKILEGNLDEVEAQVEYMKRSSNAFPGVCRKLRDAIKLMEVGLEKRKDLNQILISRQNTLYNALQLLDPTASPMNRCS

SEQ ID NO: 11857 - protein, 132 aa, Zea mays
DKFAPDANSQIVPASAIPDGWMGLDIGPDSVASFNAALDTTKTVIWNGPMGVFEFDKFAVGTEAVAKKLAELSGKGVTTIFGGGDSVAAVEKVGVADVMSHISTGGGASLELLEGKELPGVVALNEAATVTV

SEQ ID NO: 11858 - protein, 555 aa, Mycobacterium avium 104
MTAARPVKTRNEGQWALGDREPLNDTEKIKLADGPLNVRERIINVYAKQGFGSIDKSDLRGRFRWMGLYTQREQGYDGSWTGDDNTDKIEAKYFMMRVRSDGKAMSAHTMRTLGQISTEFARDTADISDRENLQLHWIRIEDVPEIWRRLESVGLQTTEACGDCPRGIHGSPLAGDSLDEVLDPSPAIEEIVRRSLNNPEYANLPRKYKTAVSGLQDVSHETHDVAFVGVDHPEHGPGLDLWVGGGLSTNPMLAQRLGVWVPLDEVPDVWEAVTQLFRDYGYRRLRAKARLKFLVKDWGIEKFREILEQEYLNRRLIDGPAPAPVKHTIDHVGVQKIKNGLNAVGVAPIAGRVSGTTLSAVADLMEQVGSDRARWTPFQKLVILDVPDDKVDELVAGLDALGLPSRPSSWRKNTMACTGIEFCKLSFAETRVRTQTLVPELERRLADVDAQLDAPISLHLNGCPNSCARIQVADIGFKGQWIDNGDGTSVEGFQVHLGGGLGEQSGFGRKLRQHKVTSEELGDYIDRVTRRYLEGRNDGETFASWALRADEEELR

SEQ ID NO: 11859 - protein, 453 aa, Arabidopsis thaliana
MIKGRLNLALVLGMDCEKITKKKKMVRSDENSLGLIGSMSLQGGGVVGKIKTTATTGPTRRALSTINKNITEAPSYPYAVNKRSVSERDGICNKPPVHRPVTRKFAAQLADHKPHIRDEETKKPDSVSSEEPETIIIDVDESDKEGGDSNEPMFVQHTEAMLEEIEQMEKEIEMEDADKEEEPVIDIDACDKNNPLAAVEYIHDMHTFYKNFEKLSCVPPNYMDNQQDLNERMRGILIDWLIEVHYKFELMEETLYLTINVIDRFLAVHQIVRKKLQLVGVTALLLACKYEEVSVPVVDDLILISDKAYSRREVLDMEKLMANTLQFNFSLPTPYVFMKRFLKAAQSDKKLEILSFFMIELCLVEYEMLEYLPSKLAASAIYTAQCTLKGFEEWSKTCEFHTGYNEKQLLACARKMVAFHHKAGTGKLTGVHRKYNTSKFCHAARTEPAGFLI

SEQ ID NO: 11860 - protein, 415 aa, Vibrio sp. Ex25
MKEKSKTNRKPPKSGGFFIRKELMTDQPISLEEIRLRLNELDDQLLSLLSERRKLSIEVAKSKVQTSKPVRDAVREQQLLVKLISNGRDKYELDAQYITKLFHTIIEDSVLLQQSYLQNLVNPQQSRKPLARVAFLGAKGSYSHLASREYFSRKNTELIELNCEHFKEVTQTVESGHADYGVLPIENTSSGSINEVYDLLQHTTLYIVGELTQPIEHCLVAKKDIRLENIKTLYSHPQPHQQCSEFLSRMKGVKLESCASTADAMQKVQEMDRDDVAAIGNASSGKLYGLQAIQGNIANQTENHTRFIVVARKPVEVSTQIPAKTTLIMSTSQEAGSLVETLLVLQRYGINMTKLESRPIMGNPWEEMFYVDLESHLASTEMQQALEELTKITKHLKVLGCYPSENVKPTQVKLS

SEQ ID NO: 11861 - protein, 290 aa, Streptococcus pyogenes str. Manfredo
MDKLARIDEAIRRYYKTTSNGVSEELIDAILYSVDSGGKRIRPLILLEMIEGFGVSLQNAHFDLAAALEMIHTGSLIHDDLPAMDNDDYRRGRLTNHKQFGEATAILAGDSLFLDPFGLIAQAELNSEVKVALIQELSLASGTFGMVGGQMLDMKGENQSLSLSQLSLIHLNKTGKLLTFPFKAAALVTEQAITVRQQLEQAGMLIGHAFQIRDDILDVTASFEDLGKTPKKDLFAKKATYPSLLGLEASYQLLTESLDQALTIFQTLESDVGFKPQIITKLIEGLRLNA

SEQ ID NO: 11862 - protein, 189 aa, Bradyrhizobium japonicum USDA 110
MFIQTEATPNPATLKFIPGRVVVDGSPMEFASRESAARSPLAEKLFEVPGVTGVFYGSDFITVTKANGEWQQLKPAILGAIMEHYMSGAPLLADGAAQSDADLDDEDEFFDEADAETVDMIKDLIETRVRPAVANDGGDITFRGFKDGIVYLNMKGACSGCPSSTATLQHGIQNLLKHFVPDVVEVRPM

SEQ ID NO: 11863 - protein, 494 aa, Zea mays
  misc_feature (211)..(211): Xaa can be any naturally occurring amino acid
MVLSHGVGGSDESVHSTFASRYVRTSLPRYRMPEQSIPKEAAYQIINDELMLDGNPRLNLASFVTTWMEPECDKLIQASVNKNYVDMDEYPVTTELQNRCVNMIAHLFNAPLGDAETAVGVGTVGSSEAIMLAGLAFKRRWQNKMKAAGKPCDKPNIVTGANVQVCWEKFARYFEVELKEVKLSDGYYVMDPQKAVDMVDENTICVAAILXGSTLNGEFEDVKLLNDLLTKKNAETGWDTPIHVDAASGGFIAPFLYPELEWDFRLPLVKSINVSGHKYGLVYAGIGWCIWRTKADLPEELIFHINYLGADQPTFTLNFSKGSSQVIAQYYQLIRLGFEGYKNIMENCQENATVLKQGLEKTGKFNIVSKDNGVPLVAFSLKDNSRHNEFEISDFLRRFGWIVPAYTMPPDAQHVTVLRVVIREDFSRTLAERLVLDIEKVLHELDALPARVPSGDLAALAAAESSEREMEKKRQVISLWKRAVLAKKKTNGVC

SEQ ID NO: 11864 - protein, 269 aa, Physcomitrella patens subsp. patens
AMATATAGEVAAGVIVGAGRVGQAFEKMGGGRDIVVRRGETVPEDSAGPIFVCTRNDVLGTIVDATPASRRGDLVFIQNGMLEPWLESKGLGDATQVLVYFAVAKLGDPPLDGKTDTNPEGLTAATGKWAKATAARLHSAGLSCKVLDAEEFKKPMLEKLIWICAFMLVGARHPGATVGVVEKEHRKEVEDLINELAGAAEAEKQLKFDAGIVDRLCAYARSVAHFPTAVKEFEWRNGWFYEISRRALESGKSDPCPLHTAWLKEIGVV

SEQ ID NO: 11865 - protein, 504 aa, Ehrlichia ruminantium str. Gardel
MSSLTGKVKGRARKIKGDADIRVNESTENVGLVIRVMTAVVDIKFPSGKVPKILNALESKEIYNGKKLVLEVSQHISDSIVRCIALDSTDGLSRNDEFIDTGAPISVPVGRATLGRVFDVLGNPIDNCGPLTKSDYSIKPIYSEVPKLTDQKVTTEILVTGIKVIDLLAPYLKGGKVGLFGGAGVGKTVLIMELIHNIAKAHKGVSVFAGVGERTREGNDLYHEMIESGVINLEEKDKSQAVLVYGQMNEPPGARLRVALSALTMAEYFRDVENQDVLFFVDNIFRFTQSGSEISALLGRIPSAVGYQPTLAAEMGAMQERITSTNRGSITSVQAIYVPADDLTDPAPATSFAHLDSTTVLSRQIAELGIYPAVDPLDSASQALSIDIVGEKHYEVSKEVQRILQTYKSLQDIIAILGMEELSEEDKLIVARARKIQRFLSQPFHVAEVFTGTPGVFVSLEDTVSSFKDIVEGKYDHLPEAAFYMVSNINEAVKKAELLQKEGK

SEQ ID NO: 11866 - protein, 333 aa, Bradyrhizobium japonicum USDA 110
MADVKYDVLGIGNALFDVLVRTDEAFLAKHGMTKGSMSLIDEARAAAIYQDMGPATEVSGGSAANTIVGIGSLGARAAYVGKVKDDQIGKLYVHDIRAAGVAFNTPAAKDGPATGCSYILVTGDGERTMNTYLGAAQDLSPADIDPAEIASAGIVYLEGYLWDPKNAKEAFVKAAKIAHDARRKVALTLSDSFCVDRYRDEFLSLMRNGTVDIVFANESELHSLYMTSDFDTALKQLRNDVNLGVVTRSEKGCMVVSAEDAVAAPAAPIAKLVDTTGAGDLFAAGFLYGLARNLPYKQCGELGALAAAEVIQHIGARPQVSLKELAEQRGLTA

SEQ ID NO: 11867 - protein, 306 aa, Vibrio cholerae O1 biovar eltor str. N16961
MNKLVVLGSVNADHVLQVPSFPRPGETLHGRNYQVIPGGKGANQAVAAARMQADVGFIACVGDDSFGINIRESFKLDGINTAGVKLQPNCPTGIAMIQVSDSGENSICISAEANAKLTAAAIEPDLAAIRDARYLLMQLETPLDGILKAAQEAKTAKTNVILNPAPARELPDELLKCVDLITPNETEAEVLTGITVYDDSSAQQAADALHCKGIEIVIITLGSKGVWLSQNGRGQRIPGFVVKATDTTAAGDTFNGALVTGLLQEMPLESAIKFAHAAAAISVTRFGAQTSIPTRAEVEAFLAEHS

SEQ ID NO: 11868 - protein, 465 aa, Debaryomyces hansenii CBS767
MSNRAQLSNPAALAAAAASHNPSSSNSSNNSVVGLHYKIGKKIGEGSFGVIFEGTNIINGVAVAIKFEPRKTEAPQLRDEYRTYKHLQGSEGIPSAYYFGQEGLHNILVIDLLGPSLEDLFDWCGRRFSVKTVAQIAIQMLSLIEEVHRHDLIYRDIKPDNFLIGRQGLVDENHVHLVDFGMAKQYRDPRTKQHIPYREKKSLSGTARYMSINTHLGREQLRRDDLEALGHVFFYFLRGQLPWQGLKAPTNKQKYEKIGDKKRTTPALQLCDGLPRQFAEYLDSVRSLAFDAEPAYEEYRMLFLSILDDLGQACDEDFDWLHLNNGKGWDSSINKKPNLHGYGHPNPPNERDRRHRDQRRSRQHHASHHPQAPASQQAQPPSTQMTTAQLHQQKLQHLVNRPLPPIKQESQTGMNANAMDESALKAPQSKNYENTAANRQNQYDQQQMVDDNEETKGFWSKLCCH

SEQ ID NO: 11869 - protein, 497 aa, Bradyrhizobium japonicum USDA 110
MTPTAAARAQHATATLRDRLKDPSLLKEACYIDGAWVGTPVFAVNNPATGVELAKVPQLGADDTTKAVEAAERAFPAWAKHTAKQRSNILRKWFELIIANREDLALILTSEQGKPLSEALGEVDIGAAYIEFFAEEARRVYGETIPTQRPDARLLAIKQPIGVCGAITPWNFPNSMITRKVSPALAAGCTVVLKPANETPLSALALAVLAEKAGIPKGVLNIITGDAPPIGKVLCEHPAVRFVGFTGSTAVGKILYQQASVGVKRLGLELGGNAPFVVFDDADIDAAVEGAIVSKYRNMGQTCVCANRLYAQDKIYDEFVQKLSKKVAVMKIGDGTEAGVTQGPLINLKAVDKVERHIADAVKRGAKVVTGGKRSELGRSFFEPTVLADVKPDSLVAQEETFGPLAPVIRFKDEADVIAMCNASPFGLASYFYSRDLGRVWRVAEALESGMVGVNTGLITTEVAPFGGVKESGLGREGSRHGMEEYVEIKYVMMAGV

SEQ ID NO: 11870 - protein, 582 aa, Debaryomyces hansenii CBS767
MSDKEDARSVVESAIGGSSSNDTGSNEKASSKWQNFRDSFKRPAEEKEIEYGQNDNLNDIEKANIGASKSPLMRDLKNRHLQMIAIGGSVGTGLLIGSGSSLRTGGPAALLIAWGLVGTMVFCTIHALGEMCVAFPVSGAFSSYATRFVDPSWGFAVGWNYAIMWLIVLPLELVAAAMSIQYWDSTINPVAWVAIFYIFIFVINLFGVKGYGEAEFYLAIVKIIAIIGFIILGIVLVCGGGPTHEFIGGKNFHNPGAFANGFKGVCTVFVTASYSLAGSEMVGLAAAETANPKKTLPKAIKQVFWRIFLFYILSLTFIGLIVPYDSEELLGSSSTGSASPFVIAIKIGGINALPSIFNAVILISVLSVGNSAVYGCSRTIQSLGAQGLGPKILNYVDRRGRPLAGLAISGIFGLLCFLSAYENEGEVFTWLLSVSGLATIFSWFSIGLCHLRFRAALRYQGRSTDELSFTSIAGIWGSIYSMIFLIVVLGVQFWVALFPIGSDGKPNVTSFFQNYLGVFVILLFYVCHKVYSRNWKFYIKLSEIDLDTGRRETDVDLMNYEMEEDTIKEGVPMYLRLWRSLV

SEQ ID NO: 11871 - protein, 486 aa, Physcomitrella patens subsp. patens
MCREAQSNIIPHLLEYVDNSCTPFHATAEARKFLLTAGFQEISECEEWALQPGGRYFFTRNMCSIYAFAIGHKYKPGSGFHVIAAHTDSPCPKLKPVSYSAKGGFVHVRVQPYGAGVWQTWFDRDLSVAGRVLLRRKDGDLVNELVRVGRPILRIPTVANPVDRGLAADGSKVDAEVNLAPVLAMQIESELAMSCDSESSMPVEHNDHGSHIYPQPATAHHPLLIQVLADALKCDVSEVADFDLSVYDTQPACVGGARDDFVFAGRLDNLTSTFCALWALLHTCADPSSLVDESCVRMIALFDSGEVGGPDSAQAAGPQIMLQAMTRIARWLARGSDSEGVVERAMRRSLIVSADMVEGMYPIQVSSPGQEESFHHPKLRDGLVLRQDASNANDIVTSFLFREVAKRSSIPVQNFPVSRETGCCSTVSSILAAGYGLRLIDCGVPLLSMHSVREMCSTDDIETTFRHFREFFQHFTAIDEQLRVDV

SEQ ID NO: 11872 - protein, 426 aa, Symbiobacterium thermophilum IAM 14863
MTFYRKTTLPNGLRVVTEAIGHVRSAAVGVYVGTGSLYEAPAEMGVSHLIEHMLFKGTERRSALEIARAIDGRGGALNAYTAKEYTCYYARVLDEHLPLALDVLADMILNSRFDPDDLAREKDVICEEIRMYDDVPDDLVHDLFAGALWRGHALGRPIVGTVERVQAMSRADILAYKNRHYVPANMVVAAAGHLEHERVVEWVAELFGAAAAEADGRPAPDAPPVPRTPAIAVRQKEIEQAHLVLGTTALSLDDPNIYALHVLNAIVGGSSSSRLFQEVREKRGLAYSVYSYHSSYRSAGAFGVYAGVSPRMVGATLDVVTGVLSELGRRGVTEEELAEAREQLKGQLMLGLESTSSRMSRLGRGELIRGFVHSPDEVIARVEAVTLEQVNELAHRLFVEEARVMAAVVPHALQYDFAQYGEVLHD

SEQ ID NO: 11873 - protein, 311 aa, unidentified eubacterium SCB49
MKKYTTIEDIENLTELINKAIQLKNNAFQFEALGKHKTLVMLFFNASLRTRLSTEKAAKNLGMNVTVLNVNDAWNLEYEDGSVMNLNTAEHVKEAAKVISQYADIIAIRAFPTLKDKTKDESEFIINSFIKYATAPIVSMESATAHPLQALADAITIEELKTSPKPKVVLSWAPHTKTLPQAVPNSFVSMMQKLDVDFVITHPEGYALNPEITKDVPVYHNQEEALKDADFVYSKNWSSYSNYGKILEVDSSWMMTKEKLASAKFMHCLPVRRNLVVEDAVLDSDQSLVIEQANNRTFAAQIVLKNLLENL

SEQ ID NO: 11874 - protein, 258 aa, unidentified eubacterium SCB49
MKTLKIIKIGGNIINDPIALDAFLKAFSKLEGLKLLVHGGGKSATKLASQMGIKVKMVEGRRITNTETLDIATMMYAGKINKQIVAQLQAYNCNAMGFSGADSNTIEAVKRPVKEIDYGFVGDVVKVNTNVLQLLLTNDVCPVFCALTHNTKGQLLNTNADTIASALAIGFAKDFNVELYYCFEKNGVLTAVNDDTSVIQNLDKKKYKLLIDKKIITDGMLPKLNNCFYALQHQVSKVCIGKAEMLYNPNAIFTTITE

SEQ ID NO: 11875 - protein, 542 aa, Ipomoea tricolor
MAFGLSSLLQNSELFTSDHASVVSMNLFVALLCACIVLGHLLEENRWVNESITALIIGLCTGVVILLLSRGKSSHLLVFSEDLFFIYLLPPIIFNAGFQVKKKQFFVNFMTIMLFGAIGTLISCSIISFGAVKIFKHLDIDFLDFGDYLAIGAIFAATDSVCTLQVLSQDETPLLYSLVFGEGVVNDATSVVLFNAIQSFDMTSFDPKIGLHFIGNFLYLFLSSTFLGVGIGLLCAYIIKKLYFGRHSTDREVALMMLMSYLSYIMAELFYLSGILTVFFCGIVMSHYTWHNVTESSRVTTRHSFATLSFVAETFIFLYVGMDALDIEKWKFVKNSQGLSVAVSSILVGLILVGRAAFVFPLSFLSNLAKKNSSDKISFRQQIIIWWAGLMRGAVSIALAYNKFTTSGHTSLHENAIMITSTVTVVLFSTVVFGLMTKPLINLLLPPHKQIASGHSSMTTSEPSSPKHFAVPLLDNQHDSESDMITGPEVARPTALRMLLRTPTHTVHRYWRKFDDSFMRPVFGGRGFVPFVAGSPAEQSPR

SEQ ID NO: 11876 - protein, 568 aa, Arabidopsis thaliana
MARFAVIGLTFLLLLGTSLSARSDEETRERFYGNVVNSTAPGNGEGSIAKMFDRVLEKEFSENDSPEGSDGASFNSSVADQQAEIETVAKVTHEKGKRNDTQENNGTRPFQLQDVFSLENEDSDDMTLIDKKNNVFVMSNKKSKYPILQVDLRLISDLVVIIVFAAIGGIVFSCLGQPVIVGYLLAGSIIGPGGLKFISEMVQVETVAQFGVVFLLFALGLEFSMTKLKVVGPVAVLGGLLQIVLLMFLCGVTALLCGARLSEGIFVGAFLSMSSTAVVVKFLVERNSTSSLHGQVTIGILIFQDCVVGLLFALLPVLGGNSGLLQGIISMGKLLLILSIYLTVASLLTWSFVPRFLKLMIQLSSQTNELYQLAAVAFCLLSAWCSDKLGLSLELGSFVAGVMLSTTEFAQHTLEQVEPIRNLFAALFLSSIGMLINVHFLWNHVDILLASVILVIVIKTAIAAVVVKAFRYNMRISFHVGVLLAQIGEFAFVLLSRASNLHVIEGKMYLLLLGTTALSLVTTPLLFKLIPSAMNLGVLLRWFPSENSSPNESLQEKASLIEVHNRTK

SEQ ID NO: 11877 - protein, 475 aa, Brassica napus
MTSINVKLLYHYVITNLFNLCFFPLTAIVAGKAYRLTIDDLHHLYYSYLQHNLITIAPLFAFTVFGSVLYIATRPKPVYLVEYSCYLPPTHCRSSISKVMDIFYQVRKADPSRNGTCDDSSWLDFLRKIQERSGLGDETHGPEGLLQVPPRKTFAAAREETEQVIIGALENLFKNTNVNPKDIGILVVNSSMFNPTPSLSAMVVNTFKLRSNVRSFNLGGMGCSAGVIAIDLAKDLLHVHKNTYALVVSTENITYNIYAGDNRSMMVSNCLFRVGGAAILLSNKPRDRRRSKYELVHTVRTHTGADDKSFRCVQQGDDENGKTGVSLSKDITDVVGRTVKKNIATLGPLILPLSEKLLFFVTFMGKKLFKDKIKHYYVPDFKLAIDHFCIHAGGKAVIDVLEKNLGLAPIDVEASRSTLHRFGNTSSSSIWYELAYIEAKGWMKKGNKVWQIALGSGFKCNSAVWVALNNVKAFK

SEQ ID NO: 11878 - protein, 527 aa, Photobacterium profundum SS9
MTTSTNIHDQRILILDFGSQYTQLIARRIREIGVYCELWSWDVDEADIRDFNPNGIILSGGPESVTGDESPRAPQYVFEAGVPVFGVCYGMQTMAEQLGGKVAGSSMREFGYAQVEIVEPTSFFKNIEDAVAEDGNGLLDVWMSHGDKVVEIPSDFVKVAQTDTCPFAAIANEEKHFYGVQFHPEVTHTRQGMRIIENFVLNICGCENLWTSANIIEDAIANIKEQVGDDEVILGLSGGVDSSVVAMLLHRAIGDKLTCVFVDNGLLRLNEGEQVMDMFGDHFGLNIVHVKAEDRFLNALAGENDPEAKRKIIGHAFIDVFDEESKKLKNAKWLAQGTIYPDVIESAASKNGKAHVIKSHHNVGGLPDDMEMGLVEPLRELFKDEVRKIGLELGLPYNMLYRHPFPGPGLGVRVLGEVKKEYCDLLRRADAIFIEELHSADLYNKVSQAFTVFLPVRSVGVMGDGRKYDWVVSLRAVETIDFMTAHWAHLPYDFLGKVSNRIINEVDGISRVVYDISGKPPATIEWE

SEQ ID NO: 11879 - protein, 376 aa, Photobacterium profundum SS9
MSDQFIKSKAAIAWGPKQPLSIEEIDVMLPRAGEVLVRIVATGVCHTDAFTLSGDDPEGIFPVVLGHEGGGIVEQIGEGVTSVQVGDHVIPLYTAECGECKFCKSGKTNLCQAVRETQGKGLMPDGTTRFYKDGQPLFHYMGCSTFSEYTVLPEISLAKVSKEAPLEEICLLGCGVTTGMGAVLNTAKVEKGDTVAIFGLGGIGLSAIIGAKMAGASRIIGVDINESKYKLATKLGATDCINPTKFDKPIQDVIVEMTDGGVDYSFECIGNVNVMRSALECCHKGWGESVIIGVAGAGQEISTRPFQLVTGRVWRGSAFGGVKGRSELPEIVERYMAGEFALDDFITHTMGLEGINDAFDLMHEGKSIRSVIHFDK

SEQ ID NO: 11880 - protein, 553 aa, Aspergillus oryzae
MPAFSQATDLSAWKELQEHHTAVGRNIVLKEAFEKDPQRFEKFSRTFKNTVDNSDILFDFSKNFLTEETLSLLVKLAKEANVEELRDAMFKGEHINFTEDRAVYHAALRNVSNEPMQVDGKSVVEDVNSVLEHMKEFSEQVRSGEWKGYTDKKIDTIINIGIGGSDLGPVMVTEALKPYGAPGMKLHFVSNIDGTHIAEALKDSNPETTLFLIASKTFTTAETTTNANSAKKWFLETAKDESHIAKHFVALSTNEAEVTKFGIDKKNMFGFESWVGGRYSVWSAIGLSVALYIGYDNFHQFLAGAQAMDKHFREAPLEQNIPAIGGLLSVWYSDFFGAQTHLVAPFDQYLHRFPAYLQQLSMESNGKAITRSGEYVKYTTGPILFGEPATNAQHSFFQLLHQGTKLIPSDFIMAAESHNPVEGGKHQRMLASNFLAQSEALMVGKTPEQVKTEGAPDNLVPHKTFLGNRPTTSILAQKITPSTLGALIAYYEHLTFTEGAVWNINSFDQWGVELGKVLAKKIQQELETSGAGAGHDASTSGLLAAFKQKANLA

SEQ ID NO: 11881 - protein, 165 aa, Brassica oleracea
FTPISTITDGTSFYGLDIVGISVGGQKLAIPQTVFSTPGALIDSGTVISRLPPKAYAALRGAFKAKMSQYKNTSAVSILDTCFDLTGFKTVTIPTVSFYFNGGAVVELGSKGVLYAFKMSQVCLAFAGNSDDNNAAIFGNVQQQTLEVVYDGAAGRVGFAPNGCS

SEQ ID NO: 11882 - protein, 98 aa, Aphanizomenon flos-aquae
MATYKVTLIDAEGTTTTIDCPDDTYILDAAEEAGLDLPYSCRAGACSTCAGKLVTGTIDQSDQSFLDDDQVEAGYVLTCVAYPTSDVTIETHKEEDLY

SEQ ID NO: 11883 - protein, 99 aa, Nostoc muscorum
MATVYKVTLVDQEGTETTIDVPDDEYILDIAEDQGLDLPYSCRAGACSTCAGKIVSGTVDQSDQSFLDDDQIEKGYVLTCVAYPTSDLKIETHKEEDLY

SEQ ID NO: 11884 - protein, 100 aa, Aphanothece sacrum
MATYKVTLINEEEGINAILEVADDQTILDAGEEAGLDLPSSCRAGSCSTCAGKLVSGAAPNQDDQAFLDDDQLAAGWVMTCVAYPTGDCTIMTHQESEVL

SEQ ID NO: 11885 - protein, 259 aa, Microcystis aeruginosa PCC 7806
MNWQEIAGNWVFLPRRPRGIIHFLGGAFVAAAPNITYRWLLESIGNSGYAIVATPFVNTLDHKSIARTVLNRFDNIIERLRWNHSLRQGYLPIYGLGHSMGCKLHLLIGSLYEVEREGNILISFNNYPIRRAIPFIEPLQIDTTFNLEFTPSPEETNELIFQDYAIRRNLLIRFQDDTIDQSLVLNPLLKKRFNDLIALRTLPGNHLTPLGQDVSWQTGEVFTPLDAIGQWLKQGLARDNSRLKDEILQWLNPVLPASR

SEQ ID NO: 11886 - protein, 99 aa, Nostoc muscorum
MATYKVRLFNAAEGLDETIEVPDDEYILDAAEEAGLDLPFSCRSGSCSSCNGILKKGTVDQSDQNFLDDDQIAAGNVLTCVAYPTSNCEIETHREDAIA

SEQ ID NO: 11887 - protein, 441 aa, Magnetospirillum magnetotacticum MS-1
MSAAAASMVGGQGTVVAAGGLLVLCMGLWATGLVAEIVTALMFFALAMLLELAPAQTVFSGFASSAFWLVTSGMVVGLAMNRTGLGDRLARRLAAQLPASYPGFVAGLVAFSFLLAFVMPSNLGRIALMVPVVIALCDAFGLEAGRPGRTGAVLAFGIATPMLSAAILPANVPNLVMAGTAETLFGIHLGYLPYLFLHAPVLGFVKGALLVACTVLLFPDRLDGKRPELPPLPPLSGEERRLAAILTVMLGLWLSDGWHGIPPAWIGLAAAVICLLPGVGVLSPQSFGEIPLKTCFYVAALFGLTGIVNETGLGADLGHALLGLAPLEPGAPARNFATLTGLSIGFLFAATANGAPALYTALAEEFSRASGFDLMSVLMVQVVGYSTLFLPYQAPPIVMAMDLGRVSLRDATKLTLATGIVSFLAATPLAYLWFRLTGGLA

SEQ ID NO: 11888 - protein, 98 aa, Cyanidium caldarium
ASYKIHLVNKDQGIDETIECPDDQYILDAAEEQGLDLPYSCRAGACSTCAGKLLEGEVDQSDQSFLDDDQVKAGFVLTCVAYPTSNATILTHQEESLY

SEQ ID NO: 11889 - protein, 484 aa, Triticum aestivum
MASLLEIFVGSCSSSAPPVDWEAEAYPEYADYAVLPLLLAFFPALRLLLNQFLFEVLARRLIFGKGTQPNPSGFSNPPQKRAPVHPLPFLAAIRYHQGGRFSTPPRLLLAQLHPYQISTPRQLRVDSSVLLPGSGAPVGFSDRRRVRFPCSDPRNQLGARFLDLDLPPAMAALVELFTRSLSSSTPVDWEAEAYPAYGDYAVLPILVAFFPALRFLLDRFVFEILARRLIFGKGYDKLAETDERRKKINKFKESAWKFVYFLSAEVLSLSVTYNEPWFTNTRYFWVGPGEQLWPDQKMKLKLKAVYMYAAGFYTYSIFALLFWETRRKDFGVSMSHHVATVVLIVMSYICRLSRAGSVILAVHDASDIFLEIGKMAKYSSCEGLAVVAFLLFVASWILLRLIIFPFWILRSTSYEVAVILDKEKKEFYSSVYYYLFNSLLFSLLVLHIYWWVLIYRMLVKQIQSRGRVGDDVRSDSEGEEDHED

SEQ ID NO: 11890 - protein, 97 aa, Aphanothece sacrum
MASYKVTLKTPDGDNVITVPDDEYILDVAEEEGLDLPYSCRAGACSTCAGKLVSGPAPDEDQSFLDDDQIQAGYILTCVAYPTGDCVIETHKEEALY

SEQ ID NO: 11891 - protein, 798 aa, Physcomitrella patens subsp. patens
MATGNATVTTCKTMPASSNGVWQGDIPIHFALPLLIIQICIVLTITRVLAALFKPLKQPRVIAEVVGGILLGPSALGKNTAYIANIFPKQSVIILEVFAQMGLIFFLFMVGLELDIRQIRRTGFQALVISAAGIAVPFSTGVGVSFVLLNTIAGDVKFGPFVVFMGVAMSITAFPVLARILAERKLLTTEVGQLAMSVAAVDDVVAWCLLALAVALTGTNTKPSVVAWVLLTGIAFIITMFVVVQPVMRWVATRSADNEPVKEILVCLTFAGVLIAAFTTDLIGIHAIFGAFLFGLIVPKDGPFAVALVEKIEDFISILMLPLYFASSGLKTNIGAIKTGQSFGLLVLVIAVACFGKMCGVFLAATASKVNPRKALTLGVLMNTKGLVELIVLNIGKDRGVLNEETFAIMVLMALVTTFMTTPLVMALYKPARNPIPYNRRKLAMEDSKDDLRILSCVHGMKNVPAMINLTEGTRGIRKRALRLYILHLMELSERTSAIMIVQRARKDGRPFFNQRKSAESRDQIVAAFETYGHLSKVTVRPMTAISNFEDMHEDICATATDKRAAMIILPFHKTQRLDGQFDTTAPGFRLVNQKVLQHAPCSVAILIDRGVGGSAQVAPNNVDHKVVVYFFGGQDDREALAYGLRMAEHPGIQLHVIRFLNRYHIATGALDQDQERKLDEAALDGIRKGEKGKVDADEVHSKVSWEECRVADPFEAVVQAAIAGDHNIILVGRSRRPTAFVGSMVHRHPEYTELGPLGEALMAPEVRASVLVFQQYDPLLDLDAAASAKSAKSAPHV

SEQ ID NO: 11892 - protein, 125 aa, Zea mays
  misc_feature (11)..(11): Xaa can be any naturally occurring amino acid
PFSWPGFCRRXLGDVPQGNALGVFRQVGGDIVQFIKDAGLYDKIWQAFAVFLPVQTVGVQGDQRTHSNAVVLRAITSEDGMTADWYYFEHAFLVDVVNKICNNVRGINRVCQDITSKPPATVEWE

SEQ ID NO: 11893 - protein, 99 aa, Chlorogloeopsis fritschii
MATYKVTLINDAEGLNQTIEVDDDTYILDAAEEAGLDLPYSCRAGACSTCAGKIKSGTVDQSDQSFLDDDQIEAGYVLTCVAYPTSDCTIETHKEEELY

SEQ ID NO: 11894 - protein, 59 aa, Glycine max
MKFFSAFDPWPVFFRREWGRTWPFLAGFAVTGALITKMTAGFTEEDLKNSKFVQAHKNK

SEQ ID NO: 11895 - protein, 406 aa, Symbiobacterium thermophilum IAM 14863
MRIIVQKFGGTSVATPEGREAVVRRVRQALDDGYATVVVVSAMGRQGDPYATDTLIQLAQSAGPDLAPREMDLLLSCGEIISSVLMAATLTAAGIPAVALTGGQAGIQTDENYGNAQIVKVDPAPVLSRLKEGLVVVVAGFQGVNAAGEVTTLGRGGSDTTAAALGGALRAEVVEIYTDVDGVKTADPRLVAEARTLSVTTYDEIAQMAHYGAKVVHPRAVEIAMQHRVPIRVRSTFSDNPGTLITYSAEAGVIWSEPFSDRVVTAVTHVVGLAQVVVKTGRDWATPRLFRRLANAGISVDLISVSMESSAFSIPESRAAQAEMILTELGLVDLQVRHGCAKVTVVGSGMRGRPGVMATVAEALYAAEVPIWQTADSHVTISCLIPAADVQRAVQALHDAFELGRI

SEQ ID NO: 11896 - protein, 587 aa, Arabidopsis thaliana
GRDIAIPEWYSRAENELGQSAGSSPTVQANENNSLVESCIDDFDILQGDVQGLSDTCTFLKSLAMLDAIHDSEKSTEKKTVRERKAAGGLFNWEEEIFVARAPGRLDVMGGIADYSGSLVLQMPIREACHVAVQRNLPGKHRLWKHAQARQQAKGQVPTPVLQIVSYGSEISNRAPTFDMDLSDFMDGDEPISYEKARKFFAQDPAQKWAAYVAGTILVLMIELGVRFEDSISLLVSSAVPEGKGVSSSAAVEVASMSAIAAAHGLSIDPRDLAILCQKVENHIVGAPCGVMDQMTSSCGEANKLLAMICQPAEVVGLVEIPNHVRFWGIDSGIRHSVGGADYRSVRVGAYMGRKMIKSMASSILSPSASSANGGNPEELEDEGIDLLEAEASLDYLCNLSPHRYEARYADKLPDIMLGQTFIEEYADHDDPVTVIDQKRSYSVKAPARHPIYENFRVKTFKALLTSATSDEQLTALGGLLYQCHYSYSACGLGSDGTNRLVQLVQGMQHNKSNSEDGTLYGAKITGGGSGGTVCVVGRNSLRSSQQILEIQQRYKAATGYLPLIFEGSSPGAGKFGYLRIRRRISL

SEQ ID NO: 11897 - protein, 225 aa, Zea mays
MERAASVISSLLGGGGGGSGAQAATVKSVLVYPIKSCRGISVPQAPITATAGFRWDRQWMLVNSKGRACTQRVEPKLALVEVQMPPEAFAEDWHPTPDDHMVIRAPGMEPLKVPLSVECATISDVSVWEWTGAAYDEGAEAAEWFSTFLGCPTRLVRFNEDSETRLTDPDYARGYKTMFSDGFPYLIVSQGSLDALNEILKEPIPINRFRPKLVVHTARLCLTTF

SEQ ID NO: 11898 - protein, 505 aa, marine gamma proteobacterium HTCC2143
MFTFPSFRDVVAGLSVALILVPQAIAYADLAGLPPAQGLFAATLPLIIAAIFGSSPWLQTGPVAMTSILTLGALSAISAPFTAEYIGMAALLAFIVGLTRVLIGLVKAGHLVYLMSQPVLNGFTTAAALVILTTQAPAFFGVEAVSGNFFSRLLDVLLQPRLWSVPGMIFGSGALLVIIAGKRFHVLFPGILIAVVAGILLQSVYDCECKTVGSFPTDLPSFSWLLPWHRFGELLIPGIMIALVGFAEPAAIARTLAASSRRPWSASKEFIGQGAANIAAGVIGAFPVGGSFSRTMISHSAGATSRWSGALTGIMVLAFLPVANLMSTLPQPVLAAIIISAVYPLIKFGPLIQLTRTSRAQAMVAWATFLLTLILSPRIDLALLLGMGLGVVVHLWREMRINVSPSYTEHTLLLEPAGVLFFGSAQGLDETLVDELSKHPEAKELILDLRGLGRIDYTGALVIHRIALEAEQAGLAVKVIPGQPPQGERLLKRVFGNDSRRMLSV

SEQ ID NO: 11899 - protein, 557 aa, Shigella flexneri
MLGYLLAGIAIGPWGLGFISDVDEILHFSELGVVFLMFIIGLELNPSKLWQLRRSIFGVGAAQVLLSAALLAGLLMLTDFAWQAAVVGGIGFAMSSTAMALQLMREKGMNRSESGQLGFSVLLFQDLAVIPALALVPLLAGSADEHFDWMKIGMKVLEFVGMLIGGRYLLRPVFRFIAASGVREVFTAATLLLVLGSALFMDALGLSMALGTFIAGVLLAESEYRHELETAIDPFKGLLLGLFFISVGMSLNLGVLYTHLLWVVISVVVLVAVKILVLYLLARLYGVRSSERMQFAGVLSQGGEFAFVLFSTASSQRLFQGDQMAPLLMKLVDKWLSRQFNGPEEEDEKPWVNDDKPQVIVVGFGRFGQVIGRLLMANKMRITVLERDISAVNLMRKYGYKVYYGDATQVDLLRSAGAEAAESIVITCNEPEDTMKLVEICQQHFPHLHILARARGRVEAHELLQAGVTQFSRETFSSALELGRKTLVTLGMHPHQAQRAQLHFRRLDMRMLRELIPMHADTVQISRAREARRELEEIFQREMQQERRQLDGWDEFE

SEQ ID NO: 11900 - protein, 317 aa, Triticum aestivum
MAASAAFAAVAVMMLVAAHLAVAAAAPVTAPAFLWAPENYGSHETKGVVHYQTMPPASLAKSVLDEGGWSNLVCSREGSYKNVDIAVVFLGSKLQSSDISRDKQADPSLADTLKLSFTGSEFSMAFPYVALTDNDKLESSLLSGLAENCDNDFRGNHITYTDTCTVSGEDLKKHQSMDSIRDLVMSRKRSNPRGKTDLIVFCNGGFKDLDNAKSEGELLSELVSVLKMSEARYTVLYASQPYGLLENPSNLPLARYLAEKTNTTTKSGLGKCDGECLVKSSLLEGTFVGLVLLIILISGLCCMMGIDTPSRFEAPQD

SEQ ID NO: 11901 - protein, 371 aa, marine gamma proteobacterium HTCC2143
MTDTPNLDELRQQIDDIDVQIHQLINQRATCAEQVADTKLKAFVAENGDSDVSKVTFYRPEREAQVLRKVIDRNSGPLEGKTVARIFREIMSACLALEKPTEVAYFGPEGTFTHAATIKHFGQAVVSLPQASIATVFSKVESGQCHYGVVPVENSTEGMVSHTLDNFMDSPLKICGEVEMRIQLHLLVNDLANPGTIKSICAHQQALAQARNWLDSNWPNVERIAVASNAEAARMAQKDSSIAAVAGDIAAEQYDLLKLAESIEDYANNTTRFLIIGQQHVEPSGNDKTSLIVEANNKPGALFNLLEPFHAAGVSLTRIDTRPSRTDTWAYVFFIEFEGHQQDAVIEKILVKVGENSRMSKVLGSYPKAVL

SEQ ID NO: 11902 - protein, 392 aa, Synechococcus sp. CC9605
MPRPPELSDRAVALKPSLTLEISAKAKALRDSGKDICSLSAGEPDFATPPFIVEAAQHALGSGFTRYGPAAGDPDLRAALAHKLSVENGIPTQPEQVLVTNGGKQAIYNLFQVLLNPGDEVLLPAPYWLSYPEMAALAGASTRIIATKAEEGFRLDLDLLEQQITPRSRLLVINSPGNPSGKVMTRAELEALAALVARHPQLMVMSDEIYEYLLADGQQHCSFAAIAEEIRSRCFTVNGFAKGWAMTGWRLGYLAGDAAVIKAASALQSQSTSNVCSFAQRGALAAIEGPRDCVREMANSYNRRRTLLIEGLQALEGITLTPPQGAFYAFPRLPDGVPDSMEFCRQALEQEGLAVVPGLAFGDDRCIRLSCAVADETINDGLLRLKRLLRSF

SEQ ID NO: 11903 - protein, 191 aa, Oryza sativa
  misc_feature (101)..(101): Xaa can be any naturally occurring amino acid
  misc_feature (168)..(168): Xaa can be any naturally occurring amino acid
PPQHRRRASPPPLERKLRRGGMDRYQRVEKPREEAPIKENEIRITTQGRMRNYITYATTLLQDKGSDEVVFKAMGRAINKTVMIAELIKVPMVAPCKHYFXHFLSVGFSFVLQRRIVGLHQNTTTGSTDITDMWEPLEEGLLPLETTRHVCMITITLSKKELDTCCMXYESAVPADKGKALGEYDNEQDAG

SEQ ID NO: 11904 - protein, 506 aa, Oleomonas sagaranensis
MIHQTIEEISKSIAFRSRYDNFIGGKWVAPVRGQYFDNITPITGMPVAQIARSTAEDIELALDAAHAAKDAWGRTSVAERARLLNKIADRMEEKLDLLAMVETIDNGKPIRETKAADLPLAIDHFRYFASCVRAQEGSIGEVDHDTMAYHFHEPLGVVGHIIPWNFPLLMACWKLAPALAAGNCVVLKPAEQTPLSIMVWADLIGDILPPGVLNIVNGFGIEAGKPLASNKRIAKIAFTGETTTGRLIMQYASENLIPVTLELGGKSPNIFHEDVAAEDDDYFDKAIEGFVLFALNQGEVCTCPSRAIIHEKIYDKFMERALARVAAIKQGSPLEAATMLGAQASNDQLEKILSYIDIGKAEGAELLIGGERNILGGELAGGYYVKPTVFRGNNKMRIFQEEIFGPVVSVTTFKDEAEALSIANDTLYGLGAGVWTRDGNRAYRFGRAIQAGRVWTNCYHLYPAHAAFGGYKQSGIGRETHKMMLDHYQQTKNLLVSYSPKALGFF

SEQ ID NO: 11905 - protein, 164 aa, Heterocapsa triquetra
MAKIVPTIIAAALCALVLRSAVNTFVAPQLPVAQTVHQACRPVGGSAVAPAFGAAPAIISAKPARPGVAAHFTVKLQTPDGEQSFECPDDVYILDQAEEEGIELPYSCRAGSCSSCAGKVIDGSIDQSDQAFLDEDQTDSGFCLTCVTYATSDVTIKTHCEDDL

SEQ ID NO: 11906 - protein, 99 aa, Nostoc muscorum
MATFKVTLINEAEGTKHEIEVPDDEYILDAAEEEGYDLPFSCRAGACSTCAGKLVSGTVDQSDQSFLDDDQIEAGYVLTCVAYPTSDVVIQTHKEEDLY

SEQ ID NO: 11907 - protein, 165 aa, Heterocapsa triquetra
MAKIVPTIIAATLCALALRSVVNTTFVAQQLPAAQTVHQACRPVSGSAAAPAFGAAPAIISAKPARPGVAAHFTVKLQTPDGEQSFECPEDVYILDQAEEEGIELPYSCRAGSCSSCAGKVIDGSIDQSDQAFLDEDQTGSGFCLTCVTYATSDVTIKTHCEDDL

SEQ ID NO: 11908 - protein, 98 aa, Porphyra umbilicalis
ADYKIHLVSKEEGIDVTFDCSEDTYILDAAEEEGIELPYSCRAGACSTCAGKVTEGTVDQSDQSFLDDEQMLKGYVLTCIAYPESDCTILTHVEQELY

SEQ ID NO: 11909 - protein, 490 aa, Bromus inermis
RPGVSTIEEKSTGRIDQIIGPVLDVTFPPGKLPYIYNALVVQSRDTADKQINVTCEVQQLLGNNRVRAVAMSATDGLMRGMEVIDTGAPLSVPVGGATLGRIFNVLGEPVDNLGPVDSSATFPIHRSAPAFIELDTKLSIFETGIKVVDLLAPYRRGGKIGLFGGAGVGKTVLIMELINNIAKAHGGVSVFGGVGERTREGNDLYMEMKESGVINEKNIEESKVALVYGQMNEPPGARMRVGLTALTMAEYFRDVNKQDVLLFIDNIFRFVQAGSEVSALLGRMPSAVGYQPTLSTEMGSLQERIASTKKGSITSIQAVYVPADDLTDPAPATTFAHLDATTVLSRGLASKGIYPAVDPLDSTSTMLQPRIVGNEHYETAQRVKETLQRYKELQDIIAILGLDELSEEDRLTVARARKIERFLSQPFFVAEVFTGSPGKYVALAETIRGFQLILSGELDGLPEQAFYLVGNIDEASTKAITLEEENKSKK

SEQ ID NO: 11910 - protein, 99 aa, Arthrospira maxima
MATYKVTLISEAEGINETIDCDDDTYILDAAEEAGLDLPYSCRAGACSTCAGKITSGSIDQSDQSFLDDDQIEAGYVLTCVAYPTSDCTIQTHQEEGLY

SEQ ID NO: 11911 - protein, 169 aa, Isochrysis galbana
SADEPPPHTMLSYLVAGLSLNAPVSKIGASRVARASPAQMYAVTLIDPSGTFNIECPNDTYILDKAEEDGIDLPYSCRAGACSTCAGKVTAGTIDQSDGSFLDDDQMGQGLLPHLCLVPHVGLHHRDAQGGGALLSSPPCPAPEVCRREGRYSASPGGRRTPCLRPRRD

SEQ ID NO: 11912 - protein, 99 aa, Arthrospira platensis
MATYKVTLINEAEGINETIDCDDDTYILDAAEEAGLDLPYSCRAGACSTCAGTITSGTIDQSDQSFLDDDQIEAGYVLTCVAYPTSDCTIKTHQEEGLY

SEQ ID NO: 11913 - protein, 144 aa, Brassica napus
  misc_feature (116)..(116): Xaa can be any naturally occurring amino acid
MEEPCETRNNGEAFQRPKYRNYNHLISRISSPWLDLRVFYVRISNFTVEDSTPEVLTINHIPLDPDTLLEINGVRMSMYSEGCTSQLRRDRVDKTSEEATYVSTDNIRLNGSVKFXVYDKNELVLSGTLELSDGTGESNSQWNM

SEQ ID NO: 11914 - protein, 97 aa, Synechococcus lividus
MATYKVTLVRPDGETTIDVPEDEYILDVAEEQGLDLPFSCRAGACSTCAGKLLEGEVDQSDQSFLDDDQIEKGFVLTCVAYPRSDCKILTHQEEELY

SEQ ID NO: 11915 - protein, 99 aa, Cyanothece sp. PCC 7418
MASYKVTLINEEMGLNETIEVPDDEYILDVAEEEGIDLPYSCRAGACSTCAGKIKEGEIDQSDQSFLDDDQIEAGYVLTCVAYPASDCTIITHQEEELY

SEQ ID NO: 11916 - protein, 132 aa, Isochrysis galbana
ILQIALTMLSYLVAGLTFTAQVSKIGSSRIARASPAQMYTVTLIHPTGTYTIDCPADTYILDKAEEEGIDLPYSCRAGACSTCAGKVTAGTVDQSDGSLLDDDQMAKGFCLTCVSYPTSDCTIETHKEEDLF

SEQ ID NO: 11917 - protein, 97 aa, Synechocystis sp. PCC 6714
MASYTVKLITPDGENSIECSDDTYILDAAEEAGLDLPYSCRAGACSTCAGKITAGSVDQSDQSFLDDDQIEAGYVLTCVAYPTSDCTIETHKEEDLY

SEQ ID NO: 11918 - protein, 225 aa, Zea mays
MDAAGARPSAPSAAAAAVAGASVADEPRDARVVRELLRSMGLGEGEYEPRVVHQFLDLAYRYVGDVLGDAQVYADHAGKAQIDADDVRLAIQAKVNFSFSQPPPREVLLELARSRNRMPLPKSIAPPGSIPLPPEQDTLLAQNYQLLPPLKPPPQYEENEDENEESNPSLTPNPANSNPTFSQDQRSNEQQHTPQHGQRVSFQLNAVAAAAAKRPRMTVDQLNIG

SEQ ID NO: 11919 - protein, 185 aa, Dichelobacter nodosus VCS1703A
MRSVATFLTVLRIILVPFFIILYYYQFDFWGRWPALIVYAVAGISDYLDGYLARKLKETSAFGAFLDPVADKLMVAAVLIVVLQQNPHIWLMVCTLIIIGREIWISALREWMASMQMRDVVAVAKIGKWKTTLQMLALGFLIYREPFIGLPIWSIGQILMIGAALLTLYSMWSYNLSAWKAIKEK

SEQ ID NO: 11920 - protein, 146 aa, Zea mays
  misc_feature (7)..(7): Xaa can be any naturally occurring amino acid
  misc_feature (17)..(17): Xaa can be any naturally occurring amino acid
  misc_feature (24)..(24): Xaa can be any naturally occurring amino acid
  misc_feature (38)..(39): Xaa can be any naturally occurring amino acid
  misc_feature (56)..(56): Xaa can be any naturally occurring amino acid
  misc_feature (58)..(58): Xaa can be any naturally occurring amino acid
  misc_feature (63)..(63): Xaa can be any naturally occurring amino acid
  misc_feature (65)..(66): Xaa can be any naturally occurring amino acid
  misc_feature (69)..(69): Xaa can be any naturally occurring amino acid
  misc_feature (74)..(74): Xaa can be any naturally occurring amino acid
  misc_feature (82)..(82): Xaa can be any naturally occurring amino acid
  misc_feature (85)..(85): Xaa can be any naturally occurring amino acid
  misc_feature (93)..(95): Xaa can be any naturally occurring amino acid
  misc_feature (97)..(97): Xaa can be any naturally occurring amino acid
  misc_feature (113)..(113): Xaa can be any naturally occurring amino acid
  misc_feature (116)..(116): Xaa can be any naturally occurring amino acid
  misc_feature (119)..(119): Xaa can be any naturally occurring amino acid
  misc_feature (123)..(123): Xaa can be any naturally occurring amino acid
  misc_feature (133)..(134): Xaa can be any naturally occurring amino acid
RVFCPFXFCFGACRLGXRCSRLLXGPSFSPSLLLCRLXXRPVLFSPGVVAPGCPFXPXRFPAXFXXFCXVFFVXLRLRGVFXCLXVCGSLSVXXXGXVSVVFRVAEQAARASXALXGRXYSVXPFVAVFSPVXXFRRASPRLPSLG

SEQ ID NO: 11921 - protein, 273 aa, Candida albicans
MSRTGVLVLGPAGVGKSTFCNSMIAYMQSIGRRAHIVNLDPAANPTEYEFTIDVKDLISLQDVMEEMELGPNGGLVYCFEFLLNNLDWLDEEIGDYNDEYLIFDCPGQIELYTHIPVLPTIVRHLQTSLNFNLCATYLLEAPFIIDNSKFFSGALSAMSAMILLELPHINILSKIDLVKDEYSKKQLKKFLNPDPLLLAKQEDYINPKFAKLTQSIANLVDDFGMVQFLPLDCSKDSRSVETILSYIDDVTQWSEAQEPKEPHDEVELPDEVF

SEQ ID NO: 11922 - protein, 490 aa, Calamagrostis canadensis
  misc_feature (1)..(1): Xaa can be any naturally occurring amino acid
  misc_feature (93)..(93): Xaa can be any naturally occurring amino acid
  misc_feature (127)..(127): Xaa can be any naturally occurring amino acid
  misc_feature (446)..(446): Xaa can be any naturally occurring amino acid
XPGVSTIDEKSTGRIDQIIGPVLDVTFPPGKLPYIYNALVVQSRDTADKQINVTCEVQQLLGNNRVRAVAMSATDGLMRGMEVIDTGAPLSVXVGGATLGRIFNVLGEPVDNLGPVDSSATFPIHRXAPAFIELDTKLSIFETGIKVVDLLAPYRRGGKIGLFGGAGVGKTVLIMELINNIAKAHGGVSVFGGVGERTREGNDLYMEMKESGVINEKNIEESKVALVYGQMNEPPGARMRVGLTALTMAEYFRDVNKQDVLLFIDNIFRFVQAGSEVSALLGRMPSAVGYQPTLSTEMGSLQERIASTKKGSITSIQAVYVPADDLTDPAPATTFAHLDATTVLSRGLASKGIYPAVDPLDSTSTMLQPRIVGNEHYETAQRVKETLQRYKELQDIIAILGLDELSEEDRLTVARARKIERFLSQPFFVAEVFTGSPGKYVGLAEXIRGFQLILSGELDGLPEQAFYLVGNIDEASTKAITLEEENKSKK

SEQ ID NO: 11923 - protein, 436 aa, Frankia sp. EAN1pec
MRPGARDAGWSLADVPDQRGRTAVVTGANSGIGFEAAKALAERGATVVLACREPARAEQAAARIRAAAPRADVHVEPLDLISMTSVRAAAERIRAAHPRLDLLVNNAGVMLPSPGPGGAALGAGFGDDGLGDHGIEPTFGVNHLGHFALTGLLLDRLLATPHSRIVTVSSLAHLVGRLDLEQLRRLPPHADRPGGSPPVVVPDQRAGSPSEPPLASPARQRSQRRSETQRRSETQRRSETQRGSGTPRAQGMQRLQSLQGTRGPQSRRLPRQRLPYPTSKLANLMFTFELQRRLAATGASTIAVAAHPGIARTGLTRNLMPPARVFMGQRLAPLMSWLVQEPEIGALATVRAALDPAVHAGEYYGPSGLFRSTGPPAVGRSSARSRDARQQQRLWAESERLTGVTYDFDPSSGTGPGGVGSWRNNGRSASRSAELT

SEQ ID NO: 11924 - protein, 271 aa, Kluyveromyces lactis
MSRVGVLVLGPAGAGKSTFCNAIISHMQSIGRRAHIVNLDPAAEATKYEFTIDIRDLISLEDVMEEFGLGPNGSLIYCFEYLLNNLDWLDEEIGDYNDEYLIFDCPGQIELYTHIPVLPTIVRHLQNQLNFNLCATYLLEAPFVIDTSKFFSGALSAMSAMILLELPHINILSKLDLVKDSHNKKALKKFLNPDPLLLTDKVNEETNPKFHKLNEAIANLVDDFGMVQFLPLEAKNPESVSTILSYIDDVTQWAEAQEPKEPNDQIEIDDM

SEQ ID NO: 11925 - protein, 496 aa, Hydrangea arborescens
  misc_feature (5)..(5): Xaa can be any naturally occurring amino acid
  misc_feature (60)..(60): Xaa can be any naturally occurring amino acid
  misc_feature (119)..(119): Xaa can be any naturally occurring amino acid
INPTXSGPGISTLEKKNLGRIAQIIGPVLDVAFPPGKMPNIYNALVVKGRDTGGQPINVXCEVQQLLGNNRVRAVAMSATDGLTRGMEVIDTGAPLSVPVGGATLGRIFNVLGEPVDNXCPVDTGTTSPIHRSAPAFIQLDTKLSIFETGIKVVDLLAPYRRGGKIGLFGGAGVGKTVLIMELINNIAKAHGGVSVFGGVGERTREGNDLYMEMKESGVINEQNIAESKVALVYGQMNEPPGARMRVGLTALTMAEYFRDVNEQDVLLFIDNIFRFVQAGSEVSALLGRMPSAVGYQPTLSTEMGSLQERITSTKEGSITSIQAVYVPADDLTDPAPATTFAHLDATTVLSRGLAAKGIYPAVDPLDSTSTMLQPRIVGEEHYETAQRVKQTLQRYKELQDIIAILGLDELSEEDRLTVARARKIERFLSQPFFVAEVFTGSPGKYVGLAETIRGFQLILSGELDGLPEQAFYLVGNIDEATAKAMNLEMESNLKK

SEQ ID NO: 11926 - protein, 885 aa, Schizosaccharomyces pombe 972h-
MLIELQQIVKSGLVRNGAKHCTKRSLLCSNASVIASKRFQGSFAPGQQQPLNPLAKPIEQDRDAIIRILSSIGSRREVEQYLRYFTSFEAQRFAIIKVGGAIITDELDTLAQSLAFLNHVGLYPIVVHGAGPQLNKILASRNVEPEYSDGIRITDAETLSVARKVFLEENAKLVDALEKLGTRARPITGGVFQAEYLDKEKYKYVGKIVKVNKAPIEHSIRAGTLPILTSMAETASGQLLNVNADITAGELARVLKPLKVVYLNEKGGLINGETKKKISSIYLDREYDGLMKQPWVKYGTKLKIKEIKELLDTLPRTSSVAIISTKDLQKELFTESGAGTLISRGFVINKHDSLDSIPDAALENLIIQKNSLAAPSESLKQFKDTLKDRKLRIYSDSFNESVAIVDTTDSSLPVLLAFGAADNNWLNNVVDSILTTLKADFPSLLWRLQPSAKNLEWFFSKSEGTLFANNFYYFWYGVKDLNKISKFIQSDKPFADAIIQTQSTKPPTASSTTNNPSSSQINQKRSYSTSSLFSKNKKMNRSLFLKGGKRFFSAEAQKTQKPLKAVSSKPAKVVLLGARGYTGKNLIGLINTHPYLELSHVSSRELEGTKLPGYTKKEIQYVNLSTDDVKKLEEEGAVDAWVMALPNGVCKPYVDALTSANGKSVIVDLSADYRFEPSWQYGLPELNDREALRNSKRISNPGCYATGSQVGLTPILSLIDGQPSIFGVSGYSGAGTKPSPKNDLNVLTNNLIPYSLTDHIHEREISYRLKQPVAFIPHVAQWFQGITLTINVPLKKSITSRELRNLYQDRYNGEPLIHVQGDVPLVKDNAHKHHVSVGGFGVHSSGKRAVIVVTIDNLLKGAATQALQNLNLSCGYDEYAGIHLD

SEQ ID NO: 11927 - protein, 327 aa, Schizosaccharomyces pombe 972h-
MSFKKFPRHLLSIRDLSRGEIVKLIDRSSEIKQAYKQNFQNRRSVQMSGLSSQNVAMIFSKRSTRTRVSVESAVSCLGGNAMFLGKDDIQLGVNESLYDTSKVISSMVSGIVARVNKYSDVATLAKHASCPVINGLCDTFHPLQALADLLTIKETFKSFDGLKVAWVGDANNVLHDLMIANAKVGIHTSVAKPKDVNVRDDILSIVNEAANENGSTFEIVNDPKVAVKNADIVVTDTWISMGQEAEKEQRLKQFTGFQVTGEIMKLAKPSCKFMHCLPRHPEEVSDEVFYGENSLVFQEAENRKWTTVAVLEALLVNRGEILPPASA

SEQ ID NO: 11928 - protein, 240 aa, Chlamydomonas reinhardtii
MPLPLRVPPDADDHDLARFLKARNYDLQAAKQMWEGMISWRRENRVDNIHEWFVFHERSEYEKVFPTGLHKTDKEGHPVLIQQLGRVNIGALYKVTTDDRIRMAHIAENEQMRRTVFPACSYRAGRPVDKLFTIIDLEGIAFTSVMRTTSILKMYMQMDSNNYPETLARMAIINAPGWFSTSWSAIKGVLNGETVKKIEILGKDYQAALLRHIPRENLLTQYGGTSAGSLTDNIGPWQEP

SEQ ID NO: 11929 - protein, 173 aa, Helicobacter pylori
MNLEKLEVSHDASVLSVVIEISKHSNIKYELDKESGALMVDRVLYGAQNYPANYGFVPNTLGSDGDPVDALVLSDVAFQAGSVVKARLVGVLNMEDESGMDEKLLALPIDKVDPTHSYVKDIDDLSKHTLDKIKHFFETYKDLEPNKWVKVKGFENKESAIKVLEKAIKAYQG

SEQ ID NO: 11930 - protein, 394 aa, Oryza sativa Japonica Group
MMELCRIRTFQKSLLRPLLLLQHAPCRTLQTLGRSPSPSVFRPPRRRPPLLLLLLRSSFASVSPGPAPGSGTGECPPPPPAPLPPDELASDDDAYYHEHILEATQEDQSRLVPVKAYFPCTSINLKSLQSQNSFNVIPPTSRATNYVVLRYYDVKGDPEGFKAGIIDESHCHYMVVFQYGSIVLFNVSDHEADGYLKIVEKHASGLLPEMRKDDYAVVEKPTLETWMQGGLDFIILRDLSIDGIRTIGSVLGQSIALDYYIRQVDGMVAEFTDINRGMEKTGTFTMERKKLFQLVGKANSNLADVILKLGLFERSDIAWKNANYAQIWEYLRDEYELTQRFGNLDFKLKFVEHNIRFLQEILQNRKSDFLEWLIIILISVEILISVYNIVQEQM

SEQ ID NO: 11931 - protein, 1099 aa, Saccharomyces cerevisiae
IGTQMISNPSIMFLDEPTTGLDAYSAFLVIKTLKKLAKEDGRTFIMSIHQPRSDILFLLDQVCILSKGNVVYCDKMDNTIPYFESIGYHVPQLVNPADYFIDLSSVDSRSDKEEAATQSRLNSLIDHWHDYERTHLQLQAESYISNATEIQIQNMTTRLPFWKQVTVLTRRNFKLNFSDYVTLISTFAEPLIIGTVCGWIYYKPDKSSIGGLRTTTACLYASTILQCYLYLLFDTYRLCEQDIALYDRERAEGSVTPLAFIVARKISLFLSDDFAMTMIFVSITYFMFGLEADARKFFYQFAVVFLCQLSCSGLSMLSVAVSRDFSKASLVGNMTFTVLSMGCGFFVNAKVMPVYVRWIKYIAFTWYSFGTLMSSTFTNSYCTTDNLDECLGNQILEVYGFPRNWITVPAVVLLCWSVGYFVVGAIILYLHKIDITLQNEVKSKQKKIKKKSPTGMKPEIQLLDDVYHQKDLEAEKGKNIHITIKLEDIDLRVIFSAPFSNWKEGNFHHETKEILQSVNAIFKPGMINAIMGPSGSGKSSLLNLISGRLKSSVFAKFDTSGSIMFNDIQVSELMFKNVCSYVSQDDDHLLAALTVKETLKYAAALRLHHLTEAERMERTDNLIRSLGLKHCENNIIGNEFVKGISGGEKRRVTMGVQLLNDPPILLLDEPTSGLDSFTSATILEILEKLCREQGKTIIITIHQPRSELFKRFGNVLLLAKSGRTAFNGSPDEMIAYFTELGYNCPSFTNVADFFLDLISVNTQNEQNEISSRARVEKILSAWKANMDNESLSPTPISEKQQYSQESFFTEYSEFVRKPANLVLAYIVNVKRQFTTTRRSFDSLMARIAQIPGLGVIFALFFAPVKHNYTSISNRLGLAQESTALYFVGMLGNLACYPTERDYFYEEYNDNVYGIAPFFLAYMTLELPLSALASVLYAVFTVLACGLPRTAGNFFATVYCSFIVTCCGERLGIMTNTFFERPGFVVNCISIILSIGTQMSGLMSLGMSRVLKGFNYLNPVGYTSMIIINFAFPGNLKLTCEDGGKNSDGTCEFANGHDVLVSYGLVRNTQKYLGIIVCVAIIYRLIAFFILKAKLEWIKW

SEQ ID NO: 11932 - protein, 248 aa, Geobacillus stearothermophilus
MIICKTPREIEIMREAGKIVALTRKELEKHIRPGITTKELDAIAEKVIRQYGAIPSFKGYNGFPGSICASVNEELVHGIPGDRVLKEGDIISIDVGAQYNGYHADSAWTYPVGEIAEETKKLLEVTEKSLYIGLEEAKPGARLSNISHAIQTYVESHHFSIVREYVGHGIGQDLHEDPQIPHYGPPNKGPRLKPGMTLCIEPMVNAGSRYVKTLADNWTVVTVDGKMCAHFEHTIAITENGYEILTTL

SEQ ID NO: 11933 - protein, 337 aa, Pseudomonas sp. 7A
  misc_feature (1)..(7): Xaa can be any naturally occurring amino acid
XXXXXXXKLANVVILATGGTIAGAGASAANSATYQAAKVGVDKLIAGVPELADLANVRGEQVMQIASESITNDDLLKLGKRVAELADSNDVDGIVITHGTDTLEETAYFLDLTLNTDKPIVVVGSMRPGTAMSADGMLNLYNAVAVASNKDSRGKGVLVTMNDEIQSGRDVSKSINIKTEAFKSAWGPLGMVVEGKSYWFRLPAKRHTVNSEFDIKQISSLPQVDIAYSYGNVTDTAYKALAQNGAKALIHAGTGNGSVSSRLTPALQTLRKTGTQIIRSSHVNQGGFVLRNAEQPDDKNDWVVAHDLNPEKARILVELAMVKTQDSKELQRIFWEY

SEQ ID NO: 11934 - protein, 164 aa, Paxillus involutus
MANVFFDILINNQPAGRIVFRLYDQQVPITTKNFRELATGQNGFGYEGSSFHRVIPQFMLQGGDFTKGNGTGGQSIYGEKFADEKPGLALKHSKPGLLSMANAGKNTNGSQFFITTVVTSWLDGVHVVFGEVVEGFDVVKEIEARGTASGKPNANIKIAKSGTV

SEQ ID NO: 11935 - protein, 473 aa, Mycobacterium avium 104
MTTESVASKTTTSANGTASADIAGTVARLRQTFATGRTRDVEWRKRQLLQLQKLMEENEAAIAAALAEDLDRGPFEAYIADIATTAGEAKYAAKRVRKWTRRRYQLLELPQLPGRGWVEYEPYGTVLIIGAWNYPFYLTLGPAVGAIAAGNAVILKPSEIAAASSRVMAELVPKYLDNDAIAVIEGDGATSQELIAQGLDRVMFTGGTEIGRKVYEGAAPHLTPCTLELGGKSPVIVAADADVEVAAKRIAWMKLLNAGQTCVAPDYVLADAKIRDELVDKIGAAITKFTADKPEGMRVVNQRQFDRISSYLSGSDGKVTVGGACDPSTLRIQPAVVVDPDPDGPLMRNEIFGPVLPVITVQNLDEAIRFVNSRPKPLSAYLFTKTRETRERVIKEVPAGGMLINHLAFQVSTAKLPFGGVGASGMGAYHGRYGFEEFSHRKSVLTKPTRPDLSSFIYPPYTERAFKMARKMF

SEQ ID NO: 11936 - protein, 367 aa, Photobacterium profundum SS9
MGLSTAKEIIDDIRHGKMVILMDDEDRENEGDLIIAAEKITPEAVNFMAMFGRGLICLTLTHARCKQLSLPLMVQDNTEQFSTNFTVSIEAAVGVTTGISAADRATTVQAAVAPNASFSDIVMPGHIFPLMAQEGGVLSRAGHTEAGCDIARLAGLEPSSVIVEILNEDGTMARRPQLEVFAEKHGLKLGTIADLIEYRNNNETTIERIAECRLPTEFGEFDMITYRDTIDNEIHYALRSGDVKENAETLVRVHLQDTFKDVLHSGASQWTLPTAMQRIASEGGVLVVLSKQENHDTIITKVKNLAANDNGQPKVKLNPKDQSRQVGVGSQILSDLGVSKMRLLASSTQRYHSLSGFGLEVVEYICE

SEQ ID NO: 11937 - protein, 156 aa, Photobacterium profundum SS9
MNVIEGAIAAPNAKIAIVIARFNSFINESLLAGALDALKRQGQVSDDNITVVRCPGAYELPLVAQQVAKSDRYDAIVALGSVIRGGTPHFDYVAGECNKGLAQVALEYNTPVAFGVLTVDSIEQAIERAGTKAGNKGAEAALSALEMVNVLSQIES

SEQ ID NO: 11938 - protein, 367 aa, Opitutaceae bacterium TAV2
MLKAGIVGLPNVGKSTLFNALTRSRKAEAANYPFCTIDPNVGVVTVPDERAYVLQKIAKTQVVIPAAIEMVDIAGLVKGASKGEGLGNQFLANIREVDAIVQVVRCFEDSDIVHTMGSIDPVRDIEVITTELVLADLDSVQKRLEKTQKKAKSGDKEAQAEAALCERLIPHLDQNKPANILPVNEEEARLLKLFQLLSAKPVLYACNVAEGDLATAEENPFVKQVAEFVRTHHDAAYVPISARIESELVELSAEEAKEFLKDLGVDDSGVSSLIRATYALLGLQTYFTAGEKEVRAWTIVKGWKAPQAAGVIHTDFEKGFIKAEVVSYEDLVRLGSTAAAREAGKYRLEGKEYVFQDGDVALFRFNN

SEQ ID NO: 11939 - protein, 168 aa, Vibrio sp. Ex25
MDDMLDTKLNLVRVMPNTPSQLGLGMSGLFAPAHVTEQDKAFAAELMEAVGKVCWVEQESGINNVIAAAGSAPAYFFLFMEAMQAEAIAQGFDKDTARLLVQQAALGAASMVVSNPETELSTLRENVTSKGGTTAEALRTFNEHQLSDIVAKAMQAAVARAEEMEKLF

SEQ ID NO: 11940 - protein, 393 aa, Arabidopsis thaliana
MSCFKSKFAGKSYFRRTFHSSIVQFHPQLSILIWHRRYSIIRTYELIANAAYIGTPGKGILAADESTGTIGKRFVSINVENVESNRRALRELLFTTPGALQYISGIILFEETLYQKTASGKLFVDVMKEAGVLPGIKVDKGTVELAGTNGETTTIGLDGLGDRCKKYYEAGARFAKWRAVLKIGNNEPSELAIHENAYGLARYAVICQENRLVPIVEPEILVDGSHDIEKCAYVTERVLAACYKALSDHHVILEGTLLKPNMVTPGSDSGSKVKPEVIAKHTVRALQRTVPAAVPAVVFLSGGQSEEEATVNLNAINQLKGKKPWSLTFSYGRALQQSTLKAWGGKEENVDKAQKAFLARAKANSEATLGGYKGDAQLGEGASESLHVKDYKY

SEQ ID NO: 11941 - protein, 137 aa, Pavlova lutheri
GIRHEAKTMFRLLLISACLAYASAFNVATSAFRRTGAASTVSMYTVTLKTPSGESKIECPEDTYILDKAEEEGIDLPYSCRAGACSTCCGKVASGTVDQSDQSFLDDGQMESGFVLTCVAYPSSDCTIETHKEEDLF

SEQ ID NO: 11942 - protein, 137 aa, Acetabularia acetabulum
MLAVATSPLLGSRVTLKPATTSQIFAAITRPIASRRSLKVLAYKVTLITPDGNQNSFECADDVYILDAAEEEGIDLPYSCRAGSCSSCTGVVKSGTIDQSDQSFLDDDQMGNGFVLTCVAYPTSDCTIETHKEEELN

SEQ ID NO: 11943 - protein, 238 aa, Oryza sativa Japonica Group
MGEEANCNVAMESAAPKENGHTTGGAAAEAKAAAAWAEIAVTDAAAVPKPTPPPAAVAVDPRLQGISDAIRVVPHFPKQGIMFNDITPLLLRPGVFKDAVDIFVERYRGMAIAAVAGIEARGFIFGPAIALAIGAKFIPLRKPKKLPGEVISETYVLEYGTDCLQMHVGAIEPGERVLIVDDLVATGGTLCAAIRLLERAGADVVECACLIGLPKFKDFYKLNGKPVYVLVESREYEK

SEQ ID NO: 11944 - protein, 238 aa, Chlamydomonas reinhardtii
MAELSLNSPEVQIALLVVAATLVLLVILKLFSGGKRGSAVLLVGPCNGGKTTLFYRLKDGSTELGTVASMQENEGIVQVRNDKDRVVGSVRVMDLPGHPRLRSKLEQYLKDASAVVLVLDSVDLTPNKTEAAEDLFEVLTHTTVARRRTPVLLACNKADLETQAHSVDFCRRTIEKQLDTMRKTRLALGGEAGRSLAALGKPDKPLQLAALRSPIAVCEISAEKGEVAEVMRFLAKLV

SEQ ID NO: 11945 - protein, 176 aa, Glycine max
  misc_feature (89)..(89): Xaa can be any naturally occurring amino acid
MAKEEEQQQPTSPMHPPYAYTIILNIFSKRRTWACLFLLVYGTLLTSSWNFLKSTLSWYNLQVESSTTSAWPALYASVLLGTVFGVLSXMVAALVVMVPALVVTWITIVVLLAFFGKPKRTLVVEGRKITREIFGFVMRTLLKEGNFVAAVCAVLGYFALVRRNGTQGGVVVVGES

SEQ ID NO: 11946 - protein, 428 aa, Tropheryma whipplei TW08/27
MCLIDSVHARQILDSRGTPTVEVEVTLEDGSMGRSAVPSGASTGAFEAHELRDQDNNEYLGKGVTRAVRSVNSEIAPVLIGFDAFDQVGLDHRMIELDGTNNKSRLGANAILGVSLASASAAARAADLSLFRYLGGPSSRILPVPMMNIINGGAHADTGVDIQEFMILPVGARSFSESLRWGCEVYHSLKVQLRESGLSSGLGDEGGFAPALRSNRTALDLILSAIEKAGFSPGIDIVLALDIAASEFCKAPGHYRFEGKDITSDELISYYEGLLSSYPLVSIEDPLDQDDWEGYRTLTTHIGDRVQIVGDDLFVTNTSRLSRGIQSGVANSILVKVNQIGTLTETFDAVDMAAKGGYTAVLSHRSGETEDTTIADMAVATNCGQIKTGAPARGERIAKYNQLLRIEEKLGRSARYAGWLSYPRWQGK

SEQ ID NO: 11947 - protein, 490 aa, Cynosurus cristatus
RPGVSTIEEKSTGRIDQIIGPVLDVTFPPGKLPYIYNALVVQSRDTADKQINVTCEVQQLLGNNRVRAVAMSATDGLMRGMEVIDTGAPLSVPVGGATLGRIFNVLGEPVDNLGPVESSATFPIHRSAPAFIELDTKLSIFETGIKVVDLLAPYRRGGKIGLFGGAGVGKTVLIMELINNIAKAHGGVSVFGGVGERTREGNDLYMEMKESGVINEENIEESKVALVYGQMNEPPGARMRVGLTALTMAEYFRDVNKQDVLLFIDNIFRFVQAGSEVSALLGRMPSAVGYQPTLSTEMGSLQERIASTKKGSITSIQAVYVPADDLTDPAPATTFAHLDATTVLSRGLASKGIYPAVDPLDSTSTMLQPRIVGNEHYETAQRVKETLQRYKELQDIIAILGLDELSEEDRLTVARARKIERFLSQPFFVAEVFTGSAGKYVGLAETIRGFQLILSGELDGLPEQAFYLVGNIDEASTKAITLEEENKSKK

SEQ ID NO: 11948 - protein, 172 aa, Debaryomyces hansenii CBS767
MAAVFPRSCYKCGEAGHLADNCQQEQRLCYNCRQPGHESNDCPAPKQATQKQCYSCGDLGHVQSDCPTQSQGAKCYNCGQFGHISKNCTEAGNESAKKPASSKLQKPATTCYKCGGPNHYARDCQAGVVKCYACGKTGHISKDCNSASGGEFTSKTCYNCGKSGHISKECDE

SEQ ID NO: 11949 - protein, 491 aa, Nelumbo lutea
  misc_feature (446)..(446): Xaa can be any naturally occurring amino acid
  misc_feature (486)..(486): Xaa can be any naturally occurring amino acid
  misc_feature (489)..(489): Xaa can be any naturally occurring amino acid
SGPGVSALEEKNLGRIAQIIGPVLDVAFPPGKMPNIYNALVIKGRDTAGQQINVTCEVQQLLGNNRVRAVAMSATDGLMRGMEVIDTGAPLSVPVGGATLGRIFNVLGEPVDNLGPVDTLTTSPIHKSAPAFIQLDTKLSIFETGIKVVDLLAPYRRGGKIGLFGGAGVGKTVLIMELINNIAKAHGGVSVFGGVGERTREGNDLYMEMKESGVINEQNIAESKVALVYGQMNEPPGARMRVGLTALTMAEYFRDVNEQDVLLFIDNIFRFVQAGSEVSALLGRMPSAVGYQPTLSTEMGSLQERITSTKEGSITSIQAVYVPADDLTDPAPATTFAHLDATTVLSRGLAAKGIYPAVDPLDSTSTMLQPRIVGEEHYETAQRVKQTLQRYKELQDIIAILGLDELSEEDRLTVARARKIERFLSQPFFVAEVFTGSPGKYVGLTXTIRGFQLILSGELDGLPEQAFYLVGNIDEATAKAMNLEVXSKXKK

SEQ ID NO: 11950 - protein, 327 aa, Brassica napus
  misc_feature (236)..(236): Xaa can be any naturally occurring amino acid
  misc_feature (252)..(252): Xaa can be any naturally occurring amino acid
  misc_feature (310)..(310): Xaa can be any naturally occurring amino acid
MPSGGNGVGNGGAGTSGGSQTFKPYRHLKTLEGHTAAISCVKYSNDGNLLASASLDKSMILWSATNYSLIHRYEGHSSGVSDLAWSSDSHYTCSASDDCTLRIWDARAPYECLKVLRGHTNFVFCVNFNPPSNLIVSGSFDETIRIWEVKTGRCVRVIKEAHSMPITSVHFNRDGSLIVSGSHDGSCKIWDAKEGTCLKTLIDDKSPAVSFAKFSPNGKFILVATLDSTLKLSNYXTGKFIKVYTGHTNKVXCITSAFSVTNGKYIVSGSEDNCVYLWDLQHKTILQRLQGHTDAVISVTCHPVHNQIAXSANHLDRTIRIWKQEDA

SEQ ID NO: 11951 - protein, 278 aa, Schizosaccharomyces pombe 972h-
MAPDISKKRLPCKVLVFNLPPTLPEQVFLQSINSFLPHVEWHRFSKGKATVGTRSELLSFAYLKFQSATAVQEFFRVYQGHTFIDKKNNTYRAIVTIAPYQKIPPSKVKADSLEGSLEQDPKFQEFKVQRESYSQTASNDDVIEKLQTSTPLLQYLAEKKNAVVEKGKSKPSKKSVKAKKKLRLAEKPASNNSKAGKSSQESKKSSKAPAESAAAVIKEDKVSDRKKSKKKPKKTPVSNSTASQASENASDKKTKEKKSSGKQKIASKKKDQLTTDNV

SEQ ID NO: 11952 - protein, 173 aa, Helicobacter pylori
MNLDQLEVSHDADSLCVVIEISKHSNIKYELDKESGALMVDRVLYGAQNYPANYGFVPNTLGSDGDPVDALVLSDVAFQAGSVVKARLVGVLNMEDESGMDEKLLALPIDKIDPTHSYVKDIDDLSKHTLDKIKHFFETYKGLEPNKWVKVKGFEKKESAIKVLEKAIKAYQG

SEQ ID NO: 11953 - protein, 552 aa, Paxillus involutus
MSGKLATEYSSWKKLQQIYDAEHPRLILKELFSQDPHRFSKFSKEYVDPTDPNTTFLLDYSKNLVTQPILDTLLSLASEAQLETYRDKMFAGERINTSEDRAVLHVALRNFDDFKIQENGVEEVASVLAHMKEFSEAIRSGSWKGYTGKTINTIVNIGIGGSDLGPVMVTEALKPYAKRDLTALFVSNIDGTHLAETLRECDPERTLFIIASKTFTTQETITNAESARAWFLSFAKDKAHVAKHFVALSTNTKAVTAFGIDEANMFQFWDWVGGRYSLWSAIGLSIALYIGYDNFESLLKGAHGMDKHFKETPLESNLPVLLAVVGVWYNDFYGAQTHALLPYDQYLHKFADYFQQGDMESNGKFVTKSGERVDYQTGPIIWGAAGTNGQHSFYQLVHQGTKLIPADFLAPATSHNPIADSKHHRILLSNFFAQPEALAFGKTEEEVRKELGSGASEALVKSKVFEGNRPSNSIMFPLLTPRTLGALIALYEHKIFTQGVIWGINSFDQMGVELGKVLAKNILSQLGKPSDVTGHDSSTAGLIHYYQKNRKE

SEQ ID NO: 11954 - protein, 564 aa, Plasmid NR1
MSTLKITGMTCDSCAVHVKDALEKVPGVQSADVSYAKGSAKLAIEVGTSPDALTAAVAGLGYRATLADAASVSTPGGLLDKMRDLLGRNDKTGSSGALHIAVIGSGGAAMAAALKAVEQGARVTLIERGTIGGTCVNVGCVPSKIMIRAAHIAHLRRESPFDGGIAATTPTIQRTALLAQQQARVDELRHAKYEGILEGNPAITVLHGSARFKDNRNLIVQLNDGGERVVAFDRCLIATGASPAVPPIPGLKDTPYWTSTEALVSETIPKRLAVIGSSVVALELAQAFARLGAKVTILARSTLFFREDPAIGEAVTAAFRMEGIEVREHTQASQVAYINGEGDGEFVLTTAHGELRADKLLVATGRAPNTRKLALDATGVTLTPQGAIVIDPGMRTSVEHIYAAGDCTDQPQFVYVAAAAGTRAAINMTGGDAALNLTAMPAVVFTDPQVATVGYSEAEAHHDGIKTDSRTLTLDNVPRALANFDTRGFIKLVVEEGSGRLIGVQAVAPEAGELIQTAALAIRNRMTVQELADQLFPYLTMVEGLKLAAQTFNKDVKQLSCCAG

SEQ ID NO: 11955 - protein, 588 aa, Nicotiana tabacum
MGSYRVCVCFTRKFRVTEAEPPSDVKEAFKKYAENGNQMNSEQLLKFLIEVQGETLLTVGDADAIVRQILQKRHPITKLTRQTLALEDFHHFLFSTDLNPPINYKVHHDMNAPLSHYFIFTGHNSYLTGNQLTSDCSDVPIIKALKKGVRVIELDIWPNSDKDDIHVLHGRTVTTPVELIRCLKSIKEHAFVASPYPLVITLEDHLTPDLQAKVAQMLTETFGEMLFVPESDSLKECPTPEELKHRIIISTKPPKEYLEASASTTASKERRNSSQRSNCSEDDVWGTEPSSLTADQEENEKSDSDNFEDEDDSNHRPQLASAYKRLIAIHAGKPKGGLKEALKVDPDKVRRLSLSEQALEKAAESHGTEIVRFTQRNILRVYPKGTRFNSSNYKPLIGWMHGAQMVAFNMQGYGRALWLMHGMFRSNGGCGYVKKPDFLLNVGPNNEVFDPKAKLPVKITLKVKVYMGDGWHLDFKQTHFDLYSPPDFYTRVGIAGVPADEIMKKTKTKEDKWTPVWDEEFTFPLTVPELALLRIEAHEYDMSEKDDFAGQTCIPISELKPGIHAVPLCDRKGEKFSSARLLMRFEFV

SEQ ID NO: 11956 - protein, 312 aa, Corynebacterium efficiens
MKHLLSIADLSRDEIISLLDEADRFKEVLEGREVKKLPTLRGRTIFTLFYENSTRTRSSFETAGKWMSADVINISASSSSVKKGESLKDTGLTLSAIGADAIIMRHPSSGAAQQLAGYVAPGGVGPSVINAGDGSHQHPTQALLDALTLRQRLGGIEGRKIVIVGDILHSRVVRSNVDLLSTLGAEVILVAPPTLLPYGVENWPVRTSYDMDAEIRDADAVMMLRVQQERMQGGFFPSHREYATLYGMSKAREASLKDSAIIMHPGPMLRGMEINFGVADAPRTAVLQQVSNGVHVRMAVLFALVAGSDATI

SEQ ID NO: 11957 - protein, 163 aa, marine gamma proteobacterium HTCC2143
MRHIISVLLENEPGALSRVVGLFSQRGYNIESLNVAPTEDATLSRLTLTTEGDDQKIEQITKHLNRLIEVVKLVDLTEGAHIERELMMLKVRATGAQRAEIKRCTDIFRGQIIDVGPNVYTIQVAGAADKLDAFIESIGDAAILEVVRSGVSGIARGEKVLTL

SEQ ID NO: 11958 - protein, 528 aa, Funalia trogii
MSKFQSLAAFIALSLSTGRLAAAAIGPTADLTISNANISPDGFTRAAVVANNQFPGPLITGNKGDTFQLNVIDNLTNDTMLTATTIHWHGFFQKGTNWADGPAFVNQCPISEGNSFLYDFAAPGQAGTFWYHSHLSTQYCDGLRGVMVVYDPNDPHKSLYDVDDESTVITLADWYHTAARLGPRFPFGADTVLINGLGRFATGDPDAELAVITVTKGKRYRFRLANISCDPNFTFSIQGHTMNVIEVDSVNVTPYEVDAIQTFAGQRYSFVLTVDQDIDNYWMWAIPNIGTINTDGGVNSAILRYDGAAEVEPDAASPSPSNQLVERNIVPLTDLAAPGNPTVGGVDYALNLDFSFDGANFAINGESYTSPSVPVLLQILSGAQTAPDLLPGGSVYVLPSNATIELSFPMTASNAPGGPHPFHLHGHTFHVVRSAGQTDYNYVNPPQRDTVSVGAAGDNVTIRFRTDNPGPWFLHCHIDFHLEAGFAVVFAEDTPNVASANKPSAAWEDLCPTYNSVYPNGDNGDARR

SEQ ID NO: 11959 - protein, 549 aa, Coprinopsis cinerea okayama7#130
MPRARTTSKPESRLTRQGTQNSEKTDASDKSDKKRSRSPATRTSKRARVEPATTAATKAKTTTKAAAAQKAASKSAEKPVAKPAPKAAAPRAPKAPKPDLISPPTLPAPTRPSPLVWVWGATDSGQLGLGENYNSEVPKPRRHPWAEQQISEGTFGSEPGAGILSVTSGGLHTYLLDEKGRIWSAGTNDEGALGRETKKEPTENEAHLRAQEFVLIQTLADEGFRAVQLATGDNFGAALNDQGDLKVWGTFRDDEGKSNFSSDVGKQLAPTSITIHGLYTPKSSSDKIASIAGGENHLVALTTQGEVYSWGIGGSGQLGRRVLSRHKNEALAPKRVVLGSRSRKAVLIGAGLRSTFAVDQAGEVWGWGLNSVGQLGIGERGEIVLQPTKLEVLSPSNLPSSVEGEQDRVVQIRGGEFHTVFRTAQGKVYACGACNDYQLGLPEDHEVFEGKGTRGAECITEPVLVPLPDAVKDDPVVWISAGPRYSMAVTQDGALLSWGVGEQSELGLGDETEAVTPQIVVRRTGSWSAMQVSCGGQHVVGLFKKRESS

SEQ ID NO: 11960 - protein, 284 aa, Yarrowia lipolytica CLIB122
MSVSIPLRALSSGYNIPAIGLGVYQSADAETIVYEALKKGYRLVDTAQEYGNEAATCRGISKFLKETGTNRREVFYTTKLDDATGGYEGTMQLAEARLAEARKGGIDYIDLLLIHAPFSKSPYTETRLAAWKALTELVDGGAIRSIGVSNYGVKHLKEFWDADVKYKPVLNQVESSPWNVRQDIHDFCKSHNVIVEQYSPLCRGNRFKEPGVLKLADKYKKTPAQILIRWSLDKGMLPIPKTDNVDRLSPNLDVFDFNLTPQEVEDLQDLNSYTCYEWDPTVTK

SEQ ID NO: 11961 - protein, 124 aa, Synechococcus sp. CC9605
MSRETPQWTCIKHCGACCRLAPEERADALEALSEEQQRTYLAMVGPDGWCIHYDTGSQRCTIYEERPDFCHVSGLGRLFDVPDDQFDAFAIACCHQQIRSTYGGRSGVMRRFNRAQNAGGSVDK

SEQ ID NO: 11962 - protein, 371 aa, Aspergillus oryzae
MFRQSIRRFGTTALRAAEGSTAYSVRVSQAQGYVNGLTEAIGNTPLIRLKRLSEETGCNILGKAEFQNPGGSVKDRAALFVVKDAEEKGLLKPGGTVVEGTAGNTGIGLAHVCRSKGYKLVIYMPNTQSQGKIDLLRLLGAEVYPVPAVAFDNPQNYNHQARRHAESLDNAVWTNQFDNTANRQAHIEMTGPEIWAQTGGQVDAFTCATGTGGTLAGITRYLKTASDGRVKCFLADPPGSVLHSYIQSGGNLIERSGSSITEGIGQGRVTDNLQPDIDLLDGSLNISDEKSIEMVYRCLDEEGLYLGASSALNVVAAKEVAEKLGKGKTVVTILCDGAYRYADRLFSNNWLQSKGLRTAIPKHLEKYIVLP

SEQ ID NO: 11963 - protein, 89 aa, Synechococcus sp. PCC 7002
KGADSIELLKQVHQLIQERGWQIGNIDSVIVAERPKLKSHIQAMTQCLAEALGVDPDQVGVKATTNEKLDAMGEEKGICVHAVALLVQV

SEQ ID NO: 11964 - protein, 347 aa, Heterocapsa triquetra
NVAEGALAAGMPSSAARSAGVFYPLVCSVAKASGSDPAQGTEKKTGAFLVQSAFQATGNSSSLWLYGAAQNLLALRLAAQCGYEIASPFTAWLKATCVPALVAMALTPLVTFWALKPEVTKTPEAPAEAKRKLDEMGPMSRDEAILGGVVAGMLVLWAGSTAFGIPAVTTAVLGLSALLLTGTMTWADCASEQGAWTTMTWFAILVSMSAMLNKRGVVSWLAATISGQITGAGLSAAPAFFLLLFIYTFSHYAFASQVAHLSALYVPFIAMMVKTGTPPAVAVFALAVASNVFGSLTPYASAQAPVFYGGGYVTLKDWYRMGLIFIVFNLAVWISVGSVWWKIIGLY

SEQ ID NO: 11965 - protein, 490 aa, Dichelachne micrantha
  misc_feature (405)..(405): Xaa can be any naturally occurring amino acid
  misc_feature (419)..(419): Xaa can be any naturally occurring amino acid
RPGVSTIDEKSTGRIDQIIGPVLDVTFPPGKLPYIYNALVVQSRDTADKQINVTCEVQQLLGNNRVRAVAMSATDGLMRGMEVIDTGAPLSVPVGGATLGRIFNVLGEPVDNLGPVDSSATFPIHRSAPAFIELDTKLSIFETGIKVVDLLAPYRRGGKIGLFGGAGVGKTVLIMELINNIAKAHGGVSVFGGVGERTREGNDLYMEMKESGVINEKNLEESKVALVYGQMNEPPGARMRVGLTALTMAEYFRDVNKQDVLLFIDNIFRFVQAGSEVSALLGRMPSAVGYQPTLSTEMGSLQERIASTKKGSITSIQAVYVPADDLTDPAPATTFAHLDATTVLSRGLASKGIYPAVDPLDSTSTMLQPRIVGNEHYETAQRVKETLQRYKELQDIIAILGLDEXSEEDRLTVARARKXERFLSQPFFVAEVFTGSPGKYVGLAETIRGFQLILSGELDGLPEQAFYLVGNIDEASTKAITLEEENKSKK

SEQ ID NO: 11966 - protein, 135 aa, Brassica napus
  misc_feature (110)..(110): Xaa can be any naturally occurring amino acid
  misc_feature (121)..(121): Xaa can be any naturally occurring amino acid
ASDFICVWFVGGLTGFHLYLMSTNQSTYENFRYRYDRHENPFNKGILGNFMEVFCTSVASSKNSFRAKVSNEPVIPPRIVNGAMSSPSLQKVSQDIEMGRKPVWHQTVDXELGDMDKDMEXSVHPRNLTKMLQPE

SEQ ID NO: 11967 - protein, 659 aa, Oryza sativa Japonica Group
  misc_feature (123)..(123): Xaa can be any naturally occurring amino acid
MISLNFFSQCCCSLFSTMNPIPRKHGMKKAFLKSCSSQRCSKHGPDIRFPFRLSTHDPSCGMPGMQLSCSGHDTILDHPVLGSCKVTAIYYRYRVINAILLVESSSNCPLQKLASTNVSTAVXEPQKKDGATIVGCSKDSIATNQDGIVGPRSCLNLSSHGSQLWYLVPPRTYMSALPPDCTVVAKGIPIPYNYDRNGPNENQYLDISNLKEKANKVINFGETAFTWHLNKITNACQGCEWNGHHCGFSSQRGQAFCQHQDFVYSCSNKSCFVPFSFCFKKQILAHTLLILMEQTNFIYFYTATSSAATLVVLLLMVGTTIYLSLKTRYNEEIHLKVEMFLKTYGTSKPTRYSFSEVKKITRRFREKIGHGGYGNVYKGELPNGVPVAVKMLENSRGDGQEFINEVATIGRIHHANVLRLLGFCSEGTRRTLIYEFMPNDSLEKYIFSQGPNVSREFLVPDKMLDISLGIARGMEYLHQGCNQRILHFDIKPQNILLDYSFNPKISDFGLAKLCARDQSIVTLTAARGTMGYIAPELYSRNFGVISYKSDVYSFGMLVLEMVSGRRNLDPGIDNQHEVYFLEWIYEKVFTGQNLLIGTEMTQDEKYKVRKLAIVALWCIQWNPKNRPSTTQVVNMLTGRLQDLQMPPKPFVSSASESIP

SEQ ID NO: 11968 - protein, 722 aa, Gibberella zeae PH-1
MSGIMSKRQQARNEKALQDLVQNVPGNNMCADCHARNPAWASWSLGVFLCMRCAAIHRKLGTHISKVKSLSMDSWTNEQVDNMRKVGNVTSNNLYNPEHGKPSVPVDVDEADSAMERFIRQKYMNNTVNGTGKSKSPHMGEGTPPPLPPKNSKFGFRSASSIFPLSSKSKKDAKTIAAARANRTESPRPPNKPSKVFGATLDLDQPDELDQKMARLLDMGFQDAKRNALVLKGVNGNLERAIETLVRLGEGSGRPSPLPTPSPREQTLRTSRSLTPLTPNSGGLGLGAGLSVPSRSATDRPTTPSSASTNPFDNLGTAPPQTAQSTGSLQNRNPYGQTNPFGAPVAQEQQPTDAFSQAFQNMSLSPQQPLFPHHTGGPVPQPAAQQLTGYQQVAPSAPTTPGGFSSLGFSNNMTYPQPLQAQSTGYNPFFTNQTAAVQQQPQQLNNPFPQVNTNQAPAGYKPFTRSPTRIASPSLGQIPEQTQSSFQNPAVYQTSAVYQSSAVYQSPAPLSPPETTTNPFFANAGQSIAQTGQVFGQQPAMQPMQNQTQATNNPFVQQQTGQQLYGQQQIPQMQQQQQMQQQQQQQQMQQQQQFYQPQRPDNASIMALFNNYPQMTPQQASAESTQSSYQTAHQPQQPTIPENQPMAPVQQNHGVPAPMSSGTNPFMTNAPAANSIASPNAMTTSDPFAARSRESMNLGMDLAWTNGRHSPDAFASLSARHG

SEQ ID NO: 11969 - protein, 398 aa, Dehalococcoides sp. VS
MTSQVGTDKGFISDRAKELKPSGIRKFFDLAAKMGSGAISLGVGEPDFTTPWHIRESAIYALEKGYTMYTSNAGLLELRQEISKYLYQTYKLDYNPETEILITVGSSEALDLVMRATLNPGDEVLMTDPAYVAYPSCVFMSYGNPVQIPTFEANNFEISAADIAPRITPKTRSILLGYPSNPTGAVMPKAKLTEIAKLACEKNLLVVSDEIYDKIIYSGFEHTCFATLPGMRERSVIINGFSKTYAMTGWRIGYAAGPADIIQAMTKIHQHTMLCAPIAAQKAALEALRNGQDDVRLMVEEYDRRRRFIVKSFNDMGLSCFEPKGAFYTFPSVKKTGLSSAEFAEKLLLEEKVAAVPGTAFGDSGEGYLRCCYATSMKDIEEAMKRFRHFLKHNCPGM

SEQ ID NO: 11970 - protein, 586 aa, Neurospora crassa
MLTAVLGQLGSVVIAVPLEFKYQRVIQNISSEGHRGAVASESAICSQIGIDALRKGGSAADAMVATTLCVGTIGMYHSGIGGGGFMLVRDPDGNYHTVDYRETAPAAATQDMYNDDPNASVLGARSVAIPSELRGLEYVHSKYGRLPWHDLVMPSVKIAHDGFKVTEDLVRYMASASASDDFLTRDPVWAQDFAPNGTLLGLGDTITRKRYAKTLLKIALLGADAFYTGPIADSIIALLQPLGGILTHSDLANYEASIRPALNITYRDSFRIFATDAPSSGAVTLSILKTMEQFPSLNLSSNIPLTNHRFVEAMKFAYGARQSLGDPSFITNITSFQEAMLSPQSAKFISSKILPNSTLPLSEYDPVKNYAAASHGTSHIVTADRSGLTLSSTTTINLLFGSRLMTPDTGIILNDEMDDFSQPNKNNSFGFVPSPSNFIRAGKRPLSSICPLMVEHVSNGSLWFATGAAGGSRIISSTTQVAFNVLEGLAVHPNTTDLKVKGVGGEGSVMRAAVAAPRLHDQLMPEVLLVEKGYGQDVYDDLKRRGHNVTWQAPGLSAVQAVMRFGNGTFVAASETRQVNSGGFAV

SEQ ID NO: 11971 - protein, 174 aa, Zea mays
  misc_feature (22)..(22): Xaa can be any naturally occurring amino acid
VIAETGDSWFNCQKLKLPEGCXYGSIGWSVGALLGYAQGANHKRVIAFIGDGSFQVTAQDVSTMLRCEQNSIIFLINNGGYTIEVEIHDGPYNVIKNWNYTGFVDAIHNGLGKCWTSKVKSEEELTAAIETALGEKKDCLCFIEVIAHKDDTSKELLEWGSRVSAANSRPPNPQ

SEQ ID NO: 11972 - protein, 494 aa, Xylella fastidiosa Temecula1
MSRKHAFQFLDLPRQMPQRIPVELRTSGDWRELYGKFDKGEAQYQAGRCLDCGNPYCSWKCPVHNAIPQWLQLVQENRIDEAAALCHATNPLPEVCGRVCPQDRLCEGSCTLEEFGAVTIGAVEKYIVDTALQQGWRPDLSHVQPTGWRVAVVGAGPAGLACADRLARAGVQAVVYDRYEQIGGLLQFGIPSFKLDKAVMSTRRQVLEGMGVEFRLGVEIGKDLGIEALLEDYDAVFLGVGAYRYTDGGLPGQDLKNVLPALPFLVQNGRIISGNDPYGRPIAGWEDQVQLPDVAGKSVVVLGGGDTGMDCVRSAIRLGATKVTCIYRRDEANMPGSAREVANAREEGVRFLFNRQPLSIQSGTDKQAIGVTVVETKLAEPDANGRRNAVPIQGTEAVLEADVVIIAFGFSPMLLEWLTAQGVQASSNGRIVVALSDTGDRLTYQTTHPKLFAGGDCVRGADLVVTAVAEGRDAAESIVRWLRATAQVMDVAVI

SEQ ID NO: 11973 - protein, 152 aa, Paxillus involutus
MPNAAERTYIMLKPDGVDRGLIGEILARFEKRGFKLIAAKLALPSKEHLEKHYADLKDKPFFPGMIKYMQSGPVFCMVFEGLDAVKTGRAMLGATNPLASQPGTIRGDYALAVGRNICHGSDSVENAEKEIALWFPDGTLQYRLSQEAMIYE

SEQ ID NO: 11974 - protein, 284 aa, Xylella fastidiosa Temecula1
MPHVTLLPSPSQIAFIGGGNMARSLIAGMIRQGAPSTSICVIEPIAALRDALIADFKIKAVTTATEAATDTSTWVLAVKPQVMPDVCATLPLPVQPNTPLVISIAAGITTCKLKHWLGDTCAIVRAMPNTPALLGAGVTGLFATSQTTGTQRTIAEELFNSVGKTLWITEEALMDAVTAVSGSGPAYAFLLAEAMETAAIMQGLSTANARTLVQQTLLGAARMMTESGETPAALRHRVTSPHGTTEAAITTFQENDFQTLVAKAIDAATRRARALGKINDTDPT

SEQ ID NO: 11975 - protein, 436 aa, Haemophilus influenzae 86-028NP
MAKIVKVIGREIIDSRGNPTVEAEVHLEGGFVGLAAAPSGASTGSREALELRDGDKSRFLGKGVLKAVAAVNNEIAQAIVGKDATNQAEIDQIMIDLDGTENKSNFGANAILAVSLANAKAAAASKGLPLYAYIAELNGTAGVYSMPLPMMNIINGGEHADNNVDIQEFMIQPVGAKTLREALRIGAEVFHNLAKVLKSKGMSTAVGDEGGFAPNLASNADALACIKEAVEKAGYVLGKDVTLAMDCASSEFYNKENGMYEMKGEGKSFTSQEFTHYLEELTKQYPIVSIEDGQDESDWEGFAYQTKVLGDRVQLVGDDLFVTNTKILKEGIEKGIANSILIKFNQIGSLTETLAAIKMAKDAGYTAVISHRSGETEDATIADLAVGTAAGQIKTGSMSRSDRIAKYNQLIRIEEALERAGTPAAFPGLKAVKGQA

SEQ ID NO: 11976 - protein, 89 aa, Triticum aestivum
MAARNFFVRSPTEEESSAAIREAVLLGGKNAAIAGTFVACRVLPWAKHNLNYTAQALIISTACVAGFFITADKTILRNARQNTIGRIDE

SEQ ID NO: 11977 - protein, 306 aa, Brassica napus
MANASTTLFALSSSIPTRLSLPRRSESLKLVVPVAMAASSASTAKKVAPAVIVGGGRVGRALQEMGSGDDLLVKRGEPVPVDFEGPIFVCTRNDDLDAVLEATPQSRWKDLVFFQNGMMEPWFESKGLVDTDQVLAYFAVSKLGEPPVDGKTDTNPEGLTAAYGKWASAVAARLQSGGLSCKVLDKESFQKQMLEKLIWICAFMLVGARHPGASVGTVENEYRDEVSRLIQELAAAASAEKGLTFEEDMVERLCAYSRAVAHFPTAVKEFKWRNGWFYSLSEKANAEGKPDPCPLHTEWLRELKVI

SEQ ID NO: 11978 - protein, 775 aa, Desulfotalea psychrophila LSv54
MTRTVINGLDENGRRISSMEFEKMVRAAASSSANIHLNSYGQHNIGIRLEHKEGLNITVEGPSGQRLGCMGLPGTKIVCKGATSDDVGYLNIGAEITVLGDATNGACNAMAMGKVYIGGSIGARGLTMTKWNPEYEKPELWVLGSTGDSFAEFNCGGIAVVCGIKPKTPKNILGYRPCVGMVGGSIYFRGPIDDSYSRLNAKLCKLDDQQWQWLLENMPTFLGNIQREDLSEELTIREDWHVLSSITTQERALMWAGPMPMAEFRREHWDKTFGGDPLRDIAPGLDRSPINAITTGELRRKKPYWANNEYSAPCTYYCPIHIPTVERLRLLREGRADEAYELLLRYTPLPASVCGAICPNQCIQNCSRKGVDEAIDTQILGRAAGHFPAPKPAAATGKRVAIIGGGPGGMNAAWQLALKGIEAHIFEQDDKLGGKLAGVIPWERLPQATWQYEIDRFTSMEGIELHLNTTMTKGKFAELQRDYDYVIVAVGTHEPRSIPFPGHEKVIPALHFLKDAKNASHPPQVGREVVIIGAGNVGCDVACEAYRLGAEKVTLIDIQKPLAFGNEKEAAEALGAQFRWPITTKEVTDQGIITTDGELIPAQTVIVSIGDVPALSFLPDSVETMTVGGADWVTTNEAYVTSNKKVLAVGDVKRPGLATNALGAGKDAAEYILATEKGEKWEPFSKPLIAQSALTITHYAPIAKEATEANQADRCLSCASCRDCHLCETICPEGAISREDLGNGEYRYVSNDDKCIACGFCADTCPCGIWVMNPY

SEQ ID NO: 11979 - protein, 140 aa, Triticum aestivum
  misc_feature (8)..(8): Xaa can be any naturally occurring amino acid
  misc_feature (37)..(37): Xaa can be any naturally occurring amino acid
RVEPRGGXIFNIDDGRPTPRFAAYGATKRSVVHLTTXSLQAELQMNEVNDVVVHNLSPGMVTTDLLMSGATAKQAKFFINILAETPDVVADYLVPNIREIPTNQSMKPTYIRFLTGLKAYSRIFSRIAFGARRNKYVAED

SEQ ID NO: 11980 - protein, 149 aa, Paxillus filamentosus
  misc_feature (66)..(66): Xaa can be any naturally occurring amino acid
  misc_feature (69)..(69): Xaa can be any naturally occurring amino acid
  misc_feature (80)..(80): Xaa can be any naturally occurring amino acid
  misc_feature (84)..(84): Xaa can be any naturally occurring amino acid
  misc_feature (113)..(113): Xaa can be any naturally occurring amino acid
  misc_feature (118)..(118): Xaa can be any naturally occurring amino acid
  misc_feature (133)..(133): Xaa can be any naturally occurring amino acid
GRIVFRLYDQQVPITTKNFRELATGQNGFGYEGSSFHRVIPQFMLQGGDFTKGNGTGGQSIYGEKXADXKPGLALKHSKXGLLXMANAGKNTNGSQFFITTVVTSWLDGVHVXFGEVXEGFDVIKEIEARGTXSGKPNANIKIAKSGTV

SEQ ID NO: 11981 - protein, 340 aa, Glycine max
MASDKKIRIGINGFGRIGRLVARVALQRNDVELVAVNDPFITTDYMTYMFKYDTVHGQWKHFDVKVKDSKTLLFGEKPVTVFGIRNPEEIPWGEVGADYVVESTGVFTDKDKAAAHLKGGAKKVVISAPSKDAPMFVVGVNEKEYKPELDIVSNASCTTNCLAPLAKVINDRFGIVEGLMTTVHAITATQKTVDGPSNKDWRGGRAASFNIIPSSTGAAKAVGKVLPALNGKLTGMSFRVPTVDVSVVDLTVRLEKPATYEQIKAAIKEESEGKLKGILGYTEDDVVSTDFVGDNRSSIFDAKAGISLNENFVKLVSWYDNEWGYSSRVIDLIAHIASVA

SEQ ID NO: 11982 - protein, 149 aa, Glycine max
VSYVRPPPHHVLLEGTLLKPNMVTPGSDSKKVTPEVIAQYTVRTLQRTVPAAVPAVVFLSGGQSEEEATLNLNAMNKLSTKKPWALSFSFGRALQASTLKAWAGKVENVEKARAAFLARCKANSEATLGTYKGDAAADTESLHVKDYKY

SEQ ID NO: 11983 - protein, 200 aa, Synechococcus sp. CC9605
MTDTGCLRVGQLAPDFTATAVVDQEFKEVTLSQYRGKYVVLFFYPLDFTFVCPTEITAFSDRYADFSSKNTEVLGVSVDSQFSHLAWIQTPRNQGGLGDINYPLVADLKKEISTAYNVLDDAEGVALRGLFIIDPDGVIMHATINNLPVGRNVDETLRVLQAFQYVQSNPDEVCPANWTPGEKTMKPDPKGSKEYFSAIG

SEQ ID NO: 11984 - protein, 128 aa, Triticum aestivum
RRLICIVASIYIGLNSSSQEGTGARTGHRYLDVRTEGEFGGGHPAGAVNVPYMYSTGSGMAKNPHFLEQVSAIFGRDDEIIIGCQSGKRSLMAAAELCSSGFTAVTDIAGGFSTWRENGLPVNGRGLL

SEQ ID NO: 11985 - protein, 365 aa, Isochrysis galbana
AALALAPGLAPAPRVASRAAVSMDSSKPVVIGLAADSGCGKSTFMRRVTGIFGGESKFNDIGRETNTLVSEMTTVICLDDYHKWDRTGRKSNPEWPDGITALHKDCQNWDKMAEDVLNLKNGVAVEKPIYNHITGMLDPDEMVSPTPIVIFEGLHPMHDERVNQALDLTIYLDITDDVKFAWKAQRDIAERGATMEEVQKAINDRKPDFSAYVEPQKAKADIIIQVLLSDLIDDATGKFLKVKFIQKKSCPVCESPFLFDKGSKITWTPNGDKLTTSAPGVVLASYDDEWFGEAVSVIEMDGKIDVLDELIYVESAMCSTGTKYYGELTEQMVKNKQAPGSENGTGLFQTLCAFKIREAYESLRK

SEQ ID NO: 11986 - protein, 452 aa, Heterocapsa triquetra
EIKKRAEGDMKGFLGYCDEDLVSTDFETCTISSTFDSKACIMLDPTFVKLVAWYDNEWGYSCRVVDLIKHMAKVDAGESGAAPKGVKKSVADLSDADLDGKTVLIRCDLNVPLNGDLEITDETRITASIPTIEYLCKKGAKVLACSHLGRPKNGPEDKFSLKPVAKRMSELMGKEIKCAPDCKATDEVKKMVGAMGKGDVMILENTRFYKGETKNDPELAESMASLADLFVNDAFGTAHRAHSSTEGVTKFLKPNVSGFLLKKELDYLAGAVDSPVRPMCAIVGGAKVSTKIPVIESMLDKVDKLVIGGGMVFTFLKARGLSVGGSLVEEDMLDLAKKLEEQAKAKGVELILPSDIACGDAFPADGKEVGFKVVPAIEIPDGWLGLDNGPDATEEIKKALADCKTVIWNGPMGVFESPQFSKGTYEIAECLARSRRRTAPSPSSAVATPCQP

SEQ ID NO: 11987 - protein, 252 aa, Microcystis aeruginosa PCC 7806
MLSTLLADFKIIFERDPAARNWLEVLFCYPGLQALLCHRFAHWLYHIGIPFIPRLISHLARFLTGIEIHPGAQIGQGVFIDHGMGVVIGETAIVGDYALIYQGVTLGGTGKESGKRHPTLGENVVVGAGAKVLGNIYLGNNVRVGAGSVVLRDIPADCTVVGVPGRLIYRAGTRVEPLEHGDLLDSEAVAIRALVDRIEQLEKQVYELRLERSKEPDYRINCPVLAHLEEEASHSCCPAADRDMREFLERAV

SEQ ID NO: 11988 - protein, 199 aa, Triticum aestivum
  misc_feature (182)..(182): Xaa can be any naturally occurring amino acid
MENGSSKGDVPEDANAHCPGTQSDEAGKADSCAGCPNQQICATAPKGPDPDLVAIAERMATVKHKILVLSGKGGVGKSTFSAQLSFALAEMDHQVGLLDIDICGPSIPKMLGLEGQDIHQSNLGWSPIYVESNLGVMSIGFMLPNPDDAVIWRGPRKNRLIKQFLKDVDWGEIDYLVVDAPXGTSDEHSSIVQCLQANE

SEQ ID NO: 11989 - protein, 415 aa, Heterocapsa triquetra
  misc_feature (219)..(219): Xaa can be any naturally occurring amino acid
PAKLSIDDVDVAGKRVFMRVDFNVPQDKKDPTIITNTQRIDGALPTIQAVLAKGAKCVVLASHLGRPDGSVMEKYSLAPVAKIVEEKLGKPVTFCKDCCGPEVEATCADPAMGSVILLENLRFHVEEEGKGVDASGEKIKADKEKVKEFRASIRKLADIYCNDAFGTAHRAHSSMVGEGFDVKCSGGLMAKELSAFAKVLDEPARPLLAILGGAKVSDXIQLIMNMLDKVNKIIIGGGMAYTFLKVKDNMSIGTSLYDEEGANIVPDILKKAEEKGVELILPVDFVISSKFGEDGEIKTATKEEGIPDGFMGLDCGEKTLELNRAGVAASKTIIWNGPMGVFEMAKFETGTKTLMDDIVKRLRMASFTVIGGGDTATACKKYGTEDKVSHCSSGGGASLELLEGKDLPGVSALND

SEQ ID NO: 11990 - protein, 481 aa, Silicibacter pomeroyi DSS-3
MRRLRKVKIVATLGPASETYETIRALHEAGADVFRLNMSHGTHDEIRAKHQIIRQVEQDLDSPIAILADLQGPKLRVGTFVNEAEELAEGAAFRLDLDPAPGDAGRVCLPHPEIFQVLEPGAHLLVNDGKIRLKVLDCGPDFAECTVVTGGTISNRKGVNVPDVVLPLAALSDKDRDDLEFACALGVDWLALSFVQRARDVFEARALADGRAAILSKIEKPAAVEAFDAILDASDGIMVARGDLGVELPVAAVPPIQKRLVRKCRAAAKPVIVATQMLESMIESPMPTRAEVSDVATAIYEGTDAIMLSAESAAGQYPLEAVRTMDNVAVEVEADPTYTQIIAASRTAKGTTIADGIVAAAREIAEKTDIKAICCFTQSGTTALLTARERPGVPIIAMTSLLATARRLCLSWGCHCVITPELERFKGAVVNAARAARAGGFAIETDQIVVTAGVPFNVPGTTNILRVAPCDERLIYNTDPG

SEQ ID NO: 11991 - protein, 172 aa, Prochlorococcus marinus str. NATL2A
MDHLKKYITEINDYPKKGIVFKDLNPIYKEPKIWKELMFPLQNLISTKKPDYIAGIESRGFISASALAFKLEIGLITIRKPNKLPGEVIGTNYKLEYGEDRLEIQQNIMEKDSKIMLFDDLLATGGTAGAAGNLIKKAGGNLIGYAFLVELTELKGRENLDSNLFVETLIKY

SEQ ID NO: 11992 - protein, 436 aa, Isochrysis galbana
MVARTATLALALFGGAEALRIGAAPMRSTSRTCTIEMAKKSVGDLTKADLEGKRVLVRCDLNVPLDGKTITDDTRIRASIPTIKYLIDNGAKVLLSSHLGRPKGGPEDKFSLGPVAPRLSELLGKEVTMAPDCIGDAVADCVTKMANGDVLLLENTRFYKEEEKNDPEFAEKLAANADMFVNDAFGTAHRAHGSTEGVTKFLSPSVAGFLLQKELDYLDGAVSDPKRPFAAIVGGSKVSSKIGVIESLMEKVDKIVIGGGMVFTFLKARGLETGSSLVEEDQLELAKKLEVIAKEKGIDFILPTDVIVADKFAADAATQIVSVDAIPEGWMGLDNGPESTKMIQQKLSECKTIIWNGPMGVFEFEAFAKGTFDVADTLAELTGKGCTTIIGGGDSVAAVEKAGLAEKMSHISTGGGASLELLEGKVLPGVAALQEA

SEQ ID NO: 11993 - protein, 629 aa, Yarrowia lipolytica CLIB122
MTLENKAEASPATKEETTTEAAPAEGEAKTESSEEKGSKEDQGDNASLYVGELDPSVTEAMLFEIFNPIGPVTSVRVCRDAITRRSLGYAYVNFHNQADGIRALEELNYSPIKERPCRIMWSQRDPALRKTGAGNIYIKNLDPAIDNKALHDTFSAFGQILSCKIATDEFGNSRGFGFVHYESAESAESAIQHVNGMLLNDKKVFVGPHVPKSDRMQSFEEQKNSFTNVFIKNLGTEITEAEFEELVNKFGETSSVHLSTNDEGKPTGFGFVDYKEHDVAVKAIDGLSETEFKGNKLFAGRAKKKYERADELRKQYEASRLEKLNKYQGVNLYIKNLDDTIDDDKLRAEFAPHGTITSAKVMVDEAGKSKGFGFVCYSSPEEATKAVTEMNHRLVAGKPLYVVLAQRKDVRRSQLQQQIQAKNQMRLQQQAAAGGLPGQYMGNPGVFYPGQPGFMPPGRGGMPFGANPQMMMRPPMPPQNQFPPRGVPGGPNMYGAPPQGYQQGGFPPQGPMRGGQPPRSGQPGPQGQFRGAPRRKDGESRVADSISNALENAPEEQHKQLVGEALYPKVLAEKAIDGNAEFAGKITGMLLEMPIKEILEVIDDEEGLQAQINDAITAYNEYLNSQKEE

SEQ ID NO: 11994 - protein, 448 aa, Isochrysis galbana
VPQDKKDPSVITNTARIDGAMPTIKYCLDGGAKAVILMSHLGRPDGLPKPEYSMAPVAKCLEAIVGKPVTFLKDCVGPEVEAACADPEPGSVILLENLRYHVEEEGKGLDEAGAKVKASPESVTAFRASLAKLGDVYVSDAFGTAHRAHSSMVGDGYEVKTSGFLVAKELEAFGKVLDAPVKPVLAILGGAKVSDKIQLIKNMLDKVDKMIIGGGMAYTFLKVLHNMPIGSSLYDEEGAKIVSEIMADAKAKGVEITLPVDFVISSKFGEDGDISTATLDAGIPDGFMGLDCVAKVHRDEQGGDHGLQDDHLERPDGRLRDVLLRDGHQEHDGHHRGGHHRRSHHRHRRGGHGHLLQEVRHRGQGDARLDRWRRIARAPRGKGSAWSRGPDGQVKQLMAAPESGRLGRHMARETCARLRKSAKVELRGLWAWMLGCGCAPAVEGWLRE

SEQ ID NO: 11995 - protein, 490 aa, Elymus trachycaulus
RPGVSTIEEKSTGRIDQIIGPVLDVTFPPGKLPYIYNALVVQSRDTADKQINVTCEVQQLLGNNRVRAVAMSATDGLMRGMEVIDTGAPLSVPVGGATLGRIFNVLGEPVDNLGPVDSSATFPIHRSAPAFIELDTKLSIFETGIKVVDLLAPYRRGGKIGLFGGAGVGKTVLIMELINNIAKAHGGVSVFGGVGERTREGNDLYMEMKESGVINEKNIEESKVALVYGQMNEPPGARMRVGLTALTMAEYFRDVNKQDVLLFIDNIFRFVQAGSEVSALLGRMPSAVGYQPTLSTEMGSLQERIASTKKGSITSIQAVYVPADDLTDPAPATTFAHLDATTVLSRGLASKGIYPAVDPLDSTSTMLQPRIVGNEHYETAQRVKETLQRYKELQDIIAILGLDELSEEDRLTVARARKIERFLSQPFFVAEVFTGSPGKYVALAETIRGFQLILSGELDGLPEQAFYLVGNIDEASTKAITLEEENKSQK

SEQ ID NO: 11996 - protein, 417 aa, Physcomitrella patens subsp. patens
NRVRRYTISVFVGDESGMINRIAGVIARRGYNIESLAVGLNKDKALFTIVVSGTDRVLQQVMKQLSKLVSVKQVADLSKEPRVERELMLLKVNVGPTQRAEVLGLVEIFRARIVDVAEESLTIEVTGDPGKIAAMQATMGKFGIKELARTGKIALRREKPYGRTHTSPLQDVSKMDSSDDEDEVSPSQAAAISDLFPTPKNYDPAPDGDVYAVEPDNDGVWYHQILDAHWGGVEEDDPSGFISHTLGILVNDAPGVLNRVTGVFARRGYNIQSLAVGPAETPGTSRILTVVPGTDESIKKLLSQLSKLIDVLAVQDITHQPFSERELMLIKVAATSDVRREVLDVAAIFRAKPVDLSNRTITLELTGDLEKMAALQRLLEPFGILEVARTGRVALVRGGGVDTKYLRQFQPAASTSF

SEQ ID NO: 11997 - protein, 330 aa, Campylobacter jejuni
MMMKILISGGAGYIGSHTLRQFLKTDHEICVLDNLSKGSKIAIEDLQKIRSFKFFEQDLSDFQGVKALFEREKFDAIVHFAASIEVFESMQNPLKYYMNNTVNTTNLIETCLQTGVNKFIFSSTAATYGEPQTPVVSETSPLAPINPYGRSKLMSEEVLRDASMANPEFKHCILRYFNVAGACMDYTLGQRYPKATLLIKVAAECAAGKRDKLFIFGDDYDTKDGTCIRDFIHVDDISSAHLAALDYLQENESNVFNVGYGHGFSVKEVIEAMKKVSGVDFKVELAPRRAGDPSVLISDASKIRNLTSWQPKYDDLELICKSAFDWEKQC

SEQ ID NO: 11998 - protein, 267 aa, Chlamydomonas reinhardtii
MRRPRWSLDDYQLLKQLHKGYASDVYQARCKVTGEVVGLKVYKLAGQGDIQRMQLYREIKLHAGLRHSNVVQYYACFLEQNRVVLVVEFCTGGDLLRLMYKCGGRLLERQAVNMVLQPFLTALHYLHTQGIVHRDIKPENVLFAEGKILKLADFGLAISLKEERANTRAGTLDYMAPEAVSAHYHQSVDAWAVGVFAYELIVGAPPFKAAQMIDTARNIIHANVSFPDAVSDLARDFISRALHKDAAERLTVLEMLHHPWITMFQRR

SEQ ID NO: 11999 - protein, 331 aa, Brassica napus
  misc_feature (7)..(7): Xaa can be any naturally occurring amino acid
  misc_feature (12)..(12): Xaa can be any naturally occurring amino acid
  misc_feature (16)..(16): Xaa can be any naturally occurring amino acid
  misc_feature (22)..(22): Xaa can be any naturally occurring amino acid
  misc_feature (35)..(35): Xaa can be any naturally occurring amino acid
  misc_feature (45)..(45): Xaa can be any naturally occurring amino acid
  misc_feature (61)..(61): Xaa can be any naturally occurring amino acid
EQPQPFXVSPQXSRLXAEIQEXQTLLKTYEVMVKXFQSEIQNKDXEIKQMMEKIEEANQKXLKLEKNLKLRGMGDGGGGGMEFPDLTVELFMSNYEAAAKAVHDFSKPLINMMKAAGWDLDSAAESIEHGVEYAKRPHKKYAFESYICQRMFSGFQQRTFSLDSERTATMDDDDDDTETFFRQFLSLKDMDPLDALCANPDSNFGKFCRGKYLVLIHPKMEASFFGNLDQRDYVAGGGHPRTGFYQAFLKLAKSVWILHRLAYSFDPAAKIFQVKKGSEFSDSYMESVLKNIVVDEKGESPRVGLMVMPGFWIGGSVVQSRVYVSGVKVVE

SEQ ID NO: 12000 - protein, 335 aa, Frankia sp. EAN1pec
MATRVGVNGFGRIGRNFWRALAASRRSDLEIVAVNDLTDNKTLAHLLKYDTTLGTLPESVSVGEDGIRVGDSTIKVLAERDPAALPWADLGVDVVIESTGRFTTAETAGKHLTAGAKKVIISAPAKGEDLTVVMGVNDDVYDPAKHHILSNASCTTNCVAPLAKVLDEAFGIERGLMTTIHAYTNDQVILDFPHSDLRRARAAAQNIIPTTTGAAKATALVLPHLKGKLDGIAMRVPVLDGSVTDLVVNLARPASKDEINAAYKAAAEGPLKGYLVYTEDPIVSSDIVGTPASCTFDSLLTMSSGSQVKVVGWYDNEWGYSNRLVDLTGLVAARI

SEQ ID NO: 12001 - protein, 400 aa, Frankia sp. EAN1pec
MRTIDDLQVTGHRVLVRSDLNVPLDHSKGAPRITDDGRVRASVPTIQALLDRNAKVIVCSHLGRPKGAPEEKYSLAPVAERLAELLGIPVAFAGDGGGDIAGDRAREVVGQLAEGQVALLENLRFHPGETSKDTVARATFADELSALAEFYVGDAFGAVHRAHASVSEVPKRLPHAAGRLVLTELEVLRALTAAPARPYAVVLGGSKVSDKLGVIRALLPKVDALLVGGGMCFTFLAALGHPVGASLLESEMIDTCKDLLAEAGDRLVLPTDVVVADRFAADAETAVVAADAIPDGWLGLDIGPASTAAFARVVAGAATIFWNGPMGVFEFAPFAEGTRGVAEAVASGGGFSVVGGGDSAAAVRILGIPEDDFSHISTGGGASLEYLEGKTLPGLAALDV

SEQ ID NO: 12002 - protein, 490 aa, Bacillus halodurans C-125; identical to SEQ ID NO: 1582

SEQ ID NO: 12003 - protein, 371 aa, Gibberella zeae PH-1
MCFGNRDKGDRGLARSREIEKQLRQDEKRLSKEVKLLLLGAGESGKSTVLKQMKLIYSQGFTKNEKLEWKPVIFNNIIQSFKIIAEAMGEHDLHFDSPDNEKYMAHILVDHEISPHDPMPADYLAPVKALWVDSGVRTAIGMGNEYALHDNLTYFIEDIDRLWGEDYVPDDQDLLRSRLRTTGITETIFDLGQLTYRMFDVGGQRSERKKWIHCFENVNCLLFLVAISGYDQCLVEDKDGVSTSQTWAYHGSLTTMQNQMNEALMLWESIANSHWFARSALILFLNKMDLFKEKLPKSPISNHGFTDYHGPKDDYKAASKYFLDKFKALNRNTEKEIYGHFTNATDTNLLKITMASVQDMIIQRNLKQLIL

SEQ ID NO: 12004 - protein, 793 aa, Oryza sativa Indica Group
MAPPKISKDRFDAAIRAMADIGILKETAAPVLNNLLNLFDYNWVHIEADNYLALADAIFCDSDPKEGQKRQANETNLDADQSNKKLKTKKRSQNPTSKMHGNDNREFVEAPPQQGRGTLSARTVNGKKVTRAHLELPSSQLLIKEPHTCPSIAKNTTIVENNSAVLCHGQDLQTFEVPVATTCPQVVAPSTRKALYFISNQVFWIFYFSRYEDARRTSGAHHDQKHEGVSGAHERNRAVACSNQEIVSSKDSPSNIEVVLSNYGAGKLSFTYNSSLANRSDFHLPDIKLICKKMEARCLRKYKSLEPNFSFKNLIKDTCQCIVESSGPRHEGIIQTVPALDILSKPSVPQILQSNQANSSFMPPNNVMSLGGTSSSCAVAGVSQNSSNMPVVPHQLHIGANRPPHDVNDITKGEERLRIPIINEYGNGILPPPFHYIPHNITLQEAYVNISLARIGDDNCCSDCFRDCLAQSLPCACAAETGGEFAYTTDGLLKGAFLDSCISMIREPLKHPHFYCKICPNERMKIEVNSDSSNTEMNPGPCKGHLTRKFIKECWRKCGCTRNCGNRVVQRGITRHLQVFLTPEKKGWGLRSTEKLPRGAFVCEYVGEILTNIELYDRTIQKTGKAKHTYPLLLDADWGTEGVLKDEEALCLDATFYGNVARFINHSCCFYGMGKKRDELVLVAFWFSRCFDANIIGIPVEIETPDHHYYHLAFFTTRIIEPFEELTWDYGIDFDDVDHPVKAFKCHCGSEFCRDKTRNEWFYAAALVWFINEIALADKSLYTATGSKSRARV

SEQ ID NO: 12005 - protein, 330 aa, Schizosaccharomyces pombe 972h-
MTNTIDSFQKGSALENYNIWIDCDPGHDDVVALTLAACAGHCKILGVSTVHGNTTLEFTTKNALAVMELLNQDVDVHAGAAKPLMRESAFATHIHGTNGLAGISLLPDYPKKKATPDAVFAMYTTISNYPEPVTLVATGPLTNIALLLATYPSVTDNIERFIFMGGSTGIGNITSQAEFNVYADPEAARLVLETKSLIGKLFMVPLDVTHKVLLDANIIQLLRQHSNPFSSTLVELMTVFQQTYENVYGIRNGVPVHDVCAVALALWPSLWTSRSMYVTVSLDSLTLGRTVCDVWSQQNQYPANVHVVLEADVSLFWETFIGVIDRLNYL

SEQ ID NO: 12006 - protein, 658 aa, Daucus carota
MAQIQVQPQQQQQQIPVSGSNGVSAGAAANAGGSNQFTTTSLYVGDLDQSVTDSQLYDLFNQVGQVVSVRVCRDLSTGRSLGYGYVNYSNQQDATRAIDVLNFTPLNNKTIRVSVSRRDPTDRKSGAGNIFIKNLDKSIDIKALHETFSSFGTIISCKIATDASGQSKGYGFVQYDSEEAAQTAIDKLNGMLMNDKQVYVGVFLRKQDRDSEMSKTKFNNIYVKNLSDSTSEDDLRKTFGEYGTITSVVVMRDADGKSKCFGFVNFENPEDAAKAVDALNGKKFDDKEWYVGKAQKKSEREVELKSRFEQTVKEQVDKYQGVNLYVKNLDDTIDDEKLKELFSEYGTITSCKVMRDPSGISRGSGFVAFSTPEEASRALGEMNGKMIVSKPLYVALAQRKEERRARLQAQFSQMRPVAMPPSMGPRMPMYSPGAPGMGQQLFYGQAPPAMIAPQAGFGYQQQLVPGMRPGGGPMPNFFMPMVQQGQQGQRPGGRRGAGPAQQTQQPVPMMPQQLMPRGRMYRFPPGRNVGDVTMPGVGGGMLPVPYNMGGMLPREAAMGQPMPITALASALANAPADQQRTMLGENLYPLVDQLEHDHAAKVTGMLLEMDQTEVLHLLESPDALKAKVAEAMDVLRNVSQPNVADQLGGLSLNENLVS

SEQ ID NO: 12007 - protein, 270 aa, Haemophilus influenzae 86-028NP
MNPMLNIAIRAARKAGNVIAKNYERRDAIESTQKGINDYVTNVDKAAEAEIIEIIRKSYPDHTIITEETGAIEGKEGKDSDVQWIIDPLDGTRNFMTGLPHFSVSIAVRVKNRTEVGVVYDPIRNELFTAVRGEGAKLNEVRLRVDSKRELQGSILATGFPFKQPKLMPAQFAMMNALIEDAADFRRTGSAALDLCYVASNRIDGYFEMGLKAWDCAAGDLIVREAGGLVCDFDAGNGYLRSGNIIAAPSRVIKEMLNKIRPCLGAEFNH

SEQ ID NO: 12008 - protein, 142 aa, Paxillus filamentosus
YIMLKPDGVDRGLIGEILARFEKRGFKLIAAKLALPSKEHLEKHYADLKDKAFFPGMIKYMQSGPVFCMVFEGLDAVKTGRAMLGATNPLASQPGTIRGDYALAVGRNICHGSDSVENAEKEIALWFPDGTLQYQLSQEAMI

SEQ ID NO: 12009 - protein, 99 aa, Arabidopsis thaliana
METTKSNSSESDVNAKWDACLDLTARRFVYSSLGGAFAGLLFFRSPVTRWASIAFGAGIGIGSAYTDCSRVFDASSSTSATLLAAPKSTETSVSQAAEE

SEQ ID NO: 12010 - protein, 81 aa, Zea mays
MVANGDVPARGSAAAAASLRRRRTTSGAAAGGGGTSSMLQFYTDEAAGRKMSPNTVLIMSIGFVAVVAVLHVFGKLYRTSN

SEQ ID NO: 12011 - protein, 637 aa, Rhodobacter sphaeroides 2.4.1
MTDRPCTPTLDRVTLPVDIKGLTDRELRSLADELRAETISAVSVTGGHLGAGLGVVELTVALHAIFDAPRDKIIWDVGHQCYPHKILTGRRDRIRTLRQGGGLSGFTKRSESPYDCFGAGHSSTSISAAVGFAAAREMGGDTGDAVAVIGDGSMSAGMAFEALNHGGHLKNRVIVILNDNEMSIAPPVGALSSYLSRLYAGAPFQDFKAAAKGALGLLPEPFQEGARRAKEMLKSVTVGGTLFEELGFSYVGPIDGHDLDQLLPVLRTVKQRAHAPVLIHVITKKGRGYAPAEAARDRGHATNKFNVLTGAQVKPVSNAPSYTKVFAQSLIKEAEVDERICAVTAAMPDGTGLNLFGERFPKRTFDVGIAEQHAVTFSAALAAGGMRPFCAIYSTFLQRGYDQIVHDVAIQRLPVRFAIDRAGLVGADGATHAGSFDVAFLSNLPGIVVMAAADEAELVHMVATAAAHDEGPIAFRYPRGDGVGVEMPVKGVPLQIGRGRVVSEGTRIALLSFGTRLAEVQVAAEALAARGISPTVADARFAKPLDRDLILQLAAHHEALITIEEGAIGGFGSHVAQLLAEAGVFDRGFRYRSMVLPDTFIDHNSAEVMYATAGLNAADIERKALETLGVEVLARRA

SEQ ID NO: 12012 - protein, 494 aa, Paxillus filamentosus
KLQQIYDAEHPRLILKELFAQDPDRFSKFSKEYVDPTDPNTTFLIDYSKNLITQPILDTLLSLASEAELETYRDKMFAGERINTSEDRAVLHVALRNFDDFKIQEKGVEEVASVLAHMKEFSDAIRSGSWKGYTGKTINTIVNIGIGGSDLGPVMVTEALKPYAKRDLTALFVSNIDGTHLAETLRECDPERTLFIIASKTFTTQETITNAESARDWFLSFAKDKAHVAKHFVALSTNTKAVTAFGIDGANMFQFWDWVGGRYSLWSAIGLSIALYIGYDNFESLLKGAHGMDKHFKETPLESNLPVLLAVVGVWYNDFYGAQTHALLPYDQYLHKFADYFQQGDMESNGKFVTKNGERVDYQTGPIIWGAAGTNGQHSFYQLVHQGTKLIPADFLAPATSHNPIADSKHHRILLSNFFAQPEALAFGKTEEEVRKELGRGASEALVKSKVFEGNRPSNSIMFPLLTPRTLGALISLYEHKIFTQGVIWGINSY

SEQ ID NO: 12013 - protein, 193 aa, Desulfotalea psychrophila LSv54
MNLNDITFLLSVHGLDQLPEDGLPEFAFAGRSNVGKSSLMNTLLRRSGFVKVSGRPGKTQGLNFFQAAEDCMLVDLPGYGFARVSKEMQNNWQKLITSYISEREALKCVVVIIDIRHEPKALDRQLLDWLREQKVPVLPIYTKIDKLSGNQLSRHAAILDAGHGIKKDERILFSSKTGQGRDELIAVLESYLA

SEQ ID NO: 12014 - protein, 289 aa, Rhodobacter sphaeroides 2.4.1
MSFSKALTDAAARVQGRLDAALADREDLPVVHAMRYAVQGGKRLRGFLVLESARLHGIAPEAAVSAAASIEALHAYSLVHDDMPCMDDDDLRRGLPTVHRKWDECTAVLAGDALQTLAFELLADPALGPAAVRIELVASLAKASGAEGMVLGQALDIAAETAAVPLTLDQITHLQAGKTGALIRWSAEAGAILGQADRVPLRRYATALGLAFQIADDILDVEGDAEKAGKRLQKDAEAGKATFVSLLGLDGAKARARALVEDAEAALAPYGPEAGTLIEAARFVISRES

SEQ ID NO: 12015 - protein, 419 aa, Pavlova lutheri
MSLSSKLQLSSVDVKGKRVLIRVDFNVPQDKKDPSKITNTARIEGALPTIKHCLDSGAKSVVLMSHLGRPDGSRVDKFSLKPVAGELEKLLGKPITFLSDCVGEEVEAACAAPADGSVILLENLRFHIEEEGKATTESGEKLKADPAKVAAFRASLAKLGDVYVSDAFGTAHRAHSSMLGEGFTTKAAGFLVAKELVAFAKVLDAPARPVLAILGGAKVSDKIQLIKNMLDKVDKMIIGGGMAYTFLKTTNSMPIGSSLYDEEGAKIVPEIMALAKEKNVEIHLPVDFVTSSKFGEDGTIGAATLAAGVPDGMMGLDCGPKSSEAFAKVIMESKTIIWNGPMGVFEMASFETGTKAMMDVMCKATEAGIVTVIGGGDTATCCKKYDTEDKMTHVSTGGGASLELLEGKEMPGIAALSSA

SEQ ID NO: 12016 - protein, 418 aa, Guillardia theta
MSSLNKKQLKDVDVSGKRVFIRVDFNVPQDKADPSKITNNARIVGALPSIKHCLEKGAKSVVLASHLGRPDGARIEKYSLAPVAKELSKLLDKEVKFLNDCVGAEVEAACADPAPGSVILLENVRFHVEEEGKGEVNGEKIKADPAKVKDFRASLRKLADVYVSDAFGTAHRAHSSMVGEGYDVKCAGFLVAKELENFSKVLDNPTKPVLAILGGAKVSDKIQLIKNMIPKVDKMIIGGGMAYTFLKVLDKMEIGTSLYDEEGAKIVPEIMSLAKEKNVEIVLPVILSSPRSLERDGETGTATKAEGIKAGFMGLDCGPESIKKNREAIMSSKTIIWNGPMGVFEMSKFEGGTKAMMDGMVEATSKGVLTVIGGGDTATWCVKYNTEDKVSFVSTGGGASLELLEGKVLPGVSALSDA

SEQ ID NO: 12017 - protein, 246 aa, Prochlorococcus marinus str. NATL2A
MRKPVIAGNWKMNMTCTEAIEYMRVLIPLLKDIPKKDREIVIAPPFTALYPLSEFIRDRNEYLSLSSQNVHWEDSGAYTAEVSPLMLNELSVKCAIVGHSEPRKYFSESDEQINKRAKSAQDHQLIPIVCVGETFQQREMGEAERVIRRQIEQGLEGIEVKRLIVAYEPIWAIGTGKTCEANEANRICGLIRKWIGYEDVIIQYGGSVKSNNIDEIMSMSDIDGVLVGGASLDPTNFARIANYEKI

SEQ ID NO: 12018 - protein, 198 aa, Yarrowia lipolytica CLIB122
MSAENKIEEITEDQVPQIEENSTIVIKKEEKAARALISKLNLQKVEGITRVVLKRTRQHIFVIANPEVYKTPTGNSYVVFGEAQHEDMQATARAAQIAAAQAQQAAAETGSVSEAAAAGEVGAELASKDPASITADLEAASLSKDEDAEDEAEADATGLEDSDIKLVMEQANVSRNKAINGLKKNDSDVVNTIMDLCK

SEQ ID NO: 12019 - protein, 442 aa, Kryptoperidinium foliaceum
GRATESSILHCTIMVQTRKRNVGDILESLPSDGGAKNILVRVDFNVPLNGSFEITDDSRIRGAMPTIESILKAKHNAILMSHMGRPKAVQKGEDTDGSQRKALTLQHVQKRLSELSGVDVQFVDDCIGDKVKDAVSKLPKEGGAILLLENLRFYKEEEKNAPEFAKSLASIADAYVNDAFGTSHRAHASVSGVPGLMPKEKCAVGSLVAKEVAFLDFSSLGEDEVVAAVIGGSKVSTKLPVIKGLLNQVHILVLGGGLAYTFAKAKGITIGTSLCEEEMVETAKDLIREAEVKGKKLILPIDAVCSKEFPKGEMKMEDTQTFDLVPGNGITDGWMGLDVGPKTAALFDQALTTATKIVFNGPMGVFEIRPFDEGTKAMVDTLEAVTKKGAITVVGGGDSVAALEQFHKTDVVTYVSTGGGATLELLAGDTLPGVAAIADLEE

SEQ ID NO: 12020 - protein, 328 aa, Dehalococcoides ethenogenes 195
MSTEAEIREILGKVKVAAAGTTLAELNLLREVTVQPDKIAVKVASAGLSEDSRQILRQEIELALKPVLKKQTLEIEYITVPLKDLNRVKKVVAVMSGKGGVGKSLITGLCAVALNRQGYRVGILDADITGSSIPKMFGANQKIIGNEEAILPVQSRGGISLVSTSLLLTNQDDAVIWRGPLISKMINQFWDDVLWGELDYMVVDLPPGTSDAALTVLQALPISGILVVFTPQGLVEMVARKAVSMAKKMEKPIIGLVENMAYLKVPELDKKIEVFGAGHGEELAKSIGVPFIGQMPLDPALAALCDNGNIEKYQHPLLDELEKAISRS

SEQ ID NO: 12021 - protein, 330 aa, Campylobacter jejuni
MMVKILISGGAGYIGSHTLRQFLKTDHEICVLDNLSKGSKIAIEDLQKIRAFKFFEQDLSDFQGVKALFEREKFDAIVHFAASIEVFESMQNPLKYYMNNTVNTTNLIETCLQTGVNKFIFSSTAATYGEPQTPVVSETSPLAPINPYGRSKLMSEEVLRDASMANPEFKHCILRYFNVAGACMDYTLGQRYPKATLLIKVAAECAAGKHDKLFIFGDDYDTKDGTCIRDFIHVDDISSAHLAALDYLKGNESNVFNVGYGHGFSVKEVIEAMKKVSGVDFKVELAPRRSGDPSVLISDASKIRNLTSWQPKYDDLELICKSAFDWEKQC

SEQ ID NO: 12022 - protein, 191 aa, Zea mays
  misc_feature (140)..(140): Xaa can be any naturally occurring amino acid
  misc_feature (176)..(176): Xaa can be any naturally occurring amino acid
MMGGFLSRVLLLAFGYAYPAYECYKTVELNKPEIAQLIFWCQYWILVALLTVLERFGDFTISWLPFYSEAKLMFFVYLWYPKTKGTTYVYGTFFKPYISQHENEIDRNLLELKARATDTVVLYFQKAASAGQSTFFDVLXYVAAQSPSQKSRQRLHQESQQPPQQQQPQVQVQQAXTTKKAAPVMRRASSI

SEQ ID NO: 12023 - protein, 222 aa, Triticum aestivum
  misc_feature (181)..(181): Xaa can be any naturally occurring amino acid
  misc_feature (212)..(213): Xaa can be any naturally occurring amino acid
ERERETSPNPVSPLRRRLRFGSARLEQKKMQRAVQAVRSHGNVLKYAVLQHISAPKPAMLPAAFSRFMSVSSARLEDRGFETATVADVLKSKGKSADGSWLWCTTEDSVYDAVKSMTQHNVGALVVVKPGQNKSIAGIVTERDYLRKIIVQGRSSKSTKVGDIMTEENKLITVNPDTKVLXAMQLMTENRVRHIPVIDGTGMLGMVSIGDVXXPVVAEHKED

SEQ ID NO: 12024 - protein, 437 aa, Pseudomonas syringae pv. syringae B728a
MATAETSSLRRAITAPMLTLFILGDVLGAGVYALAGTIAGRVGGAIWAPLLIALCFALLTAASYAELVTKYPRAGGAAVYAEKAFGKPLLSFLVGFSMVAAGVTSAAGLAVAFAGDYFQALLDWPAQWVCVAFLVTVGLLNARGIKESLSANLVMTVIELSGLLMVIAAAIWFVSQGQGVPQRVFELDSASPATAILGASLLAFYSFVGFETSANLAEEIKDVRKVYPRALFGALLAAGAVYILVGMGAAMVLPVEQLKDSQAPLMDVVSASGLGIPAPWFAVIALIAVANGALLTMIMASRLTFGMAREGLLPAVMGSVLPKRRTPGLAILATTLVAIALSFTSTLTILAETVVLLLLFVFLSVNIAVLVLKRDKVEAGHFQVHWVIPLLGILSCLLLLTQQGPETWLRAGIMLAVGAALYGLTRLGSSALASHPR

SEQ ID NO: 12025 - protein, 480 aa, Schisandra chinensis
  misc_feature (132)..(132): Xaa can be any naturally occurring amino acid
  misc_feature (478)..(478): Xaa can be any naturally occurring amino acid
NLGRITQIIGPVLDVAFPPGKMPNIYNSLVVKGRDTVGQQINVTCEVQQLLGNNRVRAVAMSATDGLMRGMKVIDTGAPLSVPVGGSTLGRIFNVLGEPVDNLGPVDTLTTSPIHRSAPAFIQLDTKLSIFXTGIKVVDLLAPYRRGGKIGLFGGAGVGKTVLIMELINNIAKAHGGVSVFGGVGERTREGNDLYMEMKESGVINEQNIAESKVALVYGQMNEPPGARMRVGLTALTMAEYFRDVNEQDVLLFIDNISRFVQAGSEVSALLGRMPSAVGYQPTLSTEMGSLQERITSTKEGSITSIQAVYVPADDLTDPAPATTFAHLDATTVLSRGLAAKGIYPAVDPLDSTSTMLQPRIVGEEHYETAQRVKQTSQRYKELQDIIAILGLDELSEEDRLTVARARKIERFLSQPFFVAEVFTGSPGKYVGLAETIRGFQLILSGELDGLPEQAFYLVGNIDEATAKAMNLEVESKXKK

SEQ ID NO: 12026 - protein, 303 aa, Oryza sativa Japonica Group
MTAGQPLRDDPQPRRHSPPALHPAVVPAYPPPESDADESWVWSQIKAEARRDADAEPALASFLYATVLSHPSLDRSLAFHLANKLCSSTLLSTLLYDLFVASLAAHPTLRAAVVADLLAARSRDPACVGFSHCLLNYKGFLAIQAQRVAHVLWAQDRRALALALQSRVAEVFAVDIHPAAAIGKGVLLDHATGVVIGETAVIGDNVSILHHVTLGGTGKAVGDRHPKIGDGVLIGAGATILGNVRIGAGAKIGAGSLVLIDVPPRTTAVGNPARLLGGKKGDDMPGESMDHTSFIQQWSDYSI

SEQ ID NO: 12027 - protein, 578 aa, Physcomitrella patens subsp. patens
MAVSSLVFIAPTSSSCGCSGIQYRALNLAHTARGRGLESSSSLYFFGGKLQTWKFVENAAKWRNAAGSLRVRCDAGVALVEQRVEEEQKQRLSSDFTTVMKFGGSSVASAHRMREVAQLILSFPDERPVIVLSAMGKTTNNLLKAGEKAVSCGVEESGNIEELQVIRDLHKTTARELKVDESLVTELFEELEQLVMGIALMKELTLRTKDYLVSFGERLSTRLFTAYLNSIGTYARQYDAFDLGIITTDEFTNAEILEVTYPTVRERLLKDLKADADRGTPICVVTGFLGKGVETGCVTTLGRGGSDLTATALGKALGLREIQVWKDVDGVLTCDPRVYSNALPVPFLTFDEASELAYFGAQVLHPQSMRPARDANIPVRVKNSYNPQAPGTLITGERDMSEAEMTSIVLKKDVTMLDIQSTRMLGQVGFLAKVFTTFEHLGISVDVVATSEVSISLTLDPSKLWERELIEQASQCLWLQQELDKMKSELSKIANVQLLKKKSIISLISNVKQSSAVLEKVFRVFKKNDINVQMISQGASKVNISMVVDDDDAPKCVQELHKVFWPDADEATERNGHV

SEQ ID NO: 12028 - protein, 550 aa, Oryza sativa Japonica Group
MESLRIAASHRPPLLLPSPHQLRRRHIAAVSLSLPHTSLSLSSHHHHHHRLAPTPLRRRIPPLLASQTPNPEADSPAPAGTKLAPLLVSLAVGLAVRFLAPRPPEVSPQAWQLLSIFLSTIAGLVLGPLPVGAWAFLGLTAAVATHTLPFAAAFSAFTNEVIWLIVISFFFARGFVKTGLGDRIATYFVKWLGGSTLGLSYGLTISEAFISPAMPSTTARAGGVFLPIIKSLSLSAGSKPNHPSSRKLGSYLVMSQFQAAGNSSALFLTAAAQNLLCLKLAEELGIIVANPWVAWFKAASLPAIASLLATPYLLYKIFPPETKDTPDAPALAAEKLERMGPVTKNEWVMIGTMLLAVSLWVFGDAIGVSSVVAAMLGLSILLLLGVLDWDDCLNEKSAWDTLAWFAVLVGMAGQLTNLGIVSWMSSCVAKLLESFSLSWPAAFCVLEASYFLIHYLFASQTGHVGALYSAFLAMHVAAGVPRVLSALALAFNTNLFGALTHYSSGQAAVYFGAGYLELPDVFRMGFVTALINILIWGVVGTFWWKLLGLY

SEQ ID NO: 12029 - protein, 471 aa, Halobacterium salinarum
MVDWTEKYRPASLSEVRGNDTARDALAEWAETWPDHREAVVVHGSPGIGKTSAAHALANDAGWDVVELNASDQRTADVVERVAGEAARSGTLTGGSGGRKLVLLDEADNLHGNIDRGGSAAITRLVDDAPQPIVLVANEYYEMSSSLRSACREIEFRDVSKRSIVPVLRDVCRREDVTYEEDALAAIAEQNAGDLRSAVNDLQALAEQDRTLTADDVVMGERDRTEGVFDYLDDVIATHSAREALQAAYDVDETPDDLLSWVADNVPKDYRGGELADAYEFLSNADVWLGRVRATQNYAYWRYATDNVAAGVAAARRHDHGGWTRYGPPSYWRKLGSSRATREKRDYVARHIAETAGCSMATARNDVLPFLRVLTHHCKNRELTVAMAAAYELDTEHVAFVTGSGETTNKVASIVADAEERRTDAAVDHSEGAFAGAVREDNTDEDSAADETTDGDEDTGADSQRGLDEFF

SEQ ID NO: 12030 - protein, 201 aa, Tropheryma whipplei str. Twist
MLPNVITCTRIAFAFPLFFLCLDKDFRWLTLCLFLIGMLTDGLDGFIARKYNSVSKFGALLDPIADKILVASVVLPLCILGEIPWWVFVVIFLREVSVTIFRLIVAKRKVISANTWGKAKTVVQTLAFSVALLPIFAAPDQMYSSNPSLSDYVGGLGDSVIFFPPISTGLSFVRTGLIFAAVFITACTGIVYCVAACRLKH

SEQ ID NO: 12031 - protein, 377 aa, Kluyveromyces lactis NRRL Y-1140
MYVHIFPTSYSQTSINRLIMKAQLFSKTPLLKHQFKRSKGPQVLLKYEFLQPSGSFKSRGIGHLISTKVEEIKKSSPEKIGHVFASSGGNAGLAAAVASLELNVPCTVVVSNATRPRIIEKIRSYGADVVVHGNHWKEADSFMKEHLMKKLDSFKYEPIYSHPFDNPLIWEGHSFMVDEIMDVLASSKIPITKIKGIVCSFGGGGLYNGLILGLQRYNLADKIPIVCVETKGTDVLSASLRVGAPVEFEKISSCATSLGTATISTTAYQNVKRHGSKSAVISDTEVISTCLQFSNDTNIVAEPGCGATLYFGYNIDKLQNILGSDIKDDDYVILIGCGGSSTSLEDLKELSSFTNCEFELPSTGVSRLNSHSLHTLQ

SEQ ID NO: 12032 - protein, 366 aa, Bacillus halodurans C-125
MALTTGIVGLPNVGKSTLFNAITQAGAESANYPFCTIDPNVGIVEVPDPRLQKLTELVNPKKTVPTAFEFTDIAGIVEGASKGEGLGNQFLSHIRQVDAISHVVRCFDDENITHVSGSVDPIRDISVINLELILADLESVDKRFSRVQKLAKTKDKEAVAELEVLEKLKDAFENEKPARSIEFTEEQQKIVKGLHLLTSKPVLYVANVSEDDVLSPDDNPFVQKVKAFAAEENSEVIVVSAKIEEEIAELDGEEKAMFLEELGIQESGLDQLIRAAYSLLGLQTYFTAGEQEVRAWTFRKGTKAPQAAGIIHSDFEKGFIRAETVSYNDLVEAGSMAVAKERGKVRLEGKEYVVQDGDVIHFRFNV

SEQ ID NO: 12033 - protein, 197 aa, Synechococcus sp. WH 5701
EIADSNPSKFFMPGQFDNPANPEIHFKTTGPEIWNDCDGAIDVFVAGVGTGGTITGVSRYIKNEAGKAIESVAVEPTNSPVITQTMNGEAVKPGPHKIQGIGAGFIPKNLDLSVVDKVEQVTNEESIAMALRLAEEEGLLVGISCGAAAAAAIRLAEQDAYAGKTIVVVLPDLAERYLSSVMFAEVPTGIIEQPVAV

SEQ ID NO: 12034 - protein, 454 aa, Haemophilus influenzae 86-028NP
MTMITPVQAILASNQHFLDRQDVMESNVRSYPRKLPFAYAKAQGCWVTDVEGNEYLDFLAGAGTLALGHNHPILMQAIKDVLDSGLPLHTLDLTTPLKDAFSEELLSFFPKDKYILQFTGPSGADANEAAIKLAKTYTGRGNIIAFSGGFHGMTQGALALTGNLGAKNAVENLMPGVQFMPYPHEYRCPFGIGGEAGAKAVEHYFENFIEDVESGVVKPAAVILEAIQGEGGVVPAPISFLQKVREVTQKHGILMIVDEVQAGFCRSGRMFAFEHAGIEPDIIVMSKAVGGSLPLAVLAIRKEFDAWQPAGHTGTFRGNQLAMATGYASLKIMRDENLAQNAQERGEYLTNALRELSKEYPCIGNVRGRGLMMGIDIVDERQAKDAIGAYPRDCELAAAIQKACFKNKLLLERGGRGGNVVRVLCAVNINQSECEEFIKRFKQSVVDALKVVRS

SEQ ID NO: 12035 - protein, 383 aa, Bacillus halodurans C-125
MIYLDQAASSFPKPKEVAEAMVAAVNEYGANPGRGGHRLATQARVTIDETRELLKTLFNAPSKKHVWFYQNATGALNQALFGFPFKEGDHVVSTALEHNSVRRPLEQLRERNGLVITYAQPDEEGIISPEKIAQACTDQTKAIVLSHGSNVTGAYLELEKIGEMAEAHGIVFIVDASQTAGVIDIDMKRDRISMLACAGHKGLLGPQGTGVLIVADDYGLTPLSYGGTGSYSELIDQPSQWPDRYESGTLNTPGIAGLKAGIEYVLDNGVAQIFAHEWALTERLLKGLGAQKVDVYGPPLPRKRLGVVSFRLSGFDSHEVALILDEHYQIAVRAGLHCAPMTHETLQTTDTGLIRVSVGPFNTEREVDQLLQAVMDIQQAFTS

SEQ ID NO: 12036 - protein, 174 aa, Brassica napus
MASASPTATLLKPNPPPPPHKPTVITASVSPPLRHTLLRRDLLSLTAASTLILTQSIIPFVAPSPASAAEDEEYVKDTSAVISKVRTTLSMERTDPNVADTVAELREASNSWVAKYRKEKALLGKASFRDMYAALNAVSGHYVSFGPTAPIPAKRKARILEEMETAEKALSRGR

SEQ ID NO: 12037 - protein, 431 aa, Schizosaccharomyces pombe 972h-
DPAWGFAVSWNYFLNYFVTCPLELTTCAITFKFWTEINSAAWISIFLAVVIVINLFGVRAYGEVEFILSTIKVIATVGFIILAIIINCGGVPTDHRGYIGGSIIKQKPFRHGFKGFCSVFTTAAFSFSGTEIIGLAAAEVGNPRKSVPSAVKQVFWRIAIFYVVSLILIGLLVSPDDPRLMGNGDVSVSPFVLAIQEANIKGLPSVFNAVIIISVVSVTNSTTYTAARTLQGMATLKQAPKFFSYTDRVGRPLIAMVVVLLFGFFAYINEADKNGSDISDTVFDWLLAISGLSSFFTWGSICLSHIMFRLAFKKQGHSLKELGFVSPMGIWGSVIGLGFNILCLMAEFYVSLFLIGGSPNANDFFQGYLAACIALAFFIGYKIYDRSHIPSLDKLDIDTGLKTYDNQDEEKEEYSSKGPLNILKKAWNAVC

SEQ ID NO: 12038 - protein, 638 aa, Xanthomonas campestris pv. vesicatoria str. 85-10
MIDTTRYPRLSRIQTPDDLRRFDEAELTAIAEELRSYLIESVGKSGGHFAAGLGVIELTVALHYLYQTPVDQLVWDVGHQTYPHKILTGRRDQIHTVKQKDGVAPFPKREESIYDTFGVGHSSTSISAALGMAIAAQRNGDDRKVVAVIGDGAMTAGMVYEALNHAGGMDPEPNLLVILNDNRMSISEAVGGLTKMLGRASGSRTLNAIREGGKKILGDKKNNPTARFVRRWEEHWKGMFVPSTLFEEMGFHYTGPIDGHDLPSLVGALKTLQTLKGPQLLHVITTKGKGYELAEGDQIGYHAVGPFDPSKGLVAKAGAKKPTYTDVFSDWVCDMAAAEPKLLVITPAMREGSGLVRFSKEYPQRYFDVAIAEQHAVTLAAGMATQGAKPVVAIYSTFLQRGYDQLVHDVAVQQLDVLFAIDRGGVVGPDGATHAGNLDLSFLRCVPHMVVMAPADEAECRQMLSTGVQYQGPAAVRYPRGTGPGVALDASLATLPIGKAQLRHSGTRIALLGFGATVDAAEAVGRELGLTVVNMRFVKPLDKAMLLELAKTHDGFVTIEDNVVAGGAGAGVSELLNAEAITMPMLHLGLPDSFQHHASREDLLAEAGIDQAGIRAAVLKRWPQLMTSKTPALNAAAG

SEQ ID NO: 12039 - protein, 290 aa, Streptococcus pyogenes MGAS8232
MDKLARIDEAIRRYYKTTSNGVSEELIDAILYSVDSGGKRIRPLILLEMIEGFGVSLQNAHFDLAAALEMIHTGSLIHDDLPAMDNDDYRRGRLTNHKQFGEATAILAGDSLFLDPFGLIAQAELNSEVKVALIQELSLASGTFGMVGGQMLDMKGENQALSLSQLSLIHLNKTGKLLTFPFKAAALVTEQAITVRQQLEQAGMLIGHAFQIRDDILDVTASFEDLGKTPKKDLFAEKATYPSLLGLEASYQLLTESLDQALTIFQTLESDVGFKPQIITKLIEGLRLNA

SEQ ID NO: 12040 - protein, 425 aa, Chlamydomonas reinhardtii
VVIASGEGCWLTTTDGRKLLDMASGIGAVSTGHCHPAVVAAVQAQAARVVHAQQNVVGAHTAMVDLFDRLSGVLPSSLDQYFLANSGAEAVDNAVKIAKAATGRPNVIAFEGGFHGRTLGAMALTSSKTIYRQGFGPTMAGVHIAPYPYCLHCKVSLPGPLQSLEWMLATQSAPSDTAAIILEPILGEGGFVAPPPGFLAGLRRLCDKHGILLIADEVQTGAGRTGLWWGHQHWLPDPSSASSPSSSAPANGGGPDLLVFAKGIASGYPLAGVATRRELVPAERMPPGTLGGTYGGNAVACAAAAATIDVINNERLTDNAQERGQQLREGLVKLASELPPGLIADVRGRGLMVGVEFGGVTDGGSAAPRFATPKKGASAARDMLLLTAGARESVRFLPPLTITAAEVDIALGVFGEAVREVAAKQ

SEQ ID NO: 12041 - protein, 490 aa, Helictotrichon convolutum
RPGVSTIDEKSAGRIDQIIGPVLDVTFPPGKLPYIYNALVVQSRDTSDKQINVTCEVQQLLGNNRVRAVAMSATDGLMRGMEVIDTGAPLSVPVGGATLGRIFNVLGEPVDNLGPVDSSATFPIHRSAPAFIELDTKLSIFETGIKVVDLLAPYRRGGKIGLFGGAGVGKTVLIMELINNIAKAHGGVSVFGGVGERTREGNDLYMEMKESGVINEKNIEESKVALVYGQMNEPPGARMRVGLTALTMAEYFRDVNKQDVLLFIDNIFRFVQAGSEVSALLGRMPSAVGYQPTLSTEMGSLQERIASTKKGSITSIQAVYVPADDLTDPAPATTFAHLDATTVLSRGLASKGIYPAVDPLDSTSTMLQPRIVGNEHYETAQRVKETLQRYKELQDIIAILGLDELSEEDRLTVARARKIERFLSQPFFVAEVFTGSPGKYVGLAETIRGFQLILSGELDGLPEQAFYLVGNIDEASTKAITLEEENKSKK

SEQ ID NO: 12042 - protein, 451 aa, Vibrio cholerae O1 biovar eltor str. N16961
MGFTSLGLSAPILKAIEEKGYNTPSPIQLQAIPAVLAGKDVMAAAQTGTGKTAGFTLPILELLAKGPKVRANQVRALILTPTRELAAQIQDNVMLYGRHLPLKSAVVFGGVKINPQMQRMCKGADILVATPGRLMDLYNQNAVKFDQLEILVLDEADRMLDMGFIRDIHKILKLLPEKRQNLLFSATFSTEIRELAKGLVNNPVEISVSPANSTARTVEQCIYPADVKKKPDMLVKLVKEGNWQQVLVFMRTKHGANRLATYLNEQGLTAAAIHGNKSQGARTRALADFKAGEVRILVATDIAARGIDIPQLPQVVNFELPKIAEDYVHRIGRTGRAGEVGKAISLVSAIEAPELFAIERLTQALLPRVNLAGFEPTNQLPESKLDTRPLKPKKPKKPKKVEGAGENKGSVAENKPKAGHRGQPTGQARTAKKGGTHSEPKKPTKRPVRNG

SEQ ID NO: 12043 - protein, 129 aa, Oryza sativa
  misc_feature (17)..(17): Xaa can be any naturally occurring amino acid
  misc_feature (45)..(45): Xaa can be any naturally occurring amino acid
  misc_feature (50)..(50): Xaa can be any naturally occurring amino acid
  misc_feature (64)..(64): Xaa can be any naturally occurring amino acid
  misc_feature (98)..(98): Xaa can be any naturally occurring amino acid
GWMGLDVGPDAVKIFTXALDTCYTIFWTAFMGVFEFDKFPVVSDXLPSSXADLTSSKGATTIVXGVTSGAAVQKLGLVARVSYISPSGGTILELFKGXPLPGVLDFDEASANSACFHLAVCTFVLGLFL

SEQ ID NO: 12044 - protein, 184 aa, Arabidopsis thaliana
MGRPGSQPNEAQPPPVQVQPTVNRDNQVHSQNGAIGQANIQTGRPVNNQTQNLWSSDLFDCMNDSENAVITCLAPCVTLGQIAEIVDEGATPCATGGLLYGMIFFIGVPFVYSCMFRAKMRNKYGLPDAPAPDWITHLFCEHCALCQEYRELKHRGFDPNIGWAGNVQAQQPVMSPPTGQRMMG

SEQ ID NO: 12045 - protein, 315 aa, Aspergillus oryzae
MITTTAIVAREPEEPLSINWTMEEVEVYTPGEGEILVEMRATGICHTDIVLSSVPAGTSGIQYPKILGHEGAGIVRALGQNVKSVEVGDPVLLSYYSCSSCASCQSAHPAYCEAFAGENYVGRQGGMKISKNGEEPWSKYFGQSSFARHSLASEISVVNVKDMIKSEDELKLFAPLGCGFQTGMGAILNSSNAGPDDVVMILGLGAVGMGALMTAKIRECKAIIVVDKVEARLEHAKRLGASHTINTGTPDKPNLKDAVRQLFPSGASVVIDTTGVPTLIEQSLQATQKRGKLVLIGVPPLGYELNVDVVQHINV

SEQ ID NO: 12046 - protein, 112 aa, Arabidopsis thaliana
  misc_feature (52)..(52): Xaa can be any naturally occurring amino acid
  misc_feature (76)..(76): Xaa can be any naturally occurring amino acid
RTRANRMRSSATMVEHPSQATRGTASNGRKASASLQTTRRATNDTTFITSNXHRDNWMQVCTAIEKNKFETLFYLXDTTDHKAAIKTDYHILNTSIASVEFKWEQTFVYLVH

SEQ ID NO: 12047 - protein, 274 aa, Rubrobacter xylanophilus DSM 9941
MSTSTSGRSEEAPEELHGFVCELARRAGELQLSRYEDPGRVREKGPKDIVTEVDLLCEELLVGAIRERYPQDAILAEEGGGEVSETGRTWLLDPVDGTANFSRANPLFCACVSVVEGGAVTHAAVAAPRLGDLYHARLGGGAYRDSGGRTERLRVSETGRLEDCFVAADLSFAKRRKSPHAAGLEALFSACWQFRSLGSAGIRGAWLAAGYLDISVGTNNTPWDYATTALLVAEAGGRVTDLSGGPWSLSSQTLIATNGAVHEAVLERLGAGRY

SEQ ID NO: 12048 - protein, 475 aa, Rhodobacter sphaeroides 2.4.1
MAKEPMLQFVKMARETPEKRPASLRSQDFHEIYREFAAATAAEQSSRCSQCGVPFCQSHCPLHNNIPDWLRLTATGRLQEAYEISQATNTFPEICGRICPQDRLCEGNCVIEQSGHGTVTIGAVEKYITDTAWENGWVVPGKPAYERSESVGIIGAGPGGLAAADALRRAGLQVTVYDRYDRAGGLLTYGIPGFKLEKDVVARRVEQLEQAGVQFVLNCNVGEDLSFDAIRGQHDAVLIATGVYKQRDLAAPGVGSAGVVQALSYLTASNRRSFGDEVDDDGLDANGKRVVVIGGGDTAMDCVRTAIRQGATSVKCLYRRDRANMPGSQREVANAEEEGVEFVWLSAPRGFIAGDAVEGVIVQKMRLGEPDATGRQMPEIIEGADYVEPADLAIMALGFEPEDLPTLWGVPDLTVTRWGTIKADFRTHATSLPGVYAVGDIVRGASLVVWAIRDGRDAAQSILDYLAQPAVVAAE

SEQ ID NO: 12049 - protein, 249 aa, Brassica napus
MKFNVANPTTGCQKKLEIDDDQKLRAFYDKRLSQEVSGDALGEEFKGYVFKIMGGCDKQGFPMKQGVLTPGRVRLLLHRGTPCFRGHGRRTGERRRKSVRGCIVSQDLSVLNLVIVKKGEKDLPGLTDTEKPRMRGPKRASKIRKLFNLTKDDDVRKYVNTYRRKFTNKKGKEVSKAPKIQRLVTPLTLQRKRARIADKKKRIAKANADAADYQKLLASRLKEQRDRRSESLAKKRSRLSSAAAKPVAA

SEQ ID NO: 12050 - protein, 217 aa, Methanococcus maripaludis S2
MVVIGEKFPEVEVTTTHGKLKLPEHYIESGKWFVLFSHPGDFTPVCTTEFVAFQKRYDQFRELNTELIGLSIDQVFSHIKWVEWIKEKLDVDIEFPIIADDRGELAVKLGMISPYKGNNTVRAVFVVDATGTIRAIIYYPQEVGRNMDEIVRLVKALQTADKGYATPANWPNNDFLNEKVIVPPANNMDARKKRLEACKSGELEGYDWWFCYTDLKE

SEQ ID NO: 12051 - protein, 236 aa, Triticum aestivum
ARGLEFVGDTCKKLLRLRIERGDDDPGQEEQGGVSQIGLTAVAVGCRELEYIAAYVSDITNGALESIGTFCKNLYDFRLVLLDKQNKIADLPLDNGVRALLRNCTKLRRFAFYLRPGGLSDVGLGYIGLYSGNIQYMLLGNVGESDNGLIQFAMGCTNLRKLELRSCCFSERALAVAVLQMPLLRYIWVQGYRASQTGQDLMLMARPYWNIEFVPPGPESAYRVMADGQPCVDTHA

SEQ ID NO: 12052 - protein, 223 aa, Xanthomonas campestris pv. vesicatoria str. 85-10
MQPTAIAPSILSADFARLGEEVNNVLKAGADWVHFDVMDNHYVPNLTIGPMVCQALRKHGITAPIDVHLMVEPVDRIVPDFADAGATTISFHPEASRHVHRTIQLIKSHGCQAGLVLNPATPVDILDWVLPELDLVLVMSVNPGFGGQAFIPSALDKLRAIRRKIDATGKPIRLEIDGGVKADNIGAIAAAGADTFVAGSAIFNAPDYAQVIAQMRAAVDAVR

SEQ ID NO: 12053 - protein, 405 aa, Corynebacterium glutamicum
MKGRPNVLAIVLAGGEGKRLFPLTEDRAKPAVPFGGTYRLIDFVLSNLVNSGFLKIAVLTQYKSHSLDRHISLSWNVSGPTGQYIASVPAQQRLGKRWFTGSADAILQSLNLISDEKPDYVIVFGADHVYRMDPSQMLDEHIASGRAVSVAGIRVPREEATAFGCIQSDVDGNITEFLEKPADPPGTPDDPDMTYASMGNYIFTTEALIQALKDDENNENSDHDMGGDIIPYFVSRNDAHVYDFSGNIVPGATERDKGYWRDVGTIDAFYECHMDLISVHPIFNLYNSEWPIHTTSEGNLPPAKFVRGGIAQSSMVSSGSIISAGTVRNSVLSNNVVVEEGATVEGAVLMPGVRIGKGAVVRHAILDKNVVVRDGELIGVDQVRDAQRFKVSAGGVVVVGKNQVV

SEQ ID NO: 12054 - protein, 122 aa, Streptococcus mutans UA159
MALNIENIIAEIKEASILELNDLVKAIEEEFGVTAAAPVAAAGAAGGEEAAAKDSFDIELTAGGDKKVAVIKVVREITGEGLKEAKGLVDNAPSVLKEGVAAAEAEELKAKLEEAGATVTLK

SEQ ID NO: 12055 - protein, 457 aa, Arabidopsis thaliana
MASLSQITLPRAPSSEIGLLRRRLERPIIRTRIGFNGRIASVLTNAGDQAVSVKASVSQKVIEEEAKVIVGTYARAPVVLSSGKGCKLFDPEGKEYLDCASGIAVNALGHGDPDWLRAVTEQAGVLAHVSNVYYTIPQIELAKRLVASSFADRVFFCNSGTEANEAAIKFSRKFQRFTHPEDKEVATGFIAFTNSFHGRTLGALALTSKEQYRTPFEPIMPGVTFLEYGNIQAATDLIRSGKIAAVFVEPIQGEGGIYSATKEFLQSLRSACDAAGSLLVFDEVQCGLGRTGLMWAYEAFGVTPDIMTVAKPLAGGLPIGAVLVTEKVAETINYGDHGSTFAGSPLVCSAAIAVMDKVSKPSFLSSVSNKGRYFRDLLVKKLGGNSHVKEVRGEGLIIGVELDVPASSLVDACRDSGLLILTAGKGNVVRIVPPLVISEEEIERAVEIMSQNLTALD

SEQ ID NO: 12056 - protein, 339 aa, Moniliophthora perniciosa
MVKVGINGFGRIGRIVLRNALQLQDIDVVAVNDPFIDLEYMVYMFKYDSVHGRFDGTVETKDGKLVINGKSIVVYGERDPAAIPWGSVGAHYIVESTGVFTTIEKASAHLKGGAKKVVISAPSADAPMYVCGVNLDTYDSSHTVISNASCTTNCLAPLAKVIHDKFGIVEGLMSTIHATTATQETVDGPSNKDWRGGHGINNNIIPSSTGAPKADSKVIPSLHGKLTGLSFRVPTPDVSVVDLVVRTEKACSYDDIKVAIKEAANGSLKGILTYTEENVVSTDFVGNNASSIFDATAGIQLNKNFVKLIAWYDNEWGYSRRVCDSCRRMTRRWADKWFN

SEQ ID NO: 12057 - protein, 373 aa, Pseudomonas syringae pv. syringae B728a
MDRFRESAAMNNNKLRIAAIAGDGIGLEVLPEGVRVVQAAAARHGLELEFEYFEWASCDYYLKHGKMMPDDWFEQLKGFDSIFFGAVGWPEKVPDHISLWGSLLKFRREFDQYANIRPVRLFPGVPCPLANRKPGDIDFVVVRENTEGEYSSLGGIMFENTENEFVLQESVFTRRGVDRILKFAFEMASKRERKHVTSATKSNGMAISMPYWDKRTEAMASQYPGISWDKQHIDILCARFVLQPERFDVVVASNLFGDILSDLGPACAGTIGIAPSANLNPERHFPSLFEPVHGSAPDIFGQNIANPIAMIWSGALMLEFLGQGDQRFTAAHDEIITAIEQVIANGDVTPDLGGTLSTQHVGAAIAERVSAGH

SEQ ID NO: 12058 - protein, 361 aa, Methylobacillus flagellatus KT
MKCGIVGLPNVGKSTLFNAITRAGIEAANYPFCTIEPNVGIVEVPDPRLKPLIEIVNPQKVQPAIVEFVDIAGLVAGASKGEGLGNKFLANIRETDAIAHVVRCFDDGNIVHVAGKVDPLADVETINTELALADMETVEKTLQRESKKAKSGDKEAIALCAVLEKVQQHLDQGHPVRTLGLDEDQLKLIKPLCLITVKPVMYLANVDEEGFDNNPLLEKVLELGKKESAPVVAICAKIESEIADLEDEDKAMFLAELGLEEPGLDRVIRAAYDLLGLQTYFTAGVKEVRAWTIRKGSTAPQAAGVIHTDFERGFIRAEVIAYDEYVKHKGEKGAQEAGKMRLEGKDYIVQDGDIMHFRFNV

SEQ ID NO: 12059 - protein, 223 aa, Silicibacter pomeroyi DSS-3
MKWNLPNILTLLRLLAAPGLAVMFLYFTRPYADWFALILFVSAAITDWFDGYLARAWKQETKMGAMLDPIADKAMVVIALMILVGYSTEHWTPWLVLPATVILFREVFVSGLREFLGDVAGTLKVTKLAKWKTTAQMIAIAVLFSQGIFEHYLVMSSFGMDQGIVDQIMAGEVADLQGLRWKLDGMIWSGRVGLWLLWIAAGLTLITGYDYLRKSMPHLKETR

SEQ ID NO: 12060 - protein, 223 aa, Streptococcus pyogenes MGAS8232
MDLLTNKKKIFETIRLSTEAANRTNDSVSVIAVTKYVDSTIAGQLIEAGIEHIAENRVDKFLEKYDALKYMPVKWHLIGTLQRRKVKEVINYVDYFHALDSVRLALEINKRADHPVKCFLQVNISKEESKHGFNISEIDEAIEEIGKMEKIQLVGLMTMAPANASKESIITIFRQANQLRKNLQLKKRKNMPFTELSMGMSNDYPIAIQEGSTFIRIGRAFFH

SEQ ID NO: 12061 - protein, 372 aa, delta proteobacterium MLMS-1
MKIDYYKTLGVGTDASMEEIKKAYRKLALQYHPDRNPGDQEAEEKFKTATEAYEVLGDLEKRKIYDRYGVDGLRDSGYQGPGGFDDIFSSFSDIFGDLFGFGGARGGSRRASGGPIPGNDLRYDLVISFMEAAHGVEKEVEISKGETCWTCEGSGARPGHPPESCSTCNGIGQVLHAQGPFRVQSACPHCRGQGRVVTEPCQDCQGQGLVKRSKKVSLKIPAGVDSGARMRLKGEGEGGRRGGPAGDLYVIIHVQPHDFFQREGYDIVCSLPLSFTQAALGCSLEVPTIYGSHKLKIPAGTQPGQHFTINEMGVAKLRGGGYGDMICEVRVVVPKRLTKKQKKLLKEFADSEEDPSDDAAKGDGFLKKFFHL

SEQ ID NO: 12062 - protein, 343 aa, Acinetobacter calcoaceticus
  misc_feature (246)..(246): Xaa can be any naturally occurring amino acid
  misc_feature (341)..(341): Xaa can be any naturally occurring amino acid
MKILITGGAGFIGSAVIRHIIQNTENEVLNVDKLTYAGNLESLLSVASNSRYKFSQTDICDRSALDQLFSSFQPDAIMHLAAESHVDRSITGPYAFIETNIIGTYQMLEASRCYWLSLDEEKKAAFRFHHISTDEVYGDLEGTTDLFTETTSYSPSSPYSASKASSDHLVRAWNRTYGLPVLITNCSNNYGPYHLPEKLIPMMILNALQGKSLPVYGNGQQIRDWLFVEDHARALFTVVTQGAVGXTYNIGGHNEKANLDVVHAICELLEEFAPNKPEGIATYKDLITYVKDRPGHDVRYAIDATKIKKELNWVPQESFETGLRKTVEWYLSNTEWVEHVXKW

SEQ ID NO: 12063 - protein, 635 aa, Candidatus Protochlamydia amoebophila UWE25
MTQSILSNLNHPNDIKNLSYSDLKYLAHEIRQRIIEVLSVNGGHLASNLGVVELTLALHKVFESPDDKFIWDVSHQTYVHKLLTGRNDRFHEIRQFKGLCGFSHPKESIHDHFHAGHAGTALSLALGVAKNRDLTKRKDYIIPIIGDATLTCGLTLEALNNISRELKRFIVILNDNAMSISKNVGAITHILSRLLSNPTTNKIHQELDTIVSKIPNYGPILSQQGHKITESLKNLVSPAVYFEQYGLSYIGPIDGHDTKKLVDVLEGVKDSNWPVIIHVLTRKGEGMDEAIKNPISYHGAKPFSKDTGKFLPNPVTKPTFPKIFGSHLLKMAEKDPSIVAITPAMSAGSCLDDFMKTFPERCIDVGIAESHAITFAGGMAYGGKMKIVASIYATFLQRAFDNVFHDICLQELPVVFAIDRAGISGPDGSTHHGIYDISFLNAMPNMIIAQPRNGQVLKELMESAFSWKRPTAIRYPNLMTEEFNHPICERELGKGEVLIEGTEILIVALGHMNQAALKVRDLLAQTGIEATVLDPIFVKPLDSELFCKLLLNHNKIVTIEEHSVVSGMGSIINNFLVGQGFNQIQVLNLGIPEAFLDHGRNQDLLNEIGLVPEKIFRQIQSHFNLIAQNTLNPVA

SEQ ID NO: 12064 - protein, 369 aa, Pseudomonas syringae pv. syringae B728a
MAFDRIEDIIEDYRQGKMVLLVDDEDRENEGDLLLAADCCSPQAISFMAREARGLICLTLTDEHCQRLGLEQMVPSNGSVFATAFTVSIEATTGVTTGISAADRARTVQAAVNPHAVPEDLVQPGHIFPLRARDGGVLTRVGHTEAGCDLARLAGFTPASVIVEVMNDDGSMARRPDLEVFAKKHGIRIGTIADLIHYRLSTEHTIVRIGERELPTVHGTFRLFSYEDRIEGGVHMAMVMGDIRRDAATLVRVHVVDPLRDLVGAEYNGPANWTLWAALQRVAQEGHGVVVVLANHESSQALLERIPQLTQPPRQYTRSQSRIYSEVGTGAQILQDLGVGKLRHLGPPLKYAGLTGYDLEVIESIPFPG

SEQ ID NO: 12065 - protein, 296 aa, Acinetobacter calcoaceticus
MSLKRKGIILAGGSGTRLHPITKGVSKQLLPIYDKPMIYYPLSVLMLAGIREVLIISTPEDLPNFEKLLGDGSQFGIELSYKVQPSPDGLAQAFLIGEEFIGTDPVCLILGDNIYYGQHFSQQLEAASALPNGATVFGYHVTDPERFGVVEFDNTGKVLSIEEKPLKPKSAYAVTRLYFYDNRVVEFAKQVKPSARGELEITDINNAYLNDGSLNVELLGRGFAWLDTGTHESLLEAGQFIYTIEKRQSFKVACLEEIGFHQGWISKEQLLDSAEALKKTEYGQCLKKVWEESNEG

SEQ ID NO: 12066 - protein, 668 aa, Ustilago maydis 521
MHASQFMIHDYASEARLDGEIGSKEQQPTSMHGEVVLCLTHDSRLYLCTIHDSRFTIRLTHASTLSKVNAVSKPSLTQNHVAYGLRRTAEITKYESQSRIVNSRLVGEQTNVDDCGKREEVKTRRPNHRRENHEITNHESRITNHESRIVKSWMTRGPGSSARTDALKSRTRTHVEHLHEASSARMTRVLSATWFHLPKRLLPTIGRSIMTSCSAADRTRWATHRAQRIHQELDSGVDVWSLFNPVVFPTAINLGQGFMNWQPPSYILDTLTHEFANRVDLHHYSHPKGRARLRQAISDFYSSQFHLPRGAAEEVPIEVGKQRAAGHRKLDVETEIQITSGANGGIYSVMGAFINDGDGVVCIEPFFDQYNAEILFHGGKPLYVPLLPPAASGTSHIDANDWTLDMAHLERVLSQASTKALILNTPHNPVGKVFSHAELASIAELCVKYDILVVADEVYDCLTFDGQPHTRIASFSGMWDRSVTVGSAGKSFACTGWRVGWLIGPDHLIAPSRAVHTRITFAVNSSAQEGAAIGLESADSHHFFQSQINQYAHRRQLLSNALDQIGLSYTIPHGGYFIMADATKIQIPDTWIESNNVPDAILNKPQDYLKAWFIAKVCDVVVIPATAFYAEKGAEQVGKNYVRFSFCKDDQIEQAAPRLKKLIPYLTK

SEQ ID NO: 12067 - protein, 436 aa, Vibrio parahaemolyticus RIMD 2210633
MSTETKKMSVVQLTILTFINMAGSGIIMLPSKLAQVGTISVLSWLITAAGSLALAYVFAKCGRFSKRDGGMNGYASYAFGKSGAFMAGWTYGLSLLIANIAIAITCVGYGSAFFEVTLSPVETCLYTIAILWICTFANFGGAKITGQIGTFTVWGVILPVCSLGIVGWFWFNPTMYIEAWNPHSLPFGEAVSASIAMTLWAFLGLESACANSEAVENPEKNVPIAVLGGTLIAAVVYIVSTNICSGIVANSELAASTAPFSTVWTVMLGSAAGKVVAGMAVLACAGSLLGWQFTIASVFKSSSDAGFFPKLFSQVDKRGTPIKGMIAITIIQSVLSLMTISPTLNEQFEALVNLAVVTNVIPYILCMGAIFIMQQVAHVPEREMKTTNVIALIGSLYSFYALYGSGYEAMMWGSIVTFLGWSAYGLIAAKHEPLAN

SEQ ID NO: 12068 - protein, 361 aa, Schizosaccharomyces pombe 972h-
MVIRSGASEVGRSLSLLTRDLRHMMEPHTAIRLKERKANKIKDYLTMAGPLGVTHLLVLSRTDNNANLRIIRAPRGPSLHFRIHEYMLNKDVRRLQKNPKSPTTEFLTPPLLVMNHFNQNSSKDSPHEALLTTTFQNMFPPISVQHTNINSVKRVLLLNRRDDGYIDLRHFIISTKPVGISRPIRHLLKGEKKDSDIPDLHNVRDISDYVLHGDGISGAASDSEIEEDATVEIDRPVPTKTEENLLSASQLLKPKQQAIKLIEIGPRMTLELIKITEDAMGGKVLYHSHVHKSKEEIKQQDNFHEQSRALKEKRKKEQDENVRRKRENKKRRKDQKKEGITSSNKNDDSGNEGSSAYSDTE

SEQ ID NO: 12069 - protein, 465 aa, Buchnera aphidicola str. APS (Acyrthosiphon pisum)
MATGKIIQIIGAVVDVEFNQDSVPKIYNALEVKNKQYKLILEVQQQLGSGVVRTIAMGSSNGLKRGLIVTDLGHYIKVPVGEATLGRIINVLGETIDNKGALKNNQSDKIEYWEIHRSPPSYRDQASCREILETGIKVIDLICPFSKGGKVGLFGGAGVGKTVNMMELIRNIAVEHSGYSVFTGVGERTREGNDFYHEMNDSQVLDKVSLVYGQMNEPPGNRLRVAFTGLTIAEKFRDEGKDVLLFIDNIYRYTLAGTEVSALLGRMPSAVGYQPTLAEEMGLLQERITSTKNGSITSVQAVYVPADDLTDPSPATTFAHLDSTVTLSRQIASLGIYPAIDPLNSTSRQLDPYIVGDEHYETALGVQSILQRYQELKDIIAILGMDELAEKDKLLVSRARKIQRFLSQPFFVAEVFTGFPGKYVSLKDNIRAFKGIIKGEFDDLPEQAFYMVGSIEEVIEKAKKL

SEQ ID NO: 12070 - protein, 297 aa, Rhodobacter sphaeroides 2.4.1
MTTNKVTKAVFPVAGLGTRFLPATKSIPKEIMTLVDRPLIQYAIDEARAAGIKEFIFVTSRGKSALEDYFDNAPELEAALKKPGKEHLLDVLESTNMESGAIAYVRQHKALGLGHAVWCARRLIGDEPFAVMLPDDVIAAEKPCLQQMVEAYEQTGGNMVAAMEVPPEKASAYGVLSVAEDMGSIVKVNGMVEKPKENPPSNLAVIGRYILTPQVLNNLNRKKEGAGGEIQLTDAIAEEIDESGKVYGFRFRGQRYDCGSKAGFLQATVAFGLARPELRDEFSGYLHDMLALEKAAQ

SEQ ID NO: 12071 - protein, 228 aa, Staphylococcus epidermidis RP62A
MPKLILCRHGQSEWNAKNLFTGWADVKLSKQGIEEAQSAGKKIYGNQIEIDIAFTSLLTRALETTQYILAGSDQQWIPVYKSWRLNERHYGGLQGLNKDDARKKWGEDQVHQWRRSYDVRPPRESEEQREAYLKNRRYQHIDHRMMPYCESLKDTLERVVPFWTDHISQHLLDDKTVLVSAHGNSIRALIKYLEGLSEEDIVGYEIKTGAPLVYELTDDLVVKDKYYL

SEQ ID NO: 12072 - protein, 120 aa, Streptococcus mutans UA159
MDKIILKGCRFYAYHGVFSEEKTLGQIFTVDLELSLDLKAASKTDKLEDTVNYGQVFSVLKSRIENSQYTLIERLAGVICEDIFEQFSPVRAIKICITKENPPIAGHYDRVGIELKRERS

SEQ ID NO: 12073 - protein, 276 aa, Glycine max
MGLPASPGAATRKVVFSAEEAKLQAENGNKVELMRPETSPEDIEGMVASEALVTTHGDGSAGDLYLRAIETVNAEHSEEFDQFLTWSEEIARLQARMNAETPQDIKAGYNFGSKRIGLVRTEHMFFGPERLIEMRRFILASNHDERVQALEKIKTYQVEDFETIFRLSQDRPTIVRLLDPPLHEFLPSSEEDINNVSQQLNVSSEFLRKRIVDLNEVNPMLGHRGCRLAVTYPELYEMQVEAIIESVIKLQKEGITCLPEIMIPLVSTVEEFTTLK

SEQ ID NO: 12074 - protein, 213 aa, Brassica napus
  misc_feature (202)..(202): Xaa can be any naturally occurring amino acid
MATNIGMMDSAYFVGRNEILGWINDRLHLNLSRIEEVASGAVQCQMLDMTFPGVVPMHKVNFAAKNEYEMIQNYKVMQEVFTKLKITKPLEVNRLVKGRPLDNLEFLQWLKRFCDSINGGIMNENYNPVERRSRGGKEKSIKGSSKVSKSLQTNNTHHTPTVTASSKPTGPKQARSHAIGGGSNSSAEVQALSKELEDLKVXVDVLEKERDFY

SEQ ID NO: 12075 - protein, 311 aa, Methylobacillus flagellatus KT
MMVFTGNANRALAEEVVSHLGIALGRATVDRFSDGEVMIELLDNVRGKDVFILQSTCMPTNDHLMEVMVMVDALRRSSAARITAAIPYFGYARQDRRPRSARVAITAKVIANMLTTVGVNRLLTMDLHSDQIQGFFDIPVDNIYATPILLQDLTQQNHDDLVVVSPDVGGVVRARAAAKHLNVDLAIIDKRRPKPNVAKVMNIIGDVSGRTCVLMDDMVDTANTLCEAAIALKQQGAKKVVAYCTHPVLSGEAVSRITNSELDELVVTNTIPLRPNAQQSPKIRVVSAGELFAETIRRISNEDSVSSLFVE

SEQ ID NO: 12076 - protein, 518 aa, Chlamydomonas reinhardtii
ATAVKLLLLPTYRSTDFEVHRNWLAITHSLPLSKWQADGYVDATSVWTLDYPPLFAWFEWALSQAAAAVDPAMLRVVNLDHDSAATVAFQRGSVIVTDLVLLLAAFWLARSSAAALAGRRGVALFALLALNAGLLLVDHIHFQYNGAMMGVLLLSLAAARTGRHLLSGVLFAVLLNMKHLFLFAAPVYFVYLLRHYCFETTGGSSSSGSSGAQGNWAARGLTRLAVLGAAVIAVFAASFGPFIHTHQHIPQVFGRLFPFGRGLLHAYWAANAWAPYAAADKLLVLAAPALNRQLGWAALRVDAEAVGSANLAGGLVKVQRFAVLPQITPSITAAAVLMALVPCLVGLSRQHVRRVFARALAYSCLCGFVFGWHVHEKAIIVALLPLAVDAVCSRLAARRFLVLSTAGHYGLLPLLFRPEEYGTKVLLVASYFAVAATALGALHGDAASPHARAARTGGKRNAGLALGWLQRAYLVGFVAVELYCSVVHERVPALRERLPFAPLMLTSVYCSLGVLGVW

SEQ ID NO: 12077 - protein, 153 aa, Zea mays
MDYSNLRRQAASMKKTLFDQGYLDEQFCQVEDLQDEASPNFAEEVVTLFFKDSARLISNAEQALEKYPKDFNRWDAYMQQLKGSCSSIGASRMKSECVSFRDYCGQGNVEGCMRSFQKVKREHGALRQKLEAYFQLLRQAGPAGAATRPGCKN

SEQ ID NO: 12078 - protein, 355 aa, Vibrio angustum S14
MKKNLICLGILVAGLSFQSSSFAQGTELPNIKILATGGTIAGAGQSATGSAYTSGQIGIDALINAVPEMAKIADISGEQVANIGSQDMNDQVWLTLAKRVNELLAKDDVDGIVITHGTDTMEETAYFLNLTVKSDKPVVLVGAMRPSTAMSADRPVNLYNAVITAADTDSKGRGVLMAMNDVILDARDVTKTSTTAVDTFKSPNFGELGYIHNGDAVYQRSPERHNTKDSKFDISKVKALPKVGIVYNYSNASDLPVKALIDAKFDGIVSAGVGNGNIYKGIFEQLAKASKDGIMVVRSSRVPTGATTLAAEIDDSKYGFVASGTLNPQKARILLMLSLTQTNNYRDVQKMFQYY

SEQ ID NO: 12079 - protein, 401 aa, Oryza sativa Japonica Group
MVGQDLIVCLDPEVNSFVFQQEERLFQCWYPDSFMRIIGADNIITTLGSSHKYIRNLILRLFGPENLRRAMLQDVHRTAQASLLSWLDRPSIELKDAVSSMIFSVTAKKLISYDSLASDGKMWKQFDAFIRGLLAFPIGIPGTAFYKCMQGRKNIMKMLKELIDERKEASGRRGSIDFIDVLLEELNEEKPLISENVALDLIFLLLFASFETTASAITAVVRFLTDNPEALQELAEEHDNIQKRRVDLNSEITWEEYKSMKFTSHVIHEALRLANIAPVMFRKATEDVHIKGFFIPKGSKIMICPSTVHLNPMIYKDPNIFNPWRWKDTAEPTGGASKDFMAFGGGLRLCVGADFAKLQTAIFLHCLVTKYRWKAIKGGTMVLGPGLRFPEGFHIQLFPKP

SEQ ID NO: 12080 - protein, 180 aa, Bacillus pumilus SAFR-032
MAERFVGKQAPRFEMEAVLANKEFGKVSLEENMKNDKWTVLFFYPMDFTFVCPTEITAMSDRYDEFEDLDAEIIGVSTDTIHTHLAWINTDRKDNGLGELKYPLAADTNHTVSREYGVLIEEEGIALRGLFIINPEGELQYQTVFHNNIGRDVDETLRVLQALQTGGLCPANWKPGQKTL

SEQ ID NO: 12081 - protein, 184 aa, Brassica napus
  misc_feature (15)..(15): Xaa can be any naturally occurring amino acid
  misc_feature (38)..(38): Xaa can be any naturally occurring amino acid
NFGLFDFDIWLSAVXHTTFPSLSLQFTPLLSHYIPNKXMKKIKYENTEREAILKRPASMATAAAARSTPAKQIALIDGLPDHISEICLSLVSRPSLLAAVCTRWRRLVYSPEFPPFSSLYALFVASSSDPTPGLRRVNSAIRLMCFDPVSSKWDPLPPPPPELPLNRIIYRHPSYISFNLPIQC

SEQ ID NO: 12082 - protein, 847 aa, Bordetella pertussis Tohama I
MDIGFLVFGLAGLLTLVCFMPPLAGRLKLPYSVLLALVGCLLGIGVHLHGWAPPVLGDLLDTIEHFEISSETFLMVFLPVLLFETALSMNVRRLIDDIGPILMMAIVAVVVCTLVVGFAVDAVSSYGLIVCLLLGAIVATTDPAAVVGIFREVGAPKRLTTLVEGESLFNDAASIALYSVLLAALGGSGELSVGAVFNDFIFHFVGGGLAGFLMGRLACALFAWLRGFPTAEITLTLTLAYLSFFISEHYLGVSGVVATVIAGLVVDSTGRTRMSPTTFEFLSSAWGQFGFWANSLIFLFAAMLIPKLMAEADWQELLLVLVVFAATLAARAIVVFGLLPLLRVARIGAEVSNPYKSVMWWGGLRGAVSLALALAVTEQSSVPEQARQFVAVATTGFVLMTLMINGVSLRPLIRMLGLNQLSPVERTIRNQVLAAALEDLQGRTEEIAKVDHVNPEARDRIRAMFDASLTSVHDGQVGQMTLDQRVAVGLSIVARREEEMFFDILKAQIVDWRLAEGLLARAERLEDAVRAGGLAGFEAGIVADVRYWRLFRMALRTHYMFGFQGWLARELGKRFASLLTKRSVARDLMKFAREQVAPLLGEEAADRIIAAHQRRLDLIENALQALTLQYPSYSLWLQESHLGRVARELERRRYRDMLEQFLISGEVYADLMAQLKARWQHIDKHPPLDIELGSAELVKRVPLFEGLSQDSLRAICRLLKPRLALPDQHILTEGRHGQEMCIVASGAVVVHLPDHTTIELGSGEFFGELALLGEEQLVPDVTSLGYSKLLMLSARDFHALLARDEHLHERIQTVAKQRMRAIEVWKQYSQAAAAAAASTASEDSAPA

SEQ ID NO: 12083 - protein, 493 aa, Pseudomonas syringae pv. syringae B728a
MSLTRFQMCIDGQWVDALSGKTFDSLDPALAEPWAQLPDADEADVERAVQAAQKAFEGQAWRGLTATARGKLLRKLGDLIAENKEQLAQLESRDNGKLIRETRGQVGYLPEFFHYTAGLADKLEGGTLPLDKPDLFAYTVHEPMGVVAGIIPWNSPLYLTAIKLAPALAAGNTIVLKPSEHASATVLELARLALEAGIPPGVVNVITGYGPTTGAALTRHPLVRKIAFTGGAATARHVVRSSAENFAKLSLELGGKSPNIIFADADLDSAINGAVAGIYAASGQSCVSGSRLLVQDEIYDEFVERLAERASRIRIGNPQDEGTEMGPMATAQQLAVVEGLVADALAEGARLRLGGKRPELDSKGWFYEPTLFECDHNSMKIMQEEVFGPVASVIRFKDEAEALAIANDSQFGLAAGIWTRDLGRAHRLARDIRSGIIWVNTYRAVSAMAPIGGFKNSGYGRESGIDSVLAYTELKTVWINLSQAPMPDPFVMR

SEQ ID NO: 12084 - protein, 379 aa, Pseudomonas syringae pv. syringae B728a
MKAIVYSGPRDVSVKNVPDAKIQKPTDALVRVTSTNICGSDLHMYEGRTSFETGRIFGHENLGQVIEVGAGVDRIKVGDWVCLPFNIGCGFCENCEKGLTGYCLTANPGSAGAAYGFADMGDHEGGQAELLRVPYADFNCLLLPEDAAEREEDYVMLSDIFPTGWHATELAGLLPGESVAIYGAGPVGLMAAHSAMIKGASQVFVVDNHPDRLALAAKMGATPINSLEQGAVDQILNLTDGKGTDRGCECVGYQCCDRHGHEANHVTMNNLVASTKATGGIGVVGVFVPQDPGAKSDLAKEGKMAFDFGSFWFKGQQIRTGQANVKAYNRRLAELIHHGRAKPSQIISHRLKLEEGPDAYKHFDARDEGWTKVVLKPGA

SEQ ID NO: 12085 - protein, 157 aa, Dehalococcoides ethenogenes 195
MRIGNGYDVHRLAPGQKLVLGGVEIPFECGLIGWSDADVLTHAIMDSLLGAAALGDIGLYFPPGDPKFKGISSLKLLEQVTALLAEKGFGIINVDSVIVAEEPKLRGHVDTMRKHLAKAMGIDPGRVGIKASTSEQLGFVGREEGMAAWAVALVDEK

SEQ ID NO: 12086 - protein, 421 aa, Schizosaccharomyces pombe 972h-
MAFRGIRPSNKVAASRPDVWTLVNQATAECKVPPVSLSQGFFNYNPPKFVLDAAKKSIDEVACNQYSHTRGRPSLRKALSEAYSPYFKRTLNPDTEIVVTAGANEGFFSVFAAFLNPGDEVIVMEPFFDQYISNITMNGGVPVYVPIIPPEEGSVKPVSAGAWKLDMNKLRNAITEKTKMIVINTPHNPLGKIFSEEELNEIADLVLKHNLLVVSDEVYDRLSFVPFVRLATLRPELFKHVVTVGSGGKTFGCTGWRVGWLIGDESLIKYSAAAHTRICFAVNSPCQEALAIAFGEAEKHNYYEEYKSSYKKRFEILAKAFDQLEIPYTIPDGSYYTMANFSKLKLPKDYPFPEEIANRPRDFKLCYWILKEIGVATIPPTEFYTDEDAPVAENYLRFAFCKTFETLEEAARRLQKLKDYF

SEQ ID NO: 12087 - protein, 490 aa, Parapholis incurva
RPGVSTIEEKSKGRIDQIIGPVLDVTFPPGKLPYIYNALVVQSRDTADKQINVTCEVQQLLGNNRVRAVAMSATDGLMRGMEVIDTGAPLSVPVGGATLGRIFNVLGEPVDNLGPVESSATFPIHRSAPAFIELDTKLSIFETGIKVVDLLAPYRRGGKIGLFGGAGVGKTVLIMELINNIAKAHGGVSVFGGVGERTREGNDLYMEMKESGVINEENIEESKVALVYGQMNEPPGARMRVGLTALTMAEYFRDVNKQDVLLFIDNIFRFVQAGSEVSALLGRMPSAVGYQPTLSTEMGSLQERIASTKKGSITSIQAVYVPADDLTDPAPATTFAHLDATTVLSRGLASKGIYPAVDPLDSTSTMLQPRIVGNEHYETAQRVKETLQRYKELQDIIAILGLDELSEEDRLTVARARKIERFLSQPFFVAEVFTGSAGKYVGLAETIRGFQLILSGELDGLPEQAFYLVGNIDEASTKAITLEEENKSKK

SEQ ID NO: 12088 - protein, 405 aa, Glycine max
  misc_feature (59)..(59): Xaa can be any naturally occurring amino acid
  misc_feature (126)..(126): Xaa can be any naturally occurring amino acid
QVKNLNLLRPQFSAMANSHLSTPSELFSRQHKPPRVPNLIGGSFLDSKSLTFIDVINPXEEFKAAVSAAKKAFPSWRKTPITKRQRVMLKFQELIRRDMDKLALNVTTEQGKTLKDAQGDVFRGLXVEHACGMATLQMGEYVSDVSSGIDTYSIREPLGVCAGICPFNFPAMIPLWMFPVAVTCGNTFILKPSEKVPGASVMLAELAMEAGLPEGVLNIVHGTHDIVNAICDDDDIKAISFVGSNVAGMHIYARAAAKGKRVQANMGAKNHAVVMPDASVDATVNALVAAGFGAAGQRCMALSTVVFVGDSKLWESKLVEHAKALKVNVGTEPDADLGPVISKQAKERIHRLIQSGVESGARLVLDGRNIVVALIFSFIFIISYFIHGHFHTFSCMINLPLQSLA

SEQ ID NO: 12089 - protein, 476 aa, Pseudomonas syringae pv. syringae B728a
MYPDVQLYIDGQWRASRDNRTLSVINPATGEALGAVAHAGIADLDEALAAAERGFATWRATSAYDRYKLMQKAANLVRERADSIARIMTQEQGKPLAEARMETLSAADIIDWLAEEGRRSYGRLVPSRNVSIEQKVIKEPVGPVAAFTPWNFPINQVVRKLSSALAAGCSIIVKAPEETPASPAELIRAFADAGVPAGVIGLVYGDPAEISGYLIPHPVIRKVTFTGSTPVGKQLAALAGKHMKRATMELGGHAPALVFDDADIDLAARVLATAKFRNAGQVCVSPTRILVQRKVLDAFTEKFVGLTREIKVGNGLEAGTTMGPVANDRRIPALVDLIDDAVRGGATLSAGGKAGEGPGYFFEPTVLSGLKPHMRIMNEEPFGPVALLVPFDTLEEAIAESNRVPFGLASYAFTTSMKTAQALSTYIEAGMLSINHQGIGLPEVPFGGIKDSGYGSEGGTEAIEAYLNTKLVTQYN

SEQ ID NO: 12090 - protein, 380 aa, Schizosaccharomyces pombe 972h-
MNNPFKDMDCYEILQVNHDSDLQEIKANYRKLALQYHPDRNPGIEDYNEIFSQINAAYNILSNDDKRKWHEKDYLRNQYSVQIEDVLQHLQTIEKIPFESTSAFVERLRQDEKIAGSTDDLPTLGDTTWLWTYAKPIYQKWLRFSTKKSFEWEALYNEEEESDAATRRLMKRQNQRQIQYCIQRYNELVRDLIGKACDLDPRRKNVVKLSDGERYNSLQEASRKQSERDRRQYQETFKNQSIASWTIIDQEETSSDDESLSKEIVNSNPIMCMVCNKNFRSQNQLENHENSKKHKKNLRKMNQEIKKHAKEAQKNAESNKQPEDAPSESPYSNKVSSSDFYTRSFEEIEKTFTFVEISDNEFYTASEDGFLNEDDKLDQD

SEQ ID NO: 12091 - protein, 575 aa, Lactococcus lactis subsp. lactis
MTTMLKGIAASSGVAVAKAYLLVQPDLSFETKTIADTANEEARLDAALATSQSELQLIKDKAVTTLGEEAASVFDAHMMVLADPDMTAQIKAVINDKKVNAESALKEVTDMFIGIFEGMTDNAYMQERAADIKDVTKRVLAHLLGVKLPSPALIDEEVIIVAEDLTPSDTAQLDKKFVKAFVTNIGGRTSHSAIMARTLEIPAVLGTNNITELVSEGQLLAVSGLTGEVILDPSTDQQSEFHKAGEAYAAQKAEWAALKDAETVTADGRHYELAANIGTPKDVEGVNDNGAEAIGLYRTEFLYMDAQDFPTEDDQYEAYKAVLEGMNGKPVVVRTMDIGGDKTLPYFDLPKEMNPFLGWRALRISLSTAGDGMFRTQLRALLRASVHGQLRIMFPMVALVTEFRAAKKIYDEEKAKLIAEGVPVADGIEVGIMIEIPAAAMLADQFAKEVDFFSIGTNDLIQYTMAADRMNEQVSYLYQPYNPSILRLINNVIKAAHAEGKWAGMCGEMAGDQTAVPLLMGMGLDEFSMSATSVLQTRSLMKRLDSKKMEELSSKALSECATMEEVIALVEEYTK

SEQ ID NO: 12092 - protein, 424 aa, Triticum aestivum
SRVVQPLFSRQLTTSIRRYFDLHEYQSKDIMRKYGVLVQRGDIATNPQQAYQVAKNLNVKEGDLILKAQVQAGGRGKGRLSSGLRGGVQILKTPEEVRNLSTLMFGYNLTTHQTTGDGLTVNAVLIHEGVDIVRQIYLAFILDRNSQRPAIVASIEGGMEIEEVAKKNPDAVKLYPFEYHTGPTDAILNSLEKDLQLQDVPGFREQIHNLYKLFQSTDCVQLEINPWAVNPKKEIYSVDAKIGIDDNAKFRQKELFDLKKTSLASEDVDPHEDKAIAAGLNYVALDGNIGCMVNGAGLAMATMDIIKLKGGEPANFLDVGGGANVQQVKTAFEILSSHPKVKTILINIFGGIMKCDTIANGIIKAAEQVNLKIPLVCRLTGTNAKEANALLEEFTKNHTHLKIVVASDLDDAAVKAVATVRSQK

SEQ ID NO: 12093 - protein, 488 aa, Pseudomonas aeruginosa PAO1
MNAVAPLIPCIVSGGSGTRLWPVSRESMPKPFMRLADDQSLLQKTFLRIAGLPDVARLLTVTNRDLLFRTLDDYRAVNRSGLAQDLLLEPVGRNTAPAIAAAALHVQEHFGDQAQLLILPADHLIRDEQAFAAAVAEARGLAAQGYLVTFGITPERAETGFGYIEQGAPLGNGFRVARFVEKPDQATAQSYLDSGKYLWNAGMFCFQAATVLQELERHAPEVLIAARAALADGSSLENGQCRQRELAAGAFAEAPDISVDYALMERSDKVAVVPCSIGWSDIGSWQALRELSAADENGNQVRGESVLHDVSNCYIDSPKRLVGAVGVHDLIIVDTPDALLVADAARSQDVKFVAQELKRRGHDAFRLHRTVSRPWGTYTVLEEGRRFKIKRIVVRPKASLSLQMHHHRSEHWIVVSGMALVENGEREFLLNTNESTFIPAGHSHRLSNPGIIDLVMIEVQSGEYLGEDDIVRFNDIYGRAPASDEKKA

SEQ ID NO: 12094 - protein, 549 aa, Oryza sativa Indica Group
MQAWFSGTGPSASSASSSSSPPQPSLLAEWNSYAAARSAEEEEDGGGGGFGIDIEAAVRSANDRVSGTFGVVSKGVLGLPGSFKSTTSSVPSSKSLVYFGLFLASGIFLVFIAFTIFLPVMRLPFTMGFVGSMAATIYVSMVLHSYILSVFFSCLQNLTGILGGMARLPYPGTGDGVFAAHGYLRFGLGIWYILSLSLSAYELIKTAKYIATPGKGILAADESTGTIGKRLASINVENVEPNRQALRELLFTTPGAFQYLSGVILFEETLYQSTAAGTPFVDVLKAGGVVPGIKVDKGTVDIAGTNGETTTQGLDSLGARCAKYYEAGARFAKWRAVLKIGAAGEPSELAVKQNAEGLARYALICQENGLVPIVEPEILTDGAHDIKTCAAVTERVLAAVYKSLNDHKVLLEGTLLKPNMVTPGSDSPKVGAEVIGEYTVAALRRTVPPAVPGIVFLSGGQSEEEASQNLNAMNKLEVLKPWTLTFSFGRALQQSTIKKWGGKKENVAAAQAAFLARCKANSEATLGKYGGAAGDAATSESLYVKGYTY

SEQ ID NO: 12095 - protein, 421 aa, Oryza sativa Indica Group
MGAKDSKPSYSYSSSYDYGNSSSGYNSRYPAYPANASSSQNTRYAPSMENYVQPETHARLQRKYSRIGDDYRSLNQVTEALAQAGLESSNLIVGIDFTKSNEWTGKLSFNRRCLHDIGNTPNPYEQAISIIGRTLSAFDEDNLIPCFGFGDASTHDQEVFSFYPENRPCNGFEEALERYREIVPTLRLAGPTSFAPMIETAIGIVDSTGGQYHVLLIIADGQVTRSVDTQSGQLSPQERDTIDAIVKASQFPLSIVLVGVGDGPWDMMHQFDDNIPARSFDNFQFVNFTDIMSKSIAADRKEAEFALSALMEIPTQYKATLDLQLLGRRQRIQPRIPLPPPMRNAYSRSTSFDQHSGVYSRSSSFGPQTSGFQQSESFKQRQPVATTAPDTYTSESSLEGRLLCAICMDKSKDLAFGCGHQ

SEQ ID NO: 12096 - protein, 239 aa, Methanococcus maripaludis S2
MARTKKANDEVATDSDSLKLKVAKQAAKLVKDEMVVGLGSGSTANLFIQELGKRVVEEELYIYGVPTSFDSRMMASNSGIPLISLDQCGEIDIAIDGADEVCKKTLSLIKGGGGCHTMEKIVDYHAKEFVVLADEGKLVESLGDKTAVPLEVIPFAYSTVLNKLLDMNTAPAIRSGSGKMGPVITDNGNMIIDVFINIEDAEETETMLNNIPGVLENGIFSKCDKVLVGTSKKVEILKK

SEQ ID NO: 12097 - protein, 269 aa, Staphylococcus aureus subsp. aureus COL
MSGGDVNEAYRVETDTDTFFLLVQRGRKESFYAAEIAGLNEFERAGITAPRVIASGEVNGDAYLVMTYLEEGASGSQRQLGQLVAQLHSQQQEEGKFGFSLPYEGGDISFDNHWQDDWCTIFVDKRLDHLKDELLNRGLWDANDIKVYDKVRRQIVAELEKHQSKPSLLHGDLWGGNYMFLQDGRPALFDPAPLYGDREFDIGITTVFGGFTSEFYDAYNKHYPLAKGASYRLEFYRLYLLMVHLLKFGEMYRDSVAHSMDKILQDTTS

SEQ ID NO: 12098 - protein, 544 aa, Xanthomonas axonopodis pv. citri str. 306
MQNFVPSLAQLSNRGLGMEGIDANNAKKWPATARCPSSLASPAMSESVPRVSLLIDGELVVSASTQWQDVVNPADQSVLAQVPFATTAEVDAAVAAASRAFVTWRKTPIGTRARIFLKYQQLIRENMPELAALLSAEQGKTLADAEGDVFRGLEVVEHAAAIGNLQLGELANNVANGVDTYSLLQPLGVCAGITPFNFPAMIPLWMFPMAIATGNTFVLKPSEQDPMVTMRLVELALEAGIPKGVLNVVHGGEEVVNALCDHPDIRALSFVGSTKVGTHVYRRASLAGKRVQCMMGAKNHAVVLPDANREQTLNAMVGAAFGAAGQRCMAASTLVLVGESRAWIPELVAKAKSLKIGAGNAPGTEVGPLISCAARARVEGLIASGVEQGATLELDGRAPQVPGFEQGNFVGPTIFSGVKPGMRIYDEEIFGPVLVILEAATLDEAIALVNANPNGNGTALFTQSGAAARRFQEDIDVGQVGINVPIPVPVPLFSFTGSRASKLGDLGPYGKQVVMFYTQTKTVTARWFDDQTLGHGVNTTISLK

SEQ ID NO: 12099 - protein, 382 aa, Rhodobacter sphaeroides 2.4.1
MAKRDYYEVLGVSRTASADELKKAYRTKAKELHPDRNADNPQAEAQFKEVNEAYDVLRDADKKAAYDRYGHAAFEGGMGGGARAGGGYGQQGDFASAFSDVFEDLFGDFMGGRGGAPRSRAQRGSDLRYNLRVTLDEAYRGVQKTINVPASVACDACKGTGAEGGAEAVTCPTCSGMGKVRAQQGFFTVERTCPTCNGMGQIVKNPCKVCHGAGRVEKERSLSVNIPAGVETGTRIRLAGEGEAGMRGGPSGDLYIFIEVREHALFQRDGVHLFCRVPVSIAAAALGGEVEVPTIDGGSSRVKIPAGSQTGKQMRLRGKGMPALRGGGAGDMLIELAVETPVNLTARQKELLREFEKLSEDNNPEGKSFFSKVKGFWDGMTG

SEQ ID NO: 12100 - protein, 259 aa, Rubrobacter xylanophilus DSM 9941
MGVLELFNLRGKTAIVTGGGRGLGLYMAEALAEAGASLTICSRRREQLEEARGRLESAGKGGVLALGCDVTDPEQVEEVVEKTVEGFGSVDIVVNNSGATWGAPPLEMPLEKFDHVLRVNVRGTFLMSRSAARRMIERGSGGVIVNVSSVAGLVGGDPRYMQTVGYNASKGAIISMTRDLATSWAPHGIRVNAVAPGWFPTRMSRGLIERHERQMLADIPMKRFGGPEDIKGAVLFLASPASSYMTGQTLVVDGGLTAW

SEQ ID NO: 12101 - protein, 254 aa, Arabidopsis thaliana
MARKFFVGGNWKCNGTAEEVKKIVNTLNEAQVPSQDVVEVVVSPPYVFLPLVKSTLRSDFFVAAQNCWVKKGGAFTGEVSAEMLVNLDIPWVILGHSERRAILNESSEFVGDKVAYALAQGLKVIACVGETLEEREAGSTMDVVAAQTKAIADRVTNWSNVVIAYEPVWAIGTGKVASPAQAQEVHDELRKWLAKNVSADVAATTRIIYGGSVNGGNCKELGGQADVDGFLVGGASLKPEFIDIIKAAEVKKSA

SEQ ID NO: 12102 - protein, 249 aa, Populus trichocarpa
MKFNIANPTTGCQKKLEIDDDQKLRAFFDKRISQEVSGDALGEEFKGYVFKIMGGCDKQGFPMKQGVLTPGRVRLLLYRGTPCFRGYGRRNGERRRKSVRGCIVSQDLSVLNLVIVKKGENDLPGLTDVEKPRMRGPKRASKIRKLFNLSKEDDVRKYVNTYRRTFTTKSGKKVSKAPKIQRLVTPLTLQRKRARISDKKKRISKAKAEAAEYQKLLATRLKEQRERRSESLAKKRSRLSVASKPSVVA

SEQ ID NO: 12103 - protein, 148 aa, Paxillus involutus
GRIVFRLYDQQVPITTKNFRELATGQNGFGYEGSSFHRVIPQFMLQGGDFTKGNGTGGQSIYGEKFADEKPGLALKHSKPGLLSMANAGKNTNGSQFFITTVVTSWLDGVHVVFGEVVEGFDVVKEIEARGTASGKPNANIKIAKSGT

SEQ ID NO: 12104 - protein, 505 aa, Novosphingobium aromaticivorans DSM 12444
MTWEPEIEELRRREAMAEQMGGAEKVARQHARGKLDARARIAGVVDAGSFREIGKIAGKGRYGPDGELLDLAPSNLIFGRANVEGRPVVASADDFTVRGGAADAAIARKFIQCEQMAHTLKIPLIRMIDGTGGGGSVRTLEDIGATYVPATPGWGDVVRNLDTVPVVALSLGPTAGLGAARVVASHYSIMVKGLSQLFAAGPAVVAAIGEDRDKEGLGGSAIHTRNGVVDEEVANEAEAFARARRFLSYLPSHVGGAAPRTVAADPTDRREDFLIDLVPREAKQVYSMRRLLDAVVDKGSLFEMGRLWGRAVITAFARLDGWPVAVLASDPSYLGGSWDARSSEKAERFVKLADQFRLPLVHMVDNPGFMIGHTAESTGTIRYGVQAMNAIYKATVPLCSVIVRRAYGIAGSAMSNAEAFQYRFAWPSGDWGSLPIEGGIEVAYKSEIEAAEDPAAHLGAIRDRLNRVRSPFRTAERFGVEDIVDPRDTRPLLCEFANLAWRTLP

SEQ ID NO: 12105 - protein, 301 aa, Brassica napus
MAFLLNIFLLAVLVMIILLILSSYSTKKIQETTANGPRAYPLIGSTLSFNKNRRRLLQWYTELLRLSPSQTISIPLLGSRRTIVTANPENVEYILKTNFFNFPKGKPFTDLLGDLLGKGIFNVDGHAWSSQRKLASHVFSARSLRSFSFEVLKEEVENRLVPGLSAAADAGTAVDLQDVLKRFAFDVVCKVSLGWDPDGWDLTRPVNPLAEACDTAAEISARRATEPVYAVWKVKRALNVGSERRLREAIRTVHVLVSEIVRAKKKSLEIGTGEEAKQDLLSRFLAAGHDGESVRDMVISF

SEQ ID NO: 12106 - protein, 355 aa, Zea mays
MSAYCGKYKDELIKNAAYIGTPGKGILAADESTGTIGKRLSSINVENVEENRRALRELLFCCPGALQYISGVILFEETLYQKTKDGKPFVDVLKEGGVLPGIKVDKGTIEVVGTDKETTTQGHDDLGKRCAKYYEAGARFAKWRAVLKIGPNEPSQLAIDLNAQGLARYAIICQENGLVPIVEPEILVDGPHDIDRCAYVTETVLAACYKALNEHHVLLEGTLLKPNMVTPGSDSKKVTPEVIAEYTVRTLQRTVPAAVPAVLFLSGGQSEEEATRNLNAMNKLSTKKPWSLSFSFGRALQASTLKAWAGKVENLEKARAAFLARCKANSEATLGTYKGDAAADTESLHVKDYKY

SEQ ID NO: 12107 - protein, 368 aa, Bordetella pertussis Tohama I
MKTKAAIAWKAGAPLTVEDVDLEGPKAGEVLVEIKATGICHTDYYTLSGADPEGIFPAILGHEGAGVVMDVGPGVTTLKKGDHVIPLYTPECRQCKFCLSRKTNLCQAIRTTQGKGLMPDGTSRFSIDGKPLFHYMGTSTFANHIVVPEIALAKVRPDAPFDKICYIGCGVTTGIGAVVFTAKVEAGANVVVFGLGGIGLNVIQGAKMVGADKIIGVDLNPAREAMARKFGMTHFVNPSEVENVVDHIIQMTDGGADYSFECIGNTKVMRQALECCHKGWGQSVIIGVAEAGAEISTRPFQLVTGREWKGSAFGGARGRTDVPKIVDWYMEGKINIDDLITHTLPLDRINEGFDLMKRGESIRSVVVY

SEQ ID NO: 12108 - protein, 348 aa, Synechococcus sp. WH 7805
MLLTQFALSQGWLPLVSFLIAGLGIIPIALLLSESTEEIAEHSGSTIGAILTALFGNCAEFIIALTALRKGLVDVVKASITGAILSDLLLVTGLAMLIGGLRYSEQSFQPTMMRTNGAAMTLAVIALALPASLISTSGIDNPQDIHGLSITVAAILIAIYLLTLVFSLATHNHLFDPPIIIDKDNENVEAETSSWKTLRPWLIQLVVSTVALAYQSEQFVVALEPATEQLGLSALFTGVIIIPIIGGFSEYLPAARGALNNRMDLSLSLAMGSSLLVALFMAPVLVIIANFIGQPMDLDFASFEVIALGFSVFIVNLVGMDAKSNWLEGVLLLGTYTIFGAAFYYYPS

SEQ ID NO: 12109 - protein, 125 aa, Zea mays
  misc_feature (25)..(26): Xaa can be any naturally occurring amino acid
  misc_feature (111)..(114): Xaa can be any naturally occurring amino acid
MVDNDSLSEFLASAVDAAQKAGEIXXKGFYQTKHVEHKGQVDLVTETDKACEELIFNHLKQLYPTHKLIGEETTAACGATELTDDPTWIVDPLDGTTNFVHGFPFVCVSIXXXXGKTPTAGVVSN

SEQ ID NO: 12110 - protein, 507 aa, Agrobacterium tumefaciens str. C58
MSDEAIHDIFVIGGGINGCGIARDAVGRGYSVALAEMNDFASGTSSAATKLIHGGLRYLEHYEFRLVREALMEREVLWAMAPHIIWPMRFVLPFQKGGVRPAWLVRLGLFLYDHLGGRKLLPATRSLDLRRDPAGKPLKPIFARAFEYSDGWVDDARLVVLNARDAADRGAVILNRTQVVSARREGAFWRVETKNAAGESKTYRARMLVNAAGPWVDKVLAATFGKNNVHNVRLVQGSHIIVRKKFADPRAYFFQNPDGRIIFAIPYEQDFTLIGTTDRDYTADPRAVKISDEEISYLCNAASEYFAEPVKPADIVWTYSGVRPLFDDGASKAQEATRDYVLKTEGAEGEAPLLNIFGGKLTTYRRLAEHALEKIGDALGEKGTPWTAGSHLPGGNFGAEAYAEEVKALRSRYPFLDRRHAERLVRCYGTDAVAIIGAAADTTALGRHFGGTLYEAEVRWLMAREWALTAEDILWRRTKQGLFLTPEEVLGLTDYIDDIAGGRLKAI

SEQ ID NO: 12111 - protein, 567 aa, Dehalococcoides ethenogenes 195
MEELGSSFGLDLIIVLVSAVLAGLLARRFRLPLLLGYLGAGIAIGPNGFGLVQSPGVIESMATVGVILLLFTLGLDFSLDELKRVGKVAVLGGLIQIVVTAGFGFLLGRGLGWDINASIFFGFMVSLSSTLIVLKILMDKGEAEAPHGRVMLGILLVQDICLIPLMIILPALGGEGGDIGLTIGVAFAKAAAFILAMFGLGFWVFPRLLGRVASHSHELFLLSVITLSLGAALGATALGLSPAVGAFIAGLLIGQSMYAKQALADIIPLRDIFGALFFVSLGMLANLNFAVENIGLVLLVVVFLLVIKSLVAGAVPWLFGYTFQTSFTTGIGLMQIGEFSFVLAGVGLASSVISDSIYAITISSAVITMIITPFALSFSGAAYRKVSQWPLASKLVSLRTSGQAEFMDLDISNHAVICSQGGVAKTLTRVMNRRNFPFLVIDLDPQTIAELRRQKAPAIYGDAANPEILRFARLDKARLLICAMPGFADTEQVVKNARKINDRLDIVARVSSDIQAEKLKKMGVSEVVQPEFEVGLELSRHAMHRFGMTTIEIQYILNSLRNMGKPE

SEQ ID NO: 12112 - protein, 592 aa, Candida glabrata CBS 138
MCRCIEEKDNIVNSKTEQKTVHTMSDFLSQLNIFNKENYKFSSSEKSEDDTSDFETGQQFATELDQGEKRLGLISCIGLICNRMLGTGVFAVSSTIYTLSGSIGLALILWAVGALIALAGLYVYMEFGTAIPRNGGEKNYLEAIFKKPKFFITCMYASYVFFLGWAAGNSVNTAVMFLTAANTEVTKWNQRGIGVAVVFFCFAVNSINVRAGLYIQNVLGVFKLGIVIFISITGWVALAGGLKHGYQSHNFHNAFEGTNKATAYGVVNALYNVIWSFVGYSNVNYALGEVKNPVRTLKIAGPTSLICLAIIYIFVNIAYFAVVPKDKLISSKLILAADFFDICFGGHAKRVAAALVGLSALGNVMSVIFSQGRIIQQLGREGVLPFSNFFATSKPFNSPMVGLFQHFIICMITILAPPPGDAYNIILNLISYPMNIVNFVISAGLLWIYWQRRQGKIEWNPPIKAGVFITTFFMLSNVYLIVAPYIPPTHGESVYEHAPYWIHCVVAWGIFAFGGFYWLVWAKLLPRWGHYRLESKEVLGDDGFWRMQIIKVPESEVGDDSIDSSDGENIHSNDIEVLDYQESKESHKISHE

SEQ ID NO: 12113 - protein, 252 aa, Pyrococcus horikoshii OT3
MGGTMIIVFVGTAGSGKTSLTGAFGEYLEENYKVAYVNLDTGVKELPYKPDIDVREFVTVEEIMKEGYGPNGAIVESYDRLMNKFDYYLKEILELESKKDYVLIDTPGQMETFLFHEFGVKLMENLPYPLVVYLSDPEILRKPTDYCFVRFFALLIDLRLGATTVPALNKVDLLKEEQLEKHRKYFEDLDYLMGRLKFDPSMQGLMAYKMCSIMMEVLPPIRVLYLSAKTREGFEDLETLAYEHYCTCGDLT

SEQ ID NO: 12114 - protein, 633 aa, Arabidopsis thaliana
MVKIEVGSVGDSFSVSSLKAYLSEFIATLLFVFAGVGSAVAFAKLTSDGALDPAGLVAIAIAHAFALFVGVSIAANISGGHLNPAVTLGLAIGGNITLITGFFYWIAQCLGSIVACLLLVFVTNGKSVPTHGVSAGLGAVEGVVMEIVVTFALVYTVYATAADPKKGSLGTIAPIAIGFIVGANILAAGPFSGGSMNPARSFGPAVVSGDLSQIWIYWVGPLVGGALAGLIYGDVFIGSYEAVETLKSSSDFAMVSVEKLRRRTRKSSKISAEKTPDRTQSSPIPPVPPISSPIQQNFATRSSVYPFPQFDFADAHYSPYALSNGDNPGTTIVSEVLDGSNFSSWKIAMFVALDAKNKIAFVDGTLPRPPEFDPSFRVWSRCNSMVKSWILNSVTKQIYKSILRFNDAAEIWKDLDTRFHITNLPRSYQLTQQIWSLQQGNMSLSDYYTTLKTLWDDLDGASCVNTCRNCKCCSATASVNEHSKIVKFLAGLNDFYSTIRSQIIMKKTIPDLAEIYNLLDQDHSQRNIVTNPTNASAFNVSILSNDQIAVNATRSFQPNSKPKVQCSHCGYTGHTADTCYKIHGYPIGIGPDGIAELVGNMSKSQIQDVIAYFSTIRHSLIGKMSLLSIYGSS

SEQ ID NO: 12115 - protein, 487 aa, Ustilago maydis 521
MPMIPPALRRTQAAATPTTSSPAASSSTTATLDSQSLCALPRIRVSASTLNSIVTPVKKITSETDVEAWKASAAYSIYTLFLQRVCEACVGKPTRLPTRSTDAPVTPVDKLVSLLWELDSWTQEIEPHEKPQRFGNLAFRDWGARLEERIDSLLSDLLPSRLHAFAVELRVYLLDSFGSFTRIDYGSGHELAFFAWLCFLYRLGFFDASEEQEQDETLADIQVEERIGLDIFPLYLMVVWKLQDRYGLEPAGSHGVWGLDDFQFLPYVIGAAQLRRQSGLRPNQVIGASSHASILQTQLATRTDPASLISTTLVLPASSLVGTQVEVPLPNLYLSSLLRIHVLKRGPFHEHSPLLNDIASSVPNWLKVYFGMLKMYAAECLAKKVVVQHFAFGGVGWVWTHQAHSELPRLATPSAPVAARRHLPLGGIQGNMTSMGVPTPRITRPPATPDSFDHPLRLPPRSTPSRPSTTPSVPPLAASTRPAPKPE

SEQ ID NO: 12116 - protein, 125 aa, Pyrococcus horikoshii OT3
MTTFKLVISDPKSGIAKQIEISGANAEKLIGKKIGDQIPVKELGLDLKALFGKDFPEDVKMEIRGGTDKDGFPMRPDIHGPRRVRILLSKGPGFRPKEKGERRKKTVRGNTISPEIVQVNVKLVY

SEQ ID NO: 12117 - protein, 288 aa, Oryza sativa Indica Group
MAKDIEASAPEGGEFSAKDYTDPPPAPLIDVEELTKWSLYRAVIAEFIATLLFLYITVATVIGYKHQSDATVNTTDAACSGVGILGIAWAFGGMIFILVYCTAGISGGHINPAVTFGLFLARKVSLIRAVLYIIAQCLGAICGVGLVKGFQSSYYARYGGGANELSDGYSKGTGLGAEIIGTFVLVYTVFSATDPKRNARDSHIPVLAPLPIGFAVFMVHLATIPITGTGINPARSLGAAVIYNKDKAWDDQWIFWVGPLIGAAIAAAYHQYVLRASAAKLGSYRSNA

SEQ ID NO: 12118 - protein, 431 aa, Escherichia coli
MVSLEKNDHLMLARQLPLKSVALILAGGRGTRLKDLTNERAKPAVHFGGKFRIIDFALSNCINSGIRRMGAITQYQSHTLVQHIQRGWSFFNEEMNEFVDLLPAQQRMKGENWYRGTADAVTQNLDIIRRYKAEYVVILAGDHIYKQDYSRMLIDHVEKGARCTVACMPVPIEEASAFGVMAVDENDKIIEFVEKPANPPSMPNDPSKSLASMGIYVFDADYLYELLEEDDRDENSSHDFGKDLIPKVTEAGLAYAHPFPLSCVQSDPDAEPYWRDVGTLEAYWKANLDLASVVPELDMYDRNWPIRTYNESLPPAKFVQDRSGSHGMTLNSLVSGGCVISGSVVVQSVLFSRVRVNSFCNIDSAVLLPEVWVGRSCRLRRCVIDRACVIPEGMVIGENAEEDARRFYRSEEGIVLVTREMLRKLGHKQER

SEQ ID NO: 12119 - protein, 524 aa, Oryza sativa
  misc_feature (164)..(164): Xaa can be any naturally occurring amino acid
  misc_feature (194)..(194): Xaa can be any naturally occurring amino acid
MASQPPALDILVREPDGFSVWSGPPYPTGSAPPVRLPKTACSATYFSSDGSRLLATVASASATVYDCRTLSVVRSFELPGLLAAALSPAGTFLQTFQKSSSPQEKNVTVWHVDTATALYQHYQKNMSKATWPMVQFSADESVACRMMTNEIQFFDPKNFTKGFXYKLKMPWISCYAASKGPGDLRVVGFVPGRXRGVPASVQIFSCDKDAQGQAVARRSFFRCSTVQFHWNKGSTGLLVVAQADVDKTNQSYYGETKLNYLTTDRAFEGIVPLKKDGPVHDVQWSYSGSEFAVVYGFMPARATIFNKKCNPLLELGEGPYNTIRWNPKGRFIVLAGFGNLPGDMAFWDYSEKKLVGKTKAECSVTSEWSPDGRHFMTATTAPRLQIDNGIKIFDHNGSLQFKKMFEKLYQADWKPEAPEKFSDIADLTISLGSIKIEETKKQVSAQGSKSAQPSSKAPANIAAKPTAYRPPHSKNSADVQDKLFGGLASTGGEMSKNALRNKKRREKQKEKKAAEGSGASADDN

SEQ ID NO: 12120 - protein, 358 aa, Haemophilus influenzae 86-028NP
MQSYNVAVLAGDGIGPEVMAEAMKVLNKVQEKFGFKLNFNEFFVGGAAIDHCGYPLPAETLKGCDEADAILFGSVGGPKWTNLPPDQQPERGALLPLRKHFKLFCNLRPATLYKGLEKFCPLRADIAAKGFDMVVVRELTGGIYFGQPKGREGEGSQTKAFDTEVYYKYEIERIARAAFEAAMKRNKKVTSVDKANVLQSSILWRETVTEMAKDYPEVTLEHIYIDNATMQLIKAPESFDVLLCSNIFGDIISDEAAMITGSMGMLPSASLNEAGFGLYEPAGGSAPDIAGKGIANPIAQILSAAMMLRYSFNLNEAADAIESAVQKVLASGHRTADLADDSTPVSTAEMGTLITQAI

SEQ ID NO: 12121 - protein, 1523 aa, Ustilago maydis 521
MSSSASSDLSGAILPTSVSSGRLGDHHHHHHLQTSSHSSHQHHHLDNSNSVFASSSRHTLDQPDEPIHPAHLSNQSALGAANTRRTSVSSTPSSPASTPPIDDQDLESQSLSTHFPLQSSQDGLHFGIVSSRSAHSDHPNTSAMATLSVHTPPAVHQSDPMLQVRTTSSPLHTATASFHQRHRSQSPAPPPPTYTQPPTASSLANVTSGDGWAIVANPTRCTNAAPDAAALSGVPSPIASAISTAWQPNTADLTPLSHAANDASIRRCGPVDLASPHDVPFGERASPAIISLAQRNARSLSRNGTRPPSPLTLSPALASESLNPSGAHRGGLRGSDEDLEVADKDATMDTSDNNCASTGATPLVPPATRKLCVRHQRMADEGTTARLQKSIESLPLADQTAVNTVWSLFSSSSHSRRALILQGILTMCCFSQLSLLSSELALAIRIDPFSLFPREVSLRVLGHLDAMSLGRAAQVSRSWKQLADDDLLWRNMCEQHIERKCEKCGWGLPLLSERRRRVPGPAVQLGTPESRDLSSDGSGCNPSTTPGSLKRSITAAANAAALEKQSRSRASSPTPSNGRSHSLSVSAHRDLHLDTIPEQRDRDAPPLKKQRSGIHGQATASSGPGSSSGTAPKTRPWKSVYCERLAIERNWRRGRYTSRTLAGHTDGIMCLQFNENLAHPAFPVVITGSYDRTARIWNLETGEMLRVLEGHTRGVRCLQFDEAKLITGSMDRTLKIWNWRTGALMRTLEGHTEGIVCLHFNEDTLASGSADSNIKIWNFRTGECYTLRGHRDWVNAVTLWTGPAAKKRQQRLRAALREARSATSMNEDDPTAAGTFLFSASDDGSIRLWDLGLRECLLTFEGHVGQVQSLKLVMMDDEAVRKLVGGAAGGVDGESSIDQRHGTRHGSTQTNASGDDETVATEDGEQDMLSVEDQESYFLGDTSLSPSLRPVAAGLAFTVGAADIGAASSSRDNATTRVGGARPLSSAAEVSERSFFANGSNGAGGRRSASGGGTSSAWSTSQQRQRRRIDKNLLRVQERLCAAGLVDALPLDAEMGDLDPTMRGARSTNGNRSGDESQPAGGKDKASERHHAKPRPVLISGSLDNTLKIWDVRTGRCIRTLFGHVEGVWSLDVDKLRIASASHDRTIKIWDRDTGYCQNTLIVSGSDDGDIKVWSFAAASAAAPPNAVARNSAALTPQHRFATPVVPTPADLVSRGSVGKWVMGMGLRLGLGGLWHWGGVGVGDGKGCDGLEAQAARWDELGAQVCARLLGERVDGLYGWSVELLHGGKLVGCHVQCIPHRTAGCQQVRCRQRRTHRLTRDQAHHPHHHAHGQQRKQEQRNAQQPHGERMTQQRYPARIRRTAYPRQCGKQEMQRLHVFRSSLDHLSCNPRSNAMTHNHDVRVMLFGIVLLMDSVYLRRVGGEIVEPRMAAVRDRDDLDTALIEPRRRVDRVQKVHVSELAIDAMPVDPITRSYRHQVLVGFQYTSLNQPKTSPNPRLVSFQLVRLVTVPAVARRSTCTRSMW

SEQ ID NO: 12122 - protein, 693 aa, Xanthomonas axonopodis pv. citri str. 306
MLPGFDGLRFSHWQADLREDGVVVLSLDRQGAPVNAFSQEVLLELGALVERLALDPPTGVVLRSGKPNGFIAGADLKEFQEFDRKGTVNDAIHRGQQVFQKLAELPCPTVAAIHGFCMGGGTEIALACRYRVASDDGSTRIGLPETKLGIFPGWGGSARLPRLIGAPAAMDLMLTGRTVSAKAARAMGLVDKVAAPAVLVDAAASLALAGTTRAFKQRATAWATNTLLARKLLAPQMRKQVGRKARKEHYPAPYALINVWERAGGSGIQARLAAERKAVVKLASTPTARNLIRIFFLTERLKGLGGKDAAGVAVAPIRHVHVIGVGVMGGDIAAWAAYKGFDVTLQDREQRFIDTALTRGGELFAKRVKDDAKRPAVAARLRGDLAGAGVTQADLVIEAIIENPQAKRDLYQSIEPQLKPDALLTTNTSSIPLTDLRGHIQRPAQFAGLHYFNPVAMMPLVEIVQHDGLDPANVARLAAFCKTLDKFPVPVAGTPGFLVNRVLFPYLLEAATAYAEGIPGPVLDKTAVKFGMPMGPIELIDTVGLDVAAGVGAELAPFLRLPIPAALATVEAGKRGKKDGQGLYKWENGRAVKPEVASGYAAPADLEDRLILPLLNEAVACLHDGVVADADLLDAGVIFGTGFAPFRGGPIQYIRSVGADALLERLQALHARYGERFAPRPGWDSPLLREAVA

SEQ ID NO: 12123 - protein, 148 aa, Paxillus involutus
  misc_feature (118)..(118): Xaa can be any naturally occurring amino acid
GRIVFRLYDQQVPITTKNFRELATGQNGFGYEGSSFHRVIPQFMLQGGDFTKGNGTGGQSIYGEKFADEKPGLALKHSKPGLLSMANAGKNTNGSQFFITTVVTSWLDGVHVVFGEVXEGFDVVKEIEARGTASGKPNANIKIAKSGT

SEQ ID NO: 12124 - protein, 1794 aa, Haemophilus influenzae 86-028NP
MLNKKFKLNFIALTVAYALTPYTEAALVRNDVDYQIFRDFAENKGKFSVGATNVEVRDNKNNNLGSALPKDIPMIDFSAVDVDKRIATLVNPQYVVGVKHVGNGVGELHFGNLNGNWNPKFGNSIQHRDVSWEENRYYTVEKNNFSSELNGKTQNNEKDKQYTSNKKDVPSELYGQALVKEQQNQKRREDYYMPRLDKFVTEVAPIEASTTSSDAGTYNDQNKYPAFVRLGSGSQFIYKKGSHYELILEEKNEKKEIIHRWDVGGDNLKLVGNAYTYGIAGTPYKVNHTDDGLIGFGDSTEDHNDPKEILSRKPLTNYAVLGDSGSPLFVYDKSKEKWLFLGAYDFWGGYKKKSWQEWNIYKPQFAENILKKDSAGLLKGNTQYNWTSKGNTSLISGTSESLSVDLVDNKNLNHGKNVTFEGSGNLTLNNNIDQGAGGLFFEGDYEVKGTSENTTWKGAGISVAEGKTVKWKVHNPQFDRLAKIGKGKLIVEGRGDNKGSLKVGDGTVVLKQQTTTGQHAFASVGIVSGRSTVVLNDDNQVDPNSIYFGFRGGRLDANGNNLTFEHIRNIDDGARLVNHNMTNASNITITGAGLITNPSQVTIYTPAITADDDNYYYVPSIPRGKDLYFSNTCYKYYALKQGGSPTAEMPCYSSEKSDANWEFMGDNQNDAQKKAMVYINNRRMNGFNGYFGEEATKADQNGKLNVTFSGKSDQNRFLLTGGTNLNGELKVEKGTLFLSGRPTPHARDIANISSTEKDKHFAENNEVVVEDDWINRTFKATNINVTNNATLYSGRNVESITSNITASNKAKVHIGYKAGDTVCVRSDYTGYVTCHNDTLSTKALNSFNPTNLRGNVNLTESANFTLGKANLFGTINSTENSQVNLKENSHWYLTGNSDVHQLDLANGHIHLNNVSDATKETKYHTLNISNLSGNGSFYYWVDFTKNQGDKVVVTKSAKGTFTLQVANKTGEPNHNELTLFDASNATERSGLNVSLANGKVDRGAWSYTLKENSGRYYLHNPEVERRNQTVDTPSIATANNMQADVPSVSNNHEETARVEAPIPLPAPPAPATGSAMANEQPETRPAETVQPTMEDTNTTHPSGSEPQADTTQADDPNSESVPSETIEKVAENSPQESETVAKNEQKATETTAQNDEVAKEAKPTVEANTQTNELAQNGSETEETQEAETARQSEINSTEETVVEDDPTISEPKSRPRRSISSSSNNINLAGTEDTAKVETEKTQEAPQVAFQASPKQEEPEMAKQQEQPKTVQSQAQPETTTQQAEPARENVSTVNNVKEAQPQAKPTTVAAKETTASNSEQKETAQPVANPKTAENKAENPQSTETTDENIHQPEAHTAVASTEVVTPENATTPIKPVENKTTEAEQPVTETTTVSTENPVVKNPENTTPATTQSTVNSEAVQSETATTEAVVSQSKVTSAEETTVASTQETTVDNSGSTPQPRSRRTRRSAQNSYEPVELHTENAENPQSGNDVATQLVLRDLTSTNTNAVISDAMAKAQFVALNVGKAVSQHISQLEMNNEGQYNVWVSNTSMKENYSSSQYRHFSSKSAQTQLGWDQTISSNVQLGGVFTYVRNSNNFDKASSKNTLAQANLYSKYYMDNHWYLAVDLGYGNFQSNLQTNHNAKFARHTAQFGLTAGKAFNLGNFAVKPTVGVRYSYLSNANFALAKDRIKVNPISVKTAFAQVDLSYTYHLGEFSITPILSARYDANQGSGKINVDRYDFAYNVENQQQYNAGLKLKYHNVKLSLIGGLTKAKQAEKQKTAEVKLSFSF

SEQ ID NO: 12125 - protein, 444 aa, Arabidopsis thaliana
MATITVVKARQIFDSRGNPTVEVDIHTSNGIKVTAAVPSGASTGIYEALELRDGGSDYLGKGVSKAVGNVNNIIGPALIGKDPTQQTAIDNFMVHELDGTQNEWGWCKQKLGANAILAVSLAVCKAGAVVSGIPLYKHIANLAGNPKIVLPVPAFNVINGGSHAGNKLAMQEFMILPVGAASFKEAMKMGVEVYHHLKSVIKKKYGQDATNVGDEGGFAPNIQENKEGLELLKTAIEKAGYTGKVVIGMDVAASEFYSEDKTYDLNFKEENNNGSQKISGDALKDLYKSFVAEYPIVSIEDPFDQDDWEHYAKMTTECGTEVQIVGDDLLVTNPKRVAKAIAEKSCNALLLKVNQIGSVTESIEAVKMSKKAGWGVMTSHRSGETEDTFIADLAVGLSTGQIKTGAPCRSERLAKYNQLLRIEEELGSEAIYAGVNFRKPVEPY

SEQ ID NO: 12126 - protein, 636 aa, Oryza sativa Japonica Group
MDFTNLLITVLLLLSPLKYESDVATASDDEDFFKTCSSQRCSKHGPEIRYPFRLSTQPPSCGAPGMQLSCSGQDTILDHPVLGSCKVTMIYYRHVIMNAIPLVDSLPHCPLQKLVSVNQSTAVYKPHTSEVASVVGCSRDSIDTNQYGIVGPTSCPSLANNASQFWYLAYPYTYMSILPLGCTIVSKDIPMPYSYDKNGPNFDISIFTETAKRVISTGETVFTWYTSNVTSICQQCEREVWITVGGTTVRVVTISIRPFGARDALDSAVARGPRVTIIAATSSVGTFIVLSLIVATALYISLKSRYNEEIHLKVEMFLKTYGTSKPTRYTFSEVKKIARRFKDKLGHGAFGTVYKGELPNGVPVAVKMLENSVGEGQEFINEVATIGRIHHANIVRLLGFCSEGTRRALIYELMPNESLEKYIFPHGSNISRELLVPDKMLDIALGIARGMEYLHQGCNQRILHFDIKPHNILLDYSFNPKISDFGLAKLCARDQSIVTLTAARGTMGYIAPELYSRNFGAISYKSDVYSFGMLVLEMVSGRRNTDPTVESQNEFYFPEWIYERVINGQDLVLTMETTQGEKEMVRQLAIVALWCIQWNPKDRPSMTKVVNMLTGRLQNLQVPPKPFISSQNQLVI

SEQ ID NO: 12127 - protein, 148 aa, Paxillus involutus
  misc_feature (1)..(1): Xaa can be any naturally occurring amino acid
XRIVFRLYDQQVPITTKNFRELATGQNGFGYEGSSFHRVIPQFMLQGGDFTKGNGTGGQSIYGEKFADEKPGLALKHSKPGLLSMANAGKNTNGSQFFITTVVTSWLDGVHVVFGEVVEGFDVVKEIEARGTASGKPNANIKIAKSGT

SEQ ID NO: 12128 - protein, 458 aa, Staphylococcus epidermidis RP62A
MAKQLQRELNNRHIQLIAIGGAIGTGLFLGSGQTISLTGPSLLFTYMLIGIVLFAFMRALGELLLSNSKFNSFVDIANEYLGPFGGFVIGWTYWVCWIVSSMSDLTAMGQYFAYWYPQVPHWLTVLFIVLLLISFNLLGARLFGELEFWFSIIKVVTIITMVIVGLVLIFLSFKTEYGHASFGNLIHHGGMFPHGAAGFLMSFQIAVYSFIGIELIGVTAGETKNPEKTIPKAINNVPIRILLFYIGGLLVIMSVIPWFKVDPDSSPFVKLFTLIGVPFAAGIVNFVVLTAAASATNSGIYSNSRILFGLAKQGLGPKVLTKTNSNGVPYLSMLVSSITLLIAALLNFVFPDAIKLFIYVTTLSTVLFLVVWGMIIVSYIAYVKKNPEQHQSSAFKLWGGKIIAYIVLSFFIFIFILLFFSKDTRVAIFISPLWFIFLFFYYKKYKNNAESLADRQRH

SEQ ID NO: 12129 - protein, 142 aa, Paxillus involutus
YIMLKPDGVDRGLIGEILARFEKRGFKLIAAKLALPSKEHLEKHYADLKDKPFFPGMIKYMQSGPVFCMVFEGLDAVKTGRAMLGATNPLASQPGTIRGDYALAVGRNICHGSDSVENAEKEIALWFPDGTLQYRLSQEAMI

SEQ ID NO: 12130 - protein, 433 aa, Novosphingobium aromaticivorans DSM 12444
MTTNAELWTRREAAVPRGVSSMHQRFFARGENAEAFDAEGNRYIDFATGIAVCNTGHGHPRVLAAVQRQLDAFSHCSFQVTPYENYIELAERLNAIAPIDGPVKSIFFTTGAEALENAVKIARAHTGRRGIITFQGGYHGRTLLTLAMTGKVLPYKARFGPMPGDVFHARFPIPYHGFSEEEAIAGIEALFASAIEPSAVAAIVLEPVLGEGGFYTASYAFFRALREICDRHGILLIADEVQAGFARTGRMFAMDWVREATGVTPDLMTVAKAMAGGFPISGVMGRAEIMDAPDPGGLGGTYGGSPLGCAAGLAVLDVIADEDLCARAVAIGNRIKARLRRMRDNGMTAIGDVRGPGAMIAMELVHDGDPSRPNPDATRALVQEGAREGLLLLSCGLRGNVVRFLPALTMPDALLDEALDRLEIALNRVLGGQ

SEQ ID NO: 12131 - protein, 445 aa, Staphylococcus aureus subsp. aureus COL
MSKAHQLIQEDEHYFAKSGRIKYYPLVIDHGYGATLVDIEGKTYIDLLSSASSQNVGHAPREVTEAIKAQVDKFIHYTPAYMYHEPLVRLAKKLCEIAPGDFEKRVTFGLTGSDANDGIIKFARAYTGRPYIISFTNAYHGSTFGSLSMSAISLNMRKHYGPLLNGFYHIPFPDKYRGMYEQPQANSVEEYLAPLKEMFAKYVPADEVACIVIETIQGDGGLLEPVPGYFEALEKICREHGILIAVDDIQQGFGRTGTWSSVSHFNFTPDLITFGKSLAGGMPMSAIVGRKEIMNCLEAPAHLFTTGANPVSCEAALATIQMIEDQSLLQASAEKGEYVRKRMDQWVSKYNSVGDVRGKGLSIGIDIVSDKKLKTRDASAALKICNYCFEHGVVIIAVAGNVLRFQPPLVITYEQLDTALNTIEDALTALEAGNLDQYDISGQGW

SEQ ID NO: 12132 - protein, 164 aa, Populus trichocarpa
MLRLLASERLLLSQRTRILPRFYHEKVIDHFNNPRNVGSFDKNDPAVGTGLVGAPACGDVMKLQIKVDDTTGEIIDARFKTFGCGSAIASSSVATEWVKGKQMEEVMTIKNTEIAKHLSLPPVKLHCSMLAEDAIKAAVKDYQTKRAKLSGVSETEPVEQAAQA

SEQ ID NO: 12133 - protein, 470 aa, Novosphingobium aromaticivorans DSM 12444
MLFATLAAGEGLDVLNPATQQRIATVKAYSTEEIARLIEAADAARGAWAARTAKERSVVLRRWYDLVMSHQEDLAALVTAESGKPLAEARGEVAYGAAFIEWFAEEGKRAYGDTIPTFANGKRVLTIRQGVGTCAAITPWNFPVAMITRKVAPALAAGCAMVVKPAEATPLSALALETLAHEAGVPAEVFRVVPTDDPAGVGTLFCTHPQVRKLSFTGSTRVGQLLMEQAAANVTRLSLELGGNAPFIVFDDADLDAAVDGLMASKFRNAGQTCVCANRILVQDSVHDAFLAKVQERVAALVVGDGAQPGTTIGPLINEAAVKKVGALVADACEAGARVLAGGGKSPVGTGFFEPTILADVTPDMAVASAEIFGPVVPVIRFADEPQAIRIANDTPYGLAAYFYARDVGRIWRVMEALEYGMVGVNDGIISTEVAPFGGIKHSGLGREGSRHGLDEYLELKYCLMGGIDR

SEQ ID NO: 12134 - protein, 385 aa, Populus trichocarpa
MVTDQEIAKGVETVLRQADPSAVTSLNGVVQQLEAKLGLDLSHKAAFIRDQIDLLLRSHPITTTASATAPASVTTTGHPPPQHQAFQFQQGQALNLTPKDHFALQFQQQFHPSHFAIHPHHQHQHQHHPQQHHQHQVFSQDLNFRQPQAVVTPPAPPPQLQAQQQHRQTQHVQNAGVVTNEVAKESSAPVGSKRRGGPGGLNKVCGVSPELQAIVGEPALPRTEIVKQLWQYIRKNNLQDPSNKRKIICDDALRVVFETDCTDMFKMNKLLAKHIIPLQPSKESSQAKRAKVDVETPTENTEPGASLVGISERLAEFLGTTEREMTQTEASRRVWEYIKLKQLEDPLNSMAIQCDTKLRDLLGCESISAVGVGEVLARHHLFKRS

SEQ ID NO: 12135 - protein, 141 aa, Arabidopsis thaliana
MGDSSVSTSSWAVIESANRFQVSSVMGESSGSSSSLAAINSSNIGFQLLKKHGWKEGTGLGIAEQGILVPLQAEPKHNKRGVGAKQPAKRKVAQPQAKDEEVSKQSKKLSKKMRKMMEHEKHLQEKEFERAFFREFWPDNV

SEQ ID NO: 12136 - protein, 607 aa, Zea mays
MNSHKFLLAVLLLLLLNYASYAATSKEDDDFRKSCPSHRCHKHGPEIRFPFRLPSHPPSCGTPGMQLSCSGHDTILDHPVLGSCRVTAIYYRHRVMNVIPPEDSSSHCQLQKLVKRNQSTDVYTPVVNPVSVLVGCSREATNQDGIVGPSSCLSLINNASQLWYLVDPSTDMSTLPMGCEVVAKEIPVPYTYDKNGPKVETFSGRSLFNEKANRAINFGETSFNWDLNNITGSCQTCEQEGKHCGFSSNRRQAFCLHHGSHVILIAATTSVATFVVLVVTALYLSLKKRYNEAIHLKVEMFLKTYGTSKPTRYTFSEVKKIARRFKEKVGQGGFGTVYKGQLPNGVPVAVKMLENSTGEGEDFINEVATIGQIHHANIVRLLGFCSEGTRRALIYEFMPNESLGRYIFLPQELLVPEKMLDIATGIARGMEYLHQGCNQRILHFDIKPHNILLDYSFNPKISDFGLAKLCARDQSIVTLTAARGTMGYIAPEIYSPNFGGVSYKSDVYSFGMLVLEMVSGRRNSDPGIENQNGVYLPEWVYERVVTGQDLTLSKKIADQEKETVRQLAIVALWCIQWNPKNRPSMTKVVNMLTGRLQNLPIPPKPYA

SEQ ID NO: 12137 - protein, 246 aa, Methylobacillus flagellatus KT
MSDNTKTHFGFQTVDEREKARKVGEVFHSVARKYDLMNDVMSAGLHRAWKRFTVEVSGVRPGDRVLDVAGGSGDLSRLFSNKVGQSGQVILTDINASMLAVGRDRLIDDGKAVPALQCDAEQLPFPDEHFDCVIVAFGLRNMTHKDKALTEMQRVLKPGGRLLVLEFSQVWKPLAPIYDAYSFKLLPLMGKLLANDADSYRYLAESIRMHPDQETLKQMMLDAGLSKVDYYNLAAGVVALHKGWKT

SEQ ID NO: 12138 - protein, 507 aa, Populus trichocarpa
MALYVVPLWLPLILLLALLLLFMKKMEVKRQSEQLLPPSPPKLPILGNLHQLGSLPHQSLWQLSKKYGPVMLIRLGRIPTVVISSAEAAREVLKVHDLAFCSRPLLAGTGRLTYNYLDIAFSPYSDHWRNMRKVLTLELFSLKRVQSFRFIREEEVSLLVNFISESSALAAPVDLTQKLYALVANITFRMAYGFNYRGTSFDRDKFHEVVHDTEAVAGSISADESIPYLGWIVDRLTGHRARTERVFHEVDTFFQHLIDNHLKPGRIKEHDDMVDVLLRIEKDQTELGASQFTKDNIKAILLNLFLGGVDTISLTVNWAMAELVRNPRVMKKVQDEVRKCVGNKGRVTESDIDQLEYLRMVIKETLRLHPPAPLLITRETMSHCKVSGHNIYPKMLVQINVWAIGRDPRYWKDPEEFFPERFLDSSIDYKGQSFEYLPFGSGRRICPGIHMGSITMEIILANLLYCFDWVFPDGMKKEDINMEEKAGVSLTTSKKTPLILVPVNYLQ

SEQ ID NO: 12139 - protein, 337 aa, Streptococcus pyogenes MGAS8232
MTQVFQGRSFLAEKDFTRAELEYLIDFSAHLKDLKKRGVPHHYLEGKNIALLFEKTSTRTRAAFTTAAIDLGAHPEYLGANDIQLGKKESTEDTAKVLGRMFDGIEFRGFSQRMVEELAEFSGVPVWNGLTDEWHPTQMLADYLTVKENFGKLEGLTLVYCGDGRNNVANSLLVTGAILGVNVHIFSPKELFPEEEIVTLAEGYAKESGARILITEDADEAVKGADVLYTDVWVSMGEEDKFKERVELLQPYQVNMDLVQKAGNDKLIFLHCLPAFHDTNTVYGKDVAEKFGVKEMEVTDEVFRSKYARHFDQAENRMHTIKAVMAATLGNLFIPKV

SEQ ID NO: 12140 - protein, 416 aa, Rhizobium leguminosarum bv. viciae 3841
MTRLDVESAEEAMRSLFPATPLQLNDHLSARYGADIWLKREDLSPVRSYKIRGAFNFFRKAIGQGAAGKTFVCASAGNHAQGFAFVCRHFGVPGVVFMPVTTPQQKIDKTRMFGAEFITIRLFGDFFDQCYQAAREHVEAIGGVMVPPFDHADIIEGQATVAAEIMQQLPEGTVPDMVVLPVGGGGLAAGITSYLDGTVPKSAFVFTEPAGAPSLKRSIEAGKVTTLAKVDNFVDGAAVARIGDLNFAALRDFPAEQVQLIPENAICVTIQEMLNVEGVVLEPAGALSLTAIAAMDGQAIRGKTIVAVVSGGNFDFERLPDVKERAMRYAGLKKYFILRLAQRPGALRDFLNLLGPDDDIARFEYLKKSARNFGSILIGIETKAPENFARLIGNFEAAGMGYEDITENEILANLII

SEQ ID NO: 12141 - protein, 539 aa, Bacillus pumilus SAFR-032
MIAVNNVSLRFADRKLFEEVNIKFTPGNCYGLIGANGAGKSTFLKILSGEIEAQTGDVHMSPGERLAILKQNHFEYEEFEVLKVVMMGHKRLYDVMQEKDAIYMKPDFSDEDGIRAAELEGEFAELNGWEAESEAAILLKGLGIPESLQSKKMSELGGSEKVKVLLAQALFGKPDVLLLDEPTNHLDLQAIQWLEEFLINFENTVIVVSHDRHFLNKVCTHIADLDFGKIQVYVGNYDFWYESSQLALKLSQDANKKKEEQIKQLQEFVARFSANASKSKQATSRKKLLDKISLDDIKPSSRKYPYVHFAPEREIGNDVLQVEGLSKTIDGVKVLDNVSFIMNREDKIAFLSRNELAVSTLFKILAGEMEPDNGTYKWGVTTSQAFFPKDNSEYFEGNDVDLVDWLRQYSPNDQSESFLRGFLGRMLFSGEEVKKKASVLSGGEKVRCMLSKMMLSGANVLLLDEPTNHLDLESITALNNGLMSFKGAMLFSSHDHQFVETVANRIIEVTPNGIVDKQTTYDEFLSDQEIQKRLVELYA

SEQ ID NO: 12142 - protein, 159 aa, Lactococcus lactis subsp. lactis Il1403
MKIKLVVVGKLKEKYLKDGIAEYVKRMGTMLPLEIIELADEKIPDNASEKEAEALKKREGEKILSRIQAGDQLAILAIQGKLMSSEEVADFVKKAEVYGTGNLVFVIGGSLGLSKEVYQRSDLQISFGRMTLPHQLMRLVLVEQIYRAQMINRGSAYHK

SEQ ID NO: 12143 - protein, 328 aa, Synechococcus sp. WH 7805
MSRVYADNSQAIGNTPLVRLNHVTKGCKATVLAKVEGRNPAYSVKCRIGANMIWDAEKRGELTDGKVIVEPTSGNTGIALAFTAAARGYKLVLTMPESMSIERRRVMAVLGAEIVLTEAAKGMPGAIAKAKEIADSDPAKYFMPGQFDNPANPDIHFKTTGPEIWNDCDGAIDVLVSGVGTGGTITGVSRYIKNEAGKAIESVAVEPSHSPVITQTLNGEEVKPGPHKIQGIGAGFIPKNLDLSIVDKVEQVTNEESIAMALRLAKEEGLLVGISCGAAAAAAIRLAQQDDYAGKTIVVVLPDLAERYLSSVMFAEVPAGIIEQPVPA

SEQ ID NO: 12144 - protein, 381 aa, Aspergillus oryzae
MAPTIRVVGSLNADMVSVTPRFPEAGETITSSSYFISAGGKGANQAVACGRLSRARSASSTSSGKGSVKVEMVGAVGGLDGHFDALLKPTLEKSGVDTSRVKIVEDAYTGVAVIIVDSSAGGENRILFSPGANYQGMQPEPSVLGMAMAAPVPDVIVMQGEIPVDSVIGILREIRAWKTKNRAEGKRGIEAGPDVMFNPAPAPPGGLPEDVYAAVDHFIMNETEAELMTPPAEQLLKVVPDAEGLSGNDKVARYFHQLGVTYVLITLGSKGVWYSATDAGTSGPADGVNRFTNQIPAAKVSRVLDTTAAGDTFVGAYAVGVARWREQRRADGKAGQDLTSEEKPVRYQKVMDDAMGLATQASARCVERQGAMDSIPWEDEI

SEQ ID NO: 12145 - protein, 441 aa, Synechococcus sp. WH 7805
MPALSSTMTEGKIVEWLKKPGEKVARGESVLVVESDKADMDVESFNEGFLAAVLMPAGSTAPVGETIGLIVESEAEIAEAQAKAPAGAPAAASTGAPTASASASVPAPAVSVPSPPPAPTTQAPAAVPAPPVAPAPTSTGRLIVSPRAKKLAAQMGVDLSLVRGSGPKGRIQAEDVERAAGRPVSVPQVGEGTAPAASSGGAVPAPPSAPAGNSFGLPGETVPFNTLQAAVNRNMEASLAVPSFRVGYTITTDKLDAFYKQVKPKGVTMTALLAKAVAVTLARHPQVNAATTAEGMAYPADVNVAVAVAMEDGGLITPVLRQADRIDLYELSRQWGDLVKRSRSKQLQPEEYSTGTFTLSNLGMFGVDRFDAILPPGTGAILAVAASRPTVVAGKDGSIAVKRQMQVNLTADHRVIYGADGAAFLKDLAELIETRPESLAL

SEQ ID NO: 12146 - protein, 295 aa, Pyrococcus horikoshii OT3
MDVDKLIEAGKIAKKVREEAVKLAKPGVSLLELAEKIESRIVELGGKPAFPANLSLNEVAAHYTPYKGDQTVLKEGDYLKIDLGVHIDGYIADTAVTVRVGMDFDELMEAAKEALESAISVARAGVEVKELGKAIENEIRKRGFNPIVNLSGHKIERYKLHAGVSIPNIYRPHDNYVLQEGDVFAIEPFATTGAGQVIEVPPTLIYMYVRDAPVRMAQARFLLAKIKREYKTLPFAYRWLQGEMPEGQLKLALRSLERSGALYGYPVLREIRGGMVTQFEHTIIVEKDSVTVTTE

SEQ ID NO: 12147 - protein, 365 aa, Clostridium acetobutylicum ATCC 824
MAKKPVMLMILDGFGISDKVDGNAVKAASKPNFDKYFNNYPHTHLGASGLSVGLPDGQMGNSEVGHLNIGAGRIVYQSLTKITKAIEDGDFFKNAALNKAVNNVLENDSTLHLMGLLSPGGVHSHTNHLKGLLQLAKKKNVKKVFVHAFLDGRDVPPSSAKEFIKDIEDYMNEIGLGEIATVSGRYYAMDRDNRWEREELAYNAMVLGKGEEAESAIKAVDASYHDNKTDEFVLPTVIVKEGKPVATIKDKDSVIFFNFRPDRARQITRAIAEEAFDGFKRDRLNIEFVTMTEYDASFKGVDVAFGPENITNTLGEYVSNKGLNQLRIAETEKYAHVTFFFNGGVEEPNKNEDRALISSPKVATY

SEQ ID NO: 12148 - protein, 483 aa, Synechococcus sp. PCC 7002
MVATQEKTLGKITQIIGPVIDAEFPSGKMPRIYNALKIQGKNPYGQEINLTCEVQQLLGDNQVRAVAMSSTDGLVRGMDILDTGAPISVPVGKKTLGRIFNVLGEPVDEKGEVGAEETSPIHRPAPKLTELDTAPSVFETGIKVVDLLTPYRRGGKIGLFGGAGVGKTVIMMELINNIATNHGGVSVFAGVGERTREGNDLYNEMIESGVINPDNLNDSKIALVYGQMNEPPGARMRVGLSGLTMAEYFRDVNKQDVLLFVDNIFRFVQAGSEVSALLGRMPSAVGYQPTLGTDVGDLQERITSTKEGSITSIQAVYVLADDLTDPAPATTFAHLDGTTVLSRALASKGIYPAVDPLDSTSTMLQPSIVGEDHYNTARAVQSTLQRYKELQDIIAILGLDELSEEDRLTVDRARKIERFLSQPFFVAEVFTGSPGKYVTLEETIEGFKRILSGELDDLPEQAFYLVGNIEEAIAKGKKLKEQG

SEQ ID NO: 12149 - protein, 428 aa, Pseudomonas aeruginosa PAO1
MGTHVIKMPDIGEGIAEVELVEWHVQVGDSVNEDQVLAEVMTDKATVEIPSPVAGRILALGGQPGQVMAVGGELIRLEVEGAGNLAESPAAATPAAPVAATPEKPKEAPVAAPKAAAEAPRALRDSEAPRQRRQPGERPLASPAVRQRARDLGIELQFVQGSGPAGRVLHEDLDAYLTQDGSVARSGGAAQGYAERHDEQAVPVIGLRRKIAQKMQDAKRRIPHFSYVEEIDVTDLEALRAHLNQKWGGQRGKLTLLPFLVRAMVVALRDFPQLNARYDDEAEVVTRYGAVHVGIATQSDNGLMVPVLRHAESRDLWGNASEVARLAEAARSGKAQRQELSGSTITLSSLGVLGGIVSTPVINHPEVAIVGVNRIVERPMVVGGNIVVRKMMNLSSSFDHRVVDGMDAAAFIQAVRGLLEHPATLFLE

SEQ ID NO: 12150 - protein, 133 aa, Nicotiana benthamiana
LIYVSREKRPGFQHHKKAGAMSALVRVSAVLTNGPFMLNLDCDHYINNSKALREAMCFLTDPNLGKYVCYVQFPQRFDGIDRNDRYANRNTVFFDINLRGLDGIQGPVYVGTGCVFNRTALYGYEPPIKPKHK

SEQ ID NO: 12151 - protein, 464 aa, Pseudomonas aeruginosa PAO1
MSQILKTSLLIVGGGPGGYVAAIRAGQLGIPTVLVEGAALGGTCLNVGCIPSKALIHAAEEYLKARHYASRSALGIQVQAPSIDIARTVEWKDAIVDRLTSGVAALLKKHGVDVVQGWARILDGKSVAVELAGGGSQRIECEHLLLAAGSQSVELPILPLGGKVISSTEALAPGSLPKRLVVVGGGYIGLELGTAYRKLGVEVAVVEAQPRILPGYDEELTKPVAQALRRLGVELYLGHSLLGPSENGVRVRDGAGEEREIAADQVLVAVGRKPRSEGWNLESLGLDMNGRAVKVDDQCRTSMRNVWAIGDLAGEPMLAHRAMAQGEMVAELIAGKRRQFAPVAIPAVCFTDPEVVVAGLSPEQAKDAGLDCLVASFPFAANGRAMTLEANEGFVRVVARRDNHLVVGWQAVGKAVSELSTAFAQSLEMGARLEDIAGTIHAHPTLGEAVQEAALRALGHALHI

SEQ ID NO: 12152 - protein, 289 aa, Schizosaccharomyces pombe 972h-
MLRRAVRERRQFIYKRNQELQEAKLNEKRRALRKALEGNKELNKDLQEDSQLQKDYKYDESRATQEETETNLDDEYHRLGEREPKVLVTTSREPSSRLAQFAKEVRLLIPNSYRLNRGNIVVGSLVEAARANDITDIVILHEHRGIPDGLVISHLPYGPTLSFSLHNVVLRHDIPNTGTMSEAYPHLIFENLTSKLGKRVKTALSALFPPDPKDTTPRVVTFANTDDYISFRHHIYAKTGPKQIILSEAGPRFEMKLFEITLGTVDMVDADVEWKLKPYQRHKRDVLAE

SEQ ID NO: 12153 - protein, 122 aa, Buchnera aphidicola str. APS (Acyrthosiphon pisum)
MSITKEQILEAISEMSVMNVVDLITAMEEKFGVSASMSINSNNHNEKDLREEKTEFDIFLKVIGPNKVSVIKTVRSATGLGLKEAKDLVESAPTVLKENISKEDAESLKKTLEDVGAEIEIK

SEQ ID NO: 12154 - protein, 223 aa, Nicotiana tabacum
LDGIQGPVYVGTGCVFNRTALYGYEPPIKPKHKKAGLFSSCFGGSRKKSSKSSKKGSDKKKSSKNVDPTVPIFNLEDIEEGVEGAGFDYEKSLLMSQMSLEKKFGQSAVFVASTLMENGGVPQSATPETLLKEAIHVISCGYEDKSEWGSEIGWIYGSVTEDILTGFKMHARGWRSIYCMPKRPAFKGSAPINLSDRLNQVLRWALGSVEILFSRHCPIWYGY

SEQ ID NO: 12155 - protein, 392 aa, Crocosphaera watsonii WH 8501
MHFAQRIQALEKNVFADMDRAKSQAISKGKKIIDLSLGSSDLPADPEAIATISASLEDPSTYGYLLHHGTLNFRETVGQWYSNRFGVEVDPQREVLTLIGSQEGTAHLPLALLDPGDFALLLDPGYPSHAGGVYLAGGQIYPMPLLAENDFLPVFEDIPSQVLGQAKLMVLSYPHNPTTATASLSFFQEAVNFCRNHGLVLVHDFPYVDIVFEGMTQPPSILQADTQKSLSIEFFTLSKSYNMGGFRIGYAIGNAEIIQALRQVKAVVDFNQYQGILNGAIAALTGEQTTVKKTLARFQSRRDAFIKALNNIGWQVTPPQATMYVWAKLPQTWENKSVEFSTELVAATGVAVSPGAGFGKQGEGYVRFALVHDPHVLELAVEKIAQFLATRT

SEQ ID NO: 12156 - protein, 245 aa, Neisseria meningitidis MC58
MALQDRTGQKVPSVVFRTRVGDTWKDVSTDDLFKGKKVVVFSLPGAFTPTCSSSHLPRYNELFGAFKENGVDAIYCVSVNDTFVMNAWAAEEESDNIYMIPDGNGEFTEGMGMLVGKEDLGFGKRSWRYSMLVNDGVVEKMFIEPEEPGDPFKVSDADTMLQFVAPDWKAQESVAIFTKPGCQFCAKAKQALQDKGLSYEEIVLGKDATVTSVRAITGKMTAPQVFIGGKYIGGSEDLEAYLAKN

SEQ ID NO: 12157 - protein, 156 aa, Oryza sativa Indica Group
MNGIELSSEDKAILVETLKNKLQALAEQHVDVLESLAPSVRKRVDVLMEIQSQHDELEVKFFEEKAALEAKYQKLYGPLYSKEKGVPDFWLNAMKNNEILAEELAHVARSTLRDKIIPHAVSWFTREAVQDEDYGASWVDDEEEDDNDDEYSDEEA

SEQ ID NO: 12158 - protein, 441 aa, Novosphingobium aromaticivorans DSM 12444
MNTMPKIDAQFAQGLAAERCRVLFADQLNLARGKYVPMADAARGHTRMCVGTFAVTYDKALVAAPGGGMLDGLPDMEVTFDPQALRPSWDPGTKIALGSLRFKGEPFALCGRSALQRAIDAWRARGLEPMVGIEMEAYVFQRGADGGWVPYDTPGAFVYGTGPFSDPAGLIDEIWRTAEACGIPVESMNAEFDAPQFELTLRYADAMKAADDAFLFRQMAREVLYKRGYLLSFLPKPFAQKSGSGLHFNLSFTKDDGGNVFANDVATGTLSPEMKGCIAGLIRHHEALAAIMAPITNSYARLQPASLSGYWANWGIDHRSVTVRVSAETGPAARIEHRMADCAASPYFAMAAMLQAALLGLENGYDLPEPETNDGLETINTDRHTPHCLSDALDALEADTALAYAVGADLVANFVAIKRDEVRIVGDLSEAEQLAYYLHYV

SEQ ID NO: 12159 - protein, 153 aa, uncultured marine bacterium 577
MENLEKLNLTELKSKLSAEQFKVTQKGGTEEPFRNLYWNNSEPGLYVDVVSGESLFSSLDKYDSGTGWPSFTRPVQNSGIIEKKDNEYGMVRTEVRSGYADSHLGHVFTDGPSPTGKRYCINSASLRFIPVDSLSEERYKDYIDSDSKENKIE

SEQ ID NO: 12160 - protein, 142 aa, Paxillus involutus
  misc_feature (17)..(17): Xaa can be any naturally occurring amino acid
YIMLKPDGVDRGLIGEXLARFEKRGFKLIAAKLALPSKEHLEKHYADLKDKAFFPGMIKYMQSGPVFCMVFEGLDAVKTGRAMLGATNPLASQPGTIRGDYALAVGRNICHGSDSVENAEKEIALWFPDGTLQYQLSQEAMI

SEQ ID NO: 12161 - protein, 382 aa, Zea mays
MERMLARLMRRRSSVPLSGLLHHGGAPAPLQAAGATGASPLILSHQQQQQHTAASAVLPGLKIRDSASQLIGRTPMVYLNKVTEGCGARVAAKLEFLQPSFSVKDRPAISMLEDAEKRGLITPGKTTLIEPTSGNMGIGLAFMAALKGYELVLTMPSYTSLERRVTMRAFGANLVLTDPAKGMGGTVRKATELYERHPSAHMLQQFQNPANVKVHYDTTGPEIWEDTLGQVDIFVMGIGSGGTVTGVGKYLKEKNPNAKIYGVEPAEANVLNGGKPGPHLITGNGVGFKPDILDMDVMEKVLEVKGEDAVKMARELAVKEGLLVGISSGANTVAALELAKRPETKGKLFVTVLPSLGERYLSSALFDELRKEAQAMDPVAVD

SEQ ID NO: 12162 - protein, 468 aa, Agrobacterium tumefaciens str. C58
MAYDVVVIGTGPGGYVCAVKAAQLGLKVAVIEKRATYGGTCLNVGCIPSKALLHASETFAHVAHGVDTLGIEVAAPKLNLEKMMGHKDGVVKANVDGVAFLFKKNKIDAFQGTGKVVSAGKVSVTNDKGETQEIEAKNIVIATGSDVAGIPGVKVDIDETVIVSSTGAIALSKVPEKLIVVGGGVIGLELGSVWSRLGAKVTVVEYLDNILGGMDGEVSKQSQRLLAKQGLDFKLGAKVTAVEKTAAGAKVVFEPVKGGAAETLEADVVLISTGRKPYTEGLGLAEAGVVLDSRGRVEIDGHYKTNVDGIYAIGDVVKGPMLAHKAEDEGVALAEILAGQRGHVNYDVIPAVVYTQPEIASVGNTEEELKAAGVAYKVGKFPFTANGRARAMQVTDGFVKILADKETDRVLGGHIVGFGAGEMIHEITVLMEFGGSSEDLGRTCHAHPTMSEAVKEAALATFFKPIHM

SEQ ID NO: 12163 - protein, 166 aa, uncultured marine bacterium 577
MTSKIRIGQGSDVHQLVEGRDLIVGGVVIPFDKGLLGHSDADVLLHAICDALLGAAALGDIGRHFSDTNPQYKNIDSRVLLQEVCHLLEERGYIVINIDATIIAQAPKMAPHIPTMISNISQDIGIQEKDINIKAKTAEHLGPIGRGEGIEAEAICLIAKTDNVRC

SEQ ID NO: 12164 - protein, 310 aa, Chlamydomonas reinhardtii [sequence omitted]

SEQ ID NO: 12165 - protein, 312 aa, Chlamydomonas reinhardtii
MSLFKSSLPAGFLFPYRHPKAKGLVEGTLYGLGSLFRGVGAALDELGSMVQGPQGSVKDHVQPNLAFAPVHRKPDVPVNAGQVVPAPPAAARTLKIKEVVVPNKHSTAFVAANANVLGNVKLGAGSSVWYGAVLRGDVNGIEVGANSNIQDNAIVHVSKYSMDGTARPTVIGNNVTIGHAATVHACTIEDNCLVGMGATVLDGATVKSGSIVAAGAVVPPNTTIPSGQVWAGSPAKFLRHLEPEEASFIGKSASCYAELSAIHKFEQSKTFEEQYTESCIIKDRAALADPSNSVHQMWEYDSQTALVARAKR

SEQ ID NO: 12166 - protein, 312 aa, Pseudomonas syringae pv. syringae B728a
MFLVCGEALFDIFTRADDSGSLNRLGFDAIAGGSPFNVAIGLRRLGVEASFLAGLSTDYLGRRLRAVLEKETVNTDHLIDFDAPTTLAMVAVGSDGSPTYSFRGDGCADRQLRLEHLPELDGQVRGIHVGSFSLVVQPIADTLLALVARESSTRLISLDPNVRLNPAPDIQRWRSQVAAFAEHAHMIKVSDEDLHLLYPDSDPQKIAEGWLGKRTQLVIVTRGTQGASVFTRQHGTWSAPAKTVVTADTVGAGDTFQAALLTFLSERQLDTPEGLATLSRELLDEMLSFAVGAAALTCTKVGPDLPYRHQLG

SEQ ID NO: 12167 - protein, 574 aa, Agrobacterium tumefaciens str. C58
MPSFREDALSRIRHDGDFDAVVIGGGINGIAAYRDLALQGLRVLLVERNDFSSGCSAAPSRMIHGGLRYLENGEFGLVAESLRERDALLTLAPHMVQPLPTTIPIFSMFSGLFNAAATFFGSGGKPASRGALAIKAGLTLYDFVTRKNRLLPRHEFRGAGKTLKRWPGLTPDIRYSATYYDAWISQPERLALELLIDTSADAPQSIALNYAELVRNGDEYHIRAEETDETLPIRPRIIVNATGAWIDETIGTLSAGPAAEKQKPTVSGTKGSHLIIANDGLLKALNGHMIFFENADNRVCILFPYLGRVLAGSTDIKVDRPERVRCEPDERDYILDAIRQVFPDITVDHSDIVFSFSGIRPLPRSDAAFTGRISRSHFIHRVAGDPPQLCMIGGKWTTFRAFGEQVSDEVLAFLGRKRLTGTMNRPIGGGRNFPTGAGRLPALLSEQFSIDRRRAQHLALAYGSRAFELMGFCRGRPDDAPLSQKSPITAAEILWLIRCEHVRHLTDLILRRTTLAIAGLIDADLIDAILGVAARELGWTPTRAAVERQQLTQELETFYGVTPAMLQNRCKENA

SEQ ID NO: 12168 - protein, 66 aa, Glycine max
  misc_feature (32)..(33): Xaa can be any naturally occurring amino acid
AIIAEESKQFEAWRDSLETVPTIKKLRAYAEXXRLAELEKCLGKMGFQENRGRKKQSGAIKGRGTG

SEQ ID NO: 12169 - protein, 341 aa, Prochlorococcus marinus str. NATL2A
MRIGINGFGRIGRLVLRALWDRENIEISHINDPFGDAKGAAHLLEYDSVHGRWNKAISNDQNNLSIEGQPISFSQESDYTKVPWNEKGTELILECSGKFKTPQTLNPYFDTLGMKRVVVACPVKGSIQGEDTLNIVYGINHDLYEPNKHRLVTAASCTTNCLAPVVKVVNQAFGIKHGSITTLHDLTNTQVIVDSFKSDLRRARSGSQSLIPTTTGSAKAIGMIFPELQGKLNGHAVRVPLLNGSLTDAVFELEKEVTQEEVNHVFKEASEGELKGILGYEEKPLVSIDYVNDSRSSIIDAPSTMVINKTQLKVYIWYDNEWGYSCRMADLVCHVINLEKD

SEQ ID NO: 12170 - protein, 396 aa, Salmonella typhimurium LT2
MFENITAAPADPILGLADLFRADDRPGKINLGIGVYKDETGKTPVLTSVKKAEQYLLENETTKNYLGIDGIPEFARCTQELLFGKGSALINDKRARTAQTPGGTGALRIAADFLAKNTPVKRVWVSNPSWPNHKSVFNAAGLEVREYAYYDAENHTLDFEALQASLSEAQAGDVVLFHGCCHNPTGIDPTLEQWQVLAELSVEKGWLPLFDFAYQGFARGLEEDAEGLRAFAALHKELIVASSYSKNFGLYNERVGACTLVAADAETVDRAFSQMKSAIRANYSNPPAHGASIVATILSNDALRAIWEQELTDMRQRIQRMRQLFVNTLQEKGANRDFSFIIKQNGMFSFSGLTKDQVLRLREEFGVYAVASGRVNVAGMTPDNMAPLCEAIVAVL

SEQ ID NO: 12171 - protein, 375 aa, Archaeoglobus fulgidus DSM 4304
MDWIEREKKHILQTYTRQKVVIERGEGCYVYDVNGKRYLDLVAGIATVSIGHCNSHLVERLKEQLEKLIHISNLYYTTPQVELAEKLSEIAGMDRFFFCNSGAEAVEAALKFARRATGRKKFVSFTGDFHGRTMGALSVTHKEKFRKPFEPLVSPVEFAEFNNPESLEKVVDEETAAVIVELVQGEAGVYPADREFVKAIEELREKYGFLLIVDEVQTGFGRTGRWFAKDHYGIEPDMITMAKAMGSGVPIGCCALKEEVAEKIQVGDHGSTFGGNPLACTAALATIEVIEREGLVENSARMGEYFVKRLKESFENVIGVGLMIGFDVGDAAEFVRKCLENGLLVNNTSERRIRLVPPLVITEREVDKAVEIMLN

SEQ ID NO: 12172 - protein, 315 aa, delta proteobacterium MLMS-1
MVSWSPNRLQNLTRAKVTTLDIKQYLAAQRELVEAALEQLLPAEDGPLAAHIEAMRYSLLAGGKRVRPILCLAAAEAVGSDPKPLLPVAGALECIHTYSLIHDDLPAMDNDDLRRGMPTSHKKFGEAAAILAGDGLLSFAFELLARPLGEHGPGPAAQLRLLATVAAAVGPRGMVGGQVLDIEAEGRRLELDELQQIHRHKTGALITAAVQAGAIGGGASETQLQALTRYGQQTGLAFQIVDDLLNVTSDTATLGKAAGSDAARGKATYPALLGLEATEDKAREAVAAAVAALESFDHRAEPLRELARYIHSRKK

SEQ ID NO: 12173 - protein, 367 aa, Dehalococcoides ethenogenes 195
MAVTIGIIGLAKSGRTTIFNAATRSNAATGSYSQSSSANVGIVKVPDARLTPLEEMFHPKKLTPAEIKYFDVGASLKGGTKDSSFSGELLTQLQNVDALLNVIRAFEDTAIPLPAGGLNAERDLTTMNAELIFSDLTIIEKRLNRIGSQMKGAKPPERAALEREKELMARIKEAMEKDIPARDIELDEEEAKILSGYQFLSSKPVLMVINIGEDDLPKAAEMEAELNGRYGGKNYRVIVMCGKLEAELINMDEAEAAEFRSSYGLKETGLDRTIRASYELLDLISFFTVGPDEVRAWTITRGTIAQKAAGKIHSDIERGFIRAEIVHVNDLLAAGSLAEVRKRGQLRLEGKTYLVQDGDTANFLFNV

SEQ ID NO: 12174 - protein, 625 aa, Ustilago maydis 521
MQSDAGPSRAIAPSASTATKRPDKRLARSATPAEEHDQTFFAFNIINQAESSIQQRTSSQSSPTTSKHPALARSSRPLRSIMTLLLLTLVAALLLSPTALASQGDRSPEYRLCVDSCTADLCRDGVDDGTMLAHRLPFILRITRWTCEDDCKYHCTHRITNDAAERVHKIQHDARIEVELLAQSQPLSASVKAERIKGIIKSKLAELRPVQKQMVQFHGKWVFIRFLGAQEPLSVLFSLLNFKIHWNALFMMRNQLPDASPLKLVYIVHTLISMNAWLWSAIFHTRDKNWTEKLDYFSAGSVVMSALFFSAARLFRLAPGSKRFVLLRRVCMAALALHVLYLSIGRFDYAYNMAANVVIGLIHTLLWLMYSLRPTTFPSNPLVDRTAYSRAAMRATKPNLSVLSTPTPLSNGAQTPPVPVSTNIGPPNSHTRRRRRLQLILALMSASVLFELLDFAPILRILDAHALWHLATVPITKMWYDWLVNDAQECVNTGWWLSDRSAGVQGGELASTLEHLSEKLKGRAASLAQNIELHALTTKLNELANKAGFSGRVGGLNGKVGFSGVNSTSGLGLEMEEQHQHATSSVAKGGLSATSTGIGLGSSSLTDRDAGHGASSGSTGKAKNW

SEQ ID NO: 12175 - protein, 260 aa, Synechococcus sp. WH 7805
MAQALVRPLVESGSLRGSDLIAVVGQEPSVARLKPELPSEITLISASDPRVHEAWEAPVQLLAVKPQQLDRVAESASTPPAGHAPLLISVLAGVTLERLQSTFPSRVCVRAVPNTPCLVAEGLCGLAWGRDVSPEQKAWVRRMFEPVSEVLELPESQLDAFLALTSSGPAYVALMAEAMADGAVAAGLPRVLAHHLAHRTLAGTAALLQEQELHPGQLKDMVASPGGTTMAALRRLEQAGVRSALIEAVVAAAEHGRALR

SEQ ID NO: 12176 - protein, 634 aa, delta proteobacterium MLMS-1
MTANHHEPQTAPALLESIESPHDLRRLERAQLPALAAELRQRIVNTVATTGGHLAPSLGVVELTLALHYIFNTPADKIIWDVGHQCYAHKLLTGRRERFDTLRCYQGISGFPKREESEYDTFDTGHSSTSISAALGMAVATDLKGEDNKTIAVIGDGSMTGGLAFEGLNQTGHLGKNLIVVLNDNEMSISPNVGALSSFLSRKLTGRTMVRIKRELEHLLKNRRTGENILHFLKRGEESLKGFFTPGMLFEALKFEYVGPLPGHKLDVLLETLSNVRDFSQGPVLVHVLTTKGKGYPPAEERPWDFHGVGPFEVATGKIRKSPAGPPSYTKVFGDTLAELAATDPRLTAITAAMPAGTGLDRFAAEFPDRFFDVGIAEQHAVTFAAGLASEGLRPVVAVYSTFLQRAFDQVVHDVCLPNLPVILAIDRGGVVGDDGPTHHGSFDLSFLRIIPNLLLMAPKDENELRHMFYTALHCPGPAALRYPRGAGVGVELEEELKKIPFGKGELLREGDDLLLLPVGNRVYPALEAAAELAGEGIEAAVINPRFIKPLDGDLICHWAEKTGRVLTVEDNTRTGGFGAAVLELGQRRGLRQVRYKLLGLPDRFLEHGEPQRLRQLAGIDPAAISAAAQELMK

SEQ ID NO: 12177 - protein, 161 aa, Nicotiana tabacum
  misc_feature (31)..(31): Xaa can be any naturally occurring amino acid
SDKHADGSVPVFNLEDIEEGIEGSGFDDEKXLLMSQMSLEERFGQSSVFVASTLMEYVGVPQSATPESLLKEAIHVISCGYEDRSDWGREIAWIYGSVTEDILTGFKMHARGWRSIYCMPKRPLSSSAPINLSDRLNQVLRWALGSVEILFSRHCPIWYGY

SEQ ID NO: 12178 - protein, 365 aa, Aspergillus oryzae
MAEFVRAQIFGTTFEITSRYTELQPVGMGAFGLVCSARDQLTGQPVAVKKIMKPFSTPVLSKRTYRELKLLKHLRHENIISLSDIFISPLEDIYFVTELLGTDLHRLLTSRPLEKQFIQYFLYQILRGLKYVHSAGVVHRDLKPSNILINENCDLKICDFGLARIQDPQMTGYVSTRYYRAPEIMLTWQKYDVEVDIWSAACIFAEMLEGKPLFPGKDHVNQFSIITELLGTPPDDVIETICSENTLRFVKSLPKRERQPLATKFKNADPDAVDLLERMLVFDPKKRIRAGEALAHEYLAPYHDPTDEPVAEEKFDWSFNDADLPVDTWKIMMYSEILDFHNIDQGTEASQVLVEGAGDAQQNFV

SEQ ID NO: 12179 - protein, 447 aa, Bacillus pumilus SAFR-032
MAFEFKLPDIGEGIHEGEIVKWFVKPNDEINEDDVLAEVQNDKAVVEIPSPVKGKVLELKVEEGTVATVGQTIITFDAPGYENLQFKGSEEEGEAKTEAQVQGTAEAGNEPEKKEVAQEEAAAATDAGAQEQVDADPNKRVIAMPSVRKYAREKGIEIYKVAGSGKNGRVLKEDIDSFVNGGSATQEAAPQAAESAKEEAAPKAAAAAPVLEGEFPETREKMSGIRKAIAKAMVNSKHTAPHVTLMDEVDVTNLVAHRKQFKQVAADQGIKLTYLPYVVKALTSALKKYPVLNTSIDDKTDEVVQKHYYNIGIAADTEKGLLVPVVKNADRKAIFEVSNEINELATKARDGKLAPAEMKGASCTITNIGSAGGQWFTPVINHPEVAILGIGRIAEKAVVRDGEIVAAPVLALSLSFDHRMIDGATAQNALNHIKRLLNDPQLILMEA

SEQ ID NO: 12180 - protein, 379 aa, Phragmites australis
MATAGQVIKCKAAVAWEAGKPLSMEEVDVAPPQAMEVRIKILFTSLCHTDVYFWEAKDQTPVFPRIFGHEAGGIVESVGEGVTDVAPGDHVLPVFTGECKECAHCKSAESNMCDLLRINTDRGVMIGDGKSRLSINGKPIYHFVGTSTFSEYTVMHVGCVAKINPEAPLDKVCVLSCGISTGLGASINVAKPPKGSTVAIFGLGAVGLAAAEGARIAGASRIIGIDLNANRFEEARKFGCTEFVNPKDHNKPVQEVLAEMTNGGVDRSVECTGNINAMIQAFERVHDGWGVAVLVGVPHKDAEFKTHPMNFLNERTLKGTFFGNFKPRTDLPNVVELYMKKELELEKFITHTISFAEINKAFDLMVKGEGIRCIIRMDN

SEQ ID NO: 12181 - protein, 470 aa, Bacillus pumilus SAFR-032
MVVGDFPIETDTLVIGAGPGGYVAAIRAAQLGQKVTIVEKGTLGGVCLNVGCIPSKALINAGHRFENAKHSEDMGIKAENVTVDFTKVQEWKASVVNKLTGGVQGLLKGNKVDIVKGEAYFVDSNSVRVMDENSAQTYTFKNAILATGSRPIELPTFKYTDRVINSTGALALKEVPKKLVVIGGGYIGTELGTAYANFGTEVVILEGGDEILPGFEKQMSSLVKRNLKKKGNVEIHTNALAKGVEEKSDGVTVTFEVKGEEKTVDADYVLVTVGRRPNTDELGLEQVGVELTDRGVVKTDKQCRTSVSNIYAIGDIVDGPPLAHKASYEGKIAAEAIAGEPAEIDYLGIPAVVFSEPELATVGYTEAEAKEEGIDIVAAKFPFAANGRALSLDATDGFMKMITRKEDGLVIGAQIAGVGASDMISELSLAIEAGVTAEDIAMTIHAHPTLGEITMETAEVAIGSPIHIVK

SEQ ID NO: 12182 - protein, 482 aa, Comamonas sp. NCIMB 9872
MNSSLHYNYVGGDWVNGATERHNLNPSDLSDSIGIYVGANEAQTQAAIDAAFDARTAWACWTAEQRADALDRIGTSILASAKELGHLLSREEGKTLAEGIGEAARAGRIFKYFAAEALRCGGDLLPAIRPGVSVEVTREPEGVVGIITPWNFPLAIPAWKIAPALAYGNTVVFKPADLVPGSAWALTEIIHRVGGLPPGVFNLVMGPGSKVGNTLANAPKVRALSFTGSATTGRQVGLACMERGAKVQMEMGGKNPLVVLNDADLQSAASVAIQGSFYSTGQRCTGSSRLIVEAGIHDAFVEAMRQQMSALSIGHALKQGTDIGPVASEDQLQQDLEYIRIGVAEGGRLYCGGSQLERETEGFYLSPALLTETDNSMRINREEIFGPVASVIRVGSYEEALHTANDTVFGLSSGICTTSLKYASDFKRRSAAGMVMVNVPTAGVDYHAPFGGRKGSSYGAREQGAYAREFYTVIKTAYTSAG

SEQ ID NO: 12183 - protein, 316 aa, Pseudomonas aeruginosa PAO1
MADFEILCFGETMAMFVAEQPGELDRVEQFGKRIAGADSNVAIGLARLGFAVAWLSRVGDDSLGRFVLDSLTREGLDCRFVEVDAQAPTGFQMKSREVDGADPRVEYFRRGSAASRLGLAHIREEMLGARHLHATGIPPALSASACELSHELMRRMRGKGASLSFDPNLRPSLWPSERRMIAEINALAAHAHWVLPGLEEGRLLSGWQEPADIAAFYLDMGVDAVAIKLGPSGAYYRDAHGEGLVPGVPVATVVDTVGAGDGFAVGVVSALLEGLPLPDAVARGNWIGSRAVQVRGDMEGLPKRSQLLDRERRRSA

SEQ ID NO: 12184 - protein, 410 aa, Agrobacterium tumefaciens str. C58
MATEIRVPTLGESVSEATVGTWFKKVGDTVKADEPLVELETDKVTVEVPAPASGVLTEIVAQNGETVGLDALLGQIAEGAAGAATSAPAAKPAAPAAAPAPAAAVAAAPGGSAMPPAPAAGKLLAENNLSADQVDGSGKRGQVLKGDVLAAVAKGVSAPAAAPAPVAAPRPVSAEQDQVREERVKMTRLRQTIARRLKDAQNTAAMLTTYNEVDMSAVMDLRNRYKDVFEKKHGVKLGFMGFFTKAVTHALKELPAVNAEIDGTDIIYKNYCHVGMAVGTDKGLVVPVIRDADQLSIAGVEKELGRLAKAARDGSLGMADMQGGTFTITNGGVYGSLMSSPILNAPQSGILGMHKIQERPVAIGGQVVIRPMMYLALSYDHRIVDGKEAVTFLVRVKESLEDPERLVLDL

SEQ ID NO: 12185 - protein, 357 aa, Pisum sativum
MAVKEATSETKKRSGYEIITLTSWLLQQEQKGIIDAELTIVLSSISMACKQIASLVQRANISNLTGTQGAVNIQGEDQKKLDVISNEVFSNCLRSSGRTGIIASEEEDVPVAVEESYSGNYIVVFDPLDGSSNLDAAVSTGSIFGIYSPNDECLPDFGDDSDDNTLGTEEQRCIVNVCQPGSNLLAAGYCMYSSSVIFVLTIGKGVFVFTLDPLYGEFVLTQENLQIPKSGKIYSFNEGNYKLWDENLKKYIDDLKEPGPSGKPYSARYIGSLVGDFHRTLLYGGIYGYPRDKKSKNGKLRLLYECAPMSFIVEQAGGKGSDGHQRVLDIQPTEIHQRVPLYIGSTEEVEKVEKYLA

SEQ ID NO: 12186 - protein, 393 aa, Neisseria meningitidis MC58
MIIDVKVPMLSESVSEGTLLEWKKKVGEAVARDEILIDIETDKVVLEVPSPQAGVLVEIVAQDGETVVADQVLARVDTAATAAAEAPAAAPAEAAPAAAPAATQNNAAMPAAAKLAAETGVDVNALQGSGRDGRVLKEDVQNAAAKPAGAAAPAVALPAGARPEERVPMSRLRARVAERLLASQQENAILTTFNEVNMKPIMDLRAKYKEKFEKEHGVKLGFMSFFVKAAVAALKKYPVVNASVDGKDIVYHGYFDIGIAIGSPRGLVVPILRDADQMSIADIEQAIVDYAKKAKDGKIAIEDLTGGTFSITNGGTFGSMMSTPIINPPQSAILGMHATKERAVVENGQVVVRPMMYLALSYDHRIIDGREAVLTLVAIKDALEDPARLLLDL

SEQ ID NO: 12187 - protein, 171 aa, Oryza sativa Indica Group
  misc_feature (3)..(3): Xaa can be any naturally occurring amino acid
MEXQGDWMPAARRPDPLHHNCGFFGSAATMNMCSKCHKEMIMKQEQAKLAASSIDSIVNGGDSGKEPIIAGHAEVAVAQVEVKTLVAQPAEIAGPSEGVTVNPKGREGPNRCSTCRKRVGLTGFNCRCGNLYCATHRYSDKHDCQFDYRTAARDAIAKANPVVKAEKLDKI

SEQ ID NO: 12188 - protein, 397 aa, Agrobacterium tumefaciens str. C58
MNIHEYQAKALLKGYGAPVAEGVAILKVEEAEAAAKQLPGPLYVVKSQIHAGGRGKGKFKELGPDAKGGVRLAKSIEEVVSHSRDMLGNTLVTAQTGDAGKQVNRLYIEDGADIARELYCSLLVDRSVGQVAFVVSTEGGMDIEAVAHDTPEKIHTIAINPEKGVSDADVAAISKALELDGVAAEDAKALFPILYKAFNEKDMALLEVNPLIVMENGHLRVLDAKMSFDGNALFRHEDVKALRDETEEDAKEIEASKWDLAYVALDGNIGCMVNGAGLAMATMDIIKLYGKEPANFCDVGGGAGKEKVAAAFKIITADPKVEGILVNIFGGIMKCDVIAEGVIAAVKEVGLQVPLVVRLEGTNVELGKKLLNESGLAITAADDLDDAAKKIVAAING

SEQ ID NO: 12189 - protein, 274 aa, Buchnera aphidicola str. APS (Acyrthosiphon pisum)
MCILKISRIWNKILYDVSFLLKKEPILSDFYQSSILQHQSFTSSLSYILSNKLSTSMISEKKIQGIFDDVYLNDRSILNFIVQDIKAVLKRDPAVNDYLTPLLYLKGFHALEAYRISHYLWNTGKKSLSLYLQSRISSEFSVDIHPAAFIGSGVMLDHATGIVIGEGVTIENDVSILHSVTLGGTGKNFSQNRHPTIRKGVVIGAGAKILGNIEVGSGAKIGAGSIVLKNVPSDVTVVGVPAKIVSQVSSKKYYSQKKKNSLKYINIFQHGDGI

SEQ ID NO: 12190 - protein, 527 aa, Oryza sativa Indica Group
MDHQLVARGLFKPLLLFVAGLIVLYALRRRRHRRSSDLRLPPSPFGLPILGHLHLLAPLPHQALHRLAARHGPLLFLRLGSVPCVAACSPDAAREVLKTHEAAFLDRPKPAAVHRLTYGGQDFSFSAYGPYWRFMKRACVHELLAGRTLDRLRHVRREEVARLVGSLRASADGGERVDVDAALMGLTGDIVSRMVMGRRWTGDDNDAEEMRSVVAETAELTGTFNLQDYIGVFKYWDVQGLGKRIDAVHRKFDAMMERILTPREAKRKLRRQAAADGEDDEKDLLDMLFDMHEDEAAEMRLTRDNIKAFMLDIFAAGTDTTTITLEWALSELINNPPVLRKLQAELDAVVGGARLADESDIPSLPYLQAVAKETLRLHPTGPLVVRRSLERATVAGYDVPAGATVFVNVWAIGRDAAWWPEPTAFRPERFVSGGGGGGTAADVRGQHFHLLPFGSGRRICPGASLAMLVVQAALAAMVQCFEWSPVGGAPVDMEEGPGLTLPRKRPLVCTVSPRIHPLPAAASASLT

SEQ ID NO: 12191 - protein, 458 aa, Glycine max
MSITHSLTTPLSSSSSAFLAPSSFNCRGQVSLPVKSVSICKCVATPEAETAYKTGVNRNPNMGKLQAGYLFPEIARRRSAHLLKYPDAKVISLGIGDTTEPIPEVITDAMSKRSHALSTIEGYSGYGAEQGEKPLRRALASTFYSDLGIEEDDIFVSDGAKCDISRLQIVFGSNVKMAVQDPSYPAYVDSSVIMGQTGLFQKNVEKFANIEYMRCNPENGFFPDLSSISRPDIIFFCSPNNPTGAVATREQLTQLVQFAKDNGSIVIHDSAYAMYISGDNPRSIFEIPGAKEVAIETSSFSKYAGFTGVRLGWTVVPKQLLFSDGFPVAKDFNRIVCTCFNGASNISQAGGLACLSPEGLKAMRDVIGFYKENTNIIMETFDSLGFKVYGGKDAPYVWVHFPGRSSWDVFAEILEKTHVVTTPGSGFGPGGEGFIRVSAFGHRENVLEACRRFKQLYK

SEQ ID NO: 12192 - protein, 407 aa, Triticum aestivum
  misc_feature (13)..(13): Xaa can be any naturally occurring amino acid
  misc_feature (140)..(140): Xaa can be any naturally occurring amino acid
  misc_feature (311)..(311): Xaa can be any naturally occurring amino acid
MAADTSKPLFPAXPHASLLPSHGNANRLSPEAAYWGNFRSSTLDTGSTAFSVTHLDFSPGRSRAKLAAALASAGNLFRGEPVWAAGQGEPSGRDPPPLFPLLPLRKKPLFPPGQRAGGFCGLFPGEKTPPGDAMTIMPIXGTFLTRFVQKSTLLPRGVFPGYRRPTRPASISPTGPLRTLSAHAAQTRVVRYPAACGDKVHLLTAGDDALLAYWDVPSETPVFTVPAAHRDYIRAGAPSSVDHNLFATGSYDQSAPLWDAGTGKAPALSFSHGASVESVLFLPSGGLLATAGGTTVKIWDVIGGGRLVHSXESHVKTIFALPLGKMGAPWENPFSLPQGGDGYVQGFEYGGSSTMTPLQWPESPRKRLSRGLCLTRAGNRASSHPGPSKGETLVLCPPKGKKKFHPH

SEQ ID NO: 12193 - protein, 584 aa, uncultured marine bacterium 577
MTQLIEIKVPDVGDFKEIPVIEILVQPGDNVEKETSLITLETDKATIEIPAPQNGTVKEIKVKIGDTVSEGSIILTLKPITNPTDSPPHTKKDTKAEFSPPTVNPISTQPTTIPRGDFHADVAILGAGPGGYTAAFRAADLGKKVILIERYPVLGGVCLNVGCIPSKALLHMAKVVTDAEETIHAGVNFNTPKLELDKLRKWKESIIGKLTNGLTALAKKRNVEVIQGNGKFITPNMISVTTPNGQKTVSFEYCVIAAGSSVAHPPGIIQNDPRIIDSTGALELEDIPKRMLIIGGGIIGLEMATIYDAFGSKVSVVEMKDQLISGADKDLIKPLYRRIKKRYEAIYLRTKVSEINPQKDGLEVTFEGEESPGTQTYDRILVAVGRRPNGHAIEAGNAGVHVTKQGFITVDNQLRTNVPNIFGIGDIVGEPMLAHKATHEGKLAAEIIAGQKAAFDVRTIPSVAYTDPEIAWMGLTEIEAKNQGIDYEKASFPWAASGRAIAMGRDEGMTKLLFDKNTRRLLGAGIVGINAGELISETVFALEMGTDMEDISLTIHPHPTLSETINFAAEIAEGSITDLYMPKK

SEQ ID NO: 12194 - protein, 482 aa, Oryza sativa
MAYQGIDLLSTKAAGDDHGENSSYFDGWKAYDTNPFDLRHNRGGVIQMGLAENQLSLDLIENEQDHPEASICTPEGVSQFKRIANFQDYHGLPEFRKAMAQFMGQVRGGKATFDPDRVVMSGGATGAQETLAFCLANPGEAFLVPTPYYPAFDRDCCWRSGIKLLPIECHSFNDFRLTKEALVSAYDGARRQGISVKGILITNPSNPLGTITDRDTLAMLATFATEHRVHLVCDEIYAGSVFATPEYVSIAEVIERDVPWCNRDLIHVVYSLSKDFGLPGFRVGIIYSYNDAVVAAARRMSSFGLVSSQTQYFLARMLSDEEFIGRFLQESKCRLVARHERFTSGLREVGIGCLRGNAGLFSWMDLRRMLREKTAEAELELWRVIVHQVKLNVSPGTSFHCREPGWFRVCHANMDDETMEVALGRIHDFVRQHQQRRVKAERWAANRQLRLSLPHHHHLSPAHLSSPLALLSPQSPMVRATS

SEQ ID NO: 12195 - protein, 216 aa, Synechococcus sp. WH 7805
MTSIQSRWQQLTTALPSEVKLLAVSKGHPADAIRDLVACGQLDFGESRVQEALPKQDALRDLPQIRWHFIGRLQANKVRAVVKAFSWIHSIDSLALAQRASRIALEEQQLPTALLQVKLRDDPAKGGWEIEALQDAWPELQTLQGLQISGLMTMAPMGVAAEDRSELFRECRELANSLGLQHCSMGMSGDWHEAAAAGATWVRLGSVLFGPRQSSV

SEQ ID NO: 12196 - protein, 371 aa, Vitis vinifera
MLSPTSFPPPPLTPTSPLLPSLISEASWFSWNPKLIADVIALLYKQGQLKEAETLVSETLIKLGSRERDLVSFYCNLIDSHSKHSSNQGVFDVISRLSRIVSESSSVYVKERAYKSMISSLCAVGLPLEAENLIEEMRVKGLKPSVFEFRSVVYGYGRVGLSEDMQRILLQMGNEGFELDTVVSNMVLSSYGAYNKQSEMVSWLQRMKNSSIPFSIRTYNSVLNSCPMIMSILQDLKTFPPTIDELMETLKGDEALLVKELIGSMVLAELMEWDCFRGEAGFAWNAPGVCILDNVAVEGGAEGKPGGCFAKHGSKIDVKGKHAVYNVELPSTMSPNKKVLVYLSPLCCVSKYRNSKEDSMHGSDSIGKEAR

SEQ ID NO: 12197 - protein, 822 aa, Ustilago maydis 521
MFTVVGLQVRRHAPSHPHAPYAADSWPLAARRRAPIVTRGDLTLMTCPHAHVTQAVSEARVHESTLGHVVQTCCCEYCIRDFNGTLAAGQTERVSDRSLRTAPPACWSFAISPVAQLLGYYPPSAQPLSQHWHHKRSHSKHSSFATMASLIPPKKPRKPGMPKLTIPTRPTSSSSAPSGSLACDDAPFDAASAAKAQPGHPSQRPQPSLIIPQHSTSSLSLGGHAYQDEGYEDGHPGVFNTTASTIYPDTVPHLTNSQMYTAITDDLRRAIGGMSITDSDGERLDASGLRIPVTGGKSSSHGYWMTNDSATASINADGTEPNGADVSSQPSQSRTRTDSSASAASTRASNQGGHDDELVLAGNFEMLSRLGEGASGEVHKVRHRPTGLIMAKKTISTSPNPAIHRQILRELAFNRSCHSDYIVRYYGAFLEEQDTSIAICMEYAEAGSLDAIYKKVKSRNGRTGEKVLGKVAECVLKGLSYLHERKIIHRDIKPSNIVVTRQGQIKLCDFGVSGELINSVAGTFTGTSFYMAPERIRGLAYTITSDVWSLGLTILEVASNRFPFPAEGEPPLGPIDLLSYVVNMKVPELQDDEKAGVKWSRALRDFIERCLEKEPTKRPGPHKMISHPFIRKSETRQPQPDIAKFVADVYGWSYLPSSIANQQEQTPTQATTKSATLGRIPSVRSAPVATAALTAMTNDQPIPVPIPTSVTATATATATQFGAPPCIAPATQASRSIGAPSDRLRTLPKISVTIDEQARTEPTNEPPEESAGTQAASFGIRPRSHSQARSQEERLAARLREADIGLVGSPTTTTDEDEAGRA

SEQ ID NO: 12198 - protein, 268 aa, Bacillus pumilus SAFR-032
MTNWVEIDRLAKLWVKEAGSRIKASMQDGLSIETKSNPNDLVTNIDKETERFFIEKIQSTFSDHHILGEEGQGEEVTSLDGVVWIIDPIDGTMNFVHQKRNFAISIGIFENGIGKIGLIYDVIHDELYHAIKGEGAYMNDTLLPPLKDVAIEKAIVGINPTWAIESPYFDAKPFARLVRDVRGTRTIGSAALELAYIASGRSDAYVTLRLAPWDYAAGCVLLDEVGAVYSNIHGERLTFLDKNSIVAGNRSVCEKILHDYIKGSENKK

SEQ ID NO: 12199 - protein, 246 aa, Ustilago maydis 521
MNIVESLFGRAKSPAERLRQHQRTLQKAQRELDRERTKLEQQEKKLTQDIKKSARAGQMPACKVMAKDLVRTRRHIHKFYQMKTQLQAVSLRIQTLRSNQQMAEAMKGATRAMGTMNRSMNLPAIQRIMRDFERESATMDMKDEMMGEAVDEAMDDEDEGVGEEEESDNILKEVLDEIGVSVGQQLGEAPTAALSAPLAAPQQRIAIGEGASGGGGFGGGGGGGGGGGASKDEDALQARLDNLRRD

SEQ ID NO: 12200 - protein, 863 aa, Oryza sativa Japonica Group
MALLLAYFTVFVLAASVPATGQQGFLSIDCGLEGDDSYPDDQTGITYVPDGPYVDSGENHRVTTVYRNYWGQDYRTLKTLRSFPSASGKRNCYSLPTNVGDKYLVRLEFLYGNYDSMDSSLLKFNLSLGVNHWNTVNLDTTDDQDGYNFYEAVFVAWASWAPVCLINIGQGIPFVSTVELRLLGTLPYPAIIGNQSLSLYVRRSIGSSADDDMRYPDDQYDRYWIMGETTGAADMSNISTPTIIPPSVPFAVPSPILQKAVVPADNSMKLVFHSDQLDAQLRDHLVILHFADFQNNKSREFTVSIDSGVQSGPFSPPYLKVLSITTDWSSDTEGKYNFTLTATSTSSLPPILNAYEVYGRIIHDNPMTFSQDFDAIMAIKYEYGIRKNWMGDPCFPPEFAWDGVECSSDGKTMRIISLDLSNSELHGLISNNFTLLTALKYLNLSCNQLNGAIPDSLRRKNGSMVLSYESGGDMCKKPVSPSSRNRAAALAVSVVVPMLAVAILGLAYLFWRAKRKHNNDPPTVLELTGAPGHKTNHWDRLQKPENRRFTFEELQKFTDNFKRLIGHGGFGHVYYGSLEDSTEVAVKMRSESSLHGLDEFLAEVQSLTTVHHRNLVSLFGYCWDDDHLALVYEYMSSGNLCDYLRGKTSMTETFNWATRVKIALEAAQGLDYLHKGCNLPIIHGDVKTNNILLGRNLKAKIADFGLSKTYHSDSQTHISASIAAGSMGYIDPEYYTTGRLTESSDVYSFGVVLLEVTTGEPPIIPGNGHVVQRVKQKIVTGNISSIVDTRLGGSYNVSSMWKVLDAAMMCTTNIAAERPTMATVVMQLKESLELEEAHGERGDMENQARDNTYLMSTFGPLAR

SEQ ID NO: 12201 - protein, 477 aa, Neisseria meningitidis MC58
MSQYDVVVIGAGPGGYVAAIRAAQLGFKTACVDAGVNKAGNAPALGGTCLNVGCIPSKALLQSSEHFHAAQHEFAEHGITVGDVKFDAAKMIERKDAIVTKLTGGVKFLFQKNKVTSLFGTASFAGKNGDAYQIEVDNKGEKTVIEAKHVIVATGSVPRPLPQVAIDNVNVLDNEGALNLTEVPAKLGVIGSGVIGLEMGSVWNRVGAEVTILEAAPTFLAAADQQIAKEAFKYFTKEQGLSIELGVKIGDIKSEGKGVSVAYETAAGEAKTEVFDKLIVAIGRIPNTKGLNAEAVGLEKDERGFIKVDGECRTNLPNVWAIGDVVRGPMLAHKASDEGVAVAERIAGQKPHIDFNNVPFVIYTDPEIAWVGKTEEQLKAEGVEYKKGTSGFGANGRALAMGKAKGTVKVLADAKTDRILGVHMIGPVVSELVTEGVTALEFFASSEDIARIIHAHPTLSEVVHEAALAADKRALHG

SEQ ID NO: 12202 - protein, 388 aa, Neisseria meningitidis MC58
MNLHEYQAKELLASYGLPVQGGILAHNGEEAAAAYDKLGGKFAVVKAQVHAGGRGKAGGVKVVKSREEAKEVAESLIGTNLVTYQTDANGQPVNSVLVCEDMYPVQTELYLGAVVDRSTRRITFMASTEGGVEIEKVAAETPEKIFKVTVDPLVGLQPCQAREVAFQLGLKDKQINEFVKLMTGAYKAFVENDFALFEVNPLAVRENGALACVDGKIGIDSNALYRLPKIAELRDKSQENERELKASEFDLNYVALEGNIGCMVNGAGLAMATMDIIKLKGGQPANFLDVGGGATKDRVVEAFKLILEDKSVQGVLINIFGGIVRCDMIAEAIVAAVKEINVNVPVVVRLEGNNAELGAKILNESGLKLTSADGLNDAAEKIVAAVNA

SEQ ID NO: 12203 - protein, 308 aa, Bacillus sp. SG-1
MNIDNEILAKMVSEARPISAEGKLVDYIPALKKENKDNLSVSVCFLNGEFFYAGDYLEKFTLQSISKVITLALVLMDNGEEEVFSKVGMEPTGDPFNSIIKLETNRVSKPLNPMINAGALAVTDMIKGSTNEEKWERLLAFVRRLTGDSEVTYNQEVAESEFHTAFLNRSLGYFMKQHGIIKGDIEHLIYIYTKQCAIEMNCQDLAKIGAVFANDGIDPVTGKQLITRDVARICKTFMVTCGMYNSSGEFAIKVGIPAKSGVSGGIMGSVPRKCGIGIFGPSLDDTGNSIAGLRLLELMGSEYKWSIF

SEQ ID NO: 12204 - protein, 215 aa, Buchnera aphidicola str. APS (Acyrthosiphon pisum)
MNQTLLSKFGKPIERIKNAILALKSGQGVIILDDEERENEGDLVFACENMTVEQMALSIRYGSGIVCLCITESKRKQLNLPMMVKKNTSAYRTGFTVTIEASKGISTGVSAKDRLTTIKTAIADDAKPSDLNRPGHVFPLRAHKGGVLSRPGHTEAAIEIVSLAGFKPAGVICELTNKDGTMARTPEIIKFSENKKMQVLTIQDLIFYIKNINHL

SEQ ID NO: 12205 - protein, 292 aa, Zea mays
MLRSTHPPSPTSGSSAAPASSSDAAAMVGGGAAAGSGGAPSGAKLLQILNVRVVGSGDRVVVLSHGFGTDQSAWSRVLPYLTRDHRVVLYDLVCAGSVNPEHFDFRRYDTLDSYVDDLLAILDALRIARCAFVGHSVSAMIGILASIRRPELFAKLVLIGASPRFLNDHDYHGGFELPEIQQVFDAMAANYSAWATGYAPLAVGADVPAAVQEFSRTLFNMRPDISLHVCRTVFNTDLRGVLGMVRSPCVVVQTTRDVSVPASVAAYLKAHLGGRSRVSLEGPKLTRTQLSV

SEQ ID NO: 12206 - protein, 281 aa, Erwinia carotovora subsp. atroseptica SCRI1043
MHHYAIVNAFSDRPLAGNPVAVFFDCDELETNVMQRIAAEMRLSESTFVSQPKHGGDVHVRIFTPVNELGFAGHPLLGTALALSLRLGKSTLNIETAKGIFPFTLEHPERLGDAVVAHIDMVQPEPVIQIYTQTDALLHALGVPCSTLPVEMYDVGPRHVFVGVETLEMLSALVPDQRALGQHENMAALCFCGTGNAWRMRMFSPAYGVVEDAATGSAAGPLALHLARHGVTRFGRTLEILQGVEMGHPSKMYGLAQADGEKYRLYAGGHAIQVAQGTYFI

SEQ ID NO: 12207 - protein, 571 aa, Buchnera aphidicola str. APS (Acyrthosiphon pisum)
MISGILASPGIAFGTALLLKEDEIVINRKIINIKNITKEIERFFEGRRKSIQQLTEIKTKTKEKFGEKKESIFEGHIMLLEDEELEQEVISLIKEKNMSAAAATELIIEGQAKALEKLKDEYLKNRAIDVRDIGNRLLKNILNLNIIDLNNINNEVILIAKDLTPSETAQINLKYILGFITDLGSRTSHTSIMARSLEIPAIVGTGNITKIVKNNDFIILDSINNQILINPSHKLINQTEVIKKKYLTKKNQLINLKNLQAITTDGHAIKIGSNIGNVEDIKSAKKNGAECIGLYRTEFLFMGRNCLPDENEQFQAYKTIAELMKNKSVIIRTMDIGGDKDLPYMNLPKEENPFLGWRAIRISMDRKEILHTQLNAILRASAFGKIYILFPMIISVEEIRILKSEVRKLQIQLKNNNIPFDKNIKIGIMIETPASAIIAEYLIKEVDFFSIGTNDLTQYTLAVDRGNDLISHLYNPMNPSVLKLIQQVINVSHTHGKWTGMCGELAGDERATILLLGMGLDEFSMSSISIPKIKEIIRKTSFSSAKKLAQKALTLPTNREILNLVENFVNH

SEQ ID NO: 12208 - protein, 534 aa, Schizosaccharomyces pombe
MSNESIYSVLDLTQVIFEDRYLVKQKLGDGSFGTVYLAQRKEKNGLYETALRKISKHPCLIDLLETFMDPYRNIFLVMEFMDCNLFQLFKRRQGRLFTKETAFNILLQIISGIEHIHKHGFMHRDIKPENILVKRISPKPISSRYSIKLGDFGLARPSVSSDPLTEYVSTRWYRAPELLLRSGSYNHSVDLYAFGCIVFEIYSLKPLFPGRNETDQLNRVCEILGNPGIDELDTLHYWSQAKELAKRLGFMLPPTKPYPIQKLLPQNCPEGHAKMIPCLLAWNPDVRPTAKYCKEVFFPLPPSASKSNSVPQKISNPKVEQNLGFPISREDKKSTRRVGWLKKNLSEFVSSVKSVFPDSHGSQPHVKTEKPINAKESTGHLANPIASSNVPAISLKPGELHESVFFSENEQIDYLLTSIDYLPSYKPPSNGSNIAINAFNETVGDRIPSSKDILITEKIPFKKENEIRDSIVPSCSQPDESNKEGVASCLLLQKSGMEMTSVLEYSTPNPAEVQNICNDHAKFETSKSLHLSSP

SEQ ID NO: 12209 - protein, 284 aa, Rhodobacter sphaeroides 2.4.1
MLLNLGSINIDHVYRMPHLPAPGETLEAESYSVGLGGKGANQSVAAARAGARILHVGAVGPEGRWARDWMAAAGVDVTHVAVGEVATGHAIINLDEEAENTIVIFPGANRTLDAATVTAALAAAGPGDTLLLQNETSAQVEAARLASQRGLRVIYCAAPFEIGAVQAVLPYVSLLVMNEGEAAALRAALGALPEVAMVVTLGARGAEWLVPGEDRLSVPAFPVTAVDTVGAGDCFTGNLAAALDAGLAPAEAMRRASAAAALQVTRPGAAEAMPTAEEVDAFLG

SEQ ID NO: 12210 - protein, 759 aa, Rhodobacter sphaeroides 2.4.1
MLAQDGPLMTKTKITPEEALLYHLEPRPGKYEITASTPMATQRDLSLAYSPGVAVPVQAIADAPETVYDYTVKGNMVAVISNGTAILGMGNLGAMASKPVMEGKAVLFKRFADVNAIDIELDTEDPDEIIQAVKLMGPTFGGINLEDIKAPECFMIEQRLKELMDIPVFHDDQHGTAVICAAGLINALELSGKKIEDCRIVLNGAGAAGIACLELLKTMGARHDNCIMCDTKGVIWQGRTEGMNQWKSAHAARTELRTLEEAMAGADVFLGVSAKGAVTPEMVRSMADNPVIFAMANPDPEITPEEAQAVRADAIVATGRSDYPNQVNNVLGFPYLFRGALDIHARAINDEMKIACARALAQLAREDVPDEVAMAYGRKLSFGRDYIIPTPFDPRLIYTIPPAVAKAGMDTGVARRPIIDLQGYELALKSRMDPTASILQGIHARAKAAQARMIFAEGDDPRVLRAAVAYQRAGMGKALVVGREQDVREKLEATGLGDAVRELEVVNAANSRHMEAYKSFLYNRLQRGGFDSYDIQRLATRDRHVFSALMLAHGHGDGLVTGATRKSAYVMQLINHVFDAKASDGAVGVTALLHKGRIVLIADTLVHEWPEAEDLADIAIKSARVARNLGLEPRVAFVSFSTFGYPVSERAAKMGEASRVLDGMKVDFEYEGEMTVDVALNKTAMAQYPFCRLTGPANILVVPARHSSSISIKLMQEMAGATVIGPILTGVSKPIQICGVNSTVNDILNMAVMAACKVG

SEQ ID NO: 12211 - protein, 290 aa, uncultured marine bacterium 577
MSKKHPVIAVTGSSGAGTSTVKNSFEQIFCREKINVAVVEGDSFHRYDRVAMKKAVAKSVEKHGRPISHFGPEANEFKKLETLFKEYSKNGSGKTRLYLHNDEEGAPYKQKAGTFTPWSSIARGSDMLFYEGLHGGVKSSTADVAKYVDLLVGVVPAVNLEWIQKIYRDTSARGYSAEAVTDTILLRMHDYAHYITPQFSRTHINFQRVPTVDTSNPFIAREIPTLDESLVVIRFQDTKNVDFSCLLSMIHDSFMSRPNTIVVPGGKMGLAIELILTPLILELAAKRKKK

SEQ ID NO: 12212 - protein, 345 aa, Rhizobium leguminosarum bv. viciae 3841
MTFHPSVLEAIGNTPLIKLKGASEATGCTILGKAEFLNPGQSVKDRAALYIIRDAERKGLLRPGGVIVEGTAGNTGIGLTLVAKALGYRTVIVIPETQSQEKKDALKLLGAELVEVPAVPYKNPNNYVKVSGRLAEQLAKTEPNGAIWANQFDNVANRQAHVETTAKEIWQDTDGKVDGFICSVGSGGTLAGVAAGLKAFKADVKIGIADPDGAALYEFYQNGALKSEGSSITEGIGQGRITANLEGFTPDYAYRIPDAEALPYLFDLVENEGLCLGGSTAINIAGAVNLARDLGPGHTVVTILCDYGNRYQSKLFNPDFLTSKGLPVPGWMAKSSDIHVPYEPV

SEQ ID NO: 12213 - protein, 412 aa, Vibrio angustum S14
MSSSLPLSQHVDQLRKQFPALNCQVDGRPAIYFDGPGGAQQPLSVIESYGNYLKQGNTNLGGHFSVSRKTVELVDTCREKAAALFGAEKKEEIIFGANMTSMTFHFSRAISNDWKEGDEIILSTADHGSNRSSWAMAAQDKGVKVHYIPILDNTCQLDIEAFEGLLNDKTRLVAVTAASNLSGTLVDIEKITRLGKANGSVVYIDAVHLLPHKIINVTSLGADFVAGSAYKFFGPHLGVLYGRQQALEYYSPYKVEPAPSYSPNCWETGTLNFEALSAFSSTIDYLASLGHGKCLREQLESGYENIGNYESFLASKFLTRLKDYPSIELFGEPSIDNRTATFALRFGELNPAEVAAHLGEQEIYTWSGHLYADMLTDALKITEKGGILRVGLMHYNTEEEIERFFIALDQIL

SEQ ID NO: 12214 - protein, 425 aa, Streptomyces griseus
MGRRQPTKHSFSDSPRPAHDVRGGRHHTPSSEDARVVDSDVVGSVLRTARAVLADRIDEAVRSDASFCEELARRVADFTLEGGKRMRPRLLWWGMRSCGAAETAAALRLGVALELIQSCALIHDDVMDRSRLRRGKPAMHIGLAERAGLSPDSERGSDFGASAAVLAGDLALVWADDTVAETVLSAAQRRRIGALWRAMRTEMVAGQYLDLRGQLSGGSSVAQALRTACLKSASYSVERPLAIGAALAGADDRTTDALRSAGRCAGIAFQLRDDLLGVFGDPALTGKPSGDDIREGKSTYLLAVARNSAEASGDEQALAVLGRATGNADLTEEDLADVRGVLEVTGARAHVERKAEHLRDHAVRRLGQAVDVDAHGGRQLLGLLRTVSGERTAHSPTTAGETHGGGTGVAGASPVLMTTEGGNAG

SEQ ID NO: 12215 - protein, 210 aa, Zea mays
  misc_feature (203)..(203): Xaa can be any naturally occurring amino acid
MAIVREEAVDTSISPRAGMDAIRNGYTRYTPNAGTLELRKAICTKLQEENGVSYLPDEVLVSNGAKQCITQAVLAVCSPGDEVLIPAPYWVSYPEMARLADATPVILPTNISENFLLRPELLTDKINEKSRLLILCSPSNPTGSVYPKELLEKIADIVKKHPRLLVLSDEIYEHIIYQPAKHTSFASLPGMWERTLTVNGFSXAFAMTGW

SEQ ID NO: 12216 - protein, 348 aa, Pyrococcus horikoshii OT3
MSEKMVAIMKTKPGYGAELVEVDVPKPGPGEVLIKVLATSICGTDLHIYEWNEWAQSRIKPPQIMGHEVAGEVVEIGPGVEGIEVGDYVSVETHIVCGKCYACRRGQYHVCQNTKIFGVDTDGVFAEYAVVPAQNIWKNPKSIPPEYATLQEPLGNAVDTVLAGPISGKSVLITGAGPLGLLGIAVAKASGAYPVIVSEPSDFRRELAKKVGADYVINPFEEDVVKEVMDITDGNGVDVFLEFSGAPKALEQGLQAVTPAGRVSLLGLYPGKVTIDFNNLIIFKALTIYGITGRHLWETWYTVSRLLQSGKLNLDPIITHKYKGFDKYEEAFELMRAGKTGKVVFMLK

SEQ ID NO: 12217 - protein, 274 aa, Candida albicans SC5314
MKDYTITVLGCGVMGTAVTSAILKSKFDPYPKKIIACTIPSQEQSLKETFADQPLVHVSAGVENNNKAVTEADVIILGCKPYMYEGIYEEVKESLTGKQLLISLLAGTTIKELSIFTPYVAKVMTNTPARFGCGTAAIAFAPEVSEESQELVMKLIDTVGMTVKIPEKNMDIATSLIGSGPAFCLLMMESMIDGAVRMGMPYDVASVAAAKVMEGTARMVLETGEHPAALKSKVCTPGGTTIGGLLTMEDRGLRSAIARGVEEAANISASFAKS

SEQ ID NO: 12218 - protein, 291 aa, Allium cepa
MANKEVDVPETKDTQFTAKDYTDPPPAPLFDMGELTKWSLYRAVIAEFVATLLFLYITVATVIGYSHQSDATIPGNTDAHCSGVGVLGIAWAFGGMIFVLVYCTAGISGGHINPAVTFGLFLARKVSLIRALLYMIAQCLGAICGVGFVKAFQSAYYSRYGGGANTLNAGYSKGTGLAAEIIGTFVLVYTVFAATDPKRSARDSHVPVLAPLPIGFAVFMVHLATIPITGTGINPARSFGAAVIYNKDKAWDDQWIFWVGPFIGAAIAAAYHQYVLRAGAVKALGSFGSNA

SEQ ID NO: 12219 - protein, 172 aa, Brassica napus
DERRIIHRDLKPSNLLINHRGEVKIADFGVSKILSSTSSLANTFVGTDFYMSPERISGKAYGNKCDIWSLGVVLLECATGKFPYTPPENMKGWTSMYELVDAIVENPPPRAPSHLFSPEFCSFISQCVQKDPRDRKSAKELLEHRFVNMFEDVDLSSYFTAAGSLIPPLANS

SEQ ID NO: 12220 - protein, 309 aa, Bacillus pumilus SAFR-032
MACRDNEELQRFVEEAKKVAKDGQVASYIPALGKADQTDLSVAVYHVSNTCHSAGDVDKRFTLQSISKVLALALVLSEEGPKKVFQFVGQEPTGDPFNSMIKLETASPNKPLNPMINAGALAVTSLIRGATPEAQLGRLLSFIRELANDKSITYCKETAASEFETSMINRAMCYYMKQYHIIRGNVEEVMDVYTKQCAIMMNSLDLAKIACVFSLDGRHPETGKQILSKDVARICKTFMVTCGMYNASGEFAINIGIPAKSGVSGGIMGAAPYDFGIGIFGPALDEKGNSIAGIKLLELMSEKYEMSIF

SEQ ID NO: 12221 - protein, 454 aa, Pantoea stewartii subsp. stewartii
MVMDTLSQDLKQWSLNHQQRLARYKPIRRYGKVTGINGILIECSLPGARIGDLCLIQRSEGDAVLSEIVGFSAEHILLSALGALDGISQGALITPLYLPHSICVSERLMGSVLDGFGRALEPGGYSAFAEPGLQCTTVPVLNDAPPPTERPRIDTVLPTGLRAIDGLLTIGKGQRVGVFAGAGCGKTTLLAELARNSPCDVIVFGLIGERGRELREFLDHELDDTLRKRTILLCATSDRSSMERARAAFTATAIAEAFRAEGKSVLLIIDSLTRFARAQREIGLALGEPPGRGGLPPSVYTLLPRLVERAGQTRKGAITALYSVLIEQDSMGDPVADEVRSLIDGHIVLSRRLAERNHYPAIDILASLSRTMSNVVDQVHLKQVGNIRSLIAAYKQVEVLIRLGEYQPGHDILTDAAVNANDTINHFLRQTMRTPEPFEHILSQLNEVSAHAPE

SEQ ID NO: 12222 - protein, 288 aa, Allium cepa
MEGKEEDVRVGANKYSERQPIGTSAQMTEDKDYKEPPPAPFFEPGELKSWSFYRAGIAEFMATFLFLYITILTVMGVVKSPSKCSTVGIQGIAWAFGGMIFALVYCTAGISGGHINPAVTFGLFLARKLSLTRAVFYMIMQCLGAICGAGVLKGYQKGLYMTQGGGANVVAPGYTKGSGLGAEIIGTFVLVYTVFSATDAKRNARDSHVPILAPLPIGFAVFLVHLATIPITGTGINPARSLGAAIIYNKGHAWNDHWIFWVGPFIGAALAAMYHQIVIRAIPFKSRS

SEQ ID NO: 12223 - protein, 512 aa, Candida albicans SC5314
MSNQIFKKIFVFFFQHFFFCARDFQPIEFHDSVRFIKYTNINFFFLFRAVIGAVVDVQFDEGNLPAILNALTLKNGDQDLVLEVAQHLGENTVRAIAMDGTEGLVRGTEVNDTGAPISVPVGRGTLGRIINVVGEPIDDRGPIECKEKKPIHAEPPSFVEQSTAAEILETGIKVVDLLAPYARGGKIGLFGGAGVGKTVFIQELINNIAKAHGGFSVFTGVGERTREGNDLYREMKETGVINLEGDSKVALVFGQMNEPPGARARVALTGLTIAEYFRDEEGQDVLLFIDNIFRFTQAGSEVSALLGRIPSAVGYQPTLATDMGLLQERITTTKKGSVTSVQAVYVPADDLTDPAPATTFAHLDATTVLSRGISELGIYPAVDPLDSKSRLLDASVVGQEHYDVATGVQQTLQAYKSLQDIIAILGMDELSEADKLTVERARKIQRFLSQPFAVAEVFTGIPGRLVRLQDTVKSFKDVLEGKYDNLPENAFYMVGGIEDVVAKAEKLAAESN

SEQ ID NO: 12224 - protein, 416 aa, Ustilago maydis 521
MSLSSKLGITDVDLKDKKVLIRVDFNVPMDGDKITNNQRIVAALPTVKYAIEQNAKAVVLMSHMGRPDGKPVPKYSLKPVAAEVSKLLNKDVEFLADCVGAETEKAVESATGGKIFLLENLRYHVEEEGKGTNEAGEKVKADPKKVEEFRASLTKLGDVYINDAFGTAHRAHSSMVGVQLPQRAAGFLMKKELEFFAKALESPERPFLAILGGAKVSDKIQLIDNMLDKVNSLIICGGMAFTFKKTLDNVKIGTSLFDEAGSHKVAELVEKAKKNNVELVFPVDYITADKFDKNAKTGSATDADGIPDEWMGLDAGEESRKKFRETILKAKTILWNGPAGVFEFDNFAGGSKAMLDACLEAEKNGSTVIVGGGDTATVVAKYGAEDGISHCSTGGGASLELLEGKTLPGVKELSEK

SEQ ID NO: 12225 - protein, 71 aa, Physcomitrella patens subsp. patens
MVDAAALIIGVILFVVLSPGLVLQIPGDDRPVEFTNQRTSIASVIVHAVVFIILFYLLQLVFHVHGGTKVD

SEQ ID NO: 12226 - protein, 315 aa, Buchnera aphidicola str. APS (Acyrthosiphon pisum)
MSKIYQDNSLTIGNTPLVRLNRIGNGNILVKIESRNPSFSVKCRIGANMIWHAEKNNNINKNVKLIEATSGNTGIALAYVAASRNYRLTLTMPETMSIERKKILKSLGAELILTDGRYGMKGAISKANDIISRNPSKYFLLKQFENPANPEIHQITTGPEIWNDTNGNLDILISAVGTGGTITGITRYIKKIKRKKNLISIAVEPSESPVITQFLAGKAIEPGPHKIQGIGPGFIPKNLDLTIIDQVITVSSEEAILTAKELMKKEGILAGISSGAALYAAIKIQQQKKFSDKKIVVILPSSGERYLSTELFSEL

SEQ ID NO: 12227 - protein, 377 aa, Ustilago maydis 521
MTSTAAKILKNASSGVLRLGMMPADGIGREVLPCAQRILQNTPGAPKFEFVHLDAGFEHFQKTGSALPEETVKALKNDCHGAMFGSVSSPSHKVEGYSSPIVKLRKELDLYANIRPVVGVRGTKDDEKFIDSVIIRENTECLYIKSETSESGPDGQIARAIRQITEKASTRIGKKAFEVALARKELRKTTQPSYVPTVTICHKSNVLSVTDGLFRTSVRGIYEQDQKANGGAGRYEEVKLNEQLVDSMVYRLFREPEVFDVVVAPNLYGDIVSDAAAALVGSLGLVPSVNAGDSFFMGEPVHGSAPDIAGQGKANPIASIRSAALMLEYMGYTEPALKIYTAVDQVIREGKYLTPDLGGSATTTQCEEAILKKIQEA

SEQ ID NO: 12228 - protein, 388 aa, Mycoplasma pneumoniae M129
MRLNKLRHAKSKKDFPLFHLKCSLKMAKLKWKSGWPNLRKNLINVKPSKVKRSSANCANNMDRHNHVVFSLSKTHDLVSRICQKLKMPMGLITHNEFADGETYIRFEESVRNKDVFIFQSTCAPVNDSLMELLIAIDALKRGSAKSITAILPYYGYARQDRKTMGREPITSKLVADLLTTAGVSRVALTDIHSDQTQGFFNIPVDTLRTYHVFLTRTVELLGKKDLVVVSPDYGGVKRARLIATSLELPLAIIDKRRPAHNVAESINVLGEVANKNCLIVDDMIDTGGTVIAAAKLLREHHAKKVCVMATHGLFNGEAPQRFQKAFNEGLVDYLFVSNSIPQTKFDQCPQFQVIDLAPLFEEVLLCYANNSSISAIYTRHIEWIKKHV

SEQ ID NO: 12229 - protein, 199 aa, Kluyveromyces lactis NRRL Y-1140
MSHAIVKRKQLETRICNHHRIYCSAFIILLIGIILKVLPLHNCFTLLMLSRSCSRILSLNLSKQFYRTMNSTGKWNPSLTSEQLRVLRDKGTERPNTGNYLHNKQTGIYSCANCDLPIYKSETKFDSGCGWPAFYDAIPGSLTFTRDESFGMVRIEICCSRCGGHMGHVFEGEGWQKILNLPTDQRHCVNSCSLNFKEG

SEQ ID NO: 12230 - protein, 263 aa, Physcomitrella patens subsp. patens
GPRTFTYKELRKATRNFDETMILGSGGSGAVYKGILSPSGIVIAVKRPRHKSGSGEKAFVAEASSVSQIRHRNLLQLLGWCQEENNYLLVYEYMSNGSLDGWLFPGRRRHPNGPNYKRSGVLPWELRSSILAGVAAALDYLHEDWVQCVLHRDIKSSNVMLDADFNPHLGDFGLARLMDHEKLGETTLVAGTLGYMAPEIPFTGKATKESDVYSFGILVLEVVCGRRPLNLQAEGPDEEFVLLQSVWRAHEAGDILRAVDMRL

SEQ ID NO: 12231 - protein, 144 aa, Bacillus sp. SG-1
MIVKEIMSRNVETCTLLDNVYEVAVKMKENDVGGIPIVDGDHLVGMITDRDIVVRGVAEKHPGSSKVEEVMSDELVTVGADTTIDEAASLMSRHQIRRLPVVDGQKLIGIVSLGDLAVRDKLDHQTNLAIEKISEHENISNKPI

SEQ ID NO: 12232 - protein, 201 aa, Magnetospirillum magnetotacticum MS-1
MASYTIPTVVERTPLGERAFDVFSRLLSERIVFLGTEIDDGVANVVMAQLLHLESDAPDQEIGLYINSPGGSATALMAIYDTMQFVRCDVSTICMGQAASAAAVLLAAGTPGKRFVLEHSRVLLHQPSGGGEGTISDLSIQAEEILRIRSETEEVLARHTGQTVERLRADTDRDLVLTARQAVEYGVADAVVTSRKLAAAA

SEQ ID NO: 12233 - protein, 364 aa, Rubrobacter xylanophilus DSM 9941
MKGMVAALAGPERVEVRSFDVPEPEPGAVVARVRRANVCGSEVHIYHFHHPLIRECVLGHEFVGEIVALGEGVTTDYAGQPVREGDRVTAPYYLTCRRCPACLRGDFNLCQRAYAFWSRPPEVEPHFHGAFATHYYIHPDQYFYRVPEGLPDEVVAGANCGLSQVLFGLHRAGLSAGDTLVVQGAGGLGLYAAAVGRHMGARVVAVEGIPERLELARRFGAEEVVDMAEHPTPGERAGRVRELTGGYGADVVLEVTGVPAAFVEALELARPGGCVVEIGNVNVGREHEVPLAPGLITRKMLRIQGFVRYQPWYLHRALRFLEQHHREHPFGELTDREYPLKQVGEAIEREEARRVARPAIVPDL

SEQ ID NO: 12234 - protein, 467 aa, Buchnera aphidicola str. APS (Acyrthosiphon pisum)
MAAIMSSYLFRGILMNLRFAQFLKNISSFESRIEKLSDIINYGRLVSINGLILEVVGLNTSIGSECLIERTIDGKNANINAEVIGFSGEKTFLLSFEDIHGIFPGARVFSKIASNSNFFIKKLPLGMELLGRVLDGRGQPLDQLPKIDHKYYSTIKNYSINPLNRTPITEVLDTGIRAINGLLTIGRGQKIGIFSSSGIGKSILLGMIARYTQADIIVIALIGERGREVKDFIENILGLAGLSRSVIIAAPADVSPLLKIKAASYATNIAEYFYKNNKHVLLIMDSLTRYAMAQREISLSLGELPVSKGYPSSIFSKIPNLIERTGIFNKNKGSITSFYTVLTEGEDEQDPVSHLARSVLDGHIMLSRYYADLGHYPAIDIESSISRVMPNIINAKQYSQAFYFKKLVASYQRNRDLINIGAYVSGTDVILDHAIKIWPKLEKFLQQEISEKSDYLFSCEALNKIFI

SEQ ID NO: 12235 - protein, 487 aa, Rubrobacter xylanophilus DSM 9941
MSETQTREELVSYPAIIGGERVSPERSFEDVDPSTGRPCALVARCGRQEVDRAVEAAREAHEKAWRRSTPAERARVLHRISQLLRRDHEEIARLESLDTGKPLSQARADATVAARYFEFYANTIESFYGETIPALPDAFVYTLREPHGVTGHIIPWNYPIQISCRSVAPALATGNCCVLKPAEEAPLTALRLGELALEAGLPPGALNVVPGYGEEAGAALAAHPGIDHLSFTGSVEVGRLVSRSAADNVVPVTLELGGKSPNIVLADADLERAVPVIVNSIIQNAGQTCSAGSRLLVESRLHGELVERVASRFQEIRIGPGPEDPDLGPIISEAQRERVKGYVETGRREAELVTGGGVPQDPRLAGGFYFEPTLFDRVEPGSTIFREEIFGPVLAVSTFEEAEEAAALANATDYGLIAAVWTRDVGKAHWLARELRVGQVYINTYGAGGGVELPFGGFKKSGHGREKGYEALYEYTQVKTVALSYAR

SEQ ID NO: 12236 - protein, 476 aa, Staphylococcus aureus subsp. aureus COL
MNESGDNKLSKSSLIGLVIGSMIGGGAFNIMSDMGGKAGGLAIIIGWIITAIGMISLAFVFQNLTNERPELDGGIYSYAQAGFGDFVGFISAWGYWFSAFLGNVAYATLLMSAVGNFFPIFKGGNTLPSVIVASLLLWGVHFLILKGVETAAFINSIVTVAKLIPILLVIICMIIAFNFDTFKTGFFSMTSEGVLPFSWASTMSQVKSTMLVTVWVFIGIEGAVIFSSRAKNKKDVGSATVIGLISVLIIYFLLTVLAQGVILQNHISQLDSPSMAQVLATIVGGWGSTLVNIGLIISVLGAWLGWTLLAGELPFIVAKDGLFPKWFAKENKNGAPVNALLITNILVQLFLISMLFTQSAYQFAFSLASSAILYPYMFSAFYQVKYTLEHRQQATTKQWTIGIIASIYAIWLIYAAGINYLLLTMLLYIPALLVYTIVQKNNQTRLIKSDYILFMIIIVLAVIGLIKLLMGTINVF

SEQ ID NO: 12237 - protein, 338 aa, Vitis vinifera
MELRSSSDSFGLDVDSSQALTFCKRRSIHDINDITKGAENVKISLVDEIGSEGLPNFFYLPENTIYQNAYLHFSLARISDEDCCSSCSDNCLSSLVPCACARETAGEFAYTPRGLLKRNFLDTYISMSKEPQKHHYFYCEDCPLERSKNQYLPDPCKGHLVRKFIKECWRKCGCSMYCGNRIVQRGITFKLQVFMTHEGKGWGLRTLEALPKGAFVCEYVGEILTNMELYERNKQSNGNDRHTYPVLLDADWGSEGVLKDEEALCLDATFYGNVARFINHRCFDANLLEIPVEIESPDHHYYHLAFFTKRKVDALEELTWVSGLNLYQKLYLKTLFPK

SEQ ID NO: 12238 - protein, 373 aa, Erwinia carotovora subsp. atroseptica SCRI1043
MQMIKTRAAIAWGPNQPLSVEEVDLMPPQKGEVLVRIVATGVCHTDAYTLSGKDPEGVFPAILGHEGGGIVEAIGEGVTSVAVGDHVIPLYTPECGECKFCRSGKTNLCQAIRSTQGKGLMPDGTTRFSKNGQPIFHYMGTSTFAEHTVVPEISLAKVNKEAPLEEVCLLGCGVTTGMGAVLNTAKVKAGDTVAIFGLGGIGLSAIIGAHMAGAGRIIGIDLNTSKFDLARKLGATDLLNPKDYDKPIQDVIVELTDGGVDFSFECIGNVNVMRSALECCHKGWGESIIIGVAGAGEEIATRPFQLVTGRVWRGSAFGGVKGRSELPGLVDRYLKGEFPLNDFITHTMGLDDINTAFDLMHEGKSIRTVIHFG

SEQ ID NO: 12239 - protein, 496 aa, Populus trichocarpa
MPPILPDFSNSVKIKYVKLGYQYLVNHILYLLLIPVMVGILIEVLRLGPDEILSLWRSLHFNTVQILCSSFLIIFIATVYFMSKPRTIYLVDYACYKPPVTCRVPFSTFMEHSRLILKDNPKSVEFQMRILERSGLGEETCLPPAIHYIPPKPTMEAARGEAELVIFSAMDSLFKKTGLKPKDIDILIVNCSLFSPTPSLSAMVINKYKLRSNIKSFNLSGMGCSAGLISIDLARDILQVHPNSNAVVVSTEIITPNYYQGNERAMLLPNCLFRMGGAAILLSNRRSHRWLAKYRLVHVVRTHKGADDKAYRCVFEQEDKEGKVGINLSKDLMAIAGEALKSNITTIGPLVLPASEQLLFLLTLIGRKIFNPKWKPYIPDFKQAFEHFCIHAGGRAVIDELQKNLQLSAEHVEASRMTLHRFGNTSSSSLWYELGYIEAKGRMRRGDRVWQIAFGSGFKCNSAVWKCNRTIKTPTDSPWADCIDRYPVHIPEVVKL

SEQ ID NO: 12240 - protein, 192 aa, Physcomitrella patens subsp. patens
PLLQVTQPKGSFCTIDCRFATTLEPDGVYDILTDPNNHRVFKNIKEVIYRKVLEDDGNRQVVEVEQLGRWKFLFLSGTFPTRVMIEQKRQEKTIVFDLAKQGGIMKKFTGSWKIEPMRASEAASQNVSTSVGVETEPGSDPILGSWITFQQVVEPSIKPPWPLSNYIRGVSDKIVREMLADLQQECQRLTEL

SEQ ID NO: 12241 - protein, 140 aa, Bacillus pumilus SAFR-032
MTKKVVTCQQDDNSYEAAVKMRDADIGAIPVVNGDQLVGIVTDRDLVLRGIAEKKPNSQEVGSIMTKEVLTAEEDATLEEIVRLMSEHQLRRIPVVKNGALTGIVALGDLSVEDLSNDRAGDALTEISQQDQDHGQGFLH

SEQ ID NO: 12242 - protein, 216 aa, Bacteroides fragilis NCTC 9343
MKPIISPSILSADFAYLAKDIEMINRSEADWVHIDIMDGVFVPNISFGFPVLKYVAKLTSKPLDVHLMIVNPEKFIPEVKALGAHIMNVHYEACPHLHRVVQLIREAGMQPAVTINPATPITLLQDIIRDVYMVLVMSVNPGFGGQKFIEHSVEKVKELRELIERTGSKALIEVDGGVNLETGARLIAAGADALVAGNAIFAAENPEGMIHAMKGL

SEQ ID NO: 12243 - protein, 184 aa, Nocardioides sp. JS614
MTTSANTRHTLSVLVENKPGVLARIAGLFSRRGFNIDSLAVGPTEHPEVSRMTIVVNVEDSPLEQVTKQLNKLVEVIKIVELDSAASVKRELLLVKVKADAETRGQVLDAVQLFRAKVVDVAPDAITIQAVGNADKLSDLLRVLEPFGIRELVQSGMVAIGRGSRSISERSLRPVAIPAPPAAV

SEQ ID NO: 12244 - protein, 155 aa, Petunia integrifolia subsp. inflata
MSTSKMIVLKSSDGETFQVEESVALESQTIKHMIEDDCADTSIPLPNVTSKILAKVIEYCKRHVEANKSEDKASEDELKSFDSDFVKVDQGTLFDLILAANYLNIKSLLDLTCQTVADMIKGKTPEEIRKTFNIKNDFTPEEEEEVRRENAWAFE

SEQ ID NO: 12245 - protein, 156 aa, Petunia integrifolia subsp. inflata
MSTSKMIVLKSSDGETFEVEESVALESQTIKHMIEDDCADSSIPLPNVTSKILAKVIEYCKRHVEAAAKTDDKVSEEDLKNFDAEFVKVDQGTLFDLILAANYLNIKSLLDLTCQTVADMIKGKTPEEIRKTFNIKNDFTPEEEEEVRRENAWAFE

SEQ ID NO: 12246 - protein, 125 aa, Hordeum vulgare
GSHMAASATAAAVAAEVISVHSLEQWTMQIEEANTAKKLVVIDFTASWCGPSRIMAPVFADLAKKFPNAVFLKVDVDELKPIAEQFSVEAMPTFLFMKEGDVKDRVVGAIKEELTAKVGLHAAAQ

SEQ ID NO: 12247 - protein, 667 aa, Arabidopsis thaliana; identical to SEQ ID NO: 1080

SEQ ID NO: 12248 - protein, 196 aa, Schizosaccharomyces pombe
MDYIQTLFTSVNQVGEKIDSYKSSLNLINPGTCENLSKEVSKDILLSNYAFTGVRADVTKGFCTSPWFTVSHAFALGSQVLPPYSFSTMFGGEPLFLRGSVDNDGAVQAMLNCTWNSNVLSKVQMQLSNGAVPNMCQIEHDHKGKDFSFSFKAMNPWYEEKLTGIYIISLLQSVTPKLSLGVEALWQKPSSSIGPE

SEQ ID NO: 12249 - protein, 491 aa, Erwinia carotovora subsp. atroseptica SCRI1043
MAQHDIQQTTQGAPTLRRELKARHLTMIAIGGSIGTGLFVASGATVSQAGPGGALLSYALIGLMVYFLMTSLGELAAFMPVSGSFSTYGSRYVEEGFGFALGWNYWYNWAVTIAVDLVAAQLVMGYWFPEVSGWIWSALFLALMFLLNYISVKGFGEAEYWFSLIKVTTVIIFIAVGVMMITGIMSGAENAGFHNWEIGDAPFAGGFSAMIGVAMIVGFSFQGTELIGVAAGESQEPSKNIPRAIRQVFWRILLFYIFAILIISLIIPYTDPNLLRNDVKDITVSPFTLVFENAGLLSAAAVMNAVILTAVLSAGNSGMYASTRMLFTLASEGKAPRIFAKLSKGGVPRNALYATTVVAALCFLSSLYGNQTVYLWLLNTSGMTGFIAWLGIAISHYRFRRGYVMQGHDLNRLPYQSRFFPLGPIFAFVLCLIITLGQNYQAFLQDNIDWYAVTATYIGIPLFLLIWFGYKLYRGTGFIKYQDMTFPDHKD

SEQ ID NO: 12250 - protein, 414 aa, uncultured marine bacterium 578
MPTQKNVELPDIGDFDSVDVIEVLVKVGDVINENDSIITLETDKATMEIPAPFAGKVTTLSIKVGDKIAKGELILTLESESEEIKSELDQVEGKSENVEKTIKQEDIEVKPDNSETPQDSIKNNDEPQEELSVKTEIDSHASPSIRKLARELGVSLAKIKGTGQKGRILDKDLKSFVKQIVSHGSTDDEVEIVPLSRIKKISGKHLAKCWSTIPHVTQFDEVNIEQMEKFRLHQKERNIKLSPLVFIMKAVVQTLKRHPNFNASLDESGENLVIKKYFNLGIAVDTPNGLVVPVVRNVGKKSLIELSDELTEISSRAREGLLEANEMKGASFTISSLGGIGGTQFTPIINSPEVAILGVSRSQIKPIWNGDSFEPTATLPLALSYDHRVIDGAEGARFMAELNQILRNIMEMLL

SEQ ID NO: 12251 - protein, 468 aa, uncultured marine bacterium 578
MIKTQVLVIGSGPGGYTAAFRAADLGKEVVLVEKYKSLGGVCLNVGCIPSKSLLHTAQIINEAKHASQLGISFGDTKIDINGVRKNKESIVNKLTAGIQALAKARKVKVVTGHAKFLSKNQVGLEGTDEVIEFEHCIIAAGSRVTKLPMFPFNDERVMDSTDALMLDDIPKRLLVVGGGIIGLEMATIYDALGSEITIVELEGQIIPAADKDIVSPLLKRIKKNYANIFLNTKVTKMTASKKRIKVNFEGKDAPKTDTFDKVLVAVGRSPNGQMIGAENAGVNVDQNGFISANNQMQTNVDNIFAIGDIVGQPMLAHKATHEAKVAAEVICGQKSGFDALTIPSVAYTDPEVAWTGKTEKELTEEGIKFDKGVFPWAASGRSLSIGRSEGVSKGLFDAKSGKILGMGICGTNAGDLISEASLAIEMGCDMSDIALTIHAHPTLSETTAFAAEMVEGTITDLMPPKKKK

SEQ ID NO: 12252 - protein, 331 aa, Streptococcus mutans UA159
MGIRSLFGSLREKIVSKNVRIVFPEGNDERVVRAAARLKFEGLIEPIILGDATEVRNLLTKLGFADQDYTIINPEDYTDFEHMKQEFVEIRKGKATIEDAEQLLKDVNYFGVMLVKLGLADGMVSGAIHSTADTVRPALQIIKTKPEISRTSGVFLMNRETTDQRLIFADCAINIEPDEQELAEIAINTADTAKIFDIDPKIAMLSFSTKGSAKASQVEKVQEATRIAKELRPEITLDGELQFDAAFVPTTAKIKAPESDVAGQANVFIFPDLQSGNIGYKIAQRLGMFDAIGPILQGLNMPVNDLSRGSSAEDIYKLAIITAAQTLDNTK

SEQ ID NO: 12253 - protein, 169 aa, Guillardia theta
MKHTLSVLVEDESGVLTRIAGLFARRGFNIESLAVGPTEKLGISRITMVVPSDERTIEQLTKQLYKLVNILKVEDITNLPTVERELMLIKLRVSTFERTEALDIINIFRAKVVDLSEDFLIIEVTGDPGKIVAIEQILSKFTISEIVRTGKISLVRESNVNTRSLLKEY

SEQ ID NO: 12254 - protein, 218 aa, Streptococcus pneumoniae TIGR4
MSQYKIAPSILAADYANFEREIKRLEATGAEYAHIDIMDSHFVPQISFGAGVVESLRPHSKMVFDCHLMVSNPEHHLEDFARAGADIISIHVEATPHIHGALQKIRSLGVKPSVVINPGTSVEAIKHVLHLVDQVLVMTVNPGFGGQAFLPETMDKVRELVALREEKGLNFEIEVDGGIDDQTIAQAKEAGATVFVAGSYVFKGEVNERVQTLRKQLD

SEQ ID NO: 12255 - protein, 309 aa, Physcomitrella patens subsp. patens
MNEDASLLQKPITYGNIFGAVGKLGSDSVLPEDAALMQSAEARTFGQTQKDGAASVMQAAAELNVKAGFVEKDAHSQVAEKGVMAQEILVPGAEIDVEYIAGQPVIANVKPTPVDPFLVAQDAVTIGDALEAAAVGSGQRPVEDSDARAIQSAVARATGAPPTAGSLAAAAMSAAELNPRVPNADKTTLADILMDATIDLEADKTVTQEDAAKVLDAEMRGSPTGEPLPGGVAAAMQAAADINERAGLIEPASGDHPRAFPFEDTPVLPQEQDAFTPEIENTPKPASGEEKAPSSPTLASREKVHAKED

SEQ ID NO: 12256 - protein, 633 aa, Oryza sativa
MSPPTGVLACTAGLLCRRCWAPTSSPTGSPLPPPTGVSACTAGLYAAVVGRLRLHRPACLRRCRLVFPPARLAFMPPLLGVYVFTDRLAFAAADWCFRLHSWPIMPPLLGAYVFTDRLAFVAADWCPRLHGWPIMPPLLGAYVFTDRLAFGAADWCPRLHGWPIMPPLLGAYVFTDRLAFAAADWCPRLHGWPIMPPLLGAYVFTDRLAFAAADWCPRLHGWPIMPPLLGAYVFTDRLAFAAADWCPRLHGWPIMPPLLGAYVFTDRLAFVAADWCPRLHGWPIMPPLLGAYVFTDRLAFVAADWCPRLHGWPIMPPLLGAYVFTDRLAFVAADWCPRLHGWPIMPPLLGAYVFTDRLAFVAADWCPRLHGWPIMPPLLGAYVFTDRLAFVAADWCPRLHGWPIMPPLLGAYVFTDRPASVAADWGMRQPDRQINTHSADSNPQTGVGEAIRSYAEKAHELVVDVAAKLATSLGLDCSFGDWPCQFRINRYNYTPDTVGKTGVQVHTDSGFLTVLQEDDRVGGLEVADPDTGEFAPVDPLPGTFLVNLGDVATAWSNGELHNVRHRVRCVAGVQRVSIALFLLAPKDDVVRAPEAFVSAERPRRFRDFGYDDYRRLRQSTGEHAGEALARLAA

SEQ ID NO: 12257 - protein, 281 aa, Vitis vinifera
MDPNGGSSSAGAADGASDPAAAHSRFTQQELPACKPILTPGWVVEIVHRYDTDCVPASYRNDMLAYIQSNETNKTCTRTFLVSQVPHSSDVFQEISAYISHLLISIFPTALLKVPKQMKSPVYIYYQLDNFYQNHRRYVKSRSDKQLRSRASENDTSSCDPEDVTSNKSAIVPCGLIAWSLFNDTYGFSVNNTLLGVSKKNIAWKSDQQHKFGSDVYPKNFQSGGLIGGAKLNSSIPSCLTLYLFFVMHVTVESTSGSYCLDANCSTANFQKTIWEDRGGP

SEQ ID NO: 12258 - protein, 425 aa, Physcomitrella patens subsp. patens
MIQSSAALGSSSLQASSSTRGDASISSSGGFAQKSNVTYSADGSFMGSLKGLKLSAAPVRRLAQRCSTTRATATEFPTKTTKSGSQEKVRIGINGCGRIGRLVLRVILARDDVEVVAVNDPFIDTKYMAYMLKYDSTHGLLKSEVNAVDDNTLQVGSQTIKVFGCRDPAEIPWGSVGADFVVESTGVFTAVDKASAHFKGGAKKVVISAPSGDAPMFVMGVNQQSYKDSMNVVSNASCTTNCLAPLAKVIQDNFGIEEGLMTTVHATTATQKTVDGPSGKDWRGGRGAGQNIIPSSTGAAKAVGKVLPELNGKLTGMAFRVPTPNVSVVDLTVRLQKSGSYEDIKAAIKAASEGPMNGILGYTEDDVVSNDFVGDARSSIFDAKAGIALSDKFVKLVSWYDNEWGYSNRVVDLILHMAGVKANLN

SEQ ID NO: 12259 - protein, 715 aa, Pseudomonas fragi
MIYEGKAITVTALESGIVELKFDLKGESVNKFNRLTLNELRQAVDAIKADASVKGVIVSSGKDVFIVGADITEFVENFKLPDAELIAGNLEANKIFSDFEDLNVPTVAAINGIALGGGLEMCLAADFRVMADSAKIGLPEVKLGIYPGFGGTVRLPRLIGVDNAVEWIASGKENRAEDALKVSAVDAVVTADKLGAAALDLIKRAISGELDYKAKRQPKLEKLKLNAIEQMMAFETAKGFVAGQAGPNYPAPVEAIKTIQKAANFGRDKALEVEAAGFAKLAKTSASNCLIGLFLNDQELKKKAKVYDKIAKDVKQAAVLGAGIMGGGIAYQSASKGTPILMKDINEHGIEQGLAEAAKLLVGRVDKGRMTPAKMAEVLNGIRPTLSYGDFGNVDLVVEAVVENPKVKQAVLAEVENHVREDAILASNTSTISISLLAKALKRPENFVGMHFFNPVHMMPLVEVIRGEKSSDLAVATTVAYAKKMGKNPIVVNDCPGFLVNRVLFPYFGGFAKLVSAGVDFVRIDKVMEKFGWPMGPAYLMDVVGIDTGHHGRDVMAEGFPDRMKDDRRSAIDALYEAKRLGQKNGKGFYAYEADKKGKQKKLVDSSVLEVLKPIVYEQRDVTDEDIINWMMIPLCLETVRCLEDGIVETAAEADMGLVYGIGFPLFRGGALRYIDSIGVAEFVALADQYAELGALYHPTAKLREMAKNGQSFFG

SEQ ID NO: 12260 - protein, 476 aa, Zea mays
MARFILSLMELGVSATVHMLFGLYVFSTAVAADISQAAAASGCLLLRRPPPAAAGSTGGALVDVAAAGESDELRGAAPVILDASPPPIVLVHGIFGFGKGRLGGLSYFAGAEKKDDRVLVPDLGSLTSIHDRARELFYYLKGGQVDYGEEHSKACGHNRFGRIYHTGHYPVWDEHNPVHFVGHSAGAQVVRVLHQMLADKAFPGHDTSEDWVVSLTSLSGALNGTTRTYYDGMLVVDGRSMKSICLLQLCRLGVIVYDWLDIPWLKNYYNFGFDHYEMSWRKVGFSGLINLLLGHTGPFASGDWILPDLTIQGSMKLNSTLRTFPNTFYFSYATKKTRKIFGITVPSSVLGVHPILFLRVLQMCMWRHPQNAPLPYKGYRDEDWEDNDGALNTISMTHPRIPIEHPHHFVVDDSDCHPLQPGIWYYKIIEADHILFIVNRERAGVQFDLLYDGIFQRCRKHAFRKSPPTVPNETSR

SEQ ID NO: 12261 - protein, 484 aa, Acinetobacter sp. ADP1
MTLLDASIWNKKLFNGGWFESGQPYGVVEVATGEQLGQTGSASPTDVAQAAKEAQTAQRQWWALDYLERQAVFEKAVQIATEHQDELVNWLIRESGSLALKAQFEVKVSIQMLKNCIAFPQLDQGNILPSRNGKLSLAKRLPLGVVGVISPFNFPLYLALRAVGPALAFGNAVVLKPDERTAVCSGYAIARIFELAGLPKGLLHVLPGGADTGEALTLDPHIASIQFTGSTQVGRIIGANAGKTLKKVSLELGGKNSLIILDDADLDLAAENIAWGAFLHSGQICMTSGKILIHEKIYDALKARVIEKVKRFVVGNPLEQNVTIGPLINEKQSKRVEALVQAAVEHGATLEIGGKANGPFFEPSVLSQVQADNPIFSEEIFGPVAVLIPFASDEQAIELANMGDYGLSAGIISSNVGRAMQLGAQLNVGLLHINDQTVNDETINPFGGFGASGNATRIGGPANPDEFTQWQWMTIQAEAPHYPF

SEQ ID NO: 12262 - protein, 326 aa, Streptococcus mutans UA159
MSNAYPDKHLKLFSLTSNTAIAEKIAKVVGVPLGKLSSRQFSDGEIMINIEESVRGNDIYVIQSTSYPVNNHLWELLIMVDACKRASANSVNVVIPYFGYSRQDRIAAAREPITAKLVANMLVKAGVDRVLTLDLHAVQVQGFFDIPVDNLFTTPLFADHYTNLGLYGEDIVVVSPKNSGIKRARSLAQYLDAPIAIIDYAQDDDSSREEGYIIGEVAGKKAILIDDILNTGKTFAESAKIVERGGATEIYAVASHGLFASGATEILQAAPIKDILITDSVYTEQELPSNLHYLSASELIGEAIIRIHERRPVSPLFAYNRKGDEA

SEQ ID NO: 12263 - protein, 219 aa, Rhizobium leguminosarum bv. viciae 3841
MSLRINDIAPDFTADTTQGPISFHEWIGSGWAVLFSHPKNFTPVCTTELGAMAGLAAEFSKRGAKVIGISVDPVESHAKWKNDIKTATGFDVEYPLIGDKDLKVAKLYDMLPAGAGESSEGRTPADNATVRSVFIIGPDKKIKLILTYPMTTGRNFNEILRAIDSIQLTAKHQVATPANWNQGEDVIITAAVSNEDAITRFGSFDTVLPYLRKTKQPTA

SEQ ID NO: 12264 - protein, 609 aa, Zea mays
MGYLSCRADSSVATCRSITAISPLPLSRRSGSGSGGGSSRPPLPPAQAAIERFDCAELEAATSHFADAALLGRGSHGAVYRAVLPSGRAVAVKRPSPRRPEVDNEIRILSSVRGPRLVNLLGFSDPGPAPRLLVVEYMPNGTLYDLLHSNPRPPGWARRLRLALQTARALRALHDADPPVIHRDVKSANVLLDANLGARLGDFGLALRVPKATAGANAAAAAAPTPPPAGTLGYLDPAYVTPESLSTKTDVFSFGILLLEIMSGRKAIDVQHSPPSVVEWAVPLLRKGKVASLFDPRVAPPRDPVTRKDLAALAASCVRSCRERRPSMADIVQRLVLLSKAVSAKVWNGLADGLAVVGNPCAVVDVQKTISKRGAASRRAESERESTSALVFDDDEKEDVDAEALEEDQVPSNKSPPRPLKNGIVFSEAGARERRNLLDLMARIDGVAGQRFGITRARTVRATGELIEKDAVLLLRRNQTVRVVGSEALPKSGRISRYDVKIKHKAGEEQEEPGKAQDKVEKIQVNASGIQESSKEILGRTDKLLDALEPNLDKEEKVQDKEEQHLDEVDNVQENEGKVQCPAEKIQEGGEVQCPRQRKSRKVEDSETK

SEQ ID NO: 12265 - protein, 154 aa, Petunia integrifolia subsp. inflata
MAEKMIVLKSSDGETFQVEESVAVESQTIKHMIEDDCADSSIPLPNVTSQILAKVIEYCKRHVEASKTEDKATEDDLKSFDADFVKVDQSMLFDLILAANYLNIKSLLDLTCQTVADMIKGKTPEEIRKTFNIKNDFTPEEEEEVRRENAWAFE

SEQ ID NO: 12266 - protein, 501 aa, Arabidopsis thaliana; identical to SEQ ID NO: 1070

SEQ ID NO: 12267 - protein, 742 aa, Petunia integrifolia subsp. inflata
MNQRSTIDLDQGWEFMQRGITKLKNILEGLPEPQFSSEDYMMLYTTIYNMCTQKPPHDYSQQLYDKYREAFEEYITATVLPSLREKHDEFMLRELVKRWSNHKIMVRWLSRFFHYLDRYFIARRSLPGLNEVGLTCFRDQVYQELNGKVRDAVISLIDQEREGEQIDRALLKNVLDIFVEIGMGQMDQYENDFEASMLKDTAAYYSRKASNWILEDSCPDYMLKAEECLKREKDRVAHYLHSSSETKLLEKVQHELLSVYATQLLEKEHSGCHALLRDDKVEDLSRMYRLFSKILRGLDPVANIFKQHVTAEGTALVKQAEDAASNKKAEKRDVVGLQEQVFVRKVIELHDKYLAYVNNCFQNHTLFHKALKEAFEVFCNKGVAGSSSAELLATFCDNILKKGGSEKLSDEAIEDTLEKVVKLLAYISDKDLFAEFYRKKLAGGCYLIKSANDEHERSILTKLKQQCGGQFTSKMEGMVTDLTLARENQASFEEYLSNNPAANPGIDLTVTVLTTGFWPSYKSFDLQPPTEMVRCVEVFKEFYQTKTKHRKLTWIYSLGTCNINGKFDPKTIELVVTTYQASALLLFNASDRLSYQEIMAQLNLSDDDVVRLLHSLSCAKYKILNKEPSTKTISQTDVFEFNSKFTDKMRRIKIPLPPVDEKKKVIEDVDKDRRYAIDASIVRIMKSRKVLGYQELVMECVEQLGRMFKPDVKAIKKRIEDLITRDYLERDKDNPNLFKYLA

SEQ ID NO: 12268 - protein, 840 aa, Pyrococcus horikoshii OT3
MILGRSEPQKEEIKLRVAEALKRDVGRGIVRFDRRYQKMIGVEPGDIVEIEGERVTAAIVANSHPDDKGLDIIRMDGYIRKNAGVSIGDYVTIRRAQVKEAKKVVLAPAQKGVIVQIPGDIIKNNLLGRPVVKGDIVVASGRGDLYYSSGTPFDEIFRGFFEAMSVGFGELKFMVVNTIPKGIVQITYNTEVEVLPQAVEVREEKIPEVTYEDIGGLKEAIQKIREMVELPLKHPELFERLGIEPPKGVLLYGPPGTGKTLLAKAVANEANAYFIAINGPEIMSKYYGESEERLREIFKEAEENAPAIIFIDEIDAIAPKREEVVGEVEKRVVSQLLTLMDGLKGRGKVIVIGATNRPDALDPALRRPGRFDREIEVGVPDKQGRKEILQIHTRGMPIEPDFEKDAVIKVLKDLEKDERFEKEKIEKIIEKVSKANSEDEIKEILKEDGNVYVEVRNRLIDKLLEELAEVTHGFVGADLAALAREAAMVVLRRLINEGKINPEAESIPREVLEELKVTKRDFYEALKMVEPSALREVLIEVPNVHWDDIGGLEEVKQELREAVEWPLKYPKAFKKLGITPPKGVLLYGPPGTGKTLLAKAVATESEANFIAVRGPEVLSKWVGESEKRIREIFRKARQAAPAIIFIDEIDAIAPARGTSEGEKVTDRIINQLLTEMDGLVENSGVVVIAATNRPDILDPALLRPGRFDRLILVPAPDEEARFEIFKVHTRSMPLADDVDLRELARRTEGYTGADIAAVCREAALNALRRVVKSVPKEKLEEESEEFLNKLVVTRKDFEEALKKVKPSVSKYMMEYYRQFEEARKRVSGESVGREPDYFTG

SEQ ID NO: 12269 - protein, 419 aa, Candida glabrata CBS 138
MSVQLDPSALQKMAEVAAAAEQQSNEPMTVDEEYELWKSNVPMLYDFVSETRLTWPTLTVEWLPQKNLVAARTRQQLILGTHTSGEEQNYLKIGAVDLPVEVTENSKKDREIDEEDEDMVLSNVKIVKKFPHDGEITRARYMPQDDNIIATINGEGKIFIYDRSKNGVEALLSTLEYHTENGYGLAFNANEKYSLLSGSDDSNIALWDISNFEKNIKPTITFEDAHTDIINDVKWHSSEAHIFGSVSEDSTMKLFDKRSSQIIHNINTKKPYNTLAFSPFSSNLFAAAGTDNLVYLYDIRDVSNPLYAMTGHEDAVTAIEFDPNNDGILYSSGSDRRTIVWDLQEIGAEQTQDEIEDGPPEVLMIHAGHKTSINDIAVNPNINWLVASAEEDNIVQIWKCSSNIPRIGGEPEVDLSILD

SEQ ID NO: 12270 - protein, 740 aa, Petunia integrifolia subsp. inflata
MTIKQMNNIELQDGWAFMQKGVTKLKKILEGSSESFSSEEYMMLYTTIYDMCTQKPPHDHSQQLYDKYKGAFEEYINSTVLSSIREKHDEFMLREFVKRWLNHKIMVRWLSRFFNYLDRYFIARRTLPALKEVGLMCFRDLVYQELKVKGRDAVIALIDLEREGEQIDRALLKNVLDIFVEIGMGQMDYYENDFEDAMLKDTAAFYSRKASNWIMEDSCPDYMLKAEECLKKEKDRVSHYLHSSSEEKLLEKVQNELLVVHTNQLLEKENSGCRVLLRDDKVVDLSRMYRLFHRIPKGLEPVAKMFKQHVTAEGMVLVQQAEDSASNKAGISSGSQEQVFIRKVIELHDKYMAYVIDCFANNSLFHKALKEAFEVFCNKTVAGSSSAELLASYCDNILKKGGSEKLSDDAIEETLDKVVKLLAYISDKDLFAEFYRKKLSRRLLFDKSGNDDHERLILTKLKQQCGGQFTSKMEGMVTDLTLAKENQNHFQEYLSNNPAASPGIDLTVTVLTTGFWPSYKSSDLRLPMEMVKCVEVFKEFYQTKTKHRKLTWIYSLGTCHINGKFEPKTIELVLGTYQAAVLLLFNASDRLSYSDIKSQLNLADDDLVRLLQSLSCAKYKILTKDPSNRTVSSTDHFEFNSKFTDKMRRIRVPLPPVDERKKVVEDVDKDRRYAMDACIVRIMKSRKVLPHQQLVLECVEQLSRLFKPDFKEIKKRIEDLITREYLERDQENPNVFKYLA

SEQ ID NO: 12271 - protein, 351 aa, Xanthomonas campestris pv. vesicatoria str. 85-10
MATMAAHFLHRLPVPMSRPSLTRFLIEEQHAGRIDAELRQLITIVSRACKRISIAVSKGTLGGVLGDAGTGNVQGEAQKKLDVLSNDILLEANAWGGHLAACASEEMDHSQPVPDQYPSGDFLLLFDPLDGSSNIDVNVSVGTIFSVLRAPKGTEKPGDEHFLQPGTQQVAAGYCIYGPSTMLVLTLGHGTHAFTLEREEGSFLLTQANMRVPEDTAEYAINMSNQRHWEPAMQAYVGDLLAGKDGARGKDFNMRWIASMVADVHRILTRGGIFIYPWDKKDPSKPGKLRLMYEANPMSMLVEQAGGAATTGRERILDIQPTQLHQRVPVFLGSKNEVAEATRYHLDADKA

SEQ ID NO: 12272 - protein, 400 aa, Xanthomonas campestris pv. vesicatoria str. 85-10
MSFFANVEQVPGDPILGLTEAYNADSRPNKVNLGVGIYYDENGRIPLLRAVHKIEQQLAQDAKPRGYLPIDGLAAYDKATQELLFGADSALVTCGRVATSQTVGGSGALRVGADLLKKLLPTATIAISNPSWENHRAVFGAAGFEVVDYTYFDAAIHGLNFDGMLADLAKLEPGTVVLLHACCHNPTGADLSKEQWKQVAGLLKERNLFPFVDIAYQGFDKGIEADAYAVRLLAAEGIDSYVVASSYSKSFSLYGERVGALSVVSATAAEAKAVQSQVKRIIRTIYSSPSTHGAALVAGVLTSPELRDLWEQELTDMRERIHSLRAGLVEKLATLGAPEFDFIQRQAGMFSYSGLTKTQVDRLRDEFAIYAVGTGRICVAALSQRNLDYVAQAVATVSRV

SEQ ID NO: 12273 - protein, 175 aa, Triticum aestivum
MPPTMMASSATSVGPFQGLKSTAALPVSRRSNGASLGSVSNGGRIRCMQSWPIEGIKKFETLSYLPPLSTEALLKQVDYLIRSKWVPCLEFTKVGFIFREHNASPGYYDGRYWTMWKLPMFGCTDATQVINEVEEVKKEYPDAYVRIIGFDNMRQVQCVRFIAFNPPGCEESGKA

SEQ ID NO: 12274 - protein, 362 aa, Bradyrhizobium sp. ORS278
MKAAVLMEVNKPLVIEDISVPKPGPREVLIRTAVAGLCHSDLHFIEGLYPHPLPAVLGHESAGIVEQVGSDVTYVKPGDHVVTCLSVFCGTCDNCTTGRPVLCTDTTVKMPPGASNRLSWGRSEKLHQFLNLSSFAEQMLVHENAIVKIRNDMPLELAALIGCGVITGYGAVVNTARVTAGETVAVIGCGGVGMAAINGAEIAGAGRIIAIDTNPAKLQLATKLGATDIINPLDGDVVAQVRELTKGGVHHAFEVLGRKETAEQAFAMLAPGGTATIVGMIPFGQKIELHGFDFLRERRIQGSSMGSNHFRVDMPRLVEFYLRGKLHLEDWISAKLKLSEINEGFANMKAGKTLRSVIVFDA

SEQ ID NO: 12275 - protein, 439 aa, Vitis vinifera
MDSVKRSAVTPSKSRLARTFAKVLHLRMVTGVAPVDGIQKIKAPESSKDDQDTGSWSRSQSYDDNDEKLRNTAELEAHLAQLFASISSVKSAYAQLQYAQSPYDSNGIQSADQIVVSELKNLSELKRCYLKKQFDPSPERTLCLAEIQEQKSLLKTYEIMRKKLECQMKLKDSEITFLREKLEDCHKQNKSLEKRLNPSAHLSVLDNLHLSGISPSHFITVLQHTVKSIRSFVRLMINEMESSGWDINAAAAAIQPSVVFLKATHRCLAFESFVCREMFDSFHFPNFSLPNEFIKLKSTRVKEYLAQKPKSTFGKFCRAKYLKLVHPKMESSFFGNLSQRSIVNSGKFPDTPFFTSFSEMAKRVWLLHCLAFSFNPEAKIFQVNKGCPFSEVYMESIIDEPSPAPDCPPETHSRVAFTVVPGFRIGKTVIQCQVYLSQC

SEQ ID NO: 12276 - protein, 517 aa, Solibacter usitatus Ellin6076
MAIHTMQEKVAELHERTSKAMLGGGAERLEKQRQGGKLTARERVEALVDPDSFEESGLFAEHRATLFGMAGKDFPADGVVTGAASVNGRLVHLASQDFTVSGGSAGEVHSIKVAEIMEMSLKTGSPFVFINDSGGARVQEGIDSLSGYGKVFYTNVMLSGAVPQISLICGPCAGGAAYSPALTDFIIQTRQAQMFITGPQVIKGVTGETVTAEQLGGAEAHMANSGVIHFIAEDDRHAIMLAQKLLSFLPSNNLEDPPRVDGNPNVDPDPSLDDIVPADNKKGYDVREVIAKVVDFADFLEVQSGYAMNIVVGFARIAGRTIGIIANQPSVQAGVLDINAANKASRFIRFCNAFNISLLTFVDVPGFLPGVQQEHGGIIRHGAKMLFAYSAATVPKVTVILRKSYGGAYLAMCGKDLGADRVFAWPTAEVAVMGAEGAADIVFRKEIQEAADKTAKRAELIEQYREAFSNPYVAAGRRLVDAVIEPSKTRRHVAQVLEYLHTKRELRPPKKHGLMPL

SEQ ID NO: 12277 - protein, 111 aa, Glycine max
  misc_feature (87)..(87): Xaa can be any naturally occurring amino acid
KFKIAHPTPRCEKKVESDDDMRLRDPYDKRISQEVVGDLLCEGFESYIFKIIGGGEMRGAPMKQEVRTPGSWSPFCFTWRRPSFLGXGRRVGGRGRKSVRGCFASQALSVI

SEQ ID NO: 12278 - protein, 131 aa, Cryptococcus neoformans var. neoformans JEC21
MSSGGKGKASSETKSSSRSSKAGLQFPVGRIHRLLKKGNYAQRIGSGAPVYLAAVLEYLAAEILELAGNAARDNKKSRIVPRHLQLAVRNDEELNKLLGSVVISQGGVLPHIMAELLPVKTKGKAKASQEV

SEQ ID NO: 12279 - protein, 369 aa, Novosphingobium aromaticivorans DSM 12444
MTSRRKKTPEKTDEGVSMKIAVLPGDGIGPEVTREAVRVIEALGLGDIEMKEAPVGGAAYKAYGHPLPPETLEIARLSDGILFGAVGDPDCDSLERHLRPEQAILGLRKALTLFANLRPARVFKGMEDFSALRPEVAGAIDLLIVRELNGDVYFGEKGFRTAANGDREGYDVMSYSESEVRRIAHVAFRAAMGRKKRLCSVDKANVLETSQLWRDVMLEVAKDYPEVALEHMYVDNAAMQLVRAPGNFDVVVTGNLFGDILSDQASMCVGSIGLLASASLGERETEYGTFGLYEPIHGSAPDIAGKGLANPMATILSAAMLLRHSLGLEVAADRIEAAVAKALADGVLGRDLGGTAGTTEIGDAVLARL

SEQ ID NO: 12280 - protein, 840 aa, Chlamydophila pneumoniae TW-183
MAVRLIVDEGPLSGVIFVLEDGISWSIGRDSSANDIPIEDPKLGASQAIINKTDGSYYITNLDDTIPIVVNGVAIQETTQLKNEDTILLGSNQYSFLSDEFDPQDLVYDFDIPEDNFSNDSGDLSDSNEQGKDLEPRQTSETNHSPKPKEKLTKDQGSSDPITSGDQELADAFLASAKAEKNQPRAKVAKKGLKESSNESLNPKEQNAKDSPKGEERTNKPQNAIMEDNGASPRQDPQPKSAEPSLKNTARDETPLKENKPVEEKANKKATPDSPEKKDQPEEGSKIEATPLDSQKESEDKEAEEAFVQEEEENLTEDNKEDSDSAADANDDTASDHTAEDNKETPKKVENEKSAVLSPFHVQDLFRFDQTIFPAEIDDIAKKNISVDLTQPSRFLLKVLAGANIGAEFHLDSGKTYILGTDPTTCDIVFNDLSVSHQHAKITVGNDGGILIEDLDSKNGVIVEGRKIDKTSTLSSNQVVALGTTLFLLIDHHAPADTIVASLSPDDYSLFGRQQDAEALERQEAQEEEEKQKRATLPAGSFILTLFVGGLAILFGIGTASLFHTKEVVPLENIDYQEDLAQVINQFPTVRYTFNKTNSQLFLIGHVKNSTDKSELLYKVDALSFVKSVDDNVIDDEAVWQEMNILLSKRPEFKGISMHSPEPGKFIITGYVKTEEQAACLVDYLNIHFNYLSLLENKVVVETQMLKAIAGHLLQGGFANIHVAFVNGEVILTGYVNNDDAEKFRAVVQELSGIPGVRLVKNFAVLLPAEEGIIDLNLRYPNRYRVTGYSRYGEISINVVVNGRILTRGDVIDGMTVTSIQPNAIFLEKEGLKYKIDYNK

SEQ ID NO: 12281 - protein, 425 aa, Physcomitrella patens subsp. patens
MIRSSAALGSSSLRASSTSRGHVSVSTSGVCAQKKNVSFSAEDSFAGSVKSLRVAASPVSRSISRSFTVRATATEFPVRTTKSGSQEKIRIGINGCGRIGRLVLRVILARDDVEVVAVNDPFIDTKYMAYLLKYDSTHGLLKSEVNAVDDNTLQVGSQTIKVFGCRDPAEIPWGSVGADFVVESTGVFTAVDKASAHFKGGAKKVVISAPSGDAPMFVMGVNQQSYKDSMNVVSNASCTTNCLAPLAKVIQDNFGIEEGLMTTVHATTATQKTVDGPSGKDWRGGRGAGQNIIPSSTGAAKAVGKVLPELNGKLTGMAFRVPTPNVSVVDLTVRLQKSGSYEDIKAAIKAASEGPMYGILGYTEDDVVSNDFVGDARSSIFDAKAGIALSDKFVKLVSWYDNEWGYSNRVVDLILHMAGVKANLY

SEQ ID NO: 12282 - protein, 365 aa, Nicotiana tabacum
MESSTKSQIPTQSEEERNCTYAMQLLSSSVLPFVLHSTIQLEVFEILAKSNDTKLSASQIVSQIPNCKNPDAATMLDRMLYVLASYSLFTCSIVEDEENNGGQKRVYGLSQVGKFFVRDEDGASMGPLLALLQDKVFINSWFELKDAVLEGGVPFDRVHGVVHAFEYPKSDPKFNDVFNKAMINHTTVVMKKILENYKGFENLKTLVDVGGGLGVNLKMITSKYPTIKGTNFDLPHVVQHAPSYPGVEHVGGDMFESVPEGDAIFMKWILHDWSDSHNLKLLKNCYKALPDNGKVIVVEAILPVKPDIDTAVVGVSQCDLIMMAQNPGGKERSEEEFRALATEAGFKGVNLICCVCNFWVMEFCK

SEQ ID NO: 12283 - protein, 432 aa, Myxococcus xanthus DK 1622
MTEISQILAREVLDSRGNPTVEAEVQLAGGARGRAAVPSGASTGEHEAIELRDGDKHRYLGKGVQKAVKNVVDVLAPALVGMDAADQFAVDQRMLELDGTATKGKLGANAILAVSMAAARAAADAHGLPLYRYVGGVQARTLPVPLMNILNGGAHADTRVDVQEFMVVPAGASSFAEGLRWGAEVFHALKKILKGRKLATGVGDEGGYAPDLPANEEALKLIMEAIDQAGFKAGEQLFLALDVAASEFFDKGSKKYKLKGEGKEYDSTGLLEYYRGLSERYPIISIEDGMAEDDWEGWKKLTDALGSRMQLVGDDLFVTNVERLGRGIETGTANSILVKVNQIGTLTETFDAVRMAHRAGYTSVMSHRSGETEDTTIADLAVALDCGQIKTGSASRSDRVAKYNQLLRIEGELGAAARYAGKSVFRALNQKK

SEQ ID NO: 12284 - protein, 371 aa, uncultured marine bacterium 578
MAPIVMKFGGTSLRDEDSRAHALKHIKNYSDAGERIVVVVSAMGRKGEPYATDTLVALLKDVGHNINPRELDLVMSVGETLSSAFFSHLLSHNGMPAASFNGRQSGILTDDNAGNAEILEINPSRIVEALDEGKIAVVAGFQGVNDRGDIRTLGRGGSDTSAVSLASALGAEKVEIFSDVDGIANCDPRQVEASSYLELISVNQMLDMADEGSRVIHPRAIKASLKTKTPIVAKNNFTDSAGTLIHHNKSSEEEVVAIAHRESMVLLEFALEHKAASHVDGIVNIDSKRLLLNDDVYLSDKLAQLEETLGFYKLSRHWTTISVVFNNKVSKKPAGLDYAELLESPNNIIRYLLKESKSRETLKFLHGRYTQ

SEQ ID NO: 12285 - protein, 756 aa, Mesorhizobium loti MAFF303099
MRDQASGPRVLLKRLRELMQEPLEPQERLDRIVRDIASNMVAEVCSLYVLRADSVLELYATEGLNPNAVHLAQLRLGQGLVGTIAASARPLNLSNAQEHPAFAYLPETGEEIYNSFLGVPVLRAGRTLGVLVVQNKTMRHYRDDEVEALETTAMVIAEMIATGDLARLTRPGLELDLRRPVSFTGLSFNDGVGLGHVVLHEPRIVVTNLFNEDSEEEVRRLETSLGSLRLSIDDMLERRDVAFEGEHRQVLEAYRMFANDRGWVRRLEEAIRNGLTAEAAVEKVQSDMRARMLHMTDPYLRERMSDFDDLANRLLRQLMGRGPEDVAASLPKDAIIVARSMGAAELLDYPREKMRGLVLEDGAATSHVVIVARAMGIPVAGQMKGAVSMAENGDAIIVDGEEGVIHLRPQSDLEAAYAEKVRFRARRQEVYRELRKKPSTTRDGVQVDLLMNAGLAVDLPQLAEAGAAGIGLFRTELQFMVASTFPRAEAQEKLYRDVLEAARGKPVTFRTIDIGGDKVLPYFKGAIQEENPALGWRAIRLTLDRPGLLRTQIRALLKASGGRELKLMLPMVTELSEIAQAREIIDREVRHLSRFAHHLPTSLKLGAMLEVPSLLFQLDELMKAVDFVSVGSNDLFQFVMAVDRGNTQLANRFDTLSAPFLRVLKQIADAGIRNHTPVTLCGELAGKPISAMALIGLGFRSISMSPASIGPVKAMLTELPLDELTAFFDDNLMAPAQGLPMRALLQAFADDRSIPL

SEQ ID NO: 12286 - protein, 400 aa, Bdellovibrio bacteriovorus HD100
MIQLSKRAQNLKPSPTLFLVAKAKELAAQGHDVISLTVGEPDWPTFKGASDAGIEAIQKGITKYTPANGTVELRKSISEKLKSELGFEYSPKEITVASGAKYIIFSALQMICSPGDEVVIATPYWVSYPAMVELADGVPHIVECGEMENFKITPEKLEAAINAKTKGFLFCSPSNPTGLQYSADELKALAEVLRKHPQVVIISDDIYNRLVFDGTKVAPHILTVAPDLKDRTVLVNGGSKAYSMTGWRIGWASGPERLITAMADYQSQSTGSPSSISQHALLAAIKTSEADIKGVVDKLVARKNSGLKELETVPGFKTAEPQGAFYFWVDIRAHLGKSYQDRVIRTSKDFCDVLLEKFFVATVPGAECGTEGFMRLSFAVSEETMKRGVARMKDLVSQLV

SEQ ID NO: 12287 - protein, 417 aa, Mesorhizobium loti MAFF303099
MARIVMKFGGTSVADIARIRNVARHVKREVDAGHEVAVVVSAMAGKTNELVGWTREASPMHDAREYDAVVASGEQVTAGLLAITLQNMGVHARSWQGWQIPIKTDNAHGAARILDIDGAFLIKRFGEGQVAVIAGFQGIGPDNRIATLGRGGSDTSAVAIAAAVKADRCDIYTDVDGVYTTDPRIEPKARRLAKISFEEMLEMASLGAKVLQVRSVELAMVHRVRTFVRSSFDDPDAPGMGDLLNPPGTLICDEEEIVEQQVVTGIAYAKDEAQISLRRVGDRPGVAAGIFGPLAEANINVDMIVQNISEDGKFTDMTFTVPSGDVDKALAVLDRLKAEVGYDVVQSEAGMSKVSVIGIGMRSHAGVAATAFKALADKAINIRAITTSEIKISILIDGPYTELAVRTLHSVYGLDKQ

SEQ ID NO: 12288 - protein, 554 aa, Oryza sativa Indica Group
MATAATLPSSSSSAAAAVQTISRVLSFPRRGGGGFLHLRRHPLAAAAAATRGRGPLLRLGPRRPFSASASAGDNGAAAGGDGGGCDYDYDLFTIGAGSGGMRASRVAASLYGARAAVCEMPFATVASDSLGGVGGTCVLRGCVPKKLLVYASKYSHEFEESHGFGWRYGTEPKHDWSTLMTNKNLELQRLVVVQTNMLKNSGVTIIEGRGKVVDPHTVSVDGKLYTAKNILIAVGGRPSMPDIPGIEHVIDSDAALDLPSRPEKIAIVGGGYIALEFAGIFNGLKSGVHVFIRQKKVLRGFDEEVRDFVADQMSLRGITFHTEETPQAVMKSDDGLLTLTTNKGSINGFSHNLGLEEVGVKMDKHGAIVVDEFSRTSVDSIWAVGDVTNRVNLTPVALMEGGALARTIFGNEPTKPDYSAVPSAVFSQPPIGQVGLTEEKAIEKYGDVDVYTSNFRPLRATLSGLPDRVYMKVIVCANTNKVLGVHVCGEDAPEIIQGIAIAVKAGLMKQNFDATIGVHPTTAEELVTMRSPTRKVRRDAVDEAKMKDEATSQK

SEQ ID NO: 12289 - protein, 483 aa, Myxococcus xanthus DK 1622
MLEAASQANTQPTADTERIRAVFEAQRAHRWTMSRTTAAERIARLKRLREAIIARRAELADAIHADFRKPAMEVDLTELHPTLEELNHTVRHLKSWMKPMRVGTPMLLAGSSSHVRYEARGTVLLLSPWNYPFNLLVSPLVAAIAAGNTVICKPSEKTPHTSRFLAQLVKDVFPENEVALFEGGAETAEALLELPFDHIFFTGNTRIGRKVMEAAAKHLASVTLELGGKSPVIVDETADVAAAAERLCWGKFVNGGQTCVAPDYVFVHASKERAFLDALKASITRFYGGTEQERQASPDLTRLVDPVAWRRVKDLLKRSVAAGAKVEVGGETDEPSRYIAPTVLSGVTAENPVMEGEIFGPVLPVLTFQSREEVYAHIRAGGKPLALYVFSQDKRAVEDIFQNTTSGGAVVNNVLVHLANPNLPFGGVGTSGLGNYHGHFGFKTFSHERAVMVQWMKSLASVFFPPYRGKAQELASRATRLME

SEQ ID NO: 12290 - protein, 583 aa, Oryza sativa Indica Group
MDGLAAPSPSHSGATSGGGASHRKRKLPPSSLSDATADEDDDTTAPSSPSTSPSSPSRPSSPSSSHSDDDDDDSLHTFTAARLDGAPPSSSGRPPKPESSTVSAAAAAAAAAAAPKPDSASAAAGDGKEDPKGLFTDNIQTSGAYSAREEGLKREEEAGRLKFLCYSNDGVDEHMIWLVGLKNIFARQLPNMPKEYIVRLVMDRTHKSMMVIRNNIVVGGITYRPYTSQKFGEIAFCAITADEQVKGYGTRLMNHLKQHARDADGLTHFLTYADNNAVGYFVKQGFTKEITLDKERWQGYIKDYDGGILMECRIDQKLPYVDLATMIRRQRQAIDEKIRELSNCHIVYSGIDFQKKEAGIPRRTMKPEDIQGLREAGWTPDQWGHSKSRSAFSPDYSTYRQQLTNLMRSLLKASLLSSQIFLYDMQPFGLTSLDKPVLCLLPFEFFAPFLFQAYFLKPDQLDGLFNGSMIEMATFYKFNIQIFLNMNEHPDAWPFKEPVDSRDVPDYYDIIKDPIDVETMSKRVEFDQYYGTLEMFVPDMKRMFSNAKTYNSPDTIYYKCASRLESFFSNKVASQLAQASTKN

SEQ ID NO: 12291 - protein, 224 aa, Oryza sativa Japonica Group
MGYAQLVIGPAGSGKSTYCSSLYQHCETVGRTIHMVNLDPAAEHFSYPVSTENHRHLEDNLDDWLDEQLDGYLDDDYLVFDCPGQIELFTHVPVLRNFVEHLKRKNFNVCAVYFLDSQFVSDVTKYISGCMASLSAMIQLELPHINILSKMDLVANKKDVEEYLNPEAQVLLSQLNRQMAPKFGKLNKSLAELAAHVFQMSMLSLLFPAKSMAWWPLRAFISVG

SEQ ID NO: 12292 - protein, 343 aa, Escherichia coli CFT073
MIHFYKDIPMATSLKNRNFLKLLDYTPAEIQYLIDLAINLKAAKKSGNEKQTLVGKNIALIFEKSSTRTRCAFEVAAFDQGAQVTYIGPSGSQIGHKESMKDTARVLGRMYDGIEYRGYGQNIVEELGEFAGVPVWNGLTNEFHPTQILADLMTMLEHAPGKTLPELSFAYLGDARNNMGNSLMVGAAKMGMDIRLVAPKSFWPDEALVTQCREIASVTGARITLTEDVEEGVYDVDFLYTDVWVSMGEPKEAWAERVSLMAPYQINQQVITATRNPEVKFMHCLPAFHNEHTTVGREIEMAYGLKGLEVTEEVFESAHSIVFDEAENRMHTIKAVMVATLGD

SEQ ID NO: 12293 - protein, 130 aa, Brassica napus
  misc_feature (92)..(92): Xaa can be any naturally occurring amino acid
MFIIPGFFLFQLRICPSMQSSVHREKPSSIAMILETHRNIEFPHRIVDKRPRKRPRLAWDAAPPPPTVFHPPLYYGQEFASGVAPSFVYPNXFYNNGFPRQGSPPWRPDDKDGHFVFVVGDSLTPRYQIL

SEQ ID NO: 12294 - protein, 400 aa, Bacillus cereus E33L
MMTYTLATRMKAFQSSIFSELGTYKKEKIAAGHKMIDLSIGNPDMPPADFVREEMVHTANQKESYGYTLSGIQEFHEAVTEYYNNTHNVILNADKEVLLLMGSQDGLVHLPMVYANPGDIILVPDPGYTAYETGIQMAGATSYYMPLKKENDFLPNLELIPEEIADQAKMMILNFPGNPVPAMAHEDFFKKVIAFAKKHNIIVVHDFAYAEFYFDGNKPISFLSVPGAKEVGVEINSLSKSYSLAGSRIGYMIGNEEIVGALTQFKSNTDYGVFLPIQKAACAALRNGAAFCEKNRGIYQERRDTLVDGFRTFGWHVEKPAGSMFVWAEIPKGWTSIDFAYALMDRANVVVTPGHAFGPHGEGFVRIALVQDKVVLQQVVENIRNSGIFSLEKSEELVKN

SEQ ID NO: 12295 - protein, 462 aa, Oryza sativa Japonica Group
MGGRIARRGLSRLAAAVETAAVAPPRMADFNHVPLPYDGPSAAEIARKRAEFLSPSLFHFYSKPLNIVEGKMQYLFDERGRRYLDAFAGIATVCCGHCHPDVVGAIAAQAGRLQHSTVLYLNHAIADFAEALASKMPGDLKVVFFTNSGTEANELAIMMARLYTGSHDIISLRNSYHGNAAGTMGATAQKNWKFSVVQSGVHHAVNPDPYRGAFGSDAEKYARDVQEIIEFGTTGQVAGFISEAIQGVGGIVELSPGYLPLAYEAVRSAGGLCIADEVQAGFARVGSHFWGFETHGVVPDIVTMAKGIGNGIPLGAVVTTPEIAQVLTRRCYFNTFGGNPLCTAGGLAVLRVLEKEGLQANAHAVGSYLKDRLRALQDKHEIIGDVRGTGFMLGVELVTDRQLKTPAKDEICRAMEHMKEMGVLVGKGGFYGNVFRITPPLCFTKEDADFFVAVMDSALSKL

SEQ ID NO: 12296 - protein, 160 aa, Pyrococcus horikoshii OT3
MFQMSETERTLVIIKPDAVVRGLIGEIISRFEKKGLKIVGMKMIWIDRELAEKHYEEHREKPFFKALIDYITKTPVVVMVLEGRYAVEVVRKMAGATDPKDAAPGTIRGDFGLEVSDAICNVIHASDSKESAEREISLFFKPEELFEYPRAADWFYKKGI

SEQ ID NO: 12297 - protein, 604 aa, Physcomitrella patens subsp. patens
MENQMKTVCKDAPDVLDLDNSTLIGGGGVGDAYGEDAATEDQTFTPWTRLSMFCDDLNLVGVYSGLELLRDPRYNKGLAFCEEERARHYLQGLLPPVVMSQELQIQRILQNVRAYETDLERYVEVMDLQERNERLFYRVLIDHVEELLPIVYTPTVGEACQKYGNIFRRPHGLYISLKDRGHVLDCMRNWPEPNVQVIVVTDGERILGLGDLGLQGMGIPIGKLALYTALGGIRPSATLPVTIDVGTNNQDLLDNPFYIGLRQKRATGKEYDELLHEFMTACKQAYGEKVLVQFEDFANHNAFRLLAKYSTSHLVFNDDIQGTAAVALAGVLAALPLTGGTLADHKFLFVGAGEAGTGIAELIALEVSRQGNTSLDEARKAIYLVDSKGLVTKSRFDSLQEFKKPFAHDLKPNSELVAIIKEIKPTVLIGTTGKGGQFTQAVLEEISSYQEKPVVFALSNPTTQSECTAEQAYKYTKGKCIFASGSPFKPVTHEGKTYTIGQSNNCYIFPGMGLGCVISGAIRVHDDMFLAAAESLAQEIGEDHLEKRQLYPAFSEIRDISAHIGAAVAAKAYDLGLATKLPRPKDLLAYAKSCMYSPVYRPFR

SEQ ID NO: 12298 - protein, 380 aa, Oryza sativa Indica Group
MGSSCSRSHSLSEAETTKNAKSADIDRRILQETKAEQHIHKLLLLGAGESGKSTIFKQIKLLFQTGFDEAELRSYTSVIHANVYQTIKILYEGAKELSQVESDSSKYVISPDNQEIGEKLSDIDGRLDYPLLNKELVLDVKRLWQDPAIQETYLRGSILQLPDCAQYFMENLVRLAEAGYVPTKEDVLYARVRTNGVVQIQFSPVGENKRGGEVYRLYDVGGQRNERRKWIHLFEGVNAVIFCAAISEYDQMLFEDETKNRMMETKELFDWVLKQRCFEKTSFILFLNKFDICEKKIQKVPLSVCEWFKDYQPIAPGKQEVEHAYEFVKKKFEELYFQSSKPDRVDRVFKIYRTTALDQKLVKKTFKLIDESMRRSREGT

SEQ ID NO: 12299 - protein, 522 aa, Bacillus sp. SG-1
MATDNKGGFFVSQKTYEHVLEEKREKISGGGQQKYHEKLKEQNKLFVRDRLNLLFDNGEYQEDGMFANCQDEDLPADGVVTATGKIGGRTVCVMANDSTVKAGSWGARTVEKIIRIQETALNLKVPILYLVDSAGARITDQLEMFPNRRGAGKIFHNQVKMSGMVPQICLLFGPSAAGGAYIPAFCDIVIMVDGNASMYLGSPRMAEKVIGEKVTLEEMGGARMHCSVSGVGDMLAYSEEEAIKAAKDYLSYFPSNYLQKPAGIEGVKPKEGRTLEQIIPEHQNAPFDMYECIDSLIDEGSFFEMKKLFAQEIVTGFARIDGKPVGIIANQPKVKGGVLFVDSADKAAKFITLCDAFSIPLLFLADVPGFMIGTKVERAGIIRHGAKLIAAMSSATVPKISVIVRKAYGAGLYAMAGPAFEPDVCIALPTAQIAVMGPEAAVNAVYSNKIQAIEDPKERIAYVQEKQKEYKEHIDIYKLASEMIVDEITGPNELRGVLIDRFKLYETKEVEFSTRKHPVYPV

SEQ ID NO: 12300 - protein, 434 aa, Nocardioides sp. JS614
MSTALVAEPAERTTLAGLLAFDRAHVWHPYASMTDPTPVRLVTGAHGVRLTMADGSQVIDGMSSWWSAIHGYRVPELDAALVAQSQRMSHVMFGGLTHAPAIRLAQRLVAITPDALQHVFLADSGSVSVEVAIKMVLQYQRGVGRPERTRLLTVRGGYHGDTFGCMSVCDPIGGMHAMFAAVHHSQVFADRPPGPGGDVDGWADGVRRLAATHARELAGIIIEPLLQGAGGMHVYDAACLRILREIADEHDLVLVFDEIATGFGRTGHLFVSDHVTPDILCLGKALTGGYLTLAAVLATAEIAHGISGSESGVLMHGPTFMGNPLACAVALASLDLLQTRDWGADVRRLHAALTTGLEPLRAAPGIADVRVLGAVGVVQLDHEVDVAKATDAALAEGVWLRPFRDLVYTMPPYPTQQADAAHICAAIAHAAAVA

SEQ ID NO: 12301 - protein, 509 aa, Xanthomonas campestris pv. vesicatoria str. 85-10
MNAQPATKPLNTDPQSIFKPRYDNFIGGKWVAPKDGQYFDNTTPINGKVFTSIARSTAPDIEAALDAAHAAKEAWGKTSTTERSNVLLKIADRIEQNLELLAYAETWDNGKPVRETLNADVPLCVDHFRYFAGAIRAQEGGISEIDSDTIAYHFHEPLGVVGQIIPWNFPLLMACWKLAPALAAGNCVVMKPAEQTPASILVLMELIGDLLPPGVLNVVNGFGLEAGKPLASNPRIAKIAFTGETTTGRLIMQYASQNLIPVTLELGGKSPNIFFADVMAEDDDFLDKAVEGFVLFAFNQGEVCTCPSRALIQESIYDRFMEKALARVAAIKQGNPLDPNTMVGAQASSEQLEKILSYIDIGKQEGAQVLIGGERNTLEGDLAGGFYVKPTVFKGHNKMRVFQEEIFGPVVSVTTFKDEADALAIANDTLYGLGAGLWSRDASRLYRMGRAIQAGRVWTNCYHAYPAHAAFGGYKQSGIGRENHKMMLDHYQQTKNLLVSYSPKALGLF

SEQ ID NO: 12302 - protein, 301 aa, Bacillus thuringiensis serovar konkukian str. 97-27
MRKWGIELLILAVVIIWGINFTIAKYGLLEFTAIEFTALRMISAAPLMLLLTFFIEKSVYMERKDIPRLIIVSVVGIVLYQTLFMETVKYTSATNASLLISISPIFTTVFAIFLKQEKFSSRKLIGSIIAFGGAALVLVAGHSLASSFYGNGIGLITSICWGLYPVLAGPLIKKYSALRVTAWSALVGAIPLLLLSGPHVFTMPFHITHGMTLFALLYSIFFVTVFGLVMWYVGVQKIGASHTMVYMYITPLVAVLFAAVWADEYVSFQQIIGGIIIFFGLWFVKSEKVNIHSTAGEPISK

SEQ ID NO: 12303 - protein, 364 aa, Acidovorax sp. JS42
MSLKCGIVGLPNVGKSTLFNALTKAGIAAENYPFCTIEPNTGVVEVPDPRLQQLAEIINPERIVPAIVEFVDIAGLVAGASKGEGLGNQFLAHIRETDAIVNVVRCFEDPNVIHVAGRVDPIADIEVIQTELCLADLATVEKALQRYSKAAKSGNDKEAAKLVQLLTPIQAALDEGKPARTVPVSKEDAPLLKQFCLITAKPAMFVGNVAEDGFENNPLLDKLKAYAEAQGAPVVAICAKIEAEMAEMGDEDRDMFLQEMGLEEPGLNRLIRAGFKLLGLQTYFTAGVKEVRAWTIHVGDTAPQAAGVIHGDFERGFIRAQTIAFEDFIQYKGEQGAKDAGKMRAEGKEYVVKDGDVMNFLFNV

SEQ ID NO: 12304 - protein, 289 aa, Acidovorax sp. JS42
MSFRADHDLTGTVARLFIHPVKSCAGIEVQQALLTDTGLDLDRAWMVVDAQGVFLSQRTLPRMALIRPQLRSDDLVLRAPGMLALHVALDRVEQPATVQVWDDTVPAWDMGDLAAQWFSDFLGLRCRLVRFDPEHRRLSSLRWTGGIEAPTQFADGFPLLVASQGSLDGLNERLLAAGEGAVGMERFRPNLVIAGVEAHDEDRIDELFIGTGEGEVRLQLVKPCTRCPIPNIDPATAESTPAVSTALRRYRQDPRMDGAITFAMNAIVREGTGTVLRVGQPVAANLRFD

SEQ ID NO: 12305 - protein, 362 aa, Neurospora crassa
MMSRATTRTIKSAVGQIQARSVSNSAASSTPRHLLSISQLSPAEFSKLVLNASAYKQATKAAFAAGPGQVPRTLDGKLKGRTVAMMFSKRTTRTRVSTEAAVASWRGHPMFLGKDDIQLGVNESLYDTSKVISSMTSCMVARVGPHSDVADLARDSSVPVINALSDDFHPLQAIADFQTIHEAFAPSPPTRPASDSRHEGRLGRRSNNVLFDMATAASCWASTLPSPRPPATDSRPHEADHPQRRRGLAKPGKLIETTVPEEAVKDADILVTDTWVSMGQEAETQRRLKDCLPASKITNELAKRGGAKPGWKFMHCLPRHPEEVDDEVFYGPQSLVFPEAENRLWAAVSALEAFVVNNGRIL

SEQ ID NO: 12306 - protein, 625 aa, Ralstonia eutropha JMP134
MAHLLASRLAWRGSIIVTFTALMAACGTQSGAPAAPAAPAAPQPPATATLPPAPEIASGYRTDMSTVYAEKYMAAAANPLATEAGRDVLRQGGSAIDAAIAMQAVLTLVEPQASGVGGGAFIMYWDGKRVQAFDGRETAPAGATENLFLRPDGKPMEFSEAQIGGRSVGTPGVLRALEMAHREHGKLKWSQLFQRAISLAEKGFPISPRLYAQVASDKFMSNSPEMSAYFLDAQGKPKPAGTILKNPQLAQTLRAIAANGPNALYTGPIARDIVTKVNGSLNPGSLSTRDLVNYRAKLRVPVCTDYKRWKICGMPPPSSGGIALAQILGTLQALETRNPKYALAALKPSAVSTPAVLEANPDAVHAIAEADRLAYADRGLYVADSDFVQVDIAGMVNPAYLEQRASLISDKSMGKAQPGVPPGTSVAFAPDRSPPRISTSQIVAVDSRGGAISMTTTVESYFGSHIMVRGFMLNNQLTDFSFLPSENGKPVANRVEPGKRPRSSMAPTLVFDRESGKFLGTVGSPGGSQIIEYVSKTLVGLLDWNMDVQAAIGMANFGSRNGPTELEKGLVTPALAEALKQRGHQVAEIEMTSGTQAIMRRQRADGRLVWAGGADPRREGVAMGD

SEQ ID NO: 12307 - protein, 202 aa, Chlamydomonas reinhardtii
MLPVAHVPVVLQEELRKLRRRDAALQMQLADRSLEALELRRELASASAAAEPSVVQLKQLMLDPAVAREFARLRAELEAAQAELATAREELTAVTFTQESKVGRQLMAKCRSLQEENEEMGRELAEGKAQAAEAAEALARAHADDMRAAYRELEDHCLVMEDEAEELQREVFALRARVSELERDAGLPPSLPLGAGMGGGGM

SEQ ID NO: 12308 - protein, 121 aa, Malassezia sympodialis
MRGSHHHHHHLVPRGSVQVISSYDQFKQVTGGDKVVVIDFWATWCGPCKMIGPVFEKISDTPAGDKVGFYKVDVDEQSQIAQEVGIRAMPTFVFFKNGQKIDTVVGADPSKLQAAITQHSA

SEQ ID NO: 12309 - protein, 426 aa, Clostridium tetani E88
MFVKKEKNLKGRRSLIMFESKELNLPNGFKAVLVKKDTPIFSINLGVGIGSIFESEKEKGISHFIEHMIFKGTKNRTNEKLNEDLEELAGEYNAYTDYNCTIYSITALNDEFEKAIELISDMVINSNFQKEEVEKERKVILSELSGSRDDIEDFSFVKIKELAYRNSPLKYDTIGTKENIEKFTKKQLEDFYSRYYVPNNSYISIVSSYDYDHIEKILHKYFKSWTKKEFERKNLAFEQNIPGKYIYNKRDIEQSCILYLYTCNNLDKKEEMVLKVLNHRLGESNNSLLFRKLREEKGLAYDVYTLLDSINSFNSIYIYTAVSQNSVNETINTIDKCINDIKDGTIKFHINTIRLMKKNLKTAIAFILDDSSDLSNYIVHQIIEDRNIYEFTEDIKKLDEIKEEDIVRMANKVFNHPTIHILKNKQ

SEQ ID NO: 12310 - protein, 283 aa, Brassica napus
  misc_feature (102)..(102): Xaa can be any naturally occurring amino acid
  misc_feature (121)..(121): Xaa can be any naturally occurring amino acid
MRTRTSQTQELKLLLVCLFAALVLIFIVRSTLTTSQQHQTPEETTRSKGCAGACNKLPRSLAQALIHYSTSVITPQQTLKEIVVSSRVLEKKSPCNFLVFGXLGHDSLMWSSLNYGGRTVXFLEEDEAWIKQIKRRFPMLESYHVTYDSKVNQAENLIEVGKGPECTAIGDPRYSMCQLALKGLPAEIYETSWDLIMVDAPTGYYDEAPGRMTAIYTAGMMARNRKRVGETDVFVHDVNREVEDKFSKAFLCEGYIKKQEGRLRHFVIPSYRDGSESNRPFCP

SEQ ID NO: 12311 - protein, 320 aa, Streptococcus pneumoniae TIGR4
MPKKILVLHTGGTISMQADASGAVVTSSDNPMNHVSNPLEGIQVHALDFFNLPSPHIKPKHMLVLYQKIKEEADNYDGVVITHGTDTLEETAYFLDTMEVPHMPIVLTGAMRSSNELGSDGVYNYLSALRVASDDRAADKGVLVVMNDEIHAAKYVTKTHTTNVSTFQTPTHGPLGLIMKQEILYFKTAEPRVRFDLDHIQGLVPIISAYAGMTDELIDMLDLEHLDGLIIQAFGAGNIPKETAQKLESLLQKGIPVALVSRCFNGIAEPVYAYQGGGVQLQKAGVFFVKELNAQKARLKLLIALNAGLTGQALKDYMEG

SEQ ID NO: 12312 - protein, 618 aa, uncultured marine bacterium 578
MSWITKLFPFLLWIKDLSKPKTIKADIIAGVTVGFVIVPQSMAYAQLAGLGPQYGLYASFLPVLIGAIMGSSRQLSTGPVAVVSLLTAAALGEIVTDPSSYAVYAALLALIVGLFQFSLGVLRLGFVINFLSHPVVTGFTNAAAIIIGASQLPKVFGIRVINSNDTEWVSWCQPLSFIERMENVDSNGLHTICNADQSYETIARLLEAALFYTHLPTLAMALMGVLGIIVLQRFFPRMPAILTVAVISIAASFLIDYEAMGGAIVNSIDIDGLFSFKIPSFDFNAMGTLFIYAITISLIGFMEAISVAKSMAATTKQRLDVNQELIGQGLSNIASSFFQGYAVSGSFSRSAVNLTAGAVTGFSSVVTAIIVGLTILWLTPLLYHLPQATLAAIILMSVVNLVHFSPLRHAWKVEKHDGWVGLLTFIMTLIFAPHLENGIAFGIIMSLGLFLYRTMEPNFTELSVQKGSIIASRFIDDTTEVSNAVKIAKWSGSLYFANAAYFETKLLELISKNEELKYIIVDVASIVQVDASGEQVLRNLVESCSDSGVEIIFARTDRLEAELYRSGFKKRFGENRFFDLRADALKHVWQELEANEQEQELDEEQDHILDIDDGLNTA

SEQ ID NO: 12313 - protein, 348 aa, Physcomitrella patens subsp. patens
LAGCDIAHGKWVYDETYPLYRSRNCPFVDPGFRCEENGRPDTDYMKYRWQPNDCDLPSFDSQDMLEKLRDQRLVFVGDSLGRNQWESMLCMLAEGVQNKSRIYEINGHPISKHVGELVFRFQDYNCTVEYYRDPFLVPQTRPPPNAPDNVTNVLHIDQVSWTANMWPGASILVFNSGHWWSWEKIGRQGGAFQIGSNVTSHGFEEAFKIALETWALWIESNLDPMKTQVFFRSFASVHFRGGSWNTGGQCHEEVKPLSDEEVQKMQPVPWTNKYIEQTIKENIKTKKGVVEFMDVTTSTDYRSDGHSGLYANDVLVMGPTPMNRQDCSHFCLPGVPDTWNELLYATLL

SEQ ID NO: 12314 - protein, 377 aa, Triticum aestivum
  misc_feature (201)..(201): Xaa can be any naturally occurring amino acid
  misc_feature (213)..(213): Xaa can be any naturally occurring amino acid
  misc_feature (234)..(234): Xaa can be any naturally occurring amino acid
  misc_feature (321)..(321): Xaa can be any naturally occurring amino acid
  misc_feature (329)..(329): Xaa can be any naturally occurring amino acid
  misc_feature (342)..(342): Xaa can be any naturally occurring amino acid
  misc_feature (345)..(345): Xaa can be any naturally occurring amino acid
  misc_feature (353)..(353): Xaa can be any naturally occurring amino acid
HYRTSLYKKAGCYRSGIPGISSTHASDAAELKSLIAALHGKGVQAIADIVINHRCADYKDSRGIYCIFEGGTSDGRLDWGPHMICRDDTTYSDGTANLDTGADFAAAPDIDHLNDRVQRELKEWLLWLKSDLGFDAWRFDFAKGYSPEMAKVYIDGTSPSLAVAEVWDNMATGGDGKPNYDQDAHRQNLVNWVDKVGGAAXAGMVFDFTTKGXLNAAVEGQLLALIDPAGEGPXVMGWWPAKAVTFVDNHDTGSTQAMWPFPSDKVMQGYAYILTHPGIPCIFYDHFFTWGFKDEIAALVAIRKRNGITATSALKILMHEXGDAYVAEXDGKVVVKIGSKVXDSXAVIPAGFXVTSAHGNDYPFWGEPRAAATLQRS

SEQ ID NO: 12315 - protein, 209 aa, Triticum aestivum
  misc_feature (106)..(106): Xaa can be any naturally occurring amino acid
MSEEDSTSRPAPKLNERILSSLSRRAVAAHPWHDLEIGPGAPAVFNVVVEITKGSKVKYELDKKTGLIKVDRVLYSSVVYPHNYGFIPRTLCEDNDPMDVLVLMQXEPVIPGSFLRARAIGLMPMIDQGEKDDKIIAVCADDPEYRHYNDISELSPHRLQEIKRFFEDYKKNENKEVAVDAFLPATTAREAIQYSMDLYAQYILQSLRQ

SEQ ID NO: 12316 - protein, 321 aa, Bacillus cereus E33L
MSIVNKKIIFFGDFGIDDAVALIYANKTCKLDILGIVAEYGNVSREIVTENVYFLERYYATKVKIIEGAARPMTAEEPLFFPEIHGEHGLGPIIPPEMRICKRENFCELIKLIEPCPEDIIIVATGRLTTLATLFLLYPNVMDKVCSYYIMGGAFLFPGNVTPVSEANFYGDPIAANIVMKYAKNATIYPLNVTQQALITPEMVDIINKEGTGQAKLIKPMIDFYYENFYKKEYPGIAGSPIHDLLPFISFINDDIFEYKKSAVWISTTNDVTRGQSVADFRKIAEPTRFDDRPIQRIAVGFNYPAFKEEFMRTILKPDCP

SEQ ID NO: 12317 - protein, 390 aa, Ralstonia eutropha JMP134
MSADSTLAPLTPPVSRLPSVGTTIFTVMSALAAEKNAVNLGQGFPDFDCDPRIVDAVTHAMRTGHNQYPPMAGVPRLRQAIADKIATLYGHRYSWESEITVTAGATQGILTAILCAVHPGDEVIVLEPCYDSYLPAIELAGATAVPVTLEAPDFRVPFDRLAAAITPRTRMILINTPHNPTGTIWRAADMDKLAQLLAGTDILLLSDEVYEHMVYDREPHASVSRHPELARRSFVISSFGKTYHVTGWKVGYVAAPAALSAEFRKVHQFNVFTVNTPVQHGLADYMADPAPYLELSAFYQAKRDYFRAGLANTRFKLLPSEGTYFQCVDYSAISDLSEAEFSMWLTREIGVAAIPVSAFYTQPRESGVVRFCFAKKEETLSRALERLAKL

SEQ ID NO: 12318 - protein, 340 aa, Xanthomonas campestris pv. vesicatoria str. 85-10
MSRARILCFGELLLRLGAPGHELLLQQPRLDVHCGGAEANVGVSLAHFGHEVAMVSTVADNPLGAAVLGELRRHDVDTRHVRRVDGRMGLYFLTTGAIHRPSEVIYDRADSAFALAPADAYDWPRLLEGAQWLHLSGVSPALGAEVAQATLAAARAARAAGVKVSFDGNYRPKLWQRWQGDARGVLHQLFACADVVFADYRDIGVVLGGEFAQDTLEARVEAAAQQAFAAFPQLQLMACTQRVAHNVDHHSLGAMLLPRDGAVARAPSEELTPIIDRIGGGDAFAAGVLHGLIEGWSLEDTARFGLAAGCLKHSIPGDFNPLSVADVQACVGDARFDVKR

SEQ ID NO: 12319 - protein, 196 aa, Bacillus sp. SG-1
MREVKVNNVELVISAVRPEQYPGEFLPEFALAGRSNVGKSSFINRMIGRKSMARISSRPGKTQTLNFYKIEESLYFVDVPGYGFAKVSKKEREAWGRMIETYITMREQLKAVIQIVDLRHPPTEDDIMMYDFLKHNGIPCVIIATKADKIPKGKWQKHLKVTKEALDIEEGDEIILFSSETGLGKDQVWAALNSRR

SEQ ID NO: 12320 - protein, 910 aa, Mycoplasma pneumoniae M129
MAEAKRDYYEVLGLSRDADDNDIKKAFRKLAKKYHPDRNKAPDAAQIFAEINEANDVLSNPKKRANYDKYGHDGVDNEGGFAFQADVFDSFFEEIEKSGAFDNLSESNTKKKEKTKTKKKGWFWGKSKQEESTSDTTEYADVDAGLEDYPPQSDYPDDIPDVDARIEEVDQSAYADDIPDVDAGMDWEQNAEVANSASEIIPDVDAGLADEFNTSSAAPQASDWEAMIGNPEYGYFDAAGEWNWKGFFDEAGQWVWLEETEPSSVSNDETTTDSDAVTAATTVEETDQDSWTANSAPEPVDVETPVELQPETEPEPIITLSSEPVEAPASVVIEPTPEIEETTSAVEMDASVKADVSDEADATNEPTEQDTISEPEQETDAAALEEINHTTADLEPAEVSATNDLEQDVVEKVNFSEPESTVDTAATDPVVEQATETSTNGFKFFNFSSFVLSDQNPNPQTPTHHEEDAAAPEPTVDETSGESTAPEVTIAESTVELETAAEINNPATFVEEYLQPTKTTVVDKLDEPTVAKPTVSDSENSVAPEPEFVAGPEQTFSWKPAISETEEIPLTAVEPASETQTLIAEDVTSPVTPTATAIPAPSINAVPTAPVAETFEAAVDFLKEAAKIEAQLPLVPTVPEQIDGTDPSLLTQWDEYLEKTRKLFHKLFLTEQLPFIVKTDQFEIVDPNLDEHNVNLIYTEHVPQICFLNEQLKEIRYTRKLVDPQTQVTTTESITLEVQLSHKSQTEAIAIFKGFGHDYGSGCGDLKVVLKVIPSVFFQLQADGLHTAALVDPLVAYNGGLIDVFGPVNSFKVDIEGGIANNDLIEFNQLGVLRTKTKRGSLYVHLYYSSVAKKGTKTNCQVQQFFDLVHVEYKLLNYNLKQLHNYHSALTAQKKTLDRKSYQCLAVESH

SEQ ID NO: 12321 - protein, 515 aa, Deinococcus radiodurans R1
MTVAEQQPQHQGYANPGTPGSVVTFKKRYDNFIGGQWVPPVKGQYFDNASPVDGKVFTQAARSTAEDVELALDAAHRAAPAWGRTSVTERSNILLKIADRMEQNLEMLAVAETWDNGKPVRETLAADLPLAIDHFRYFAGCIRAQEGGLSQIDDSTVAYHFHEPLGVVGQIIPWNFPLLMGVWKLAPALAAGNAVVLKPAEQTPASIMVLMELIADLLPEGVVNVVNGFGLEAGKPLASSPRIAKIAFTGETNTGRLIMGYAADNLIPVTLELGGKSPNIFFDDVMMEDDAFLDKAVEGMVMFALNQGEVCTCPSRALIQESIYDRFMERAVQRVEAITMGHPLDPGTMIGAQASTEQLDKILSYLDIGRAEGAEVLTGGERGQREGLEEGFYVKPTIFKGHNKMRIFQEEIFGPVLAAATFKDEAEALELANDTLYGLGAGLWTRDISRAYRMGRGIQAGRVWTNCYHVYPAHAAFGGYKQSGIGRENHRMMLDHYQQTKNLLVSYSPNKMGFF

SEQ ID NO: 12322 - protein, 254 aa, Zea mays
NATARQQHTAHTHIAMAAAGGGVGDSELRLLGKSSSPWVFRVRVALGLRGLSYEYIEEDLGNKSELLLRSNPVHKKVPVLIHGGRPVCESLVILQYVDEIWRGTGPPLLPSDPYDRATARFWAAYVDDKFFPAFSALFRSRTDEQRAEALQNALLVAETLERAFTECSRGKAFFGGDAVGLVDVTLGSHPIWIRAVDQTAGTNLLDGARFPDLAAWAERFMALGAVNEVVPDAGKLLEQYRASRAKWTAAADSS

SEQ ID NO: 12323 - protein, 357 aa, Populus trichocarpa
MSAFVGKYADELIKTAKYIATPGKGILAADESTGTIGKRLSSINVENIESNRQALRELLFTSGKALPYLSGVILFEETLYQKASDGKPFVEVLQENNIIPGIKVDKGVVELAGTNGETTTQGFDSLGARCQQYYKAGARFAKWRAVLKIGPTEPSELSIQQNAQGLARYAIICQENGLVPIVEPEILTDGSHDIKKCAAVTETVLAAVYKALNDQHVLLEGTLLKPNMVTPGSDSPKVTPEVIAEYTVTALRRTVPPAVPGIVFLSGGQSEEEATLNLNAMNKLEVLKPWTLSFSFGRALQKSTLKTWAGKKENVEKAQEVFLVRCKGNSEATLGKYTGGGAGGLASESLFEKGYKY

SEQ ID NO: 12324 - protein, 409 aa, Bartonella quintana
MTTEIRVPTLGESVTEATIGKWFKKLGEAVAVDEPLVELETDKVTVEVPSPVMGKLTEIIAKEGDIVEVNAVLGFVESGAAGISQSFSPSATSIPEAPSELEQSPSSSATPSGTMPPAPSAAKLMAENNIAKSDISGSGKRGQILKEDVLGALAQGTKASTSVATLTASSSSAAPIQEMREERVRMTKLRQTIARRLKDAQNTAAMLTTFNEVDMSAVMDLRKRYKDLFEKKHGVKLGFMGFFTKAVCHALKEFPTVNAEIDGTDIVYKNYVNAGIAVGTDKGLVVPVVRDADQMSLAEIEKEISRLGRLARDGKLAVSDMQGGTFTITNGGVYGSLMSTPILNAPQSGILGMHAIKERAMVVGGQIIICPMMYLALSYDHRIVDGQEAVTFLVRVKESLEDPERLVLD

SEQ ID NO: 12325 - protein, 309 aa, Clostridium tetani E88
MAKISILGSINMDIVLKVDRMAKVGETLLTRSLDKVAGGKGANQGVAAARLGSKVYMIGKLGKDDNGDILYRNIENDNINVEYILKDDKEPTGMAIVTVDKDGNNSIVVVSGANMSLKKEDIYQFKEAIKDSNILITQFETPIDVAEDAFKLAKSFGVTTILNPAPAKEITENLLKNTDIIIPNEMEAFEITKIKIKNENDIKKSAQVFLERGIKFVIITLGEKGAAIISKYKFEIIPAYKVNAIDTTAAGDSFIGALAHKLGEKELSFENIKEGVLYGNKVSSIVVQKEGAQSSIPYLSEVKEVFKEN

SEQ ID NO: 12326 - protein, 886 aa, Chlamydomonas reinhardtii
MLYQGWKKGPYNKLQDPLPVVTLMPSSTTTSFNAPPPAGPIEVAAPGAAVGPNQAHLAAVAQSRSMRAVGSKRASLVQVLDLRSYSMARSDAAGPVPGSESTRVKADFVSEDELIALPFKPPSVWRYVYDVAAGTWELVLYILVMLLAVMLETNARYFRSGSEYDKWWVTLYKFTVVCYPAGLMVAQFMLLCEYTLRKYMYFRLLSFGIMVQYEKRKLWRSWYFVFFCCLWIILNVWAWWGLIEWWGRNGKSGPEVLSFAVFAVVNVVSFHLIIYYQRLMDAELHVLEPLQAYLMPDMVLVSENAVKKEGWRLLRALIFGYCWPGPRRYDVDWVRAQGIRITRAAHGGSPGPAQTAEDLNSEAQAKAEKTMGDEEGAYPKGGSIGGVMHPPEAEVAPKPAGSMVRSDAAAAASVASAAVVEGVQAPEIRTAGPVAEAAEHVMSPQAVGVTADATEAAAAAEKGHASGLYALPMAMMATFSWHRVWPFRRDVSFIRGIFLAAFLASLMVAGGIVFGAWLVCDAGGYNITKAWVDPDYIDPNCTLGRSWFTNGMWDYNSTDSLAQRTNYAPIRGQPLLQGYLAGTMSYYAYVNGFEGLLKGFEGQYTQRFRELFTNYGFTEYDFIFIDDKAISDTQFIVAGTGRDIFLIFRGTDGITDTFITDLAGLCKSNQDFKATTTCIHDGFLSAYRTARDQVYAALIKVILGLKAARLPDGSSWYPKNTTLPQPFTMWLTGHSLGGALATLSALDLVVNQGLTIGGVYTFGSPRVGDDRFRIMYEQSGLANVTWRFVHRKDAIPQVPPKGVGNFQHVVPATMLEGGTCKAWPEEDCPSAGCGLSGADHLMPGYMANLRACLLAQAPQLPQLAASNCSIAMLPLWNGAFGNVKDP

SEQ ID NO: 12327 - protein, 431 aa, Arabidopsis thaliana
MGGSDENRHGVIGPMNRQQGGLRGGKVIPTNGQTRRALSNINKNIIGAPVYPCAVKRPFTEKNGICNKKIPPVPVHRPVTRKFAAQLAENNLQIHKEETKKPDLISNEALDRIITDVEEGDFNEPMFVQHTEAMLEEIDKMEGIEMQDSNDIDAEVEESVMDIDSCDKNNPLSVVEYINDIYCFYKKNECRSCVPPNYMENQHDINERMRGILFDWLIEVHYKFELMEETLYLTINLIDRFLAVHQHIARKKLQLVGVTAMLLACKYEEVSVPVVDDLILISDKAYTRTEILDMEKLMANTLQFNFCLPTPYVFMRRFLKAAQSDKKLELLSFFMIELCLVEYEMLQYTPSQLAASAIYTAQSTLKGYEDWSKTSEFHSGYTEEALLECSRKMVGLHHKAGTGKLTGVHRKYNTSKFGYAARIEPAGFLLL

SEQ ID NO: 12328 - protein, 463 aa, Solibacter usitatus Ellin6076
MIVMKFGGTSVESAAAIERVAGIVRAREARRPVVVVSAMGKTTNKLLAIASAAIAGKRNEYIPQLHDLRDYHSREARLVVPLSERAELDRFLDEHFQELTELVKGLAVLGELTPRSIDAISSYGERLSSYIVTLAFRHFGMAAEHIDSRDVIITDRRHTQAAPNFPETYARLQKTIPPLAAQSVVVMGGFIGSTEDGVTSTLGRGGSDFTAAIVGAGIQAEEIQIWTDVDGMLTADPTILAGGHRVKTISFAEAAELAYFGAKVLHPATVVPAIEKNIPVMILNSRRPEVPGTHITAHTVHCENAVKSIACKRKITTVSIHSTRMLMAHGFLHRIFEIFDRYQTPVDMVATSEVSVSLTIDNTTHIDLVLGELRQFAEATVEHDSVIVCLVGENIRHTPGVARRVFNSLDGINIRMISQGASLLNISFVIAETDLVNAVRLLHEEFFATLDPNVFERKEAVHA

SEQ ID NO: 12329 - protein, 335 aa, Streptococcus pneumoniae TIGR4
MVVKVGINGFGRIGRLAFRRIQNVEGVEVTRINDLTDPVMLAHLLKYDTTQGRFDGTVEVKEGGFEVNGKFIKVSAERDPEQIDWATDGVEIVLEATGFFAKKEAAEKHLKGGAKKVVITAPGGNDVKTVVFNTNHDVLDGTETVISGASCTTNCLAPMAKALQDNFGVVEGLMTTIHAYTGDQMILDGPHRGGDLRRARAGAANIVPNSTGAAKAIGLVIPELNGKLDGSAQRVPTPTGSVTELVAVLEKNVTVDEVNAAMKAASNESYGYTEDPIVSSDIVGMSYGSLFDATQTKVLDVDGKQLVKVVSWYDNEMSYTAQLVRTLEYFAKIAK

SEQ ID NO: 12330 - protein, 69 aa, Cryptococcus neoformans var. neoformans JEC21
MIIPVRCFSCGKVIGNLWDSYLELLAAGVDEGEAMDKLQLKRYCCRRMVLTHVDLIEKLLMYNPLARDR

SEQ ID NO: 12331 - protein, 439 aa, Clostridium tetani E88
MNNIIVTKFGGSSLADVNQFKKVKNIVLGDQRRKYVVPSAPGKRHKEDQKITDLLYLCHANVEQNVEIDYIFTIIEKRFKDLAKELGVNIDIDTELENIKKNIKNGATADYTASRGEYLNGLILSNYLGYEFVDPAEIIFFRRNGVFDSDKTQEAVSKRLCNIQKAVIPGFYGSLPNGDIKTFSRGGSDVTGAIIARGVAADLYENWTDVSGFLMVDPNIVENPKNIEKITYRELRELAYMGATVLHEEAVFPVRSAGIPINIKNTNRPEDKGTLIIDDLKPASYAGSITGIAGKKDFVVIAIEKNMMNIEQGYCRKVLSVLEENYVSFEHMPSGVDAVSLVISKNQLNGKLDGILEEIEMKCKPDSIEVYPNMALVAIVGRGMLRTVGMSAKIFDALAREKVNIRMIIQGSSEINIIVGVENEDFEKALKSIYDEFAK

SEQ ID NO: 12332 - protein, 314 aa, Solibacter usitatus Ellin6076
MRRQPRIVVIGSANIDLVTYTDQFPRPGETIFGREFSLGFGGKGANQAVAARLCGAEVAMVARVGDDLFGPANIQNFTSRGIDVRHVMTTAGVSSGVAPIFVESSGQNRIWVVKGANDRLLPADVAAASDVLAGADFLVMQLEIPTETVYYALRFARERGIRTILNPAPGQALDLAQIASADYVIPNETEAEALAGTPVHALEDAQRCAQKLLDGGLRRVIVTLGANGALLATHDGMHHVAPFPVQPIDTTGAGDAFIGSFACFCAEGFDELAAIARANLYAALSTLGPGTQKSFVSRERFNTEWAARSVSVTP

SEQ ID NO: 12333 - protein, 325 aa, Glycine max
MAVEKLSIAKDVTELIGKTPLVYLNRIVDGCVAKVAAKLEMMEPCSSVKDRIGYSMIVDAEEKGFITPGESVLIEPTSGNTGIGLAFMAAAKGYKLIITMPSSMSLERRTILRAFGAELVLTDPAKGMKGAVQKAEEIRDKTPNSYILQQFENPANPKIHYETTGPEIWKGSSGKVDALVSGIGTGGTITGAGKYLKDQNPDIKLYGIEPVESPILSGGKPGPHKIQGIGAGFIPGVLDVDLLDEVVQISSEEAIETAKLLALKEGLLVGISSGAAAAAAIKIAKRPENAGKLIIAVFPSFGERYLSSVLFESVRREAESMVFEP

SEQ ID NO: 12334 - protein, 96 aa, Salmonella enterica
KITDAYAENADIANLLLAPYFKKIADEYQQALRDVVAYAVQNGIPVPTFSAAVAYYDSYRAAVLPANLIQAQRDYFGAHTYKRTDKEGIFHTEWLE

SEQ ID NO: 12335 - protein, 503 aa, Burkholderia thailandensis E264
MSVSWPRSARLFGFLACINAQVNIDIAIFKRLFVDSTMRNIFIHPRIATPTDMNALTEPTTPDTTVRTDAEWLDAHWMPFTANRQFKRDPRIIVEGKGAYYTAADGRKIFDGLSGLWCCGLGHGRAEISEAVARQIARLDYSPAFQFGHPQSFELANRIKAMTPAGLDYVFFTGSGSEAADTSLKMARAYWRAKGKGTKTRLIGREKGYHGVNFGGISVGGIGPNRKLFGQGIDADFLPHTQLPENRFSRGLPEHGAELADRLLDLIALHDASNIAAVIVEPFSGSAGVVVPPKGYLQRLREICTAHDILLIFDEVITGFGRTGAMTGADAFGVVPDLMNVAKQVTNGAQPLGAVIASKDIYDAFMAAGGPDYMLEFPHGYTYSAHPVACAAGVAALDLLVAEDALGRVRELAPHFEAAVHGLKGVRHVADIRNCGLAAGLTIEHAPGEPARRPYEIAMHCWRNGFYVRYGGDTIQLAPPFVAEKHEIDSLIGALNDALLATD

SEQ ID NO: 12336 - protein, 252 aa, Bdellovibrio bacteriovorus HD100
MIVKTEADLEGLKKIGKIVANCLQYMARKMEPGMSTKELDQLGGTYLELHGAKSGPMATYNFPGYNCISLNHEVAHGVPSDKKIIKAGDLINIDVSAEFGGYFADNGGSFIVPPGKKSDEELLKVTRLALDTAIKAVKAGELINVIGYNIEKVAKSHGYTVIENLGSHGVGRGLHEEPKFIAGYYDKTDKRKLKDGHVITIEPFVSTGARFVDEEPDNWTLVAGKEHRTAQFEHTMVVLKDRALIVTIPDSV

SEQ ID NO: 12337 - protein, 287 aa, Glycine max
INLLTQKCSVRKGARILTSLQQDLLKPSLACVSLLSFPLVGLLSQSLVIPVISTTVADQKNYYTPDPHAGSPPTGSHNSSPPSHGHGSSPPSHHNSPSTPSTPSGGNCGSSPPQHHDPTPSTPSTPSNPPSGGYYGGSPPTPVTVSPPSTPVDPGTPSIPSPPLIPSPSPFTGTCNYWRNHPAIIWGILGWWGTLGSAFGVTGTTVPGFSPGLSLPQALSNTRTDGLGALYREGTASFLNSMVNNKFPYTTNQVRDRFVASLNSNKAAEAQAQLFKMANEGRMKPRP

SEQ ID NO: 12338 - protein, 303 aa, Candida parapsilosis
MATDSNFLIDFLMGGVSAAVAKTAAAPIERVKLLIQNQDEMLKQGRLSHKYTGIIDCFRRTAADEGIVSFWRGNTANVIRYFPTQALNFAFKDQIKALFGFKKDEGYWKWFAGNLASGGIAGALSLAFVYSLDYARTRLANDAKSAKGDGKGREFNGLIDVYKKTLASDGIAGLYRGFGPSVIGIVVYRGLYFGLYDSLKPVVLVGPLEGSFLASFLLGWVVTTGASTASYPLDTIRRRMMMTSGQAVKYDGALDCARKVVAAEGVKSLFKGCGANILRGVAGAGVISLYDQLQVLLFGKKFK

SEQ ID NO: 12339 - protein, 394 aa, Bacteroides fragilis NCTC 9343
MQKENQTYKVAPADRLAGVSEYYFSKKLKEVARMNAEGKDVISLGIGSPDMPPSEQTIETLCNNAHDPNGHGYQPYVGIPELRKGFADWYKRWYGVELNPATEIQPLIGSKEGILHVTLAFVNPGEQVLVPNPGYPTYTSLSKILGAEVVNYNLKEEDGWMPDFDELEKMDLSRVKLMWTNYPNMPTGANATPELYKRLVEFARRKNIVIVNDNPYSFILNDKPISILSVPGAKECCIEFNSMSKSHNMPGWRIGMLASNAEFVQWILKVKSNIDSGMFRAMQLAAAKALEADSTWYEGNNVNYRNRRHLAGEIMKTLGCTYDEKQVGMFLWGKIPASCADVEELTEKVLQEARVFITPGFIFGSNGARYIRISLCCKDAKLAEALERIKSIMK

SEQ ID NO: 12340 - protein, 141 aa, Haloarcula hispanica
ERTFVMVKPDGVQRGLIGDIVSRFEDRGLKMVGGKFMQIDQELAEEHYGEHEDKPFFDGLVDFITSGPVFAMVWEGQDATRQVRTMMGETDPAESAPGTIRGDYGLDLGRNVIHGSDHEDEGANEREIELFFDDAELVDWD

SEQ ID NO: 12341 - protein, 243 aa, Physcomitrella patens subsp. patens
MPAIEATHRVDKFSKNDIIVSPSILSANFAKLGEQIKAVENAGCDWIHVDVMDGRFVPNITIGPLVVDAIRPVTDLPLDVHLMIVEPEQRVPDFIKAGADIVSVHCENASTIHLHRTINQIKSLGAKAGVVLNPGTSLSQIEYVLDCVDLILIMSVNPGFGGQSFIETQVKKIADLRKLCAEKGVNPWIEVDGGVTPKNAYKVIEAGANALVAGSAVFGAKDYAEAISGIKASKRPQEAPVAA

SEQ ID NO: 12342 - protein, 141 aa, Haloarcula sinaiiensis
ERTFVMVKPDGVQRGLIGDIVSRFEDCGLKMVGGKFMQIDQELAEEHYGEHEDKPFFDGLVDFITSGPVFAMVWEGQDATRQVRTMMGETDPAESAPGTIRGDYGLDLGRNVIHGSDHEDEGANEREIELFFDDAELVDWD

SEQ ID NO: 12343 - protein, 265 aa, Burkholderia vietnamiensis G4
MTLDTSAQHARYARYPSLADRAVLITGGATGIGASFVEHFARQGARVAFVDLDAQAGAALAERLVGEPEVRHAPLFVACDLTDIDALRGTIDAIRARLGAIDVLVNNAANDARHAIADVTPASFDAGIAVNLRHQFFAAQAVIDDMKRQGGGAIINLGSISWMLKNGGYPVYVMAKAAVQGLTRGLARDLGPFGIRVNSLVPGWVMTDKQRRLWLDDAGRAAIKAGQCIDAELLPDDLARMALFLAADDSRMITAQDVVVDGGWA

SEQ ID NO: 12344 - protein, 451 aa, Bacillus sp. SG-1
MHIITVGINYKTAPVEIRERLSFNEADLQRAMETLKGKKSILENVIVSTCNRTEVYAVVDQLHTGRYYIKEFLSQWFDIDKEEFTPYLFIYEQDGAVEHLFNVTCGLNSMVVGETQILGQIRSSFLSAQESGTTGTVFNHLFKQAITLAKKAHSETEIGSNAVSVSYAAVELAKKIFGDLSGKHVLIFGAGKMGELAIKNLHGSGATKVTVINRTFEKAVSLADKFKGNAKTLQELQCALVEADILISSTGAKEYVITKDQMVEVERMRKGRPLFMVDIAVPRDIDPAIESLESAFLYDIDDLEGIVQSNMAERQKAAESIGIMIEAEIVAFKEWLNMLGVVPVISALREKALVIQGQTMESIERKMPDLTERERKVLNKHTKSIINQLLKDPILQVKELAALPDGQEKLDLFIKIFNIEEQLQTEAEALESKGKEKTGVAAAKLQPSFQQ

SEQ ID NO: 12345 - protein, 780 aa, Burkholderia vietnamiensis G4
MPWNSHSNPPATRHMSTQASSKAKLREAALDYHEFPTPGKIAIAPTKQMINQRDLALAYSPGVAFACEEIVENPLNAARFTARSNLVGVVTNGTAVLGLGNIGPLASKPVMEGKAVLFKKFAGIDVFDIELNESDPHKLVDVIAALEPTFGGINLEDIKAPDCFIVEREARKRMKIPVFHDDQHGTAIVVAAAVTNGLKVVGKDIKKVKLVASGAGAAALACLDLLVDIGLPLENITVTDLAGVVYKGRAELMDPDKERFARETDARTLAEVMEGADIFLGLSAGGVLKQEMVKGMAERPMILALANPTPEILPELALEVRPDAVLATGRTDYPNQVNNVLCFPFIFRGALDVGATTITREMEIAAVNAIAELAQHEQSDIVATAYGIQDLSFGPEYLIPKPFDPRLIVKIAPAVAQAAMDGGVATRPIEDMDAYKQHLQQFVYHSGTTMKPIFQIARAAPGEKKRVVFAEGEEERVLRAVQIIVDEKLAKPILIGRPSVIEHRIQRYGLRLTPGADFTVVNTEHDERYRDFWQTYYKMMARKGISEQLARVEMRRRTTLIGSMLVKKGEADGMICGTISTTHRHLHFIDQVIGKRPGCSVYAAMNGLVLPGRQIFLVDTHVNVDPTPEELAEITIMAAEEVRRFGIEPKVALLSHSNFGTSNAPSAQKMRDTLAILQERAPELKVDGEMHGDVALDAALRKEILPESTLEGDANLLILPNIDSANIAYNLLKTAAGNNIAIGPILLGAAQPVHVLTESATVRRIVNMAALLVADVNASR

SEQ ID NO: 12346 - protein, 240 aa, Vibrio campbellii
GNLIVNGKTVRVTAERNPEDLKWDAIDVDVVAEATGLFLTDETARKHITAGAKKVVLTGPSKDATPMFVMGVNHATYAGQDIVSNASCTTNCLAPIAKVLNDKFGIESGLMTTVHATTATQKTVDGPSAKDWRGGRGASQNIIPSSTGAAKAVGVVLPELNGKLTGMAFRVPTANVSVVDLTVNLKEGASYEAICAAMKEASEGELAGVLGYTEDQVVSQDFIGEVQTSVFDAKAGIALT

SEQ ID NO: 12347 - protein, 165 aa, Desulfovibrio vulgaris str. 'Miyazaki F'
MSTIVSVWAREILDSRGNPTVEVEVSLESGHTGGAAVPSGASTGSREALEMRDGDKGRYKGKGVEKAVDNVMGEIAEAIVGLNSLRQVQVDNTLLDLDGTDNKSRLGANAMLAVSLAHRAAASSFLGLPLYQYLGGVNAKVLPVPLMNIINGGAHAPNNLDIQEF

SEQ ID NO: 12348 - protein, 182 aa, Brassica napus
  misc_feature (57)..(57): Xaa can be any naturally occurring amino acid
MAYSMLSSAAVVTSPAQATMVAPFTGLKSSSAFPVTRKANNDITSIVSNGGRVSCMXKVWPPVGKKKFETLSYLPDLTEVELGKEVDYLLRNKWIPCVEFELEHGFVYREHGSTPGYYDGRYWTMWKLPLFGCTDSAQVLKEVQECKTEYPNAFIRIIGFDNNRQVQCISFIAYKPPSFTGA

SEQ ID NO: 12349 - protein, 133 aa, Anaplasma marginale str. St. Maries
MSYSDAVLDRCKNPQNVGSLPKDDLNVGTGLVGAPSCGDVMKLQIKVDENGTIVDAKFKTFGCGAAIAASSLATERIKGKTIEEACMLKNTVLAKELSLPPVKIHCSLLAEDAVKAAVHDYKSKQQIAKGDKC

SEQ ID NO: 12350 - protein, 229 aa, Robinia pseudoacacia
AHRAHASTEGVAKYVRPAVAGFLMQKELDYLVGAVSNPKKPFAAIVGGSKVSTKIGVIESLLAKVDILLLGGGMIFTFYKAQGHSVGSSLVEEDKLDLANSLMEKAKAKGVSLLLPTDVVIADKFAADANSKVVPASSIPDGWMGLDIGPDAIKTFSETLDKTQSIIWNGPMGVFEFDKFAAGTEAIAKKLAELSGKGVTTIIGGGDSVAAVEKVGLADKMSHISTGGG

SEQ ID NO: 12351 - protein, 656 aa, Rhodococcus sp. RHA1
MGPVTGIGTAIRASLAAALCVGMLAACASDEEPQSDPAATCADVPNGTPIAKAPPPPGPAPTTQNLATNPEIATVYRSGMVPVNTASYAVSTANPVSTQAACEVLRDGGTAADALIVAQTVLGLVEPQSSGIGGGAFLLYYDAGQKSVEAYDGREVAPMAATENYLRWISDTDRTEPKPDARASGRSIGVPGVVRMLELAHREHGRDEWRELFDPAISLADQGLEISPRMAGQIAESAPDLALDEPSKAYFLNPDGSPKPAGTKLTNPAMAKTLGAIAAGGADAFYTGAIAQGIVDATATASGGRTPGQMTLDDLANYQAKKRTALCTPYRDHEICGMPNPSSGGTAVAATLGILENFDLSEYGPTNLDDNGGKPTAEAVHLISEAERLAYADRDKYVADSDFVPLPGNSLDTLLNEDYLKQRADLIDPGKSMGTAQPGNFGPVPLGVQPQDKEHGTSHISIADQYGNVASMTTTVESAFGSFHMTDGFVLNNQLTDFSAQPVGPDGTPLANRVEPGKRPRSSMAPTLVFDRSSDGSLGDVQYVTGSPGGSVIIQFVVKTLVGMLDWGLNPQQAVSAVDFGAANTPVTGVGGEHPNINAVNDGADDPLIVQLRAMGHQVSVAPQSSGLSALQRQDSGWVGGADPRREGAVMGDGTG

SEQ ID NO: 12352 - protein, 560 aa, Physcomitrella patens subsp. patens
MLAVQAEAAVVSYDWNVDYMNAAPDCVQKLVLAVNGQFPSPTIRAVEGDTVVVQVTNHIPTEGVSFHWHGIHQRGTPYYDGAAYVSQCPINPGETFTYRFKVDKAGTYFYHGHFGLQRSGGIYGSLIVDLPAGKKEPFSYDAELSIILNDWWHKSVYEQELGLNSVPFKFVGEPQSLLIEGRGRYNCSLLPQNATTAPPGCLVCNSTDPRCAPHVLPVTPGKTYRLRIASVASLSSLNFILEGHKMTVVQADARNVQPFVVDNLDVYSGQSYDVLFTANQDASKNYWASINVRGRKPATPTGLAILQYLPNPANLLPTTAAPVSPVWNDTATSVALAKKIYANVDCEASPPKKSHRTVVILGTQNNIEGRIKWALNNISYVHNPTPVLAALKYKIRGVIDAAPPPNSPVKNYDVYSPPSAAFRNASYGSPVYIFKKDIVVDVIVQNANTLSTPNNSEIHPWHLHGHDFWVMGYGDGLFDLKKDVASFNLVDPPLRNTVAVFPNGWVAIRFVADNPGVWPFHCHVEPHFYMGMGTVFAEGIHKLPSLPKETLGCGLTKRRL

SEQ ID NO: 12353 - protein, 650 aa, Bdellovibrio bacteriovorus HD100
MSKVTVIKINQMPAVFFVIGLRLKDRSRLVTGFLPGSKPLGTFVSMILHEQLLQILAFLGFSVVLVSLFQKLGLGTILGYLAAGILIGPLGWGLISDFHFVQTIAEFGVVFLLFIIGLELQPKKLWGLRKTLLGFGGLQILVCTVVFTLAGHQLGISWASAAVVGFALSLSSTAFALQSLSERKVLNTEFGRASFAILLMQDVVAIPALAVIPSLGLVTASTREVNWGGALAIFIGLALGSRLLMGRFLQVVAETRSRELFTGVTLLTVIGVAFLMESVGLSMALGAFLAGVLLSESEYRHELEADLEPFKGLLMGLFFVSVGMSVKLSLLVENPGLILGITVGYMVLKGFLIYGVGRVMKLHRPASNNLAVYLVQGGEFAFVIFGVGQSAQVLSPEWTQRFTLVVTLSMIASPIIIVLNEKIQAMIACKRPGAGPQYDQIDEADNGNAVIIAGFGRVGQIFGRILRTQDVKFTAIEHDTEQIDLLRRFGNKVYYGDASRPEILEAAGIKNAKYFVLAVDDVETSNNIARILHEDYPHVKVFARSRNRQHTFDLMAAGVTQVRRETIDSSIALSEQLLVEMGTPAKRAHEIIERFRLHDELMLQEQFKVRHDQKTFIDVSRQAAQQLAQVLKEDAEKTYIDPQHPPEASK

SEQ ID NO: 12354 - protein, 117 aa, Oryza sativa
  misc_feature (18)..(18): Xaa can be any naturally occurring amino acid
  misc_feature (64)..(64): Xaa can be any naturally occurring amino acid
MPANGDGPAKRSAAAAAXSLRRRRTTGGGGGAARGGTSTMPQFYTEQAAGCRMPPSAGLIMSIXGLFAGVARLRVFGLLYRTSSDYRDHAIIPAWQGQSSDALLRRGPSPAYRVAIR

SEQ ID NO: 12355 - protein, 436 aa, Archaeoglobus fulgidus DSM 4304
MAIEVELHKLREWMWKYSLGRDGGNNSDHFLRIKIPGGIISPDRLRGVAELSDKYGRGYAEITTRQDIQLHWIEAEDALEIFAEMEKLGFTTDLCSQAFAETCHGDVRNAVCCPLSGKKGYDAYWLVREITDFFSGNPDYVSLPHKFKIGISTCESNCIREEAQDLAMQWNGEGFVPLVGGGLGASKPGVRKAKSLRIVVYEEDAFDFIRTVIDIYKDFRAERKAEARFKNFFETAGCEWLRREIELRMGVKFDLADDFNCNPPSEHTEGLQDDGSNYYTLPVFAGILDSERLSFIAEVAEEFDGGIRLTPWQNVVFTDIDDLKALKERLSEQFDLSAPRMHIACASNFCGKTLVHAKDVLRHIPASDRFVGVSGCSNACACHPLAEIGLCGKVKAGKQLYDVFIHGWKEAENLSVEEAVELIKKHLGDGYGAKAD

SEQ ID NO: 12356 - protein, 520 aa, Oryza sativa Japonica Group
MGNFVWMVAAAAAAVASWAFIAVVVKLVWRPRAISRRLRAQAVGGPGYRFFSGNLGEIRRLRAEGAGVVLDVSSHDFVPIVQPHFRKWVSLYGKTFLFWFGAQPNICLADINIVRQVLSDRTGMYPKDLTNPYFAHLLGKGLVLIDGDEWKRHYKVVHPAFDMDKLKMMTVTISDCTGSMMSEWESELGMKGGSAEIELSQRFQELTADVISRTAFGSSYSEGKQVFLAQRKLQFLAFSMFLTIQIPGFRYLPTKKNLKIWSLDKKVRSMLRNIIKIRLANKDTMGYGNDLLGLMLETCAPEHDESQQLSMDEIIAECKTFFFGGHDTTSHLLTWTMFLLSTHPEWMRKIRKEVTTMCGDEVPTGDMLNKMNLLNMFLLETLRLYSPVSLISRRTGTNAKFGGIKVPEGTILRIPIATIHRDKEVWGEDADEFKPARFENGVSKAAKHPNALLSFSNGPRSCIGQNFAMIEAKAVITMILQRFSFTLSPKYVHTPISVITLRPKYGLPMILRSLKVKRDL

SEQ ID NO: 12357 - protein, 141 aa, Halobacterium salinarum
ERTFVMVKPDGVQRGLIGDIVTRLETKGLKMVGGKFMRIDEELAHEHYAEHEDKPFFDGLVSFITSGPVFAMVWEGADATRQVRQLMGATDAQDAAPGTIRGDYGNDLGHNLIHGSDHEDEGANEREIALFFDDAELVDWD

SEQ ID NO: 12358 - protein, 445 aa, Nocardioides sp. JS614
MPTNTRTSAQARAARTRPLARLVGADQQVPLVTGGPVRYANLDIAASAPALQSVADRVAEFLPFYSSVHRGAGYASAVSTAAYETARRTIGAFVGARGDDVVQVVRNTTDALNLLATAVPGDVVHLDVEHHANLLPWQGLGRRARAVTARETVAATLAAVEAELHRAPAALLAVTGASNVTGEILPLADLVGIAHRAGARIAVDGAQLVPHHRVHLERLGVDYLAFSGHKLYAPYGAGVLVGRRDWLDAAPPYLAGGGAVRSVSLEHTSWADAPARHEAGTPNVVGAVALAAACEAIAALPDSELRIHEEGLRDRLLNALEFLEVPTLHLWRGQVEAIGVVTFTVAGYDAELVAQYLSAEHGVGVRDGRFCAHPLLERLNGGRTAVRASLGLGSTTEDVDRLVIGIARLVAQGPAWTYDAQGRPAPDPRPLPPWVTEAGPGAACA

SEQ ID NO: 12359 - protein, 421 aa, Chlamydomonas reinhardtii
MSSRVGSSFGVLPSAINYSQEQLLSHLSKSSASQQHQDVSKGVSSNGRAMLGDLTNNGQQRPVAGERKALSALNAGQASFGFPQPVKAQQQPSFHQPSIPLAAFSDPRIIDGASVRSSGDLRKKAWIDVDSLNHEDPQAVSHYAGAIFEYLREAELMRRAIPDYLDSQPEINSKMRSILVDWLVEVSEEYRMVPDTLYYAVNFLDRVLTLQRVSRSQLQLVGITCMWIAAKYEEIYPPNVSEFSYITDNTYSREQLVAMEEEVLRQLKYELTVPTAKTFLRRLLQVCSPDDQLHFVSNYLTEISLMEATMLHFLPSEIAAAAVYLGNLILARAPWSPTLEHYSYYTPAQIAECVEALATLHIQVNSRAQGGELTALYDKYSHSKFLSVSRVSPLPLPVVNQHLSMIMGGSSASGASGIHRS

SEQ ID NO: 12360 - protein, 501 aa, Oryza sativa Japonica Group
MGFEWTVATAAAAVAASWAFIAVVVKLPRAITRRLGAQGVAGPGYRFFSGNLSEIRRLRAEGANLVLDVSSHDFVPIVQPHIRKWIPLYDMNMVRQVLSDRTGMFPKYIDNMQFARLLGKGLVLTDDDEWKRHYKVVHPAFDMDKLKMMTETISDYAQSMMFEWESELGMKGGSTEIELSRWFEELTADVISRTAFGSSYREGKQVFLAQRKLQFLAFSVFLTIQIPGFSYLLTKKNLKTWSLDKKVRSMLMNIIKSRLTNKETMGYGNDLLGLMLEACVPEHGGSQPQLSMDDIIAECKTFFFAGHDTTSQLLTWTMFLLSTHQHWMEKLRKEVRMVCNDEVPTGDMLNKLKLVNMFLLETLRLYGPVSLVTRRAGTDVKLGSIKVPKGTILTIPIATIHRDKEVWGEDADEFKPERSENGVLNAAKHPSALLSFSIGLRSCIGQNFAMIEARTIIAMILQRFSFTLSPKYVHTPISVITLRPKYGLPMILRSLKVKRDR

SEQ ID NO: 12361 - protein, 307 aa, Oryza sativa
  misc_feature (120)..(120): Xaa can be any naturally occurring amino acid
  misc_feature (216)..(216): Xaa can be any naturally occurring amino acid
  misc_feature (269)..(269): Xaa can be any naturally occurring amino acid
  misc_feature (275)..(275): Xaa can be any naturally occurring amino acid
  misc_feature (287)..(287): Xaa can be any naturally occurring amino acid
MFGLSKVQRYCFGVRIYSNFYNGEFVPSKATKFYDHRNPVTQELVGQAPQSSQEEFNAIVASAKEAFKTWSRVPLLTRQRYMFDLAALVRRDQHILADLITEEHGKTTPDARGDVQRGLXVIEHACGISHIIQGETMQNISKGIDTYSFRVPLGVCAGVAPFNFPAMIPFWMFPFAITCGNTFVLKPSERVAGASDHIAKLVKEIGLPKGVFNVVXGGFDTTKQICEHPDIKAISFVGGNQAGEYIYNEGAKRGKRMQCNMGAKNHGIXMPDADXEDAPNALVNAAXFGALGQRMMGFSTAVFGGKN

SEQ ID NO: 12362 - protein, 141 aa, Halorubrum saccharovorum
ERTFVMVKPDGVQRGLIGEIVSRFEERGLKLVGGKFMQIDEDLAHEHYGEHEGKPFFDGLVDFITSGPVFAMVWEGADATRQVRAMVGETDPAESAPGTIRGDFGLDLGHNVIHASDHEDEGANEREIDLFFDDAELVDWD

SEQ ID NO: 12363 - protein, 141 aa, Natrialba asiatica
ERTFVMVKPDAFARGLVGEVISRLEDRGLKLVGIKVENMPRGRAEEHYSEHEDKPFYDDLVDFITGGPVVPMVWEGQDATRQVRQMIGETDPLEAAPGTIRGDYALDLGRNVVHAADHEDEGANEREISIHFDDAELVDWD

SEQ ID NO: 12364 - protein, 118 aa, Brassica napus
IASKLPRLRGVVLHSGILSGLRVLCHVKFKFCCDIYSNINKIKKVKCPVLVIHGTEDDVVNWLHGNRLWKMAKEPYEPLWIKGGGHCNLEIYPEYIRHLYRFIQDMENTTTKSRLKKD

SEQ ID NO: 12365 - protein, 324 aa, Arabidopsis thaliana
MESIFSDLQRLVHQKSKSNSSAEQSQTRAGYEKPKIPTQTEAEFQVEESVHSSIDRVQKTESTVPEVATSQPSIAYRLHKRKQSTAAQVDKRQKKGKGKGVAASSTFEETRFVSREAEKRYAYFSHKNIIVEEGLSRKTDDKVREFIYDAGLIRTVTELKPFEEELVFEFWANLPTVKVDSTSVSVMQQMDMAGLLEDEVAQFLTDGKVKLLKRLLLSAFSLPGRELFKLCCTNWSPTSNNSYAQPDRAKLVYMIMHKMPFNFVRLAFDHILQLALKPETKFFLPFPNLVYQLTQIQHPVKITVNPPAPKASTIKKKVKKNSAA

SEQ ID NO: 12366 - protein, 528 aa, Magnaporthe grisea 70-15
MAARGAQSVTESATDLIGNTPLVRLNKIPQSLGIKAQVFGKLELMNTGGSVKDRIALRMIEEAEKEGRIKPGDTLIEPTSGNTGIGLALVGAVKGYKTIITLPEKMSAEKVSVLKALGATIIRTPTQAAWDAPESHIGVAKRLLKEIPNSHILDQYSNPNNPLAHEHGTAEEIWAQTGGKITAVVAGAGTGGTISGLARGLRKHSKTVKVIAADPIGSILALPESLNDNGVNEPYKVEGIGYDFIPDVLDRELVDKWYKTEDRESFMYARRLIAEEGLLVGGSSGSAMAAMVRAVKDLNLGEDDVVVVVLPDSIRSYLSKFADDDWLAANDLLLPTPDSSVNGDTLDSPAVAEAQALHKSRARRASNPYGGATVRSLRLKPVTSVLADSKCSEAIETMRDKGFDQLPVVRDNKLVGLVTLGNMLSYVSRGRVKTNSPVSDVMFDFGRLDEVITDPRDVEGAAKMSTAHGRKKRNFVEITMNTPLDVLSKFLEWNSAAIVTEKSGEVSKPVAVVTKVDLLTWMMKELKA

SEQ ID NO: 12367 - protein, 532 aa, Oryza sativa Japonica Group
MGYGWALAAVLATWCLLDALSRLVWRPRAVAAALRRQGVRGPGYRLLVGSLGDINKLRADAAGAGGAAALDVASHDFIPFVQPQFRQWIPLYGRVFLYWFGWTPDMCVADVEVAKQVLSDRTGLFPKNVTTPMLLKLFGRGLVLANGDEWQRHKKVVHPAFNTDKLKMMTATMAGVARSMVSRWEEKVASHGGKVVIELSSQFEELTADVISHTAFGSSYAEGKQVFMAIKELQFIAFSSLLSVQIPGSRYFPTKKNLKVWRLDRKVRSTLMQIISNRLAAAAKEKAGGGGGGYGEDLLGLMLEASAPPELGTKRRQPPVLSMDEIIDECKTFFFAGQETTSHLLSWTMFLLSTHPDWQDKLREEAVRECAGAGAGDDDDQLPTYDMLGKLKLLNQFLLETLRLYSPVPAIRRRTAAAVEMGGVTVPGGTMLTFPIATMHRDEEVWGADAGVFDPMRFDGGGGAMAKLLSFSTGPRACVGQSFAMVEAKAVVAAILRRFRLELSPEYVHAPTDVITLRPKHGLPMVVTRVHA

SEQ ID NO: 12368 - protein, 336 aa, Burkholderia vietnamiensis G4
MTIRVAINGYGRIGRNTLRAFYENGKKHDLEIVAINDLGDAKTNAHLTQYDTAHGKFPGEVSVDGDYLVVNGDKIRVLANRNPAELPWGELGVDVVMECTGFFTSKEKASAHLKGGAKKVIISAPGGKDVDATIVYGVNHNVLKAEHTVISNASCTTNCLAPLVKPLNDQIGLETGLMTTIHAYTNDQVLTDVYHEDLRRARSATHSQIPTKTGAASAVGLVLPELNGKLDGYAIRVPTINVSIVDLSFIAKRDTTVEEVNAIMKEASEGALKGILGYNDAPLVSIDFNHNPASSTFDATLTKVSGRLVKVSSWYDNEWGFSNRMLDTAVAFANAK

SEQ ID NO: 12369 - protein, 408 aa, Anaplasma marginale str. St. Maries
MTGSKGVQPPVFFDYQATTRVDDRVLEVMFPYFRQFSNPHSRSHSFGWRAESAVEVAREQIAESIGADPKEVIFTSGATESNNLAIKGLARFYKNKGNHIITLKTEHKCVLDSCRHLETEGFEVTYLDVRGDGILEVDKLEAAIRDDTILVSVMTVNNEIGVIQPIGEIGKICRNKGVFFHTDAAQALGKVAIDVNSMNVDLLSISGHKIYGPMGVGALYVRRRNPRVRLVPLLSGGGQERGMRSGTVPTPLVVGLGEAAKIAVQEMETENERIRGLRDVLYNKIKGELPNVVLNGSYSQRIPGNLNLSFSYVEGESVIMAINDLAVSSGSACTSASLEPSYVLRALNVEQDLEHSSIRFGIGRFTTLAEVEYAADLVIRSVRKLREMSPLWEMVQEGTDLKTINWDA

SEQ ID NO: 12370 - protein, 158 aa, Clostridium tetani E88
MINSLTNRRKLVKVSGKPGKTRLINFFLINNDFYFVDLPGYGYARVSKEEKKNWGKTIETYLTDREQLKKIILLVDSRHKPTNDDVLMCNWIKYYGYDISVVATKSDKLKRSELKKNEKIIRDTLDLSEEIKIIFHSTLNKSGREELLEDIFKTCNID

SEQ ID NO: 12371 - protein, 202 aa, Clostridium tetani E88
MNYKEEKFMSLVPVVVEQTNRGERSYDIYSRLLKDRIIMLSDQVNDVTASLIVAQLLFLEAEDPDKDIFLYINSPGGSITSGMAIYDTMQYIKPDVSTICIGMAASMGAFLLAAGAKGKRFALPNSEIMIHQPLGGFQGQATDIGIHADRILKIKQNLNSILSEKTGQPLEVIQRDTERDNFMDANQAKDYGLIDEVMVKKK

SEQ ID NO: 12372 - protein, 506 aa, Legionella pneumophila str. Paris
MDLLQRLNIKSVNPGAFSGHGWHSDNHAHTLESFNPSTGNKLAEIATCTMDDYEQVMQRAEHAAQAWRKVPAPKRGEIIRQIGQALRENKDSLGSLVSLEMGKSKQEGDGEVQEMIDIADFAVGQSRMLYGNSMHSERPNHRMYEQWHPYGIVGVISAFNFPVAVWSWNAFLSAICGNVTIWKPSAKTPLCAVAVQHICNQVLKENNCPEIFGLIIPNSHDVVEAMVDDKRIQLISFTGSTAVGKQVAAKVAARLGKSILELGGNNGIILDESADLNLAIPAIVFGAVGTAGQRCTTTRRLFVHESKYQDVIKRLRHAYEQITIGDPLDTRNLMGPLIDQQAVEQFKKAINRIKAAGGQIVYGGEILKQAGSFVQPTLVCDVKNDWDIVQEETFAPILYVMSYRTLDEAIALHNGVPQGLSSALFTQNLKNAELFLSACGSDCGIANINIGTSGAEIGGAFGGEKETGGGRESGSDSWKAYMRRQTNTINWGDELPLAQGIRFNLS

SEQ ID NO: 12373 - protein, 486 aa, Anaplasma marginale str. St. Maries
MKGKVAQKRAAASPSGVGEVIRVMPAVVDVEFPHGGVPEVLGALESELEYAGEKLVLEVAQHLGDRMVRCVAMGSTDSLSRGDKFISTGNQMMAPVGRGTLGRVFDVLGRPIDGLGSVSSDVEFRPIHAKAPSLSEQRVAAEVLVTGIKVVDLLAPYLKGGKVGLFGGAGVGKTVLIMELISNVARAHKGFSVFAGVGERTREGNDLYREMVESGVISRDEPSKSQAVLVYGQMNEPPGARMRVALTALTMAEYFRDSEGQDVLFFVDNVFRFTQSGSEVSALLGRIPSAVGYQPTLAAEMGAMQERITSTNTGSITSVQAIYVPADDLTDPAPAASFAHLDSTTVLSRQISELGIYPAVDPLESTSQALSPEVVGSEHYEVAQEVKRILQTYKSLQDIIAILGMDELSQEDKLLVARARKIQRFLSQPFHVAEVFTGHPGSFVSLEDTVRSFKGLVEGQYDDLPEAAFYMVGGIDDAVKKAASLK

SEQ ID NO: 12374 - protein, 658 aa, Oryza sativa Indica Group
MVGQQQVVDAAAAAAAATTRVPVPPPKPLLRTIGGNLMETFFPDDPFRAVARESGGRRALAALRYVFPFLEWLPSYSLAALWSDVVAGVTIASLAVPQGISYAKLGDLPPIMGLYSSFVPPLVYAVMGSSRELAVGTTAVASLLFAATLGKEAPPGEKPELYAALAFTATFFAGVLQAGLGVLRLGFLVDLLSHAAIVGFMAGAATIVCLQQLKGMLGLAHFTTSTDVVAVVRSVVTQSHQWRWQSIVVGCCFLIFLLFARYISKRKPKWFLLSAMAPLASVIAGSVLVYLIHGDRHGIPVIGYLKKGINPPSARDLLLSSPHTMVALRTGIITGIIGLAEGIAIGRSFAMLKSYNVDGNKEMIAFGAMNIVGSCTSCYLTAGPFSRAAVNHNAGCKTPMSNAVMAVAVMLTLQFLTPLFHYTPLVVLSAIIISAMIGIIDYKAAVRLWKVDKIDFCVCVGTYLGVVFGDIQIGLAIAVGISILRILLFIARPKTTVLGKMPNSTNFRRMDQYTVAKAVPGLLVLRIDSPIYFANSGYLRERIMRWIDHEEDRIKAEGLESLKCVVLDMGAVASIDTSGTKMLEDLKKNLDRSSIQIALANPGSEIMRKLDKSNVLGLIGEEWIFLTVSEACYYAQQNCKIGVGMGVVQCVVDPEHMV

SEQ ID NO: 12375 - protein, 527 aa, Streptomyces coelicolor A3(2)
MSPTSRPATGASLSAARRSREVADTVGGPVVDVLVVGLGATGAGAALDAAARGLGVVAVDAHDLAFGTSRWSSKLIHGGLRYLASGQLDVAHESAVERGVLMERTAPHLVRAQPFVLPLTPLVSRGQGALAWAGFRAGDTLRLAARTARATLPAPRRLSAVETRHLAPALRSDRLRGGLLSWDGRLADDARLVTALARTAAARGARILTRVRALELTGSGARVRDETTGEEGVIRARAVVNASGVWAGDLVDGIRIRPSRGTHLVLRSDRLGPLPAGLHVPIPGETNRFVLVLPQDDGRVYVGLTDEPVDGDVPDVPEVPETDVGFLLDVLGSVLDVPVHREDVVGAFAGLRPLLDTAPSDRPGAAPRTADVSRRHAVLTSSEGVITVVGGKLTTYRRMAEDAVDAAVAARGLAAGPSPTAALPLVGAAAPHTLAGVRAPRRLVRRYGTEAPAVQALASREPCLAERVLPGHPVTGAELVWALRHEGALDEADLLDRRTRVGLVPEDRAAALGAVRDLVGEVTADPR

SEQ ID NO: 12376 - protein, 363 aa, Chlamydomonas reinhardtii
MFSRPAVDGKPATSCIGYAAHDNAGVLVPMTFDRAAPGPSDVRIQITHCGICHSDLHMVKNEWNNAIYPMVPGHEIVGIVTEVGEGVTKFKPGDRAGVGCMVDSCGSCEFCKAECGEQQFCKGQVLTYSSKLPDGTVTKGGYSDFIVVKESFVLRIPDSLPLDATAPLLCAGITTYSPLRHFGLDKPGMRLGVVGLGGLGHMAVKIGKGLGLHVTVISTSEAKREEAVKHLGADAFIVSKDSGQMQAAAGSLDGIIDTVSAKHDLAAMVALLRVDGRLVLVGVPEVPLDLPSAALIFKRAMVSGSLIGGIKQTQEMLDFCGEKGITASIEKIPIDYVNTAYERMLRSDVRYRFVIDIQGSLVQ

SEQ ID NO: 12377 - protein, 418 aa, Magnaporthe grisea 70-15
MSLSNKLSITDVDVKGKRVLIRVDFNVPLDDNKNITNNQRIAGAVPTIKHALDNGAKTVILMSHLGRPNGSPNPKYSLKPVVSELEKLLGGKKVTFAPDCVGPEVEEIVNKAGEGDVVLLENLRFHIEEEGSAKDKEGNKTKADKAKVEEFRKGLTKLGDIYINDAFGTAHRAHSSMVGVDLPQKAAGFLMKKELDYFAQALESPKRPFLAILGGAKVSDKIQLIDNLLDKVNTLIVCGGMAFTFKKVLDNMAIGNSLFDEAGSKTVPELMKKAQEKGVKVVLPVDFITADKFAADAKTGSATDKEGIPEGWMGLDCGEKSVELFQSAIDESQTVLWNGPAGVFEFDAFAKGTKATLDAAVSGCGKGKIVIIGGGDTATVAAKYGVEDKLSHVSTGGGASLELLEGKELPGVTALSSK

SEQ ID NO: 12378 - protein, 857 aa, Brassica oleracea var. alboglabra
MKGVRNIYHHSYTSILLVFVVMILFHPAFSIYINTLSSADSLTISSNRTLVSPGNIFELGFFRTTSSSRWYLGMWYKKLSDRTYVWVANRDNPLSNSIGTLKISGNNLVILGDSNKSVWSTNITRGNERSPVVAELLANGNFVMRDSNNNDGSGFLWQSFDYPTDTLLPEMKLGYDLITGLNRFLTSSRSLDDPSSGDYSYKFESRRLPEFYLLKGSGFRVHRSGPWNGVQFSGMPEDQKLSYMVYNFTQNSEEVVYTFRMTNNSIYSRLTISSEGYLERLTWTPSSGMWNVFWSSPVDLQCDVYKICGPYSYCDVNTSPVCNCIQGFNPLNVHQWDLRDGTSGCIRRTRLSCSGDGFTRMKNKKLPETTMAIVDHSIGLKECKKWCLSDCNCTAFANTDIRNGGTGCVIWTERLEDIRTYFTDGQDLYVRLAAADLVKKRNANGKIASLIVGASVLLLLIMFCLWKRKQNRVKASAISIANRQRNKNLPMNGMVLSSKKQLRRGNKTEELELPLIELEAVVKATENFSNCNKLGEGGFGIVYKGRLLDGQEIAVKRLSKTSVQGTDEFMNEVTLIARLQHINLVQIFGCCIQADEKMLIYEYLENSSLDSYLFGKTRSSKLNWKERFEITNGVARGLLYLHQDSRFRIIHRDLKVSNILLDKNMIPKISDFGMARIFAREETEANTMKVVGTYGYMSPEYAMHGIFSEKSDVFSFGVIVLEIVTGKRNRVFYNLNYEDNLLNYAWNNWKEGRALEIVDPAILDSLSSLPSTFQPQDVLKCIQIGLLCVQDLAENRPTMSSVVWMLGSEATEIPQPKPPGYCLVRSPYEPDPSSNRQREDDESWTVNQYTCSVIDAR

SEQ ID NO: 12379 - protein, 187 aa, Vitis vinifera
MNLRVQTRYPLFREVIRINFLKSLSKRLKCNITAYENYHRVYVPEGQSPKSDPKEPLRVYVLFQHIQKMVSSETAVIAETRDSWFNCQKLKLPRGCRYEFQLQYGSIGWLVGVTLGGLAKSVSQVDNMASLSSDIFCDILKHFDGDPALTSATHACAGLCLSRLMNLLERRLSRDDEEDEEKLDKSR

SEQ ID NO: 12380 - protein, 389 aa, Xanthomonas campestris pv. campestris str. ATCC 33913
MNTPVPVVRLKNAWRSSHPWIFQKLVEKPAAKPKPGTIVDVVGVDGEWIGRGFYNGHSRIAVRILETDQSVPVDAGWFSRKIAAAVSLRRDWLQLDGVSDAWRVVHSEGDGLSGLVVDRYGDLVVVEFFAAGMFRHREWIYEALREQFPGCRFHSFADEHVQKQESFDFHSNTTTEASVITEYGIKFRADPAGAHKTGFFADQRENRQWLSEQVKDKTVLDLCCNTGGFAVYAAARGATEVLGVDIDEDVIAIAKGNAKLNNVRPKFVQADIFPWLRDAANRGEKYDVVILDPAKMTRDREQVIPALKKYLDMNKLALGVVKPGGLFATFSCTGLVAEQEFLDMLRRASYFSGRTIQILKVAGAGPDHPFMAHVQESRYLKAVFCRVVD

SEQ ID NO: 12381 - protein, 239 aa, Erythrobacter sp. NAP1
MFDKLKAYLDSVQARDPAPRSRWEILLYPGVWALGFHRVAHWLFDAKLFFLARFVNHLSRLLTAIDIHPGARIGKNFFIDHGFTVIGETAEIGDNVTIYQCVTLGGTNPTNGKGGKRHPTIQDNVIIGSGAQVIGPITVGERARIGANAVVTEEVPEGATMVGFKARSTLVPAEEWIKDFIPYGTPCEDAEGNRVDCIEKLESELIAMKAEIAALKADRQVDEPVQGDLDLTKKSGTGA

SEQ ID NO: 12382 - protein, 404 aa, Physcomitrella patens subsp. patens
MLEVIKILQEMSGEVVDSNPYSRLMALKRMGIVNNYEEIRKFSVAIVGIGGVGSVAAEMLTRCGIGRLLLYDYDTVELANMNRLFFKPDQACTAISPFELFNLAGMTKTDAAVQTLAEINPDVILESYTQNITTVDGFKKFTDSLTRDMKGNSTGGKSGVDLVLSCVDNYEARMVVNQACNELRQTWMESGVSEDAVSGHIQLLIPGETACFACAPPLVVASGVDEKTLKREGVCAASLPTTMGIVAGLLVQNTLKYLLQFGLVSRYLGYSALKDFFPTMEMRPNPQCSNTACLECQREYAAKKPVRDAAAKAKAEAEAEEASLAAQVPLHTENEWNICLVDDDDPVIFSESAANSLPDGLRRELPESDHLHNTEITGNDFVQSGGDLDDLDELQKQLEALNAM

SEQ ID NO: 12383 - protein, 454 aa, Asparagus officinalis
MGPPDVVPSEHVEFDFSDVFGPSPTPTSTGVNVFASDGSTPAASDDIVYTEPAVILARSHSLVGPTALVCQSPRLRKHILHEADLELVECPSGVEGEQDKPFSCVAEEHEVPSSENVERVGLEDFDFLKVVGQGAFGKVFQVMKKGTSEIYAMKVVRKDTILEKNHSEYMKAERDILTKIDHPFIVQLRYSFQTKYRLYLVLDFVNGGHLFYQLYHQGLFREDLARIYTAEIVSAVSHLHANGIMHRDLKPENILLDADGHVMLTDFGLAKEFEENTRSNSLCGTIEYMAPEIIQGKGHDKVADWWSVGILLFEMLTGKPPFIGGNRDKIQQKIVKDKLKLPAYLTSEAHSLLKGLLQKEASKRLGGGPAGSNEIKNHKWFKLINWRKLEAREIQPSFKPNVAGKICVANFEERWTSMPLTVSPVASPVAGSGNFSGFTYVKPSVFLQKPSPLG

SEQ ID NO: 12384 - protein, 459 aa, Pseudomonas putida GB-1
MTLRVAIIGAGPSGLAQLRAFQSAHAQGAPMPEIVCFEKQADWGGMWNYTWRTGLDQHGEPVHGSMYRYLWSNGPKECLEFADYSFDEHFGRPISSYPPREVLWDYIQGRVKKAGVRDYIRFNTVVKNVSFNERTREFTVSAHDYSVGVGIEQVFDFVVVASGHFSTPHVPEFEGFERFTGRILHAHDFREAVEFKGQDLLIVGSSYSAEDIGSQCYKYGARSITTAYRTQPMGYKWPKGWEERPQLVRVENDLAFFADGSSKRVDAIILCTGYQHHFPFLPDELTLKTNNRLWPAGLYQGVVWEQNPQLLYLGMQDLWYSFNLFDAQAWFARDYMMGRIKLPSRAGMQADSQRWREDEEGLETTASMYEFQGRYIKHLIEQTDYPRFDIDAVNRIFLQWKQDKKHDIMGYRDKSYRSVLTGTKAVPHHTRWMQAMDDSLQEYLRETDGKKGEVKALRG

SEQ ID NO: 12385 - protein, 1238 aa, Vitis vinifera
  misc_feature (101)..(101): Xaa can be any naturally occurring amino acid
  misc_feature (231)..(231): Xaa can be any naturally occurring amino acid
  misc_feature (348)..(348): Xaa can be any naturally occurring amino acid
  misc_feature (350)..(351): Xaa can be any naturally occurring amino acid
  misc_feature (357)..(357): Xaa can be any naturally occurring amino acid
MALSLHSPSSLLTPIQPSKPSSLTLLNCQYSPLTKPTNHITYNDAAVLSNPSPSKKWRVGVSFFPAFLKKGKDAKALKEELLDAIAPLDRGADATLEDQQXVDQIASELEAVNSIKEPLKSDLLNGKWELIYTTSQSILQTQRPKFLRSIANYQAINVDTLRAQNMESFPFFNQVTADLTPLTAKKVAVKFDSFKILGLIPIKAPGRARGELEITYLDEELSIHDYLTYSXDNEGREYVLRHILRRAVRYGSEVLKAQEGFFNSAHQFIIAEEEASFGKTLLKGIEKFKKAAHEVQGKILNGQANIYRLFEETNFVAFIDYLGTVFEVMEEDMFCYIHEGGQLVKCVXGXXQYQGGXSESMVVSRHMSHSDFVSKLCDALHFDQNSIKLEFTVKFEPSCLLPLHDNAALLKMFRFNEMFCHVYVSSSSEVVEGCIAPNSVPSLIVGSNSAYLLPSSGDLPINICNDSLTIESYGFSHRCAEANILERDSRRFENSIMGSEHTFPNAAEFRDVIYLMSIAGRFRYRFKRNSMKHMTVVCTVTKCPWKVTARAIGDSSIVQVHTFHNHHNHSLEDVAACQPLVRSNWASLLIDDKMVATNPGSIVELGHSSDGHFEQLFVAHSVSIQGFAMGCRPIIAIDSAHMSGPYRGALFSTTAYDANDAMFPLAFDVMSSKNYDDWSWFLQNLKKVVGDKKVVIILDRHPTLLRSVPEVFGLENHAYYYRHLKENFSSFLSKHNTRGNKGKENALQFLDSIVHARWDKMTTNLAESFNAWLMNERHHFICTFVLEHMAKLGSMLVKHKEESNNWKECIGPKIEEKVQQKIAKGEVYLVTPFMNGIFGVSIRTTFLNVDIMKRICTCRGWEMLGIPCEHATIVILSINQNVVDFVQDWYKFPMQELIYSGSFSGIETHDMPMVPNDGLVKLPKSRCSGKKFLSIMDTLPMDKKNAISDMGFGGLLQLGCKELRYELITWIVAKYDIGYHRLCMETKVVVPVMPKDVREVFYITKFYMTAFQVEVRSPLSAAWTDEQVKRRLPAEIHTYGNYDHVQVIQGSKPSAHNDGHPYEAGCSHSDDPTKVQWRKKWLCTHPTRRSCECRKKERRGKTGVHPCSDEMMRKGTGAASTHSGKQRVTGAAVDDGPCIDHDTFPPSQKSAELQSLKEVQMGVQEGCGSKQPSPTSMRRFKHTTKRLVKPAAICKSPFVSQCVQLFPKISQQERLVADYALSKDDEPRYFRLSEWYAK

SEQ ID NO: 12386 - protein, 177 aa, Zea mays
IDTKDETWEGVDLKEMGPEDIRWQEDDSGIDPVTYLRSRGGPTSGVRKPAGRGGPMPGSVRGRGLQKNMPKKDFPPPQNGVGKRSSDDIDILHTESLIKEVGKVFSVSNPDPQEVEKAKKALKEQEQSLIDAIARLAEASDGESDGHNRGRRNLYAANQHQASYVGAMPVGDRAGAM

SEQ ID NO: 12387 - protein, 575 aa, Enterococcus faecalis V583
MSEMLKGIAASDGVAVAKAYLLVQPDLSFNKTSVEDTDAEATRLDDALAKSTEELQAIRDKAAQSLGEAEAQVFDAHLMVLSDPEMVGQIKQNIQDNKVNAEAALKEVTDMYIGMFEAMDDNAYMQERAADIRDVAKRILAHLLGVTLPNPSMINEEVIVVAHDLTPSDTAQLDRTYVKAFVTDIGGRTSHSAIMARSLEIPAIVGTKEITDKVKAGDILAVNGIIGDVIIDPTDAEKSEFEAEAKAYADQKAEWDKLKNAETVTADGKHVELAANIGTPKDLEGVHKNGGEAVGLYRTEFLYMDSSDFPTEEDQYQAYKAVLEGMEGKPVVVRTMDIGGDKELPYLTLPHEMNPFLGYRALRISLSELGDGMFRTQMRALLRASVHGNLRIMFPMVATLKEFRAAKAIFEDEKQKLVNEGVEVSNDIQVGIMIEIPAAAVLADKFAKEVDFFSVGTNDLIQYTMAADRMNERVSYLYQPYNPSILRLIKNVIDAAHAEGKWAGMCGEMAGDQTAVPLLLGMGLDEFSMSATSILKTRSLMKRLDTTKMAELADRALKECDTMEEVFALVEEYTK

SEQ ID NO: 12388 - protein, 474 aa, Glycine max
MERKQGFFSALKDEVVRGLSPARSRAKSPARSASPMSSLLRRRRKHYAPPPELFIARSGSLRPAEALSPLKEGPDGTDDGGHDSTRGEGRWGQWMKGPLARAPSVSSSSSSCNNKKSDLRLLLGVLGAPLAPVHVCTTDPFPHLSIKDIPIETSSAQYILQQYIAASGGQKLQNSINNAYAMGKVRMIASEFETANKVTRSRNSSKAAESGGFVLWQMNPDMWYVELALGGSKVHAGCNGRLVWRHTPWLGAHAAKGPVRPLRRTLQGLDPRTTASMFINTRCIGEKKINEEDCFILKLCADPSTLKARSEGPAEIIRHVLFGYFSQKTGLLVHLEDSHLTRIQNNGGEAVYWETTINSFLDDYRPVEGIMIAHSGRSVVTLFRFGETAMSHTKTRMEEAWTIEEVAFNVPGLSVDCFIPPSELRFASMSEACELPQGQRVKTAVAAAAYHAKVTQLQKSHDSHTNNINWTVDV

SEQ ID NO: 12389 - protein, 900 aa, Magnaporthe grisea 70-15
MLSAARGAFRAGARRCIGARAIAAPARTLPVPRLAAAHAARRSFSASAPVLSQSNTRGVVVQAISSVASQREVQQYLSLFTSVESQKFAVIKVGGAILTDYLDELCQSLAFLYEVGLFPIIVHGAGPQLNKLLEDAGVEPQFEEGIRVTDAKTLAIARQLFLEENLNFTKKLEDYGVNVRPATAGVFYADYLNKDKWGYVGKITKVNTDIIEGAINRGCLPVLTSLAWTADGQLLNVNADVAAAELARALEPLKVVYLSEKGGLFDGDGSKISTINLDEEFDWYMGQEWCKYGTRLKIKETKQLLDTLPRTSSVAIIHPRDLQKELFTDSGAGTLIRRGGKFLTATKVSEFGDLAKIKEAFLRDHTDDPEAKTQMENYFDYLSKDVNFKAYYDEHVRVFAVVLPPKQDGGLAKLATLTMTSSGWLSGVADTIFAAIRKDHKKLVWVVDDNDENISWFQEKADGAVNQNGKVFFFYGVQDMNEVVPAMNQFFKEGNATLYSEGDMAKVEQLSSGVSTSGATRPVGRPQGQQIRSYHTSPRRPTVTQPFRTSRGPAFSRSYVSTTNPNPPLGKKNASNTRQAKVALIGARGYTGQALITLLNSHPHMELKHVSSRELAGKKLEGYNKSEIIYENLSPEDMTDMEESGEIDCWVMALPNGVCAPYVNAIYQGRRGRSDALNSVIVDLSADYRFDDSWTYGLPELVSRDSISQAKRISNPGCYATGAQLAISPLLEHVGGQPWIAGVSGYSGAGTKPSRKNDTTFLADNMLPYSLTDHMHEREISRQLGVDVAFVPHVAPWFSGIQLTIGIPLNKTMNSRDIRHIYQDRYAGERLVKIIGEPPFVKDIANKHGVEIGGFQVHSSGKRVVVCATIDNLLKGAATQCLQNMNLALGYAEYDGIPIM

SEQ ID NO: 12390 - protein, 231 aa, Triticum aestivum
  misc_feature (126)..(126): Xaa can be any naturally occurring amino acid
  misc_feature (184)..(184): Xaa can be any naturally occurring amino acid
  misc_feature (200)..(200): Xaa can be any naturally occurring amino acid
MAAADEHHEEASPLLAPPANEKLPPAQDPVKGCADGVPVVMGEPVTAPAGAEPRESWDSGILSCLGRNDEFCSSDLEVCLLGSVAPCVLYGSNVERLAAAPGTFANSCLPYTGLYMLGNSLFGWNXLAPWFSHPTRTAIRRRYNLEGSFEAFTRQCGCCGGLAEDEERREHLEVACDLATRGGXVQYFCHPCALCQEGRXELRRRVPHPGFYGRSVVVMMPPTEQTMGRTM

SEQ ID NO: 12391 - protein, 323 aa, Zea mays
  misc_feature (76)..(76): Xaa can be any naturally occurring amino acid
  misc_feature (109)..(109): Xaa can be any naturally occurring amino acid
  misc_feature (134)..(134): Xaa can be any naturally occurring amino acid
MAASLLHAAAASLQSSTQHARAGAAAFHPLACAPSLRLTRSSFSTNRHLEISLRAISASRRFAGRGAPRDRHVVAXLPGEQTEGSEVGDDRNGEIKPEEAQEIWKVMVXSSRGEALGDAGPCQCRAYDVYSERXREVLLEASEKLKIQADKAQKDLSVVATEIGQEGQEYLMMAARNSPDSIKDITTTFRALGKLNWPSEYEDYHVGIPFGTFLTVGGFLNFMLAGSTSALRFGIILGLALLALGISSLRSQRDGSRRPRLLVKGQAAIASVIFFREFSVLLQNGWFPKIFMVLLSGVVAGFYFYRIAAGSPKELSSNSDSVN

SEQ ID NO: 12392 - protein, 203 aa, Desulfotalea psychrophila
MNLIPMVVEQTPRGERSYDIYSRLLKERIIFLGSGVNDDVANVIVAQLLFLEAEDPEKDITFYINSPGGSVTAGMAIYDTMQYIKCDIATLCMGQAASMGAVLLAAGTAGKRYALPNSRIMIHQPLGGFQGQATDIEIHTKEILRIRKDLNNILAHHTGKTLKKIESDTERDNFMSSVEAQKYGLIDEVLVKREDVEGAADNG

SEQ ID NO: 12393 - protein, 164 aa, Zea mays
  misc_feature (48)..(48): Xaa can be any naturally occurring amino acid
  misc_feature (111)..(111): Xaa can be any naturally occurring amino acid
  misc_feature (126)..(126): Xaa can be any naturally occurring amino acid
MLISAAVLAITAARSSYQQVVAMPGLSSALQLVADAALTKLHGEDLQXDVQTDAIMPRLHNEKSTVRSLHLSMHRGAINISPHHARIFYEFHLQMPPHDDIANNGCLDDGXLHLIPNHRGKLDSHXLLHIVDCNINFRLTTPYIIYFAAAARDDPIIPQQLPPP

SEQ ID NO: 12394 - protein, 361 aa, Cryptococcus neoformans var. neoformans JEC21
MACNLTTSAIPSLLHSYVPQSLRPFVTLSYPITDPLAHPSAQTLYDKGPRDACFVVFWALAFTVLREAAMKGVFSPFMRICLPSPPRVKGQEREYAKARKKREHTVTRFAEQGWSWLYCSIYWTFGVIVLRQNASPTSPEQLWGTYPVIPLPALTKFYYLSQLGWWFHQLLVINCEKRRKDHWQMFGHHILTITLIVGSYAMNFTSVGVLIHCLMDFCDILLPLAKMFRYLSFTTLCDFTFVVFLISWFITRQVGLFLVIRSTYLDLPKFIPFEWTPEQGRFLTYWTHIGFVSMLSILWILATAWFYMACIVAIRVVRGMGAEDSRSDDESEEDALEQVPESVGTSTAITSEAEEDLRKRK

SEQ ID NO: 12395 - protein, 146 aa, Triticum aestivum
MQDPRGMAREDFSASKSQKRKVVYRPLPSVQIKTEPELLRRDIPHLLANTQKPPKRSFRSEPRPPMPQSDRGTPDSLPDSGPADEYRALRRKYMMLEEENYTLDAQLGMAEKEAKTLEDEKFALLDQLVVLEGLVEPSQLQTQRRL

SEQ ID NO: 12396 - protein, 430 aa, Pyrococcus abyssi GE5
MTMENPYEIVAVIAREILDSRGNPTVEVDVHTPISMGRAAVPSGASTGTHEAVELRDGGKRYHGKGVRRAVENVNKIIAPELVGMDVRWQREIDRLLIELDGTENKSNLGANAILAVSLAVAKAAANALELPLYQYLGGVNAYVLPVPLSNVINGGVHAGNDLDFQEFMIMPIGANSFREAIRWVSETYHVLKKVIAEKYGKNAVNVGDEGGFAPPMKEVTEPLDVLIKAIEEAGYKPGEEIALALDAASSEFYKDGKYIVSGKEYTREELLELYKELTSTYPIVSIEDPFHEEDWEGFVMITRELGKKVQIVGDDLFVTNPKRLKKGIEMGAANALLLKVNQIGTLTEAMDAAYMAFRAGYGVVVSHRSGETEDATIADLAVALNAGQIKTGAPARSDRNAKYNQLIRIEEELEGVAVYAGKNFRKVFF

SEQ ID NO: 12397 - protein, 546 aa, Bacillus licheniformis
MKKYRVNVQGMTCTGCEEHVAVALENMGAKRIEVDYRRGEAVFELPNGLEVETAKKAIAEAKYQPGEAEEVQSQELIQLGDEGDYDYIIIGSGGAAFSSAIEAVKYGAKVAIIERGTVGGTCVNIGCVPSKTLLRAGEINHLAKNNPFVGLHTSADDVDLAPLIKQKNELVTDLRNSKYVDLIDDYGFELIKGERKFVDEKNVEVNGIQLSAKRFLIATGASPAVPNIPGLDEVDYLTSTTLLELKKVPKRLTVIGSGYIGMELGQLFHNLGSEVTLIQRSERLLKEYDPEISEAITKALTEQGINLVIGAIYERVEQDGDMKKVHIEINGKKRIIEAEQLLIATGRKPNTESLNLHAAGVEVGSRGEIIIDDYLKTTNSRIYAAGDVTLGPQFVYVAAYEGGVAAGNAIGGMNKKLNLEVVPGVTFTTPAIATVGLTEQQAKEKGYEVKTSVLPLDAVPRALVNRETTGVFKLVADAKTLKVLGAHIVAENAGDVIYAATLAVKFGLTVEDLRGTMAPYLTMAEGLKLASLTFDKDVSKLSCCAG

SEQ ID NO: 12398 - protein, 295 aa, Triticum aestivum
AGDRTTTSVPFGAWHWSWFLLIRKASLVIYIYSRASASGKRVQCNMGAKIHAIILPDADRDATLNALIAAGFGAAGQRCMALSTAVFGGGSEPWEDELVKRASSLVVNSGTANDADLGPVISRQAKDRICKLVQSGADSGARLVLDGREIVVPQFEDGNFIGPTVLADVKGDMECYQEEIFGPVLLLMKAESLDDAIQIVNRNKYGNGASIFTTSGVSARKFQTDIEAGQVGINVPIPVPLPFFSFTGSKASFAGDLNFYGKAGVQFFTQIKTITQQWKESSPQRVSLSMPTSQK

SEQ ID NO: 12399 - protein, 405 aa, Shewanella oneidensis MR-1
MSVDMKLNRAQFDAVMVPNYAPAAVIPVRGEGSRVWDQEGNEFIDFAGGIAVNCLGHCHPALVNALKTQGEKLWHLSNVMTNEPALELATKLVNSTFAERVYFANSGAEANEAALKLARRYALEKHGVEKDEIIAFDKAFHGRTFFTVSVGGQAAYSDGFGPKPQSITHLPFNDVAALEAAVSDKTCAIMLEPLQGEGGIIDADPAFLKAVRELANKHNALVIFDEVQTGVGRTGELYAYMGTDIVPDILTTAKALGGGFPIAAMLTTTEIAEHLKVGTHGSTYGGNPLACAIGNAVLDVVNTPEVLNGVKHREQLLRDGLNKINEKYHVFSEVRGKGLLLGAVLNEQYQGRSRDFLVASVAEGLMSLMAGANVVRFAPSLVIPEADIAEGLARFERAVASIAAA

SEQ ID NO: 12400 - protein, 500 aa, Rickettsia typhi str. Wilmington
MLSTSQSRSFKNKFRAAFWPVHNYELGKFIPISALMFCILFNQNILRILKDSILISEISAEIAGFAKVYCVTPVAALFVIIYAKMINHLTFEKIFYYLSAFFISCFILFAFVIYPNIHIFHVHPDTLSDWMNKYPHFKWYISLVGNWGYIVYYSLAELWPNIFYVLLFWQFTNELTTTEEAKRFYTLFSLFGNSSLILVGFLMMNLSSEDTIIKKFVSISDSKITLVQVSTTIVAIVAIICCLLVRFISKYIFTNPLFYAKIKKSRSTTQRMGLIKSFKYIAKSKYLWLLLICSAAFGFAINLVEAVWKAKIKELYPTVNTYAEFNSLYILWTGVAIIVMTIIGNNVMRMHNWFVAAVISPVIIMVTGILFFVLIVFDQQILSLFDGAILMSPLALAVSIGGIQNILAKGTKYSIWDTSREMLYIPLDDELKTKGKAAVDVISAKIGKSSSGLVQSIIFTLVPNATFTSISPILMVVFTFVCFAWIYAVRKIYFEYQKIT

SEQ ID NO: 12401 - protein, 343 aa, Pseudomonas aeruginosa UCBPP-PA14
MIQVEPRQFVTGERGERNDEGLARAPSEPARLSEGGQMFANRLQKNLRQLGKWARRDKIECYRLYDADMPEYALAVDIYGDWVHVQEYAAPKSIDPAKAQARLFDALAAIPQTLGVAQERVVVKRRERQAGKKQYERQSSEGKFLEVGEGDVRLLVNLTDYLDTGLFLDHRPMRLRIQKEAAGKRFLNLFCYTATATVHAARGGARSTTSVDLSKTYLDWARRNLSLNGFSDKQRLVHGDVMEWLREDDGQYELIFIDPPTFSNSKRMEGVFDVQRDHVELLDLAMARLAPGGVLYFSNNFRKFELDESVQARYAVEEITGETLDPDFARNPKIHRAWRITVR

SEQ ID NO: 12402 - protein, 590 aa, Gibberella zeae PH-1
MTTIRLCTTSFVLSLLLLGDFVSGLRRYNFTITSQWSAADGHGRPVFAINGQTPGPLITATEGEEVEVFLNNQLATETTMHWHGIYQVDRPWNDGVPGVTQYSIQPRDNYTYRFTVQQQYGSYFYHGHFGPAFADGQRGPIWIEPAAWRPRPYKAISSSPQDLKAMQRAEVNPRHIVISDWNAEPMDILLIMYRDTGIVPWCSNSIVMNGKGRTYCHSKELIEETGGSGRNSLGCKVQPKQGLYANAQVCEPTNGELEVVAAADGEEWIWINFIHSGAHHELQISVDEHEFYVVAADGEFVHPQKVHAANCNLGERLSILVHLNKSPGDYAIRLTSLRTEQVIQGLGILRYPSKTNNKITKVPTSKPWVHLNGTLISTSSTSMDEMKLAPFPARPPPWTSDQTVKLFINMTGPSAWSLGLGSHQAFRQQLPPVLWEENSRGGTTLGVQNVLRNGSVVDIIFENGANVTSQHPFHKHNHKAWIIGTGHGGFPWETVQEAIDAGAADYFNFNDPPIRDGCRLGNATGDWTVIRYEITFPAASMLHCHMIHHFGAGQQIVLLEGVEAMAQVPNEVKQKVHADFVPNLRYGPLD

SEQ ID NO: 12403 - protein, 494 aa, Oryza sativa Japonica Group
VPFVIDFQHHGASRFASTSVVKQSSGGLLGWFLGGNSSQLPPLDVPLPGVIISPPLPDFVEPSKTKITTLPNGIKIASETSPIPAVSVGLYIDCGSVYETSSSSGTSHLLERMAFKSTTNRSHLRLVREVEAIGGNVFASASREQMSYTYDALKCYAPEMVEVLIDSVRNPAFLEWEVKEQLQKIKSEISEVSGDPHGLLMEALHSAGYSGALAKPLMASESAVNRLDVATLEEFVSENYTAPRMVLAASGIEHDELVSVAEPLLSDLPSVKRPEEPKSVYVGGDYHCQADSTSTHIALAFEVPGGWRQEKTAMIVTVLQVLMGGGGSFSTGGPGKGMHSWLYLRVLNNYGQIESFSAFSSIYNNSGLFGIHATTNPDFVSSAVDLAARELHEVATPGKVTQEQLDRAKEATKSSVLMDLESRIVASEDIGRQVLTYGERKPIEYFLKTVEEITLNDISSTAKKIISSPLTLASWGDVIHVPSYESVRRKFHSK

SEQ ID NO: 12404 - protein, 185 aa, Zea mays
  misc_feature (159)..(159): Xaa can be any naturally occurring amino acid
MYKNQLQELAQRSCFNLPSYSCIREGPDHAPRFKATVNFNGEMFESPVFCSTLRQAEHAAAEVALNELSKRGPSSTLAAKVLDETGIYKNLLQETAHRAGLKLPIYTTIRSGPGHTPVFACTVELAGKAFTGNPGKTKKQAQKNAAMAAWSELKKLPRXVGEPSSSSCPPDQDDEVQEQFVVTRT

SEQ ID NO: 12405 - protein, 79 aa, Zea mays
  misc_feature (33)..(33): Xaa can be any naturally occurring amino acid
  misc_feature (45)..(45): Xaa can be any naturally occurring amino acid
NKGSFSVFGLKGAVSFKGKLNVLASKRNQVVFXAPEIKVGSLGFXYGGESEVKLEIPYVSQKIRLGKGSKGLLFVFLKR

SEQ ID NO: 12406 - protein, 319 aa, Glycine max
MNMEGSYDSSCNGEAGNESLQIIKYSPYKPCTMISLSSPWFVLRVFYVRVCGIQVDESTPEFLSLNHIPLSPDTLLEVNGVRSSIYSDGEESSVLRRDRVDKKSEEATFVNTDSIRFTGSMKFEVYDKENCILSGVLETSNSNGFVGESRSGVKRWSMICQTEMSPGCGFFKGKHVAVPELPCPEIEVYVAGCFSGTPIILTKTLQLNCRKKHNRKFALDSIPEYGTTECQKDVSDHGLDLQVVDYRSFKPEQAEDYNSMYCQRTIYVDEEDGELSWFNAGVRVGVGIGLGLCVGVGIGVSLLVRSYQATTRNFKRRFI

SEQ ID NO: 12407 - protein, 439 aa, Arabidopsis thaliana
MRGVTPNYYHSYTFFFFFFVVLLALFLHVFSINTLSSTETLTISSNRTIVSPGNIFELGFFKTTTSSRNGDHWYLGIWYKSISERTYVWVANRDNPLSKSIGTLKISYANLVLLDHSGTLVWSTNLTRTVKSPVVAELLDNGNFVLRDSKGNYQNRFLWQSFDYPVDTLLPEMKIGRDLKTGHETFLSSWRSPYDPSSGDFSFKLGTQGLPEFYLFKKEFLLYRSGPWNGVGFSGIPTMQNWSYFDVVNNFIENRGEVAYSFKVTDHSMTYVRFTLTTERLLQISRWDTTSSEWNLFGVLPTEKCDLYQICGRDSYCDTKTSPTCNCIKGFVPKNVTAWALGDTFEGCVRKSRLNCHRDGFFLLMKRMKLPGTSTAIVDKTIGLNECKERCSKDCNCTGFANKDIQNGGSGCVIWTGGAHGYEELRRRRSRSICQNRPL

SEQ ID NO: 12408 - protein, 569 aa, Chlamydomonas reinhardtii
MLHTLSSTRPARGGAYHAAGSGLMPLSMLRPRPASSGRLPLGPGPLPTTPSPLQRLHLYSDRTHDDPHHPSTVARFKGAAAADDGSSQQPIAPVSSSDAPAPGTAAPLAPVLLAVAVACAGSFAFGFNLSIINGPLETIATELGIAGNKALMGLVVSSTLAGAALGSLAGGGVADSLGRRVSFLLAAVPMVAGPLISAAAGDINTMAAGRFLTGAAIGLSSALVPTYISEVAPTRIRGTLGALNQLCICLGILGALLVNVVVPAAAWRTMFQAAAAPAALLGLGMLLGPESPRWLASKHRDAAARDAAVRLWGPSGPAELDLSRPAATAAASANAGRAAASDVDGGTAVAQPGGLALLSGPAARPLLIGVLLFAFQQFAGINALVYFSSSVFRQAGVSSDALASAAVGATNVLGTLVAASLMERAGRKQLMAGSFMGQAAAMFAMAAGFSLPALQPYAGTIAVVGTLSYIAAFALGAGPVPALIVPELNPLATRGKAVSAAFVSHWVCNVLVGQSFLAAVQSYGLAPVYTFFGLMALAGAAYVNSQVPETKGKTLEQIEAELRAGAKAA

SEQ ID NO: 12409 - protein, 140 aa, Erythrobacter sp. NAP1
MAVTRTFSIIKPDATKRNLTGAVTKKLEEAGLRVVASKRIHMTREQAEGFYAVHKERPFFGELVEFMMSEPVVVQVLEGEDAVKRNRDVMGATNPAEADEGTIRKEYALSIGENSVHGSDSEENAAIEIAFFFNDDEIVG

SEQ ID NO: 12410 - protein, 368 aa, Magnaporthe grisea 70-15
MSFLQRRQDPGTDAPAPDPSVCTMDETANDWYGVRIASIFVILIGSLLGAAIPIYLVRYRNSERMGFSKLAFFISKYFGTGVIVATAFMHLISPANEILGMDCLKPLLGDYDWSMGIVLMTVMAMFFIEMIGAWFENRSNDKAGHSDALAVSKKSDEEDGSSKEATGTGVKDAGAPADGGMPSNIRGEDHLGHGRAHNEGDTHLAFAGKMTSIIILEAGVILHSVFIGLTLAVSSEFIILFVVLVFHQTFEGLGLGSRLATFDWPADKRRWTPWIFALMYGLTTPIAIAAGLGVKDALQAAPTTRYMVEGISNAISGGILLYTGLVELLAHEFIFNPEMDRASLRYKLFAFGCIAAGAGLMALLAKWA

SEQ ID NO: 12411 - protein, 300 aa, Klebsiella pneumoniae
MKMNIANLKAVIPVAGLGMHMLPATKAIPKEMLPIVDKPMIQYIVDEIVAAGIKEIVLVTHSSKNAVENHFDTSYELEALLEQRVKRQLLAEVQAICPPGVTIMNVRQAQPLGLGHSILCARPVVGDNPFVVVLPDIILDGGTADPLRYNLAAMIARFNETGRSQVLAKRMPGDLSEYSVIQTKEPMVAEGQVARIVEFIEKPDEPQTLDSDLMAVGRYVLSADIWAELERTEPGAWGCIQLTDAIAELAKKQSVDAMLMTGESYDCGKKMGYMQAFVTYGMRNLKEGAKFRESIKKLLA

SEQ ID NO: 12412 - protein, 434 aa, Avena fatua
MGKNSHLCCFSLLLLLLAGLASGHQVLFQGFNWESWKQSGGWYNMMMGKVDDIAAAGVTHVWLPPPSHSVSNEGYMPGRLYDIDASKYGNAAELKSLIGAFHGKGVHVIADIVINHRCADYKDKRGIYCIFEGGTPDSRLDWGPHMICRDDTIYSDGTANLDTGADFAAAPDIDHLNDRVQRELKEWLLWLKTDLGFDAWRLDFAKGYSAAMAKVYIDGTSPDLAVAEVWDTMQTGGDGKPEYDQDAHRQNLVNWVDGVGGAASAGMVFDFTTKGILNAAVEGELWRLIDPQGKAPGVMGWWPAKAVTFVDNHDTGSTQAMWPFPSDKVMQGYAYILTHPGTPCIFYDHFFNWGFKEEIAALVAVRKRNGITATSELKILMHDGDAYVAEIDGKVVVKIGSRYDVGSVIPAGFVTSAHGSDYAVWEKSATLQRS

SEQ ID NO: 12413 - protein, 296 aa, Haemophilus influenzae R2866
MGHFSEELQQVQNRINHFLEAQFEGIESHNAPLLDAMKYALLLGGKRVRPFLVYATGQMLGAEKQTLDYVAAAIEAIHAYSLIHDDLPAMDDDNLRRGHPTCHIQFDEATAILAGDALQSFAFEILTKTPNISAEQKLALVQILAQGSGVQGMCLGQSLDLISEHKQISLSELELIHRNKTGALLIAALKLGFICSPHFTDKRLEQSLTQYAEAIGLAFQVQDDILDIEGDSAEIGKQVGADLDLDKSTYPKLLGLSGAKQKAQDLYQSALSELEKIPFDTTALRALAEFIITRKS

SEQ ID NO: 12414 - protein, 135 aa, Nocardioides sp. JS614
MSLRTLVLLKPDAVRRGLVGAILSRYEAKGLTIVAMEQRTIDAAVADQHYAEHVAKEFYPPLRDFVTGGPLVALVLEGDNSVDVVRLLNGATDGSKAAPGTIRGDFSLSNRENLVHGSDSPESAEREIGIWFPGL

SEQ ID NO: 12415 - protein, 493 aa, Pseudomonas putida GB-1
MTLVRFQMCIDGQWRDAQSGKTFDSLNPATAQAWAQLPDADEADVELAVQAAQRAFDSKEWRSITATARGKLLRRLGDLIAENKEHLAQLESRDNGKLIRETRGQVGYLPEFFHYTAGLADKLEGGTLPLDKPDLFAYTVHEPIGVVAGIIPWNSPLYLTAIKLAPALAAGNTIVLKPSEHASATILELARLALEAGFPAGVVNVVTGYGPTTGAALTRHPLVRKIAFTGGAATARHVVRSSAENFAKLSLELGGKSPNIIFADADLDSAINGAVAGIYAASGQSCVAGSRLLVQDEIFDEFVERLIARAKRIRIGNPQDDASEMGPMATAQQLAVVEGLVAAAKAEGAKLHLGGKRAEVEGDGWFYEPTLFECDSNSMTIMQEEVFGPVAAVIRFKTEEEALAIANDSQFGLAAGIWTRDLGRAHRLARDVRSGIIWVNTYRAVSAMAPIGGFKNSGYGRESGIDSVLAYTELKTVWINLSTAPMPDPFVMR

SEQ ID NO: 12416 - protein, 400 aa, Campylobacter upsaliensis RM3195
MLIVQKYGGTSVGDLERIRAVALRVIESVKAGNELVVVVSAMSGVTNSLIEQAEYFSKNPNGADMDMLLSSGERVTSALLSIALNELGYRAVSFSGRKAGIITNSVFTKARIKHIDTSAIKAALKEGKIVIIAGFQGVDEEGNVTTLGRGGSDLSAVAVAGALSADLCEIYTDVDGVYTTDPRIEPKAKKLDKISYEEMLELASLGAKVLQNRSVELAKKLNVNLVTRSSFNNNEGTMITKEDGIEQALVSGIALDKNQARITLRNIEDKPGIAAEIFSSLARANINVDMIIQNVGTNGATNLGFTVPENELDQAKNTMKEVLGDQVSLESDSAVVKVSVVGVGMKSHSGVASMAFKALADEGINIGMISTSEIKISMIVHEKYGELAVRALHEVYGLDK

SEQ ID NO: 12417 - protein, 697 aa, Bradyrhizobium sp. ORS278
MSEVAKLDRQDIIGIVTIDSPPVNALSAAVRGGILDNVKAAIDDPAIKAIVLTCGGRTFIAGADITEFGKPPNPPALNDVLSTIENSPKPVIAAIHGTALGGGLEVALACHYRVATKDSKLGLPEVKLGLLPGAGGTQRLPRAVGPELAVKMIVGGDPIGAAEAHKSGLIEEIVEGPASGGVEFARKVVAENRPLRKLRDDDSKIAAAKADRSIFTNAVAAITKKSRGLEAPFAAADAVGYAIDLPFDEGLKREREGFLKLLTSDQSKAQRYAFFAEREAAKIAGVPEGTKGRKIERVAIIGAGTMGGGIAMSFANAGIPVTLIETAEEQLKRGMGIMQKNWEATAARGGIPADAPAKRMALIDGKVGLENVKDADLVIEAVFETMAVKKEVFGKLDQYAKPGAVLASNTSYLNIDAIAAETSRPQDVLGMHFFSPANVMKLCEIVRAEKTAPDALVTAVSIARKIAKVPAVVGVCDGFVGNRMLAQRGKQAEKLLFEGALPQQVDAVVTKFGMPMGPFAMGDLAGLDIGWRSRKDRGIKSEIADALCEAGRFGQKTGKGYYKYEAGSRAPLPDPDVEKLIDETLAKLGLKRRNVSDEEILERMMYPMINEGAKILAEGIAARPSDIDVVWLYGYGWPIYRGGPMYWADSVGLKQIAERLSYYAKETNDPSLEPAPLLKRLADEGKTFASLAQGKAA

SEQ ID NO: 12418 - protein, 428 aa, Burkholderia vietnamiensis G4
MSSQLQSIPSYLHADDLGPWGNYLQQVDRVAPYLGSLSRWLETLKRPKRILIVDVPIELDNGTVAHFEGYRVQHNVSRGPGKGGVRYHQDVTLSEVMALSAWMSVKNAAVNVPYGGAKGGIRVDPRKLSRGELERVTRRYTSEIGIIIGPNTDIPAPDVNTNEQVMAWMMDTYSMNQGQTSTGVVTGKPISLGGSLGRKEATGRGVFVVGCEAAKKKGLEIEGARIAVQGFGNVGGIAAKLFQEAGAKVIAVQDHTGTIYQPAGLDANKLLDHVARTGGVAGFEGTEPMPNDEFWTVETDILIPAALENQITEKNASKIRTKIIVEGANGPTTTAADDILSANGVLVIPDVIANAGGVTVSYFEWVQDFSSFFWTEDEINHRLERVMREAFAGVWAVAEEHNVSVRTAAFIVACKRILMAREMRGLYP

SEQ ID NO: 12419 - protein, 133 aa, Oryza sativa
  misc_feature (53)..(53): Xaa can be any naturally occurring amino acid
  misc_feature (111)..(111): Xaa can be any naturally occurring amino acid
MSRRLGIALKLLHEAAGNVVTGELKTGQMYSGSMVQCDDNWNCQFDNITSTAXEGKVSQLEHVFIIRSRARFMIIPDGLKNAPMFKRLGARMMGKGSAIGAGRGRADAVRXARAAAGRGGGPGGRGGAPPVRR

SEQ ID NO: 12420 - protein, 370 aa, Nocardia farcinica IFM 10152
MKSKAAVLWEPGAPWQIEELELDAPKYGEVLVELAASGLCHSDEHVRDGSVPVSFYPFIGGHEGAGVVREVGPGVTNLKPGDHVALGFIPACGRCRPCANGQSSICDLGAHLLDGYQVSDGTARHHVRGKDAGILCLLGTFAPYTVVNEASCVKITDDVPLDKAALVGCGVTTGWGSSVYAAGVSAGETVVVLGMGGVGCGAVQGAALAGARHVVLVDPSPVKREQAKVFGATHAVATVEEALPLVQDLTWGYLADKVLITVGVASGALIGQAMSLVAKGGVCVNVSVGDLETSDVTLNLFDLTAMRKTLKGAWFGNANIRFDIPHLLRLYMEGQLKLDEMITRTYTLEQVNEGYEAMRNAENVKGLIVY

SEQ ID NO: 12421 - protein, 352 aa, Streptococcus pneumoniae TIGR4
MKAYTYVKPGLASFVDVDKPVIRKPTDAIVRIVKTTICGTDLHIIKGDVPTCQSGTILGHEGIGIVEEVGEGVSNFKKGDKVLISCVCACGKCYYCKKGIYAHCEDEGGWIFGHLIDGMQAEYLRVPHADNTLYHTPEDLSDEALVMLSDILPTGYEIGVLKGKVEPGCSVAIIGSGPVGLAALLTAQFYSPAKLIMVDLDDNRLETALSFGATHKVNSSDPEKAIKEIYDLTDGRGVDVAIEAVGIPATFDFCQKIIGVDGTVANCGVHGKPVEFDLDKLWIRNINVTTGLVSTNTTPQLLKALESHKIEPEKLVTHYFKLSEIEKAYEVFSKAADHHAIKVIIENDISEA

SEQ ID NO: 12422 - protein, 267 aa, Shewanella oneidensis MR-1
MHTDINALFAALWQDYIQMTPSAAKVHELLGHGKPIINDHIALRTFNIAKVNLAVLAEHFTSLGYVACGDYKFEQKKLIAKHFEHPDATQPKVFISELLVEEFSSALQSTIQGLIAQVDEQATKADNFIYSGRHWTLDSKTYEALLEESEYAAWVAAFGYRANHFTVSINHLEGFDTLESVNDALKQAGFVLNTSGGEIKGSPEVLLEQSSTMADKIAVEFSDATVEIPSCFYEFALRYPKANGELYTGFVAASADKIFESTNAKKA

SEQ ID NO: 12423 - protein, 631 aa, Bacillus macroides
MKKYRVNVQGMTCSGCEQHVAVALENMGAKGIEVDFSHGEAIFELPEQVEVEAAKKAIADANYQPGEAEEVQPQQQANSMKKYRLNVQGMTCTGCEEHVAVALENAGAKGIEVDFRRGEALFELPYDVDMDIAKKAITEAKYQPGEAEEIQAQSQETEDVSLVDQGNYDYDYIIIGSGGASFSSAIEAVSYGVKVAMIERGTVGGTCVNVGCVPSKTLLRAGEINHLAKNNPFVGLHTSASNVDLAPLVKQKNELVTGMRNEKYVNLIDDYGFELIKGEAKFTNENTVEVNGNHITAKRFLIATGATSSVPNIPGLDEVDYLTSTSLLELKKVPNRLTVIGSGYIGLELGQLFHNLGANVTLVQRSERLLKEYDPEISEVITQALTEQGINLDSGATYERVEQVGDIKKVHVEINGKKRIIEAEQLLIATGRKPNTESLNLHAAGVEVGSRGEIVIDDYLRTTNSRIYSAGDVTLGPQFVYVAAYEGGLAARNAIGGLNQKVNLEVVPGVTFTSPSIATVGLTEQQAKEKGYEVKTSVLPLDAVPRALVNRETTGVFKLVADAKTLKLLGAHVVAENAGDVIYAATLAVKFGLTIENIRETLAPYLTMAEGLKLAAITFDKDVSKLSCCAG

SEQ ID NO: 12424 - protein, 359 aa, Oryza sativa
  misc_feature (206)..(206): Xaa can be any naturally occurring amino acid
MAGARAIGSLPVPNVQELAKTCNGPDEHIPERYIRPEASSEEVISNYHGEAIPIIDLNKLLSPQSSEECVKLRSACQYWGFFQLINHGVPDEVIANLKRDIVDFFSQPLDAKKEYTQLPSSLEGYGQALVFSEDQKLDWADMLYLQVHPSDSRDLRFWPTSPASFRRSLDAYSSETKSLALCLFEFMAKAVGAKPEALLGIFEFIXEEQPRGLRMAYYPPCRQADKVMGLSPHSDAGGLTLLLEINNVQGLQIKKDGKWFSIDAPNGALIANIGDTLEILSNGKFRSVEHRAVINPNKERISAALFHYPSENMVISPLPEFVKDGKVKYRSISYLDFMKQIFTQQLDGKNRVEVLKLDQ

SEQ ID NO: 12425 - protein, 206 aa, Xylella fastidiosa 9a5c
MLKLYIILSSTLSATNRKYSMSVLNTEILSFKATAYKNGQFVEVSEAVLKGKWAVFVFYPADFTFVCPTELEDLADHYEEFQKYGVEIYSVSTDTHFSHKAWHDISPAIGKIKYAMIGDPTHEISRNFNVLRPSGLADRGTFIIDPQGVIQSVEITAEGIGRDAKELLRKVKAAIYVANHPGEVCPAKWEEGGKTLAPSLDLVGKI

SEQ ID NO: 12426 - protein, 475 aa, Pyrococcus abyssi GE5
MPKLIKERVPTPERSPVERVRDFNEVNLGYTWELALREAERCLQCPKEYAPCIKGCPVNIDIPGFIRALRENRDNPRKAVREALKVIWACNSLPAITGRVCPQEDQCEGVCVVGKVGDPINIGKLERFVADYAREHGIDDELLMEEIRGIKRNGKRVAVIGAGPAGLTCAAELAKMGYEVTIFEALHEPGGVLAYGIPEFRLPKEILRKELKKLKFLGVEIKTDHIVGRTVTIPELLEEYDAIFISTGAGTPKLLKIPGINLNGIYSANEFLTRINLMKAYKFPEYDTPIVVGKRVIVIGAGNTAMDAARSALRLGAEVIIAYRRGKEDMTARIEEVQHAKEEGVKFMFFVNPVEFIGDEEGRVKAVKFEKMKPLEERDKRGKRKIVGTGEYITVEADTVIIAIGQTPNKILWRTTPGLKVREDGTIIVDENLMTSIPGVFAGGDAIRGEATVILAMGDGRKAAKAIHEYLSKSA

SEQ ID NO: 12427 - protein, 492 aa, Candida albicans
MPQVTKTNNENEFRLTRSKVQHQESISTIKNTTISNSQHKQQTQQQISSPPQVSVTSSEGVSHVNTRQYLGDVSNQYITNAKPTNKRKPLGGDNAPLQKQQHRPSRPIPIASDNNNNGSTSSSSNSSNNNNNDANRLASLAVPSRLPQKRQATESSTNLVEKLRVPQPEVGERSQSYHKKSRLIDYEWQDLDEEDNDDQLMVSEYVNEIFSYYYELETRMLPDPQYLFKQTLLKPRMRSILVDWLVEMHLKFKLLPESLFLAVNVMDRFMSVEVVQIDKLQLLATAALFTAAKNEEVFSPSVKNYAYFTDGSYTPEEVVQAEKYMLTILNFDLNYPNPMNFLRRISKADDYDVQSRTLGKYLLEITIVDYKFIGMRPSLCCASAMYLARLILGKLPVWNGNLIHYSGGYRISDMRECIELMFQYLIAPIEHDEFFKKYAMRKFMRASTLCRNWAKKFQASGRDLFDERLSTHRLTLEDDDEEEEIVVAEAEE

SEQ ID NO: 12428 - protein, 437 aa, Avena fatua
MMGIKKSHLCCWFSLLLLLLAGLASGHQVLFQGFNWESWKQSGGYYNMMMGKVDDIAAAGVTHVWLPPPSHSVSNEGYMPGRLYDIDASKYGYAAELKSLIGAFHGKGVHVIADIVINHRCADYKDSRGIYCIFEGGTSDSRLDWGPHMICRDDTIYSDGTANLDTGADFAAAPDIDHLNDRVQRELKEWLLWLKTDLGFDAWRLDFAKGYSAAMAKVYIDGTTPDLAVAEVWDTMPTGGDGKPEYDQDAHRQNLVNWVDGVGGAASAGMVFDFTTKGILNAAVEGELWRLIDSQGKAPGVIGWWPAKAVTFVDNHDTGSTQAMWPFPSDKVMQGYAYILTHPGTPCIFYDHFFNWGFKEEIAALVAVRKRNSITSTSELKILMHDGDAYVAEIDGKVVVKIGSRYDVGDVIPAGFVNSAHGSDYAVWEKSATLQRS

SEQ ID NO: 12429 - protein, 2110 aa, Mycobacterium tuberculosis
MESRVTPVAVIGMGCRLPGGINSPDKLWESLLRGDDLVTEIPPDRWDADDYYDPEPGVPGRSVSRWGGFLDDVAGFDAEFFGISEREATSIDPQQRLLLETSWEAIEHAGLDPASLAGSSTAVFTGLTHEDYLVLTTTAGGLASPYVVTGLNNSVASGRIAHTLGLHGPAMTFDTACSSGLMAVHLACRSLHDGERDLALAGGCAVLLEPHACVAASAQGMLSSTGRCHSFDADADGFVRSEGCAMVLLKRLPDALRDGNRIFAVVRGTATNQDGRTETLTMPSEDAQVAVYRAALAAAGVQPETVGVVEAHGTGTPIGDPIEYRSLARVYGAGTPCALGSAKSNMGHSTASAGTVGLIKAILSLRHGVVPPLLHFNRLPDELSDVETGLFVPQAVTPWPNGNDHTPKRVAVSSFGMSGTNVHAIVEEAPAEASAPESSPGDAEVGPRLFMLSSTSSDALRQTARQLATWVEEHQDCVAASDLAYTLARGRRHRPVRTAVVAANLPELVEGLREVADGDALYDAAVGHGDRGPVWVFSGQGSQWAAMGTQLLASEPVFAATIAKLEPVIAAESGFSVTEAITAQQTVTGIDKVQPAVFAVQVALAATMEQTYGVRPGAVVGHSMGESAAAVVAGALSLEDAARVICRRSKLMTRIAGAGAMGSVELPAKQVNSELMARGIDDVVVSVVASPQSTVIGGTSDTVRDLIARWEQRDVMAREVAVDVASHSPQVDPILDDLAAALADIAPMTPKVPYYSATLFDPREQPVCDGAYWVDNLRNTVQFAAAVQAAMEDGYRVFADVSPHPLLTHAVEQTGRSLDMSVAALAGMRREQPLPHGLRGLLTELHRAGAALDYSALYPAGRLVDAPLPAWTHARLFIDDDGQEQRAQGACTITVHPLLGSHVRLTEEPERHVWQGDVGTSVLSWLSDHQVHNVAALPGAAYCEMALAAAAEVFGEAAEVRDITFEQMLLLDEQTPIDAVASIDAPGVVNFTVETNRDGETTRHATAALRAAEDDCPPPGYDITALLQAHPHAVNGTAMRESFAERGVTLGAAFGGLTTAHTPRREPRRCWPRSRCPRRSGSSRAPTESTRRCWTLVSSRSARASSRYGHWWPAVAVGCAQPACLRAYPQCPLLLHAVDQGLQRRDPRWEADLDVLDEHGTVLLAVRGLRMGTGTSERDERDRLVSERLLTLGWQQRALPEVGDGEAGSWLLIDTSNAVDTPDMLASTLTDALKSHGPQGTECASLSWSVQDTPPNDQAGLEKLGSQLRGRDGVVIVYGPRVGDPDEHSLLAGREQVRHLVRITRELAEFEGELPRLFVVTRQAQIVKPHDSGERANLEQAGLRGLLRVISSEHPMLRTTLIDVDEHTDVERVAQQLLSGSEEDETAWRNGDWYVARLTPSPLGHEERRTAVLDPDHDGMRVQVRRPGDLQTLEFVASDRVPPGPGQIEVAVSMSSINFADVLIAFGRFPIIDDREPQLGMDFVGVVTAVGEGVTGHQVGDRVGGFSEGGCWRTFLTCDANLAVTLPPGLTDEQAITAATAHATAWYGLNDLAQIKAGDKVLIHSATGGVGQAAISIARAKGAEIFATAGNPAKRAMLRDMGVEHVYDSRSVEFAEQIRRDTDGYGVDIVLNSLTGAAQRAGLELLPFGGRFVEIGKADVYGNTRLGLFPFRRGLTFYYLDLALMSVTQPDRVRELLATVFKLTADGVLTAPQCTHYPLAEAADAIRAMSNAEHTGKLVLDVPRSGRRSVAVTPEQRPLYRRDGSYIITGGLGGLGLFFASKLAAAGCGRIVLTARSQPNPKARQTIEGLRAAGADIVVECGNIAEPDTADRLVSAATATGLPLRGVLHSAAVVEDATLTNITDELIDRDWSPKVFGSWNLHRATLGQPLDWFCLFSSGAALLGSPGQGAYAAANSWVDVFAHWPRAQGLPVSAIAWGAWGEVGRATFLAEGGEIMITPEEGAYAFETLVRHDRAYSGYIPILGAPWLADLVRRSPWGEMFASTGQRSRGPSKFRMELLSLPQDEWAGRLRRLLVEQASVILRRTIDADRSFIEYGLDSLGMLEMRTHVETETGIRLTPKVIATNKTARALAQYLADTLAEEQAAAPAAS

SEQ ID NO: 12430 - protein, 370 aa, Nocardioides sp. JS614
MLVMRTTVAVVDGPGAEFVLEEVEIDGPRADEVLVRIVATGLCHTDLSLRDTLPAEMFPRVFGHEGAGVVEEVGADVTGIEVGDHVVLSLASCRGCARCSDGLVGYCEQTLMLNYMGFRADGSTSYSRAAGPVYGHFFGQSSFARHAVALASSVVVVDQDLDLTRAAPYGCGFMAGSGAILNVARPKAGETVVVYGVGAVGLAAVAAARASGVETVVAVDLRARRLEAAEKLGAVGVDSAALGETSVVDRVKELTGGGASYAIETTAVPAVLKEAGQSLGVRGTLVVLGLDMSRPEFPVDAIDLLQNGKVVRGSVEGDSDPLEMVPRMLRLNAEGKFPVDDLVTTYPFTEINTAIADVLAGRVVKPVLVW

SEQ ID NO: 12431 - protein, 274 aa, Candida albicans SC5314
MKDYTITVLGCGVMGTAVTSAILKSKFDPYPKKIIACTIPSQEQSLKETFADQPLVHVSAGVENNNKAVTEADVIILGCKPYMYEGIYEEVKESLTGKQLLISLLAGTTIKELSIFTPYVAKVMTNTPARFGCGTAAIAFAPEVGEESQELVMKLIDTVGMTVKIPEKNMDIATSLIGSGPAFCLLMMESMIDGAVRMGMPYDVASVAAAKVMEGTARMVLETGEHPAALKSKVCTPGGTTIGGLLTMEDRGLRSAIARGVEEAANISASFAKK

SEQ ID NO: 12432 - protein, 133 aa, Ralstonia eutropha JMP134
MSYSTKVLDHYENPRNVGSFDKNDDDVGTGMVGAPACGDVMKLQIKVNEAGVIEDAKFKTYGCGSAIASSSLVTEWVKGKTVDQALEIKNTQIAEELALPPVKIHCSILAEDAIKAAVEDYKKKHPAADQKAA

SEQ ID NO: 12433 - protein, 480 aa, Geobacter metallireducens GS-15
MDKSSRKTKIVATLGPASSSPEMISKLMEAGADLFRLNFSHGANDQRRETIATIRRLSAARGKEIGILADLQGPKIRTGRMENGAISLRKGDPLDIVTDEVLGTPTLISTIYKALPHDVKPGSRILMDDGLIELKVHSVEGNLVRCTVVEGGTLKDLKGINLPGVHVSAPSLSEKDLRDLEFCLAEGVDYIALSFVRSAEDVEGLKRILFERGIHIPVVAKIEKPEALRNFKSILKAADGVMVARGDLGVEISAEKVPLFQKKIIRACNEAGKPVITATQMLESMISHPRPTRAETSDVANAILDGTDAVMLSGETASGQFPLEAVRTMAKVALDVERYAQMEDTLPQRRHNPSIAEAVAEAACRAAVTVDARAISVMTQSGSTAALISKFRPPLPIIAFTQSLETRRRLSLYWGVKPLPIGPMTGTDEQIAAVESTFLSAGYRKGDVIVITMGVPVEARGSTNLMKVHKLGTGKFFEIF

SEQ ID NO: 12434 - protein, 243 aa, Haemophilus influenzae R2866
MIELSHEEELRYNRQIILKSVDFDGQEKLKASKMLIVGLGGLGCAASQYLAAAGVGNLTLLDFDTVSLSNLQRQVLHCDARLNMPKVESAKIALKQINPHINIETINAKLDEKKLAEIIPHFDIVLDCTDNVEIRNQLDRQCNHAKIPLISGAAIRMEGQISVFTYEPNTPTYRDLSKLFGQNVLSCVEAGVLAPIVGIVGCIQALEAIKVRLKIGKNLCGRLLMIDGFSMNIREIKLPTNME

SEQ ID NO: 12435 - protein, 225 aa, Brassica napus
  misc_feature (153)..(153): Xaa can be any naturally occurring amino acid
  misc_feature (157)..(157): Xaa can be any naturally occurring amino acid
  misc_feature (168)..(168): Xaa can be any naturally occurring amino acid
  misc_feature (181)..(181): Xaa can be any naturally occurring amino acid
  misc_feature (184)..(184): Xaa can be any naturally occurring amino acid
MGLEDEKKGGEASGETSDRENRLSRMNSESSLSPTEDDDDDDEDRKPELGPMIALKEQLEKDKDDESLRRWKEQLIGVVDLEDVGETPDPVVKILHLTVRSPDRDEMVLTIPDDGVPNPKGPWFTIKEGSKYTLVFNFRVTNNIVSGLRYNNXVWKXGVKVDSTKAMXGTFSPQGEPYQHXMPXETTPSGIFARGSYSARTKFIDDDNKCYLEINYTFDIRKNWQ

SEQ ID NO: 12436 - protein, 339 aa, Enterococcus faecalis V583 [sequence omitted]

SEQ ID NO: 12437 - protein, 322 aa, Thermobifida fusca YX
MTGMKAAGQKKLMLFSGRTHPDLAAEVAVELGIETVPTRFQDFANGEIFVRYLESVRGCDAFVIQCHSDPINKSIMEQLIMVDALKRASAKRITVVTPFFGYARQDKKHRGREPISARLITDLFKAAGADRLMAVDLHTDQIQGFFDGPVDHLFALPLLADYVAANVDLSNTTVVSPDSGRVRTADRWADRLGTPLAIVHKRRDPDVAHEVRVHEVVGEVRGRTCVLVDDMIDTAGTIVKAADALFEQGAAKVIAVATHGVLSGPAVDRLKDSRISEVVITNSLPVSKDRQFDKLTQLSIAPLLARAINEVFSDGSVTSLFE

SEQ ID NO: 12438 - protein, 337 aa, Enterococcus faecalis V583
MIWPERPDNWRDGGKPVQEAFTNVAKAISQFTPMNVVVSQQQFQNCRRQLPPEITVYEMSNNDAWVRDCGPSFVINDHGEIRGVDWTFNAWGGLVDGLYFPWDQDDLVAQKICEIEHVDSYRTDDFVLEGGSFHVDGQGTVLTTEMCLLSEGRNPQLSKEAIEQKLCDYLNVEKVLWLGDGIDPEETNGHVDDVACFIAPGEVACIYTEDQNSPFYEAAQDAYQRLLKMTDAKGRQLKVHKLCCPVKNVTIKGSFKIDFVEGTMPREDGDICIASYMNFLITNDGVIVPQYGDENDHLALEQVQTMFPDKKIVGVNTVEVVYGGGNIHCITQQEPKR

SEQ ID NO: 12439 - protein, 510 aa, Clostridium tetani E88
MKKELVFIIDFGGQYSQLIARRVRENNVYCEIIPYSTSIEKIKEKNPKGIIFSGGPNSVYGENSPRISKEIFEIDVPVLGICYGQQLASFILGGKVESAKVREYGKTAVNLDNKCALFEGIDKVQECWMSHTDYVSEIPSGFNIVAYTDGCKVAAMANEDKKIYGVQFHPEVEHTPFGKKMLKNFLFNICELKGDWSVTSFAEEKIKEIRELVGDKKVICALSGGVDSSVAAVIVHKAIGDQLTCIFVDHGLLRKDEGDQVESIFKEKFQMNLIRVNAQDRFLGKLKGVTEPERKRKIIGEEFIRVFEEEANKLGKIDYLVQGTIYPDVVESGTDTSATIKSHHNVGGLPEDIEFELIEPLRELFKDEVRRVGEELGIPHKLVWRQPFPGPGLGIRVLGEVTEEKLEIVREADAIFREEIANAGLDEKIWQYFACLPNIRSVGVMGDERTYSHTIGLRAVNSSDGMTSDWAKIPYEVLDKVSIRIVNEVKGVNRIVYDITSKPPSTIEWE

SEQ ID NO: 12440 - protein, 459 aa, Lentisphaera araneosa HTCC2155
MPNTGASHSITIRLQMDHQPGLFAKAAEIIGRLGGNIGAIDIVKITKGKITRDVTVDTSSDEHKEQITEELNQIDGMKILHISDRVFLMHLGGKIEVNSRFPLQSRDELSMAYTPGVARICEAIHKDPQLAHNLTIKKNTVAIVSDGTAVLGLGDIGPEAAMPVMEGKAMLFKEFGGVDAFPICLDTRDTEEIIRTVKAIAPGFGGVNLEDIAAPRCFEIERRLQEELNIPIFHDDQHGTAIVMIAGLINALKVVNKDAKDIKAVVAGVGAAGTACTKMMLDLGIKNIIGLDRTGTLYSGRDKMNDSKVAYAEITNPHKIKGGMDEAIKDADLFVGLSGPGVLSLEQLKTMAKDPIVFAMSNPTPEIMPEVALPHVAVMATGRSDYPNQLNNVLCFPGIFKGALKCRAQSITEKMKLAAAYAIAETVKENEICADYIIPGVFNKDVARNVAKAVKKAYR

SEQ ID NO: 12441 - protein, 550 aa, Lentisphaera araneosa HTCC2155
MSAIIWIGIAFLFGTIAKLIRLPPLIGYLSAGFLLPTIGQLTTELDLSTNGIDDREALNQFADLGVTLLLFTIGLKLKVKNLLRVPIWGTGFGHMAIITIAMSGLLFLLSSTGWGPFSGLDFKAIALIGFALSFSSTVFVVKVLEEKAAMNSFYGTLAIGILIIQDIAAVIYLAASTGKIPSPWALALLIGLYPLHRLMKKFLNFIHKGELLLLFGLFIALGGAILFESFGIKGDLGALLLGIMLSKHKYATNLAKELFNFKDLFLVGFFLSIGLSGLPDSDIILTAILISLILPLKALLFFLFLTKFRVTSRTAILSSAILFNYSEFGLIVAKVGVDTQVLSPKWLTIIALALAISFLYASPLSANTQKLIEFFIDKAKRFESKHRLPEEINIDPGDVNIIIIGMGRLGTGAYDEFLHQDVDKIVGFDNDPSVVKRHLNEGRHSILANSVDPDFWHRFCVNHPSIQMVLLSMPETSNNLFAAQQLRANKFEGKVFATVKYKEDEATLKENGVDYIFNFYISAGAGFAIESLTALPKKEGSMELCAENIV

SEQ ID NO: 12442 - protein, 469 aa, Legionella pneumophila str. Paris
MNSRKNTMELMTEFLALHQQHKNNPYPSLSERKKLLIAIKKILQTEAYTLAEAINKDFTHRPVEETLFLEVFPTIKAINFCLKNMKKWMRKRRRSVSWLFIPAQAYVIPQPLGVVGILVPWNYPVYLALVPAIYALASGNRVMIKMSELSPHIGDTLQKLVHASGINHSIRIINGGIELSKHFASLPFGHLMFTGSTSVGKLVMKAASDNLTPVTLELGGKSPAIISPTMNPAYFKRLFMGKLLNAAQTCIAPDYVLIPKGWEERVETEFKKFINTFYPDLMSNEQYSSIISESHKKRLLDLVEDARSKGARVVEFGHLIPNSSKLPVFLLFDITNDMLVMKEEIFGPVLPVLTYNSIFDAVDLINSFPNPLALYYFGEDKNEIKIIQTTTLSGALTINETLMHIAIDDLPFGGVGHSGMGHYHGKEGFDTFSKLKPVLVQRFISTVSWLYPPYGAFMRMFLAWVGGIK

SEQ ID NO: 12443 - protein, 448 aa, Rickettsia typhi str. Wilmington
MALIIQKFGGTSVANIERIKKLVPIIKAEITKNNQVIVVVSAMAGVTNQLVTLCSEVSSLNKISQFAEYDVALSSGEIVTAALLALALQEEEIQAQSLLAWQLPILTNNNHSKALVEFITTDLLEKCLQLKIIPIIAGFQGINKSNRITTFGRGGSDTTAALIAAAMKADRCDIYTDVDGIFTADPRIIPNAKRIKEIDFLEMLELASSGAKVLHPRAVELVMRYKIDMRVLSTFLPNTEGTLITSKDTTPLVKSTYMDMEESAKNIKRSTKINIPDDTSGLTYKLPIELALQNRYNMENCIIRGITSNKNLLKVSVNTITLSFLQVANMITYNNNCIEFMQEIKNNIEYNFITNLTDKNNLQTLLTNCKNNKQIQNFTFDTEIATISLIGYGIKNDCKLLEMILSQLTQDNINVNMMQLSEVKITLLINDKDVEKTISNLYNLFKIS

SEQ ID NO: 12444 - protein, 276 aa, Xylella fastidiosa 9a5c
MVERQDKEIHDLRDEHWGERFSGIDRLYGLGTVARLSTCRVAVIGIGGVGSWIVEALARSAIGYMSLIDADDLCISNTNRQLPALIGQYGRNKAQAMVERCRAINPRINVSATELFLAGNNMEALLGENFDLIIDACDSFRIKVETIVSCRRHKRPLITIGAAGGRTEPTLVRVRDISRTEHDTLLALIRKKLRSEFNFPKNPKRYFGVPAVYSLENVKYPQADGSVCGIRPSLISNAALNLDCSTGLGAATHVTGAFAFAATGKAIEMLLTPKKR

SEQ ID NO: 12445 - protein, 494 aa, Bacillus cereus E33L
MLTTNIELKPKVKAFLDEEIKMFINGEFVPSIRGKTFETYNPATEDVLAVVYEAQEEDIDVAVKAARSAFESGPWVEMTTAERAHLIYKLADLIEEHGEELAQLEALDNGKPYQVALDDDIAATVENYRYYAGWATKIIGQTIPISKDYLNYTRHEPVGVVGQIIPWNFPLVMSSWKMGAALATGCTIVLKPAEQTPLSLLYTAKLFKEAGFPNGVVNFVPGFGPEAGSAIVNHHDIDKVAFTGSTVTGKYIMRQSAETIKHVTLELGGKSPNIILEDADLEEAINGAFQGIMYNHGQNCSAGSRVFVHRKHYETVVNELVKMADNVKLGAGMEKDTEMGPLVSKKQQERVLHYIEQGKAEGATVAAGGERAFEKGYFVQPTVFTDVTDDMTIVKEEIFGPVVVVLPFDSTEEVIERANRSSYGLAAGVWTQNIKTGHQVANKLKAGTVWINDYNLENAAAPFGGFKQSGIGRELGSYALDNYTEVKSVWVNIK

SEQ ID NO: 12446 - protein, 490 aa, Xylella fastidiosa 9a5c
MTLQLNKNRKTAMSEHYDVVVIGAGPAGYHAAIRAAQLGLKVACVDAALGKDGKPALGGTCLRVGCIPSKALLDSSRQYWNMGHLFNEHGISFKDAKIDVATMIARKDKIVKQFTGGIAMLFKANKITPYYGFAQLQPGNVVKVKQHEGKNIELKGANVILAAGSDSVELPFATFDGETIVDNIGALDFIKVPKRLAVIGAGVIGLELGSVWKRLGAEVTILEAMPDFLAAVDADVAKTAAKEFKQQGLDIKLGAKVSRTEISSKNNKKEVIVTYTDASGKQTFTVDKLLVAVGRKAATKGLLADGTGVQLNERGQIVVDEHCHTGVDGVWAIGDCVRGPMLAHKGFEEGIAVAELIAGLPGHVNFETIPWVIYTEPEIAWVGKTEQELKANNIPYKAGSFPFAAVGRAVAMAEPSGFVKVLAHAETDRVLGLHLIGVNVSELVHEGVLAMEFSGSADDLARICHAHPTLSEAIHDAAMAVSKRAIHKAN

SEQ ID NO: 12447 - protein, 369 aa, Proteus vulgaris
MKSRAAVAFAPGKPLEIVEIDVAPPKKGEVLIKNTHTGVCHTDAFTLSGNDPEGVFPVVLGHEGAGVVVEVGEGVTSVKPGDHVIPLYTAECGECEFCQSGKTNLCVSVRETQGKGLMPDGTTRFSYNGQPLYHYMGCSTFSEYTVVAEVSLAKINPEANHEHVCLLGCGVTTGIGAVHNTAKVQPGDSVAIFGLGAIGLAAVQGARQAKAGRIIAIDTNPAKFELARQFGATDCINPNDHDKPIKDVLLEINKWGIDHTFECIGNVNVMRAALESAHRGWGQSIVIGVAGAGQEISTRPFQLVTGRVWKGSAFGGVKGRTQLPAMVEDAMKGEIELEPFVTHTMTLDEINEAFDLMHEGKSIRTVIRY

SEQ ID NO: 12448 - protein, 140 aa, Triticum aestivum
MMASLADSFLADLDELSDNEAYPVEDTAEAVGLAEDGDDDMPDLESLNYDDLDSVSELRKTQRSSDLLHEVEGALEKDTCLANQCLILEEDPEYQLIVDCSALSVDIENELICIHNFLRDQCRLEVSELGSLGLHPVDYA

SEQ ID NO: 12449 - protein, 1172 aa, Magnaporthe grisea 70-15
MATLDSLKSALRQRAATATQALPPLSEAQYSAGFDMFVKESGWATYQDFIIPQLSQLVAPLLNRRVRLSVLEIGPGPKSVFGYLPEQQRQKITKYVAYEPNTLFAARLEEWFQSGSELVPPLPCLKTSPEIRHTPFALDGNNCMDEPEEAFDLVLFCHSMYGMRPKVKFIERALGMLDGRFDGGMVVIFHRAGSLHLDGLVCHSTASFPSGVIRVTNDDAILDAFARFVAGYAVDDVDEQSVSIRSDWREVCRSLGRREGAHPDLLGFGAPEVMIALTRHATSLPELTAQVPLLIGSPQNKIKNRQARLHRPAAVFGPTEIQHLQRCVRWALKNKTKLTVVSGSHSDQCLWPNVVAIDMGFFDKVQICVAEDGKATCTPESNVFVVAETGAKAGDIIEKTMAAGLTVPLGSRPSVGAGLWLQGGIGHLTRLHGLTCDSIVGAVMVSVSSGQVLCIGNVPGPHQPAGSERPENEADLLWAIRGGGTNFGIVVSVTFKTYTSPTYSVRNWIVPLRGDSEALLKLEMFDELVAGKLPRDCSADAYLYWDVGQMHLGVTMYEASTKAPALQTAQADRLAKVLGQEASSKVVDGIGLFDTEMYMSGMHGGHGGGKTSSFKRCMFLRRIGAEATATVLQNAIKTRPSPFCYLHLLHGGAAVMDVAADSSAFGCRDWDFACVITGVWPRDQDGIQAAETAIQWVYNVVGALLPLSTGVYGADLGPDPRDSALATKAFGPNLARLARLKTSSDPYSILAYAFPLPKVPTEPKLIILVTGLHGAGKDYCAAIWVSVFNSSNPARKYPTACAIGISDATKREYAEATGADFDRLLSDRPYKEQHRSGLNAFFKSQLRRRPRLPEEHFLKVVRDSAPIDVLLITGMREQAPVAALSHLVPKSKLLEVRVTVSEELRQVRRGSRKDLAIGRGNCAALCAAEDGTDGEGIKHARLGSMTSSDCPDLTFENDIPGSKAVKAFAQDRLLPLIHEDLQRLVQMIRSVPDHPREGIEFRHVLDIAQRPGGLDLCSSLLQSHFAGDWAQIDALVCCEAGGFLFASALATRVDVPLVLIREAGKLPPPTISTSKLPSHISSPVLADSTLGRIEMDLYAISPGASVVVVDDVLATGRTLCAVLRLLKKAGVHEKNISVIVVAEFPCHRGRDVLHQHGFAETSLQNLLVFGGP

SEQ ID NO: 12450 - protein, 299 aa, Marinobacter sp. ELB17
MNTITRLPASDFLQHCRAEIDQQLADYMDQASASQRLQDAMRYGLLGGGKRIRPALCLAAAEAVGGQRQIALAPACALEMIHAYSLMHDDLPAMDNDDLRRGRATAHIAFDESSAILAGDALQAEAFRVLATAPRLSAEVKLAMVKALANACGANGMVGGQAIDLESVARTLTLDQLENMHRHKTGALIEASVHLGALAGGVKDPALLDALARYARALGLAFQVQDDLLDIEGDTEVMGKTQGSDIARGKPTYPALLGPKGARELLARLLAEAHESLKGLGIQADALHAMADYIVARSH

SEQ ID NO: 12451 - protein, 656 aa, Marinobacter sp. ELB17
MQDTMIFREIPLQRPNTPMLDRIGSPADMRQLPADQLTQLARELRSFLLWSVGTTGGHFGAGLGVLELTVALHYVFNTPEDRLVWDVGHQAYPHKILTGRREQMGSIRRKNGLAGFPKRTESPYDTFGVGHSSTSISAALGMAIASNQQGLTRKSIAVIGDGAMTAGMAFEALNHAGHLKADMLVILNDNDMSISRNVGGLSNYFAKLLSSRTYHQMRDSSKKVLEIAPGLRELAKKTEEHFKGMIAPGTLFEELGFNYIGPIDGHDLPLLVETLENIRELSGPQFLHIVTTKGKGFAPAEADPIGYHAINKIEPMAATTVASGNPTPVKSGPAALKYANVFGQWLCDAAAADERVMGITPAMCEGSDLLAFAERFPARYFDVAIAEQHAVTLAAGMACDGAKPVVAIYSTFLQRGYDQLIHDVAIQNLDVLFAIDRAGLVGEDGPTHAGAFDISYLRCIPNMVLMTPSDENETRQLLHTGLVHEGPAAVRYPRGSGSGVEIDPLLHTLPLGKGRVVRERERKSASGRIAILNFGALLPRALKAAQALDATVADMRFVKPLDEDLIRQLAEQHDLLVTLEENAIAGGAGSAVCEWLNQEEITMPVLQLGLPDKFVDHGSRNQLLEECGLDAATIERIITGRVQRLVSQSGIAAQSS

SEQ ID NO: 12452 - protein, 204 aa, Marinobacter sp. ELB17
MAVRYIETCRLPTPFGVFEMHGFEEPDTGKEHVALTLGDLAGEEPMLARTHSECLTGDALYSMRCDCGYQLEEALRSIAREGRGILMYLRQEGRGIGLLNKIRAYNLQDQGADTVEANERLGFAADLRDYSMCKDMLEHLGIKRLRLMTNNPRKVKALSSYGIDVVERVELHVGRNPHNEHYLDTKQSKLGHFLAIHQDDDPQL

SEQ ID NO: 12453 - protein, 199 aa, Triticum aestivum
  misc_feature (140)..(140): Xaa can be any naturally occurring amino acid
  misc_feature (160)..(160): Xaa can be any naturally occurring amino acid
IFVLVYCTAGVSGGHINPAVTFGLFLARKVSLIRALLYIIAQCLGAICGVGLVKGFQSSYYVRYGGGANELSAGYSKGTGLAAEIIGTFVLVYTVFSATDSKRNARDSHVPVLAPLPIGFTVFMVHLATIPITGTGINPXARSLGAAVIYNGDKAWSDQXWIFWVGPFIGAAIRSALPPRPSSAPTPRGYGSFPLATPS

SEQ ID NO: 12454 - protein, 167 aa, Brassica napus
PTRPGTVVGCIVTPLSFFLFYRAFDVGNPNGEFKAPYALIYRNMAILGVQGFSALPLHCLQMCYGFFGFAVLVSVVRDIAPAKVGRFMPLPTAMAVPFLVGAYFAIDMCVGTLVVFIWEKRNRRKAEVMVPAVASGLICGEGLWTLPAAILALAGVKPPICMKFLAS

SEQ ID NO: 12455 - protein, 618 aa, Chlamydomonas reinhardtii
MAPPAPAPPPATGRLTDYELQYIDKGSFGAVFKAVRKSDGRVYALKQVDLRSADFKNPTLDRAAAIDEARMLAQLNHPHVIRHFESFVDGEGKLNILMEYASKGSVRQLVKSYRGRPLPEEGVWRIFIQTLIGLSYLHSKKIIHRDIKSANLFIDAYDNIKIGDFGIARSLGASSNLAQTILGTPYYMAPELCQDKPYDAKSDVWALGVVMYECCMGHYPFDVENNNQVALIRKIARGVFKPVSGPYTQQLIQLITSCLTLDPRQRPDTTALLRNPSLVAKAGALKIDLNPQPASAKEDKPVYEQRGGVATAPPPQQQVGTPPRGVPGPPEHPFASPHGGGGGAPPPYPAQPSPHSPYPYQQGQIPYLPHQRPGSGRSPGPGPGDHPFSLPGGQQAPPYGAYPSPQHQQPPQQQQGGYGGGYSPPQPYGHQQQQPSPRGSPYAQQQRGYNGYGGDPYDQLAGDINRMHLRESEVARNNVERAQQVQANAHAGRMDHAKGVIYGGPQDSGPRPQRVAPEALPAAGARPTSAHAGAPFATHYPGGGSQLQTHAQASMNEAWRATYQAPQYGRRRNPELQITGPSLRSTSARGAGGGGGYARAADDATSYVSSTSYYTSAK

SEQ ID NO: 12456 - protein, 455 aa, Cryptococcus neoformans var. neoformans JEC21
MIRTSSRAIASSSTAALRRSSLRSISLARNVSKTQISRTALQPRANIVFRSSFHSSSLLLAETVKVPQMAESITEGTLKQWSKQVGDFVKQDEEIATIETDKIDVSVNAPVSGTITELLAEEESTVTVGQDLLKIEPGEGGAQSSESKPQAKSEPKNAEEGNKDEAAPAAGKEKGAGEEALAKHEEKAPKLDKAEAEKPAPKKQEKPSPKQEPQPEKAVGSRNETRVKMSRMRQTIAQRLKASQNAAASLTTFNEIDMSSLMEFRKLYKDGVLKNEGVKLGFMSAFAKASCLALKEIPAANASIEGDSIVYRDYVDLSVAVATPKGLVTPIVRNAESMGLVEIEKAIADLGKKARDNKLSIEDMSGGTFTISNGGVFGSLYGTPIINLPQAAVLGMHTIKEKPVVVNGQIVIRPIMVVALTYDHRLLDGREAVTFLVRIKEYIEDSRRMLLPSPI

SEQ ID NO: 12457 - protein, 610 aa, Arabidopsis thaliana
MGNTCVGPSRNGFLQSVSAAMWRPRDGDDSASMSNGDIASEAVSGELRSRLSDEVQNKPPEQVTMPKPGTDVETKDREIRTESKPETLEEISLESKPETKQETKSETKPESKPDPPAKPKKPKHMKRVSSAGLRTESVLQRKTENFKEFYSLGRKLGQGQFGTTFLCVEKTTGKEFACKSIAKRKLLTDEDVEDVRREIQIMHHLAGHPNVISIKGAYEDVVAVHLVMECCAGGELFDRIIQRGHYTERKAAELTRTIVGVVEACHSLGVMHRDLKPENFLFVSKHEDSLLKTIDFGLSMFFKPDDVFTDVVGSPYYVAPEVLRKRYGPEADVWSAGVIVYILLSGVPPFWAETEQGIFEQVLHGDLDFSSDPWPSISESAKDLVRKMLVRDPKKRLTAHQVLCHPWVQVDGVAPDKPLDSAVLSRMKQFSAMNKFKKMALRVIAESLSEEEIAGLKEMFNMIDADKSGQITFEELKAGLKRVGANLKESEILDLMQAADVDNSGTIDYKEFIAATLHLNKIEREDHLFAAFTYFDKDGSGYITPDELQQACEEFGVEDVRIEELMRDVDQDNDGRIDYNEFVAMMQKGSITGGPVKMGLEKSFSIALKL

SEQ ID NO: 12458 - protein, 175 aa, Triticum aestivum
MAPTLMASSATSVALFQGHKSTAGLPVSRRSNGASLGSVSNGGRIRCMQVWPIEGIKKFETLSYLPPLSTEALLKQVDYLIRSKWVPCLEFSKVGFIFREHNASPGYYDGRYWTMWKLPMFGCTDATQVINEVEEVKKEYPDAYVRIIGFDNMPQVQCVSFIAFKKTAPQPPGKA

SEQ ID NO: 12459 - protein, 501 aa, Myxococcus xanthus DK 1622
MTFDDLQLHDTLLRAVKAEGYTTPTPIQQKAIPHALAGRDVLGVAQTGTGKTAAFALPILQRLSAKAPAGGARPVRCLVLTPTRELAGQVGDSFGTYGKGLPLRHAVIFGGVGQNPQVQTLRNGVDVLVATPGRLLDLMEQGFVSLRSLEVFVLDEADRMLDMGFIHDVRRVIKALPPKRQTLFFSATLPPDIVDLARSILTDPIRVEVTPASSTAETVSQQVYFVEREQKRGLLTHLLKEGNIHRALVFTRTKHGANRVAKQLEGAGVSSAAIHGNKSQNARERALDEFRSGTLRVLVATDIAARGIDIDGLSYVVNYDLPNVPEQYVHRIGRTGRAGASGTAVSFCDAEERAYLRDIERTIRRNVPVVEDHPYRSGQPAPRPVSHASGAAPEARPSGNGGRPQGTPRPAGNGGGGGHSAGASRRRRGGRGGAGGGGRGQGRPEGGRSAQGSGGSGGNASRGGQGGSRGSGGGRPAVAQAPAKAPEASPLPPRRPSPKWF

SEQ ID NO: 12460 - protein, 377 aa, Shewanella sp. MR-7
MLPAPHFSAFNPPRRILMGPGPSDVYPEVLAAQARPTVGHLDPLFVGMMDELKSLIQYAFQTKNEMTMAVSAPGSAGMETCFVNLVEPGEKVIVCRNGVFGERMRQNVERVGAIAVVVDNEWGTPVDPAAVEAALKANPDAKFLAFVHAETSTGALSDAKTLCALAKQYGCLSIVDAVTSLGGVELRVDEWGIDAIYSGSQKCLSCVPGLSPVSFSPAAVEKLKNRKTLVQSWFLDQSLVMAYWTSAGGKRSYHHTAPVNALYALHESLRLLAEEGLEQAWQRHKEMHLVLRAGLEKLGLKFVVAEASRLPQLNAIYIPEGVDDAAVRARLLKDYNLEIGAGLGALAGKAWRIGLMGFGARRENVALCLRALEEVLN

SEQ ID NO: 12461 - protein, 557 aa, Shewanella sp. MR-7
MLSLASSQTEQAEAQSSQVQSSQVQSDKAQSGTSALEKSQLAQSYLQKILLSSVYDVAKVTPLSSLNKLSARLGCQVFLKREDMQPVHSFKLRGAYNRIAQLSQAECQRGVVCASAGNHAQGVAMSAASRGVDAVIVMPETTPDIKVDAVRRLGGNVVLHGQAFDQANGFAMEMAEQEGRVYIAPFDDEAVIAGQGTIAQEMLQQQRDLEVVFVPVGGGGLIAGIAAYYKAVMPQVKIVGVEPEDAACLKAAMEAGEPVTLPQVGLFADGVAVKRIGTEPFRLAKWFVDEVVTVTSDEICAAVKDIFEDTRAIAEPAGALSLAGLKKYVSTNAAGESGKGEKVAAILSGANVNFHSLRYVSERCELGEQKEAVLAVKVPERPGSFLRFCELLEKRVMTEFNYRFSSRDMAVVFAGIRLTKGHGELEQIINTLEDNGFEVQDLSGDETAKLHVRYMVGGHPPEPLEERLFSFEFPEHPGALLKFLTTLQSKWNISLFHYRNHGAAFGRVLAGFEVPEGDALPFQQFLTELGFVYQEETQSPAYQLFLNAGKGKKNLPL

SEQ ID NO: 12462 - protein, 332 aa, Shewanella oneidensis MR-1
MSDLPNDYAHIHIEQPGAPEVMQLSRSSLPVVGAGQVLIRVSAAGVNGPDLKQRAGAYPPPPGASLILGLEVAGEICALGEGVTQWQLGDKVCALVPGGGYGEYTLTYAAHCLPIPKGFSMVQAAALPETFFTVWGNLFMRAGLKAGETVLIHGGSGGIGSTAIALANRLGAKVIATTGQDEKRDYCLGLGADLVVNYNSQNFVEEVMSFTQGKGVNVVFDIAGGDFINLNLQSLALDGRMVSVSTQRSPKAEVNILQLMAKRIVWTGSTLRPQTVEAKAEIARQLRERVWPLLDSQQIVPHIFATYPLIDAPKAHRLMQSGEHRGKVVLTL

SEQ ID NO: 12463 - protein, 1104 aa, Solibacter usitatus Ellin6076
MSFFTARRTSLSIFLLGAALPGFGQTLSNHYALILKDPPVSARFVGREAVRSTAAESYRQQILRTHDAVRQAVAARAIPVTGTADVVMNAVFVLASPDRVADLQQIPEVLAVIPMRVVHPMLNRALGLQNAPAAWTALGGQGSAGAGMKVGVIDYGIDQTHPALQDSSLSMPSGFPKCTDGHPEDCSYTNTKVIVARSYTRITGAGSNPSNPAADSRPDDYSPRDREGHGTAIASVIAGNAAKGVVTITGMAPKAWLGNYKVFGSPNVNDYPTEAVFIQAVNDAVKDGMDVVNISSAVTATTAATDTGAACGLSSGAPCDPMGLAYENAVKAGVVVVAAAGNSGYDGTSYPSFNTIGTPANAPSVIAVGAVTNAHYFTPTVTVAGGPSNLQNIAGQPGDDPYSPVGAITAPVIDVTTLGDDGYGCSPFPAGSLTGAFALIQRNPVGSSTVCNFATKVDNAFDAGAFGVILYMSDSSAVIPPGNLDNNGIPVVMISQSDGVALKAYIKSNPTAQVTIDPSGAEVADTADSNLLSYYSSMGPSAGDSTVKPDMVAVGTDIYMAAQSYDPAGGQYSTTRYADASGTSFAAPMVAGAAALVKQKHPSWNPAQIRSALINSASQDVTQDDSGDTIDVQWVGSGKLDAGAAVNATVVANPPTVSYGVLAGAPSNVARQITITNMGTGSVTLTAAVVPGPKSFTGNLTSGLTPTLDKTSLTLAAGAAGTLNLTINGALPAAGSYSGAVTVKGTGASLSIPYLYLVGGGAATGYNLVFVGSGGFEGIVGQQPVDPLYPLRPHGIGVKLTDAAGVPVAGSPVSWSVRPRGAVTFQNSATVTDAYGIAATDVTILTTGNITVTCTIAGQAYTFGGYGFNQPTISNGGVVNDANFQTPIAPGSYVAVFGTGLSLYSDPAVYSPLPLSVDGVNVSFDVPSAGLSYPGRIVYVSPGQINVQVPWELQGQSSAQVKVIIDQTVFGNVVTVPLADAAPAFFENTGIAAALDQNYAIVTANNPAKRGQLVQLYMNALGPLNNQPASGDPASGTTLATTKNQPKVTIGGQDAPVQFSGLAPGFPGLYQVNVTVPAGISAGTAQISLSIGGVTTKASTLPVQ

SEQ ID NO: 12464 - protein, 391 aa, Xylella fastidiosa 9a5c
MTIEVKVPVLPESVSDATIASWHKKAGEIVKRDENIVDLETDKVVLEVPSPVDGVLKEIKFDTGSTVTSNQVLAIIEEGSIVAAPSPAPSPVIDQKPVAVSAPAAKSSVDSLPPGARFTATTEGIDPAQIEGSGRRGAVTKEDIINFAKQNGAARASGTRLEERVPMTRIRQRIAERLMQSKNSTAMLTTFNEINLAKVSNIRKELQEEFQKAHGIKLGFMSFFVKAAANALQRFPLVNASIDGTDIIYHGYSDISIAVSTDKGLVTPVLRNVERMSFADIEHHIADYAKKARDGKLSLEELQGGTFTVTNGGTFGSLLSTPIVNPPQSAILGMHTIKERPIAENGHIVIAPMMYVALSYDHRIIDGKDSVQFLVDIKNQLEAPGRMLFGL

SEQ ID NO: 12465 - protein, 564 aa, Rhodococcus sp. RHA1
MVSSATGTWPVFGSLQEYRKGWVRPDVIAGLTVWAVLVPEALAYATIAGVPPVVGLYAAIPALVLYAAAGSSRHLVVGPMSATAALSAAIVAPLAGADGGKYAALTAVLAIATGIAGLLAGLLRMGFIAAFISEPVLKGFIVGLALTIIAGQVPALLGVEKEHGNFFEQAWGVITQLGDVDWGTFVVGVLSLVVVLGFTRWLPLVPGSLLAVLLGIAAVAVFGLDGRGVDIVGHIDSGLPSVGLPGGVGFDDYVDLLGPAVGVLLIGFAEGLGAAKTYAAKEGYEVDPNRELLGLGVANLGSGLCSGMVVNGSLSKTAVNGGAGAKSQVSGLLVAVLTVVTLLFLTGLFEKLPEATLAAVVIAAVIELVDISALRRLYGVWTERLGSIYGYAARADFAAALAAMVGVLVFDTLPGLVIGIGVSMLLLLYRSSRPHVAALAKEGSLWVDAERHPDLPTTPHVVVVRVEAGLFFANADHVKDRIEDLCTDDTRVVVIDAETSPFVDVSAAQMLVQLRDVLARSGIELRVARDIGQFRDTIRTSGSDATPVGLYPTVREALAEPDPQ

SEQ ID NO: 12466 - protein, 454 aa, Triticum aestivum
MPTANVRAAQPSADRRLSTLVRHLLPSSPRTSAATATSADSLQPFPTMASPSVFAGIAQGPEDPILGVTVAYNKDPSPVKVNLGVGAYRTEEGKPLVLNVVKRAEQMLIHNESRVKEYLPITGLADFNKLSAKLIFGADSPAIQENRVATVQCLSGTGSLRVGGEFLARHYHERTIYIPQPTWGNHPKVFTLAGLTARSYRYYDPATRGLDFQGLLEDLSSAPSGAIVLLHACAHNPTGVDPTLEQWEQIRQLMRSKALLPFFDSAYQGFASGSLDKDAQSVRMFVADGGELLMAQSYAKNMGLYGERVGALSIVCGSADIAVKVESQLKLVIRPMYSNPPLHGASIVATILKDSAMFDEWTVELKAMADRIISMREQLFDALKIRETPGDWSHIIKQIGMFTFTGLNSEQVAFMRQEYHIYMTSDGRISMAGLSSRTVPHLADAIHAAVTKLK

SEQ ID NO: 12467 - protein, 559 aa, Pseudomonas aeruginosa UCBPP-PA14
MGARALRRERRLLWSPNWTRILPMQPQKTLTAGQALVRLLANYGVDTVFGIPGVHTLELYRGLPGSGIRHVLTRHEQGAGFMADGYARVSGKPGVCFVITGPGVTNVATAIGQAYADSVPLLVISSVNHSASLGKGWGCLHETQDQRAMTAPITAFSALALSPEQLPELIARAYAVFDSERPRPVHISIPLDVLAAPVAHDWSAAVARRPGRGVPCSEALRAAAERLAAARRPMLIAGGGALAAGEALAALSERLAAPLFTSVAGKGLLPPDAPLNAGASLCVAPGWEMIAEADLVLAVGTEMADTDFWRERLPLSGELIRVDIDPRKFNDFYPSAVALRGDARQTLEALLARLPQEARDAAPAAARVARLRAEIRAAHAPLQALHQAILDRIAAALPADAFVSTDMTQLAYTGNYAFASRAPRSWLHPTGYGTLGYGLPAGIGAKLGAPQRPGLVLVGDGGFLYTAQELATASEELDSPLVVLLWNNDALGQIRDDMLGLDIEPVGVLPRNPDFALLGRAYGCAVRQPQDLDELERDLRAGFGQPGVTLIELRHACAR

SEQ ID NO: 12468 - protein, 573 aa, Burkholderia thailandensis E264
MKRTRRARRRTSARSARSDAPYSPAQPGRVPAAPPNLPICANPPRSRVVTLVRPIRAAMSGAGRPIEPQHETHMTQTDLVAVADTVRAFTKREFGIFIDGAMRAAHSPRRLDVYDPATGERLSRVPDADAHDVDAAVASAKRAFDARVWSGLRPADRERVLLKLADVLEAHAEELAQLETLNQGKSILVSRGVEVGATIEYVRYMAGWATKITGQTLDVSIPFPPGARYTAYTRKEPVGVVAAIVPWNFPLMIAVWKLVPALAAGCTVVLKPSPETPLTALRLAELALEAGVPAGVFNVVTGGRECGAALAGHPSVRKISFTGSTATGKLVGAAAVQNMTRFSLELGGKNPIVMLDDVDVDAALGGVAAGAFFNQGQVCAAASRIYVHRSKFRRLAQGLADVAAAMRLGPGLDPAAQINPLVSAHHRDKVVQHIEVARREGLTFLTGGTRADDLPGYFVRPAVIADAAHDSAIVRDEVFGPVVVVLPFDDPAEAVRLANASPYGLAASLWSNDLKAVMDLVPQIEAGTVWVNCHIPLDPSMPFGGYKQSGIGREFGQYAIEGFTETKSVCIAH

SEQ ID NO: 12469 - protein, 426 aa, Arabidopsis thaliana
MAKRVNTCKCVATPQEKIEYKTKVSRNSNMSKLQAGYLFPEIARRRSAHLLKYPDAQVISLGIGDTTEPIPEVITSAMAKKAHELSTIEGYSGYGAEQGAKPLRAAIAKTFYGGLGIGDDDVFVSDGAKCDISRLQVMFGSNVTIAVQDPSYPAYVDSSVIMGQTGQFNTDVQKYGNIEYMRCTPENGFFPDLSTVGRTDIIFFCSPNNPTGAAATREQLTQLVEFAKKNGSIIVYDSAYAMYMSDDNPRSIFEIPGAEEVAMETASFSKYAGFTGVRLGWTVIPKKLLYSDGFPVAKDFNRIICTCFNGASNISQAGALACLTPEGLEAMHKVIGFYKENTNIIIDTFTSLGYDVYGGKNAPYVWVHFPNQSSWDVFAEILEKTHVVTTPGSGFGPGGEGFVRVSAFGHRENILEACRRFKQLYK

SEQ ID NO: 12470 - protein, 421 aa, Rhodococcus sp. RHA1
MALVVQKYGGSSVATAERIRRVAERIVETKKAGNDVVVVVSAMGDTTDELLDLAQQVCPAPPAREMDMLLTSGERISNSLVAMAIHSLGAEARSFTGSQAGVITTGAHGNAKIIDVTPGRVRDALDEGSIVLVAGFQGVSQDSKDVTTLGRGGSDTTAVALAAALEADVCEIYTDVDGIFTADPRIVPDAQRLETVSFEEMLELAACGAKVLMLRCVEYARRYNVPVHVRSSYTTKPGTIVSGSMEDIPVEEAIITGVAHDRGESKITVVGLPDTPGYAAQVFRAVAEAEINIDMVLQNISKVETGKTDITFTLPTADGPRAVEKLTKLQGDIGFTQVLFDDHIGKVSLVGAGMKSHPGVTATFCEALAKAGVNIDLISTSEIRISVLVKDVELDKAVKAIHDAFGLGGDEEAVVHAGTGR

SEQ ID NO: 12471 - protein, 780 aa, Triticum aestivum
MSTNGGGAARPLGLGISPPKPAALLFLLLHCSLLAASATTDTILPGKGISGNETLVSKSGGFELGFFPPGPGIHYFLGVRFRNMAGNSPTFWLGDRVVITDLPAASLEIFGDSLYIKENGASLWWSPSPGGNVSSAAMAVLLDNGNLVVRDQGNSSLVLWQSFDYPGDAMLPGARLGLDQDTGKNVSLTFKSFSHNGSLSVDATRRNGFVLTTDGHANGGTFPDWMVSSQDNGSSLLLNHPETANGTEFLQFNLGQISLMRWSEQDPAANGTGGWVARWSFPSDCKSGGFFCGDFGACTGSGKCGCVDGFTPSYPIEWGLGYFVTGCSRSLPLSCESGGQTEHDDSFAPLDKLQGLPYNAQDEVAGTDEDCRAACRSKCYCIAYSYGHGCKLWYHNLYNLSLAARPPYTKIYLRMGSKLRNKKGLQTRGIVLLVTGFIGLASLVLISVLLWRFRRDSFGTGKFEVEGPLAVYSYGQIKKATMNFSDKIGEGGFGSVFRGTIPGSTAIAVKDLKVLGQAEKQFRTEVQTLGMIQHSNLVRLLGFCVKAKRRLLVYEYMRNGSLECHLFAEKSGLLSWNVRYQIALGIAKGLAYLHEECEDCIIHCDIKPENILLDAEFCPKIADFGMAKLLGREFNSALTTIRGTMGYLAPEWISGLPITKKADVYSFGIVLFEIISGRRSTEVVKFGNHRYFPVYAAAQVSEGEVLCLLDARLEGDANVKELDVTCRVACWCIQDEENDRPSMGQVVRMLEGVLDTEMPPIPASFQNLMEGDNSVIYSDF

SEQ ID NO: 12472 - protein, 227 aa, Zea mays
WTPAVRSGIFQNGRVRPRLTQGEVETMSALARTAPPLAGTIRRPSCALRPTASLSFAAASTTPRGRLGLGLSTAPAGSGRAARARAVPQRIVASSVGEIISRFEKKGFLLKGLKLFQCPKDLAQEHYKDLKDKPFFPKLIDYITSGPVVCMAWEGAGVVASARKLIGATNPLQAEPGTIRGDLAVQTGRNVVHGSDSPDNGKREIELWFKEGELCQWESVQAPWLIE

SEQ ID NO: 12473 - protein, 347 aa, Yarrowia lipolytica CLIB122
MTTTRVCIDSSVALKIVRHCQESAPSIVAGQLLGLDVDGELRISHAFAFPQNAAGGNPNSDDGLSLRLKAVAKYQPEMIDHLKEVNVDSNSVGWYQSTVLGRIYNASVIENLAVFQEKNPDSVVLVYDVAGSEVVSDTDPSSTGPQGHTTTTPSGFNLRAFRLSEEYLNVRKSGKFDTATLTENNLTYHDVLVELPVEIKNSNLATLLLYQLGQQYPNSPFAESSFSNLNVSVDPFLEKNIEAIFDSVDDFHYDQGNYNYYQRQMTREQAKITQWQQKRKAENAAREKDGRPALPTDEWKRLFKLPTEPSRQDNLLISAQLNEHCSVIEEFGAAVNSKLFATQGGLL

SEQ ID NO: 12474 - protein, 351 aa, Ostreococcus tauri
MITGAQGVRQTRSKTTYEVPQQQQQQSFEWGRTSQRTSHGKPRRGSVMGGTMTTAGADVDMRESYSTYLERSSAADVMTDALPDIDLYDHDNPLAVTQYVNDIYQYWYKVEPDTRVSETYMLIQGDINYKMRAILIDWLVEVHLKFKLMPETLFLTTNLIDRFLELKTVTRRNLQLVGVTAMLVASKYEEIWAPEVRDFVYISDRAYTRQQILEMEKQMLNTLGFHLTVPTPYCFLNRFFKAAGGDRQFQLYASYAVECALPEYGMLKYSGSTLAAAGVYIAIRGLQTGSWNHTMEAHTRLSESEVYPCACDMAELMRKAPTATLTAVYKKYSSEKFMKIATLPVPHDLRL

SEQ ID NO: 12475 - protein, 112 aa, Glycine max
  misc_feature (44)..(44): Xaa can be any naturally occurring amino acid
  misc_feature (61)..(61): Xaa can be any naturally occurring amino acid
  misc_feature (75)..(75): Xaa can be any naturally occurring amino acid
FFGPPRFPFKSFCPKTLGTPPPKGLFILGTVLWGFFEFEKFCGXGLDAIARQWAELTGKGXVTTIIGGGDSVAAXEKAGLADKMSHISTGGGASLELLEGKPLPGVLALDEA

SEQ ID NO: 12476 - protein, 78 aa, Magnetospirillum magnetotacticum MS-1
MSDIAERVKKIVVEHLGVEPEKVTEASNFIDDLGADSLDTVELVMAFEEEFNVEIPDDAAETIQTVGDAIKFLEKNSA

SEQ ID NO: 12477 - protein, 427 aa, Thermobifida fusca YX
MASIEAVHAREILDSRGNPTVEVEVALDDGTIARAAVPSGASTGQFEAVELRDGGDRYGGKGVEKAVAAVNEEISEQIVGYEAEEQRLVDSALITLDGTPDKSRLGANAILGVSLAVAKAAAESADLPLFRYLGGPNAHVLPVPMMNILNGGAHADTNVDIQEFMIAPIGAESFREALRWGAEVYHSLKAVLKAHGLATGVGDEGGFAPNLDSNRAALDLISEAITKAGFTLGQDIALALDVAATEFYADGAYQFEGSSRSAEEMAAYYTELVESYPLVSIEDPLSEEDWAGWKALTESLGDRLQLVGDDLFVTNPERLQRGIDEGAANSLLVKVNQIGTLSETLDAVSLAQRNRYTAMISHRSGETEDTTIADIAVATNSGQIKTGAPARSERVAKYNQLLRIEEELDDAAVYAGANAFPRFARQG

SEQ ID NO: 12478 - protein, 274 aa, Pseudomonas putida GB-1
MQRLTTRNGLDLPAIGLGTWPMTGSECTQAVHQALDVGYRHIDTATAYENEAAVGQALRDSDVPREQIHLTTKVWWDRLEPKAMRQSLEDSLRALGTEQVDLFHIHWPGKDWDLARSIDTLVALRDEGKTRHIGVANFPLGLLRQVVETLGAPLSAIQVEYHVLLGQQPLLDYARSHDLLLTAYTPLARGQAAAQPVIQAIARKHGVLPSQVALKWLLDQDGVAAIPKASSRENQLANLAALNVQLDEDDRAAIAGLPKDQRVVSPAFAPDWNS

SEQ ID NO: 12479 - protein, 493 aa, Ralstonia solanacearum GMI1000
MALTFDQLRHTGLIRTDNLIDGRWSAGADGARYAVTDPATGSIIAQVADSSAADARAATDAAARALPAWRDTLPAERAAILRRWHAAIVANADALGRLISLEQGKPFAEGRGEVMYGASYVAWFADEATRIYGDLIPQQQRGKRMSAIKEPIGIVAAITPWNFPLAMIARKIAPALAAGCTVVAKPAEDTPLTALALAQLAQEAGLPPGVLNMIAASRERGVAAVADWLQDGRVRKITFTGSTPVGKHLARESAGTLKKLSLELGGNAPFIVFDDADLDAAIAGLLSAKFRNGGQTCVCPNRVYVQAGVYDRFAAMLAARVSALKVAPATDPDAQIGPMINARAVDKIERHVQDAVAHGARVLAGGKRLPEVGAHFYAPTVLADAHPGMALCGEETFGPVVPLFRFTDEAEAVQAANDTPFGLAAYFYSQDVRRIDRVAHALEAGIVGINEGALASEAAPFGGVKESGYGREGSKYGLDDYLSIKYLCQGGLA

SEQ ID NO: 12480 - protein, 361 aa, Ralstonia solanacearum GMI1000
MTRKTYRIAVIPGDGIGREVMPEGLRVLDAAARRFGIDLEYQHIEWASCDYYLQHGRMMPDDWKAQLQGADAILFGAVGWPATVPDHISLWGSLLKFRREFDQYINLRPVRLFEGVPCPLANRKPGDIDYYVVRENTEGEYTSLGGIMYEGTDREVVIQESVYSRKGAERLLKFAFDLARSRARKHVTLATKSNGIAISMPWWDARADEVATHYPEVTLDKQHIDILTARFVLQPGRFDVVAATNLFGDILSDLGPATTGTIGLAPSANLNPDRTFPSLFEPVHGSAPDIYGKNIANPIAMIWSAALMLDFLTEGQGAGRAAHDAIVAAIEAVLKGGPRTPDLGGSANTTQVGEAIASHLA

SEQ ID NO: 12481 - protein, 571 aa, Pseudomonas putida GB-1
MLSLSTRRIGYLRCCYGLCRNRSHRSVPPGQQGGFGLRDILLRLPDKTLQRAGRRAGRRLKIGPAPRWRRHPGVHVMSDIPLLPAVVEFLARPHGHFIEGRYQAGEAGPSVDIHDPSSGAVISRVAEASAAEVARAVRSARQAFKGSWAEVSPYQKGVVLNRLADLIEANAEELAQLETLCSGKSINLSRGLEIAQSVVFLRYFAGWASKITGQTMTPSLPSFGGERYTAFTLREPVGVVAGIVPWNFSVMIGIWKIASALVTGCTIVVKPSEFTPLTLLRIAELAVEAGVPAGAFNVVNGRGQAGQMLIEHPEVAKVAFTGSVPTGIAVGKAAMAANLTRATLELGGKNAAALLADVDVDGAVAGIVQTAYVHQGQVCASPERLYVHRSRVDEFTGKLAAALGQLKIGSALDPDAQFGPLANATHLQKILGFFERAHASNTVVCGAKAVERPGYFVEPTVVLANDARDPLLHEETFGPIVCILPFDDEAQLLEMMNDSPYGLTASLWTNDLSKALRLIPQIEAGTVWVNMHTFLDPAVPFGGTKASGVGREFGSAFIEDYTELKSVMIRY

SEQ ID NO: 12482 - protein, 193 aa, Lactuca sativa
MATDGAAVDVGGEVAEQPHRLDKKWTFWFDNQSKPKQGAGWGNNLRNGYTFDTVEEFWCLYDQVFKPSKLPGNADFHLFKAGIEPKWEDPECANGGKWTVTSSRKANLETMWFETLMALIGEQFDEADEICGVVASVRQRQDKLSLWTKNAANEAAQMSIGRKWKEIIDVTDKITYNFHDDSKTRTSKGRYSV

SEQ ID NO: 12483 - protein, 168 aa, Magnaporthe grisea 70-15
MAALKVGDAFPDGVSFTYVPTGGKKEDVTACGNGIKYNASTEAKDKKIVIVSVPGAFTPTCQEQHLKSYVEKKDELKAKGVDKVVFIAYNDHWVMSAWGKANDIYDDFIIFASDDGISFSKSIGWNLGDSGRTARYAIVVDHGKVTYAEKEEAGGIAVSGAEAVLAKL

SEQ ID NO: 12484 - protein, 371 aa, Zea mays
IAAAYRCTYSTVHNTRARADELIKTAKCLATPGKGILASDESTGTIGKRLSSINLENVESNRQALRELLFTAPGVFDYLSGVILFEETLYQKTSDGKPFVDVLIAGGVVPGIKVDKGTVEIAGTDGETTTQGLDSLGARCAKYYEAGARFAKWRAVLKVGPAGQGQPSELAVRQNAEGLARYALICQENGLVPIVEPEILTDGGHDIGTCAAATERVLAALYKSLSDHKVLLEATLLKTNMVTPGSDSPKVSAEVIAEYTVAALRRTVPPAVPGVVFLSGGQSEEEATQNLDAMNKLEVLKPWTLSFSFGRALQQSTLKKWVGKKENVAAAQATFVVRCKANSEAALGKYAGSGAGDAAASESLYVKGYKY

SEQ ID NO: 12485 - protein, 284 aa, Solibacter usitatus Ellin6076
MRRRTEVIAFQGERGAFSEEATRKLCGADIEVLPCVRFEDLFRGLKEGRATGAIVPIENTLAGSVHENYDHLVNFELPIVAETNVRIVHNLIALKGVKFSQIKRVYSHPVALNQCLDFFAKNPGVERTPFYDTAGSVKMIQEEGLTDAAGIASAVAAEIYDAHILRRSIESDRQNFTRFFLLRTPEYARRNPVQVPQGTQWKTSLVFSTRNIPGALFRALSAFALRDLNLMKIESRPLRGKPWEYLFYLDFLGRFDSPVAQNALNHLRETADFLRILGCYPKGA

SEQ ID NO: 12486 - protein, 161 aa, Zea mays
TIIARSSLGLATPVLLTATASRSSCSASLALLLCCCTCKSATAHREMSTESRASLDQKLALAKRCSREATLAGAKAAAVATIASAIPTLASVRMLPWGKGNINPTGQALIVSTVAGMAYFIAADKKILSLARRHSFEQAPEHLKNTSFQGTGRPHPAFFRP

SEQ ID NO: 12487 - protein, 499 aa, Clarkia lingulata
  misc_feature (291)..(296): Xaa can be any naturally occurring amino acid
MASPALISETEAWKDLKAHLEGIKMTHLRELMGDTERCQSMMVEFDNIFLDYSRQQASPDTISKLYKLADAAHLKQKIDRMYNGDHINTTENRSVLHVALRAPRNSAICSDGKNVVPDVWNVLDKIKDFSDRVRNGSWIGATGKELKDVIAVGIGGSFLGPLFVHTALQTDPEASKNARGRELRFLANVDPIDVARNISGLNPETTLVVVVSKTFTTAETMLNARTLREWISSALGPSAVAKHMVAVSTNLPLVEKFGIDPNNAFAFWDWVGGRYSVCSAVGVLPLSLQYXXXXXXKFLQGAHSIDQHFSSAPFEKNIPVLLGLLSVWNVSFLGYPARAILPYSQALEKLAPHIQQVSMESNGKGVSIDGLPLPFESGEIDFGEPGTNGQHSFYQLIHQGRVIPCDFIGVVKSQQPVYLKGEVVNNHDELMSNFFAQPDALAYGKTPEQLKKENVSEHLIPHKTFTGNRPSVSILLPTLDAYRIGQLLAIYEHRVAVQG

SEQ ID NO: 12488 - protein, 499 aa, Clarkia lingulata
  misc_feature (291)..(296): Xaa can be any naturally occurring amino acid
MATPALISDTEAWKDLKAHLEGIKHTHLRELMGDTERCQSMMVEFDNIFLDYSRQQASPDTINKLYKLAEAAHLKQKIDSMYNGDHINSTEHRSVLHVTLRAPRNSAICSDGKNVVPDVWNVLDKIKDFSERVRNGSWVGATGKELKNVIAVGIGGSFLGPLFVHTALQTDPEASKNARGRELRFLANVDPIDAARNISGLNPETTLVVVVSKTFTTAETMLNARTLREWISSALGVSAVAKHMVAVSTNLPLVEKFGIDPNNAFAFWDWVGGRYSVCSAVGVLPLSLQYXXXXXXKFLQGAHSIDQHFSSAPFEKNIPVLLGLLSVWNVSFLGYPARAILPYSQALEKLAPHIQQVSMESNGKGVSIDGLPLPFESGEIDFGEPGTNGQHSFYQLIHQGRVIPCDFIGVVKSQQPVYLKGEVVNNHDELMSNFFAQPDALAYGKTPEQLKKENVSEHLIPHKTFTGNRPSLSILLPTLDAYRIGQLLAIYEHRVAVQG

SEQ ID NO: 12489 - protein, 605 aa, Burkholderia thailandensis E264
MIERGRAARGRNAARRGGGGEAWRRWLPGVATLRAYPRAWLARDLYAGVALTAVLVPVGMSYAQAAGLPVIAGLNATIAALLGYAIFGPSRILVLGPDSALTALIAGAIAPLAHGEPAHAVALAAALALMSGGFCVLAGLLKLGFVTDLLSKPIQYGYLNGLALTLIASQLPGLLGATPPGGAFVDEVAGIAATIAHGRIDFASLALGGGCLAGIVLLRRVAPAWPGMLIAVAGASIVAAWLGAAPDAAGANAHVANAHVANAHIALVGSLAGTLPPFGLPPISLADASRLVAGALAIALVSVADISVLSRVFAQNDGSETDRNQELIALGAANLLAGALRGCAVTSSSSRTPVALAAGARTQLTSVVAAACIALLLVAPTLLARVPLAALAAVVVYSAHALVDVRAIVRLYRVRRGECAVSVLCFAGVVLLGVVPGILLAVGLSLLSFVWRAWHPYDAVLGRVEGMHGYHDVSRHPEARRTPGLVAFRWDAPLFHANATIFRDHVRDAIAGAEAPVRCVVIAAEPITDVDVTAADMLATLRDELAERRIALVFAEMKGPVKDRLRTYGLFDKIGADHFFPTVTDAIAHFAQARKDAAAVRRARR

SEQ ID NO: 12490 - protein, 434 aa, Rickettsia typhi str. Wilmington
MNITFIGSGYVGLVSGIIMGYLGHNVTCFDNDDVKISKLNKKILPIYEAKLDEYLKQALESDRLKFTNIYSNDFRNVDAVFITVGTPSKELGEADLKYVYDAVDKVSKHINKDCLIVIKSTVPPGSCNNIIAYLKAKGFSFNVASNPEFLREGSAVEDFLYPDRIVVGVNNQESEALLRTIYAPLIEQGVKFLVTNLVTSELIKYASNSFLATKIAFINEMADLCEKIGANIKDLSQGVGLDQRIGRNFLNAGPGFGGSCFPKDILALNNLVENYKIDCKILKSVIKSNKLRPGNMVAKIATLLDGDLKGRNIAILGLTYKAGTDDVRASPAIEIITILLNKDVYVKAFDPIGLENAKKNLEHKNLLYFASAVEACESVDIIVIATEWSEFKELNWQEIYDLVKSPMIIDLRNILDNEVMKKIGFRYYAVGSKI

SEQ ID NO: 12491 - protein, 189 aa, Triticum aestivum
MAPTVMASSVTSVVPFQGLKSTAGLPVSRRSNGASLGSVSNGGRIRCMQVWPIEGIKKFETLSYLPPLSTEALLKQVDYRIRSKWVPCLEFSKVGFIFREHNASPGYYDGRYWTMWKLPMSGCTDATQVINEVEEVKKEYPDAYVRIIGFDNMRQVQCVSFIDFKPPGCEESGKAYTDHSAWATYKVLL

SEQ ID NO: 12492 - protein, 172 aa, Synechococcus sp. WH 8102
MAPLTSASAPWPAAQIHPGAWVSTSAVVIGNVTMQEGSSLWPTAVARGDCAEIRIGARSNVQDGAVLHGDPGQPVLIGVDVTVGHRAVIHGATLSDGCLVGIGAIVLNGVTVGEGALVAAGAVVTKDVPARSLVMGAPAQLKRELSAEAVEDQRSHAHSYAELARQHAQAGG

SEQ ID NO: 12493 - protein, 561 aa, uncultured bacterium
MTHLKITGMTCDSCAAHVKEALEKVPGVQSALVSYPKGTAQLAIVPGTSPDALTAAVAGLGYKATLADAPLADNRVGLLDKVRGWMAAAEKHSGNEPPVQVAVIGSGGAAMAAALKAVEQGAQVTLIERGTIGGTCVNVGCVPSKIMIRAAHIAHLRRESPFDGGIAATVPTIDRSKLLAQQQARVDELRHAKYEGILGGNPAITVVHGEARFKDDQSLTVRLNEGGERVVMFDRCLVATGASPAVPPIPGLKESPYWTSTEALASDTIPERLAVIGSSVVALELAQAFARLGSKVTVLARNTLFFREDPAIGEAVTAAFRAEGIEVLEHTQASQVAHMDGEFVLTTTHGELRADKLLVATGRTPNTRSLALDAAGVTVNAQGAIAIDQGMRTSNPNIYAAGDCTDQPQFVYVAAAAGTRAAINMTGGDAALDLTAMPAVVFTDPQVATVGYSEAEAHHDGIETDSRTLTLDNVPRALANFDTRGFIKLVIEEGSHRLIGVQAVAPEAGELIQTAALAIRNRMTVQELADQLFPYLTMVEGLKLAAQTFNKDVKQLSCCAG

SEQ ID NO: 12494 - protein, 429 aa, Ralstonia eutropha JMP134
MSAIVDIIGREVLDSRGNPTVECDVLLESGVMGRAAVPSGASTGSREAIELRDGDKSRYLGKGVLKAVEHINTEISEAIMGLDASEQAFLDRTLIDLDGTENKSRLGANAMLAVSMAVAKAAAEEAGLPLYRYFGGSGAMQMPVPMMNIVNGGAHANNSLDIQEFMVMPVSATSFREALRCGAEVFHALKKILADKGMSTAVGDEGGFAPNFSSNEECLNTIVQAVEKAGYRMGEDVLLALDCAASEFYHEAEDVYVLEGEGLKLSSTQFADYLANLCDKFPIVSIEDGMAEGDWDGWKTLTDKLGKRVQLVGDDLFVTNTKILKEGIDKGIGNSILIKINQIGTLTETFAAIEMAKRAGYTAVISHRSGETEDSTIADIAVGTNAGQIKTGSLSRSDRISKYNQLLRIEEDLGDIASYPGKSAFYNLR

SEQ ID NO: 12495 - protein, 48 aa, Glycine max
SMLSSATMVASPAQATMVAPFNGLKSSAAFPATRKANNDITSITSNGG

SEQ ID NO: 12496 - protein, 455 aa, Thermobifida fusca YX
MRVSNSLIELVGNTPLVRLKKVTAGLAPTVLAKVEYFNPGGSVKDRIALRMVEDAERRGLLKPGGTIVEPTSGNTGVGLAIVAAEKGYRCVFVCPDKVGADKLAVLRAYGAEVVVCPTTVAPDHPESYYSVSDRLAATIPGAWKPDQYSNPNNPESHYYSTGPEIWEQTEGRITHFVAGIGTGGTITGTGRYLKEVSNGRVKVIGADPEGSVYSGGTGRPYLVEGVGEDIWPATYDTKICDEIIAVSDKDSFLMTRRLAKEEALLVGGSCGLAVVAALKVAAQAGPDDVIVVLLPDGGRGYLGKIFNDEWMADYGFLEPETEEATAGQVLAAKDDSLPEFVHTHPHETVGTAIAIMREYGVSQLPVMKEEPPVMAAEVVGAIAERDLLDALFNGRAQLGDPVEQHMRPPLPVVGSGEPVSRCVELLQSSGAVVVLEDGKPSGILTRQDLLAHLAS

SEQ ID NO: 12497 - protein, 174 aa, Ralstonia eutropha JMP134
MALYQLGELVPNIDQDAYVAPEATIIGNVTMKSRASAWPGVVIRGDNEPIVVGVDTNIQEGSVLHVDPGCPLTLGDKVSIGHQAMLHGCTVGEGSLIGIQAVVLNRAVIGKECLVGAGAVVTEGKVFPDRSLILGAPAKVVRELTDQDVANLYRNAETYATRQAMYKQQLKRID

SEQ ID NO: 12498 - protein, 208 aa, Oryza sativa Japonica Group
MAAAEAAAEAAAALEGSEPVDLVKHPSGIIPTLQNIVSTVNLDCKLDLKAIALQARNAEYNPKRFAAVIMRIREPKTTALIFASGKMVCTGAKSEQQSKLAARKYARIIQKLGFAAKFKDFKIQNIVGSCDVKFPIRLEGLAYSHGAFSSYEPELFPGLIYRMKQPKIVLLIFVSGKIVLTGAKVRDETYTAFENIYPVLTEFRKVQQ

SEQ ID NO: 12499 - protein, 270 aa, Azoarcus evansii
MTTTLDPKRERTAAPLAGRHALVTGAGSGIGRACALELARLGATLTLVGRRGAALEATCAELEGDGHGLAVADITDFAAVRAAFDAAVAARGPIAILVNNAGAAKSAPFGRTDPELWSEMLAVNLTGTYHCTHAVLAGMQAAGWGRIVNVASTAGLVGYAYVAAYCAAKHGVVGLTRALALEVAKQGITVNAVCPGYTDTPLIEGAVDNIVAKTGRSTDDAKAALAARNPQGRLVQPEDVAATVGWLCLPSSDAIHGQSIAVAGGEVMCG

SEQ ID NO: 12500 - protein, 326 aa, Anaplasma marginale str. St. Maries
MKSQNVSKNGQGGAMSELNDGQFSGNSEWLRDVKVLSESLPYIQRFSGETFVIKYDGTAMKDANLAARFASDVVLLKQVGINPIVVHGGDYKVEEVLARFGRECTFVNGLRVMDVGTLEIAEMVLSGLVNKEVVQQINNAGGSAVGVSGKDACLVGAKKMCCTLRDGGPNNIEKIMDVGFLGEPSEVNTDLLFLLEESDFVPVISPVCSGTNGATYIVNPDLMAGAIASAMSAAKLVLLADAADCVKDAQGCLLREISSDGAEKLLQDEGMSANMLHKLQACIKFSRETCGTSHIVDCAIPHVLLLELFTTHGTGTTLCCEFRGEQ

SEQ ID NO: 12501 - protein, 205 aa, Anaplasma marginale str. St. Maries
MLSKCRFVAGVQDKHSLPDFQVPEVAFAGRSNVGKSSLINAVTKNKKGARVSSNPGSTRQINFYLNEGALALVDLPGYGYSKASKESASSYMSLVEHYLLTREALHRLVLLIDSKVGLKEVDMDFISWLEERCIHYSLVLTKIDRLACTEFNDVLSAVQSRVKGCCMLLHPIIGTSSKSGKGIKELVHEVSKCVKEWPGGRDVRA

SEQ ID NO: 12502 - protein, 499 aa, Clarkia heterandra
  misc_feature (221)..(231): Xaa can be any naturally occurring amino acid
MASPALISETEAWKDLKAHLEGIKMTHLRELMGDTERCQSMMVEFDNIFLDYSRQQASPDTISKLYKLADAAHLKQKIDRMYNGDHINSTENRSVLHVALRAPRNSAICSDGKNVVPDVWNVLDKIKNFSDRVRNGSWIGATGKELKDVIAVGIGGSFLGPLFVHTALQTDPEASKNARGRELRFLANVDPIDVARNISGLNPETTLVVVVSKTFTTAETXXXXXXXXXXXSSALGPSAVAKHMVAVSTNLPLVEKFGIDPNNAFAFWDWVGGRYSVCSAVGVLPLSLQYGFAVVEKFLQGAHSIDQHFSSAPFEKNIPVLLGLLSVWNVSFLGYPARAILPYSQALEKLAPHIQQVSMESNGKGVSIDGLPLPFESGEIDFGEPGTNGQHSFYQLIHQGRVIPCDFIGVMKSQQPVYLKGEVVNNHDELMSNFFAQPDALAYGKTPEQLKKENVSEHLIPHKTFTGNRPSISILLPTLDAYRIGQLLAIYEHRVAVQG

SEQ ID NO: 12503 - protein, 559 aa, Clarkia heterandra
MATPTLISETEAWKDLKAHLDGIKRTHLRELMGDTERCQSMMVEFDNIFLDYSRQQASPDTINKLYKLAEAAHLKQKIDRVYNGDHINSTENRSVLHVALRAPRNSAICSDGKNVVPDVWNVLDKIKDFSERVRNGSWVGATGKELKDVIAVGIGGSFLGPLFVHTALQTDPEASKNARGRELRFLANVDPIDAARNISGLNPETTLVVVVSKTFTTAETMLNARTLREWISSALGISAVAKHMVAVSTNLPLVEKFGIDPNNAFAFWDWVGGRYSVCSAVGVLPLSLQYGFAVVEKFLQGAHSIDQHFSSAPFEKNIPVLLGLLSVWNVSFLGYPARAILPYSQALEKLAPHIQQVSMESNGKGVSIDGLPLPFESGEIDFGEPGTNGQHSFYQLIHQGRVIPCDFIGVVKSQQPVYLKGEVVNNHDELMSNFFAQPDALAYGKTPEQLKKENVSEHLIPHKTFTGNRPSLSILLPTLDAYRIGQLLAIYEHRVAVQGFVWGINSFDQWGVELGKSLATQVRKQLHASRVKGEPVEEEGFNFSTKTLLTRYLQATSDV

SEQ ID NO: 12504 - protein, 380 aa, Clarkia dudleyana
MASPALISETEAWKDLKAHLEGIKTTHLRELMGDTERCQSMMVEFDNIFLDYSRQQASPDTISKLYKLADAAHLKQKIDRMYNGDHINSTENRSVLHVALRAPRNSAICSDGKNVVPDVWNVLDKIKDFSDRVRNGSWIGATGKELKDVIAVGIGGSFLGPLFVHTALQTDPEASKNARGRELRFLANVDPIDVARNISGLNPETTLVVVVSKTFTTAETMLNARTLREWISSALGPSSVAKHMVAVSTNIPLVEKFGIDPNNAFAFWDWVGGRYSVCSAVGVLPLSLQYGFAVVEKFLQGAHSIDQHFSSAPFEKNIPVLLGLLSVWNVSFLGYPARAILPYSQALEKLAPHIQQVSMESNGKGVSIDGLPLPFESGEI

SEQ ID NO: 12505 - protein, 406 aa, Oryza sativa Japonica Group
MEMAIDTPSPSPSASSAAAGRQTRAAESVRLEHQLLRVPLEALKSTVRTNHRLAEKEIAAVLSSAAAAPGGGGGGSGDAAAVDHLTSLVSRLHGLKRKMEEGARAEELQVQRCRARLNRLASASSGDDAEWEELRLKRILVDYMLRMSYYDTAANLAETSGIQDLVDVDVFLDAKRVIDSLQNKEIAPALAWCAENRSRLKKSKSKLEFFLRLQEFVELVKAKNFMHAIAYARKYLSPWGATHMKELQRVTATLVFRSSTNCAPYKVLFEQNQWDSLVDQFKQEFCKLYGMTLEPLLNIYMQAGLTALKTPFCFDGNCPKEDPLSLPGFRKLAEPLPFSKQHHSKLVCYITKELMDTENPPLVFPNGYVYSTKALDEMAKKNGGKVTCPRTGDICNYTDLVKAYIS

SEQ ID NO: 12506 - protein, 380 aa, Clarkia dudleyana
MATPSLISETEAWKDLKAHLEGIKRTHLRELMGDTERCQSMMVEFDNIFLDYSRQQAAPDTINKLYKLADAAHLKQKIDRMYNGDHINSTENRSVLHVALRAPRSSAICSDGKNVVPDVWNVLDKIKDFSERVRSGSWVGATGKELKDVIAVGIGGSFLGPLFAHTALQTDPEASKNARGRELRFLANVDPIDAARNISGLNPETTLVVVVSKTFTTAETMLNARTLREWISSALGVSAVAKHMVAVSTNLPLVEKFGIDPNNAFAFWDWVGGRYSVCSAVGVLPLSLQYGFAVVEKFLQGAHSIDQHFSSAPFEKNIPVLLGLLSVWNVSFLGYPARAILPYSQALEKLAPHIQQVSMESNGKGVSIDGLPLPFESGEI

SEQ ID NO: 12507 - protein, 474 aa, Parvularcula bermudensis HTCC2503
MNQGRISQVIGAVVDVEFDDQLPAIMNALHTDNNGSRLVLEVAQHLGQKTVRAIAMDSTEGLVRGHLVTDTGEPIMVPVGEATLGRIMNVIGEPIDEAGPIEAEGTRAIHQAAPPFVEQSTEAEVLVTGIKVVDLLCPYPRGGKIGLFGGAGVGKTVLIQELINNIAKVHGGYSVFAGVGERTREGNDLYWEMIESNVNVDPQKNGSAAGSKASLVYGQMNEPPGARARVALTGLTVAEHFRDQGQDVLFFVDNIFRFTQAGAEVSALLGRIPSAVGYQPTLATDMGALQERITTTTKGSITSIQAVYVPADDLTDPAPATSFAHLDATTTLNRSIAEKGIYPAVDPLDSTSRILDPRIVGEEHYEVARGVQNILQRYKSLQDIIAILGMDELSEEDKLTVARARKVERFLSQPFDVAEVFTGSPGVQVPLEETVRSFKGLIAGEYDHLPEQAFYMCGGIDDAIAKAEKMAEAA

SEQ ID NO: 12508 - protein, 380 aa, Clarkia dudleyana
MATPALISETEAWKDLKAHLEGIKRTHLRESMGDTERCQSMMVEFDNIFLDYSRQQASPDTINKLYKLADAAHLKQKIDRMYNGDHINSTENRSVLHVALRAPRNSAICSDGKNVVPDVWNVLDKIKDFSERVRNGSWVGATGKELKDVIAVGIGGSFLGPLFVHTALQTDPEASKNARGRELRFLANVDPIDAARNISGLNPETTLVVVVSKTFTTAETMLNARTLREWISSALGVSAVAKHMVAVSTNLPLVEKFGIDPNNAFAFWDWVGGRYSVCSAVGVLPLSLQYGFAVVEKFLQGAHSIDQHFSSAPFEKNIPVLLGLLSVWNVSFLGYPARAILPYSQALEKLAPHIQQVSMESNGKGVSIDGLPLPFESGEI

SEQ ID NO: 12509 - protein, 362 aa, Streptomyces coelicolor A3(2)
MAQEVRGVIAPGKDEPVRIETIVVPDPGPGEAVVKIQACGVCHTDLHYKQGGINDEFPFLLGHEAAGVVESVGAGVTDVAPGDFVILNWRAVCGKCRACRRGRPWYCFDTHNAEQRMTLASTGQELSPALGIGAFAEKTLVAAGQCTKVDPAVPAEVAGLLGCGVMAGIGAAINTGNVGRGDTVAVIGCGGVGDAAIAGSYLAGASKVIAVDIDDRKLETARTMGATHTVNSRGTDPVEAIRELTGGFGADVVIEAVGRPETYRQAFYARDLAGTVVLVGVPTPEMKLELPLLDVFGRGGSLKSSWYGDCLPSRDFPMLVDLHLQGRLDLGKFVTETIRLDEVEQAFDRMHAGDVLRSVVVL

SEQ ID NO: 12510 - protein, 238 aa, Oryza sativa Japonica Group
MAGGGGAGELKLLGHWASAYVTRVKLALHLKGVSYEYVEEDLRNKSDLLLASNPVHKTVPVLIHNGNPIRESQIIVQYIDEAFSGAGDSLLPADPHERAVARFWTAYIEDKLVAPWEKVFRAKTEEERAAWMKQMFVAVEALEGGLKECSKGKGCFFGGDSVGYVDVVLGGGVSFVHANDVITGGKLFDAAKTPLLAEWLGRFGELDAAKAVLQDVDRAVEYTKVLYARNAATTAANN

SEQ ID NO: 12511 - protein, 527 aa, Erythrobacter sp. NAP1
MLRYARNDEIEMGWEKELEELRQREAFADQMGGTDKVAKQHGRGKMDARARLDAICDPGSFREIGKIAGKGHYDENGDLTGVTPAPFLFGKATINGRPVVATADDFTIRGGAADAGIARKMVQAETMANELKLPIIRMIDGTGGGGSVKTLEQIGATYIPAVPGWGAVVENLDTVPVVALALGPTAGLGAARTVASHYSIMVRGLSQLFAAGPAVVDGLGAAYKSAEDHQQAKEELGGVDIHTRNGVVDDEVASEAEAFARARYFLSFMPEHVGQLARRAENTDPVDRREEALLSLVPRDPRQVYSMRQAMEMVLDQGTVFEIGKNWGRAAITAFARLDGWPVAVVASDPSYLGGSWEAKTSEKVERFVKLADQFRLPIVHLVDNPGFMIGREAEVAGTIRYGVQAMNAIYKASVPLASIVLRRAYGIAGSAMSNAERFQYRFCWPSGDWGSLPIAGGIEVAYKSELEASQDPEAELAAIRERLAKVTSPFRSAERFNVEDIIDPRDTRPLLCEFAQLAWRKLEAEA

SEQ ID NO: 12512 - protein, 339 aa, Bradyrhizobium sp. BTAi1
MLRLDKFKKYPLTFGATPIEHLPRLTAALGGKVQIYAKRDDCNSGLAMGGNKLRKLEYIVPDAIESNADTLVSIGGVQSNHTRMVAATAAKIGMKCVVVQESWVPHEDAVYDRVGNILMTRLMGADSRIVPDGFDIGIRKSWEDAIQSVKDAGGKPYGIPAGASVHKFGGLGYVGFAEEVRAQEAEMGIKFDYIIVCVVTGSTQAGMIVGFAADGRADRVIGIDASGTPEQTRTQVRQIVDNTAELVELGRKVRDDEIVILEDYAYPAYGVPSAETNEAIRLAARTEAMITDPVYEGKSMQGMIDLVKKGYFPEGSKVLYAHLGGAPAINGYSYTYRNG

SEQ ID NO: 12513 - protein, 167 aa, Ostreococcus tauri
MTVTLRSSDDETFVVDDDVALSETIKSIIEGARDGRDGVNGAKDGVRDADTEDESMVPLPNVSSKILAKVIEYAKFHVDAKKANEAEAKIKEFNTEFVKVDQATLFEIILAANYLNMKGLLDLTCMTVANMMKGKTPEEIRKTFNIKNDFTPEEEEEVRKENQWAFD

SEQ ID NO: 12514 - protein, 370 aa, Aspergillus nidulans FGSC A4
MFRQSVRRFATAALRSAAESPYNVRVSQAQGFVNGLTEAIGNTPLIRLKRLSEETGSNILAKAEFQNPGGSVKDRAALYVVKDAEERGLLKPGGTVVEGTAGNTGIGLAHVCRSKGYKLVIYMPNTQSQGKIDLLRLLGAEVYPVPAVAFDNPENYNHKARRHAESLDNAVWTNQFDNTANRRAHIETTGPEIWAQTGGKLDAFTCSTGTGGTLAGITYYLKQASGGRVKSFLADPPGSVLHSYIQSGGKLVERSGSSITEGIGQGRITDNLQPDVGTLDGSLNISDEKTIEMIYRCLDEEGLYLGASSALNVVAAKEVAEKLGKGSTVVTILADGAYRYADRLFSKSWLESKGLRNAIPKHLEKYIVLP

SEQ ID NO: 12515 - protein, 279 aa, Physcomitrella patens
MAKDVGVEPGFPSKDYTDPPPAPLIDASEFGQWSFYRAVIAEFVATLLFLYITIATVIGAVRNAGCDGVGLLGIAWAFGGMIFVLVYCTAGISGGHINPAVTFGLLLARKISLPRALAYMIAQCLGAICGAGLVKGFQTAFYMRYGGGANSVAAGYSIGTGLAAEIIGTFVLVYTVFSATDPKRNARDSHVPVLAPLPIGFAVFMVHLATIPITGTGINPARSFGAAVIYNRSKPWDDHWIFWVGPFVGAALAAAYHQYVLRAGPFKQLGSFRSAPSRV

SEQ ID NO: 12516 - protein, 621 aa, Klebsiella aerogenes
MDSHTLIQALIYLGAAALIVPIASVLGLGSVLGYLIAGCIIGPWALRLVNDAEAILHFAEIGVVLMLVAMGLELDPQRLWKLRASVFDGGALQMVACGVLIGLFCMLLGLRWQVAELIGMTLALSSTAIAMQAMNERNLTVSQMGRSAFAVLLFQDIAAIPLVAMIPLLAASGGATSLMAFALSALKVAAALALVVVLGRYLTRPLLRFVARSGLREVFSAVACSWSSALGLLLEEVGLSMAMGAFLAGVLLASSEYRHALENDIEPVKGLLLGLFFIGVGMSIDFAPWSPNPLRIVILLVGFPAIKMLMLWLIAQPLGVPRAQHRWFAVLLGQGSEFAFVVFGPARMADVLDGEWPKALTLAVALSMATTPILLVLLTRLEKSSSGQARDADEIDEEQPRVIVAGFGRFGQIAGRLLLSSGVKMVILDHDPDHVDTLRKFDMKVFYGDATRVDLLESAGAEKAEVLINAIDDPHVSLELVARVKEHFPHLQIISRARDVDHYIQLRQAGVEAPERETFEAALKSGRMTLEALGLGAYEARERPDLFRRFNLQMVEEMVAMAENDPRRGVAVFKRTSDMLTGIINEDRHHLSLVQRHGWQGTEEGRHTGDIADEPENKPSA

SEQ ID NO: 12517 - protein, 515 aa, Anaplasma marginale str. St. Maries
MFRYVMCSAVIQELESKKSKLKSGGGVSRVEKQHSKGKLTARERLEVLLDEGSFQEYGVFVEHRSANFGMDKAKISGDGVVTGSGTIYGQRVCVYSQDFTIFGGSLSEMNSKKICHVMDIAAKVGVPVIGINDSGGARIQEGVDSLAGYGEIFRRNVEMSGVIPQISLIMGSCAGGAVYSPALTDFVFMVHGSSCMFVTGPDVIRKVTFEEVTQEDLGGSAVHTKKTGVADRAFSDEIDALCQIRKFFSFMPANNRSSSRFRETRDAVDRESESLNTLVPHSSSTPYDMYELIHKVCDEGVFFELKPDFAKNIITGFGRIGGHTVGFVANQPLHLAGCLDIDASRKAARFVRFCDAFNIPIVTLIDVPGFMPGVSQEYSGIIAHGAKLLYAYAEATVPKISVIVRKAYGGAYIVMNSRHLCGDVNYAWPSAEIAVMGSEGAVGIIFRHEKDQECLQRLVQEYNDKIVNPYVAASRGFIDDVIVPSSTRKHLHSALSLLRDKQIARTWRKHDNLPL

SEQ ID NO: 12518 - protein, 197 aa, Enterococcus faecalis V583
MNLIPTVIEQSSRGERAYDIYSRLLKDRIIMLSGPIDDNVANSVIAQLLFLDAQDSEKDIYLYINSPGGSVSAGLAIFDTMNFVKADVQTIVLGMAASMGSFLLTAGQKGKRFALPNAEIMIHQPLGGAQGQATEIEIAARHILDTRQRLNSILAERTGQPIEVIERDTDRDNYMTAEQAKEYGLIDEVMENSSALN

SEQ ID NO: 12519 - protein, 508 aa, Symbiobacterium thermophilum IAM 14863
MSLDAELKAREARIKQGGAPKYHEQARAKGKLFARERIRLLLDDGSLVEDGLFANCEAPDLPADGVVTGLGRIDGRPVAVMANDSTVKAGSWGARTVEKILRIQETAERLRIPIFYLVDSAGARITDQVEMFPGRRHAGRIFYNEVRLSGLVPQICLLFGPSAAGGAYIPAFCDVVFMVRGNASMYLGSPRMAEMVIGEKVTLEEMGGAEMHTAVSGCGDVLCETEEEAIQLARRYLSYFPQRTGERPAPAPPAEPKTGRPLAEIVPVNQNAAFDMYELIDRIIDEGSWFEIKKRFAPELITGLARIGGRVVGIVANQPRVKGGVLFVDSADKAARFIWLCDAFEIPLLFLADVPGFMIGTKVERQGIIRHGAKFIAAVSEASVPKICLVVRKAYGAGLYAMAGPAFEPDCTLALPTASIAVMGPEAAVNAVYANKIAELPPEERPAYVARLREEYQKDIDIYRLASELIVDGIIPFERVREELLARFALYETRQQNWPAKKRPVTPV

SEQ ID NO: 12520 - protein, 749 aa, Oryza sativa
MNPATILGHIQLVHMHPDVSCGVHFVTCFQEPRDKAGRNPNRSEMICRSLLLLRSNAASKASNIVKHVAATGCLPKYSSEAPARYFSSEPSLQVDSTEENGFKGHGMLAPFTAGWQSTDLHPLVIDRSEGSYVYDINGKKYIDALAGLWSTALGGNEPRLIKAATDQLNKLPFYHSFWNRTTKPSLDLANEILSMFTAREMGKIFFTNSGSEANDSQVKLVWYYNNALGRPNKKKFIARSKSYHGSTLVSASLSGLPALHQKFDLPAPFVLHTDCPHYWRFHLPDETEEEFATRLATNLENLILKEGPETIAAFIAEPVMGAGGVIPPPKTYFEKIQAVLKKYDILLIADEVITAFGRLGTMFGCDMYDIKPDLVSIAKALSSAYMPIGAILVSPEITDVIYSQSNKLGSFAHGFTYSGHPVSCAVAIEALKIYKERNIIEHVQKIAPRFQEGIKAFSGSPIVGEIRGLGLILGTEFVDNKSPNDPFPAEWGVGSLFGAECEKRGMLIRVAGDNIMLSPPLIMTPDEVEEIICKYGDALKATEERIAELKAKRVIDDGDDKLTMFNVYRVVSSVDANNELLFELADFESFADALGGYLLLLLVATWEMEMDCLGASWRSDRYAWVVGDGGSREETQRPRGSMNTQDSKRMRSLGKVLGSRVAGRRQEVHVARGYGKKMATKGRKYDMRSGGGRGGTWRRVTVMNDISHLYKIALLLILGWMYSLHSARTGYMGLTYSILVNLDTYSNLY

SEQ ID NO: 12521 - protein, 623 aa, Cryptococcus neoformans var. neoformans B-3501A
MSDNEQVAFFTYILERLKQCGVKQIFGVPGDFNLTALDYIEKDPELQWVGNANELNAAYASDGYARVKGTLAVVITTFGVGELSALCGIAGCLSERVPVLHIVGAPSTSLQAKQSLLHHTLNLPESFSTFSSMSAPLSCSQALINNIEPKTPTSWTEAFDKTLKAVLEQCRPGYVEVPTDAVHAKVSAEGLKQPLPPPHSAPPPESMGTSLSNTSASAASRGAAQVSLSTAPTNVPSAPSSDDVTAHVVEDITKRFGEAKKPIILVDACAGRFGMAIEVRKLVDACGIRFFETPMGKSLMDERHPLYGGCYAGANSLPTVQKEVESADFVLYVGALKSDFNSGSFSVNIDPKVIVELHSFTTTIGYASYPTTDIRTILPLLRPAFEKLGRGKQSEGQSVEQKVEDKSVDSPVVPDPKGDEIKHEWLWPRVGKWFQDTDIIITETGTSSFGLTNVVLPSNSTYIAQILWGAIGWSVGACLGAAMAAKENGNNRRTVLFVGDGSLQLTLQEIGTMLRRGVHPYIFVLNNDGYEIERQIHGWTAEYNDIQLYDHQLLLPFLAGKKTKTPYQSYAVHTPQEFSKLLDDEEFNKPDRLRLIEVFMPRGDAPAGLIRQAKLTAEANDRI

SEQ ID NO: 12522 - protein, 541 aa, Oryza sativa Japonica Group
MAPLPAAATATASSAATPADDEAHSLLPSTPSNEEDDDDLEERAYEATEKVIVSISDFPDADDDEEESGLATSTAASGIPPFSWRKLWLFTGPGFLMSIAFLDPGNLEGDLQAGAVAGDTLLWLLLWATSMGLLVQLLAARVGVATGRHLAELCRDEYPSWARRALWLMAEVAMVGADIQEVIGSAIAIKILSRGFLPLWAGVVITALDCFIFLSLENYGVRKLEAVFAILIATMAVSFAWMFTDTKPNMKNLFIGILVPKLSSRTIRQAVGVVGCVIMPHNVFLHSALVQSRKIDPNKEHQVREALRYYSIESTIALAVSFMINLFVTTVFAKGFYGTKEAGNIGLENAGQYLQEKFGGGFFPILYIWGIGLLAAGQSSTITGTYAGQFIMGGFLNLKLKKWIRSLITRSFAIVPTIIVALFFDKSDSLDVLNEWLNVLQSIQIPFALIPLITLVSKEKVMGVFKIGRNTQAVTWTVATLLITINGYLLLDFFSSEIRGLLSGSILCVAVLAYASFVLYLILRGTELPNQIITTIRKSFS

SEQ ID NO: 12523 - protein, 521 aa, Mycobacterium avium 104
MVLLDGTSSHPRELLGNKGHGIEVMRRHHLPVPPAFCLTTAVGLRYLADPAATMDAVWDDVLDRIGWLQAQTSRAFGRGPHPLLVSVRSGATQSMPGMMDTLLNLGINDSVEQALAAEHGPAFARDTHRRFREMYRRIVGVERPVPSDPYTQLRAGIEAVFASWNSPRARAYRAHYGFADRHGTAVVVQAMVFGNHGPNSGAGAFFSRNPITGDDEPFGEWLPGGQGDDVVSGSVDVEPIAALRDEQPAVYDQLMAAARTLERLDRDVQEIEFTVEDGALWLLQTRAAERSAQAAVRSALQLRREGLIDDAETLRRVTPAHVRSLLMPALQPEIRLTAPLLAKGLPACPGVVSGTAYADVDEALHAAERGEPVILVRDHTRPEDVSGMLAARGIVTEVGGAASHAAVVSRELGRVAVVGCGAGVAAMLAGRRITVDGAEGEVREGELSLSAWSENDTPELRELAEIARLISPLRAHSGGDHPRLDDDSESAVRAALAAGQTDVVSPTPLLVMLTALRQGAP

SEQ ID NO: 12524 - protein, 334 aa, Prochlorococcus marinus str. MIT 9301
MNFIQPNSIKNIHKLSIAPMMDCTDKHFRMIMRKISSEALLYTEMIVAQSLVYTDKKEYFLDFNSEEHPISIQFGGDDPKILKEAAQMAQDWGYDEINFNVGCPSPRVCSGNFGASLMKDPEKVAKCIESLKNNCNLPVTIKHRIGVDNDDSFVNLNNFVRIIANAGADRFTVHARKAILKGLNPKQNRTIPPLNYDVVKKLKKSNPELLIEINGGLTNIDQSLKALNDFDGVMIGRSIYKHPLRWSEIDQKIYGINKKNKSASNIIFSLIPYIEAHISNGGKSWDICKHLINLVEGIPKAKIWRNQISKKSIKKELDIEYLFKLTSALQEMGF

SEQ ID NO: 12525 - protein, 164 aa, Prochlorococcus marinus str. MIT 9301
MNQFLSRRTFILIPTMSFLKIIFKPMQVLASSLASKEEWNFSKDEWKARLSPETYYILREEGTERAFSSQLNNEKRKGNFHCAGCDLPLFSSDKKYDSGTGWPSFWDSIEGSVETKVDFKLIVPRTEYHCSRCGGHQGHVFNDGPPPTGKRYCNNGLALKFVPD

SEQ ID NO: 12526 - protein, 597 aa, Arabidopsis thaliana
SVNAIAVLPRAAISISIPDTGLGRTGTILDESTSSAFRDYQSLFVSQRSETIEPVVIKPIEGSIPVNFPSGTYYLAGPGLFTDDHGSTVHPLDGHGYLRAFHIDGNKRKATFTAKYVKTEAKKEEHDPVTDTWRFTHRGPFSVLKGGKRFGNTKVMKNVANTSVLKWAGRLLCLWEGGEPYEIESGSLDTVGRFNVENNGCESCDDDDSSDRDLSGHDIWDTAADLLKPILQGVFKMPPKRFLSHYKVDGRRKRLLTVTCNAEDMLLPRSNFTFCEYDSEFKLIQTKEFKIDDHMMIHDWAFTDTHYILFANRVKLNPIGSIAAMCGMSPMVSALSLNPSNESSPIYILPRFSDKYSRGGRDWRVPVEVSSQLWLIHSGNAYETREDNGDLKIQIQASACSYRWFDFQKMFGYDWQSNKLDPSVMNLNRGDDKLLPHLVKVSMTLDSTGNCNSCDVEPLNGWNKPSDFPVINSSWSGKKNKYMYSAASSGTRSELPHFPFDMVVKFDLDSNLVRTWSTGARRFVGEPMFVPKNSVEEGEEEDDGYIVVVEYAVSVERCYLVILDAKKIGESDAVVSRLEVPRNLTFPMGFHGLWASD

SEQ ID NO: 12527 - protein, 345 aa, marine gamma proteobacterium HTCC2080
MALASIPEIIDDIRAGRMVVLMDDEDRENEGDLIIAAEKVTPEIINFMATEACGLICMPITPEKARHLRIPLMVRDNRSQHETNFTVSIDASEQIGPGVSAQQRSHTILQAVAHNAQPSDIRQPGHIFPLVAKPGGVLRRAGHTEAGVDLARMAGCEPAAVIVEIMNTDGTMARRPQLEIFAEQHDLKMGTIADLIEYRSIHEHSVEVGESHEVDTEWGKFILHSFRDLIDDTPHFALQRGTISADKPVPVRVQSVNLLRDVLGTQLGEGRTGWSYRSAMQFVADANEGVVVLVGQPSSSDQILTDVHQFLSSGAPPPQPQNYRLIGTGAQILRHLGVSRMALLS

SEQ ID NO: 12528 - protein, 177 aa, Sulfolobus solfataricus P2
MKITYTDILVKVVAKLLRDHPYLNATLEGDQIKIIEEVNIGIAVALDQGLIVPVIRNADTKPITEIAKESHELADKARENKLNPDEVSGGTFTISNLGMYDIDSFTPIINPPQTAILGVGRIRRAPVVVGDNISIGYIMWLSLTFDHRVMDGHTAAKFLKELTEILEDENKLRTFLS

SEQ ID NO: 12529 - protein, 428 aa, Collimonas fungivorans
MTIKHEVPSYLTQHGIGPWGDYLEQIDRVTPYLGNLARWVETMKRPKRMLIVDVPIERDDGTIAHFEGYRVQHNTSRGPGKGGVRFHQDVTLSEVMALSAWMTVKNAAVNVPYGGAKGGIRVDPKTLSQGELQRMTRRYTSEIGIIIGPNKDIPAPDVNTNEQIMAWMMDTYSMNQGSTASGVVTGKPISLGGSLGRREATGRGVFVVGCEAAVKRGLDIHGAKIAVQGFGNVGGIAARLFSEAGAKVVAVQDHISTVVRSSGLDVAALQAHVNETGSVAGFKGGEEISDRAQFWAVDCDILVPAALEQQITVENAPTIRAKIILEGANGPTSPAADDILHEKGVLVVPDVIANAGGVTVSYFEWVQDFSSFFWTEDEINLRLTRIMREAFTAVWQLAEEKKVSLRTAAFIVACTRVLQAREMRGLYP

SEQ ID NO: 12530 - protein, 512 aa, Hieracium pilosella
MTLLSLIIYLCITGVTAYVLVNLRTRRANRLPPGPTPWPIVGNLPHLGTIPHHSLADLATRYGPLMHLRLGFVDVVVAASASVAAQFLKTHDANFASRPPNSGAKHMAYNYQDLVFAPYGPRWRMLRKICSVHLFSAKSLDDFRHVRQEEVAILTRALVGAGKSTVKLGQLLHVCTTNALVRVMLGRRVFGDGSGGGDPKADEFKNMVIEMMVLAGEFNLGDFIPVLDLLDLQGVTKKMKKLHTRFDSFLNSILEEHRTSSGGASGHVDLLSTLISLKDEADGEGGKLTDTEIKALLLNLFVAGTDTSSSTVEWAIAELIRNPQLLKQAQQELDTVVGQGRLVNESDLSQLTFLQAIVKETFRLHPSTPLSLPRIASESCEINGYNIPKGSTLLVNVWAIARDPKMWTEPLEFRPSRFLPDGEKPNADVKGNDFEVIPFGAGRRICAGMSLGLRMVQLLTATLIQAFDWELANGLEPRNLNMEEAYGLTLQRAQPLMVHPRPRLAPHVYGTG

SEQ ID NO: 12531 - protein, 113 aa, Synechococcus sp. WH 8102
MRVERPWGWYEDLLAAPGYKVKRLLIRRGRQLSLQRHRHRSESWTVVAGDGALLCGECWLEANAGVMLTIPCGALHRARSDQSDLVILEVQHGNDLREDDIERLQDDYGRVIS

SEQ ID NO: 12532 - protein, 781 aa, Oryza sativa
  misc_feature (560)..(560): Xaa can be any naturally occurring amino acid
  misc_feature (630)..(630): Xaa can be any naturally occurring amino acid
MAAAAILPELAAQVVIPVAEAVGIAFAVLQWALVSKVKLTAEPRRGEAGGAAGGKSGPSDYLIEEEEGLNDHNVVSKCAEIQTAISEGATSFLFTEYKYVGLFMSIFAVLIFLFLGSVEGFSTKSQPCHYSKDKTCKPALANAIFSTIAFVLGAVTSLVSGFLGMKIATYANARTTLEARKGVGKAFITAFRSGAVMGFLLAASGLLVLYIAINLFGIYYGDDWEGLFEAITGYGLGGSSMALFGRVGGGIYTKAADVGADLVGKVERNIPEDDPRNPAVIADNVGDNVGDIAGMGSDLFGSYAESSCAALVVASISSFGINHEFTPMVYPLLVSSVGIIACLITTLFATDFFEIKAVSEIEPALKKQLIISTAVMTVGIALVSWLGLPYTFTIFNFGAQKTVQSWQLFLCVAVGLWAGLIIGFVTEYYTSNAYSPVQDVADSCRTGAATNVIFGLALGYKSVIIPIFAIAFSIFLSFSLAAMFGVAVAALGMLSTIATGLAIDAYGPISDNAGGIAETAGMSHRIRERTDALDAAGNTTAAIGKGFAIGSADLVSLALXFGAFVSRAAISTVDVLTPKVFIGLIVGAMLPYWFSGMTMKSVGRAALKMVQTVASSQHIPGFWWPTKPNXTCVKISTDASIKEMIPPGALVMLTPLIVGILFGVETLSGVLAGALDYNCIQWSVLLIRFTFSQIAISASNTGGAWDNAKKYIEAGASEHARTLGPKGSDPHKAAVIGDTIGDPLKDTSGPSLNILIKLMAVESLVFAPFFATHGGILFKLF

SEQ ID NO: 12533 - protein, 497 aa, Erythrobacter sp. NAP1
MRQVDHFIVGERPAPTRKANVWNPSTGEVQAEVALGDRDLLERVVATAKEVQPAWAATNPQKRARVMFRFKELIEANMQELAELLSSEHGKVVDDAKGDVQRGLEVIEFACGIPQVLKGEYTQGAGPGIDVYSMRQPLGIGAGITPFNFPAMIPMWMFGMAIAAGNAFILKPSERDPSVPVRLAELFVEAGAPEGLLQVVHGDKEMVDAMIEHPDIPAISFVGSSDIAHYIYRRGAEFHKRVQAFGGAKNHGIVMPDADLDQVVNDLSGAAFGSAGERCMALPVVVPVGDETADKLREKLIPAINALRVGVSTDPDAHYGPVVTPQHKERIEQWITTAEREGGEIVVDGRGFSLQGHENGFFVGPTLIDHVTPNMSSYKEEIFGPVLQIVRAKDFEEAVRLPSEHQYGNGVAIFTRNGHAAREFASRVNVGMVGVNVPIPVPVSYHTFGGWKRSGFGDIDQYGTEGLQFWTKKKKITQRWPDGGGDGSNAFIIPTMG

SEQ ID NO: 12534 - protein, 604 aa, Bradyrhizobium sp. BTAi1
MAAGASSAIMKIEPLSVGFNDEQKRYLEGLAAGLKVNLAGRAQTATAPLAEPSGPDAIHIKAQDKVLAAGRKLADQEKVKREQHPFDAYPRLKQQAHSNAAPSAADNFRWRYFGLFHVAPAQDSYMCRLRIPNGILKHWQLTGLADLADQLCGSYSHVTTRANLQLREIPPKHAVMLLEGLSDLGLTARGSGADNIRNVTGTPTAGIDPQELLDTRAYAREWHFHILNDRSLYGLPRKFNVAFDGAGRIAALEDTNDIAFSAVEVKDGFGVAPGVWFRLGLGGITGHKDFAKSTGIIVEPERATEVADAIVRLFIETGDRTNRLKARLKYVLDSMGHDKFMEAVESRLGRKLARVADEAIKPRPEADRMAHIGVHPQKQQGLNWIGVVLPLGKLTTDQMRALARIAADLGDGEIRLTVWQNLLLPGVRDENVAMACAAIEQIGLSTKASHIRAGLIACTGNSGCKFAASNTKRHAAEIGDWCESRVEVDTPLNIHLTGCHHSCAQHYISDIGMIGAKVPVGDGDETVEGYHLFAGGGFGPQADIGREVYRDLKAEDAPRTVEKLLKAYLAHRLSPDETFLSFARRHDGETLRKLADAQTSEVAA

SEQ ID NO: 12535 - protein, 517 aa, Dichelobacter nodosus VCS1703A
MLHSNLHNDKILILDFGSQFTQLIARRVREAGVYSEIYAYDVDPQMIRAFAPKGIILSGSPNSTLESDAPTIPEIVWQLDCPILGVCYGMQAMIKHWGGQVTHTNQQEFGYAALDFQADHAFFAGLDMRDVWMSHGDHVSQLPAEFVAIASSNNAPIAACAHQSKPWYGVQFHPEVTHTPNGAALIAQFVRKICGCSADWTTEHFITEKRREIAEKVGTEKVILGLSGGVDSSVVAALLHEVIGAQLTCVFVDTGLLRLHEGDEVMAVFAQNMGVNVIRVNAADRFFAALKGVTDPEEKRKTIGRLFIEIFDEEAAKIKDAKWLAQGTIYPDVIESAGSKTGKAQVIKSHHNVGGLPEKMNLSLLEPLRMLFKDEVRQLGLALSLPKTMIYRHPFPGPGLGVRILGEVKAEYADLLRQADAIFIQALREYDLYDAVSQAFAVFLPIRSVGVMGDGRRYDFVVALRAVETIDFMTARWAKLPYDFLDEVSRRIINHVSGISRVVYDVSSKPPATIEWE

SEQ ID NO: 12536 - protein, 637 aa, Glycine max
MLLPTSGVGMNSAMDDMNLIQQTQRHHLVVREIGEEIDLEIGAGEDDPSFGSATLIGAPMRESSVEEHGESKQMGMISQLPNDAQDMSKTQQGKRKKKVVKRWREEWADTYKWAYVDVKDGTPRIFCSVCREYGRKHRRNPYGNEGSRNMQMSALEEHNNSLLHKEALRLQMASKDKIVVDKPVYVKVAMSKTAGSILEATLKRDPHEVEFIQAVQEAVQALERVIAKNSRYINIMERLLEPERMIVFRVSWVDDRGGTCVNRGFRVQFNQSMGPCRGGIRFHPSMNLSVAKFLGFEQTLKNALSPYKLGGAAGGSDFDPKGKSDNEIMRFCQSFMSEMYRYLGPDKDLPSEEMGVGTREMGYLFGQYRRLAGHFQGSFTGPRIFWSGSSLRPEATGYGLVFFAQLMLADMNKELKGLRCAVSGSGKIAMHVLEKLIAYGALPISVSDSRGYLVDEDGFDYMKISFLRDIKAQQRSLRDYSKTYARSKYYDEAKPWSERCDVAFACTSQNEIDQSDAINLVNSGCRILVEGSNMPCTPEAVQILRKASVLIAPAMAAGAGGVVAGELELNHECSLMHWSPEDFESKLQEAMKQTYQRAMKAATDFGYQKESPEALVHGAVISAFLTIAQAMTDQGSI

SEQ ID NO: 12537 - protein, 429 aa, Zea mays
MAGAVSALFLLDMKGRVLVWRDYRGDVSALQAERFFTKLLDKEGDSEVHSPVVYDDAGVTYMFIQHNNVFLLTAARQNCNAASILLFLHRVIDVFKHYFEELEEESLRDNFVVVYELLDEMMDFGYPQYTEAKILSEFIKTDAYRMEVTQRPPMAVTNAVSWRSEGIRYKKNEVFLDVVESVNILVNSNGQIVRSDVVGALKMRTYLSGMPECKLGLNDRVLLEAQGRATKGKAIDLDDIKFHQCVRLARFENDRTISFIPPDGSFDLMTYRLSTQVKPLIWVEAQIEKHSRSRIELMVKARSQFKERSTATNVEIEVPVPSDATNPNIRTSMGSAAYAPERDAMVWKIKSFPGGKEYMCRAEFSLPSITAEEGAPEKKAPIRVKFEIPYFTVSGIQVRYLKIIEKSGYQALPWVRYITMAGEYELRLI

SEQ ID NO: 12538 - protein, 143 aa, Magnetospirillum magnetotacticum MS-1
MTVARILAEKGNSVVTVPPHRTVDEAIHLLAEKQIGALVVADAGGHVIGILSERDVMRALARDGAAALDQSISHYMTAKVVTCTRRASIEDVMETMTEGRFRHLPVVEDGHLVGVVSIGDVVKRRIAAVEAEHQAMRDYITMA

SEQ ID NO: 12539 - protein, 709 aa, Synechococcus sp. WH 8102
MLGSPIGPTVMAMQASIGQVMHHPLGVFSLLVAISAAVPPLIRRIGLPDLVGLLVAGVVVGPHALNWVDSGSETVRLLSDLGAVYLLFTMGLEIDLEEFNRVKRRSFIYGLLILLIGVGTGVSIGLLAGFASVSCLLLGALMATHTPLGYPIVRSYGAQKDESVVVSVGSTIFTDIVALLLLAVGLGLGQGDLSGVGLGLLLLRIGLFAVLVVVGIRWLGRRLVLRGINDENRMVLAVLVALFLASLGAELAGVEKIVGAFLAGLAVNSVLPEGRVKEQVIFVGGVLFIPIFFIDLGLLLDVGSLGASLSNYQFTGLMLVGAIGGKGLASWISGALFGYRRPQILMMWSLTMPKVAATLATAFIGFQAGLLNQTVLNAVLAVMVVTATLGPILTERSVTRLNEARQGTLPASFGEEVSALDGVSEVVQRPLRIVVPVANPSNEQGLITMASRLLRGSAGGDGLLLPLAMVNPSLEEVRGGLNRAVAAARSRLRVAESIGADLQVPTRTLLRLDEDVAGGMSRTALEQAADLLLIGAGRQDQLRAWLMGDIVDGVCRTAHCPVVVVNLGRHADAAMHRILVPIKDLSASAREQVELALRVINSAPENQRTRITLLHVHDPRFSGSDRQWMEEQLIRWRPAGIPADRFHIVIVRGPGIDGSIHRLSRDHDLVILRTQRRRVAGLPIPGSDRTSKLISQLPCASMVISDPLV

SEQ ID NO: 12540 - protein, 401 aa, Marinobacter sp. ELB17
MAHQEDLARLMTLEQGKPIAESRGEVAYGASFVEFYAEEAKRMAGETLQSHGVDKRILVFRESIGVVAAVTPWNFPLAMITRKCAPALAAGCTVVIKPAEATPLTALALVRLAELAGLPAGVINVITASQPAAVGDVLTTDPRVRKFSFTGSTAVGKKLLAQCAGTVKKASMELGGNAPFIVFDDADLDAAIEGAIASKYRNSGQTCVCTNRFLVQSGVYDAFVEKLAARVKQLKVGNGLDAGVVQGPLINQAAVEKVKAHIADALEKGGRLICGGKAHALGGTFFEPSIIADATGDMRVAQEETFGPLAPIFRFDTDEQAIAMANATNSGLAAYFYAKDYRRIWHVMEGLEYGMVAVNEGILSTELAPFGGVKESGLGREGSRHGLDEFTELKYVCVGGL

SEQ ID NO: 12541 - protein, 467 aa, Pseudomonas putida GB-1
MQDMSASLEQSKPAEPARDGHLQRTLENRHIQLISIGGAIGTGLFMGSGKVIALSGTSILLVYAILGFFVFFVMRAMGELLLSDLRFKSFADIVAHYLGPRAGFVLSWSYWLSWSVAVVGDVVVVAGFFQYWYPDAPAWLPAFFTLFVLLGLNLLAVRIFGEVEFWFGIIKIVAIVLLIITAAVMIATSYTSPNGVVASLSNVVAPGAVLPHGISGFFAGFQIAVFSFAGTELIGTTAAEAKNPHRSLPKAINTIPLRILLFYILALVCIISVVSWAEVPANRSPFVELFLLAGFPAAAGMINFVVLTSAASSANSGVYSGCRMLFGLAERRNAPALFARLSALSVPVYSLVFSGVCMLIGLSLLFIIPEVMTVFTLISTVSAILVIFTWSMILAAYLAYRRLNPAAHDASLFKLPGGVPMAVTTLGFLGFVLVLLALQPDTRLALCVMPLWFVFLLVAYHRRREHN

SEQ ID NO: 12542 - protein, 398 aa, Bradyrhizobium sp. BTAi1
MLTASQPFDALMEITARPRTVFVQGKGSWLWDDTGKRYLDFIQGWAVNALGHAPPELAKALADQAARLITPSPAYFNETSLKLAKALVDRSCFDQVFFTNSGAEANEGAIKLARKYGALRKNGAHEIITFEGGFHGRTLATMSASGKKAFEPLFEPKVPGFAKARLNDIASVEALMSDKTVAIMLEPIQGEAGVWPATTGFLQQLRALTTQHGLLLIVDEIQTGMGRTGKLLGYEHADIVPDIMTLGKGIGGGVPLAALLATNEASCFAHGDQGGTFNGNPLMCAAGLAVLDVIETPSFLKAVADSGIYLESELQRLSARHGLGEVRGRGLLLALDVVRPIAPSIVAEAFELGLLLNAPRADTLRFMPALNVTRDEIAAMIETLDGILTKLGAARCVA

SEQ ID NO: 12543 - protein, 363 aa, Pseudomonas putida GB-1
MSKPFRIAAIPGDGIGNEVLPEGIRVVEAAARKHGLDISFEFFEWASCDYYLAHGKMMPDDWFEQLKGFDALYFGAVGWPDKVPDHISLWGSLLKFRRDFDQYVNIRPVRLFPGVPCPLAGREPGDIDFVVIRENTEGEYSSLGGRMFEGTENEFVLQESVFTRRGVDRILKYAFDVAQTRERKHVTSATKSNGMAVSMPYWDERTAAMAANYPEISWDKQHIDILCARFVLQPDRFDVVVASNLFGDILSDLGPACAGTIGIAPSANLNPERKFPSLFEPVHGSAPDIYGKNIANPIAMIWSGALMLDFLGNDGADPRYRAAHDDILKAIEQVIAAGDVTRDMGGQQSTQQVGQAITALVEA

SEQ ID NO: 12544 - protein, 151 aa, Zea mays
TKLCYNRRPEKQSALVQWLIKLAAIAAMVAAYSIPFFVIPRTVHPIMGWSVYLFGALALSVLVFNVFLLPPLDVLTTWLAIVGMLIVMAFPWYHDGVVRALAIFGYAFCSAPILWASMVRMMDSLQTMLERDSFFPRIGEPAQETEFSKLY

SEQ ID NO: 12545 - protein, 341 aa, Arabidopsis thaliana
MDHAADAHRTDLMTITRFVLNEQSKYPESRGDFTILLSHIVLGCKFVCSAVNKAGLAKLIGLAGETNIQGEEQKKLDVLSNDVFVNALVSSGRTSVLVSEEDEEATFVEPSKRGKYCVVFDPLDGSSNIDCGVSIGTIFGIYTLDHTDEPTTADVLKPGNEMVAAGYCMYGSSCMLVLSTGTGVHGFTLDPSLGEFILTHPDIKIPNKGNIYSVNEGNAQNWDGPTTKYVEKCKFPKDGSPAKSLRYVGSMVADVHRTLLYGGIFLYPADKKSPNGKLRVLYEVFPMSFLMEQAGGQAFTGKKRALDLVPEKIHERSPIFLGSYDDVEEIKALYAEEEKKN

SEQ ID NO: 12546 - protein, 315 aa, Bradyrhizobium sp. BTAi1
MGGPEALVYEPVDLAAPGPGEVRIRQHAIGLNFIDVYYRTGLYKAPGLPFIAGNEAAGEVIAVGPGVTHFHPGDRVAYYENLGGYATERNIAWQRLVKLPDHITYEQGAVLMLKGLTVWYLLHKTFKVEPHHRVLIHAAAGGIGLLACQWARALGAHVIGTVGSRAKADLALANGCDHVILYNEEDFVARVKQISRGELCDVVYDGVGKSTFPGSLSCLKPRGLFVSFGNASGPVPPFSIAELNSHGSLFATRPKLNDYVGKRSELLEGADTLFAAVISGKLHVPINHAYALKDAAKAHADLESRATTGASILKP

SEQ ID NO: 12547 - protein, 401 aa, Spinacia oleracea
MASNMLSIANPSLRVYNKGFSEFSGLHTSSLPFGRKGSDDLMAFVSFQTNAVGGKRSSQNGVVEAKLKVAINGFGRIGRNFLRCWHGRKDSPLDVVVINDTGGVKQASHLLKYDSILGTFDADVKTAGDSAISVDGKVIKVVSDRNPVNLPWGDMGIDLVIEGTGVFVDRDGAGKHLQAGAKKVLITAPGKGDIPTYVVGVNEEGYTHADTIISNASCTTNCLAPFVKVLDQKFGIIKGTMTTTHSYTGDQRLLDASHRDLRRARAACLNIVPTSTGAAKAVALVLPNLKGKLNGIALRVPTPNVSVVDLVVQVSKKTFAEEVNAAFRESADNELKGILSVCDEPLVSIDFRCTDVSSTIDSSLTMVMGDDMVKVIAWYDNEWGYSQRVVDLADIVANKWQ

SEQ ID NO: 12548 - protein, 800 aa, Coprinopsis cinerea okayama7#130
MGGSSVVDGMKLVVLGGTVETARRISSSAWSHFVNSFFLTAHFCEEEHPYDWLMLWLSRRPEWQRSREFETTIRSGSTSTSSTFGSPADQEWDEAEREWEAYNAHFERGYSHHGQDGEDDTDPIEKPKTRIVFQPTYDTTHTIFFRGHWLRVRRSRKHDTNSEMISISVIARSNNILKQLVLQAKKEYEAECVHRIQIYFADAHGSWRWTDSRAKRPLSSIVLNPGVKEMLVDDAKDFLRSEKWYADRGIPFRRGYLLYGVPGSGKSSLIHALAGYLQLDIYVVSLSASWISDSTLTSLMGRVPARCVVLLEDLDAAFTRSVSRDDEEEILGSSNNNNNNGNNGGNNNNAEGPQEQQSGFSSFYGSGRRRGGRSGRSGEYLSDVNTLSLSGLLNALDGVAASEGRLLFATTNHLDKLDEALRRPGRMDVWIEFKNASKWQAEALFRNFFPACDEDEVEDVDSDGALSAGELEARRRDAREAQKRREREVDEALKNIKVESRMFTPNPPVPTTGVPSSPSTSSVWSIASSASNLLSSASSLSLPFGSSSGSSTPSVSPASSTSASRKTSSASSSIASAAAAVSSSRPHVKKFGEGNTAYIAPPPTDDIASRRHSAAPLDKKTLAVLAKKFADGVPEEEFSVAGLQGYLLKHKSNPHLAASNIESWVASERALRVKLAQEKAAREEREKQLREKRRQELLLKREEKKKQEEKEAEMEKIKAKLAEKEKEEELEKMRQKLREKEEEARKKEREEREGKSGDSAEEKKEEEKVEEKKEEHKTEEEKKSDSDDDEDKENWSDALP

SEQ ID NO: 12549 - protein, 340 aa, Prochlorococcus marinus str. MIT 9301
MTLRVAINGFGRIGRNFMRCWLSRGAYTNIEVVGINVTSDPKTNAHLLKYDSVLGQLDGVDIQYTDDTFVINNKTIKCFSDRNPLNLPWKDWGVDLVIESTGVFNTDVGASKHLEVGAKKVILTAPGKGDGVGTYVVGVNADTYKHTDYDILSNASCTTNCLAPVVKVLDQTFGINKGLMTTIHSYTGDQRILDNSHRDLRRARAAATNIVPTSTGAAKAVALVYPEMKGKLTGIAMRVPTPNVSAVDFVFESSKSVTTEEVNNALKEASLSSMKGIIKYGDEPLVSSDYAGTNESSIVDSDLTMCIGDNLVKVLAWYDNEWGYSQRVVDLAEIVAKNWE

SEQ ID NO: 12550 - protein, 294 aa, Solanum lycopersicum
MDQYEKVEKIGEGTYGVVYKARDRVTNETIALKKIRLEQEDEGVPSTAIREISLLKEMQHANIVRLQDVVHSEKRLYLVFEYLDLDLKKHMDSCPEFSKDPRLVKMFLYQILRGIAYCHSHRVLHRDLKPQNLLIDRRTNALKLADFGLARAFGIPVRTFTHEVVTLWYRAPEILLGSRHYSTPVDVWSVGCIFAEMVNQPPLFPGDSEIDELFKIFRVLGTPNEDTWPGVTSLPDYKSAFPKWPPKDLAIIVPNVDGAGLDLLGKMLSLDPSKRITARNALEHEYFKDIGYVP

SEQ ID NO: 12551 - protein, 294 aa, Solanum lycopersicum
MDQYEKVEKIGEGTYGVVYKARDRVTNETIALKKIRLEQEDEGVPSTAIREISLLKEMQHGNIVRLQDVVHSEKRLYLVFEYLDLDLKKHMDSCPEFSKDPRLVKMFLYQILRGIAYCHSHRVLHRDLKPQNLLIDRRTNVLKLADFGLARAFGIPVRTFTHEVVTLWYRAPEILLGSRHYSTPVDVWSVGCIFAEMVNQRPLFPGDSEIDELFKIFRVVGTPNEDTWPGVTSLPDFKSAFPKWPSKDLGTVVPNLGAAGLDLIGKMLTLDPSKRITARSALEHEYFKDIGFVP

SEQ ID NO: 12552 - protein, 651 aa, Triticum aestivum
MSKLLVIALLLLPLINHGIYLATAWDDQDFFKYCPPSNCSQHGPEVRFPFCLESSNTSAVAAAAAASCGCSSTDGLIWKLACFGQDTILVHPVLGSYSVSAIDYRRSSVKLIPLVDPCLMLQQKLAISRRWSSRQVDVIDGMQLPDRQFSILSYKYATLVCCSSEFTPAAVDADSIAGPVSCLSNTTLFLYLVAAYKDMSILPLDCKVFPVSDGVSGRLIPMYMLEDPMSGTPFSLSFKERAERMLSFAETTVYWFGGNCRQCELSGQRCAFSSQRDETFCIPDPHGSRIKVIAATSSVAAFVVLLVTVATVLYPSLKTRYNAEIHLKVEMFLKTYGTSKPTRYTFSEVKKMARRFKEKVGQGGFGSVYKGELQNGVPVAVKMLENSTGEGEAFINEVATIGLIYHANIVQLLGFCSEGMRRALIYEFMPNESLEKYIFSRDSANFQHLLVPDKLLDIALGIARGMEYLHQGCNQRILHFDIKPHNILLDYNFNPKISDFGLAKLCARDQSIVTLTAARGKMGYIAPELYSRNFGGVSYKSDVYSFGMLVLEMVSGRRNSDPRIGSQDDVYLPEWIYEKVINGEELALTLETTQEEKDKVSQLAMVALWCIQWNPRNRPSMTKVVNMLTGRLQSLQMPPKPFVSYENEPMP

SEQ ID NO: 12553 - protein, 359 aa, Marchantia polymorpha
RVAAQSAVAVSGAQKRAVVEAKVKVAINGFGRIGRNFIRCWHGRKDSPLEVVVINDTGGVKQASHLLKYDSMLGIFDADVKAVGDDAISVDGKIIKIVSDRNPLNLPWGEMGVDLVIEGTGVFVDKEGAGKHLQAGAKKVLITAPGKGPIPTYVIGVNEELYDPSEQIISNASCTTNCLAPFVKVLDEKFGIIKGTMTTTHSYTGDQRLLDASHRDLRRARAAALNIVPTSTGAAKAVALVLPNLKGKLNGIALRVPTPNVSVVDLVVQVEKKTFAEEVNAAFREAANGDMKGILAVCDEPLVSVDFRCTDVSSTVDSSLTMVMGDDMVKVVAWYDNEWGYSQRVVDLANLVAEKWTGA

SEQ ID NO: 12554 - protein, 393 aa, Marchantia polymorpha
VAAQAASFKRSSLGEFSGLKASSAVTFGKSSSENGFFDAVASQVAVKAGASGAIKGETSAKLRVAINGFGRIGRNFLRCWHGRGDESPLEVVAVNDSGGVKNAAHLLKYDSMLGIFKADVKVGDDTTLLVDGKPITVVSNRDPLKLPWAELGIDIVIEGTGVFVDGPGAGKHIQAGAKKVIITAPAKGADIPTYIMGVNEGDYSHEVANIISNASCTTNCLAPFVKVLDEKFGIVKGTMTTTHSYTGDQRLLDASHRDLRRARAAALNIVPTSTGVAKAVSLVLPQLKGKLNGIALRVPTPNVSVVDLVINTEKKGLTAEDVNNAFREAANGPLKGILAVCDIPLVSIDFHCSDVSSTVDSSLTMVMGDDMVKVVAWYDNEWGYSQRVVDLAH

SEQ ID NO: 12555 - protein, 292 aa, Prochlorococcus marinus str. MIT 9301
MMKTASLIGNKNKFLILGCGYSGSYFAKTIKKFGCTVLTSSRSISGDPNSFVFNSENGVVPDAKIFDGVTHILSCIPPDKNGNDPVLKSLKNKLKSMSLEWVGYLSTTGVYGNTKGDWVSEINEPNPFQKRSYKRLNCEKEWIESGLPVQIFRLPGIYGPGRSTFEAIKNKKIRVISKKNQVFSRIHVADIANAIIYLLQNKNSLKFYQIINIADDEPCSQIEVIQFCYDLLGLTMPKPILFEDAKEELSPIAKSFWMENRRVSNKLLCETLGYKLIYKNYKVGLKNCYLNS

SEQ ID NO: 12556 - protein, 459 aa, Rickettsia typhi str. Wilmington
MEQYDVAVIGGGPGGYVAAIRAAQLKKKVVLIEKSHLGGVCLNWGCIPTKSLLKSAEVFEYIKHAKDYGIDVGIAEINIQKIVERSREIASTLACGVQLLLKKNKVTIINGVASFGENKVINVNDKPTVKANNIIIATGARPKILQGFEPDITQIWTSKEAMIPQYVPKSMIIIGSGAIGIEFASFYNSIGVDVTIIEAYNRILPSEDTEIAGIAHKIFEQKGIKILTNAKLIKQTKSQNKIEVELELEGKKQKLQATILLMAVGITANIENLGLEKTKVQVENGYIVTNGLMQTAESGIYAIGDVSGVPCLAHKASHEGIIAAESIAGLKPNSINKHNIPYCIYSSPQIASVGLTEEVAKDLGYEIKIGRFPFRANGKALVSGNSYGLIKTIFDVKTGELLGAHMIGLEVTELIQGYVVSKNLEGTELDLIHTIFPHPTLSEMMHESVLAAYDMAIHI

SEQ ID NO: 12557 - protein, 345 aa, Marchantia polymorpha
MAGSTEPSTISSGKVKIGINGFGRIGRLVARVALERDDIELVAVNDPFISTEYMAYMFKYDSVHGRYTKNTIEAKDDKTLLFGKFPVSIFQCRDPAEIPWGQTGAEYVVESTGVFTTKDKAAAHLKGGAKKVVISAPSADAPMFVMGVNEKEYTTDIDIVSNASCTTNCLAPLAKVIHDKFGIVEGLMTTVHSITATQKTVDGPSAKDWRGGRGASFNIIPSSTGAAKAVGKVLPALNGKLTGMSFRVPTADVSVVDLTVRTEKKATYEEVKAAIKAESEGEMKGIMGYTEDDVVSTDFIGDSRSSIFDAKAGIAPNDNFMKLVSWYDNEWGYSNRVVDLILHMA

SEQ ID NO: 12558 - protein, 270 aa, Frankia sp. EAN1pec
MAKGAPARGSAGTGRRTLVAGNWKMNLNHLEAIALVQKVAFDLKPAELERVEVVFLPPFTDLRSVQTLIDGDKLAVGYGGQDLSPHGSGAYTGDISGPMLARLGCSYVVVGHSERRTYHHEDDALVASKVLAAYKHGITPILCVGEHEDIRAAGTHVEHVLAQLEGSLAGVSAEQAATLVVAYEPVWAIGTGRTASAQDAQDMCAAVRGQLTKLYDEPIAAGIRVLYGGSVKAANAAELFTMPDVDGGLVGGASLVAEEFVGIIRSGPAA

SEQ ID NO: 12559 - protein, 389 aa, Oryza sativa Japonica Group
MGAVASTVAARFAFFPPAPPSYGVEPPPSPSPAAAAEDGAVVELSGVPRRAGVEARRLPTGRGTEVVAMYVRQPGARLTLLYSHGNAADLGQMYELFVELSSHLNVNLMGYDYSGYGQSSGKPSEQNTYSDIEAAYRCLVETYGATEENIILYGQSVGSGPTLDLASRLPHLRAVVLHSPILSGLRVMYPVKHTYWFDIYKNIDKVPLVKCPVLVIHGTADEVVDCSHGRALWELSKIKYEPLWVKGGNHCNLELYPEYIKHLKKFVMAIEKLPPTKDESSGSSGPSDPCEIGSESMQSSRKSTDVKDKSRSSIDHRHSVDRREKPRGSIDRRDKSRKSIDHPDKPRASVDQPDRPRRSIDRFGGMMRSVTSVKLCNIDCFKVTYASGS

SEQ ID NO: 12560 - protein, 341 aa, Dichelobacter nodosus VCS1703A
MKKLLLSILWTSAMLTTQTAFTLPSLNIYATGGTIAGSSDSVTDTSQYQVATLGVEKLIAAVPELKKIATVTGKQIASVDSNDISVNILLELAKTLNQDLAGGTDGAVITHGTDTLEETAFFLSLTTKTEKPIVIVGAMRPATAISADGAMNLLQASALAVAKEAYNRGVMMVMNDRIGSGYYISKNHANAPDAFKSVESGYLGLMVGLTPHFYYQPQQPMNAANFDVSQYKELPRVDIIFGYQDADADLLDAAVERGARGVVIDATGAGMLSTKLLERVKALTAEGFPVVRASRTGQGYVSIAEDEGIGSGFLNAQKARILLMLALANGDDLAAIRARFQ

SEQ ID NO: 12561 - protein, 408 aa, Marchantia polymorpha
SSISTTLQSGAKAEGRNANSQSMVAFSNQGRSVNMQTKGSFFSSTELLSSGTPPRKQQLSGPIRATATQTPTISKKSGSKEKAKIGINGFGRIGRLVLRIALSRDDVEVAAVNDSFLTADYIRYLFKYDSTHGVYPGEVEVIDENTLSVDGHKIKFFGSKTPADIPWGDSGVDYVVESTGVFTNIAKASAHLQGGAKKVIISAPSEDAPMYVMGVNEEKYSADQNIVSNASCTTNCLAPLAKIVHQEFDIVQGLMTTVHATTATQKTVDGPSGKDWRGGRGAGQNIIPSSTGAAKAVGKVLPELNGKLTGMAFRVPTPNVSVVDLTCRLEKKASYDDIKKVIEAASESSMKGILGYTEDAVVSSDFIGDARSSIFDAHAGIGLGDGFMKLVSWYDNEWGYSNRVVDLI

SEQ ID NO: 12562 - protein, 575 aa, Rickettsia typhi str. Wilmington
MNDHILINVIILLGTAVFIVAILKRFRLSPVLGYLIAGAAIGDHGLKIVTYDQTKLLGELGVVFLLFAIGLELSFERLKAMRRYVFGLGSLQVLTTAIVIAGAMVLIDGNSSAAIITGGGLALSSTALVMQVIDENRSQSTQIGRVSLAILLLQDLAVVPLLVIVPLLASNNKASLAVALGIAFLKAVTALLTIFIVGRVLLRPVFSFISSESNNTSELPISMTLLIVLSAAWATETFGLSLALGAFVAGVLVAETEFRLQAEESIYPFKSLFLGLFFMTVGMNIDALEMYEKISHILTLSIALICIKTLIITAFCVLFGFNKGVAFYSGLLLSQGGEFGFILFSLGKDSGVLEESTADILLLVVTFTMALTPLLAALGKKIAEKVDKGLGKTPTQMIELGARDLTNHIIIAGLGNTGKMVARVLEAEGISYVILDLDDDRVKEELSNGLPVFKGDVSQADTLKALGTERAFAIILTMNNQVTIKKSLKTISGNYQDIHVVVKLKNLKNAREFYDLGATTIIPESYETGLQIGGTVLKNIGISEQEINRIKVQFRLGNYIIAKKEDALSEVEDND

SEQ ID NO: 12563 - protein, 310 aa, Mesostigma viride
SPLEVVAINDSGGVKQASHLLKYDSMLGTFAADVKAVSDDTISVDGKLIKIVSSRDPLSLPWKEMGIDIVIEGTGVFIDEAGAGKHITAGAKKVLITAPGKGPNIPTYVVGVNADQYKSTDTIVSNASCTTNCLAPFAKVLDEKFGIIKGTMTTTHSYTGDQRLLDASHRDLRRARAAALNIVPTSTGAAKAVALVLPKLKGKLNGIALRVPTPNVSVVDLVIQVEKKTFAEEVNAALREAANGPMKGVLAVCDEPLVSVDFKCSDVSSTIDASLTMVMGDDMVKVVAWYDNEWGYSQRVVDLAHIMAKE

SEQ ID NO: 12564 - protein, 76 aa, Dichelobacter nodosus VCS1703A
MSNIEERVIKVIAEQLNVDEGQVKADAHFIDDLGADSLDLVELVMTLEKEFDCEIPDEEAEKITTVQSAIDFVKSR

SEQ ID NO: 12565 - protein, 274 aa, Fagus sylvatica
YEEKTEWGSEIGWIYGSVTEDILTGFKMHARGWRSIYCMPKRPAFKGSAPINLSDRLNQVLRWALGSVEILLSRHCPIWYGYNGRLKWLERFAYVNTTIYPITAIPLLMYCTLPAVCLLTNKFIIPQISNIASIWFISLFLSIFATGILEMRWSGVGIDEWWRNEQFWVIGGVSAHLFAVFQGLLKVLAGIDTNFTVTSKASDEDGDSAELYLFKWTTLLIPPTTLLIINLVGVVAGISYAINSGYQSWGPLFGKLFFAFWVIVHLYPFLKGLM

SEQ ID NO: 12566 - protein, 205 aa, Oryza sativa
  misc_feature (159)..(159): Xaa can be any naturally occurring amino acid
  misc_feature (193)..(193): Xaa can be any naturally occurring amino acid
TRTCLYRGIGHYRRGHMPEPYEELVENCKILESHYKEMMDIEFTVQENRLWMLQCRTGKRTGKGAVKIAVDMVNEGLVERRTALKMVEPGHLDQLLHPQFENPSGYKDKVIATGLPASPGAAVGQIVLTAEDAEAWHAQGKDVILVRTETSPEDVGGMXHAAVGILTARRGMNSHAAVVARGWGKCCVSGCSXSVRVTDATRLTR

SEQ ID NO: 12567 - protein, 510 aa, Frankia sp. EAN1pec
MASTASGNPLRDPRDRRLPRLPDNSALVVFGATGDLARKKLIPAVYDLANRGLLPPGFVLVGFARRDWSDDEFAAFARESAERGARTPFREDTWERLAGSLRFCQGSFSDDAAFDGLAATLTDLEHSHGIRGNAAFYLSIPPTAFPVVLKQMQRTGLASNEAAGGWRRVVIEKPFGHDLESARELNSLVDDVFTPDDVFRIDHYLGKETVQNLFALRFANTLFEPIWNSHFVDSVQITMAEDVGIGTRAGFYDETGAARDVLQNHLLQLLALTAMEEPVSFGADTIRTEKLKVLRAVSLPDDYATFAVRGQYSQGWLAGERVRGYLEEADIPADSTTETFVAVKLGVETRRWAGVPFYLRTGKRLPRRVTEIAITFTKAPHLPFDETDTAELGNNQLVIRVQPDEGVTLRFGSKVPGSAMEVRDVAMDFLFGEAFTEALPEAYERLILDVLLGDATLFPNNAEVEESWRIIDPLEEFWRSTKPHTYRAGSWGPAAADDMLARDGRRWRRP

SEQ ID NO: 12568 - protein, 341 aa, Dichelobacter nodosus VCS1703A
MSTEVKIPTLPESVSDAILVNWHKSVGDFVEQGENLIDLETDKVMLEMPAPVSGIIAEILQEDGMTVISGQVIARIEEQKQQHEVPPAKKITIEEPVITEPSAAEHFPLSMEERVPMSRLRKKISERLLNVQQTTAMLTTFNEINMQAVMNYRHDFQNDFVKKYGVKLGLMSFFVRAAVAALRQFPVINAMIDGDDVVYRRYCNIGIAVASPRGLVVPILRNAETLSFADIERQIKIFAEKAADGSLSLEEISDGTFTITNGGTFGSMLSTPILNPPQSAILGMHAIVDRPMVENGAIVIRPVMYVALSYDHRLIDGREAVLFLKTIKNMLEAPARLLLDL

SEQ ID NO: 12569 - protein, 217 aa, Campylobacter upsaliensis RM3195
MRYTRVKWLVGDENYEKISMTRVLIFGLGGVGGICTDALFRTGFTKLTLIDADSFETTNLNRQIHSEYIGENKAEVFAKIYQAKGIVAKVDEEFLSIFDLSKFDLIIDAIDDIPAKVALANKIDFKKQIFISSTGGARKLDPTLIKTTSIFKTYGDALAKKFRYELRKSGFKGDFDVVFSNEEAKCKNLGSFMGVTASFGLALASLALKKVLNTDKF

SEQ ID NO: 12570 - protein, 285 aa, Acidovorax avenae subsp. avenae
SDIEVVGINDLLEPDYLAYMLQYDSVHGRFEGTVSVEGNTLVVNGKKIRLTQERDPANLKWGEIGADVVIESTGLFLDKTTAQKHLDAGAKKVVLSAPSKDDTPMFVYGVNHDTYAGQAIISNASCTTNCLAPVAKVLNDKWGIKRGLMTTVHAATATQKTVDGPSNKDWRGGRGILENIIPSSTGAAKAVGVVIPALNKKLTGMSFRVPTSDVSVVDLTVELEKAATYEEIKAEMKAQSEGALKGVLGYTEDKVVATDFRGDARTSIFDADAGIALDGTFVKVV

SEQ ID NO: 12571 - protein, 484 aa, Streptomyces avermitilis MA-4680
MAVTKSAVASLKREAEGAHAAHEGILRRQSARESAARTYARALPIVPVRARGLTIEGADGRRYLDCLSGAGTLALGHNHPVVLEAIRKVLDSGAPLHVLDLATPVKDAFTTELFRTLPAGLADRARVQFCGPAGTDAVEAAFKLVRTATGRSGLLAFTGAYHGMTAGALEASGGATDGRVARLPYPQDYRCPFGIGGERGAELGARWTESLLDDVKSGVPLPAGMILEPVQGEGGVIPAPDAWLRRMRAITADRSIPLIADEVQTGVGRTGRFWAVEHSGVVPDVMVLSKAIGGSLPLAVVVYRDDLDVWQPGAHAGTFRGNQLAMAAGTATLAYVREHRLAERAQTLGARMLDQLRSLATEFPCVGEVRGRGLMIGVELVRAEEDREAVSPGSGDFASLDTAGAGPRPAAPELAAAVQRECLRRGLIVELGGRHASVVRLLPPLTISDEQATAVLDRLADAVEAVARGRAERSRGFQRSERAG

SEQ ID NO: 12572 - protein, 128 aa, Zea mays
YLIVFIYLGLQVSGDATLQVDHFTFSPSIADNMRTASLVISHAGSGSIFETLRLGKPLIVVVNEDLMDNHQSELAEELAERKHLFCARPQTLGETIRAMDLETLVPYEPGDAKPVVALINRFLGFPVA

SEQ ID NO: 12573 - protein, 364 aa, Thermobifida fusca YX
MSLSIGIVGLPNVGKSTLFNALTKNDALAANYPFATIEPNIGVVGVPDPRLDTLAEIFGSARTVPATVTFVDIAGIVRGASEGEGLGNQFLAHIRETDAICQVIRVFEDPDVTHVDGVVDAARDIETINTELILADLQTLDKALTRLAREARANAKDKEKQETLAAAEKARTVLDSGKTLFSGAAEAGVDVGLLRELNLLTTKPFLYVFNGNLEAFADEAFRAKLSGLVAPAEAIFLDAKLEAELSELDEDEAAELLESMGQTESGLAQLARVGFDTLGLQTFLTAGPKEARAWTIRKGATAPEAAGVIHSDFQRGFIKAEVVSFDDLVAAGSLQEARAAGKVRMEGKDYVMADGDVVEFRFNV

SEQ ID NO: 12574 - protein, 391 aa, Triticum aestivum
  misc_feature (236)..(236): Xaa can be any naturally occurring amino acid
  misc_feature (280)..(280): Xaa can be any naturally occurring amino acid
IGMAALHVVILLSLICICRSDDRLTPAKPLSTGDKLVSSNGVFALGFFSPTNSTVGSYVGIWYNNIPKRTYVWVANRDKPITNASSGKLVVTNNSDLVLSESQGRTLWTTMNNFTTGATGTSAVLLDSGNFVIRLPNSTDIWQSFHYPTDTILPGMQLPLSTDDDLYTRLVAWRGPDDPATSDYSMGGDSSSDLQVVIWNGTRPYWRRAAWDGALVTALYQSSTGFIMTQTPGDVXFLAWNSTSSSWNVFIERPNPSCDRYAYCGPFGYCDATETVPKCXCLSGFEPDGVNFSQGCRRKEELTCGGGDSFSTLSGMKTPDKFVYVRNRSFDQCEAECRNNCACTAYAFSNMKNGSTSSDQARCLIWLGELVDTGKFRDGSGENLYLRLASS

SEQ ID NO: 12575 - protein, 522 aa, Neisseria gonorrhoeae
MKHRTFFSLCAKFGCLLALGACSPKIVDAGTATVPHTLSTLKTADNRPASVYLKKDKPTLIKFWASWCPLCLSELGQAEKWAQDAKFSSANLITVASPGFLHEKKDGEFQKWYAGLNYPKLPVVTDNGGTIAQNLNISVYPSWALIGKDGDVQRIVKGSINEAQALALIRNPNADLGSLKHSFYKPDTQKKDSAIMNTRTIYLAGGCFWGLEAYFQRIDGVVDAVSGYANGNTENPSYEDVSYRHTGHAETVKVTYDADKLSLDDILQYYFRVVDPTSLNKQGNDTGTQYRSGVYYTDPAEKAVIAAALKREQQKYQLPLVVENEPLKNFYDAEEYHQDYLIKNPNGYCHIDIRKADEPLPGKTKAAPQGKGFDAATYKKPSDAELKRTLTEEQYQVTQNSATEYAFSHEYDHLFKPGIYVDVVSGEPLFSSADKYDSGCGWPSFTRPIDAKSVTEHDDFSFNMRRTEVRSRAADSHLGHVFPDGPRDKGGLRYCINGASLKFIPLEQMDAAGYGALKGEVK

SEQ ID NO: 12576 - protein, 287 aa, Arabidopsis thaliana
MEGKEEDVNVGANKFPERQPIGTAAQTESKDYKEPPPAPFFEPGELKSWSFYRAGIAEFIATFLFLYVTVLTVMGVKRAPNMCASVGIQGIAWAFGGMIFALVYCTAGISGGHINPAVTFGLFLARKLSLTRALFYIVMQCLGAICGAGVVKGFQPGLYQTNGGGANVVAHGYTKGSGLGAEIVGTFVLVYTVFSATDAKRSARDSHVPILAPLPIGFAVFLVHLATIPITGTGINPARSLGAAIIYNKDHAWDDHWIFWVGPFIGAALAALYHQIVIRAIPFKSKT

SEQ ID NO: 12577 - protein, 387 aa, Prochlorococcus marinus str. MIT 9301
MAIQQKLSLMIPGPTPVPEKVLQALSKHPIGHRSKEFQDLVQSTTKNLQWLHQTQNDVLTITGSGTAAMEAGIINTLSRGDKVICGENGKFGERWVKVAKEFGLEVIKIDSEWGIPLDPEEFRKVLEEDKHKEIKAVILTHSETSTGVINDLETISSYIRKHNTALSIVDCVTSLGACNVPVDEWKLDIVASGSQKGYMIPPGLSFISMSQKAWEAAEKSNLPKFYLNLKSYKKSLQSNSNPYTPAVNLVFALDEALKMMREEGLDNIFRRHNKHKLAMSNAVKALNLKLFADEKYLSPSITAIKTEGMDAEEFRKTIKNNFDILLAGGQDHLKGKIFRVGHLGYVNDRDIITVVSAIGNTLLKMRKISAQQVGEALVVVSKYLEEK

SEQ ID NO: 12578 - protein, 528 aa, Prochlorococcus marinus str. MIT 9301
MSQKSFKKERDPSILILDFGSQYSELIARRIRETNVFSLVVSNCISIEDINDINPKGIILSGGPNSVYEQNAPKCDKKIFNLGIPILGICYGMQLMVKELGGSVISATKKAEYGRAPINIDQESDLLRDVEDKSIMWMSHGDSINCLPDGFNKIAHTENTLHAAISNDIKKLFGVQFHPEVVHSEFGMKIIKNFVYNISCCEADWTTETYIEETIPRIREQVGNKKVLLALSGGVDSSTLAFLLNKAIGNQLTCMFIDQGFMRKGEPEFLMNFFDKKFHIKVEYINARERFIAKLKGITDPEQKRKIIGEEFIRVFEEESNRLGPFQYLAQGTLYPDVIESAGTNIDPKTGERIAVKIKSHHNVGGLPKDLQFKLVEPLRKLFKDEVRKVGGALGLPDEIIKRHPFPGPGLAIRILGEVNNEKLDCLRDADWIVRDEIKKAGLYNDIWQAFAVLLPVKTVGVMGDKRTYAWPIVLRCVSSEDGMTADWSKIPFKILERIANRIVNEVISVNRVVYDITSKPPGTIEWE

SEQ ID NO: 12579 - protein, 384 aa, Mesostigma viride
ARLAPVQATGSSQKQVTEAKLKVAINGFGRIGRNFLRCWVGRENSPLEVVAINDSGGVKQAAHLLKYDSMLGTFKADVKVISETALAVNGKTIEIVSSRDPLQLPWAKMGVDLVIEGTGVFIDGPGAGKHIIAGAKKVLITAPAKGAEIPTYVVGVNEKDYTHDVSNIISNASCTTNCLAPFAKVLDENFGIVKGTMTTTHSYTGDQRLLDASHRDLRRARAAAFNIVPTSTGAAKAVSLVLPKLKGKLNGIALRVPTPNVSVVDLVINTTKKGMTAEEVNAAFRKEANGAMKGILAVSDLPLVSIDFRCSDVSCTIDSSLTMVMGDDMVKVVAWYGNEWGYSQRVVDLADIVANNWPGMVQETGSDPLETFCNTNPDADECRV

SEQ ID NO: 12580 - protein, 167 aa, Arabidopsis thaliana
MMLKQAAKKALGLTSRQSTPWSVGILRTYHENVIDHYDNPRNVGSFDKNDPNVGTGLVGAPACGDVMKLQIKVDEKTGQIVDARFKTFGCGSAIASSSVATEWVKGKAMEDVLTIKNTEIAKHLSLPPVKLHCSMLAEDAIKAAVKDYKEKRVKTNGAAAAGETTQA

SEQ ID NO: 12581 - protein, 127 aa, Triticum aestivum
MDDAGEIHAFGRSLRRESSVWSRGGDDLFSRSSRDEDDEEALRWAALEKLPTYDRARTAVLAMPEGELKEVNVEKLGAQEKHALLQRIAWVGDDHERFLSKFKDRVDRVGIQLPTIEVRYDNLNVEA

SEQ ID NO: 12582 - protein, 329 aa, Mesostigma viride
FGRIGRLVWRATLNRDDVEVVAINDPFIDVPYMVYMAKYDSVHGNLTHDVQQGDGKLMVNGKSITIFGKMDAKEIPWKEAGATFVVESTGVFTTLEGASSHLVGGAETVVISAPSNDAPMFVMGVNEEGYKPDMKVVSNASCTTNCLGPLAKVIHLKFGILEGLMTTVHATTATQKTVDGPSKKDWRGGRGILDNIIPSATGAAKAVGKVLPALNGKLTGMAFRVPTPDVSVVDLTVRLEKGASYDAIKAEIKRASENELKGILAYTEDAVVSTDFIGNKHSSIFDAEAGIALNDNFVKLVSWYDNEWGYSNRVADLIAHMAKVKAASH

SEQ ID NO: 12583 - protein, 381 aa, Shewanella oneidensis MR-1
MSNPAQRATKLFVQTFGTKADDLYQAPGRVNLIGEYTDYNDGFVLPAAINFHTVIAVKRREDSKFRAVADAFPGQIKEWTFGKETEIHPEDGWVNYLKGFTAAMANTGLIAKGLDLAVVGDVPLAAGLSSSGALVVAFGTAISDSSQLHLSPMAVAQLAQRGEYRYVASACSIMDHMVCAMGEPDHALLIDCLDLDSEAIAIPENLSLIIIDAHIEKQRLATISQQRREECAQAAEFFGLDALRHLDLRQLESAKNKLDETLYRRAKHVVTENKRTQSAARALEQNNISKFSLLMAQSHQSLRDDFEVTLPEFDTLVDIVSQVIGERGGIRMTDGCVVALVDHELTDAVVSAVEQAFFEQTGIDATVYLCSASSGAGRIDS

SEQ ID NO: 12584 - protein, 289 aa, Sulfolobus solfataricus P2
MKVGFIGLGIMGFPMASNLLKAGYDLTVYNRTIEKAEKLGKMGAKVAHSPKEVAEVSEIVISMVTDAPDVEEVLFGENGVVKSNKRGLIFVDMSTNSPEFAKKVTKRLSEYGMEFLDAPVTGGDKGAREGTLTIMVGGKEDVFKRVEPIFKAMGKNIIHVGDVGSGQALKLCNQVVVALNMVSVVEGLLLARSLGIDDDKLFSVLSTGAANSFTVQYYLPKIMKGDLNPGFKAAHLKKDLKYAMEIANSKSLPLLGTSLALQLYNAMVSLGIGELGTQGLVKVYEKLVK

SEQ ID NO: 12585 - protein, 285 aa, Acidovorax defluvii
  misc_feature (271)..(271): Xaa can be any naturally occurring amino acid
SDIEVVGINDLLEPEYLAYMLQYDSVHGRFQGTVSVEGNTLIVNGKKIRLTQERDPANLKWNEVGADVVIESTGLFLDKVSAQKHIDAGAKKVILSAPSKDDTPMFVFGVNHDTYAGQAIVSNASCTTNCLAPVAKVLNDKWGIKRGLMTTVHAATATQKTVDSPSNKDWRGGRGILENIIPSSTGAAKAVGVVIPALNKKLTGMSFRVPTSDVSVVDLTVELEKAATYEEIKAEMKAQSEGALKGVLGYTEDKVVATDFRGDTRTSIFDXDAGIALDGTFLKVV

SEQ ID NO: 12586 - protein, 320 aa, Brassica rapa subsp. rapa
MEENIKPPVIDLSKLNDEERDQTMALIDDACQNWGFFELLNHGIPYDLMDNIERMTKEHYKKFMEQKFKEMLRSKGLDTLETEVEDIDWESTFFLHHLPQTNLYDIPNMSDEYRTAMKDFGKRLENLTEELLDLLCENLRLEKGYLKKVFRGTKGPTFGTKVSNYPPCPNPEMIKGLRAHTDAGGLILLFQDDKVSGLQLLKDGDWVDVPPLKHSIVINLGDQLEVITNGKYKSVMHRVMTQKEGNRMSIASFYNPGSDAEISPAQSLVDKESEYPSFVFDDYMKLYSGVKFQPKEPRFEAMKNAAVTTDVNPVATEETF

SEQ ID NO: 12587 - protein, 286 aa, Acidovorax delafieldii
SDIESRGINDLLEPEYLAYMLQYDSVHGRFDGTVAVEGNTLIVNGKKIRLTQERDPANLKWNEVGADVVIESTGLFLDKVTAQKHLDAGAKKVILSAPSKDDTPMFVFGVNHDTYAGQAIISNASCTTNCLAPVAKVLNDKWGIKRGLMTTVHAATATQKTVDGPSNKDWRGGRGILENIIPSSTGAAKAVGVVIPALNKKLTGMSFRVPTSDVSVVDLTVELDKAATYEEIKAEMKAQSEGALKGVLGYTEDKVVATDFRGDTRTSIFDADAGIALDGTFVKVVA

SEQ ID NO: 12588 - protein, 301 aa, Debaryomyces hansenii CBS767
MGDSSFVIDFLMGGVSAAVSKTAAAPIERVKLLIQNQDEMMKQGRLSRKYDGIIECFKRTAAEEGMVSFWRGNTANVIRYFPTQALNFAFKDKFKAMFGFKKNEGYWKWFAGNLASGGMAGATSLLFVYSLDFARTRLANDAKSSKGDGQRQFNGLIDVYKKTLASDGIAGLYRGFGPSVIGIIVYRGLYFGLYDSLKPVILVGPLEGNFLASFLLGWAVTTGASTASYPLDSVRRRMMMTSGQAVKYDGAFDCFKKVVAAEGIKSLFKGCGANILRGVASAGVLSMYDQFQMIMFGKKFS

SEQ ID NO: 12589 - protein, 291 aa, Acidovorax facilis
  misc_feature (15)..(15): Xaa can be any naturally occurring amino acid
  misc_feature (17)..(17): Xaa can be any naturally occurring amino acid
  misc_feature (229)..(229): Xaa can be any naturally occurring amino acid
  misc_feature (269)..(269): Xaa can be any naturally occurring amino acid
DIEVVGINDLLESDXLXYMLKHDSVHGPFKGEVSVEGRNLVVNGNRIRLTQERDPANLKWGEIGADIIVESTGLFLTKEGAQKHIDAGARKVIMSAPSKDDTPMFVYGVNDKTYAGQEIISNASCTTNCLAPLAKVLNDRWGIKRGLMTTVHAATATQKTVDGPSKKDWRGGRSILENIIPSTTGAAKAVGVVIPALNKKLTGMSFRVPTSDVSVVDLTVELHNEASYXEICAEFKAQSEGPLKGILGYTEDKVVATDFRGDARTSIFXADAGIALDGTFVKLVAVRQQCY

SEQ ID NO: 12590 - protein, 199 aa, Neisseria meningitidis Z2491
MALKTSNLEHAMLVHPEAMSVGALADKIRKIENWPQKGILFHDITPVLQSAEYFRLLVDLLVYRYMDQKIDIVAGLDARGFIIGAALAYQLNVGFVPIRKKGKLPFETVSQSYALEYGEAAVEIHTDAVKLGSRVLLVDDLVATGGTMLAGLELIRKLGGEIVEAAAILEFTDLQGGKNIRASGAPLFTLLQNEGCMKG

SEQ ID NO: 12591 - protein, 229 aa, Dichelobacter nodosus VCS1703A
MSKTRIEISPSILAADCARLGEEVAQVLAAGADSIHFDVMDNHYVPNLTFGAPICQALRNYGISAAIDVHLMAQPVDALINAFAQAGATSITIHPETTLHLNRSLQLIRDLGLKAGLALNPATGISCLEYVLDQLDIILIMTVNPGFGGQNFLPVILDKIRAVRQKLADFKPPIRLAVDGGINQQTIAAAAAAGADTFIAGSAIFHAPDYQNIMQQLRDTATRAFCQPR

SEQ ID NO: 12592 - protein, 287 aa, Acidovorax konjaci
SDIEVVGINDLLEPDYLAYMLQYDSVHGRFEGTVSVEGNTLVVNGKKIRLTQERDPANLKWGEIGAEVVIESTGLFLDKVTAQKHLDAGAKKVVLSAPSKDDTPMFVYGVNHDTYAGQAIVSNASCTTNCLAPVAKVLNDKWGIKRGLMTTVHAATATQKTVDGPSNKDWRGGRGILENIIPSSTGAAKAVGVVIPALNKKLTGMSFRVPTSDVSVVDLTVELEKAATYDEIKAEMKAQSEGALKGVLGYTEDKVVATDFRGDARTSIFDADAGIALDGTFVKISPV

SEQ ID NO: 12593 - protein, 288 aa, Acidovorax temperans
SDIEVVGINDLLEPDYQAYMLQYDSVHGRFQGTVAVEGNTLIVNGKKIRLTQERDPANLKWNEVGADVVIESTGLFLDKASAQKHIDAGAKKVILSAPSKDDTPMFVFGVNHDTYAGQAIVSNASCTTNCLAPVAKVLNDKWGIKRGLMTTVHAATATQKTVDGPSNKDWRGGRGILENIIPSSTGAAKAVGVVIPALNKKLTGMSFRVPTSDVSVVDLTVELDKAATYDEIKAEMKAQSEGALKGVLGYTEDKVVATDFRGDTRTSIFDADAGIALDGTFVKVVAVR

SEQ ID NO: 12594 - protein, 409 aa, Opitutaceae bacterium TAV2
METRKFAELGLSPELLKAVDKMGFEEASPIQAAVIPLLLAGSDVVGQSSTGSGKTAAFALPAIERVDTKLKAVQVLILCPTRELAVQVAEEVNKLASFKRGVMEVPIYGGQSYERQFRALAAGAQVVIGTPGRVMDHMERGTLKLDKLSMVILDECDRMLDMGFRDDIEHILKSVPEQRQSLFFSATMPREIRDMISRFIPNPAWVKIETQMQSAPQVDQVYFEVDRRSKLEVLTRLIDLNDFRYGIIFCSTKIMVDELDENLHARGYACDRLHGDITQAQRTRTMEKFKRRGFEFLIATDVAARGLDVDDLEVVFNFDLPNDAEDYTHRIGRTGRAGRKGKAFTFVSGRELWKLQSMVRFARLDIRRERVPSLDQVEEARENVFFEKTTRHARRQKIPSARPLHRPPS

SEQ ID NO: 12595 - protein, 413 aa, Zea mays
SGAICRVRRHTISVFVGDESGMINRIAGVFARRGYNIESLAVGLNKDKALFTIVVSGTDRVLNQVIEQLNKLVNVLSVEDLSKEPQVERELMLIKLNVEPDQRPEVMVLVDIFRAKVVDISEKTLTMEVAGDPGKIAAVQRNLWKFGIKEICRTGKIALRRERIGATARFWRFSAASYPDLIDALPKNPLTSVNRTVNGSFGQPSNAGGDVYPVESYESLSVNHVLDAHWGVLDDDDATGLCSHTLSILVNDCPGVLNIVTGVFARRGYNIQSLAVGSAEKEGISRITTVVPGTVESIGKLVQQLYKLIDVHEVHDITHSPFAERELMLIKVSVNTAARREILDIAEIFRAKPIDVFDHTVTLQLTGDLDKMVALQRLLEPYGICEVARTGRVALVRESKVDSKYLRGYFFPL

SEQ ID NO: 12596 - protein, 614 aa, Marchantia polymorpha
SSCFFHSSSSSLRILRSRADQPLRRALSIPHHRIEAMASGQHAPISESAAWADLKQHVKTIEGTHLRNLMQDNNRCEELIKEYDGIVVDLSRQRVIHDTVDKLLNLAEEAKLKEKIDQMFDGVHINETENRSVLHAALRAPRDEVINCDGQNVVPAVWDVLDKIDAFSDQIRSGSWLGSTGKPLTDVVAIGIGGSFLGPLFVHTAMQTEPGCAQAAKGRRLRFLANVDPIDVARALLDLNQETTLVVIVSKTFTTAETMLNARTVRTWITSALGVEAVSKHMVAVSTNLKLVKEFGIDPANAFGFWDWVGGRYSVCSAVGVLPLALQYGFSHVKKFLQGAWSIDDHFRSAPLESNLPVLLGLMSVWNVSFLGCPARAILPYCQALAKLAPHIQQVSMESNGKGVSLDGVPLPFGTGEIDFGEPGTNGQHSFYQLIHQGRVIPCDFIGIIKSQQSVYLKGEQVSNHDELMCNFFAQADALAYGKTREELVAEKVPEALIPHKMFSGNRQSLSILLPNLTPYTVGQLLALYEHRVAVQGWIWGINSFDQWGVELGKSLAGKVRTQMNAARTKTQPLSGFNYSTTTLLTRYLQGKTQLLYPDPHDVFPSNVLPGFEK

SEQ ID NO: 12597 - protein, 259 aa, Rickettsia typhi str. Wilmington
MTIKIHTDKDFIKMRAAGKLAAETLDFITDHVKPNVTTNSLNDLCHNFITSHNAIPAPLNYKGFPKSICTSINHVVCHGIPNDKPLKNGDIVNIDVTVILDGWYGDTSRMYYVGDVAIKPKRLIQVTYDAMMKGIEVVRPGAKLGDIGYAIQSYAEKHNYSVVRDYTGHGIGRVFHDKPSILNYGRNGTGLTLKEGMFFTVEPMINAGNYDTILSKLDGWTVTTRDKSLSAQFEHTIGVTKDGFEIFTLSPKKLDYPPY

SEQ ID NO: 12598 - protein, 407 aa, Heterocapsa triquetra
IIETLVTVLNNIKQEHNDGTVEKPVLLHIKTTKGKGYQAAEDARDKLHAVQPKFNLPKKKDAVPAKPAPPPLTRVFADALVKEAERDEKIVAITAAMPGGTGINIFEKRFGPERTFDVGIAEQHAVTFAAGLAAGGLKPFCSIYSTFMQRGYDQLVHDVALQQLPVRFVLDRAGLVGADGATHGGTFDLSFMGCIPDMLICAPSDEQELANLVHTMAKIDDLPTAMRYPRGNAYGDLVMPDRPRFLEPGKGRVAREGRDSSLALLSVGGRLRECLQAAETLENMGISATVADARWVKPLDTKLLQWLASEHRAVITVEENAIGGFSAQVHQELLESGALDGRGKTPTVLRSMILPDRWIDHHHDAKAQYDDAGLNAKHIVAKALQALERAGVKVNAEAMEQERIALP

SEQ ID NO: 12599 - protein, 152 aa, Prochlorococcus marinus str. MIT 9301
MTKERTFIAIKPDGVQRGYVSEIIGRFEKKGFKLVGLKQLIPSKELAQNHYGVHRERPFFGDLVDFISSGPVVAMVWEGEGVILSARKLIGSTKPLEAEPGTIRGDLAIDIGRNIIHGSDGEDTAKFEIDLWFNEEELCEWETSDLKWRSEN

SEQ ID NO: 12600 - protein, 674 aa, Arabidopsis thaliana
MNLTHLESALRKGFEVKLVIDEIPCQECSSSRGICGFNSTTQICCNVTSLSGGVTCVPQHQPSADELRRRCSERFSCGNQRNLYYPFWIPGREYCGHPDFKLDCSGGFAELNIASVNFRILNMSYDSSNKRLARSDYLNDLCPPNPLNDEPLIETVLQFSADTELLTLYYDCQLNSSATSPFPSSYFGELGCDEGRSYYVTRNLSSPLLDRFRGVLNNLREMCKRKVSVPASGPALNTLQTNPNSNNLKMALEHGFELQDNSNCSMCVLSGGSCGYNQNSMAIIIGIFVALCTIGGFIAFLVLLCPCCKVRIFRNRKTSDDRRQEKLKALIPLKHYTYAQVKRMTKSFAEVVGRGGFGIVYRGTLCDGRMVAVKVLKESKGNNSEDFINEVSSMSQTSHVNIVSLLGFCSEGSRRAIIYEFLENGSLDKFISEKTSVILDLTALYGIALGVARGLEYLHYGCKTRIVHFDIKPQNVLLDDNLSPKVSDFGLAKLCEKKESVMSLMDTRGTIGYIAPEMISRVYGSVSHKSDVYSYGMLVFEMIGARKKERFGQNSANGSSMYFPEWIYKDLEKADNGDLEHIEIGISSEEEEIAKKMTLVGLWCIQSSPSDRPPMNKVVEMMEGSLDALEVPPRPVLQQIHVGPLLESSWITEESSSISEIENRNLQVCEKILS

SEQ ID NO: 12601 - protein, 240 aa, Pavlova lutheri
AIEGLKPFVAIYSTFLQRGYDQVVHDVVTQKLPVRFILDRAGLVGNDGPTHHGSFDLAYLGCLPDLVIMAPSDELELLHMIATAYELESLPSAIRFPRGNALGLEAMREQLGYDISAMPAKGTALPIGRGRYVKRADASRSKRVALLSLGTRLAPAMQAARALEEDADFGGTLGVTVADARFMKPLDMQLLRELAAQHDVLITIEDGSVGGFGDHVLHVLALDGALDEGKLRVRPMVLPD

SEQ ID NO: 12602 - protein, 496 aa, Epichloe festucae
MDLTQFKTAGIVWPTVAAMAISYILLSSFLSWYRLRHIPGPFLASISSLWNVLNIVTGRTSPVLEKLPGKYGPMVRTGPNYVLTDDAEILRHVNGARSTYPRNGWYEGFKVDEHDHMGSHIDTSVHDAIKSKVIGGYNGKDGIDLEGAIGSQVKTLVSEIRRRHLGQPVDFSRLMRQMALDAITAVAFGEALGFLTAEDGDVFGYVSAVDKMLTYLTLASDLPIVRSFVRSRRMAPAVRCVLAYTGIGRMLNHTRRVVAERYAADDPGKGDMTASFIRKGLTQIECEGESHLQLIAGADTAVTVLRSTLLYIMTTPRVYTRLKAEIKAAVDAGEVVEVITMAQAQGLPYLQAVVLEGFRMRPAVVYGHFKSVPAGGDTLPNGVRLPAGTAIAPNYIALTRRTDVYGADVDLFRPERFLDAEPAKRHEMERAMDLNFGLGRWQCAGRNIALMEMNKVFFELLRHFDLQIVYPGKAWDEYTGVVYSQHNMWVQITESS

SEQ ID NO: 12603 - protein, 285 aa, Acidovorax valerianellae
LDIEVVGINDLLEPDYLAYMLQYDSVHGRFQGTIAVEGNTLVVNGKKIRLTQERDPAQLKWNEVGADVVIEATGLFLTKETAQKHIDAGAKKVILSAPSKDDTPMFVHGVNCNSYAGQPIISNASCTTNCLAPVAKVLNDKWGIKRGLMTTVHAATATQKTVDGPSNKDWRGGRGILENIIPSSTGAAKAVGVVIPALNKKLTGMSFRVPTSDVSVVDLTVELEKPATYAEICAEMKAQSEGALKGILGYTEDKVVATDFRGESCTSVFDADAGIALDDTFVKIV

SEQ ID NO: 12604 - protein, 441 aa, Frankia sp. EAN1pec
MTVVETRAAGAGAHAGAGFDVERVRRDFPILARTVHDGLPLVYLDSAATSQKPLAVLDAERTYYERHNANVHRGIHVLAEEATALYEESRDKIAAFVGAPDRREIVFTKNSSEALNLVAYAMSNAVTGGPEAERFRLGPGDEVVITEMEHHSNLVPWQMLCARTGATLRWIGLTEDGRLDLAHLDEVITDRAKIVSFVHQSNILGTVNPVATIVARAREVGALTVLDGSQSVPHMPIDVVDLGVDFLAFTGHKMCGPTGIGVLWGRRELLEVMPPFLGGGEMIEVVTMEASTYAAPPHRFEAGTPMISQAIGLGAAVDYLTGLGMDAVAAHEHEITAYALDALAGVPGLRVIGPPTAEGRGGAISFALRDSEDRPLHPHDVGQILDEQGVAVRVGHHCARPVCLRYGVPATTRASFHLYTNTADVDALVEGLGQVRRFFLK

SEQ ID NO: 12605 - protein, 332 aa, Zea mays
MSTANRYQHIKSTKPVVGKARKLKDLMIKSDNRICADCGAPDPKWASANIGVFLCLKCGDVHRALGPDISKVLSVTLDDWSDSDIDSMVEVGGNSYANSIYEAFLPKDHPKPKPDSTMEYRTKFIRAKYETQDFLKPSLRISSRSSFKSTTSVKSVDSNFSSTSRKDVSEDTREFVGELNITLVKGTNLAVRDMLTSDPYVVLTLGGQKAQSTVKKSDLNPVWNEMLKISVPRNYGPLKLEVYDHDTFSADDIMGEAEIDLQPMITAAMAFGDTSRLGDMQIGRWFTTKDNALMKDSTVNVVAGKVKQEVHLKLQNVESGELELELEWVPIL

SEQ ID NO: 12606 - protein, 387 aa, Saccharomycopsis fibuligera
MSGAAQRLSQISGILNPGTTSENTILIVPEKPFKISVIGSGNWGTTIAKVIAESTGENPELFQKDVHMWVFQEKIDGRNLTDIINTEHENVEYLPEVKLPENVIAEPDITKTVEGSDLIVFNIPHQFLGNVCRQLKGHVPTTARAVSCLKGLDVTPQGCKLLSSYITENLGIYCGALSGANLAPEVARQKWSETTVAYNEPADFRGQGKDIDKAILKKVFHRPYFHVRVVGDVPGVSLAGALKNVVAMAAGFVEGLGWGDNAKSAIMRIGLVEIIKFAQKYFPESDPKTFTEESAGVADLITTCSGGRNVRVGKYMAETGKDAAEAEKVLLNGQSSQGIVTTKEVHDLLANDNATQDFPLFEATYQIIYNGLPMGKLPSLLESAGDN

SEQ ID NO: 12607 - protein, 413 aa, Frankia sp. EAN1pec
MRSPRVLGLVLAGGAGKRLAPLTADRAKPAVPFGGIYRLVDFVLSNLVNGGYLRIAVLTQYKSHSLDRHITTTWRMSNLLGNYVTPVPAQQRLGPQWFAGSADAIHQSLNLVHDEAPDVVVVFGADHVYRMDPRQMVAQHLETGAGVTVAGLRVPRSEGSAFGVIRTADDGVTIAEFLEKPADPPGLPGSPDEIFASMGNYVFTTDVLIDALRADAADPESVHDMGGSIVPMLVEQGTAAVYDFAANQVPGALERDHGYWRDVGTLDSYFDAHMDLCALDPVFNLYNRDWPIYTNVPPSVPPAKFVHDTPGRVGVATDSIVSNGVIISGGAVRRSVLSPGVRVNSWSVVENAVVMDNSVIGRRAVVRDAILDKNVVVPPGATVGVDKEHDRARGYQVSEAGVTVVGKGVTIAD

SEQ ID NO: 12608 - protein, 719 aa, Oryza sativa
MAAPATLAPCPCHRGTRAVVECDRSTVPMASGHREWMNSCPGLCRACSFGDETSPPVCTGIWGRSSIRQWLCQVFRARTVRIGSEAALDLIWAVHCSQGTGGADEASRDPRLLLAAAARGFPNREILFSPKKPNKEKSLRANSTRSEARIEVGFHNFMDFDCKTARGDSSSVNRSCIVTEGTVVQAKPVSHNGKAKHWNSLSTLNNQKCSYELLSDPKKNVETSDGETASKCDSWCFTDLPSALVCEVLEHLDPKELGIVSCVSTLLHTLATDHQGWKKFYCERWGIPTPPVTLNGPLVPGGTSDWKSWKTLFVEREFRSKSFMGRFSVDVLRDHSEDVRTVFLLASVNLIFTGGNDSVIRMWDLEEGLLIDKSRPLCCTIRAIAADTRLLVTAGTNAFIHCWRAVEGNSYPFHISGNGTDQSPEFRLWGHEGPVTCLALDSLRIFSGSWDMTVRVWDRSEMKCVQKFMHADWVWSVAPHGNTVASTAGRDAYVWDIRSGELENVISNAHYGNAFSLARTHLADVLFTGGEDGAIRLFNVSEVSDDEDIKPAATWVPHTGPVHSLAFEYPWLVSASSDGRVALIDLRKLLTPRKSSKQPFRVKNFDPSSIEPPQRMLHGFGCDLFSVAIGADRIVCGGEDGAVKVWNFSEALEIEKRAQALRSMRQENRMRRKKAQVEMNANGRRSDQCGSIAMKRNQLKGDKSVTWHSKRAINDKVKS

SEQ ID NO: 12609 - protein, 750 aa, Dehalococcoides sp. VS
CLVYEVTKNDIPLVGGKGANLGEMTGAGIPVPPGYIVTANAYFDFINSSNLRPSISKALESLDINDSKQLAVVANIVKEMILSTPLPAELATQIKVAYEKMGQGLVAVRSSATAEDLPEASFAGQQSTYLNIEGGDEVVKAVQKCWASLFEARAIYYRVQQNFDHLQVGIAVPVQKMVQSQASGVCFTIEPITSDPTKIVIEAIYGLGEGLVSGEITPDLYIIDKEGPSVLSRTISHQERRLVRKNGNSASGAEDESGNNYWQPVPSAKQEQQKITEDDIITLAKLAMLIEKHYSGPQDIEWAKEENEIYIVQSRPVTALKDASELEPEIEAPILLQGAAASPGLATGEVKVLQDPSEIDLVNQGDILVAEMTTPDFVPAMKRAAAIVTNRGGRTSHAAIVSRELGIPCVVGTGEATKLLKNGQMITVDGTHGKVYNGKVTRNVKTSSIASIVREAIRTKTRVYVNLAQPELADKVAARNVDGVGLLRAEFIFSQIGKHPRYMIEMGQQEEYIQQVYEGVLSFAKAFHPRPVVYRTNDFKTNEYRDLLGGDKYEGQEENPMLGYRGVSRYIKDIEVFKMEIEAIKRVRKDYPNVYVMLPFVRTVDELKKVKQILEDEGLKRGPDFKLWMMVEVPSNIFLIDKFIDAGIDGISIGSNDLTQLILGVDRDSEMLRETFDERNEAVLVALEKAVTTAARRGITASICGQAPSVYPELTEKLVSWGITSVSVSPDMIGTTREIIAKAEAKLKIK

SEQ ID NO: 12610 - protein, 114 aa, Aspergillus nidulans FGSC A4
MAPLKAGDPFPSDVSFQYIPWSEDKGEVTACGIPIKYDASKEWADKKVVLFSVPGAFTPTCSVNHLPGYIKNLPELKKKGIQIVAVVASNDPFVMSAWGKANQVTGDDIVLHLF

SEQ ID NO: 12611 - protein, 434 aa, Desulfotalea psychrophila LSv54
MPFNTQHLKDLNTIKVWGKVTKIVGLVVEGHCPHASIGSLCEISPVDHGSPIFGEVVGFRDGKVLLMPLGELRGLGAGSLIRVIRQSATMRVGPHLLGRVIDGMEVPQDTLPPPELSEEVELYALPPNPMLRDNICQPIDLGVRAINGLLTCGLGQRMGIMAGSGVGKSVLLGMMAKYAQADINVIALIGERGREVREFIERDLGPEGLARSVIVVVTSDQSPLLRMRGAFVATAIAEFFCKQGKNVLLMMDSVTRFAMAMREIGLAIGEPPTTKGYTPSVFATLPKLLERAGRFKGQGSITGIYTVLVDGDDMTEPVADSVRSILDGHIVLSRAIAAKNHFPAIDILASASRVMRDIVSPEHIELAGKLRTVLADYREAEDLINIGAYVKGTNKNIDLAIEKIEQAKLFLKQGYNQTTDMTETLEQLESLFAL

SEQ ID NO: 12612 - protein, 309 aa, Campylobacter upsaliensis RM3195
MRGYKIFSGSANLEFAKQISKYLSLPLSDAGVKRFSDGEISVQIDESVRGKDVFIIQSTCAPANDNLMELLILTDALRRSSANSITAIIPYFGYARQDRKANPRVPISAKLVADLIEAAGIDRVATIDLHAGQIQGFFNIPVDNLYGSIVFNDYIKSKHFKNAVVGSPDIGGIARARSVAKKLGLDIIIVDKRRERANESEVMNIIGDVNGKDVVLVDDIIDTAGTIVKAAKALKEKGANSVMACCTHAVLSGEAYERIAKGDLDELVITDTIPLKKEHEKIKVLSVAPIFAEVIRRVYHNESVNSLFI

SEQ ID NO: 12613 - protein, 370 aa, Thermobifida fusca YX
MAERRPVADRLPTFPWDRLAPYKETAAQHPDGIVDLSVGTPVDPVPPRLRAALAEAADTPGYPQTYGTRALRESISGWLARRHQVQVDPDATLPTIGSKELVAWLPTLLGLGPGDTVVFPELAYPTYDVGARIAGATPVAADSLTQLGPVRPGLLWINSPANPTGRVLGLEHLRKVVSWARERGVVVASDECYLELGWEGERPLSILHPEVCGGSHEGLLAVHSLSKRSNLAGYRAGFVAGDPALVQQLLQARKHAGMMVPAPVQAAMRAALDDDEHAEEQKQRYAARRTQLRDALEKAGWQITHSEAGLYLWASHPDYDAWGSVRVLAEQGILVAPGEFYGPAGARHVRVAFTATDERVAAAVKRLAEL

SEQ ID NO: 12614 - protein, 106 aa, Zea mays
  misc_feature (28)..(28): Xaa can be any naturally occurring amino acid
PKCYKLTDKTVIGCSGFHGDCITLTKIXIEARLKMYKHSNNKAMTTGAIAAMLSTILYSRRFFPYYVYNIIGGLDEEGKGAVYSFDPVGSYQRDSFKAGGSASAML

SEQ ID NO: 12615 - protein, 192 aa, Zea mays
  misc_feature (57)..(57): Xaa can be any naturally occurring amino acid
  misc_feature (86)..(86): Xaa can be any naturally occurring amino acid
MNDAHESGVPSGIVPILQNIVSTVNLECKVDLQHVANSARNAEYNPRSQRDPDTYLXRFAAAIMRIREPKTTTLIFASGKMYVSIXPLQFARIVQKLGSPARFKDFKVQNIVGSCDLKFPIRLEGLALASGLSATYEPEIFPGLVYRMVDPKVVILVFVSGKIVLTGAKVREEICAAFEKIHPMLVQFRKRS

SEQ ID NO: 12616 - protein, 460 aa, Oryza sativa Japonica Group
MTTSRRLADRKTAKFQKNITKRGSVPETTVKKGNDYPVGPLVLGFFIFVVIGSYLALMSGAELFIREDLGLADEQVEVLSGSMNVFMLASILAAGTVADAAGRRGTLVLANALLMAGALAMSLGGSYAALMAARFVTSVGVGFAVVVAPVYAVEISPASSRGVLSSLPEIFINAGILLSYVSNYALAGLPAAPRLARHVRRGRRAARVPRRGRARHAGVAPVARHARARRRGARRARAHLGYPRGGGPPPRGDHAGRRGAGRRGRRRLEAAARPANADARWCSSRPAWRRTPPCWPPPSPVGVVKTCSILVATLLSDRLGRRPLLLWSAAGMAVALASLALTLCVGAGAPSPARAAAGVASAAAYVAAFSVGLGPLAPSYGSEIMPLWLRAQGAGVGVAVNRVTCGVLSMTFISVAGGITMAGCFFVYAGAAVAAWVFVYVRLPETRGRSLEDMDVLFTK

SEQ ID NO: 12617 - protein, 187 aa, Arabidopsis thaliana
MDSSTSTKKNTKLFVRNQTCFKKSSLSSSNAKKTTNLSMREQTMFKKALELSTLCDIEVCVIYYGRDGKLIKTWPEDQSKVRDMAERFSRLHERERCKKRTNLSLFLRKQILHDKKLSEKVLEMEDSLESGLRVLQDKLLLLQPEKNQTELGQSCAVYSTTYPLSSPSLIEDHQHQQQWTEPLSNTE

SEQ ID NO: 12618 - protein, 481 aa, Oryza sativa Japonica Group
MEADAGKLFIGGISWDTNEDRLREYFDKYGEVVEAVIMRDRATGRARGFGFIVFADPAVAERVIMEKHMIDGRMIHDDDDGVLDPSMVVEAKKAVPRDDQHALSKSGGSAHGSPGPSRTKKIFVGGLASTVTEADFRKYFEQFGTITDVVVMYDHNTQRPRGFGFITYDSEDAVDKALFKTFHELNGKMVEVKRAVPKELSPGPSMRSPVGGFNYAVNRANNFLNGYTQGYNPSPVGGYGMRMDARFGLLSGGRSSYPSFGGGYGVGMNFDPGMNPAIGGSSSFNNSLQYGRQLNPYYSGNSGRYNSNVSYGGVNDSTGSVFNSLARNLWGNSGLSYSSNSASSNSFMSSANGGLGGIGNNNVNWGNPPVPAQGANAGPGYGSGNFGYGSSETNFGLGTNAYGRNAGSGVVNTFNQSTNGYGRNFGDSSGGGGGGGGGSIYGDTTWRSGSSELDGTSPFGYGLGNAASDVTAKNSAGYMGH

SEQ ID NO: 12619 - protein, 355 aa, Gossypium hirsutum
MTEPRRLRGHKATATCCIASRDKPGLVATSGEDGCICWFDMRCKDVKFVMDVSNEPISSLCFNSGNENIIYVSTGNEVKSFDVHMLADNSWKPLESYNYNKEEINQVTCNSRSSFLASADDGGEIKIIDIHQKRIFKTLRAGHTIVTGGLDSKFIIWDFSKGRSSKIVDFGLPDMRSGSNAGQCLNPAFVHSVKVPDVDMLDKIGKICVVARGDGVIDVINTESELTATKPKSSTKSRKGTQSKGSDGGVPDENGRKWLHLDYSLGGHTAAMSCVTFSLFGEKGKFLVSGGNDKLVKVWDCSRCLDSWQTGDTNELLHLNINLTKKVNWLCTTPAESDNLVVCDTTKLVKVYSVS

SEQ ID NO: 12620 - protein, 733 aa, Zea mays
  misc_feature (319)..(319): Xaa can be any naturally occurring amino acid
MAPAAGTATGSASGGSAVHDDAEAVELGHNNLIRRRHPGADVEDEADDRNVGASAAAGKELAPSSVEQAFADQPVPSWREQLTVRAFVVGALLSVVFNVILMKIDLTTGINPSLNVCASLLSYFLLRTWTRAIGCMGLLRQPFTRQENTMIQTCVVSAYGITFTDSNLTGGFSSYLFGMSAKIANKTEVNDPQDIKDPHLGWMMGFMFLVSFLGLFALVPLRKVMIVDYKLTYPSGAATAYLINGFHAPEGSERAKKQVRTLGKYFSLSFLWAFFQWFYTAGNHCGFGSFPTLGLEAYKNRFFFDFSPTYIGVGMICPXYIVNVSLLLGGIMSWGIMWPLISTKKGSWYPETLPDSSLHGLHGYRVFLTISVILGDGLYNILKVLYSTIEAFVSRYRNRKANTLPVSNDGTPADATTETESFDDKRRLELFTKDQIPKTVALGGYVVLAAITIGCLPLIIPQLKWYHILVAYIVSPALAFCNAYGCGLTNWSFASAYGKLAIFSFGAWAGASHSGVIVALAACGVMMSIVGTAADLMQDFKTGYLTLASPRSMFISQVIGTAMGCVIAPCVFWLFYKSFDVGATNGAYPAPYTFMYRNMAIMGVDGLSLPKHCLTLSYIFFAAAFAVNMVKDLVPKKVAKFIPIPMAVAIPFYVGAYFTIDMFLGCTILFIWEMRNKAEADSFGPAVASGCMCGDGLWALPEAILSLANVKPPICMKFLSRSVNARVDSFLGN

SEQ ID NO: 12621 - protein, 805 aa, Gossypium hirsutum
MAKAAPNLCFSPLTLNQNRKENFFSSQNGCFIHKPSLKTKIFSPIFSSCIPIRISATPTRTIDHQVTDYNAKILHFCQLGDLENAMELICMCKKSELETKTYSSVLQLCAGLKSFTDGKKVHSIIKSNSVGVDEALGLKLVSFYATCGDLKEGRRVFDTMEKKNVYLWNFMVSEYAKIGDFKESICLFKIMVEKGIEGKRPESAFELFDKLCDRDVISWNSMISGYVSNGLTERGLGIYKQMMYLGIDVDLATIISVLVGCANSGTLSLGKAVHSLAIKSSFERRINFSNTLLDMYSKCGDLDGALRVFEKMGERNVVSWTSMIAGYTRDGRSDGAIKLLQQMEKEGVKLDVVAITSILHACARSGSLDNGKDVHDYIKANNMESNLFVCNALMDMYAKCGSMEAANSVFSTMVVKDIISWNTMIGELKPDSRTMACVLPACASLSALERGKEIHGYILRNGYSSDRHVANALVDLYVKCGVLGLARLLFDMIPSKDLVSWTVMIAGYGMHGYGNEAIATFNEMRDAGIEPDEVSFISILYACSHSGLLEQGWRFFYIMKNDFNIEPKLEHYACMVDLLSRTGNLSKAYEFIETLPIAPDATIWGALLCGCRNYHDIELAEKVAERVFELEPENSGYYVLLANIYAEAEKWEEVKRLREKIGKQGLRKNPGCSWIEIKGKVNLFVSGNNSSHPHSKNIESLLKKMRRKMKEEGHFPKTKYALINADEMQKEMALCGHSEKLAMAFGLLTLPPRKTIRVTKNLRVCGDCHEMAKFMSKETRREIVLRDPNRFHHFKDGYCSCRGFW

SEQ ID NO: 12622 - protein, 618 aa, Gossypium hirsutum
MEQHIMWVFWFFLHWFCSVHSASDGDSLLSPKGVNYEVAALMSVKRELRDDKQVMDGWDINSVDPCTWNMVACSAEGFVISLEMASTGLSGMLSPSIGNLSHLRTMLLQNNQLSGPIPDEIGKLSELQTLDLSGNHFVGAIPSTLGSLTHLSYLRLSKNNLSGPIPRHVANLTGLSFLDLSYNNLSGPTPKILAKGYSITGNNFLCASSEHICTDVSYPLNGSVSSSRVSGNHHWLLSVAIGIGFAFVVSVMLLACWVHWYRSRIMLPSYVQQDYDFEIGHLKRFSYRELQIATGNFNPKNILGQGGYGVVYKGCLPNRSVVAVKRLKDPNFTGEVQFQTEVEMIGLALHRNLLRLYGFCMTPDERLLVYPYMPNGSVADRLRDACHGKPALNWSRRMHIALGAARGLLYLHEQCNPKIIHRDVKAANILLDESFEAVVGDFGLAKLLDKRDSHVTTAVRGTVGHIAPEYLSTGQSSEKTDVFGFGILLLELITGQKTLDAGNGQVQKGMILDWVRTLHEERRLEVLVDRDLQGCFDTIELETVTELALQCTRPQPHLRPKMSEVLKVLEGLVQSGTDEPQGGTNHCETSAYSFSRNYSDVHEESSFIIEAMELSGPR

SEQ ID NO: 12623 - protein, 432 aa, Tropheryma whipplei str. Twist
MSKIKLVTAIPGPESERLHRMRQATVARGVSSTFPIYIKESHGSILIDEDGNHLIDMGCGIGVTTLGHSHPAVVDAARAQINSVWHTLFSITPYESYVEVCKLLAKNTPGDFPKKSLLLNSGAEAVENAVKISRAYTGRPTVAVLDRSFHGRTNLTSSMTYRGSLYSSDFGPTASNIVSAPNSYPLHDRLSGKEAAARTISYLETRVAARNIACLFYEPIQGEGGVIVPADGFLPALQDWCRENDIVFVADEIQSGFGRTGCFFASETDGLEPDIVCSAKGIANGLPLSAVTGRSDIVDAARPGTLGGTFTGNHVSCAAALEVFEQYKDNAPLDSASRLGDILKELLLNLQSKHPQIAEVRGRGAMFGAEFSGNHAGEMVSRVITRAAELGVIFLSSGVEGNVVRFLPNVFMDKETIEEAIGVLDSAISSVV

SEQ ID NO: 12624 - protein, 296 aa, Haemophilus somnus 129PT
MYQFAQDLQESKQRINFFLEKQFECIDSSPSPLAEAMKYGLLLGGKRIRPFLVYATGKMLGANLIQLDYAAAAIEAIHAYSLIHDDLPAMDNDSLRRGHPTCHIAFDHATAILAGDALQPFAFELLTQTPDLSAEQKLALVQTLANASGVKGMCLGQSLDLISENQQINLSALEKIHRNKTGALLSAAVKMGFICSPHFANIKLEEQLMHYSSAVGLAFQVQDDILDIEGESIVIGKTAGSDLLADKSTYPKLIGLDGAKQKARELYHQALQELDALPFDTSALHALAEFVVNRQS

SEQ ID NO: 12625 - protein, 617 aa, Haemophilus somnus 129PT
MNKYPLLSLINSPDDLRLLSKDKLPQLCQELRSYLLESVSQSSGHLASGLGTVELTVALHYVFKTPFDQLLWDVGHQAYPHKILTGRRDKMSTIRQKGGLHPFPWREESEFDVLSVGHSSTSISAGLGIAIAAQKENLGRKTICVIGDGAITAGMAFEALNHAGSVHTDMLVILNDNEMSISENVGALNNHLARLLSGSIYSTLRESGKKILSGLPPIKEFVKKTEEHVKGFVSPVGTLFEQLGFNYIGPIDGHNIHELISTLKNMQSLSGPQFLHIKTKKGKGYAPAEKDPIGFHGVPKFDHKLGELPKSSTTPTYSQIFGSWLCEIAVQDEKLIGITPAMREGSGMVEFSQQFPQQYFDVAIAEQHAVTFAAGLAIAGYKPVVAIYSTFLQRAYDQLIHDVAIQNLPVLFAIDRAGIVGADGQTHQGAFDLSFMRCIPNLVIMTPSNENECRQMLYTGYKCGKPAAVRYPRGNAIGVKLEPLAELPLGKSKLIRQGKNIAILNFGTLLSEATKVAEDLDATVVDMRFVKPLDTQRIQEIAQTHSLIVTLEENAIQGGAGSAVAETLYQQQQKVSLLQLGLPDNFIPQGTQKEMLAELKLNAEGIFEQIKQFLQKI

SEQ ID NO: 12626 - protein, 525 aa, Pisum sativum
MEYGTRKLSDVYEVSEILGRGGFSVVRKGTRKSNNDDEKSQSQSKSQSQSQVAIKTLRRLGTSNNLPRKKDGGENSTETMMKFPTMRQVSVSDALLTNEILVMRRIVENVSPHPNVIDLYDVYEDTNGVHLVLELCSGGELFDRIVAQDKYSETEASTVVHQIVAGLEAIHRANIIHRDLKPENCLFLDVGKDSSLKIMDFGLSSVEEFTDPVVGLFGSIDYVSPEALSQGKITTKSDMWSLGVILYILLSGYPPFIAQNNRQKQQMILNGNFSFYEKTWKGISQSAKNLISSLLTVDPAKRPSAQELLSDPWVKGEKAKDDQMDPEIVSRLQRFNARRKLRAAAIASVWSSTIFLRTKKLKSLVGSYDLKEDEIENLRMHFKKICADRDNATLCEFEEVLKAMKMPSLIPFAARIFDLFDNNRDGTVDMREILCGFSSLKNSKGEDALRLCFQARDRSGCITKEEVASMLRALPYDCLPTDITEPGKLDEIFDLMDANSDGKVTFDEFKAAMQRDSSLQDVVLS

SEQ ID NO: 12627 - protein, 301 aa, Debaryomyces hansenii CBS767
MSATEQEILDSFPQISPPTKETGYTSNLTDDQKKTLEQLRAELTADGYKERLDDATLLRFLRARKFDIVKAKQMYVKCETWRKDFGTNTILTDFHYDEKPLVAKLYPQYYHKIDKDGRPVYFEELGKVNLNEMLKITTQERMLKNLVWEYESFALYRLPACSRQQGSLVETSCTIMDLKGISLSAAYQVVNYVKEASAIGQDYYPERMGKFYLINSPFGFSTAFRVFKPFLDPVTVSKIFILGSSYQKELLKQIPPENLPAKYGGKSDVTDDQLYLNDIGPWRDPKYIGPEGEAPRSFNMN

SEQ ID NO: 12628 - protein, 520 aa, Pisum sativum
MGYGTRKLSDVYEVSEILGRGGFSVVRKGTRKSNNDDEKSQSQSKSQSQSQVAIKTLRRLGTSNNLPRKKDGGENSTETMMKFPTMRQVSVSDALLTNEILVMRRIVENVSPHPNVIDLYDVYEDTNGVHLVLELCSGGELFDRIVAQDKYSETEASTVVHQIVAGLEAIHRANIIHRDLKPENCLFLDVGKDSSLKIMDFGLSSVEEFTDPVVGLFGSIDYVSPEALSQGKITTKSDMWSLGVILYILLSGYPPFIAQNNRQKQQMILNGNFSFYEKTWKGISQSAKNLISSLLTVDPAKRPSAQELLSDPWVKGEKAKDDQMDPEIVSRLQRFNARRKLRAAAIASVWSSTIFLRTKKLKSLVGSYDLKEDEIENLRMHFKKICADRDNATLCEFEEVLKAMKMPSLIPFAARIFDLFDNNRDGTVDMREILCGFSSLKNSKGEDALRLCFQARDRSGCITKEEVASMLRALPYDCLPTDITEPGKLDEIFDLMDANSDGKVTFDEFKAAMQRDSSLQ

SEQ ID NO: 12629 - protein, 344 aa, Tropheryma whipplei str. Twist
MGLTVGIVGLPNVGKSTLFNALTRGKALAANYPFATIEPNVGIAPLADARLEKLSTIFASEKIIFATVSFVDIAGLVEGASRGEGLGSKFLANIREVDAIAHVVRVFSDSQVVRAQDTLGPAADVDIVNTELALADMQTLEKVLAKKHPQPTSSQPDRVQLQKAYDALASNLVPEKISGLNLLRAKPVIYVINADQEVLSDTAARAQIESAFSPCVFLDAKFESDLAELDDKTALELRELSGNESCLDTFVAASFSALQLQTFFTAGPKEARAWTIKQLTKAPQAAGVIHSDFEKKFIRAEIISCTDLFECGSMNAARALGKVRLEGRDYVMHDGDVVEFRHAA

SEQ ID NO: 12630 - protein, 592 aa, Oryza sativa Japonica Group
GLHLPPSPSPSPSPPRAAGATRGGFSPLAFPHRRGPPPPRPPCAPFAPASFRGYNLLRDPRYNKGLAFNERERETHYLRGLLPPAIVSQELQERKIMHNIRQYQLPLQKYMAMMDLQEGNERLFYKLLIDNVEELLPVVYTPTVGEACQKYGSIFSRPQGLYISLKEKGKILEVLKNWPERSIQVIVVTDGERILGLGDLGCQGMGIPVGKLALYTALGGVRPSACLPITLDVGTNNEALLNDEFYIGLRQKRATAQEYADFLHEFMTAVKQNYGEKVLIQFEDFANHNAFELLAKYGTTHLVFNDDIQGTASVVLSGLVAALKLVGGSLSEHSYLFLGAGEAGTGIAELIALEISRQTKAPIEECRKKIWLVDSKGLIVSSRKETLQHFKKPWAHEHEPVGNLLDAVKTIKPTVLIGTSGKGQTFTQEVVEAISSFNERPVIFALSNPTSQSECTAEQAYTWSKGRAVFASGSPFDPVEYDGKIYVPGQANNAYIFPGFGLGVVMSGAIRVHDDMLLAASEALAQQVTQENFDKGLTYPPFSNIRKISAHIAANVAAKAYELGLASRRPRPKDLVKYAESCMYSPLYRNYR

SEQ ID NO: 12631 - protein, 320 aa, Leuconostoc mesenteroides subsp. mesenteroides ATCC 8293
MSEILTLGEPVVTFASTDLNKGLVDSINYYKFLGGAELNVMIGATRLGHNTEYISQVGADPLGQFTIKEIARYNVGNHYIATDEGNWTAFQLKELVDQGDPSTFNFRRNSAAAHFDKSLIDQVDFSDVKIAHLSGIFPAISLQAREAFRYFAEQLIDHGIRTTFDPNLRPALWESREVMIETINDLAKYGEIVLPGIDEGEILIGSRDPETIADFYLNNSDRTQTVVVKIGSDGAYVKNKSGESYIVNGFKVEKVVDTVGAGDGFALGLITGLIEGLTMADAVRRGNAVGALQVQTPGDNDGYPTQEELEAFLADNKKEA

SEQ ID NO: 12632 - protein, 280 aa, Vitis vinifera
MKDFLKSLSKRLKCNTTAYENYHRDYVPEGQSPKSDPKEPLRVYVLFQHIQKMLSSETAVIAETGDSWFNCQKLKLPRGCRYESIGWLVGVTLGYAQAVPNKRVMIACIGDGSFYVTLLDISTMILYEQGKAYLEGYVNPCADLSRKSLWGIALPLGGSADKLEGEGAAIISLKTEAAAKRALVLDGADRGELFQEIQHSSMQLRGSKCKLVVSFMNFVLHDVEEEQKEQDLSCHSEKFAVAVGIISTPAGMLIKVFKNLRTCVDSTLPLSSSSRLIREK

SEQ ID NO: 12633 - protein, 372 aa, Arabidopsis thaliana
MAANLARRLIGNRSTQILGAVNSSSGAASSVARAFCSSTTPITATLFPGDGIGPEIAESVKKVFTTAGVPIEWEEHYVGTEIDPRTQSFLTWESLESVRRNKVGLKGPMATPIGKGHRSLNLTLRKELNLYANVRPCYSLPGYKTRYDDVDLITIRENTEGEYSGLEHQVVRGVVESLKIITRQASLRVAEYAFLYAKTHGRERVSAIHKANIMQKTDGLFLKCCREVAEKYPEITYEEVVIDNCCMMLVKNPALFDVLVMPNLYGDIISDLCAGLVGGLGLTPSCNIGEDGVALAEAVHGSAPDIAGKNLANPTALLLSGVMMLRHLKFNEQAEQIHSAIINTIAEGKYRTADLGGSSTTTEFTKAICDHL

SEQ ID NO: 12634 - protein, 444 aa, Zea mays
MATALSSEELMRMEQDCSAHNYHPIPMVFSKGEGSHIVDPEGNKYIDFLSAYSAVNQGHCHPKVLRALIEQAERLTLSSRAFYNDKFPIFAEYLTSMFGYDMMLPMNTGAEGVETAIKLARKWGYEKKHIPKNEALLVSCCGCFHGRTLGVISMSCDNDATRGFGPLVPGHLKVDFGDIDGLKKIFEELGDRICGFLFEPIQGEAGVVIPPDGYLKGARDLCSKHNVLMIADEIQTGIARTGKMLACDWENIRPDMVILGKALGAGVVPVSAVLADKDVMLCIRPGEHGSTFGGNPLASAVAVASLKVVRDEGLVERAAKLGQEFRDQLQKVQQKFPQILREVRGRGLLNAVDLNNDALSPASAYDICIKLKERGILAKPTHDTIIRLAPPLTISPEELAEASKALSDVLEHDLPQLQLQKQIKKPESEAEKPVCDRCGRDLYG

SEQ ID NO: 12635 - protein, 297 aa, Aspergillus niger
MFSGRFGVLLTAHAALSAAAPTPLDVRSVSTSTLDELQLFSQWSAAAYCSNNIDSDDSNVTCTADACPSVEEASTKMLLEFDLTNNFGGTAGFLAADNTNKRLVVAFRGSSTIKNWIADLDFILQDNDDLCTGCKVHTGFWKAWEAAADNLTSKIKSAMSTYSGYTLYFTGHSLGGALATLGATVLRNDGYSVELYTYGCPRVGNYALAEHITSQGSGANFRVTHLNDIVPRLPPMDFGFSQPSPEYWITSGTGASVTASDIELIEGINSTAGNAGEATVDVLAHLWYFFAISECLL

SEQ ID NO: 12636 - protein, 318 aa, Betula pendula
MATFPVIDMEKLNGEERGATMELIEDACENWGFFELVNHGISHDLLDTVEKLNKEHYRKCMEERFKDMVASKGLEAAQSEVRDMDWESTFFLRHLPASNMSEIPDLDEDYRKAMKEFAGNLEKLAEQLLDLLCENLGLEKGYLKKSFYGSKGPNFGTKVSNYPPCPKPELIQGLRAHTDAGGLILLFQDDKVSGLQLLKDGKWVDVPPMRHSIVINLGDQLEVITNGKYKSVLHRVLAQPDGNRMSLASFYNPGSDALIYPAPVLVEKEAEKGQVYPKFVFEDYMKLYAGLKFQAKEPRFEAMKAMESTVKLGPIATA

SEQ ID NO: 12637 - protein, 686 aa, Coprinopsis cinerea okayama7#130
MEDEVSIYAVIACRCTHAGKLLYRADRFKTSLQFRTLPYRRYYETLDACKVADYVVFALSSAVEVDTWGDILLRSLQSQGLPEVVTIVSPDTEMDVKARPSILKSLLSFIQYFVPSQTKVFDLHNTSDRLNALRSLSEGKPADVRWREGRSYLLGEQVQWDGDVLRVTGVVRGASLSANRLVHIPNSGDHQISKIYSSPLPRARKGQENGMEVEPTLIAEPNPDDADSLVSTNDPDDLENEQTWPTEEEMNGKHTGNNDPSIPDAVPGTTPKAVKRIPKGMSEYQAAWIIDETDDEDGDDDSQGGSDKDGMEEEEEMEEMVEVEDTTEMDIDNQRHVTFQDLDIEEETAQLEKWRNRKREEEDDAAFPDEVDTPQDIPARTRFARYRGMRSFRTSPWDPYENLPRDYARIFQFEDFKRTERSVRKRSEQELNTVEPGTRVTVHITGVAREAVSSGPLTLFSLFQHEHKVSVLHFTVQRNTEYHASVRSKDPMILCVGPRRFSVNPIYSQHTRGGGKGTNNVHKFERYLRHGSTAVATVYGPVTYGKQPCTLLRESNDSQAPQLVAYGSFLNTDTTRVISKRIILSGHPFKVHKKTATIRYMFFNPEDVHYFKPIQLHTKYGRVGHIKESLGTHGYFKAYFDGPINQMDTVCMSLYKRVYPKWAQLYRDGARPQSAPHAHDDVAMEE

SEQ ID NO: 12638 - protein, 298 aa, Aspergillus niger
MFFRREFGAVAALSVLAHAAPAPAPMQRRDISSTVLDNIDLFAQYSAAAYCSSNIESTGTTLTCDVGNCPLVEAAGATTIDEFDDTSSYGDPTGFIAVDPTNELIVLSFRGSSDLSNWIADLDFGLTSVSSICDGCEMHKGFYEAWEVIADTITSKVEAAVSSYPDYTLVFTGHSYGAALAAVAATVLRNAGYTLDLYNFGQPRIGNLALADYITGQNMGSNYRVTHTDDIVPKLPPELLGYHHFSPEYWITSGNDVTVTTSDVTEVVGVDSTAGNDGTLLDSTTAHRWYTIYISECS

SEQ ID NO: 12639 - protein, 396 aa, Marchantia polymorpha
MASMVAASSALGASCSLAAVPSQATTSSNNAAQAVILRSAKLGGRSSSILGQSLAGLSVKSVAHKAVASRSRVASTRAELGDSLEEFLFKNTKNINLRQLMLSMGLAIKKISFKVRTASCGATACVNTFGDEQLAVDMLANKVLFEALLHSHVCKYACSEEEPNLVDMGGPTEGGFSVAFDPLDGSSIVDTNFTVGTIFGVWPGDKLTGVTGREQVAAAMGIYGPRTTYVLCLAEVPGTHEFLLMDDGTWQHVKETTTIGEGKLFSPGNLRATYDNPEYEKLINYYVSEKYTLRYTGGMVPDVNQIIVKEKGIFTNVISPTTKAKLRLLFEVAPLGLLVEKAGGYSSDGKISVLDKVVVNTDDRTQVAYGSRNEIIWFEEALHGTSRVAALVGASA

SEQ ID NO: 12640 - protein, 327 aa, Oryza sativa
MEIHLHLHFLAILVVVPMLGSPAAGGLCRDSCGGIPVRYPLSIDDGCGSPYYRNMLTCADNATLRLRTPSGTYPVVGADYADPHLVVTDPSMWTCERPFTSVRAAPFSLDTSTRFSLSPRNDYLFFDCDEERVIVEPRPAVCDRYPERCDSTCDSTGYLCRNLPGCRGALEENNMSCCAYRPRAAESLRLMLRHCESYTSVYWRAVGDKFPPYDQVPAYGVRVDFEIPVTTRCLQCEDRRRGAGGTCGFDPVTRDFVCICNDARNSTTDCADGPASRYHSSAGVVAASAVFSISAAVGITGLVWYIRKIKSTKVVTCGVQSNENRFF

SEQ ID NO: 12641 - protein, 245 aa, Debaryomyces hansenii CBS767
MSANDFYSSGDQGSYEPRRDQQQGQQGQQGQQGQQGQQGEDGDRGLISTLAGGSIGAFGGSKLGGNHSTLGGIGGAIAGAIGANKVEDRFENHGSSNNNHGHSQQGGGLMSGLSSFLGGDKHEGRNDGYGGSQGGYGGNQGGYGGSHSGRHDGGRHEGGRHEGGYGGGQGGFGSGNNGGNQGGYGGGQGGYSGGQGGYGGGQGGYGGGQGGYGGGQGGYGGGQGGYGGGQGGYGGGQGGNQGGRW

SEQ ID NO: 12642 - protein, 355 aa, Gossypium hirsutum
MTEPRRLRGHKATATCCIASRDKPGLVATSGEDGCICWFDMRCKDVKFVMDVSNEPISSLCFNSGNENIIYVSTGNEVKCFDVHTLADNSWKPLESYNYNKEEINQVTCNSRSSFLASADDGGEIKIIDIRQKRIFKTLRAGHTIVTGGLDSKFIIWDFSKGCPSKIVDFGLPDMHSGSNAGQCLNPAFVHSVKVPDVDMLDKIGKICVVARGDGVIDVINTESELTATKPKSSTKSRKGTQSKGSDGGVPDENGRKWLHLDYSLGGHTAAVSCMTFSLFGEKGKFLVSGGNDKLVKVWDCSRCLGSWQTGDTNELLHLNINLTKKVNWLCTTPAESDNLVVCDTTKLVKVYTVS

SEQ ID NO: 12643 - protein, 200 aa, Glycine max
MADQGLEGSQPVDLQKHPSGIVPTLQNIVSTVNLDCKLDLKTIALQARNAEYNPKRFAAVIMRIRDPKTTALIFASGKMVCTGAKSEQQSKLAARKYARIIQKLGFPAKFKDFKIQNIVGSCDVKFPIRLEGLAYSHGAFSSYEPELFPGLIYRMKQPKIVLLIFVSGKIVLTGAKVRDETYTAFENIYPVLTEFRKNQQ

SEQ ID NO: 12644 - protein, 314 aa, Tropheryma whipplei str. Twist
MPRYDVVSLGEGQIRLTVPRGENLLTAKQLYLTAAGSEANVTGLLSQLGHSCAWASVIPKGELGDRIVREYRAVGTDVSHIVRTDTGRVALYFLQPGADPMPAEVVYDRLHTPFREIEPEIFDWGSLLDTRILFITGITMALTEKTRRVIEYGVACASERGVDIVLDVNHRARLWSGKEARGVIVPLLDKVKILFCSRGDADRVFGITGEPDDVARTLRARYGVPTVVSTAGTQGVYLSSATGEESFPVTPVRVIDRPGAGDAFVGGSLHGHLSGDLRMGIKTGMLAAQHALSHYGDLVSTSAFGEYTSTDILR

SEQ ID NO: 12645 - protein, 374 aa, Kluyveromyces lactis
MLRLTSARSIVSPLRKGAFGSIRTLATSVPETQKGVIFYENGGKLEYKDIPVPKPKPNEILINVKYSGVCHTDLHAWKGDWPLPTKLPLVGGHEGAGVVVAMGENVKGWNIGDFAGIKWLNGSCMSCEYCELSNESNCPDADLSGYTHDGSFQQYRTADAVQAARIPKGTDLAEVAPTLCAGVTVYKALKSANLKAGDWVAISGAAGGLGSLAVQYAKAMGYRVVGIDGGEEKGKLVKQLGGEAFVDFTKTKDMVAEIQEITNGGPHGVINVSVSEAAMNASTQFVRPTGTVVLVGLPAGAVIKSEVFSHVVKSINIKGSYVGNRADTREAINFFANGHVHSPIKVVGLSELPKVYELMEQGKILGRYVVDTSN

SEQ ID NO: 12646 - protein, 269 aa, Azotobacter chroococcum (strain mcd 1)
MSLLAQWREDIRCVFERDPAARTTFEVLTTYPGVHAIMLYRLAHRLWRPNALPRPAAVVRARLVSNVDIHPGAVIGARFFIDHGACVVIGETAEIGRDVTLYHGVTLGGTTGAKGKRHPTLGDVVLVGAGAKILGPITIGANARVGANSVVVQDVPEGCTVVGIPGKVVKLREAGQLNPYGIDLDHHLIPDPVGKAIACLLERIDSLEKRVEAGGLVAAAASSTFYEGCNPDNSICETNLRRSAPWSSGRPRRPAHAGDRVSGRAKGSD

SEQ ID NO: 12647 - protein, 387 aa, Saccharomycopsis fibuligera
MSGAAKRLSQVSGILNPGATSEDTTLIVPVKPFKISVIGSGNWGTTIAKVVAESTGENPDLFQKDVHMWVFQEKIDGENLTDIINTKHENVKYLPDVKLPENVIAEPDITKTVINSDLIIFNIPHQFLGNVCKQLKGHVPTTARAVSCLKGLDVTPQGCNLLSSYITENLGIYCGALSGANLAPEVANQKWSETTIAYNEPDDFRGQGKDIDKAILKKLFHRPYFHVRVIADVPGVSVAGALKNVVAMAAGFVEGMGWGDNAKSAIMRIGLVEIVKFADKYYPESDSKTFTEESAGVADLITTCSGGRNVRVGKYMAETGKDATEAEKVLLNGQSSQGIVTTKEVHDLLENDNATHEFPLFEATYQIIYNGLPMDKLPSLIESIGDN

SEQ ID NO: 12648 - protein, 81 aa, Glycine max
SNSYTRAVHQLSHRARGTAWLHPYTGLKSMAGLPTRKTNTDITSIASNGGRVQCMQVRPPAGSMKFETLSYLPDLDDAQLA

SEQ ID NO: 12649 - protein, 469 aa, Leuconostoc mesenteroides subsp. mesenteroides ATCC 8293
MAEKQNRELSRDLSSRQMQMIALGGTIGVGLFMGSSATIKWTGVSVLLAYAIAGLVLYLVMRALGEMLYVDPSVGSFANYATKYIHPVAGYLTVWANVFQWLTVGVSETIAVGMYLDYWFPHIPGWVTGVVVLAMLTAANLVTVKAYGEMETWFSLIKVVTIIFMIILGLLVIVLGFGNHWQPIGFSNLWTHGPFFAGGVKGFFFALSIVITSYQAIEIIGITAGEADNPQVAIVKSIKSIVARILIFYIGAIFVIITIYPWNELDQVGSPFVETFSRVGITAAAGIINFVMMTAAMSALNSGIFSSSRMLYTLAIGKELSPKFLKLSKHRVPTLPVLAISGGILLGIILNAVLPLFWHGSSSIFVLVYSASTLPGMVPWFVILWSQIKFRKENASQMVNHPFKMPFAPYTNYFAILMLLVTLVFMVFNPDTRVPLFIGLGFLVIMSIVFFATRKSHRRNSEVSSSKTL

SEQ ID NO: 12650 - protein, 583 aa, Oryza sativa
MDGLAAPSPSHSGATSGGGASHRKRKLPPSSLSDATADEDDDTTAPSSPSTSPSSPSRPSSPSSSHSDDDDDDSLHTFTAARLDGAPPSSSGRPPKPESSTVSAAAAAAAAAAAPKPDSASAAAGDGKEDPKGLFTDNIQTSGAYSAREEGLKREEEAGRLKFLCYSNDGVDEHMIWLVGLKNIFARQLPNMPKEYIVRLVMDRTHKSMMVIRNNIVVGGITYRPYTSQKFGEIAFCAITADEQVKGYGTRLMNHLKQHARDADGLTHFLTYADNNAVGYFVKQGFTKEITLDKERWQGYIKDYDGGILMECRIDQKLPYVDLATMIRRQRQAIDEKIRELSNCHIVYSGIDFQKKEAGIPRRTMKPEDIQGLREAGWTPDQWGHSKSRSAFSPDYSTYRQQLTNLMRSLLKASLLSSQIFLYDMQPFGLTSLDKPVLCLLPFEFFAPFLFQAYFLKPDQLDGLFNGSMIEMATFYKFNIQIFLNMNEHPDAWPFKEPVDSRDVPDYYDIIKDPIDLKTMSKRVESEQYYVTLEMFVADMKRMFSNAKTYNSPDTIYYKCASRLESFFSNKVASQLAQASTKN

SEQ ID NO: 12651 - protein, 467 aa, Aggregatibacter actinomycetemcomitans
MFISVIMAGGSGSRLWPLSRSMFPKQFLALDKKNNLTMLQATIDRINQMSTSEPIIITNEQHRFIVAEQLREYGVKSRIILEPVGKNTAPAIALAAFEAIKHGEDPILLVLAADHVVLNKEAFQTSVRNALVQAQTGYLVTFGIVPTAPETGYGYIQRGEKITEEAYKVERFVEKPNFETAEKYVASGNCYWNSGCFMFKASCYLHELRKFALEIYEACEKATSNRLKNNDFIRVDVDEFLKCPDDSVDYAVIEKTDKAIVVPMDAGWSDVGSWSALWEVSDKDENQNSYHGDVIMKNTSGCYIYAPNKLVAAVGLENIVIVDTKDAVLVADRSKVQEVKQIVEQLKKEDRREYKEHREIYRPWGRSDAIAQGERYKVNRITVNPGESEETQVHYHRAEHWIVVSGMAKVTKGEQESLITENQSIYIPVGVPHQIANLGKIPLELIEVQSGGYLDDDDVSVLRKYYK

SEQ ID NO: 12652 - protein, 367 aa, Coccidioides immitis RS
MKISQLYVYPIKSLRPTALSESELTSHGFPHDRHFMLLKVEEDGRLVNMHVPNFPRMALFLTDIVFPDDAQGQDGKIIVTYRQPMSHNDKDCIKTLDIPLKPRIDNLKTFEVVMHQSPTHAYDMGEQYNSWFSDCFGFDVILAYIGDNRRTVLGNMSPNAEQEKTQSGWLSRVAENVTSLGGWVGKDTNDPESITFADVAPYLVVSESSLDNVSARLPEKMDITKFRPNIVISGAPKEFEEDYWRELKVKDDITLVLTNNCARCISINIDFDTGAPGTGEMGAVLKKLMKDRRIDQGTKYSPIFGRYGFLGRGCEGSHIKIGDEVEVSKTNSEHTKLGELIIKASLLLQPANKSARVAWVDKLIISL

SEQ ID NO: 12653 - protein, 552 aa, Synechococcus sp. CC9605
MRGHHARSWIRSARLQRPPGMSFPDFSASDAHIQWQRFCDLSWYHDDLGVWLDISRMHVNASDLQQLQPRMDKAFAAMQELEAGAIANPDEQRQVGHYWLRTPELAPSSELQQHISREIDLIAAFGRDVVNGTIKAPNGEAFTDVLWIGIGGSGLGPALMIKALQNPGEGLPFHFFDNVDPNGMSNVLAGLEGRLDRTLVVTVSKSGGTPEPHLGMEQARHRLEAAGGQWAGQAVAVTMLDSKLDQQAQKEGWLKRFDMFDWVGGRTSITSAVGLLPGALIGCDIRDFLSGASQMDAATRMADLRRNPAALMAASWHVAGGGRGQRDMVVLPYRDRLEVFSRYLQQLVMESLGKRLDRNGDVVHQGIAVYGNKGSTDQHAYVQQLRDGVDNFFATFIEVLEDVSDIPTISGECPGDFLDGFLQGTRSALTESGRQSMTISMRCFDARRLGALIALFERAVGLYGELVNINAYHQPGVEAGKKAAAAILNLQGRVEAILADGVARSADEIRLALGDGTDESIFWILRHLTGNQRGFSAQGDWSQPASMRFSKG

SEQ ID NO: 12654 - protein, 572 aa, Coprinopsis cinerea okayama7#130
MKLAYPTGSDIFALHNSLLAVKIARHSPCAVCSSSCQGMHPPKGVRIVMDVQDESSGVDDYSHLFNESDDEDDGIPASGYLEICACGHDCKSHHADEDELGKREFKRRAALAIRMDELLKDSGRLLDFEYTDDDINNLRKQMVIPYKRESISPGKRLPIDPVSTAHITYAERRQSVPLSSPASSSLSELDPSSALSGRKRRASTSSLSEAVDDPDPEENEDDDSDEEEDKPLASRLLGANAPGRSVLGKAKRTTPSKRSRSGKAGGKKAKRVHTIASDDDDDEDDDKPHGQVNGVNGHKKVKEEKAEAAVLADATAARPVVPGYGGMLMDYFKAHIRKEYPDMNHFLTYADNYAVGYFEKQGFTKEITLDKSVWAGYIKDYEGGTIMQCTMIPKVDYLEKKRIFNEQHDAILEKIRQMSRAHIVYPGLPQFQPGQPEGVTVDPRDVPGLRESGWTPEMDKELRNLKSPDHHLMEKTLATLRADSHAWPFQTPVTIEAVPDYFDVIKHPMDFETIENKLHANHYKNVEQFVDDCLLIFDNCRLYNPETSSYHRKANKMEQLLKRLLPGYVRDR

SEQ ID NO: 12655 - protein, 805 aa, Gossypium hirsutum
MAKAAPNLCFSPLTLNQNRKENFFSSQNGCFIHKPSLKTTFFSPIFRSCIPVRISATPTRTIDHQVTDYNAKILHFCQLGDLENAMELVCMCQKSELETKTYGSVLQLCAGLKSLTDGKKVHSIIKSNSVGVDEALGLKLVSFYATCGDLKEGRRVFDTMEKKNVYLWNFMVSEYAKIGDFKESICLFKIMVEKGIEGKRPESASELFDKLCDRDVISWNSMISGYVSNGLTERGLGIYKQMMYLGIDVDLATIISVLVGCANSGTLSLGKAVHSLAIKSSFERRINFSNTLLDMYSKCGDLDGALRVFEKMGERNVVSWTSMIAGYTRDGWSDGAIILLQQMEKEGVKLDVVAITSILHACARSGSLDNGKDVHDYIKANNMASNLFVCNALMDMYAKCGSMEGANSVFSTMVVKDIISWNTMVGELKPDSRTMACILPACASLSALERGKEIHGYILRNGYSSDRHVANALVDLYVKCGVLGLARLLFDMIPSKDLVSWTVMIAGYGMHGYGNEAIATFNEMRDAGIEPDEVSFISILYACSHSGLLEQGWRFFYIMKNDFNIEPKLEHYACMVDLLSRTGNLSKAYKFIETLPIAPDATIWGALLCGCRIYHDIELAEKVAERVFELEPENTGYYVLLANIYAEAEKREEVKRMREKIGKKGLRKNPGCSWIEIKGRVNLFVSGNNSSHPHSKKIESLLKKMRRKMKEEGYFPKTKYALINADEMQKEMALCGHSEKLAMAFGLLTLPPRKTIRVTKNLRVCGDCHEMAKFMSKETRREIVLRDSNRFHHFKDGYCSCRGFW

SEQ ID NO: 12656 - protein, 166 aa, Citrus unshiu
MSSTLFSGDETAPFFGFLGAAAALVFSCMGAAYGTAKSGVGVASMGVMRPELVMKSIVPVVMAGVLGIYGLIIAVIISTGINPKAKSYYLFDGYAHLSSGLACGLAGLSAGMAIGIVGDAGVRANAQQPKLFVGMILILIFAEALALYGLIVGIILSSRAGQSRAD

SEQ ID NO: 12657 - protein, 618 aa, Gossypium hirsutum
MEQHIMWVFWFFLHWFCSVHSVSDGDSLLSPKGVNYEVAALMSVKRELRDYKQVMDGWDINSVDPCTWNMVACSAEGFVISLEMASTGLSGLLSPSIGNLSHLRTMLLQNNQLSGPIPDEIGKLSELQTLDLSGNHFVGAIPSTLGSLTHLSYLRLSKNNLSGPIPRHVANLTGLSFLDLSYNNLSGPTPKILAKGYSITGNNFLCASSEHICTDVSYPLNGSVSSSRVSGNHHWLLSVAIGIGFAFVVSVMLLACWVRWYRSQIMLPSYVQQDYDFEIGHLKRFSYRELQIATSNFNSKNILGQGGYGVVYKGCLPNRSVVAVKRLKDPNFTGEVQFQTEVEMIGLALHRNLLRLYGFCMTPDERLLVYPYMPNGSVADRLRDACHGKPALNWSRRMHIALGAARGLLYLHEQCNPKIIHRDVKAANILLDESFEAVVGDFGLAKLLDKRDSHVTTAVRGTVGHIAPEYLSTGQSSEKTDVFGFGILLLELITGQKTLDAGNGQVQKGMILDWVRTLHEERRLEVLVDRDLQGCFDTIELETVTELALQCTRPQPHLRPKMSEVLKVLEGLVQSGTEEPQGGTNHCETSAYSFSRNYSDVHEESSFIIEAMELSGPR

SEQ ID NO: 12658 - protein, 467 aa, Oryza sativa Japonica Group
MEADAGKLFIGGISWDTNEDRLREYFDKYGEVVEAVIMRDRATGRARGFGFIVFADPAVAERVIMEKHMIDGRMVEAKKAVPRDDQHALSKSGGSAHGSPGPSRTKKIFVGGLASTVTEADFRKYFEQFGTITDVVVMYDHNTQRPRGFGFITYDSEDAVDKALFKTFHELNGKMVEVKRAVPKELSPGPSMRSPVGGFNYAVNRANNFLNGYTQGYNPSPVGGYGMRMDARFGLLSGGRSSYPSFGGGYGVGMNFDPGMNPAIGGSSSFNNSLQYGRQLNPYYSGNSGRYNSNVSYGGVNDSTGSVFNSLARNLWGNSGLSYSSNSASSNSFMSSANGGLGGIGNNNVNWGNPPVPAQGANAGPGYGSGNFGYGSSETNFGLGTNAYGRNAGSGVVNTFNQSTNGYGRNFGDSSGGGGGGGGGSIYGDTTWRSGSSELDGTSPFGYGLGNAASDVTAKNSAGYMGH

SEQ ID NO: 12659 - protein, 375 aa, Kluyveromyces lactis
MFRLARAQTALANKASVSRSFLRLNSSFAIPETQKGVIFYENGGKLEYKDLPVPKPKANEILINVKYSGVCHTDLHAWKGDWPLPVKLPLVGGHEGAGIVVAKGENVKNFEIGDYAGIKWLNGSCMSCELCEQGYESNCLQADLSGYTHDGSFQQYRTADAVQAAQIPKGTDLAEIAPILCAGVTVYKALKTADLKPGQWVAISGAAGGLGSLAVQYRKAMGLRVLGIDGGDGKEELFKQCGGEVFIDFRKSKDMVADIQEATNGGPHGVINVSVSEAAVSMSTEYLRPTGLVVLVGLPADAYVKSEVFSHVVKSISIKGSYVGNRADTREATDLFTRGLVKSPIKIIGLSELPEAYALMEQGKILGRFVVDTYK

SEQ ID NO: 12660 - protein, 370 aa, Mesostigma viride
MQASQRRASARSAAVAPKASFSAKASSSGFMGASMPAMQASRARVASKAAPSPVRAEIGDTLEEFLVKATPNPKLRQMMQSLGEAMRTIAFKVRTASCSQISCTNTFGDEQLAVDVLADKLMFEACRYSGVCLSACSEEVPEIVNMGSGEDGFSVAFDPLDGSSIVDTNFTVGTIFGVWPGSKLTGIKGSQLAASGMGVYGPRTTYVLSIAGYPGTHEFLLIDEGKWVHVKETTEIKEGKLFSPGNLRATFDNPSYEKLISYWIGEKYTLRYTGGMVPDVGQIIVKEKGVFCNASSPSTKTKLRMVFEVAPLAYLIEKAGGYSSNGTMSILDIPINTVNDVSQVCYGSKNEVRRFEEYIVGASRIPAESA

SEQ ID NO: 12661 - protein, 475 aa, Streptococcus pyogenes str. Manfredo
MAKQYKNLVNGEWKLSENEITIYAPATGEELGSVPAMTQAEVDAVYASAKKALSDWRALSYVERAAYLHKAADILVRDAEKIGAILSKEVAKGHKAAVSEVIRTAEIINYAAEEGLRMEGEVLEGGSFEAASKKKIAIVRREPVGLVLAISPFNYPVNLAGSKIAPALIAGNVVALKPPTQGSISGLLLAEAFAEAGIPAGVFNTITGRGSVIGDYIVEHEAVNFINFTGSTPIGEGIGKLAGMRPIMLELGGKDSAIVLEDADLALAAKNIVAGAFGYSGQRCTAVKRVLVMDKVADQLAAEIKTLVEKLSVGMPEDDADITPLIDTSAADFVEGLIKDATDKGATALTAFNREGNLISPVLFDHVTTDMRLAWEEPFGPVLPIIRVTTVEEAIKISNESEYGLQASIFTTNFPKAFGIAEQLEVGTVHLNNKTQRGTDNFPFLGAKKSGAGVQGVKYSIEAMTTVKSVVFDIQ

SEQ ID NO: 12662 - protein, 490 aa, Oryza sativa Japonica Group
MAVIALKCPDVEVVVVDISAARIDAWNSDALPIYEPGLDDVVRRCRGRNLFFSSDVERHVGEADIVFVSVNTPTKARGLGAGKAADLTYWESAARMIAAVATSDKVVVEKSTVPVKTAEAIEKILDHNGRDGVGFQILSNPEFLAEGTAIRDLLAPDRVLIGGRETAAGRAAVQALKDVYTRWVPEERILTTNLWSAELSKLAANAFLAQRISSVNAMSALCEATGADVAEVAYAVGKDSRIGAKFLNASVGFGGSCFQKDILNLVYICECNGLPEVANYWKQVIKGFKSPAIATTMSKDIYSLTPFQVIKINDYQKSRFVNRVVSSMFNTVAGKKIAVLGFAFKKDTGDTRETPAIDVCKGLIGDKAKVSIYDPQVTEDQVQRDLAMSKFDWDHPVHLQPMSPTAIKQVSVAWDAYEAARAAHGVCILTEWDEFRSLDYARIYGGMQKPAFVFDGRNVVDAEKLREIGFIVYSIGKPLDAWLKDMPAVA

SEQ ID NO: 12663 - protein, 193 aa, Coprinopsis cinerea okayama7#130
MGLYSYYTYGLPSFLITVIALYLLFTGSGEAFNVGRFLEEISPYAWGATGIGLCIGLSVAGAACIIFCEVVAIYGVIIGIVYSAKLTNVAEDVLYTRENYYTGFALFWGGLTVGACNLLCGVCVGVTGSTAALGDAADPDLFVKILVVEVFGSILGLFGLIVGLIMVGSAGDFQAAAGIAATSARAMVSPYVA

SEQ ID NO: 12664 - protein, 396 aa, Arabidopsis thaliana
MRKTMVISDLPHEIESEILSRVPTKSLAKLHTTCKRWYALFRDPRFVKKNFGKSERRLMLHSNFGVYKITDDLHGILNSGDPSLEFTSKLSNLKISEDLTITKIFHCDGLILCSTKENTRLVVWNPCTGQTRWIKPSKRYRSDDSYCLGYVNSKSSYHNYKILRYCFYYNDQDACVSEFEIYDFSSESWRVLDDYCTREWGLFCHGMSLKGNTYFVAGEKETGFFMLYFDFKTERFERLPLPYQSFDSEDTAVLSIVGGEKLAVLHQNIQSFSNEMRIWVTNKIDEAKDLTWSNFFLAVDYDIFNLPSVNNVTSFLLDEENKVAVCCDRHIDDEDKTRIYIVGVDLYKEVYKERTKGAHFNWPLLISYLPSLVHIQEKYPKDKRKGNKRRLVKRIT

SEQ ID NO: 12665 - protein, 478 aa, Gossypium hirsutum
MDSTSKSNAATSSKKDANNGQTLLLGRYEVGKLLGHGTFAKVYHARNVKSGDNVAIKVIDKEKILKSGLIAHIKREISILRRVRHPNIVQLFEVMATKSKIYFVMEYVRGGELFNKVAKGRLKEDVARKYFQQLISAVHFCHARGVYHRDLKPENLLLDENGDLKVSDFGLSAVSDQIRQDGLFHTFCGTPAFVAPEVLARKGYDAAKVDIWSCGVILFVLMAGYLPFQDQNIMAMYKKIYKGEFRCPRWFSPELIRLLTKLLDTNPETRITIPEIMEKRWFKKGFKHIKFYIEDDKLCSVEDDDNDVGSCSDQSSMSESETELETRKRVGTLPRPASLNAFDLISFSPGFNLSGLFEEGEEGSRFVSGAPVSTIISKLEEIAKVVSFTVRKKDCRVSLEGSREGAKGPLSIAAEIFELTPSLVVVEVKKKGGERGEYEDFCNRELKPGLKELMVEESQSSAAASLATSSSYLPSDTE

SEQ ID NO: 12666 - protein, 323 aa, Heterocapsa triquetra
MAPAKTSSAAMLGLGAAGWLSSGSLFVSPTPPRAAELSRYAPQATAAPAAGASQGFAPGVRCSILGVAAVTVAAGARRVARRATQDELKKQVGYKAVDDYVKSGTVIGLGTGSTAAFAVERVGQLLKSGELKDIIAIPTSIRTKEQAESLGIPLATLDTHSDLDVAIDGADEVDPNLNLVKGGGGALFREKIVEMCAKKFIVIVDESKMCGGLGPGFPIPVEIVPFCHEHTMREIAKLPALAGCKPVLRLGDVANNKPDGDKPAVTDNSNYIVDLVFETPIKDAVAAGEQLKNTVGVVDHGLFTGMTTACIIAGSDGISVKEA

SEQ ID NO: 12667 - protein, 130 aa, Zea mays
MAAASGRAPSACALLLFLLLVVGAAAAAAVVVDANRGEQEQDRDWEQLSAASPSPWSPAPAPAPSPVSFIDCGSACGARCALSSRWNLCRRACGSCCARCNCVPPGTAGNHDVCPCYAAITTRGGRPKCP

SEQ ID NO: 12668 - protein, 169 aa, Isochrysis galbana
SLSTLASHPNIDVCIDGADAVDANLNIIKGGGGAHLREKMVAEAAARLVVIVDESKMCESLGPSFPLPVEVTPFGHLHTLRRIGQLHSLSGSAAAPYLRQLKAGGLYTTDNGNYIVDVACGKPIADTVAVAAELSRLTGVVAHGLFNQMASEVIVAGKDGVSVIKSGRQ

SEQ ID NO: 12669 - protein, 221 aa, Tropheryma whipplei str. Twist
MDNLVLLRHGNSLWNQENLFTGWVDVRLSELGEKEAKTAGQLLREANRYPDVLFTSLLTRSIQTAHIALMEIDRVWLPTFRSWRLNERHYGSLQGKNKAQVLEEFGEEQFNSWRRGYDTPPPPLHSQADDPRYEEPPPLSESLKDVQNRLLPYWQGVILPHLVAGKVVLVVAHGNSLRALVKHLECISDTDVCQLNIPTGIPLVYSIDPSGCATHPGRYLP

SEQ ID NO: 12670 - protein, 402 aa, Azotobacter vinelandii
MADVYLDNNATTRVDDEIVQAMLPFFTEQFGNPSSLHSFGNQVGMALKKARQSVQKLLGAEHDSEILFTSCGTESDSTAILSALKAQPERKTVITTVVEHPAVLSLCDYLASEGYTVHKLPVDKKGRLDLEHYASLLTDDVAVVSVMWANNETGTLFPIEEMARLADDAGIMFHTDAVQAVGKVPIDLKNSSIHMLSLCGHKLHAPKGVGVLYLRRGTRFRPLLRGGHQERGRRAGTENAASIIGLGVAAERALQFMEHENTEVNALRDKLEAGILAVVPHAFVTGDPDNRLPNTANIAFEYIEGEAILLLLNKVGIAASSGSACTSGSLEPSHVMRAMDIPYTAAHGTVRFSLSRYTTEEEIDRVIREVPPIVAQLRNVSPYWSGNGPVEDPGKAFAPVYG

SEQ ID NO: 12671 - protein, 454 aa, Haemophilus somnus 129PT
MTIKTPVQATLASNQYFLDRQDIMESNVRSYPRKLPFAYQKAQGVWVTDVEGNEYLDFLAGAGTLALGHNHPKLIQAIKDVLDSGLPLHSLDITTPLKDAFTEELLSFFPKDKYILQFTGPSGADANEAAIKLAKTYTGRGNVIAFSGGFHGMTHGALSLTGNLGAKNAVQGLMPGVQFMPYPHEYRCPFGIGGKAGVKAVEDYFENFIEDVESGVVKPAAVILEAIQGEGGVVPAPISFLQKVREVTQKHGILMIVDEVQAGFCRSGKMFAFEHANIEPDIVVMSKAIGGSLPLAVLAIKKEFDAWQPAGHTGTFRGNQLAMATGYVSLKIMREENLAQNAKERGEYLTKALTELSQEFPCIGNVRGKGLMMGIDIVDEHQAKDATGAYPRDCDLAVAIQKYCFKNKLLLERGGRGGNVVRILCAVNITQAECEEFIKRFKQSVAEAVKAVRG

SEQ ID NO: 12672 - protein, 397 aa, Klebsiella pneumoniae
MKQVYLDNNATTRLDPMVLEAMMPFLTDFYGNPSSIHDFGIPAQAALERAHQQAAALLGAEYPSEIIFTSWPRATPRHAAIALLPERREIITSVVEHPATLAACEHLERQGYRIHRIAVDSEGALDMAQFRAALSPRVALVSVMWANNETGVLFPIGEMAELAHEQGALFHCDAVQVVGKIPIAVGQTRIDMLSCSAHKFHGPKGVGCLYLRRGTRFRPLLRGGHQEYGRRAGTENICGIVGMGAACELANIHLPGMTHIGQLRNRLEHRLLASVPSVMVMGGGQPRVPGTVNLAFEFIEGEAILLLLNQAGIAASSGSACTSGSLEPSHVMRAMNIPYTAAHGTIRFSLSRYTREKEIDYVVATLPPIIDRLRALSPYWQNGKPRPADAVFTPVYG

SEQ ID NO: 12673 - protein, 184 aa, Kluyveromyces lactis
MSVPIVPTDFAHAPKLEQLKNEFVECYDTDDSRKFFITRSPGRVNLIGEHIDYCQFHVPMASENDLMLACRLTSESENPSITLTNHDSNFAQRKFDLPLDGSLIEIDPSVSDWSNYFKCGLLVVQQFLQEKYNFKGPVHGMEIYVKGDIPSGGGLSSSAAFICAVSLATIYSNVPAGSQSSRMN

SEQ ID NO: 12674 - protein, 339 aa, Mesostigma viride
MAPIKIGINGFGRIGRLVWRATLNRDDVEVVAINDPFIDVPYMVYMAKYDSVHGNLTHDVQQGDGKLMVNGKSITIFGKMDAKEIPWKEAGATFVVESTGVFTTLEGASSHLVGGAETVVISAPSNDAPMFVMGVNEEGYKPDMKVVSNASCTTNCLGPLAKVIHLKFGILEGLMTTVHATTATQKTVDGPSKKDWRGGRGILDNIIPSATGAAKAVGKVLPALNGKLTGMAFRVPTPDVSVVDLTVRLEKGASYDAIKAEIKRASENELKGILAYTEDAVVSTDFIGNKHSSIFDAEAGIALNDNFVKLVSWYDNEWGYSNRVVDLIAHMAKVKAASH

SEQ ID NO: 12675 - protein, 268 aa, Triticum aestivum
MAMARRRALALVSQILQRRVLPAPRFLSSAAGGALDRLNSPPFARQAAHRNPAPPSPWDRLGGQKRTMFIQTQSTPNPQSLMFHPGKPVMEVGSSDFPHARTAMTSPLAKALFAIEGVTRVFFGSDFVTVTKSDETSWDYLKPEVFAAIMDFYSSGQPLFLDSNTAAAMDTAIHEDDSEIVAMIKELLETRIRPAVQDDGGDIEYRGFEPETGIVKLKMQGACSGCPSSSVTLKSGIENMLMHYVPEVKGVEQEFDGDEEAELAGQME

SEQ ID NO: 12676 - protein, 179 aa, Physcomitrella patens subsp. patens
MASAVVSVSIVAAASPASVCRESSSVKQFSGLKSTTLSASKARRLSSVHNGSRVQCMQVWNPIGQPKFETFSYLPPLTDDQIAKQVDFMIQQNLIPCIEFDTVGSVSRTNFSGPGSSGYYDGRYWTMWKLPMFGCTDSAQVLREIQECKQSFPSCWVRVLGFDSKKQVQICGFLVARPN

SEQ ID NO: 12677 - protein, 687 aa, Kluyveromyces lactis
MSEDKYCLVTGGAGYIGSHTVVELCEAGYKCIVVDNLSNSSYESVARMELLTGQEIKFAKIDLCELEPLNKLFDDYKIDSVLHFAGLKAVGESTQIPLTYYFNNIVGTINLLECMKSHDVKKLVFSSSATVYGDATRFENMIPIPETCPTGPTNPYGKTKLTIEDMMRDLHFSDKSFSFAILRYFNPIGAHPSGVIGEAFGIPNNLLPFMAQVAIGRRPKLYVFGDDYDSVDGTPIRDYIHVVDLAKGHLAALKYLEKYAGTCREWNLGTGHGTTVLQMYRAFCDAIGFNFEYVVTARRDGDVLNLTAKCDRATNELEWKTELDVNKACVDLWKWTQDNPFGYQIKGVDSKFFGDKGDFSSRVVSLGKGTSFEVKLANLGATIVDIVVNGCSVVASLDNETEYKDQSNPFFGATVGPYANRIANGTFEINGKRIQLTVSKEDGNVVHSGINSYHSKKFLGPIVKNPEAHIWTADFKYVDEETEFPARLSTLVRYKVDSEKKTLTVEYESKVAGQGSTGANITNHTYFNLNKFNEATIKGSKVQLIDNTGLEVNNKLLPTGNLKKYTQVATFNDSPTEITEKEPVLDFCFVSGLPAKLDTRSSPLTPVFKLSNEDAKLEVEVATTEPTFQVYTGDYVDVKDKYENRAGICCEPGRYIDAVNNPEWKSSVVLPAGETYGHKLSYTFRTL

SEQ ID NO: 12678 - protein, 630 aa, Debaryomyces hansenii CBS767
MKIISLLYCIVFALGIVAKTHTFHFNASYITANPDGVHERRVIAINNEWPIPTIRIKKNDRVEIYFTNLLENRNTSLHFHGLFQQESNSMDGAEMVTQCPIAPGSTFLYNFTVTEQAGTYWYHSHSGAQYSDGLRGMFIVEDDKEPPFQYDEETTLTVSDWYHMEYPDVMSNFLSRYNPTGAEPIPQNSLFNDTKNSTWHVKPDTTYLVRIVNMGMFTSQYLYIEDHTFTIVEIDGNLIEPVETDSLYIAVAQRISVLVHTKKSKATNYRFVNIMDEEMLDFLPDELLVISTNWVAYNDKDLPQSLKNGPNEFEKLTEKLNPVDDFGLKPLSREALLPDSDYQIQLNFTMDNLGNGVNYAFFNNISYVLPKVPTLMTVLSSGEHAGDTEIYGSNTNTFVLQHNEVVEIVLNNMDDGKHPFHLHGHIFQVISRSEAGEDAEDPIVYDPENPDHTNFPDFPMIRDTVMVNPNGFIVLRFKANNPGVWFFHCHVDWHLEQGLAITLVEAPFEIQKSQSLSSNHLDACTSANVSSKGNAAGRYGDSSDIWHDLSGENSQPEPLPAGFTMKGYIAFFICSFCAVFGIYSIYKYGMEDIKNDSNEAVVQKLYRILDSHGALDESEQSALFSVNSRE

SEQ ID NO: 12679 - protein, 627 aa, Frankia sp. EAN1pec
MATPVSEVVGVADLETVRELAQQLRVDSVRSSTSAGSGHPTSSMSAADVMAVLLTRHLRYDWDTPDDPANDHLIFSKGHASPLIYSMFKAVGVVTDDELMTGYRRFGHRLQGHPTPVLPWVDVATGSLGQGLPDAVGVALAGKFLDKVPYRVWVVCGDSEMAEGSMWEALDKAAFYGLSNLIAIVDVNRLGQRGPTEFGWDMDAYARRVEAFGARAVVIDGHDLGAIDAALADAEDATRPTVILARTRKGEGFSEVADAEGWHGKPLPEDMATRAIIELGGERNLRVRGPVPPADMARPAPAQKPAIKLPTYELGAKVATRRAYGQALAAVGAHTDVVALDAEVSNSTYAEDFAKAHPDRFFEIFIAEQQLVAAAVGLSVRGYVPFASTFAAFFSRAYDFIRMAAISQVDIRLAGSHAGVEIGADGPSQMALEDLAMMRAVGGSTVLYPSDATSAAKLIEAMVGISGVSYMRTTRGAYPVLYGPDETFAPGGSKVLRSSDADTVTLIGAGVTLHHCLAAADVLAAEGVSARVIDLYSVKPVDTATLAEAARATGGRLVVAEDHYAEGGLGGAVLEGLAGVLRDGSVSLRLAHLAVGELPGSGTPDELLDFAGISTPHIVEAARGLLR

SEQ ID NO: 12680 - protein, 309 aa, Azotobacter chroococcum (strain mcd 1)
MWDYSEKVKEHFYNPKNAGAVEGANAIGDVGSLSCGDRLRLTLKVDPETDVILDAGFQTFGCGSAIASSSALTEMVKGADLDDALKISNRDIAHFLGRLPREKMHCSVMGRERLQAAVANYRGEELRTDHEKPQLICKSFAIDEVMVRDTIRANKLSTVEDVTKHTKRGGGCSACHEGIERVLSEELAPVARSSSCADQGQEEVKVLAPSRLRSWPRRLRATPKLSNLQRIRRIETVLAAIRPTLQRDKGDVELIDVDGKNIYVKLTGACTGCQMASMTLGGIQQRLIEELGEFVKVIPVSAGPRQMEV

SEQ ID NO: 12681 - protein, 444 aa, Neisseria meningitidis Z2491
MTDLNTLFANLKQRNPNQEPFHQAVEEVFMSLDPFLAKNPKYTQQSLLERIVEPERVVMFRVTWQDDKGQVQVNRGYRVQMSSAIGPYKGGLRFHPTVDLGVLKFLAFEQVFKNALTTLPMGGGKGGSDFDPKGKSDAEVMRFCQAFMTELYRHIGADTDVPAGDIGVGGREIGYLFGQYKKIRNEFSSVLTGKGLEWGGSLIRPEATGYGCVYFAQAMLQTRNDSFEGKRVLISGSGNVAQYAAEKAIQLGAKVLTVSDSNGFVLFPDSGMSEAQLAALIELKEVRRERVATYAKEQGLQYFENQKPWGVAAEIALPCATQNELDEEAAKTLLANGCYVVAEGANMPSTLGAVEQFIKAGILYAPGKASNAGGVATSGLEMSQNAIRLSWTREEVDQRLFGIMQSIHESCLKYGKVGDTVNYVNGANIAGFVKVADAMLAQGF

SEQ ID NO: 12682 - protein, 450 aa, Escherichia coli
MTKHYDYIAIGGGSGGIASINRAAMYGQKCALIEAKELGGTCVNVGCVPKKVMWHAAQIREAIHMYGPDYGFDTTINKFNWETLIASRTAYIDRIHTSYENVLGKNNVDVIKGFARFVDAKTLEVNGETITADHILIATGGRPSHPDIPGVEYGIDSDGFFALPALPERVAVVGAGYIGVELGGVINGLGAKTHLFEMFDAPLPSFDPMISETLVEVMNAEGPQLHTNAIPKAVVKNTDGSLTLELEDGRSETVDCLIWAIGREPANDNINLEAAGVKTNEKGYIVVDKYQNTNIEGIYAVGDNTGAVELTPVAVAAGRRLSERLFNNKPDEHLDYSNIPTVVFSHPPIGTVGLTEPQAREQYGDDQVKVYKSSFTAMYTAVTTHRQPCRMKLVCVGSEEKIVGIHGIGFGMDEMLQGFAVALKMGATKKDFDNTVAIHPTAAEEFVTMR

SEQ ID NO: 12683 - protein, 274 aa, Klebsiella pneumoniae
MWNYSEKVKDHFFNPRNARVVDNANAVGDVGSLSCGDALRLMLRVDPQSEIIEEAGFQTFGCGSAIASSSALTELIIGHTLAEAGQITNQQIADYLDGLPPEKMHCSVMGQEALRAAIANFRGESLEEEHDEGKLICKCFGVDEGHIRRAVQNNGLTTLAEVINYTKAGGGCTSCHEKIELALAEILAQQPQTTPAVASGKDPHWQSVVDTIAELRPHIQADGGDMALLSVTNHQVTVSLSGSCSGCMMTDMTLAWLQQKLMERTGCYMEVVAA

SEQ ID NO: 12684 - protein, 390 aa, Bradyrhizobium sp. BTAi1
MEQRIASLTAPSARSNVPPFMVMDVMAAAERIEASGGHVIHMEVGQPAAPAPRTALAAAHAALDQARIDYTSALGLPSLRGRIARHYRETYGCDIDPGRIVITTGSSAGFILAFLAMFEPGDRVAVTVPGYPPYRHILTALGCEPVLIETTAETRHALTGEALLAAHRKTPLKGVLVASPANPTGTMMSRAALGDVIAAARDAGIRFISDEIYHGLDYAFPAVTAAQLTADALIINSFSKYFCMTGWRVGWMVVPDALVRPIERLQQNLAISVPTLSQIAAEAAFDGRPEMDGIKHGYQENRRILIEGFPKAGLSRFLPADGAFYLYADVSDFTKDSLDFAKRMLEETHVAATPGVDFDPIHGRNFVRFSYARSAEDMREAVARIARWLG

SEQ ID NO: 12685 - protein, 336 aa, Symbiobacterium thermophilum IAM 14863
MTIRIGINGFGSIGRRVFRIALSRPDIEIVAINDLTPPATSAHLLKYDSNYGILDAEVSATENSIIVNGKEIRVYAEKDPAQIPWKEHGVDIVMECTGRFTDKQQAEVHITSGGAKKVIISAPAKNEDITIVMGVNHEQYDPANHHVISNASCTTNCLAPVVKVLHDKFGVVKGMMNTIHSYTNDQVILDYPHKDLRRARAGALSIIPTTTGAAKAVALVIPELKGKLTGFAMRVPTPVVSVVDFTAELATPTTKEEINAALKAAAEGPMKGILAFEEAPLVSVDFKGNPNSSIVDGPSTLVLDGNLVKVVSWYDNEWGYSNRMVDLAAYIASKGL

SEQ ID NO: 12686 - protein, 511 aa, Oryza sativa Japonica Group
MDGLAAPSPSHSGATSGGGASHRKRKLPPSSLSDATADEDDDTTAPSSPSTSPSSPSRPSSPSSSHSDDDDDDSLHTFTAARLDGAPPSSSGRPPKPESSTVSAAAAAAAAAAAPKPDSASAAAGDGKEDPKGLFTDNIQTSGAYSAREEGLKREEEAGRLKFLCYSNDGVDEHMIWLVGLKNIFARQLPNMPKEYIVRLVMDRTHKSMMVIRNNIVVGGITYRPYTSQKFGEIAFCAITADEQVKGYGTRLMNHLKQHARDADGLTHFLTYADNNAVGYFVKQGFTKEITLDKERWQGYIKDYDGGILMECRIDQKLPYVDLATMIRRQRQAIDEKIRELSNCHIVYSGIDFQKKEAGIPRRTMKPEDIQGLREAGWTPDQWGHSKSRSAFSPDYSTYRQQLTNLMRSLLKNMNEHPDAWPFKEPVDSRDVPDYYDIIKDPIDLKTMSKRVESEQYYVTLEMFVADMKRMFSNAKTYNSPDTIYYKCASRLESFFSNKVASQLAQASTKN

SEQ ID NO: 12687 - protein, 317 aa, Pichia guilliermondii
MSITLNSGYEMPSVGFGCWKVDKATCADTIYNAIKVGYRLFDGAEDYGNEREVGEGINRALDEGLVARDELFVVPKLWNSFHDPKNVEKALDRTLSDLKVDYLDLFLIHFPIAFKFVPFEEKYPPGFYCGDGDKFTYEDVPIIDTWRALEKMVEKGKIRSIGISNFPGALIQDLLRGAKIKPAVLQIEHHPYLQQPRLIEYVQSQGIAITAYSSFGPQSFVELNHPRVKDVKPLFEHDVIKSVAEKANKTPAQVLLRWATQRGLAVIPKSNNPDRLLSNLKVNDFDLSQEDFKEISKLDIELRFNNPWDWDKIPTFV

SEQ ID NO: 12688 - protein, 481 aa, Rhodobacter sphaeroides 2.4.1
MTDFRREKILVGGDWIQADAGGRIEVTNPATGAVIGTVPDAGAAETARAVAAAEAAFGPWRALTAAERATHLRRLAQAILDHREALAELLTEEQGKPLAEARGEVGMSAAYIQWFAEEARRVYGEVIPSPWPDRRLLVTRQPVGVVAAITPWNFPSSMLARKIGPALAAGCTVVAKPASQTPFSGLAWGVLGEMAGLPAGVLNIVTGSARAIGGELTANPSVRKITFTGSTPVGKVLLAQAAGTVKKMSMELGGNAPFLVFDDADLDRAVEGAIAAKFRNAGQTCVCTNRFYAQAGIHDEFVKRLAAATAALKVGPGAQDGSEIGPLIDAAAVAKTEEMVADATAKGGRIVTGGRRHTAGAGFYEPTVIADATDAMTFAREEIFGPVAPVFRFETEEEAIRRANATEYGLACYFYTSDLGRAFRVSEALDYGIVGVNEGLVTTEVAPFGGVKESGFGSEGSHHGMQDYLTLKYTAMGGLGR

SEQ ID NO: 12689 - protein, 351 aa, Rhodobacter sphaeroides 2.4.1
MTRRHAVALIPGDGIGPEVIDASLEVLEKVARLHGFALDMTRFDWSCDRYLATGRMMPEDGIDQLRPHAAILLGAVGWPARVPDAVSLHGLLLPIRKSFDQFANMRPHRLLPGATGPLKSEAFDILCIRENTEGEYSGAGGRIHVGTPAEVAVETSIFTRRGVERILRFGFEQARRRSGRLASVTKSNAQKYSMVFWDEVTEEVAADYPDVTVSRYHIDAIAARMVMAPETLDVVVASNLFGDILTDLGAAIQGGLGFAPSANINPDRSQPSMFEPVHGSAPDIAGRGIANPVATLWSAALMLDHLGEEAAGRSLLAALSAVTAEGRLRTPDQGGRACTTDVARAVADRLS

SEQ ID NO: 12690 - protein, 392 aa, Mycobacterium avium 104
MQNERVQGFGFHTLALLTAVGFAGPLLASAKRFRIPVVIGELIAGLAIGRTGFGVVDVADPTFQLLANIGFALVMFVVGTHVPLRARLMRSALPAALARAALAGGIAAVLGVALAVQFDTGHAALYAVLMASSSAALALPVIDSLRLRGPRVLSVTTQIAIADAACIVLLPLVIDIRRAPTAALGALAVAGCAAALFVLLRAADRKGWRRRLHAYSEQHRFALELRTSLLVLFALAALAVATQVSIMLAGFAVGLVVGAVGEPHRLARQLFGITEGFFSPLFFVWLGASLQVRELGAHPQLILLGAGLGCGAVLAHCAGRLLGQPLTLAVLSAAQLGVPVAAATIGTQQHLLAPGEASALMFGALLTIAAASIAAGLAARRQGAPEPGEPAR

SEQ ID NO: 12691 - protein, 299 aa, Rhodobacter sphaeroides 2.4.1
MNVRVACVGGAVLDRVYEVAALPGTDGKSRASSYREFGGGMAGNAAVAIARLGGQARWWGRVGDDAIGAGVLAGLAAEGVATAEARVVEGAVSSHSLVLSDAEGRRAIVLYRSDGLDPDASWLPLAAVGGLDAVLADNRWIDGAVAALTAARAAGLPAVLDADAGADPRSREAVQAASHAIFSEPGLAEIYGTSDPDEGLRHAAADAPFVAVTLGEAGLRWRDARGGLASLPAFPVRAVETVGAGDVFHGAFALALAEGQPPEDALRFAAATAALKCRGSGGRASYPGRTAVEDLLRQG

SEQ ID NO: 12692 - protein, 193 aa, Glycine max
MFAEENGLKGDPRLQAISQAIRVVPHFPIHGIMFQDITTLLLDHKAFKDTVDIFVDRYRDTHISVVAGIEARGFMFGPSIALGIGAKFVPLRKPRKLPGEVISEKYALEYGTDCLELHVGAVQPGERAIIIDDLVATGGTMSAGVKLLERVGAEVVECACVIGVPDVKGQCRRIGKPLYVLVEPRKADKCYPD

SEQ ID NO: 12693 - protein, 160 aa, Glycine max
  misc_feature (99)..(99): Xaa can be any naturally occurring amino acid
  misc_feature (152)..(152): Xaa can be any naturally occurring amino acid
ASSMISSPAVTTVNRAGAGMVAPFSGLKSIAGFPTKKTNNDITSIATIRGKVQFLHVWPPLGKKKIDTLSYLPYLDDAQLPNELEYLLTNVWIPCLEFXMEHIFMYREHYTSPGYYNSRYCTMLKLPMVGCTDASRVIKELLQAKTAYPNGXFIRIIGFD

SEQ ID NO: 12694 - protein, 511 aa, Synechococcus sp. CC9605
MVDDEQRENEGDLICAAQFATPEAINFMATEARGLICLAMEGQRLDELDLPLMVDRNTDANETAFTVSIDAGIEHGVTTGISAEDRAATIQVALNPATRPAELRRPGHIFPLRARPGGVLKRAGHTEAAVDLAQLAGLSPSGVICEIQNSDGSMARLPELRSYADRWGLKLISIADLIRYRLDNERFVRRMAQAQMPSRFGNFQAVGYRNELDGSEHVALIKGEPNALSEPVLVRMHSECLTGDAFGSLRCDCRPQLEAALHQIEAEGEGVVVYLRQEGRGIGLINKLKAYSLQEAGLDTVEANERLGFPADLRNYGVGAQILSDLGIHRLRLLTNNPRKIAGLGGYGLQVEERVPLVMDPGAYNADYLAAKREKLGHLFESESPCVVLALAVNVGPESWPTVRREVEAIAQRHGFSLEALHEPRLLALWDRPQFVWKLIPDGADAAPLLKNLAALAATERVGLMRVPTERMALHPPQTLERVEHQLNELINLGSDGLLENGPSLLHWTRS

SEQ ID NO: 12695 - protein, 556 aa, Streptococcus pyogenes str. Manfredo
MYQALYRKYRSQTFDEMVGQSVISTTLKQAVESGKISHAYLFSGPRGTGKTSAAKIFAKAMNCPNQVDGEPCNQCDICRDITNGSLEDVIEIDAASNNGVDEIRDIRDKSTYAPSRATYKVYIIDEVHMLSTGAFNALLKTLEEPTENVVFILATTELHKIPATILSRVQRFEFKAIKQKAIREHLAWVLDKEGIAYEVDALNLIARRAEGGMRDALSILDQALSLSPDNQVTIAIAEEITGSISMLALGDYVRYVSQEQATQALAALETIYDSGKSMSRFATDLLTYLRDLLVVKAGGDNQRQSAVFDTNLSLSIDRIFQMITVVTSHLPEIKKGTHPRIYAEMMTIQLAQKEQILSQANLSGELISEIETLKNELAQLKQQLSQLQSRPDSLARSDKTKPKTASYRVDRVTILKIMEETVRNSQQSRQYLDALKNAWNEILDNISAQDRALLMGSEPVLANSENAILAFEAAFNAEQVMSRNNLNDMFGNIMSKAAGFSPNILAVPRTDFQHIRKEFAQQMKSQKDSVQEEQEVALDIPEGFDFLLDKINTIDD

SEQ ID NO: 12696 - protein, 368 aa, Streptococcus pyogenes MGAS8232
MEHKWKLWLFIVGVVLLIGGASVLIQKGQAKAFSQGKPQIPAKKVKSTKVDPNAPVDQKVIYLAGGCFWGVEEYFSQVDGVLDAVSGYANGRGDTTNYQLIHQTGHAETVEVAYDTNRISLKELLLHFFRIIDPTSLNKQGNDRGSQYRTGIYYTDKADLAIIDEVFKEKAKDYKKKIVVEKAPLKHFIKAEDYHQDYLKKNPNGYCHIDINQATYPVIDESKYPKPSATEIKEKLSADEYRVTQKNETEKAFSNRYWDSFDAGIYVDVVTGEPLFSSKDKFESGCGWPSFSRPISPDVVRYKEDKSFNMTRTEVRSRSGNSHLGHVFTDGPKDQGGLRYCINSLSITFIPKADMEAKGYGYLLSSVE

SEQ ID NO: 12697 - protein, 480 aa, Cucurbita maxima
MARSSLFTFLCLAVFINGCLSQIEQQSPWEFQGSEVWQQHRYQSPRACRLENLRAQDPVRRAEAEAIFTEVWDQDNDEFQCAGVNMIRHTIRPKGLLLPGFSNAPKLIFVAQGFGIRGIAIPGCAETYQTDLRRSQSAGSAFKDQHQKIRPFREGDLLVVPAGVSHWMYNRGQSDLVLIVFADTRNVANQIDPYLRKFYLAGRPEQVERGVEEWERSSRKGSSGEKSGNIFSGFADEFLEEAFQIDGGLVRKLKGEDDERDRIVQVDEDFEVLLPEKDEEERSRGRYIESESESENGLEETICTLRLKQNIGRSVRADVFNPRGGRISTANYHTLPILRQVRLSAERGVLYSNAMVAPHYTVNSHSVMYATRGNARVQVVDNFGQSVFDGEVREGQVLMIPQNFVVIKRASDRGFEWIAFKTNDNAITNLLAGRVSQMRMLPLGVLSNMYRISREEAQRLKYGQQEMRVLSPGRSQGRRE

SEQ ID NO: 12698 - protein, 580 aa, Mesostigma viride
LQSHLADVEKTHLRDLLRDEQRSSSCEVEHNGFFVDYARQRVTAETMNKLMALAKAANMKEKIQAMFAGDRINVTENRAVLHVATRAPKGEVIKVDGVNVVPDVYEVLDKIKSFSEKVRSGEWKGATGKPLKDVVCIGIGGSFLGPAFVHTALRTDHRAPLAASGRRIRFPSNVDPIDVARQLNGLDPETTLVIVVSKTFTTVETMLNARTVRAWITSNICVPDAVSKHMVAVSTDLALVKDFGIDPVNAFGFCDWVGGRYSVTSAVGILPLAIQYGYEHMERFLAGCWDMDTHFRDAPFDKNIPVLLGLIGVWNTQFLQCPTRAILPYCQALAKLPSHIQQLSMESNGKGVAMDGTELPFEAGEVEFGEPGTNGQHSFYQLIHQGRVIPCDFIGIIKSQQSVYLKNELVSNHDELMCNFFAQADALAYGKSAEELVAEGVAPDLVPHKTFTGNRPSSSILLPTLDAYTVGQLLSHYEHRVAVAGFIYGINSFDQWGVELGKVLAGKVRTTMNQARTKGVPITGYNSSTIALMNRYLSGKTKWLYPEPRDVFPSTSRQRVRPEPRRLWPLEGTSNADVGH

SEQ ID NO: 12699 - protein, 388 aa, Aspergillus oryzae
MGVSVGSSEENCDENSNSNENSNSNSNSNSNENSNTNTWGSSTDSGSMPPGGMPPIGGMPPSGGTPPGGMPPSGGTPPTGGMPPTGGTPPSSGTDTCEDCEGGTPPSGGTPPSGGTPPTSGTPPTGDVPTGDTPSGTPPTSGTETGEETGTETGGSPPSGSTPPTSGTPPTSGTPPSGGTPSGTPPTGDVPTGDTPSGTPPTSGTETGEETGTETGGSPPSGSTPPTSGTPPSGGSPPTSGTETGEETGTETGGSPPSGGSPPTSGTPPTGDVPTGSGTPPSSGTETGITTGEETGTSTGGSPPTGGMPPSGGTPPNSGTECEACQGGNNSGNSSGSSSSSSSSSSSSSSSSSSSGSSGNHASANASGPNDCAECEVSASVSPEDCEE

SEQ ID NO: 12700 - protein, 230 aa, Debaryomyces hansenii CBS767
MSQLFEWAFGKKLTPQERLRKNQRALEKTQRELARETTKLQSQEKKLVADIKKSAKQGQIASAKLQAKDLIRTKNYIVKFNSMKAQLQAILLRIQSVRSNQQMATSMRDATRLLSGMNKSMNLPQLSRIAQEFAKENDMMDQKQEFMDDAIDDAMAEDDELGEDEQADEILSKVLDEIGVDLNTSLQDTPSQINVQSPDRVDNGRVAEAIGGPSNNEEDDLQARLDNLKK

SEQ ID NO: 12701 - protein, 226 aa, Yarrowia lipolytica CLIB122
MPRPRREMTPDEEYSRKLSYILRHGATKEKLPIREDGYLSVGVLLNRAGIKGKWNLEDTKRVVRDNDKQRYKLIFEPTEKQPKEPTDPNDCTGYWIRANQGHTINTKVEMKALKTPEDFPTLEIFHATSKQVLPIVLKEGLSKMKRQHIHLATDLVTEGGSVAGKRLNREVFIYINVPKALEAGIEFFLSENGVVLTEGKDGKISREFFSKILDKNNQPVDLEALA

SEQ ID NO: 12702 - protein, 199 aa, Bacillus subtilis
MTIDHSVTNTEQLEQQNPAIKTKLKLKKLKDQVIVITGASSGIGLVTARMAAEKGAKVVAAARNEEALKELTDELKEKGHDAIWVKADVGKEEDVNRIAETAISTFGRFDTWVNNAAVSTFGHAMDVTVEDMKRMFDTNFWGPVYGTRAAVKHYTGRGVPGALINVGSLFGDRGTVIQSTYASAKFALHGWTESIRMEL

SEQ ID NO: 12703 - protein, 561 aa, Acinetobacter sp. ED45-25
MTTLKITGMTCDSCAAHVKEALEKVPGVQSALVSYPKGTAQLAIEAGTSSDALTTAVAGLGYEATLADAPPTDNRAGLLDKMRGWIGAADKPSGNERPLQVVVIGSGGAAMAAALKAVEQGAHVSLIERGTIGGTCVNVGCVPSKIMIRAAHIAHLRRESPFDGGIAATVPAIDRSKLLAQQQARVEELRHAKYEGILDGNPAITVVHGEARFKDEQSLVVRLNDGGERVVAFDRCLVATGASPAVPPIPGLKESPYWTSTEALVSDTLPERLAVIGSSVVALELAQAFARLGSQVTILARNTLFFRDDPAIGEAVTAAFRAEGIKVLEHTQASQVAHVDGEFVLTTGYGEIRADKLLVATGRTPNTRSLALDAAGVTVNAQGAIVIDQGMRTSNPNIYAAGDCTDQPQFVYVAAAAGTRAAINMTGGDAALDLTAMPAVVFTDPQVATVGYSEAEAHHDGIETDSRTLTLDNVPRALANFDTRGFIKLVIEEGSGRLIGVQAVAPEAGELIQTAVLAIRNRMTVQELADQLFPYLTMVEGLKLAAQTFSKDVKQLSCCAG

SEQ ID NO: 12704 - protein, 200 aa, Zea mays
MAEPGLEDSQPVDLSKHPSGIVPTLQNIVSTVNLDCKLDLKAIALQARNAEYNPKRFAAVIMRIREPKTTALIFASGKMVCTGAKSEQQSKLAARKYARIIQKLGFPAKFKDFKIQNIVGSCDVKFPIRLEGLAYSHGAFSSYEPELFPGLIYRMKQPKIVLLIFVSGKIVLTGAKVREETYTAFENIYPVLAEFRKVQQ

SEQ ID NO: 12705 - protein, 459 aa, Streptomyces avermitilis MA-4680
MTSRSSTATARTSSEARAVARTQTLVKGVNGIGTVRKTTLPGGLRIVTETLPSVRSATFGIWAHVGSRDETPTLNGATHYLEHLLFKGTHKRSALDISSALDAVGGEMNAFTAKEYTCYYARVLDTDLPLAIDVVCDMLTGSLILEEDVNVERGAILEEIAMTEDDPGDCVHDLFAHTMLGDTPLGRPVLGTVDTVNALTADRIRRFYKKHYDPTHLVVACAGNVDHNKVVRQVRAAFEKAGALKQPDATPIAPRDGRRAIRTAGRVELLGRKTEQAHVVLGMPGLARTDERRWALGVLNTALGGGMSSRLFQEVREKRGLAYSVYSYTSGFADCGLFGVYAGCRPSQVHDVLKICRDELDHVAEHGLSDDEIARAIGQLKGSTVLGLEDTGALMNRIGKSELCWGEQMSVDDMLARITEVTPDDVRSVARDILGQRPSLSVIGPLKDKQASRLHEAVA

SEQ ID NO: 12706 - protein, 79 aa, Glycine max
ASLMISSPAVTTVNRAGAGMVAPFTDLKFMAGFPTGKTDHDVTSIASNGGIVQCMHVSPPIGLIKHGTLYYLPDLDDAQ

SEQ ID NO: 12707 - protein, 159 aa, Bifidobacterium animalis
MAAGPVLVVDFGAQYAQLIARRVREANVYSELVPHSMPVEEMLAKKPSAIILSGGPASVYEPGAPTIDKSIFTAGVPVLGICYGFQVMAHELGGDVDKAALGEYGKTEAVVDDATGILDSSPSLQTTWMSHGVAVNKAPAGFEVTAHTEGAPVAAMEDP

SEQ ID NO: 12708 - protein, 298 aa, Desulfotalea psychrophila LSv54
MNIKNYLEQKRSLVEEAMDRFMLEESGPFKKHIEAMRYSLFAGGKRIRPILCLAAADSICAQERTQENLLPVACALECIHTYSLIHDDLPAMDDDQLRRGKATNHVLYGEAGAILAGDGLLSWAFDLIADRGKGNLTAEKRLDICHMVARAAGSLGMVGGQQLDIQSENKEIDFDTLATIHRSKTGALITCSIMSGAIGAGANAKQLHALEEYGNNIGLAFQIIDDLLDATATTEELGKTAGSDAEHGKATYPLFFGIDKTREKAKAAVDNAIKALTLFDHRADPLRGLANYIYSRTN

SEQ ID NO: 12709 - protein, 257 aa, Bradyrhizobium sp. BTAi1
MTDSIRLDGRVAVVTGAAGLIGAATMRLLAARGARIVAIDRREQDLNAAIAALPASAEPLAIAADVTDEAQVAAYVQRACDQFGTIDVFFNNAGIEGEIKSITDYPLEAFRRVLDVNVVGVFLGLKHVLPVMLQQNRGSIINTASIAGLIGSPQIAVYSASKHAVIGLTKSAAWECTGTNVRVNCICPGLIDSRMLSAIIEGRSGAPVPIDRIVDRVPARRLGQGSEVAAIVAFLASDDASYVSGAAYTVDGGRTAA

SEQ ID NO: 12710 - protein, 645 aa, Desulfotalea psychrophila LSv54
MLQQAQTTSRNTLLDRVDSPKDIRQLTHDDLIILAAEIREKIIDTVSKTGGHLAPSLGVVELTLALHYVFNTPTDKLVWDVGHQSYAHKILTGRRKQFDTLRQYRGMSGFPKRGESDYDAFETGHSSTSISAALGMTLAMDLLQQDNKAIAVIGDGSMTAGMAFEALNHAGHLDKNLIVILNDNEMSISPNVGALSSFLSRKLTGKTMRRVKSHLVEKLQDSDVGENILNVLRKSEESFKSFFTPGMLFEAFKFDYIGPIDGHDIDALISTLNTVRDTAKGPALIHVLTKKGKGYLPAEENPDAFHGVGPFNRQTGKIIKKKGPASYTTVFGQTMLELGKKNKNIVAISAAMVAGTGLTPFSEAYPDRFFDVGIAEQHAITFAAGLASQGMRPVVAIYSSFYQRAMDQIIHDVCIPNLPVTLAIDRAGVVGDDGPTHHGIFDISFLRFIPNLTIMAPKDEAELQQMLVTATGHDGPTAIRYPRGAGEDVSTSQEIESIPILEIGRGELLREGDDILLLPIGNRVYPAMRAAEELAKQGISASVINPRFIKPLDAELICQQAKKTGRIITIEDNTLCSGFGSAVLELLSQKSLYGIKTKILGHPHAFVEHGPQKTLWENSGITSRGIIMAALDLLQKETDPSVANE

SEQ ID NO: 12711 - protein, 732 aa, Arabidopsis thaliana
MSNQKKRNFQIEAFKHRVVVDPKYADKTWQILERAIHQIYNQDASGLSFEELYRNAYNMVLHKFGEKLYTGFIATMTSHLKEKSKLIEAAQGGSFLEELNKKWNEHNKALEMIRDILMYMDRTYIESTKKTHVHPMGLNLWRDNVVHFTKIHTRLLNTLLDLVQKERIGEVIDRGLMRNVIKMFMDLGESVYQEDFEKPFLDASSEFYKVESQEFIESCDCGDYLKKSEKRLTEEIERVAHYLDAKSEEKITSVVEKEMIANHMQRLVHMENSGLVNMLLNDKYEDLGRMYNLFRRVTNGLVTVRDVMTSHLREMGKQLVTDPEKSKDPVEFVQRLLDERDKYDKIINTAFGNDKTFQNALNSSFEYFINLNARSPEFISLFVDDKLRKGLKGITDVDVEVILDKVMMLFRYLQEKDVFEKYYKQHLAKRLLSGKTVSDDAERSLIVKLKTECGYQFISKLEGMFTDMKTSEDTMRGFYGSHPELSEGPTLIVQVLTTGSWPTQPAVPCNLPAEVSVLCEKFRSYYLGTHTGRRLSWQTNMGTADIKAIFGKGQKHELNVSTFQMCVLMLFNNSDRLSYKEIEQATEIPAADLKRCLQSLACVKGKNVIKKEPMSKDIGEEDLFVVNDKFTSKFYKVKIGTVVAQKETEPEKQETRQRVEEDRKPQIEAAIVRIMKSRKILDHNNIIAEVTKQLQPRFLANPTEIKKRIESLIERDFLERDSTDRKLYRYLA

SEQ ID NO: 12712 - protein, 492 aa, Prunus mume
MGSSSATANRFLLSKIATSEGHGENSPYFDGWKAYDRNPFHPTKNPEGVIQMGLAENQLSFDSIEDWIKKNPKASICTPEGVEEFKNVAIFQDYHGFPEFRKAVAMFMSKARGGRVTFDPNRVVMSGGATGANELVMFCLADPGDAFLVPSPYYPAFFRDLGWRTGVQIVPVDCDSSNNFKITKEALEAAYEKAQKNNINVKGLIITNPSNPLGTTLDRNTLESLVEFINQKNIHLVCDEIYAATVFSSPTFTCISEVIQNMNCNPNLIHIVYSLSKDMGLPGLRVGIVYSYNDDVVNIGRKMSSFGLVSSQTQHMLPSMLLDEEFVARFLETSPKRLAKRHGVFTKGLEEVGINCLKSNAGLFCWMDLRRLLEDQTFDGEMVLWRVIVNEVGPNVSPGSSFKCVEPGWFRVCFANMDDETLEVALKRIRTFVRQGKKAQDQVVQVKSPKRWKSNLRLSFSSSSTRRFDQESVNVLSPHMMSPHSPLVRAKT

SEQ ID NO: 12713 - protein, 549 aa, Haemophilus somnus 129PT
MQNINPTQTNAWKALEQHQKDLDQVTIQQLFEQEPTRFNDYSLKFAEQILVDYSKNNINQQTLSLLRQLAKECALNEATEAMFNGEKINRTENRAVLHTALRSCANTPVYVDGKDVMPEVNAVLAKMKSFCQRVISGDWKGYTGKAITDVVNIGIGGSDLGPYMVTEALRPYKNHLTMHFVSNVDGTHIAETLKKVNPETTLFLVASKTFTTQETMTNAISARKWFLAAAQDESQIANHFAALSTNAKEVEKFGIDTNNMFEFWDWVGGRYSLWSAIGLSIALSIGFDNFEQLLAGAHEMDNHFRTAPMEQNIPATLALIGIWNCNFLGAETEAMLPYDQYLHRFAAYFQQGNMESNGKYVARNGEVINNYQTGPIIWGEPGTNGQHAFYQLIHQGTKIIPCDFIAPAQTHNPLSDHHSKLLSNFFAQTEALAFGKTQQEVEAEFVKAGKSLDEVKEIVPFKVFTGNKPTNSILVQKITPFTLGALIAMYEHKIFVQGVIFNIYSFDQWGVELGKQLANRILPELTGDESISSHDSSTNGLINQFKAWR

SEQ ID NO: 12714 - protein, 653 aa, Marchantia polymorpha
MQAPAVPAVQQQQQHCPISVTSSGSRFTTPAVVQAFRLSSSCFFHSSSSSLRILRSRADQPLRRALSIPHHRIEAMASGQHAPISESAAWADLKQHVKTIEGTHLRNLMQDNNRCEELIKEYDGIVVDLSRQRVIHDTVDKLLNLAEEAKLKEKIDQMFDGVHINETENRSVLHAALRAPRDEVINCDGQNVVPAVWDVLDKIDAFSDQIRSGSWLGSTGKPLTDVVAIGIGGSFLGPLFVHTAMQTEPGCAQAAKGRRLRFLANVDPIDVARALLDLNQETTLVVIVSKTFTTAETMLNARTVRTWITSALGVEAVSKHMVAVSTNLKLVKEFGIDPANAFGFWDWVGGRYSVCSAVGVLPLALQYGFSHVKKFLQGAWSIDDHFRSAPLESNLPVLLGLMSVWNVSFLGCPARAILPYCQALAKLAPHIQQVSMESNGKGVSLDGVPLPFGTGEIDFGEPGTNGQHSFYQLIHQGRVIPCDFIGIIKSQQSVYLKGEQVSNHDELMCNFFAQADALAYGKTREELVAEKVPEALIPHKMFSGNRQSLSILLPNLTPYTVGQLLALYEHRVAVQGWIWGINSFDQWGVELGKSLAGKVRTQMNAARTKTQPLSGFNYSTTTLLTRYLQGKTQLLYPDPHDVFPSNVLPGFEK

SEQ ID NO: 12715 - protein, 348 aa, Kluyveromyces lactis
MSIPETQKGVIFYENGGELQYKDIPVPKPKANELLINVKYSGVCHTDLHAWKGDWPLPTKLPLVGGHEGAGVVVAMGENVKGWIIGDFAGIKWLNGSCMSCEYCELSNESNCPDADLSGYTHDGSFQQYATADAVQAARIPKGTDLAEVAPILCAGVTVYKALKSADLKAGDWVAISGACGGLGSLAIQYAKAMGYRVLGIDTGAEKAKLFKELGGEYFVDYAVSKDLIKEIVDATNGGAHGVINVSVSEFAIEQSTNYVRSNGTVVLVGLPRDAKCKSDVFTQVVKSVSIVGSYVGNRADTREALDFFARGLVHAPIKIVGLSELADVYDKMVKGEIVGRYVVDTSK

SEQ ID NO: 12716 - protein, 493 aa, Delftia acidovorans
MSQKFIDRHGLWSDAQKAAAVEVLKKIEQDGIQMIRLSWPDQYGLLRGKMLSVAALRSAFGSGSEITMAPFFFDTVSTFVFNPFSSDGGFGNPELAGSPNVVMVPDPTTFRVLPWADRTGWMLADLYMRSGRPFPLSPRALLKKALGQLADLGYDFHGGLEVEWYLTRIVDPCLEPETLGGPGTPAAPPKVMPVAKGYSYLLENHLDEVEPIMAEVRQHLLTLGMPLRSIEDELGPSQMETTFDVMSGLDMADTMVLFRNAVKQICRRRGYLASFMCKPKIEGFIASGWHLHQSLAARDSGVNAFVPQTGEPLSALGRAYVGGLLKHACAASSFTTPTVNGYRRRRPFSLAPDRVTWAEDNRAAMARVIAAPEDSASRVENRVGEPAANPYLYLASQLFSGIDGIRRQLDPGPLQETPYAADVPILPRNLAEALDVLEGSSFFREAFGEEFIHYWLHLRRSEWARFVAAEGADVDMAGDPVTDWEHREYFELF

SEQ ID NO: 12717 - protein, 668 aa, Triticum aestivum
MDRHHHHHQQQQQQPPSPQEEHAAQPRCWEEFLHRKTIRVLLVETDDSTRQVVTALLRHCMYQVIPAENGHQAWAYLQDMQSNIDLVLTEVFMHGGLSGIDLLGRIMNHEVCKDIPVIMMSSHDSMGTVLSCLSNGAADFLAKPIRKNELKNLWAHVWRRSHSSSGSGSGSAIQTQKCTKSKSGDDSNNNSNNRNDDASMGLNARDGSDNGSGTQSSWTKRAVEIDSPQDMSPDQSIDPPDSTCAHVSHLKSEICSNRLRGTDNKKCQKPKETNGDEFKGKELEIGAPGNLNTDDQSSPNESSVKPTDGRCEYLPQNNSNDTVMENSDEPIVRAADLIGSMAKNMDAQQAARAIDAPNCSSQVPEGKDADRENAMPYLELSLKRSRSTADDADAAIQEEQRNVVRRSDLSAFTRYNTCAVSNQGRAGFVGSCSPNGNSSEAAKTDAAQMKQGSNGSSNNNDMGSTTKSVVTKPAGGNNKVSPINGNTHTSAFHRVQPWTPATAAGKDKADETSKKNAATAAAAAKDMSGEAQSKHPCAAAHDANGGSAGGTAQSSLVNPSGPVEGHAANYGSNSGSNNNTNNGSTAATAAGAAAAVHAETGGIDKRSNMMHMKRERRVAAVNKFREKRKERNFGKKVRYQSRKRLAEQRPRVRGQFVRQPPPPAAVER

SEQ ID NO: 12718 - protein, 386 aa, Cucumis sativus
GRGNSIVPGPVNIPEPVLRAMNRNNEDYRSPAVPALTKTLLEDVKKIFKSTAGTTFLIPTTGTGAWESALTNTLSPGDRIVSFLIGQFSLLWIDQQQRLNFNVDVVESDWGQGANLDVLESKLAADGGQTIKAICIVHNETATGVTNDLSKVRFLLDKYKHPALLLVDGVSSICALDFRMDEWGVDVALTGSQKALSLPTGLGIICASPKALEASKTSKSVKVFFDWKDYLKFYNLGTYWPYTPSIQLLYGLRAALDLLFEEGLDNVIARHSRLGKATRPAVEAWGLKNCTQKEEWFSDTVTAVLVPSYIDSAEIVRRAWKRYNLSLGLGLNKVAGKVFRIGHLGNLNELQLLGCLAGVEMILKDVGYPVKLGSGVAAASESLVNA

SEQ ID NO: 12719 - protein, 266 aa, Triticum aestivum
MDRHHHHHQQQQQQPPSPQEEHAAQPRCWEEFLHRKTIRVLLVETDDSTRQVVTALLRHCMYQVIPAENGHQAWAYLQDMQSNIDLVLTEVFMHGGLSGIDLLGRIMNHEVCKDIPVIMMSSHDSMGTVLSCLSNGAADFLAKPIRKNELKNLWAHVWRRSHSSSGSGSGSAIQTQKCTKSKSGDDSNNNSNNRNDDASMGLNARDGSDNGSGTQSSWTKRAVEIDSPQDMSPDQSIDPPDSTCAHVSHLKSEICSNRLRGNCSSC

SEQ ID NO: 12720 - protein, 93 aa, Zea mays
  misc_feature (33)..(33): Xaa can be any naturally occurring amino acid
  misc_feature (43)..(43): Xaa can be any naturally occurring amino acid
  misc_feature (79)..(79): Xaa can be any naturally occurring amino acid
AFTSEGDLSVLLIAELYAWQHTSSITITWTGAXMLRFKHYFTXAVQEQNDVMKRHGDKIDHDILAVMDVLYRCINDASXSQPPLIMLLRQSHS

SEQ ID NO: 12721 - protein, 101 aa, Brassica napus
MAIFRATLLMLLILVCLTTYELHVHASEGAEAESREGAVKIDCSGRCKGRCNKSSRPNLCLRACNSCCFRCNCVPPGTHGNHHLCPCYASITTRGGRLKCP

SEQ ID NO: 12722 - protein, 321 aa, Frankia sp. EAN1pec
MSSRKAVWRARYSPFMSIALGRPGALQPVSRAGATAARTTLRHIRNHPAVQRQRNRACARYIGWQIWQRTTRRPVTIDLHGSVRLRCHPHSTSASAVLYCRLPDWMEMRFLLDYLNPGDVFVDVGANVGVYTLLAASLPGVHCIAFEPSSDSWDQLIENINLNQLSQVEVHRVAVGDQSGEIDFTIGHGTVNQVASPDIASRRERVPVVRLDDVVPHDRRVTLIKIDVEGHEPAVLDGARALIERLAPALLVEYNHPARLRSLLDELDYHPVVYNPETRAFRAIELDRESPKNILALKKSILDQYLPDNGVGTGRAKGTSK

SEQ ID NO: 12723 - protein, 771 aa, Oryza sativa Indica Group
MAQHSAAAAGGDEEVAEAEAAAGSTTTGGATLRHRHAGKGADEHEAAGGGGGGRNGGADDPDATSVERVFADKAVPSWREQLTLRAFVVSALLAVMFSVIVMKLNLTTGIIPSLNVSAGLLGFFFVRLWTSAVERIGLLKQPFTRQENTVIQTCVVSAYGIAFSGKRLRRFRLYSDFYCTTFVGLGLLVAAGVLCVLMSTSELNGASGFGSYLFGMSETIAKQATEAKDAQNIKDPHLGWMIGFLFLVSFIGLFALVPLRKIMIVDYKLTYPSGTATAYLINGFHTPEGAKLAKKQVKTLGKYFLFSFFWGFFQWFYTAGDDCGFKNFPTLGLEAYNNRFFFDFSPTYVGVGMICPYIVNVSVLLGGILSWGVMWPLIAKKKGSWYPADISDNSLHGLQAYRVFISIALILGDGLYNFLKVLIRTLAGFISMVQNNSKGMLPVSDNGMSMSTAEEVSFDDERRTEIFLKDQIPKSVAYGGYVVVAALSIGTLPEIFPQLKWYYILVAYIVAPVLAFCNAYGSGLTDWSLASTYGKLAIFVFGAWAGLSHGGVLVGLAACGVMMSIVSTASDLMQDFKTGYLTLASPRSMFISQVIGTGMGCVIAPCVFWLFYKAFSNIGTSGTEYPAPYAIVYRNMAILGVDGFNSLPENCLTLCYIFFAAAIAINLIRDLAPHKVSRFIPLPMAMAIPFYIGSYFAIDMFLGSVILFVWEKLNKAKADAFGPAVASGLICGDGIWTLPQSILALAKVKPPICMKFLSRAANAKVDSFLAG

SEQ ID NO: 12724 - protein, 409 aa, Hortaea acidophila
PGVSQCPIAPGETYTYRFRADQFGSSMYHAHYSAQYTAGVYGAMITYGPTQLDYDIDVGPVIVSDWNHIPYFSIVQNVMTMNMSEYPTYSDSGLINGRGRFDCSKPSYGQSFNDSNWLASNYPSTLQWSCVDDAQRSQFRFQSGKTHRLRLMNVGADGFQRFSIDGHTMTVIALDYVPVQPYTTDSIMLGISQRADVLITADASSTSSFWMRSELLNAATCGGLAPPGINEFPIFAEVYYEDADTTLEPVSTTTVKSTSCNNAPIDITQPEYVIPPSTQPFYQDLVLTMTVNDTGSWEWEINGQTYRADYNNPLLYDAADGQTSFPSDPQYNLYNFASNTSVVLNITNATPFPHPIHMHGHNFYVLNVGGVGAPWDGSTVNPTNPLRRDVQIVPPLGFIAIQFEANNPG

SEQ ID NO: 12725 - protein, 427 aa, Tropheryma whipplei str. Twist
MRHGIVLEDFRAAAKVMHSKFVVHTPVIQSVMLSDLVGSPVYFKCENLQITGSYKIRGVFNYLHNLKKRSTAVVAASAGNHAQSVAYAAKQIGIKAVIFMPSSVSLPKYNATKKYGAEIILDQGDIQTLILKARRYAKKHKFVFIPPFDHRDIVVGQGTIALELLEQVPDLRTVVVPTGGGGLVAGIASAVTLAQNPSGTIFTKSGLEQPAKSGIRVVGVQAKTSASFIESMVAGKPVKVNITSHFADGIAVPKPGKITFELARCFVDRFVEVGDHEIAGAILTLLEDSKIIVEPAAASAAAAVLSKKITNLKGSTVIVLSGGNIDPMTLSQIILRGLSLRSRRLTLRAQLKDVPGQLAEFSRVVAKAEANVVAVNHSRGNYTDDNGRISFGDVFMDIDLETRGHEHSQSIVRALRDSGFVVEVLGL

SEQ ID NO: 12726 - protein, 299 aa, Physcomitrella patens subsp. patens
GPNSNDFGTNRTLHHTIGVSDFSQEARCFQAVTCFQAVINCLDDAHQLVDRAISTCLLGNKPVYISMRCNLAGTEHPSFTHSSIPYAIKEQRSNKTSLEAALDAAVKILNHTVKPVLVGGPKLRLGKAKEAFQELVEASGYAYATMPSAKGQPLESHPHIIGTYWGAVSSPFCLEIVESADAYIFVGKIFNAYSSVGYSSFLKKDHMIVVNPDRVQICGKAEFGCVLMKDFCMELSKRITRNSTSFDNYKRIHVPKGTIPSCGAQDPLRVNVHLKHIQVAFLFVFFHTHEYIHCSDFVT

SEQ ID NO: 12727 - protein, 354 aa, Schizosaccharomyces pombe 972h-
MTIFNGLSESGESKKLNSKIEKQIENASKKDKKIYKVLLLGASDSGKSTISKQIKILNKNGFSQEEIMTFIPVIRRNLLESAKTLVKIIVQKGINLDPLGTHNCEIIEKFNPTPGELINANIGQAITSLWSANSVRSCTYGNDSVLIDSAPYFFSRADEICSRHYVPTIDDILRSRNSTLGISEISFTLDHLQIRMFDVGGQRTERRKWIYCFENVNSIIFCVSLNDYDKKLYERAAPERNRLVESISLFDSIINSQWFMHSSIILFLNKFDLFRKKLEHVPFQDYFPQYEGKNSVKSITRYILWLFVNPSINRAKHNIYPHITTAVDTSNIKVVFSAVKETILQHSLKEAGMF

SEQ ID NO: 12728 - protein, 185 aa, Vibrio parahaemolyticus RIMD 2210633
MINTKIKPFAATAYKNGEFVEVTEQDVLGKWAVFFFYPADFTFVCPTELGDLADHYEELQKRGVEVYSVSTDTHFTHKAWHDSSETIGKIQYYMLGDQTGNITNNFGVMREGQGLADRATFLIDPEGTIQAMEITAEGIGRDAEDLLRKVKAAQYVAAHPGEVCPAKWKEGEETLAPSLDLVGKI

SEQ ID NO: 12729 - protein, 357 aa, Pisum sativum
MAVKEATSETKKRSGYEIITLTSWLLQQEQKGIIDAELTIVLSSISMACKQIASLVQRANISNLTGTQGAVNIQGEDQKKLDVISNEVFSNCLRSSGRTGIIASEEEDVPVAVEESYSGNYIVVFDPLDGSSNLDAAVSTGSIFGIYSPNDESLPDFGDDSDDNTLGTEEQRCIVNVCQPGSNLLAAGYCMYSSSVIFVLTIGKGVFVFTLDPLYGEFVLTQENLQIPKSGKIYSFNEGNYKLWDENLKKYIDDLKEPGPSGKPYSARYIGSLVGDFHRTLLYGGIYGYPRDKKSKNGKLRLLYECAPMSFIVEQAGGKGSDGHQRVLDIQPTEIHQRVPLYIGSTEEVEKVEKYLA

SEQ ID NO: 12730 - protein, 718 aa, Neurospora crassa
MSSNRGFNPESESFEQRPPFYIGQHDVQRHESPTDNQYGQILDSGSHLQEREQWVTERGLTDAQKANPSLPLPTVPTLTDDDTSLFPSSYVGSLIAYASPWIDLCSADPIISDISRQVLNLELAYANFCGSRTIIIPGPRQDDGRAVAQYAQTLSSLLAGDGSSSSNSKETVKTDAAKGTEIDLFSTWDSWHTIRTVCKYSGRLFVALRIPKRVPEKDLQERWFSEPLHYLTLDKKIFSLNKAGHPSLTRHHQDLINRYMRLKNHPWLILINVVKENRKPYAPPYNEYVDYMKYLERHQPPYSAMETPSLVSFQDWLQSPLQPLSDNLESATYEVFEGDPVKYDQYEKAVAEAMLEWKKYNRPVSSVTPETPDGKDLIVAVAGAGRGPLVARVLRAAASTNTPIQLWALEKNQNAYVYLLRRNKREWNNSVTVIKTDMREWEGPRLAANPNIITKLDILVTELLGSFGDNELSPECLDGIQRHIARPHGISIPYSYTAHLSPIAHPRIFADLSNRVVSDPNAFDIPWVTRLFQLAYVAQKVPKHGRFQQAWEFVHPVEVSRADDFSAQNGRARKYVTHGSGSMYGSSGINEHNARHCHLTFVCPTRGVIHGLAGYFESVLYKHQEEGKTPVEISILPDQIDRKSKDMISWFPIFFPLRQPLYFPQDTELEVSMWRQTDDTRVWYEWMVEVYAWVGPKTRIKVGASEMHSSRKVACIFG

SEQ ID NO: 12731 - protein, 123 aa, Brassica napus
GVRALFKVCDGATTVFIQDCWGLDDDSFSLAKAFRRVRFLSLEGCSVLTTGSLKSVVLRWEKLESIRVMSCKNIKASEFSPALSSLFSLLKELTWRPDTRFLFSSRLQGAGIGKKGSKFFKKK

SEQ ID NO: 12732 - protein, 593 aa, Rhodobacter sphaeroides 2.4.1
MRMTTEEAFVKVLQMHGIEHAFGIIGSAMMPVSDLFPKAGITFWDCAHETNAGLMADGFTRSTGKMSMAIAQNGPGVTGFVTPVKTAYWNHTPLLLVTPQAANKTIGQGGFQEMEQMRLFADCVCYQEEVRDASRIPEVLNRVILQAWRNSAPAQINIPRDMWTQVIDVELPQIVAFERPAGGEEAVAEAARLLSGARFPVILSGAGVVLSGAIPDLARLAERLDAPVASNYQHNDSFPGSHPLAVGPLGYNGSKAAMELIARADVVLALGTRLNPFSTLPGYGIDYWPREARIIQVDINADRIGLTKKVTVGIQGDAAKVARAILAQLGEGAGDAGREERRHLVAQTKSRWAQELSSLDHEEDDPGTEWNAGARTRDADLMSPRQAWRAIMQAVPAEAIVSSDIGNNCAIGNAYPSFEAGRKYLAPGLFGPCGYGFPAILGAKIGNPDTPVIGFAGDGAFGISMNEMTACGREDWPAITMVIFRNYQWGAEKRNTTLWYDNNFVGTELDRDTSYAAIARACGAHGVQVRSQSELTAALHEAVERQMKARETTFIEVLLNQELGEPFRRDAMKKPVVVAGIDPADMRPQKGAA

SEQ ID NO: 12733 - protein, 327 aa, Agrobacterium tumefaciens str. C58
MQREKIVVIGAGAFGTALAVVIALENRHDVTLLGRDPSLMADLRNERVHEAALPGVELPDALGFSAEPDVLAGASIVLFAMPSQAHADAAQHYGPYLASDSIIVTCAKGIDRNSGRLLTELLETELPHHPIAVLSGPGFAADIARGLPTAMAIAAEDATVAERLATTISGKTFRLYASTDRIGVQLGGALKNVLAIAAGIVEGAGLGDSARAALISRGLAEMSRLIVAMGGKADTVRGLSGLGDLVLTATSHQSRNLRFGIALGRGEGKDMSGGLVEGAFAAAVAARLGEHHAIDMPVTEAVAAIIDGNLDVASAMQQLMTRPITTE

SEQ ID NO: 12734 - protein, 332 aa, Rhodobacter sphaeroides 2.4.1
MKPLERILATARAHPRHILLPEGEDPRVAQAARRLTEEGLARVSLMNGPEIAGVTRICPAEASDLPELADRWHLMRAAKGMTGAQALIEMRDPIRQAAMRVRMGLADGTVAGAVATTADTVRAALQIIGRAEGAPLVSSFFLMLACEGGAPIRGGMIFADCGLVVDPDAEGLAAIARASAESSRTLLGEEPRVALLSFSTAGSADHPSLGKIREALRLIRATDPTLEVDGEIQFDAALDEAIRARKAPGSRLTGRPNVFIFPDLASGNIGYKIAQRLGGLGAVGPILQGLARPANDLSRGCTVEDIVHAAAITAVQAAPDPAAAPEGLAAAR

SEQ ID NO: 12735 - protein, 285 aa, Mycobacterium avium 104
MPARTALSPGELSPTLPVPARIPRPEYVGKPTAREGSEPWVQTPEVIEKMRVAGRIAAGALVEAGKAVAPGVTTDELDRIAHEYMIDHGAYPSTLGYKGYPKSCCTSLNEVICHGIPDSTVIEDGDIVNIDVTAYIDGVHGDTNATFLAGDVAEEHRLLVERTREATMRAINAVKPGRALSVIGRVIESYANRFGYNVVRDFTGHGIGTTFHNGLVVLHYDQPSVSTIMQPGMTFTIEPMINLGGLDYEIWDDGWTVVTKDRKWTAQFEHTLLVTDTGVEILTLP

SEQ ID NO: 12736 - protein, 339 aa, Desulfotalea psychrophila LSv54
MVIRKKVLVTGAAGFIGARLSGQLLAAGAEVVGLDNLNDYYDPQLKRDRMQTQAVGEGFTHLQLDIADRGAMEKLFSDHSFDAVVNLAAQAGVRYSLKNPHSYVDSNIVGFVNLLEGCRHSGVKHFVYASSSSVYGANTNMPFSVHDNVDHPVSLYAASKKANELMAHAYSHLYGLPTTGLRFFTVYGPWGRPDMAPFLFTKAILEGRAIDVFNNGDMERDFTYIDDIVEGVCRVIEKQPEANPDWSGQNPDPATSYCPYRVYNIGNNNKEKLLYFIELIEEALGKKAIKNFMPMQPGDVRATYANVDDLVRDFAYKPATSLRHGVQQFVAWFRDYYHL

SEQ ID NO: 12737 - protein, 480 aa, Triticum aestivum
  misc_feature (77)..(77): Xaa can be any naturally occurring amino acid
MVKICCIGAGYVGGPTMAVIAIKCPAIEVVVVDISKPRIDAWNSDTLPIYEPGLDDVVKACRGKNLFFSTDVEKHVXRADIIFVSVNTPTKTRGLGAGKAADLTYWESAARMIADVSKSDKIVVEKSTVPVKTAEAIEKILTHNSKGINYQILSNPEFLAEGTAIEDLFKPDRVLIGGRETPGGQKAVQALKEVYAHWVPEANIITTNLWSAELSKLAANAFLAQRISSVNAMSALCEATGANVSEVSYAIGKDSRIGPKFLNASVGFGGSCFQKDILNLVYICECNGLPEVANYWKQVIKINDYQKSRFVNRVVSSMFNTVSGKKIAVLGFAFKKDTGDTRETPAIDVCKGLVGDKAQVSIYDPQVTEEQIQRDLAMNKFDWDHPMHLQPTSPTAVKQVSVVWDAYEACKGAHGVCILTEWDEFKKLDYQKIFDNMQKPAFVFDGRNVVDAEKLREMGFIVYSIGKPLDGWLKDMPAVA

SEQ ID NO: 12738 - protein, 498 aa, Rhodobacter sphaeroides 2.4.1
MTLLTTEDYKAIAAGLTLPTGAFIDGRFRPAQSGATFETRNPATGQLLAEVAACGPADVDLAVQKARDAFEDGRWSRLPPRARKEVLIRLAKLLKRHARELAVMESLDSGKTIYDCETVDLPETIHCLTWHAELIDKIYDQTAPASDDHLALVLREPVGVVGLVLPWNFPLLMLAWKIGPALAAGCSVIVKPAEETPLTALRVAELATEAGVPPGVFNVLPGHGPEVGEPIGRHMDIDAVSFTGSTETGRRFLRYAAESNLKEVTLEMGGKNPAVVLDDAENLDRVAAHVVTGAFWNMGENCSAASRLIVQSGVKEALIARILAHAREWPMGDPLDPANRVGALVSPAHLDKVRSYLAEGPTVLLGGKAHGAFVEPTILEITDREAAPAREEIFGPVLSVLTVESFDEAIALANDTPYGLAASIFTANVKKALRGARALRAGTVTVNSFGEGDITTPFGGFRQSGFGGRDNGIHAHDQYTQLKTIWIDLADDAAEAVS

SEQ ID NO: 12739 - protein, 384 aa, Debaryomyces hansenii CBS767
MSSSSQTKPVDTSPIIKKHNEKYHNSYLAMVERNQIPLSRALLCGIHLFNYIFPGGFASKFIRLQHRTGTSYSGSALYDIGIDDGYYIVHWVILLTFLRSFLMQWCFEPFASYFCNIHSRKAKVRFSEQSWSFVYYSFSFTYGAYLYYNSSYWLNFDQIFANWPHYQLGSLFKKYYLISMGFWLQQIFVLNIEERRKDHFQMFSHHIITCLLLTGSYYYYYNRIGHLILMIMDSVDIFLAAAKLLKYSGYNNACDYMFVFFMVSWVVLRHGLYNYLFYQSWHNASSLMSNSECIPGQFQKRCWTPTILNSFFFLLGGLQVITMIWMYLISKVAYKVILGKGAEDVRSDEDDLDYEEDSNIAPDGHHSSNKRRDYPNIGSDINIK

SEQ ID NO: 12740 - protein, 130 aa, Oryza sativa
MVVRAGAECKDRLFPKQVSDYTLKLLHRRIPPAVPGIMFLSGGQSEVEATQNLNAMNQVPNPWHVSFSYARALQNTCLKTWGGQPENVKAAQDALLLRAKANSLAQLGKYTSDGEAAEAKEGMFVKNYVY

SEQ ID NO: 12741 - protein, 461 aa, Microcystis aeruginosa PCC 7806
MKIIPKVKAPTFVQMAQWIINPVAFMENAARKHGDIFSTKVGLTVDNFIFVSSPSALQQVLTNDRKKFSAPGEANRIIAPIIGDYSVIMLDGDIHKKRRQLLLPPFHGERMRFYGDLIRDITLRVMAELPENQPFKTRSATTAIALQVIMEAVFGISQGERYQTLKKILAEMLDIFNSPVMVSLLFFPILQADLGAWSPWGKYQRYQAKIDDIIYTEIAERKANPNPNRSDILSLLMSARDEEGNPMSDKELRDELMTLLFAGHETTATAISWVLYWTHRYPEIKAKILKEIATLGDNPNPIDITRLPYLSAVCSETLRIHPVGMLTFPRVVEEPVELDGYPLEKGTIIMGCIYLAHHREQTFPDSHTFKPERFLEKQFTPYEYMPFGGGARRCIGEVLAIYEMKIAIATILANYQLTLVNNTPEKPSRRGVTLAPSRGVPMVLKGRREPLVTAPMLAEIS

SEQ ID NO: 12742 - protein, 334 aa, Chlamydomonas reinhardtii
MSGDNDTQLIQAKMATLGLDQTPEEFVAGLAPPVRRRVEALQELQAKHDELEAQFRKERAELEAKYEKLYAPLYVERSEIVVGSKEVPPKEGEPTGDDAIKGIPEFWLAVLLKCEVTMDMIKDKDMDVLKYLRDIQAEGLVVDGVSHGFKLRFLFDSNPYFTNEVLEKTYHMLPEDDGVLERAEGTKIEWNAGKDVTVKIMKKKPKKGGKGDSKPQVKTERVDSFFNFFDPPQVPDGEEEIDEDTMEELQAIIEADYEVGATIREKLIPEAVSWYTGEAMDEDGLYMPGDDDEDDEDFEGEEGEEDEDEDEEGAGAGEGQAAGGQAQPPECKQQ

SEQ ID NO: 12743 - protein, 664 aa, Triticum aestivum
MDRHHHQQQQQPPSPQGDHAAQPRCWEEFLHRKTIRVLLVETDDSTRQVVTALLRHCMYQVIPAENGHQAWAYLQDMQSNIDLVLTEVFMHGGLSGIDLLGRIMNHEVCKDIPVIMMSSHNSMGTVLSCLSNGAADFLAKPIRKNELKNLWAHVWRRSHSSSGSGSGSAIQTQKCTKSKSADDSNNNSNNRNDDASMGLNARDGSDNGSGTQSSWTKRAVEIDSPQDMSPDQSVDPPDSTCAHVSHLKSEICSNRLRGTDNKKCQKPKETNGDEFKGKELEIGAPGNLNTDDQSSPNESSVKPTDNGRCEYLPQNNSNDTVMENSDEPIVRAADLIGSMAKNMDAQQAARAIDAPNCSSQVPEGKDADRENAMPYLELSLKRSRSTTEGADAIQEEQRNVVRRSDLSAFTRYNTCSFSNQGGAGFVGSCSPNGNSSKAAKTDAAQMKQGSNGSSNNNDMGSTTKSVMTKPGGNNKVSPINGNTHTSAFHRVQPWTPATATGKDKVDDVSKKNAAAAAAAAAKDNGGEAQSKHPCAAAHDANGGSAGGAQSNVINPSGPVEGHAANYGSNSGSNNNTNNGGSTAATAAAAAAVHGETGGIDKRSNMMHMKRERRVAAVNKFREKRKERNFGKKVRYQSRKRLAEQRPRVRGQFVRQPPPPAAVER

SEQ ID NO: 12744 - protein, 872 aa, Frankia sp. CcI3
MRRVRAGSSGGARWLGAESGAHRRDSADCRSSGKVGSPPVHTGKRRPPLSAPVKAATGGNRSQTFGPGVRPTDEGVAGGFVDIATICPLETWTGGAVGEPILAIDYGTCSASAALAVDGRIEPVKEPASGSASWPASVFVDGGSLIVGTLAERRKRIWPAAYRGEVKRDLARDSAVSLDGRSYPAHVLVTAVLSALKAEAEQQLGGAALSRAVVTIPASYDPAGPLRRTMIAAAEAAGFVDVDLLAEPVAAAWSPVVGVAPEPGSLMLVYDLGGGTFEGALVAVGEDGRHEMLSHSALHDCGGRELDQILFDEILGLYGPGLEPLLNPPGIGETFQTTANRTRHELLDFARAVKHQLSDIAVVEDVFSPAGLLVSMQRDRFAQLASPILARTMACCQHLLKSSGYGPDKLSGVLLVGGSSRIPVVTDILEGRLGVGTDWPGQQIYLPADPELAVVLGAAAWASSVSTRRTTAARPNPVLQPARWDIPGGRATMVRWLVEPGERFDASAVLARVRLTDGSLFDLAAEAPGSLIHTHAAPGTPVRDADWLATTLPSGPVPMGSAVPADLRGFERSSRPSHHVEVTARATLKGHERDVTSAAFSPDGKLLATTSKDGTRLWDVATGRTSVTLSGRKSLVVHGCAFSSDGKLLATTGSDKTARIWDVDAARQTVTLTGHRGPVYGCAFSPDGSLLATTSTDRTVRLWGSSTGKNLATLNGHRGSVYGCAFSPDGRLLVTAGAESTLLWNVTVGEIIMSLPGHTNFAGGCAFSPDGRLLATSGNEGTRLTDASSGTTVLTLPGSAQSCAFSPDGHLLATASTDDTAQLWDVATGSAIATLTGHSSTVMSCAFAPYGLLLATTSTDMTARLWDIIYTP

SEQ ID NO: 12745 - protein, 465 aa, Dehalococcoides ethenogenes 195
MAKAGLNRMDMPKQAVSDRIQNFSEVATGYTPADAHTEAARCLQCKKRYCVEGCPVNIDIPEFILALRDGNMPEAARVLKKTNSLPGVCGRVCPQETQCEQACILNKKEAPIAIGRLERFVADWERGHSAEVNLPKSLKPKSGKKAAVVGAGPAGLTAAAELARLGHDVTLFESLHTAGGVLMYGIPEFRLPKDIVQGEIEYVKSLGVTLELNSVAGRLFSLEDLFKQGFQAVFLATGAGLPLFLNVQGENLSGVYSANEFLTRVNLMKAHNFPSSDTPVKKGRKVAVIGGGNVAMDAARCALRLGAEEVSIVYRRSELELPARKEEVDNAREEGIKFHFLTSPVRFLANEQGQVRAMECQKMALGEPDASGRRRPIPVGGSEFEMDIDLAVIALGTRPNPLVMQSAPDLQVNSNGTVLADINGQTSHRAVWAGGDIVTGSDTVISAMGAAKRSAVVIDEYLRSL

SEQ ID NO: 12746 - protein, 432 aa, Triticum aestivum
MDRHHHQQQQQPPSPQGDHAAQPRCWEEFLHRKTIRVLLVETDDSTRQVVTALLRHCMYQVIPAENGHQAWAYLQDMQSNIDLVLTEVFMHGGLSGIDLLGRIMNHEVCKDIPVIMMSSHNSMGTVLSCLSNGAADFLAKPIRKNELKNLWAHVWRRSHSSSGSGSGSAIQTQKCTKSKSADDSNNNSNNRNDDASMGLNARDGSDNGSGTQSSWTKRAVEIDSPQDMSPDQSVDPPDSTCAHVSHLKSEICSNRLRGTDNKKCQKPKETNGDEFKGKELEIGAPGNLNTDDQSSPNESSVKPTDNGRCEYLPQNNSNDTVMENSDEPIVRAADLIGSMAKNMDAQQAARAIDAPNCSSQVPEGKDADRENAMPYLELSLKRSRSTTEGADAIQEEQRNVVRRSDLSAFTRYNTCSFSNQGGAGFVGSCSPT

SEQ ID NO: 12747 - protein, 664 aa, Triticum aestivum
MDRHHHQQQQQPPSPQGDHAAQPRCWEEFLHRKTIRVLLVETDDSTRQVVTALLRHCMYQVIPAENGHQAWAYLQDMQSNIDLVLTEVFMHGGLSGIDLLGRIMNHEVCKDIPVIMMSSHDSMGTVLSCLSNGAADFLAKPIRKNELKNLWAHVWRRSHSSSGSGSGSAIQTQKCTKSKSADDSNNNSNNRNDDASMGLNARDGSDNGSGTQSSWTKRAVEIDSPQDMSPDQSVDPPDSTCAHVSHLKSEICSNRLRGTDNKKCQKPKETNGDEFKGKELEIGAPGNLNTDDQSSPNESSVKPTDNGRCEYLPQNNSNDTVMENSDEPIVRAADLIGSMAKNMDAQQAARAIDAPNCSSQVPEGKDADRENAMPYLELSLKRSRSTTEGADAIQEEQRNVVRRSDLSAFTRYNTCSFSNQGGAGFVGSCSPNGNSSKAAKTDAAQMKQGSNGSSNNNDMGSTTKSVMTKPGGNNKVSPINGNTHTSAFHRVQPWTPATATGKDKVDDVSKKNAAAAAAAAAKDNGGEAQSKHPCAAAHDANGGSAGGAQSNVINPSGPVEGHAANYGSNSGSNNNTNNGGSTAATAAAAAAVHGETGGIDKRSNMMHMKRERRVAAVNKFREKRKERNFGKKVRYQSRKRLAEQRPRVRGQFVRQPPPPAAVER

SEQ ID NO: 12748 - protein, 215 aa, Tropheryma whipplei str. Twist
MRHIPDALNALRAGRPVVVLDDKNRENEADVIMAAQFATQEWVAWIIRHTSGFLCVPLSNQRADKLQLPSMVAANEDRFKTAYTISVDAADAAITTGISAADRSLTIRTLAARDSSAKHLVRPGHILPLRARDGGLLERRGHTEAAIELMRQAQLEPVAVIAELVSDTGELLRGRALDEFIRKNNLVLVEISQIIEYMKMSDLKDISMNLNRDCL

SEQ ID NO: 12749 - protein, 179 aa, Physcomitrella patens subsp. patens
MASAVVSVSIVAAASPAAVCRESSSVKQFSGLKSTTLFASKARRLSSVHNGSRVQCMQVWNPIGQPKFETFSYLPPLTDDQIAKQVDFMIQQNLIPCIEFDTVGSVSRTNFSGPGSSGYYDGRYWTMWKLPMFGCTDSAQVLREIQECKQSFPSCWVRVLGFDSKKQVQICGFLVARPN

SEQ ID NO: 12750 - protein, 578 aa, Dichelobacter nodosus VCS1703A
MQTQQKGIAAAPGIAIGTIWRYIPTTPKIQTQKIAPAEIEEHLQHFLAAQAQVDQYLQRLYHSTLQTTGADDAEIFASHLELLHDEEFEKDIADLIRQQESATFAVKHYLDEAAARMAALDDEYLQARAADFIDLQKNLLQALNHQPLISLINAPKNCIIVAEDLTPSETAQLNPAHVRGFALRFGGRASHAAILARNLGIPAVMGLEHLSAAKDETTAILDGSQGLFIIDPDESTLNTFKNEIINTENTAKEYNELRDLPAVSQDGIDIHLFTNIGSTADLHLVDDYGSEGIGLFRSEFLFMSTTAEPSEEVQYHAYRQVVEHLAPKPVILRLLDIGGDKPLPYFNFPQEENPFLGWRGVRIYTEMRDLFETQIRAALRASAFGNLHIMVPMVNDISEMRFVRETVAQQAEILQSQGIACNPQLPVGAMIETPAAALITAQLSTVCDFFSIGSNDLTQYTLAIDRGNSKIATQYDGLHPAVLRLIAHAVDAAQVTGRTIGICGEMGGQIEAVPLLFAMGFDELSISGAGLPAVKQLIRRLNYRHCRELLARALNAASADAVRELVRPLLTTSKDHSS

SEQ ID NO: 12751 - protein, 211 aa, Tropheryma whipplei str. Twist
MMGNMDKGLDSQKQETARSCRFEVETNLPTKFGTLRVRGYRDIKNNEHIALITKQIKSEDVLLRIHSECITGEVFMSLKCDCHGQLHKALERISAEGGLVIYMRGHEGRGIGILNKLRAYRLQEQGLDTFDSNVKLGLPVDARDYGPAAEILHDLGVRSVRLLSNNPDKQLQLEQSGIRVTGVLPWQVGLGKCNHEYLKVKRDKMGHKIEL

SEQ ID NO: 12752 - protein, 306 aa, Dichelobacter nodosus VCS1703A
MRKIYLAGGDSRSVAAYFHALTGAVSVVCGYANSALPAPSYQQVCSGKTGAVKAVALTYQPHILSLSAVFLHFFRLLEPILFQYQPHHQRHGIYSVFSEERDLARAAVTALQKRHLNPITIEIAALDNFFAAENAPLSTLEPPRQANEPFSAEERQLLYAFWQKPKLAELKKILSEEEFAITQEQSTEAPFSHCYDQLFAAGIYVDLLSGEPLFCSNDKYDAGCGWPSFSQPLTEEALTYHADFKGGQKRIEVRSAVSDNHLGHVFFDEPSPSGKRYCINGTSLRFIPWSKMDAAGYGDLKIKVKK

SEQ ID NO: 12753 - protein, 156 aa, Tropheryma whipplei str. Twist
MGKDRNLSLNSPESIQSVIGDTDIKIAVIAAMWHEKIVRGLIDGATREIVSSGSHAELFRVPGSVELVLACKKLLKTFDAAVALGVILRGETDHNTHIARLVLSGITDVMLALEKPIGIGVLTIDTEQQGLDRSSGDYNAGVNAARAVIRMVRLFR

SEQ ID NO: 12754 - protein, 476 aa, Leuconostoc mesenteroides subsp. mesenteroides ATCC 8293
MSESKTRTGWLHKATPASFTTSDRHLRKTLGVKEMLALGIGTIVSTAIFTLPGIVAANHAGPAVAISFVIAAIVSGLAAFAYAEFASALPFAGSAYSWANVVFGEVFGWIAGWALLAEYFIAVAFVASGWSANFKLFLGSHNLVLPKALAGSFAAGNGGVIDIASLFAVLIVAVLLWRGTNTTARVENVLVVGKVLVILIFIGVGLTAIHPGNYVPFIPAHKAGTDFGGWSGIFAGASQIFLAYIGFDSIAASSAEAKDPKKTMPRGIIGSLIVATILFVTVALVLVGMFHYTEYKDNAAPAAWALLHSGHEFTSNLLSVVALIGMFTAIIGMMLAGSRLLYAFGRDGLLPSFLGKVNDKGLPNNALLVLSVIAILIGSVFSFTELAGLISAGTLIAFIIVSLGIYALRPREGKDIQEPGFKMPFYPVMPALAALGSGFIFYELDNQAKIYAFGWFVVGIIIYAVYGSKHSKLSQK

SEQ ID NO: 12755 - protein, 634 aa, Bacillus clausii KSM-K16
MRMPQNSDTTSKKSPFVLYASATGMTLFVLWGIVNPSHLGATAETALAWIIDNFGWFYMTIASIFILFGFIVAVTPFGKLRLGKDNDVPEHSFISWVGMLFAAGLGVGFVFFGVAEPILYYMDPPPGYSFHLPEESANAAAIGLRYGVFHWGLHAWGAFSVVGLTLAFVQYRKNRPALISSAFYPILGSKTDGWMGKTIDLLAVISTCAGVATTFGLSALQISGGISFLTPLSNSIPLQLAIIAVITCLFLFSAVAGINKGIKRLTNLNLVLAGILLLFVLFAGPTITLLESMVTTLGGYLSNVVSMSLTMTPFSNDEWLGSNTIFFWAWHMSWSPFVGLFIARISKGRTIREFIAGVLLVPTLMAVVWFCVFGGTALHIEISGLFPLAEIAQSEVELTLFYMLQNLPFTTISSILAVIVVGIFFVTSADSAAFVLGSMTSNGMLNPSFKLKMLWGVLIAGTASVLLISGDGGLDALQTAALTAALPFAIILVFMLFSIGMMIARDWRTEQRKARLAHDKALKQRLKEEAYEELRQDLSQEWRDELRRELLAAGRNTAEMLHFQTTEDTAIVGKTLAEVGFPPHVNVSAIERGDDVISPSGSTEIKAGDYLYILVEIQQKEALQAILRQTKSGK

SEQ ID NO: 12756 - protein, 200 aa, Dehalococcoides sp. VS
MTIILKTEKEIAIMRRAGHILAAALEEVKKNVRPGVTTRELDEIAERELRRRGTTPSFKGYQGFPASLCASVNDEIVHGIPGGRVLKEGDIISLDIGNILEGFQADMAVTVGVGEISPAATRLLSATQASLVAGIAQARAGGHLGDIGAVVEEYAQGRGYGVVREYTGHGIGRDMHEDPQIPNFGRRGKGPELKKGMTWL

SEQ ID NO: 12757 - protein, 444 aa, Leuconostoc mesenteroides subsp. mesenteroides ATCC 8293
MSKNKEILEEEKIHLANATRVKYFDIVIDHGKGAIITDADGHEYIDLLASASATNTGHSHPKVVEAITSQAQKLIQYTPAYFANTVTAKLADRLVNVAPGNFQKQVAFGNSGSDANDAIIKFARGYTGRQYVVSFTGAYHGSTYGSLSISGVSLNMTRKIGPLLPNTVKVPFPDQTQRIAGESDNDFSERLFKQFKLPFETYLPADEVALVIIEPIQGDGGIIKAPQHYVELVYEFTREHGIVFAVDEVNQGLGRTGKMWSIDHFGIAPDLMSVGKSIASGLPLSAVIGRKEIMDSLQAPANVYTTAGNPVTAAAALATLDVIEEENLVARSRQLGELAKAFFESAAKRYAFIGDVRLYGLNGGIDIINDHGEPDNEATNKLIYRIFELGAIMISLRGNTLRFQPPLVIQEEELQRAFEILEKAFSDLASGKIALPKTDNHIGW

SEQ ID NO: 12758 - protein, 420 aa, Candidatus Protochlamydia amoebophila UWE25
MNFLKSGSLMVKRNVHLTKLQSGYLFPEINRRKNEFLKKHPSAQLINLGIGDTTQPIPLYISEAMQNFAKQLASEKTYRGYGTEQGSILLREAIAEQYYQGKIDPQEVFVSDGSKCDVGRLQILFGSDATIAVQNPTYPAYVDTGVINGQASFFQTSTKQYQRITYMSCLPENNFFPDLANLPKTDLIYFCSPNNPTGSAATNEQLRELVQFAKKRQSIIIFDAAYASFVRSSHIPRSIYEIEGAKEVAIEVGSFSKMIGFTGVRLGWSVVPKQLRFEDGHSVQQDWERIVCTFFNGASNIAQAGGLAALQKEGLQAIDELSSYYMKNSNILKKAFEECGYKVYGGENVPYLWVHFPQLTSWEAFEILLKQSQLVSVPGSGFGSAGEGFLRFSAFGKQSDITVALPRIKHALLKIKPTVY

SEQ ID NO: 12759 - protein, 172 aa, Dehalococcoides sp. VS
MLAKVERIDPSELELNDKLIFINRVTKVVKGGKRMGFAALVVTGDGKNHVGIGVGKAKEVPSAISKASANAKRNLSRILLNGTTVPHEIVFKYGAAQVLLKPAAPGTGIIAGGSVRAVLESTGIKDILTKSMGCGNKANVAKATLGGLTAMRDPKTTVTKRRSSLKEEAAGG

SEQ ID NO: 12760 - protein, 319 aa, Zea mays
  misc_feature (302)..(302): Xaa can be any naturally occurring amino acid
MPGLVPSTSTSHLFCRSLAAARTLSAAAGHSSSSTSSSSVKMARSALDEVTDTGAFDRTPSTFRSFVSRDASARFPAVAGRYHLYVSYACPWASRCLAYLKLKGLDHAISFSSVKPIFERTRESDDHLGWVFPASAGEVPGADPDPFNGAKSVRDLYEIASTNYTGKPTVPVLWDKQLKTVVNNESSEIIRMLNSEFNGIAENPGLDLNPAHLQASIDEVNGLVYDAINNGVYKCGFAKKQGPYDEAVTTLYEALDKCEEILGKQRYMCGNQLTEADVRLFVTLIRFDEVYAVHFKCNKKLXLREYPNLFHYTKDMYQI

SEQ ID NO: 12761 - protein, 293 aa, Glycine max
MHIQFFNICKKFVCCSHHNIWRQAEIPVKTFHYYHPDTKGLDFAALLNDVKNAPDCSFFLLHPCAHNPTGVDPTEEQWREISYQFQVKNHFPFFDMAYQGFSSGDLDKDAIALRIFLEDGHLIGCAQSFAKNMGLSEHKAGCLSVLCQSIKQVAALKSQLQLMSHAMYSSIPFQGISLVTMILSEPDTEALWRKEIKVMAKRIQTMRTTLRHCLENLHSSFNWEHITDQVGMFCFSGLTPDQVQQMEKLFHIYMTPDGRMSMSGVTSSNVDYLANAIHQVTRIDEEALRSCYV

SEQ ID NO: 12762 - protein, 363 aa, Linum usitatissimum
IQMGLAENQVSFDLLEDYLEKHPEASSTTHNFKENALYQDYHGLKSFRQAMASFMSQIRGGRATFDPDRIVLTAGATAANELLTFILANPGDALLVPTPYYPGFDRDLRWRTGVKIVPIHCDSSTNFQVTKEALQSAYNEAVSMGLKVRAVLITNPSNPLGATVQRVVLEDILDFSVEKNIHLVSDEIYSGSTFSPDEFVSIAEVLNDRGSIQSESERVHIVYSLSKDLGLPGFRVGTIYSYNDAVVTTARRMSSFTLISSQTQHLLACMLSNAEFTENYISKNRERLRRRYEMIIAGLRRAGIECLEGNAGLFCWMNLGPVLVDPTREAELSLWKLILKDVRLNISPGSSCHCSEPGWFRVC

SEQ ID NO: 12763 - protein, 322 aa, Saccharum arundinaceum
MAPALSFPIIDMGLLGGEERPAAMELLRDACENWGFFEILNHGISTELMDEVEKLTKDHYKRVREQRFLEFASKTLKDAEGVKAENLDWESTFFVRHLPESNIAEIPDLDDEYRRVMKRFAGELEALAERLLDLLCENLGLDKGYLARAFRGPSKGTPTFGTKVSSYPPCPRPDLVNGLRAHTDAGGIILLFQDDRVGGLQLLKDGEWVDVPPMRHSIVVNLGDQLEVITNGRYKSVMHRVVAQPDGNRMSIASFYNPGSDAVIFPAPELVKVEEAAAETYPRFVFEDYMKLYVRHKFEAKEPRFEAFKSMETSSSNCIAIA

SEQ ID NO: 12764 - protein, 363 aa, Linum usitatissimum
IQMGLAENQVSFDLLEDYLEKHPEASSTTHNFKENALYQDYHGLKSFRQAMASFMSQIRGGRATFDPDRIVLTAGATAANELLTFILANPGDALLVPTPYYPGFDRDLRWRTGVKIVPIHCDSSTNFQVTKEALQSAYNEAVSMGLKVRAVLITNPSNPLGATVQRVVLEDILDFSVEKNIHLVSDEIYSGSTFSPDEFVSIAEVLNDRGSIQSESERVHIVYSLSKDLGLPGFRVGTIYSYNDAVVTTARRMSSFTLISSQTQHLLACMLSSAEFTENYISKNRERLRRRYEMIIAGLRRAGIECLEGNAGLFCWMNLGPVLVDPTREAELSLWKLILKDVRLNISPGSSCHCSEPGWFRVC

SEQ ID NO: 12765 - protein, 261 aa, Solanum tuberosum
MAAGRWNLEGCTALVTGGSRGIGYGIVEELASLGASVYTCSRNQKELNECLTQWRSKGFKVEASVCDLSSRSEREEFIKNVANHFDGKLNILVNNAGIVIYKEAKDYTMEDYSLIMSINFEAAYHLSVLAHPLLKASQRGNVVFISSISGASALPYEAVYGATKGAMDQLTRCLAFEWAKDNIRVNGVAPGVIASSMVEMTIQDPEQKENLDKLIDRCALHRMGEPKELAAVVAFLCFPAASYVTGQIIYVDGGFMANGGF

SEQ ID NO: 12766 - protein, 345 aa, Debaryomyces hansenii CBS767
MSADFWSSSQRNRWQLTRHSLLESRRKLLLLEKKMIQNGFIKDYPNVEYDANTRIYLHNLLIKLGRRLNVRQIALATAEIYMSRFLIKVLLKEINVYLLVTTCLYAACKIEECPQHIRLITSEARNLWPEYIPQDVTKLAEFEFYLIEEMDLFLVLHHPYRSLLQIRDYLNENFALYGFSLSDDELQNSWSLINDSYITDLHLLLPPHIIAIATIYITIVLKKNISSLRLGANSMSNDTVGMDPHTKPNSNSIHAEDLMALATGGSAINDIGNPSSGTNGFHDIELDENTIKINKFMTFLDHSHVNLNEVVEAIQDIITLYAIWNRYNEMSVKKVLQDMLLNRSV

SEQ ID NO: 12767 - protein, 587 aa, Synechococcus sp. WH 7805
MSQAYQPLHHKYRPQRLDQLVGQEAIAATLGHALRSGRIAPAYLFSGPRGTGKTSSARILARSLNCLNSEGPTPEPCGHCELCTTIAAGTALDVIEIDAASNTGVDNIRDLIERSRFAPVQARWKVYVVDECHMLSTAAFNALLKTLEEPPPQVVFVLATTDPQRVLPTILSRCQRFDFRRIPLEALERHLTWIAEQETIPIQPEALHVVAQRAQGGLRDAESLLDQLSLLPGPIQADAVWDLLGAVPEQELLALVTAMSSGEPVALLEATRTLLDRGRDAGSVLQGLAGILRDLVLMAAAPDRPELTSVSPQFRDQLPELAKAIGRSRLLQWQSQLRGTEQQLRQSVQPRLWLEVLLLGLLSEPTAPQATVPTSRQPPRPSPATADPTPPAPAQASTPAPISLPDTSTPAAEPAVAASPSPPQDLKELWQQILAGLELPSTRMLLSQQAELVRLDNHRAVVQVAGNWMGMVQSRVALLEQAIARAVGGSRQLVLESHGGAAPMAATPAPAPTPTPVPVPVPAITSSEAQLPPRPVAAPPTPTSAPAPKPESDPPPAQRQEPSVLDDKAKRLADFFNGQVLNVDLET

SEQ ID NO: 12768 - protein, 139 aa, Pinus pinaster
MSGKGAKGLLMGKSSAPVNNNNNKDKDKKKPVSRSSRAGLQFPVGRIHRLLKSRISANGRVGATAAVYSAAILEYLTAEVLELAGNASKDLKVKRITPRHLQLAIRGDEELDTLIKGTIAVGGVVFHIHKSLINKSSKD

SEQ ID NO: 12769 - protein, 216 aa, Zea mays
MAEVEAPATAVEAPAAAVATTTPEVAAPEAGAATEAKGPHKLHRQWTFWYDIQTKTKSGAAWGTSLKKAYTFDTVEEFWSMYDQIFRPSKLSGNADFHLFKAGVEPKWEDPECANGGKWTVPCNRKATFETMWLETLMALIGEQFDETEDICGIVASVRARGDKLALWTRTASNEAVQVNIGKKWKDVIDYNDKITYTFHDDSKRDKPSRGGRYTV

SEQ ID NO: 12770 - protein, 594 aa, Spinacia oleracea
MASLPVNKIIPSSTTLLSSSNNNRRRNNSSIRCQKAVSPAAETAAVSPSVDAARLEPRVEERDGFWVLKEEFRSGINPAEKVKIEKDPMKLFIEDGISDLATLSMEEVDKSKHNKDDIDVRLKWLGLFHRRKHHYGRFMMRLKLPNGVTTSEQTRYLASVIKKYGKDGCADVTTRQNWQIRGVVLPDVPEIIKGLESVGLTSLQSGMDNVRNPVGNPLAGIDPHEIVDTRPFTNLISQFVTANSRGNLSITNLPRKWNPCVIGSHDLYEHPHINDLAYMPATKNGKFGFNLLVGGFFSIKRCEEAIPLDAWVSAEDVVPVCKAMLEAFRDLGFRGNRQKCRMMWLIDELGMEAFRGEVEKRMPEQVLERASSEELVQKDWERREYLGVHPQKQQGLSFVGLHIPVGRLQADEMEELARIADVYGSGELRLTVEQNIIIPNVENSKIDSLLNEPLLKERYSPEPPILMKGLVACTGSQFCGQAIIETKARALKVTEEVQRLVSVTRPVRMHWTGCPNSCGQVQVADIGFMGCMTRDENGKPCEGADVFVGGRIGSDSHLGDIYKKAVPCKDLVPVVAEILINQFGAVPREREEAE

SEQ ID NO: 12771 - protein, 535 aa, Pseudomonas syringae pv. syringae B728a
MTILQTRINTRSPEFTLNRDALLKQVEALRSLLSNVQQGGGPKAQERHTSRGKLLPRERINRLLDTGSPFLEIGQLAAHEVYGEEVPAAGVIAGIGRVEGVECMIIANDATVKGGSYYPLTVKKHLRAQTIAQQNRLPCIYLVDSGGANLPRQDEVFPDREHFGRIFFNQANMSAQGIAQIAVVMGSCTAGGAYVPAMADEAIMVRQQATIFLAGPPLVKAATGEVVSAEELGGADVHCRTSGVADHYADNDDHALALARRSIANLNWRKQGQLNTVAPIAPLYPGDDLYGIIPTDTKQPFDVREIIARLVDGSVLDEFKALFGTTLVCGFARLHGYPIAILANNGILFAEAAQKGAHFIELACQRGIPLLFLQNITGFMVGQKYEAGGIAKHGAKLVTAVACARVPKFTVIIGGSFGAGNYGMCGRAYDPRFLWMWPNARIGVMGGEQAAGVLVQVKCEQAERAGQAFSAEQQAELKQPILDQYEHQGHPYYSSARLWDDGVIDPAQTRDILALALSASLNAPIEPTTFGLFRM

SEQ ID NO: 12772 - protein, 339 aa, Glycine max
MLHEECSKSNSFIECGHLQSRGRMADGSSTPATPSAKVSAIFIYPIKSCRAISVSRAPLTPTGFRWDRQWMVVNSQGRMYTQRVEPRLALVEVELPSEAFLENWEPTQDSYMVVNAPGMQPLKICLSQQGKEVANAVSVWEWTGSALDEGAEASQWFSDYLGKPCQLVRFNSASEVRPVDPDYVKGQHQTTFTDGYPFLLASQESLDELNEHLKEPVSINRFRPNILVEGCEPYSEDLWTDIKISKFLFSGVKLCYRCKIPTINQETAIAAPEPNETLMKTRSGELIRPNDKNKKRIYFGQNMTWNWMGFSAEGSGKIIKVGDSVYVLQKVSSTAEAAA

SEQ ID NO: 12773 - protein, 150 aa, Wolbachia persica
SDEDVFKKLNKVIDTNITPVVCIGESLDNRQSGRLKQVLATQLSLMLENLSVEQLAKVVIAYEPVWAIGTGVVASLEQIQETHQFIRSLLSKVGESLAKNIKIVYGGSLKAENANDILSLPDVDGGLIGGASLKAAEFNEIINQANKICT

SEQ ID NO: 12774 - protein, 381 aa, Oryza sativa Indica Group
MAAASSPAAAITCRAAVAWAPGQALVMEEVEVAPPEAMEIRVKVVSTSICRSDVTQWQSTAQTDLFPRIFGHEASGVVESVGEGVTEFEVGDHVLTVFIGECMSCKHCVSGKSNMCQKLGLERRGVMHSDQKTRFSLRGKPVYHYCAVSSFSEYTVVHSGCAVKVGPTVPMDRICLLSCGVSAGLGAAWKVADISKGSSVVIFGLGTVGLSVAQGAKLRRASIIIGVDTNPEKQEKGKAFGVTDFINPEELNEPVQQVVKRLTNGGADYSFECVGDTGVVSTALQSCSDGWGLTVTLGVPKAKPEVSAHYALLLSGRTLKGSLFGGWRPKSDLPLLVDKYANKEIQVDDLVTHDLSFDDINKALELMLENKCLRCVIHMPQ
